United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 167

SEQ ID NO: 6986039 - DNA, 22 bp, Homo sapiens
ttgaggtagtggcctccaaatg

SEQ ID NO: 6986040 - DNA, 22 bp, Homo sapiens
taagcaagggtctctgtatcag

SEQ ID NO: 6986041 - DNA, 22 bp, Homo sapiens
gggcagatgtctggacacctca

SEQ ID NO: 6986042 - DNA, 22 bp, Homo sapiens
ggagccaaagcacctcggacgt

SEQ ID NO: 6986043 - DNA, 22 bp, Homo sapiens
atgttttaccctttgcacaaac

SEQ ID NO: 6986044 - DNA, 22 bp, Homo sapiens
ctaattctgaaacagtgtcaat

SEQ ID NO: 6986045 - DNA, 22 bp, Homo sapiens
atcagcaatcaaattgcagagt

SEQ ID NO: 6986046 - DNA, 22 bp, Homo sapiens
acatgcaaagccacaggacccg

SEQ ID NO: 6986047 - DNA, 22 bp, Homo sapiens
ggccactttcatagcaagtgtg

SEQ ID NO: 6986048 - DNA, 22 bp, Homo sapiens
gtgccagacagggcagtggtat

SEQ ID NO: 6986049 - DNA, 21 bp, Homo sapiens
gtcaaggcagttctcttcaac

SEQ ID NO: 6986050 - DNA, 22 bp, Homo sapiens
cacctgcagggggagtcaagag

SEQ ID NO: 6986051 - DNA, 23 bp, Homo sapiens
attttttgtctttgtaactagat

SEQ ID NO: 6986052 - DNA, 22 bp, Homo sapiens
ggaatctttttcataagcctca

SEQ ID NO: 6986053 - DNA, 20 bp, Homo sapiens
gctccctggtagaaatgttt

SEQ ID NO: 6986054 - DNA, 22 bp, Homo sapiens
ttcattgtactttaagagatgc

SEQ ID NO: 6986055 - DNA, 22 bp, Homo sapiens
agcttgtgctggaattacatgt

SEQ ID NO: 6986056 - DNA, 22 bp, Homo sapiens
caggtagtccagctctgggacc

SEQ ID NO: 6986057 - DNA, 22 bp, Homo sapiens
tatacagttaagtttcttcagt

SEQ ID NO: 6986058 - DNA, 20 bp, Homo sapiens
caggatgattggacacgatg

SEQ ID NO: 6986059 - DNA, 22 bp, Homo sapiens
caggagttggtaatattgtgga

SEQ ID NO: 6986060 - DNA, 22 bp, Homo sapiens
gccctgctcatttcacgtgttt

SEQ ID NO: 6986061 - DNA, 22 bp, Homo sapiens
tttacacttgaggaaactgagg

SEQ ID NO: 6986062 - DNA, 22 bp, Homo sapiens
agtaacaggatccaaagaatgt

SEQ ID NO: 6986063 - DNA, 22 bp, Homo sapiens
atgcacaatgttttgatttgag

SEQ ID NO: 6986064 - DNA, 22 bp, Homo sapiens
cagctgccacttgctctcggct

SEQ ID NO: 6986065 - DNA, 22 bp, Homo sapiens
taattgtcctcggtccaaatga

SEQ ID NO: 6986066 - DNA, 22 bp, Homo sapiens
cccagagctgattgttggagcc

SEQ ID NO: 6986067 - DNA, 22 bp, Homo sapiens
cccaggaaagagactgctgggt

SEQ ID NO: 6986068 - DNA, 22 bp, Homo sapiens
tgggggagccttcacagtagct

SEQ ID NO: 6986069 - DNA, 22 bp, Homo sapiens
tggggacattcatgcaggttgt

SEQ ID NO: 6986070 - DNA, 22 bp, Homo sapiens
ggcttggcagaggtgggtgctt

SEQ ID NO: 6986071 - DNA, 22 bp, Homo sapiens
tgcattcacgtgattggggtag

SEQ ID NO: 6986072 - DNA, 22 bp, Homo sapiens
aggatgtccacccagaccttgc

SEQ ID NO: 6986073 - DNA, 22 bp, Homo sapiens
ccagggagcggggctgggtctc

SEQ ID NO: 6986074 - DNA, 22 bp, Homo sapiens
gaggctcactttcatcctcttc

SEQ ID NO: 6986075 - DNA, 22 bp, Homo sapiens
tgggcatcgttcccttggctat

SEQ ID NO: 6986076 - DNA, 22 bp, Homo sapiens
aacattgattgcatctgttcac

SEQ ID NO: 6986077 - DNA, 19 bp, Homo sapiens
acacatttgcacaatccac

SEQ ID NO: 6986078 - DNA, 22 bp, Homo sapiens
gcagacctgaccttgggcagca

SEQ ID NO: 6986079 - DNA, 22 bp, Homo sapiens
cctcagtctccgtgctcacctt

SEQ ID NO: 6986080 - DNA, 22 bp, Homo sapiens
atccaaactatgactagtgttc

SEQ ID NO: 6986081 - DNA, 22 bp, Homo sapiens
tctggagtgtttctaattactg

SEQ ID NO: 6986082 - DNA, 22 bp, Homo sapiens
gactaaatcagacttttccaaa

SEQ ID NO: 6986083 - DNA, 22 bp, Homo sapiens
ctttttgttgtccacactagga

SEQ ID NO: 6986084 - DNA, 22 bp, Homo sapiens
ctttacatcctgtttcccgttt

SEQ ID NO: 6986085 - DNA, 22 bp, Homo sapiens
ttgaccagtgcctgggaccccg

SEQ ID NO: 6986086 - DNA, 22 bp, Homo sapiens
tattggtttattgtgtatgaga

SEQ ID NO: 6986087 - DNA, 22 bp, Homo sapiens
agctgccctcgctggggccaga

SEQ ID NO: 6986088 - DNA, 22 bp, Homo sapiens
tccctggctggtgtagagggat

SEQ ID NO: 6986089 - DNA, 19 bp, Homo sapiens
aagatatgctagcccagag

SEQ ID NO: 6986090 - DNA, 22 bp, Homo sapiens
atgaacaacttgaagctccatg

SEQ ID NO: 6986091 - DNA, 22 bp, Homo sapiens
atctgggaatggaagccttctg

SEQ ID NO: 6986092 - DNA, 22 bp, Homo sapiens
cagagtgacattttcccttctc

SEQ ID NO: 6986093 - DNA, 22 bp, Homo sapiens
agaagccagtcgctctcccgca

SEQ ID NO: 6986094 - DNA, 22 bp, Homo sapiens
ggcaagaaggcttcaggtagct

SEQ ID NO: 6986095 - DNA, 22 bp, Homo sapiens
actgcccacagtgaatggttgg

SEQ ID NO: 6986096 - DNA, 22 bp, Homo sapiens
caggatactacaacaggactgt

SEQ ID NO: 6986097 - DNA, 22 bp, Homo sapiens
tcagatggtcattcactagggt

SEQ ID NO: 6986098 - DNA, 22 bp, Homo sapiens
tggtaagaacccatcagagaag

SEQ ID NO: 6986099 - DNA, 22 bp, Homo sapiens
tgccctgggacatgcagcggag

SEQ ID NO: 6986100 - DNA, 22 bp, Homo sapiens
gctttacagagaaagtttgcct

SEQ ID NO: 6986101 - DNA, 22 bp, Homo sapiens
gggcgcagccaatcctggccct

SEQ ID NO: 6986102 - DNA, 22 bp, Homo sapiens
tcctgaggcctctgtgatgtga

SEQ ID NO: 6986103 - DNA, 22 bp, Homo sapiens
ctgaggaggggcctgagtgaga

SEQ ID NO: 6986104 - DNA, 22 bp, Homo sapiens
ccacctccacctattgccagcc

SEQ ID NO: 6986105 - DNA, 22 bp, Homo sapiens
tcacacagcagccccgggtgtt

SEQ ID NO: 6986106 - DNA, 22 bp, Homo sapiens
ctttacagtgctgctaatggct

SEQ ID NO: 6986107 - DNA, 22 bp, Homo sapiens
tttcctctgactgctcccctgc

SEQ ID NO: 6986108 - DNA, 22 bp, Homo sapiens
ttgaagatctttgcattgcagg

SEQ ID NO: 6986109 - DNA, 22 bp, Homo sapiens
ccattaagtattattaatgatt

SEQ ID NO: 6986110 - DNA, 22 bp, Homo sapiens
tagccaggtcacactgtgtgtt

SEQ ID NO: 6986111 - DNA, 22 bp, Homo sapiens
ggcaaaagtattatctctttaa

SEQ ID NO: 6986112 - DNA, 22 bp, Homo sapiens
agggtgtgctgttgggtctttc

SEQ ID NO: 6986113 - DNA, 16 bp, Homo sapiens
tgctattttagagagg

SEQ ID NO: 6986114 - DNA, 22 bp, Homo sapiens
tttcaagtgtcctgattaatgg

SEQ ID NO: 6986115 - DNA, 20 bp, Homo sapiens
gaggcctcagcctcagctcc

SEQ ID NO: 6986116 - DNA, 22 bp, Homo sapiens
gtgacaggcatggggtcatgca

SEQ ID NO: 6986117 - DNA, 22 bp, Homo sapiens
ttatgtatgaatatagtagaag

SEQ ID NO: 6986118 - DNA, 22 bp, Homo sapiens
ccacctggggcctctgagtctc

SEQ ID NO: 6986119 - DNA, 22 bp, Homo sapiens
gtctgcatacaggacatgcaca

SEQ ID NO: 6986120 - DNA, 22 bp, Homo sapiens
ctgctccagacacctgcagggg

SEQ ID NO: 6986121 - DNA, 22 bp, Homo sapiens
tactgaaaagccacaaggacca

SEQ ID NO: 6986122 - DNA, 22 bp, Homo sapiens
tgacacttctgaaacggaagtt

SEQ ID NO: 6986123 - DNA, 21 bp, Homo sapiens
atccttgatcagaagagtgct

SEQ ID NO: 6986124 - DNA, 22 bp, Homo sapiens
atccagtcaaaattagtaaggt

SEQ ID NO: 6986125 - DNA, 22 bp, Homo sapiens
gccgaacttgagggccaggcgg

SEQ ID NO: 6986126 - DNA, 22 bp, Homo sapiens
aggtaacattgcctccatctga

SEQ ID NO: 6986127 - DNA, 22 bp, Homo sapiens
cctggagcccctctggccagcc

SEQ ID NO: 6986128 - DNA, 22 bp, Homo sapiens
gctctccaggtctcatgcactg

SEQ ID NO: 6986129 - DNA, 22 bp, Homo sapiens
gttcacagggttaggaatcact

SEQ ID NO: 6986130 - DNA, 22 bp, Homo sapiens
ctgtggcaggaagggactagca

SEQ ID NO: 6986131 - DNA, 22 bp, Homo sapiens
tgaggtcccaggggtagtgtgc

SEQ ID NO: 6986132 - DNA, 22 bp, Homo sapiens
accagctccaggcccctgctga

SEQ ID NO: 6986133 - DNA, 22 bp, Homo sapiens
aaactgcaattatttttgcaat

SEQ ID NO: 6986134 - DNA, 22 bp, Homo sapiens
aggtctgtcaaactgtcagtga

SEQ ID NO: 6986135 - DNA, 21 bp, Homo sapiens
gccaaggaggctagagaacat

SEQ ID NO: 6986136 - DNA, 22 bp, Homo sapiens
ggtcaacagaggtaatggtaac

SEQ ID NO: 6986137 - DNA, 22 bp, Homo sapiens
actcacagtgaagccagaatca

SEQ ID NO: 6986138 - DNA, 22 bp, Homo sapiens
tctggagtatgtgtgaacggtg

SEQ ID NO: 6986139 - DNA, 22 bp, Homo sapiens
tcagctacagcatctctgcttt

SEQ ID NO: 6986140 - DNA, 22 bp, Homo sapiens
taacattacggacatctgtcag

SEQ ID NO: 6986141 - DNA, 22 bp, Homo sapiens
taatgtactgatgggaagtggt

SEQ ID NO: 6986142 - DNA, 19 bp, Homo sapiens
tcattcaggaccagtggat

SEQ ID NO: 6986143 - DNA, 22 bp, Homo sapiens
ggaggtggagctggaagttcca

SEQ ID NO: 6986144 - DNA, 20 bp, Homo sapiens
gcgtggcctgggatcccaag

SEQ ID NO: 6986145 - DNA, 22 bp, Homo sapiens
gttactactgaggatatgaggg

SEQ ID NO: 6986146 - DNA, 22 bp, Homo sapiens
atgaaatatcttgaagaaattc

SEQ ID NO: 6986147 - DNA, 22 bp, Homo sapiens
ggtaatggattcctacttttgt

SEQ ID NO: 6986148 - DNA, 20 bp, Homo sapiens
agcacttgctgtgtgccata

SEQ ID NO: 6986149 - DNA, 22 bp, Homo sapiens
aggttagatagtttattagaac

SEQ ID NO: 6986150 - DNA, 22 bp, Homo sapiens
tctgggtctatgatctcacttc

SEQ ID NO: 6986151 - DNA, 22 bp, Homo sapiens
gtcagaggggacaagacacaga

SEQ ID NO: 6986152 - DNA, 22 bp, Homo sapiens
atgagatagactatgtcataca

SEQ ID NO: 6986153 - DNA, 22 bp, Homo sapiens
tgcaggctctctgctgccagat

SEQ ID NO: 6986154 - DNA, 22 bp, Homo sapiens
aatgtactaataagcaacattt

SEQ ID NO: 6986155 - DNA, 22 bp, Homo sapiens
aggagaagccaagttgtgagca

SEQ ID NO: 6986156 - DNA, 22 bp, Homo sapiens
caaaactgtctagagagagaag

SEQ ID NO: 6986157 - DNA, 22 bp, Homo sapiens
tttctactcaactgagagttgt

SEQ ID NO: 6986158 - DNA, 22 bp, Homo sapiens
aagtggctaacagtccttgcct

SEQ ID NO: 6986159 - DNA, 22 bp, Homo sapiens
gcagcaggagagtttgtcctgc

SEQ ID NO: 6986160 - DNA, 22 bp, Homo sapiens
tcaggtctgggcacatggtaca

SEQ ID NO: 6986161 - DNA, 22 bp, Homo sapiens
ctttgattatcggtgtgaatgt

SEQ ID NO: 6986162 - DNA, 22 bp, Homo sapiens
attagagctgttagtgaagtgc

SEQ ID NO: 6986163 - DNA, 22 bp, Homo sapiens
tagacatttagatatctcgctg

SEQ ID NO: 6986164 - DNA, 23 bp, Homo sapiens
aagtggttttgaacccggaccct

SEQ ID NO: 6986165 - DNA, 22 bp, Homo sapiens
gtgtcagtgtatgttaaacttt

SEQ ID NO: 6986166 - DNA, 22 bp, Homo sapiens
ggtgagaaagggattcctgttc

SEQ ID NO: 6986167 - DNA, 22 bp, Homo sapiens
atctatcccagtttaactcatt

SEQ ID NO: 6986168 - DNA, 22 bp, Homo sapiens
tgcatgcacttggctggcacgt

SEQ ID NO: 6986169 - DNA, 23 bp, Homo sapiens
acagatagggaaggcagagtttc

SEQ ID NO: 6986170 - DNA, 18 bp, Homo sapiens
ccaagtatggcagaggct

SEQ ID NO: 6986171 - DNA, 22 bp, Homo sapiens
tctttagttttctaggttctat

SEQ ID NO: 6986172 - DNA, 22 bp, Homo sapiens
acaggcccagctcttcaccaga

SEQ ID NO: 6986173 - DNA, 22 bp, Homo sapiens
aaagcacagggtgctagagagt

SEQ ID NO: 6986174 - DNA, 22 bp, Homo sapiens
gcctgctggatgtggccaggcc

SEQ ID NO: 6986175 - DNA, 22 bp, Homo sapiens
aagtctctggtgatgcaggaaa

SEQ ID NO: 6986176 - DNA, 22 bp, Homo sapiens
cagcccttgggccatcctagaa

SEQ ID NO: 6986177 - DNA, 22 bp, Homo sapiens
gacttgggtgtcggggcagtct

SEQ ID NO: 6986178 - DNA, 22 bp, Homo sapiens
agaccctgtcagtgttaggaaa

SEQ ID NO: 6986179 - DNA, 22 bp, Homo sapiens
cccgtgtgtgcgaggctcccgc

SEQ ID NO: 6986180 - DNA, 22 bp, Homo sapiens
atccacagaaggaacttgaaag

SEQ ID NO: 6986181 - DNA, 22 bp, Homo sapiens
ggtagactgagctccttgagga

SEQ ID NO: 6986182 - DNA, 20 bp, Homo sapiens
atgtcctgttgctgccccag

SEQ ID NO: 6986183 - DNA, 22 bp, Homo sapiens
catctggttagttgatgaaact

SEQ ID NO: 6986184 - DNA, 22 bp, Homo sapiens
tctgggtgaccctgggcaaggc

SEQ ID NO: 6986185 - DNA, 22 bp, Homo sapiens
atcattctgatggtcaatgcta

SEQ ID NO: 6986186 - DNA, 22 bp, Homo sapiens
tctgcaaacccccatctatcat

SEQ ID NO: 6986187 - DNA, 22 bp, Homo sapiens
aaacttccagtttaacatttac

SEQ ID NO: 6986188 - DNA, 22 bp, Homo sapiens
aaacctgttaatagagcgatgc

SEQ ID NO: 6986189 - DNA, 23 bp, Homo sapiens
gggaaatcaaaagatatttcttc

SEQ ID NO: 6986190 - DNA, 22 bp, Homo sapiens
tagtccattgattagctcattt

SEQ ID NO: 6986191 - DNA, 22 bp, Homo sapiens
tgcagctcattgctggggtctg

SEQ ID NO: 6986192 - DNA, 22 bp, Homo sapiens
ttgtcctttaatgtttagtatt

SEQ ID NO: 6986193 - DNA, 22 bp, Homo sapiens
ggaaagaaagtgtgaacaactt

SEQ ID NO: 6986194 - DNA, 22 bp, Homo sapiens
tagatcatgggtactgcatatg

SEQ ID NO: 6986195 - DNA, 21 bp, Homo sapiens
agaaatacagcagggatgatc

SEQ ID NO: 6986196 - DNA, 22 bp, Homo sapiens
ttggctgctctgtgtttagtat

SEQ ID NO: 6986197 - DNA, 22 bp, Homo sapiens
gaagccctaagagaatagagct

SEQ ID NO: 6986198 - DNA, 22 bp, Homo sapiens
ggggcctatttgttcaacttcc

SEQ ID NO: 6986199 - DNA, 22 bp, Homo sapiens
ctctgtcagagtgttgtcccca

SEQ ID NO: 6986200 - DNA, 22 bp, Homo sapiens
acagagctaaatttcaatccca

SEQ ID NO: 6986201 - DNA, 22 bp, Homo sapiens
catcaagtcatcaaagaattca

SEQ ID NO: 6986202 - DNA, 19 bp, Homo sapiens
cactttgctgaactcttct

SEQ ID NO: 6986203 - DNA, 22 bp, Homo sapiens
tgagcccagcgtcccgttctgt

SEQ ID NO: 6986204 - DNA, 22 bp, Homo sapiens
gtctggacagcagcacctcggc

SEQ ID NO: 6986205 - DNA, 22 bp, Homo sapiens
gtgaagacttggagaagttaag

SEQ ID NO: 6986206 - DNA, 22 bp, Homo sapiens
ccatttaacacagagttttcca

SEQ ID NO: 6986207 - DNA, 22 bp, Homo sapiens
tcccagaggactgttggtgcta

SEQ ID NO: 6986208 - DNA, 22 bp, Homo sapiens
aagcaccctttgtctggacatg

SEQ ID NO: 6986209 - DNA, 22 bp, Homo sapiens
ggcatggcctgtaagacggaga

SEQ ID NO: 6986210 - DNA, 22 bp, Homo sapiens
catctgctgttccttggactca

SEQ ID NO: 6986211 - DNA, 22 bp, Homo sapiens
cacttgaatgagaatttcctgg

SEQ ID NO: 6986212 - DNA, 22 bp, Homo sapiens
cagttgatcactataggcttca

SEQ ID NO: 6986213 - DNA, 19 bp, Homo sapiens
gctgctgctcctccctcgc

SEQ ID NO: 6986214 - DNA, 22 bp, Homo sapiens
aaagctattttattgcagctct

SEQ ID NO: 6986215 - DNA, 22 bp, Homo sapiens
ttattgtcttaaatttggtctt

SEQ ID NO: 6986216 - DNA, 22 bp, Homo sapiens
tagaatgtgcctggaatacagt

SEQ ID NO: 6986217 - DNA, 22 bp, Homo sapiens
ttattttcagctaggaaagcca

SEQ ID NO: 6986218 - DNA, 22 bp, Homo sapiens
actttgggaagctgcaattgcc

SEQ ID NO: 6986219 - DNA, 22 bp, Homo sapiens
agggtggctgagtagatggaag

SEQ ID NO: 6986220 - DNA, 22 bp, Homo sapiens
agccagtacagggatgtgttca

SEQ ID NO: 6986221 - DNA, 22 bp, Homo sapiens
tcagagcttcacctgttacatt

SEQ ID NO: 6986222 - DNA, 22 bp, Homo sapiens
aggtctgaaagcctcagtcaca

SEQ ID NO: 6986223 - DNA, 21 bp, Homo sapiens
ttggaatcttaggagtgtggg

SEQ ID NO: 6986224 - DNA, 22 bp, Homo sapiens
ctcactgtttaatagctggatc

SEQ ID NO: 6986225 - DNA, 22 bp, Homo sapiens
gatagataaaactatattttca

SEQ ID NO: 6986226 - DNA, 23 bp, Homo sapiens
ttattgcaaggtaaaattgctga

SEQ ID NO: 6986227 - DNA, 22 bp, Homo sapiens
agccagggaagaggcctacctc

SEQ ID NO: 6986228 - DNA, 22 bp, Homo sapiens
tttcatctgagtagcgtcggat

SEQ ID NO: 6986229 - DNA, 22 bp, Homo sapiens
agcctagactaagacttgctct

SEQ ID NO: 6986230 - DNA, 22 bp, Homo sapiens
gtcagcaaggaaaatgtgtcac

SEQ ID NO: 6986231 - DNA, 22 bp, Homo sapiens
tgccatttctcacatatgtatg

SEQ ID NO: 6986232 - DNA, 22 bp, Homo sapiens
tgcctggagaaggcaccatctg

SEQ ID NO: 6986233 - DNA, 22 bp, Homo sapiens
cacctggcctacagggaccagc

SEQ ID NO: 6986234 - DNA, 20 bp, Homo sapiens
gctttaagacacagctaaaa

SEQ ID NO: 6986235 - DNA, 22 bp, Homo sapiens
atgtcacatgagagcgcagcac

SEQ ID NO: 6986236 - DNA, 22 bp, Homo sapiens
ttgcatcttctggttgagcccc

SEQ ID NO: 6986237 - DNA, 22 bp, Homo sapiens
tggacctgctggatgggcaggt

SEQ ID NO: 6986238 - DNA, 22 bp, Homo sapiens
tcagagtttctagtcaaatcca

SEQ ID NO: 6986239 - DNA, 22 bp, Homo sapiens
ttccaatagtgtgaccttatag

SEQ ID NO: 6986240 - DNA, 22 bp, Homo sapiens
ctcagtcagttattatgccagt

SEQ ID NO: 6986241 - DNA, 20 bp, Homo sapiens
tccctggaggtggtggcatc

SEQ ID NO: 6986242 - DNA, 22 bp, Homo sapiens
tctcctgtatgggactggcgag

SEQ ID NO: 6986243 - DNA, 22 bp, Homo sapiens
atgccactgacatggacaattt

SEQ ID NO: 6986244 - DNA, 22 bp, Homo sapiens
taaacatctgaatcctgcttcc

SEQ ID NO: 6986245 - DNA, 22 bp, Homo sapiens
ctcttcttggcccccatgaggg

SEQ ID NO: 6986246 - DNA, 22 bp, Homo sapiens
tgaagacaaagtcaggcccaga

SEQ ID NO: 6986247 - DNA, 22 bp, Homo sapiens
aggcttatgtgcagtttactct

SEQ ID NO: 6986248 - DNA, 22 bp, Homo sapiens
gcgcgctaccgccagggctgca

SEQ ID NO: 6986249 - DNA, 22 bp, Homo sapiens
agaacactctcctgaaaattaa

SEQ ID NO: 6986250 - DNA, 22 bp, Homo sapiens
gctggaagaatgagtgcctcgt

SEQ ID NO: 6986251 - DNA, 22 bp, Homo sapiens
ttcttaagagggttaagtgaag

SEQ ID NO: 6986252 - DNA, 22 bp, Homo sapiens
ttgtttgactaaattggtatca

SEQ ID NO: 6986253 - DNA, 22 bp, Homo sapiens
tctggctgtgtatgagagtttt

SEQ ID NO: 6986254 - DNA, 22 bp, Homo sapiens
agctctggaactcccggctgct

SEQ ID NO: 6986255 - DNA, 22 bp, Homo sapiens
gtttcctaccagtggttccaga

SEQ ID NO: 6986256 - DNA, 22 bp, Homo sapiens
acttgcatgctatttgttgaac

SEQ ID NO: 6986257 - DNA, 22 bp, Homo sapiens
tctgagagtccatctccaagcc

SEQ ID NO: 6986258 - DNA, 22 bp, Homo sapiens
tgggctgcttctcaaatgtctc

SEQ ID NO: 6986259 - DNA, 22 bp, Homo sapiens
tcagaagaaggtatatttatac

SEQ ID NO: 6986260 - DNA, 22 bp, Homo sapiens
ttggactgagagttccaccatt

SEQ ID NO: 6986261 - DNA, 20 bp, Homo sapiens
agtttaagaaaaagctccag

SEQ ID NO: 6986262 - DNA, 22 bp, Homo sapiens
tgaggacatttatcttggcgca

SEQ ID NO: 6986263 - DNA, 22 bp, Homo sapiens
atcgatcccgcgtaaggccccg

SEQ ID NO: 6986264 - DNA, 22 bp, Homo sapiens
acccatcagcggctggagctgg

SEQ ID NO: 6986265 - DNA, 22 bp, Homo sapiens
ccttagcagggccgggcctggg

SEQ ID NO: 6986266 - DNA, 22 bp, Homo sapiens
ggagtgcagtggtgggatctca

SEQ ID NO: 6986267 - DNA, 22 bp, Homo sapiens
cagcataggatgtggagccagg

SEQ ID NO: 6986268 - DNA, 22 bp, Homo sapiens
aaagattcgagcgatgtataaa

SEQ ID NO: 6986269 - DNA, 22 bp, Homo sapiens
catgcatctggtcttggaaata

SEQ ID NO: 6986270 - DNA, 17 bp, Homo sapiens
aatgtggaagtacatgc

SEQ ID NO: 6986271 - DNA, 22 bp, Homo sapiens
aatgttttcattatcctaactg

SEQ ID NO: 6986272 - DNA, 22 bp, Homo sapiens
tgaggcaagggatggccccgtg

SEQ ID NO: 6986273 - DNA, 22 bp, Homo sapiens
tttgaatgattatctttcggca

SEQ ID NO: 6986274 - DNA, 22 bp, Homo sapiens
cctgaagatccattatagacac

SEQ ID NO: 6986275 - DNA, 22 bp, Homo sapiens
ttatacagcattgctagtgatg

SEQ ID NO: 6986276 - DNA, 17 bp, Homo sapiens
ggaaaaggatgatacag

SEQ ID NO: 6986277 - DNA, 22 bp, Homo sapiens
agcagcccagataaagctcagg

SEQ ID NO: 6986278 - DNA, 22 bp, Homo sapiens
aacaggcctatagggaaggcgc

SEQ ID NO: 6986279 - DNA, 22 bp, Homo sapiens
gattgcttctggaaagcagttt

SEQ ID NO: 6986280 - DNA, 22 bp, Homo sapiens
accaatttttacagctgtggtt

SEQ ID NO: 6986281 - DNA, 21 bp, Homo sapiens
ggtgtgggatggactgaacca

SEQ ID NO: 6986282 - DNA, 22 bp, Homo sapiens
aatctcttggttcagaagcctc

SEQ ID NO: 6986283 - DNA, 22 bp, Homo sapiens
tacagatttggggagtaaagtt

SEQ ID NO: 6986284 - DNA, 22 bp, Homo sapiens
atctgtcctgtgacagtgggag

SEQ ID NO: 6986285 - DNA, 22 bp, Homo sapiens
agcaccagcaactatgggctgc

SEQ ID NO: 6986286 - DNA, 22 bp, Homo sapiens
gctgttctgtccccatgggtaa

SEQ ID NO: 6986287 - DNA, 22 bp, Homo sapiens
cagtgcagtttcccagatgctg

SEQ ID NO: 6986288 - DNA, 21 bp, Homo sapiens
attttgtacatagaatttgtc

SEQ ID NO: 6986289 - DNA, 22 bp, Homo sapiens
tcagaataagttatgaaatgaa

SEQ ID NO: 6986290 - DNA, 22 bp, Homo sapiens
cttgcttgattatgatcataaa

SEQ ID NO: 6986291 - DNA, 22 bp, Homo sapiens
gctttggcccaggagccaaggt

SEQ ID NO: 6986292 - DNA, 22 bp, Homo sapiens
aagatataataactgttgtcat

SEQ ID NO: 6986293 - DNA, 22 bp, Homo sapiens
cagaagcattccagcaaatagt

SEQ ID NO: 6986294 - DNA, 22 bp, Homo sapiens
ggctggaaaggatattttaggt

SEQ ID NO: 6986295 - DNA, 22 bp, Homo sapiens
cgagtaattggaaatttgctat

SEQ ID NO: 6986296 - DNA, 19 bp, Homo sapiens
ggctctcttaaagctgttt

SEQ ID NO: 6986297 - DNA, 22 bp, Homo sapiens
tcacccaggctggagtgcagtg

SEQ ID NO: 6986298 - DNA, 22 bp, Homo sapiens
tctcccaggcaggagtgcagtg

SEQ ID NO: 6986299 - DNA, 22 bp, Homo sapiens
ctggggcatgggcccctagagg

SEQ ID NO: 6986300 - DNA, 22 bp, Homo sapiens
tgggagcagcagggagatgcgg

SEQ ID NO: 6986301 - DNA, 22 bp, Homo sapiens
acagatctcaaagcctggaccc

SEQ ID NO: 6986302 - DNA, 22 bp, Homo sapiens
agactgtattcaaaatgtggtt

SEQ ID NO: 6986303 - DNA, 19 bp, Homo sapiens
tcagtccagctgtgaagac

SEQ ID NO: 6986304 - DNA, 23 bp, Homo sapiens
tgcagagggactgaagccagctt

SEQ ID NO: 6986305 - DNA, 22 bp, Homo sapiens
tcctgtggctctgtggaacctt

SEQ ID NO: 6986306 - DNA, 22 bp, Homo sapiens
cctgccagacgcaccagggggc

SEQ ID NO: 6986307 - DNA, 18 bp, Homo sapiens
taatcttacagacaggat

SEQ ID NO: 6986308 - DNA, 22 bp, Homo sapiens
atgtgtgtatgtgcctatatct

SEQ ID NO: 6986309 - DNA, 22 bp, Homo sapiens
tacattctatatctgttacatc

SEQ ID NO: 6986310 - DNA, 22 bp, Homo sapiens
tgttaacatgtgtattgtatga

SEQ ID NO: 6986311 - DNA, 22 bp, Homo sapiens
gggccagagcacagaggatgtt

SEQ ID NO: 6986312 - DNA, 22 bp, Homo sapiens
tgatctggaccttggaggaaaa

SEQ ID NO: 6986313 - DNA, 21 bp, Homo sapiens
agtgttataggagcagggaaa

SEQ ID NO: 6986314 - DNA, 17 bp, Homo sapiens
tagctagaccgagtctc

SEQ ID NO: 6986315 - DNA, 22 bp, Homo sapiens
tcctggctcggcttggggactt

SEQ ID NO: 6986316 - DNA, 22 bp, Homo sapiens
ccagggctcaggctcccagtgg

SEQ ID NO: 6986317 - DNA, 22 bp, Homo sapiens
tttgtaaaagcccaagctgtag

SEQ ID NO: 6986318 - DNA, 22 bp, Homo sapiens
ccttatcacaatggagtgtcac

SEQ ID NO: 6986319 - DNA, 22 bp, Homo sapiens
taggcagaattgtgggctctaa

SEQ ID NO: 6986320 - DNA, 22 bp, Homo sapiens
tttgattctgtaaaataacagg

SEQ ID NO: 6986321 - DNA, 22 bp, Homo sapiens
cgttagtaggatagtacaagtg

SEQ ID NO: 6986322 - DNA, 22 bp, Homo sapiens
ttctgtactctttgagaagaat

SEQ ID NO: 6986323 - DNA, 22 bp, Homo sapiens
atcttcaacttgatcatttgaa

SEQ ID NO: 6986324 - DNA, 22 bp, Homo sapiens
tggagggtcaccccttgctgag

SEQ ID NO: 6986325 - DNA, 22 bp, Homo sapiens
agaggtgagtcattacctagtg

SEQ ID NO: 6986326 - DNA, 22 bp, Homo sapiens
agccatgctcagttcctggagc

SEQ ID NO: 6986327 - DNA, 22 bp, Homo sapiens
tgtctgtcagtataggcaggtg

SEQ ID NO: 6986328 - DNA, 23 bp, Homo sapiens
ttgagtcttataggattgaggtg

SEQ ID NO: 6986329 - DNA, 17 bp, Homo sapiens
tggccctagactccagc

SEQ ID NO: 6986330 - DNA, 22 bp, Homo sapiens
ttaaggttaaataaggtcataa

SEQ ID NO: 6986331 - DNA, 21 bp, Homo sapiens
acagattgctgagctctacct

SEQ ID NO: 6986332 - DNA, 22 bp, Homo sapiens
ttctcctctacatagactgtgc

SEQ ID NO: 6986333 - DNA, 22 bp, Homo sapiens
agctgtctctctggtgtccata

SEQ ID NO: 6986334 - DNA, 22 bp, Homo sapiens
ggaggtaagaggccctgggcca

SEQ ID NO: 6986335 - DNA, 22 bp, Homo sapiens
aggtcactgatttttttaatga

SEQ ID NO: 6986336 - DNA, 22 bp, Homo sapiens
aggtagcacagcctgagtccag

SEQ ID NO: 6986337 - DNA, 22 bp, Homo sapiens
tgtgccctttcctgctcctcca

SEQ ID NO: 6986338 - DNA, 22 bp, Homo sapiens
tttactgtgtaaggggaatgtt

SEQ ID NO: 6986339 - DNA, 22 bp, Homo sapiens
agaggccagaaagtatgccacc

SEQ ID NO: 6986340 - DNA, 22 bp, Homo sapiens
aaattcttttgtgcggtgaagt

SEQ ID NO: 6986341 - DNA, 22 bp, Homo sapiens
ggatgctgtgcactactctggc

SEQ ID NO: 6986342 - DNA, 19 bp, Homo sapiens
cattacaaatttgtaggga

SEQ ID NO: 6986343 - DNA, 21 bp, Homo sapiens
caaagctcattctttggtcat

SEQ ID NO: 6986344 - DNA, 22 bp, Homo sapiens
ggagtcaggcagacctagttat

SEQ ID NO: 6986345 - DNA, 19 bp, Homo sapiens
gtcctcatgttgttctcca

SEQ ID NO: 6986346 - DNA, 22 bp, Homo sapiens
aaatgatcatgtaatttcagaa

SEQ ID NO: 6986347 - DNA, 22 bp, Homo sapiens
tctgaatgcacttagttaccaa

SEQ ID NO: 6986348 - DNA, 23 bp, Homo sapiens
gaaatctagtcatttttagtctg

SEQ ID NO: 6986349 - DNA, 22 bp, Homo sapiens
aatgtgctttgttcagccattt

SEQ ID NO: 6986350 - DNA, 22 bp, Homo sapiens
cccttttttatgtcaagcattg

SEQ ID NO: 6986351 - DNA, 22 bp, Homo sapiens
ggtccacctccaagctggggac

SEQ ID NO: 6986352 - DNA, 22 bp, Homo sapiens
ttataaagtgagaagtgctatg

SEQ ID NO: 6986353 - DNA, 22 bp, Homo sapiens
attttgctgctatgccttgcaa

SEQ ID NO: 6986354 - DNA, 22 bp, Homo sapiens
aaggaactgatgctcaaagaat

SEQ ID NO: 6986355 - DNA, 22 bp, Homo sapiens
tttgaagcaccaaaggagaaaa

SEQ ID NO: 6986356 - DNA, 22 bp, Homo sapiens
aaatgctcaccacagggatgtg

SEQ ID NO: 6986357 - DNA, 22 bp, Homo sapiens
aggtttccagcatggggaaggc

SEQ ID NO: 6986358 - DNA, 22 bp, Homo sapiens
cctttggtggcttcaaaatggc

SEQ ID NO: 6986359 - DNA, 20 bp, Homo sapiens
atctggctcagatcctgcag

SEQ ID NO: 6986360 - DNA, 22 bp, Homo sapiens
attgtataagtctatttacaat

SEQ ID NO: 6986361 - DNA, 20 bp, Homo sapiens
aagagtctttactgagctaa

SEQ ID NO: 6986362 - DNA, 22 bp, Homo sapiens
tcattgatggcttctttcttgc

SEQ ID NO: 6986363 - DNA, 19 bp, Homo sapiens
ggcaccttggtcttggact

SEQ ID NO: 6986364 - DNA, 22 bp, Homo sapiens
gcccaagatcacactggaaatc

SEQ ID NO: 6986365 - DNA, 22 bp, Homo sapiens
ggcctcttatctggctcctgca

SEQ ID NO: 6986366 - DNA, 22 bp, Homo sapiens
tggcctgctcacagtcagatgg

SEQ ID NO: 6986367 - DNA, 22 bp, Homo sapiens
atccaggctggagtgcattggt

SEQ ID NO: 6986368 - DNA, 22 bp, Homo sapiens
gcttgcttatttgcccttctcc

SEQ ID NO: 6986369 - DNA, 22 bp, Homo sapiens
tggcctggctcacagtgagatt

SEQ ID NO: 6986370 - DNA, 18 bp, Homo sapiens
gtgagcagagagcatcac

SEQ ID NO: 6986371 - DNA, 22 bp, Homo sapiens
gtacacattgtctgtttacttc

SEQ ID NO: 6986372 - DNA, 22 bp, Homo sapiens
cagctgttgtgctgggcagtta

SEQ ID NO: 6986373 - DNA, 22 bp, Homo sapiens
ctcaggtcgctatttctcttac

SEQ ID NO: 6986374 - DNA, 22 bp, Homo sapiens
agaaggccagaaaattccttta

SEQ ID NO: 6986375 - DNA, 22 bp, Homo sapiens
ctgacagctcctagtgctcact

SEQ ID NO: 6986376 - DNA, 22 bp, Homo sapiens
attaatgtctgaggagtggggc

SEQ ID NO: 6986377 - DNA, 22 bp, Homo sapiens
ctggcaagtactgggccagctc

SEQ ID NO: 6986378 - DNA, 22 bp, Homo sapiens
gtacaagaggagaaaatggagt

SEQ ID NO: 6986379 - DNA, 22 bp, Homo sapiens
tccagacctagggcaccccagt

SEQ ID NO: 6986380 - DNA, 22 bp, Homo sapiens
gaagctctggacagtgaagaag

SEQ ID NO: 6986381 - DNA, 22 bp, Homo sapiens
gcaaattgctagctttctctgc

SEQ ID NO: 6986382 - DNA, 22 bp, Homo sapiens
accctaatcccttaaacctgtg

SEQ ID NO: 6986383 - DNA, 22 bp, Homo sapiens
cttaggcatccagggttcttcc

SEQ ID NO: 6986384 - DNA, 22 bp, Homo sapiens
aggtctggagtgggatctgaga

SEQ ID NO: 6986385 - DNA, 22 bp, Homo sapiens
aggatagaagccccatgttctt

SEQ ID NO: 6986386 - DNA, 22 bp, Homo sapiens
tcttccagcaatgtgaaatcac

SEQ ID NO: 6986387 - DNA, 22 bp, Homo sapiens
gcacaggaatcttcatttttta

SEQ ID NO: 6986388 - DNA, 22 bp, Homo sapiens
cagcttctccagatgaccctca

SEQ ID NO: 6986389 - DNA, 22 bp, Homo sapiens
agcagcaagcagtgcacgggtt

SEQ ID NO: 6986390 - DNA, 22 bp, Homo sapiens
ataaccatgattaatctaagaa

SEQ ID NO: 6986391 - DNA, 22 bp, Homo sapiens
tctgccacactggttcagtgga

SEQ ID NO: 6986392 - DNA, 22 bp, Homo sapiens
aaattagatatgtgtgagactc

SEQ ID NO: 6986393 - DNA, 22 bp, Homo sapiens
caggtctgagtcacatgttcat

SEQ ID NO: 6986394 - DNA, 22 bp, Homo sapiens
ttatatgattgaagtgcataag

SEQ ID NO: 6986395 - DNA, 22 bp, Homo sapiens
aggctccacggtcactggctct

SEQ ID NO: 6986396 - DNA, 22 bp, Homo sapiens
tcagggctgccgggcagaccgt

SEQ ID NO: 6986397 - DNA, 22 bp, Homo sapiens
atttctctcattgttagctagg

SEQ ID NO: 6986398 - DNA, 22 bp, Homo sapiens
tttggagttggagtggtttcta

SEQ ID NO: 6986399 - DNA, 22 bp, Homo sapiens
attcacatttagacatcaggta

SEQ ID NO: 6986400 - DNA, 22 bp, Homo sapiens
gtcaggattggggtcatgagtc

SEQ ID NO: 6986401 - DNA, 22 bp, Homo sapiens
tggaagtgtcctcttctgagtc

SEQ ID NO: 6986402 - DNA, 22 bp, Homo sapiens
tgccttgaacatagtggacagt

SEQ ID NO: 6986403 - DNA, 22 bp, Homo sapiens
tatggccaatcgggtggacgcc

SEQ ID NO: 6986404 - DNA, 21 bp, Homo sapiens
gggatcttgtactggcgtgga

SEQ ID NO: 6986405 - DNA, 19 bp, Homo sapiens
gcctgtggcttgatgttgg

SEQ ID NO: 6986406 - DNA, 22 bp, Homo sapiens
agctaaggaactctgtaacacc

SEQ ID NO: 6986407 - DNA, 22 bp, Homo sapiens
atcgttaatcttgtgtgtcaac

SEQ ID NO: 6986408 - DNA, 22 bp, Homo sapiens
tctgggtctcagagtgaccatg

SEQ ID NO: 6986409 - DNA, 22 bp, Homo sapiens
tagactgttacagcttttcaga

SEQ ID NO: 6986410 - DNA, 19 bp, Homo sapiens
ctctggagcagacactgga

SEQ ID NO: 6986411 - DNA, 20 bp, Homo sapiens
gctgtggcaagtgctcactg

SEQ ID NO: 6986412 - DNA, 22 bp, Homo sapiens
tcaagtcttgagggacagcatt

SEQ ID NO: 6986413 - DNA, 22 bp, Homo sapiens
acagacatggaccaagcactgt

SEQ ID NO: 6986414 - DNA, 22 bp, Homo sapiens
aactggctgggaacacctagag

SEQ ID NO: 6986415 - DNA, 23 bp, Homo sapiens
gcagagtcaagtagtcatgagtg

SEQ ID NO: 6986416 - DNA, 22 bp, Homo sapiens
gagatggccagtgccaggacaa

SEQ ID NO: 6986417 - DNA, 23 bp, Homo sapiens
cccagggacacgatgacacctcc

SEQ ID NO: 6986418 - DNA, 22 bp, Homo sapiens
ttatggatacaaagctagctaa

SEQ ID NO: 6986419 - DNA, 22 bp, Homo sapiens
gaggtcatctgttttggttact

SEQ ID NO: 6986420 - DNA, 22 bp, Homo sapiens
ctgaccagggtagaggtgagag

SEQ ID NO: 6986421 - DNA, 22 bp, Homo sapiens
tagactgtgagctccttgaggg

SEQ ID NO: 6986422 - DNA, 22 bp, Homo sapiens
ttctcagaaaagcaagctttct

SEQ ID NO: 6986423 - DNA, 22 bp, Homo sapiens
actttgcctacaagcccatggt

SEQ ID NO: 6986424 - DNA, 19 bp, Homo sapiens
tgtacgtgtgggtgtttaa

SEQ ID NO: 6986425 - DNA, 21 bp, Homo sapiens
agcggcagaccctgcatttga

SEQ ID NO: 6986426 - DNA, 22 bp, Homo sapiens
gggagcacatctgagcacccgg

SEQ ID NO: 6986427 - DNA, 22 bp, Homo sapiens
aggcgcagcacgtgagagttgg

SEQ ID NO: 6986428 - DNA, 22 bp, Homo sapiens
aggccctgggcagttctgtagc

SEQ ID NO: 6986429 - DNA, 22 bp, Homo sapiens
tcagtgtgcactctgtgaccca

SEQ ID NO: 6986430 - DNA, 22 bp, Homo sapiens
aaggcccaggctgccctgggca

SEQ ID NO: 6986431 - DNA, 22 bp, Homo sapiens
gtctcttagaaccttgttttgg

SEQ ID NO: 6986432 - DNA, 17 bp, Homo sapiens
tatggctgtgtttgtgc

SEQ ID NO: 6986433 - DNA, 22 bp, Homo sapiens
gagtaacatgtattggaaggcc

SEQ ID NO: 6986434 - DNA, 22 bp, Homo sapiens
ggaagacaagcagtggctgagc

SEQ ID NO: 6986435 - DNA, 22 bp, Homo sapiens
tgcatacataatcgagaccagt

SEQ ID NO: 6986436 - DNA, 22 bp, Homo sapiens
ggggctgatggaactcaggcct

SEQ ID NO: 6986437 - DNA, 22 bp, Homo sapiens
gtaaacattactgtgctgtata

SEQ ID NO: 6986438 - DNA, 22 bp, Homo sapiens
aaaaatgttatctactgtccga

SEQ ID NO: 6986439 - DNA, 21 bp, Homo sapiens
ctcaggatcttatatattagt

SEQ ID NO: 6986440 - DNA, 22 bp, Homo sapiens
agcatgcaggaaccacatggca

SEQ ID NO: 6986441 - DNA, 22 bp, Homo sapiens
ctttggaaggcagagctctgtg

SEQ ID NO: 6986442 - DNA, 22 bp, Homo sapiens
ggcagcttttatccctgacaga

SEQ ID NO: 6986443 - DNA, 22 bp, Homo sapiens
ctgtgccagggtctattccaga

SEQ ID NO: 6986444 - DNA, 22 bp, Homo sapiens
atagttataagaaaacgttgaa

SEQ ID NO: 6986445 - DNA, 17 bp, Homo sapiens
aaacttcattctcagga

SEQ ID NO: 6986446 - DNA, 22 bp, Homo sapiens
ttaaagagggaaagacttcaga

SEQ ID NO: 6986447 - DNA, 22 bp, Homo sapiens
gagagctgggggactgtggatg

SEQ ID NO: 6986448 - DNA, 22 bp, Homo sapiens
aactagaaagaacatatttcca

SEQ ID NO: 6986449 - DNA, 22 bp, Homo sapiens
aagtgaggcctaggcactgggt

SEQ ID NO: 6986450 - DNA, 19 bp, Homo sapiens
taaaggaagaagggaggat

SEQ ID NO: 6986451 - DNA, 22 bp, Homo sapiens
tgttgctactctccctgggagg

SEQ ID NO: 6986452 - DNA, 22 bp, Homo sapiens
tctgggcctgatggctaaagcc

SEQ ID NO: 6986453 - DNA, 22 bp, Homo sapiens
tgatagaaaatgctgtcaagct

SEQ ID NO: 6986454 - DNA, 22 bp, Homo sapiens
tgctaggggcactaaaagctga

SEQ ID NO: 6986455 - DNA, 20 bp, Homo sapiens
gtgtgacctcctgtggatgc

SEQ ID NO: 6986456 - DNA, 22 bp, Homo sapiens
gtttacttttcatggagcatat

SEQ ID NO: 6986457 - DNA, 22 bp, Homo sapiens
agagtgtgaagaaagtgcaatg

SEQ ID NO: 6986458 - DNA, 22 bp, Homo sapiens
acagtacagtgcagaggaagat

SEQ ID NO: 6986459 - DNA, 22 bp, Homo sapiens
gaaagggagtggacaacaggca

SEQ ID NO: 6986460 - DNA, 22 bp, Homo sapiens
actgagaaagaccacatggaga

SEQ ID NO: 6986461 - DNA, 22 bp, Homo sapiens
tttcacaacacaatctcgttaa

SEQ ID NO: 6986462 - DNA, 22 bp, Homo sapiens
aaagtcatgtaatgatatgatt

SEQ ID NO: 6986463 - DNA, 22 bp, Homo sapiens
agggagctgagctgtgagcagc

SEQ ID NO: 6986464 - DNA, 22 bp, Homo sapiens
agtgcattcctggggaagaagc

SEQ ID NO: 6986465 - DNA, 22 bp, Homo sapiens
tgatggtcaggatgcatggaga

SEQ ID NO: 6986466 - DNA, 21 bp, Homo sapiens
tgaggggttataacagggtgg

SEQ ID NO: 6986467 - DNA, 22 bp, Homo sapiens
ttcagcaggcggtagctgccac

SEQ ID NO: 6986468 - DNA, 22 bp, Homo sapiens
tgaggccagtgacatatattaa

SEQ ID NO: 6986469 - DNA, 22 bp, Homo sapiens
gactaacagtctccgcttgaaa

SEQ ID NO: 6986470 - DNA, 22 bp, Homo sapiens
cagcaagagggtaaggttgaag

SEQ ID NO: 6986471 - DNA, 22 bp, Homo sapiens
cactgtgtctggagtgagctgg

SEQ ID NO: 6986472 - DNA, 22 bp, Homo sapiens
attgccaggagggttgagaata

SEQ ID NO: 6986473 - DNA, 22 bp, Homo sapiens
caggctatatttaaagaagaac

SEQ ID NO: 6986474 - DNA, 22 bp, Homo sapiens
cctctgtgcctcagtttcatgt

SEQ ID NO: 6986475 - DNA, 22 bp, Homo sapiens
agttctaaacacttgaggaacc

SEQ ID NO: 6986476 - DNA, 22 bp, Homo sapiens
gcagaggatagcatatgaacct

SEQ ID NO: 6986477 - DNA, 22 bp, Homo sapiens
cagttactgtatgtcaaagact

SEQ ID NO: 6986478 - DNA, 22 bp, Homo sapiens
atctgaaagctaggagttctca

SEQ ID NO: 6986479 - DNA, 22 bp, Homo sapiens
cagtgagctcatggccaagtca

SEQ ID NO: 6986480 - DNA, 22 bp, Homo sapiens
tctttaacaggaattattacag

SEQ ID NO: 6986481 - DNA, 22 bp, Homo sapiens
ttaacaggagtaactctagaaa

SEQ ID NO: 6986482 - DNA, 22 bp, Homo sapiens
tgggaagaggagcactggaatg

SEQ ID NO: 6986483 - DNA, 21 bp, Homo sapiens
agcgcctgcaacaaggcagat

SEQ ID NO: 6986484 - DNA, 22 bp, Homo sapiens
agcccaggtgactcatacaccc

SEQ ID NO: 6986485 - DNA, 22 bp, Homo sapiens
tctttcagaaactttgtctgcg

SEQ ID NO: 6986486 - DNA, 22 bp, Homo sapiens
ttcttcaacaaggacactgtta

SEQ ID NO: 6986487 - DNA, 22 bp, Homo sapiens
tgcctgagtttaaccctcagag

SEQ ID NO: 6986488 - DNA, 22 bp, Homo sapiens
tttcagaaacgattatgaacac

SEQ ID NO: 6986489 - DNA, 21 bp, Homo sapiens
cagtgttgatatttaatacat

SEQ ID NO: 6986490 - DNA, 22 bp, Homo sapiens
tgttaggagaaaggaagatatt

SEQ ID NO: 6986491 - DNA, 22 bp, Homo sapiens
atctgcctggtctttgatgcag

SEQ ID NO: 6986492 - DNA, 22 bp, Homo sapiens
tgactacctgtttagggaattg

SEQ ID NO: 6986493 - DNA, 22 bp, Homo sapiens
tgtgtgcacttaatgcaatcat

SEQ ID NO: 6986494 - DNA, 22 bp, Homo sapiens
ctctgaggtccttcccagctct

SEQ ID NO: 6986495 - DNA, 22 bp, Homo sapiens
ttcctttcacgttttaatgcac

SEQ ID NO: 6986496 - DNA, 22 bp, Homo sapiens
tctgtcctctccctgaccacaa

SEQ ID NO: 6986497 - DNA, 23 bp, Homo sapiens
ccagtgagcatggctgtgttcca

SEQ ID NO: 6986498 - DNA, 22 bp, Homo sapiens
gctcgcttagattttcctctga

SEQ ID NO: 6986499 - DNA, 22 bp, Homo sapiens
cccagtgtcattctaagggagg

SEQ ID NO: 6986500 - DNA, 22 bp, Homo sapiens
gctgtctggaggctctgaggga

SEQ ID NO: 6986501 - DNA, 22 bp, Homo sapiens
ttgaacattggcaatttcatat

SEQ ID NO: 6986502 - DNA, 22 bp, Homo sapiens
cccaattaagcctttccagaat

SEQ ID NO: 6986503 - DNA, 22 bp, Homo sapiens
ctccatcagctgttggttgagg

SEQ ID NO: 6986504 - DNA, 22 bp, Homo sapiens
agcaatttttgattttcagtgt

SEQ ID NO: 6986505 - DNA, 22 bp, Homo sapiens
tagctgcttctcacatgggcaa

SEQ ID NO: 6986506 - DNA, 22 bp, Homo sapiens
tgttattgggtcccaactaggt

SEQ ID NO: 6986507 - DNA, 22 bp, Homo sapiens
cagaagtaagattactgtgaga

SEQ ID NO: 6986508 - DNA, 22 bp, Homo sapiens
cagcatgcattttctctctttg

SEQ ID NO: 6986509 - DNA, 22 bp, Homo sapiens
aagtataagctattcttcatga

SEQ ID NO: 6986510 - DNA, 22 bp, Homo sapiens
atgacatgttgggaaccctgct

SEQ ID NO: 6986511 - DNA, 20 bp, Homo sapiens
gttcacaggcttcctttcag

SEQ ID NO: 6986512 - DNA, 20 bp, Homo sapiens
gcctgatggacatttcagtt

SEQ ID NO: 6986513 - DNA, 22 bp, Homo sapiens
agctatgacacggggagcggct

SEQ ID NO: 6986514 - DNA, 22 bp, Homo sapiens
taatgcaacgtgagataattaa

SEQ ID NO: 6986515 - DNA, 22 bp, Homo sapiens
actttgaaggggaacattttaa

SEQ ID NO: 6986516 - DNA, 22 bp, Homo sapiens
caggccaggctgcatttgcccc

SEQ ID NO: 6986517 - DNA, 22 bp, Homo sapiens
gctagggtggctaataggagag

SEQ ID NO: 6986518 - DNA, 22 bp, Homo sapiens
agccctggatggacagtttccc

SEQ ID NO: 6986519 - DNA, 20 bp, Homo sapiens
tctgtggcaggtggcgcttg

SEQ ID NO: 6986520 - DNA, 22 bp, Homo sapiens
ctctgctttctcaaaccctgtg

SEQ ID NO: 6986521 - DNA, 22 bp, Homo sapiens
ttactttgccttttagtgtagg

SEQ ID NO: 6986522 - DNA, 22 bp, Homo sapiens
agtgtacaagaccttattgttg

SEQ ID NO: 6986523 - DNA, 22 bp, Homo sapiens
gctacaggtatatagatgaaac

SEQ ID NO: 6986524 - DNA, 22 bp, Homo sapiens
tctgctggaaaaccagggaatt

SEQ ID NO: 6986525 - DNA, 21 bp, Homo sapiens
tctggcagtggtctttcaaat

SEQ ID NO: 6986526 - DNA, 22 bp, Homo sapiens
tgagagcaacacgcagtagtat

SEQ ID NO: 6986527 - DNA, 22 bp, Homo sapiens
tggtacctgaatgaagggagga

SEQ ID NO: 6986528 - DNA, 22 bp, Homo sapiens
agtagattctcattgatctggt

SEQ ID NO: 6986529 - DNA, 22 bp, Homo sapiens
atttgcattgtagaccctctaa

SEQ ID NO: 6986530 - DNA, 22 bp, Homo sapiens
aatgccaatattcatttgtgtt

SEQ ID NO: 6986531 - DNA, 22 bp, Homo sapiens
tgcaaatatttccttatagcca

SEQ ID NO: 6986532 - DNA, 22 bp, Homo sapiens
gtcctctgttagaaatgtgctt

SEQ ID NO: 6986533 - DNA, 21 bp, Homo sapiens
gcacagtaagaaaagctgcct

SEQ ID NO: 6986534 - DNA, 22 bp, Homo sapiens
ttccagcagggtacttgtaatt

SEQ ID NO: 6986535 - DNA, 22 bp, Homo sapiens
acacagggggcattctaggagt

SEQ ID NO: 6986536 - DNA, 22 bp, Homo sapiens
tggtgcagttcccagggccggg

SEQ ID NO: 6986537 - DNA, 22 bp, Homo sapiens
taaacatggattctgatcacag

SEQ ID NO: 6986538 - DNA, 22 bp, Homo sapiens
tagcaaatacatgatgtaattt

SEQ ID NO: 6986539 - DNA, 22 bp, Homo sapiens
agcagggcctctggcactggtc

SEQ ID NO: 6986540 - DNA, 22 bp, Homo sapiens
caaggattaatagaatgaatca

SEQ ID NO: 6986541 - DNA, 22 bp, Homo sapiens
tggttacagagatttttaagat

SEQ ID NO: 6986542 - DNA, 22 bp, Homo sapiens
atgtgcagcttttctagagaag

SEQ ID NO: 6986543 - DNA, 22 bp, Homo sapiens
tctgcctggcggactcccggaa

SEQ ID NO: 6986544 - DNA, 22 bp, Homo sapiens
aaggcattgctgatcctcaggt

SEQ ID NO: 6986545 - DNA, 22 bp, Homo sapiens
tcttcagcagggcctctctgag

SEQ ID NO: 6986546 - DNA, 22 bp, Homo sapiens
tttgcagcaaggagagagcatt

SEQ ID NO: 6986547 - DNA, 21 bp, Homo sapiens
ctggaacaaatactagcaaac

SEQ ID NO: 6986548 - DNA, 22 bp, Homo sapiens
tacaaaccagcagaataggtcc

SEQ ID NO: 6986549 - DNA, 19 bp, Homo sapiens
atctgaggcctcatctggg

SEQ ID NO: 6986550 - DNA, 22 bp, Homo sapiens
aacacagctaatttctgtcaat

SEQ ID NO: 6986551 - DNA, 17 bp, Homo sapiens
ggcctgtgtggctgcag

SEQ ID NO: 6986552 - DNA, 22 bp, Homo sapiens
attgcatttgtcattgttgagg

SEQ ID NO: 6986553 - DNA, 22 bp, Homo sapiens
tgcgtagtacgaatttgtgcct

SEQ ID NO: 6986554 - DNA, 22 bp, Homo sapiens
catgaggatgggcagctgggga

SEQ ID NO: 6986555 - DNA, 22 bp, Homo sapiens
ggctcactttggggtcagctgg

SEQ ID NO: 6986556 - DNA, 22 bp, Homo sapiens
aagagccagtgggaaagtcttg

SEQ ID NO: 6986557 - DNA, 22 bp, Homo sapiens
ttttggtctgtagagtgactct

SEQ ID NO: 6986558 - DNA, 22 bp, Homo sapiens
tagagtcctgtgtgctctgtgg

SEQ ID NO: 6986559 - DNA, 22 bp, Homo sapiens
agggagctttcaggtagcttaa

SEQ ID NO: 6986560 - DNA, 22 bp, Homo sapiens
ttctacagaataaatgtttaca

SEQ ID NO: 6986561 - DNA, 22 bp, Homo sapiens
tttcagacattaagtgatggga

SEQ ID NO: 6986562 - DNA, 17 bp, Homo sapiens
ggaaaggtagagtaatc

SEQ ID NO: 6986563 - DNA, 22 bp, Homo sapiens
agtttgaagcaaaattgaggaa

SEQ ID NO: 6986564 - DNA, 22 bp, Homo sapiens
caggccctctgcaccctcgtct

SEQ ID NO: 6986565 - DNA, 22 bp, Homo sapiens
ggccctcttttggtttggatgt

SEQ ID NO: 6986566 - DNA, 22 bp, Homo sapiens
tgatggaaatatgtaatctggt

SEQ ID NO: 6986567 - DNA, 22 bp, Homo sapiens
ttactttgatgatcaatgagcg

SEQ ID NO: 6986568 - DNA, 22 bp, Homo sapiens
ttcaggcatggaaactggatta

SEQ ID NO: 6986569 - DNA, 22 bp, Homo sapiens
gctgcggtggctggcgatggga

SEQ ID NO: 6986570 - DNA, 22 bp, Homo sapiens
caggcttgaagcttcagagtat

SEQ ID NO: 6986571 - DNA, 22 bp, Homo sapiens
agtgctggaaagggacggagga

SEQ ID NO: 6986572 - DNA, 22 bp, Homo sapiens
tagattctttgctagatcattg

SEQ ID NO: 6986573 - DNA, 22 bp, Homo sapiens
cacattgctcatggctggatgc

SEQ ID NO: 6986574 - DNA, 22 bp, Homo sapiens
atgtgcattaaatgtcaatgtt

SEQ ID NO: 6986575 - DNA, 22 bp, Homo sapiens
aggaagacaatctgtgtgctgt

SEQ ID NO: 6986576 - DNA, 22 bp, Homo sapiens
tttaaggtggacatctaagtca

SEQ ID NO: 6986577 - DNA, 22 bp, Homo sapiens
atgctgtgttttaaatggaaat

SEQ ID NO: 6986578 - DNA, 22 bp, Homo sapiens
ctgtcctgccagtcctggactc

SEQ ID NO: 6986579 - DNA, 22 bp, Homo sapiens
ccatcagattagcaaaatccag

SEQ ID NO: 6986580 - DNA, 22 bp, Homo sapiens
ttcattcatcacatgcagctgg

SEQ ID NO: 6986581 - DNA, 21 bp, Homo sapiens
tggcttttatggagctctggg

SEQ ID NO: 6986582 - DNA, 22 bp, Homo sapiens
ggtgctgaaggactataacggt

SEQ ID NO: 6986583 - DNA, 22 bp, Homo sapiens
cagcccttcagggggctgcagg

SEQ ID NO: 6986584 - DNA, 22 bp, Homo sapiens
gcagatggtgccatgtcttgtg

SEQ ID NO: 6986585 - DNA, 22 bp, Homo sapiens
tggaaagtttctgatttcctaa

SEQ ID NO: 6986586 - DNA, 22 bp, Homo sapiens
tcctggagaactgattcgcggg

SEQ ID NO: 6986587 - DNA, 22 bp, Homo sapiens
atgagttagtttcttgtctaga

SEQ ID NO: 6986588 - DNA, 22 bp, Homo sapiens
attgaatagctgcttgttgtat

SEQ ID NO: 6986589 - DNA, 22 bp, Homo sapiens
tagcagagtttggtacctgggg

SEQ ID NO: 6986590 - DNA, 22 bp, Homo sapiens
tgaagattgccctgtctcctgt

SEQ ID NO: 6986591 - DNA, 22 bp, Homo sapiens
accagttttttatacatcttct

SEQ ID NO: 6986592 - DNA, 22 bp, Homo sapiens
cacaggaattagcagcctaaaa

SEQ ID NO: 6986593 - DNA, 22 bp, Homo sapiens
tattaattcttgccaattctcc

SEQ ID NO: 6986594 - DNA, 22 bp, Homo sapiens
ggtggcctctcatgcaaggtag

SEQ ID NO: 6986595 - DNA, 22 bp, Homo sapiens
atcctgggaatgggagggtcat

SEQ ID NO: 6986596 - DNA, 22 bp, Homo sapiens
attgagaagaaaatctaatata

SEQ ID NO: 6986597 - DNA, 19 bp, Homo sapiens
aggacccttatcctggctt

SEQ ID NO: 6986598 - DNA, 22 bp, Homo sapiens
tcctggtgaatgactttttatt

SEQ ID NO: 6986599 - DNA, 22 bp, Homo sapiens
ttctctgggaacataaatgaag

SEQ ID NO: 6986600 - DNA, 19 bp, Homo sapiens
agacatgagacacaggatg

SEQ ID NO: 6986601 - DNA, 22 bp, Homo sapiens
ttaaaagggtaagcagcaactt

SEQ ID NO: 6986602 - DNA, 22 bp, Homo sapiens
cagacaattaagtaattgaggt

SEQ ID NO: 6986603 - DNA, 22 bp, Homo sapiens
tacaaggaaaatcttgaagtac

SEQ ID NO: 6986604 - DNA, 22 bp, Homo sapiens
cttcctgcaacacctgtgttgc

SEQ ID NO: 6986605 - DNA, 22 bp, Homo sapiens
gagctgagtatcccactgaagt

SEQ ID NO: 6986606 - DNA, 23 bp, Homo sapiens
actgaaaggatcctagcagagac

SEQ ID NO: 6986607 - DNA, 19 bp, Homo sapiens
gctggccacgccccagttg

SEQ ID NO: 6986608 - DNA, 22 bp, Homo sapiens
cagtttcttcctcccccagaga

SEQ ID NO: 6986609 - DNA, 22 bp, Homo sapiens
caggctgacaactgagcatttt

SEQ ID NO: 6986610 - DNA, 22 bp, Homo sapiens
tatttgaaagtgtacaaaaact

SEQ ID NO: 6986611 - DNA, 22 bp, Homo sapiens
aacaggctaagtatttggtagc

SEQ ID NO: 6986612 - DNA, 22 bp, Homo sapiens
gcattcattcattcattaggta

SEQ ID NO: 6986613 - DNA, 22 bp, Homo sapiens
gcacagactttgattgcagtca

SEQ ID NO: 6986614 - DNA, 22 bp, Homo sapiens
tttagagaattagaacagtact

SEQ ID NO: 6986615 - DNA, 22 bp, Homo sapiens
gtaacctggaagtttagggaag

SEQ ID NO: 6986616 - DNA, 22 bp, Homo sapiens
acacagctgtgcagttttttca

SEQ ID NO: 6986617 - DNA, 22 bp, Homo sapiens
agcaaagcactttgcatacata

SEQ ID NO: 6986618 - DNA, 22 bp, Homo sapiens
tctgagacttctgaagctagaa

SEQ ID NO: 6986619 - DNA, 22 bp, Homo sapiens
ctaactgtcatgcacatgtgtt

SEQ ID NO: 6986620 - DNA, 22 bp, Homo sapiens
cctcagaccccacagggcctgt

SEQ ID NO: 6986621 - DNA, 22 bp, Homo sapiens
atgggaatccaccctttaaaat

SEQ ID NO: 6986622 - DNA, 22 bp, Homo sapiens
tagcccagctcaaatgaccggt

SEQ ID NO: 6986623 - DNA, 22 bp, Homo sapiens
cagtcacattgccctgcattta

SEQ ID NO: 6986624 - DNA, 22 bp, Homo sapiens
ccaggaaccgatgatcagaggg

SEQ ID NO: 6986625 - DNA, 22 bp, Homo sapiens
aggagctgggagaaggactaaa

SEQ ID NO: 6986626 - DNA, 22 bp, Homo sapiens
ctgctgggcctggtctctgagg

SEQ ID NO: 6986627 - DNA, 22 bp, Homo sapiens
taaagtgcgacccagtccccag

SEQ ID NO: 6986628 - DNA, 22 bp, Homo sapiens
tcctgggtctgggtgtctgagg

SEQ ID NO: 6986629 - DNA, 22 bp, Homo sapiens
taggtgtcctcgtccaaagatt

SEQ ID NO: 6986630 - DNA, 22 bp, Homo sapiens
tttgagaaggtgacaaattcta

SEQ ID NO: 6986631 - DNA, 22 bp, Homo sapiens
tgaggggcatgtgtttacacat

SEQ ID NO: 6986632 - DNA, 22 bp, Homo sapiens
aagctgtgtattacagaatatt

SEQ ID NO: 6986633 - DNA, 22 bp, Homo sapiens
agtctttatttagagttaggac

SEQ ID NO: 6986634 - DNA, 22 bp, Homo sapiens
cacagtcccattcgagagtaat

SEQ ID NO: 6986635 - DNA, 22 bp, Homo sapiens
tgatgctgctgggagtggtgct

SEQ ID NO: 6986636 - DNA, 22 bp, Homo sapiens
cttacaaaggagaggagatagg

SEQ ID NO: 6986637 - DNA, 22 bp, Homo sapiens
gattcaaagacagactcatttc

SEQ ID NO: 6986638 - DNA, 22 bp, Homo sapiens
tcccagctcacatatggtaact

SEQ ID NO: 6986639 - DNA, 22 bp, Homo sapiens
agtaccattagattaggatgac

SEQ ID NO: 6986640 - DNA, 22 bp, Homo sapiens
aacatctgggccctgattttgg

SEQ ID NO: 6986641 - DNA, 22 bp, Homo sapiens
acagatgctctgatgtctgggt

SEQ ID NO: 6986642 - DNA, 22 bp, Homo sapiens
cagaatcagtgacacatgtata

SEQ ID NO: 6986643 - DNA, 19 bp, Homo sapiens
cctttgaatcaggacactt

SEQ ID NO: 6986644 - DNA, 22 bp, Homo sapiens
attcacatgatgtatgtagggc

SEQ ID NO: 6986645 - DNA, 22 bp, Homo sapiens
gtcctcagcaccagaactaggg

SEQ ID NO: 6986646 - DNA, 18 bp, Homo sapiens
ggccttagtatgtgcctt

SEQ ID NO: 6986647 - DNA, 22 bp, Homo sapiens
tatgtagacaggctgcttttcc

SEQ ID NO: 6986648 - DNA, 18 bp, Homo sapiens
tgtctaggtacgatggat

SEQ ID NO: 6986649 - DNA, 22 bp, Homo sapiens
agatacaaaggcctacagagca

SEQ ID NO: 6986650 - DNA, 22 bp, Homo sapiens
ggtgagcgtggaaggagtggga

SEQ ID NO: 6986651 - DNA, 22 bp, Homo sapiens
tttcaccaaggtaacctttgat

SEQ ID NO: 6986652 - DNA, 22 bp, Homo sapiens
aaccatgatgcagggtgggatg

SEQ ID NO: 6986653 - DNA, 22 bp, Homo sapiens
ttcaagtctgaagaggactaat

SEQ ID NO: 6986654 - DNA, 22 bp, Homo sapiens
atgtcagaagctggatgacagc

SEQ ID NO: 6986655 - DNA, 22 bp, Homo sapiens
cagagtgttagcgctggttggg

SEQ ID NO: 6986656 - DNA, 22 bp, Homo sapiens
ctggggctcactttggtcaggc

SEQ ID NO: 6986657 - DNA, 22 bp, Homo sapiens
agaagccatggggtcaccagag

SEQ ID NO: 6986658 - DNA, 22 bp, Homo sapiens
gaagagtggttatccctgctgt

SEQ ID NO: 6986659 - DNA, 19 bp, Homo sapiens
tatctgtttcctgcttgtc

SEQ ID NO: 6986660 - DNA, 22 bp, Homo sapiens
tctggctgcaccattatagtag

SEQ ID NO: 6986661 - DNA, 22 bp, Homo sapiens
ttgggaagtttaatgacagact

SEQ ID NO: 6986662 - DNA, 22 bp, Homo sapiens
tatcccatgagccagctgcagc

SEQ ID NO: 6986663 - DNA, 22 bp, Homo sapiens
aagcagtagaatgcattgcttt

SEQ ID NO: 6986664 - DNA, 22 bp, Homo sapiens
acagccaggagccatgggcagg

SEQ ID NO: 6986665 - DNA, 22 bp, Homo sapiens
ttattgtcctacttattgtctt

SEQ ID NO: 6986666 - DNA, 22 bp, Homo sapiens
gtgggtgtctcaagaatggggg

SEQ ID NO: 6986667 - DNA, 22 bp, Homo sapiens
gctttgctggaatcaacgaatg

SEQ ID NO: 6986668 - DNA, 22 bp, Homo sapiens
tcaaaaatggtctttgagctgc

SEQ ID NO: 6986669 - DNA, 22 bp, Homo sapiens
tgagtcactggcaaggctttga

SEQ ID NO: 6986670 - DNA, 23 bp, Homo sapiens
tgagctgggcctgcaggggtctc

SEQ ID NO: 6986671 - DNA, 22 bp, Homo sapiens
tgttacaaactgttgtttctat

SEQ ID NO: 6986672 - DNA, 22 bp, Homo sapiens
ctgaagatgaggctgctggggg

SEQ ID NO: 6986673 - DNA, 22 bp, Homo sapiens
gataccaaaatcatcttatagg

SEQ ID NO: 6986674 - DNA, 19 bp, Homo sapiens
attgtgtcaatggtgttca

SEQ ID NO: 6986675 - DNA, 22 bp, Homo sapiens
gctcctggccagcacagggccc

SEQ ID NO: 6986676 - DNA, 22 bp, Homo sapiens
aacatgtatcgctttttaatat

SEQ ID NO: 6986677 - DNA, 22 bp, Homo sapiens
agggccttgctgtctgaagctg

SEQ ID NO: 6986678 - DNA, 22 bp, Homo sapiens
tggcttctcgcctgtcatcccg

SEQ ID NO: 6986679 - DNA, 22 bp, Homo sapiens
gaggagagaagctaacggtgct

SEQ ID NO: 6986680 - DNA, 22 bp, Homo sapiens
ggacaggtgcaaagggcacatg

SEQ ID NO: 6986681 - DNA, 21 bp, Homo sapiens
tattgattcaatttcttgagt

SEQ ID NO: 6986682 - DNA, 22 bp, Homo sapiens
ccaggaactcagctctgcactt

SEQ ID NO: 6986683 - DNA, 19 bp, Homo sapiens
ttgacctgggttggaaggg

SEQ ID NO: 6986684 - DNA, 22 bp, Homo sapiens
cagaatttgaagtaatattcca

SEQ ID NO: 6986685 - DNA, 22 bp, Homo sapiens
atgccatcctaattacgttgaa

SEQ ID NO: 6986686 - DNA, 17 bp, Homo sapiens
tatacacagacagactg

SEQ ID NO: 6986687 - DNA, 22 bp, Homo sapiens
tgcaggtggccatcttcgttct

SEQ ID NO: 6986688 - DNA, 22 bp, Homo sapiens
ataaggcagtcactggaatgtt

SEQ ID NO: 6986689 - DNA, 18 bp, Homo sapiens
agctacgacatcaatgtt

SEQ ID NO: 6986690 - DNA, 22 bp, Homo sapiens
taccccaagagtgtctgccatg

SEQ ID NO: 6986691 - DNA, 23 bp, Homo sapiens
atcatagtctttgtgactggccc

SEQ ID NO: 6986692 - DNA, 22 bp, Homo sapiens
ttgatttgtattgcaggcccct

SEQ ID NO: 6986693 - DNA, 22 bp, Homo sapiens
aaatgctgggaaccattggatc

SEQ ID NO: 6986694 - DNA, 23 bp, Homo sapiens
tgaaattgtagagattttgtgtg

SEQ ID NO: 6986695 - DNA, 21 bp, Homo sapiens
catgaacatgcttatcctcag

SEQ ID NO: 6986696 - DNA, 22 bp, Homo sapiens
agcaaatacatttttagcataa

SEQ ID NO: 6986697 - DNA, 22 bp, Homo sapiens
aggatttggccatggcttcggg

SEQ ID NO: 6986698 - DNA, 22 bp, Homo sapiens
ctctgctgggatgtaaagtctt

SEQ ID NO: 6986699 - DNA, 22 bp, Homo sapiens
atgtgtctgtgggcacacacac

SEQ ID NO: 6986700 - DNA, 22 bp, Homo sapiens
aggtgggggctgtgtccttgac

SEQ ID NO: 6986701 - DNA, 22 bp, Homo sapiens
acacttttgtttgaagtctcca

SEQ ID NO: 6986702 - DNA, 22 bp, Homo sapiens
tgtacttcaaaccctttggttt

SEQ ID NO: 6986703 - DNA, 22 bp, Homo sapiens
cccaggcactcttggtcatttt

SEQ ID NO: 6986704 - DNA, 22 bp, Homo sapiens
agctttaaatcaatccagtgag

SEQ ID NO: 6986705 - DNA, 22 bp, Homo sapiens
tgtcctagtcaatcctctggac

SEQ ID NO: 6986706 - DNA, 22 bp, Homo sapiens
cagtcctgtgttaaacaagagc

SEQ ID NO: 6986707 - DNA, 22 bp, Homo sapiens
ttgtaaaggctgttattgactt

SEQ ID NO: 6986708 - DNA, 22 bp, Homo sapiens
atgcctcctgtgccactgtgat

SEQ ID NO: 6986709 - DNA, 22 bp, Homo sapiens
ttggctctgtgtctccactcaa

SEQ ID NO: 6986710 - DNA, 22 bp, Homo sapiens
tgaacaaatggaaataaccagt

SEQ ID NO: 6986711 - DNA, 22 bp, Homo sapiens
agtgtttactcaaagggttcca

SEQ ID NO: 6986712 - DNA, 22 bp, Homo sapiens
aggagggtgatccgggctggtc

SEQ ID NO: 6986713 - DNA, 20 bp, Homo sapiens
tgctccaggaacactggccg

SEQ ID NO: 6986714 - DNA, 22 bp, Homo sapiens
tccattttcatctcatgtataa

SEQ ID NO: 6986715 - DNA, 22 bp, Homo sapiens
agctcagccctcctgtgcagct

SEQ ID NO: 6986716 - DNA, 22 bp, Homo sapiens
tcagaccttgtcgtcacttaga

SEQ ID NO: 6986717 - DNA, 22 bp, Homo sapiens
atctttggggcatccaggaaaa

SEQ ID NO: 6986718 - DNA, 19 bp, Homo sapiens
ctgtggctgacctctggcc

SEQ ID NO: 6986719 - DNA, 22 bp, Homo sapiens
ctggcacattgtaatatataca

SEQ ID NO: 6986720 - DNA, 22 bp, Homo sapiens
tctgttcagacactttacatgt

SEQ ID NO: 6986721 - DNA, 22 bp, Homo sapiens
cagggcagagggaaactccttt

SEQ ID NO: 6986722 - DNA, 22 bp, Homo sapiens
tgtcacaatttatttctcttga

SEQ ID NO: 6986723 - DNA, 23 bp, Homo sapiens
caggaaatgaatccaggaggatg

SEQ ID NO: 6986724 - DNA, 21 bp, Homo sapiens
ttggcctgatatcttggagca

SEQ ID NO: 6986725 - DNA, 22 bp, Homo sapiens
tagctaagcattatgtaaacta

SEQ ID NO: 6986726 - DNA, 18 bp, Homo sapiens
agcagaattctagggttc

SEQ ID NO: 6986727 - DNA, 22 bp, Homo sapiens
agacaacaccaaatgctagtgt

SEQ ID NO: 6986728 - DNA, 22 bp, Homo sapiens
tgtcaacattggctgacagttg

SEQ ID NO: 6986729 - DNA, 22 bp, Homo sapiens
gcctctgcaattacattgtgcc

SEQ ID NO: 6986730 - DNA, 22 bp, Homo sapiens
atgggagtggaggaaaaaagtt

SEQ ID NO: 6986731 - DNA, 22 bp, Homo sapiens
ttagagttcagcatgactttga

SEQ ID NO: 6986732 - DNA, 22 bp, Homo sapiens
tgattcaactttcttgaatgca

SEQ ID NO: 6986733 - DNA, 22 bp, Homo sapiens
tgcagaggaccattgtcctgga

SEQ ID NO: 6986734 - DNA, 22 bp, Homo sapiens
tttgaaagggaaataaactcct

SEQ ID NO: 6986735 - DNA, 22 bp, Homo sapiens
tgtgtgcagcggcaggtgaagt

SEQ ID NO: 6986736 - DNA, 23 bp, Homo sapiens
tctgtctgtgtatgtgcagaaag

SEQ ID NO: 6986737 - DNA, 22 bp, Homo sapiens
catgagtatgattatacccagt

SEQ ID NO: 6986738 - DNA, 22 bp, Homo sapiens
aaaggtcttttttctaacacca

SEQ ID NO: 6986739 - DNA, 22 bp, Homo sapiens
tatcacatagtgtttagtaaat

SEQ ID NO: 6986740 - DNA, 22 bp, Homo sapiens
tgagagcctagtaggtggaaaa

SEQ ID NO: 6986741 - DNA, 22 bp, Homo sapiens
atgtgcagttggtggccaggag

SEQ ID NO: 6986742 - DNA, 22 bp, Homo sapiens
aacagcagaggagcgatggctg

SEQ ID NO: 6986743 - DNA, 22 bp, Homo sapiens
tgctggcattgcataggcagtt

SEQ ID NO: 6986744 - DNA, 22 bp, Homo sapiens
tcacaaatagctatattaagga

SEQ ID NO: 6986745 - DNA, 21 bp, Homo sapiens
cccctgggagccctgtcagta

SEQ ID NO: 6986746 - DNA, 22 bp, Homo sapiens
tgggctgccagctctccagatg

SEQ ID NO: 6986747 - DNA, 22 bp, Homo sapiens
attgtcaggggttgtggagttt

SEQ ID NO: 6986748 - DNA, 22 bp, Homo sapiens
attcagaaagatatgcctggtt

SEQ ID NO: 6986749 - DNA, 22 bp, Homo sapiens
atgtatgtagtgtacatataca

SEQ ID NO: 6986750 - DNA, 22 bp, Homo sapiens
tctgtctgtagttttacatgat

SEQ ID NO: 6986751 - DNA, 21 bp, Homo sapiens
agctgggtgggctgagtgaca

SEQ ID NO: 6986752 - DNA, 22 bp, Homo sapiens
taaatcacccatctcctaatct

SEQ ID NO: 6986753 - DNA, 22 bp, Homo sapiens
tgccttggtggcagtctgcggt

SEQ ID NO: 6986754 - DNA, 22 bp, Homo sapiens
tcttcatgtcatggtatattga

SEQ ID NO: 6986755 - DNA, 22 bp, Homo sapiens
cttctttaatgtatacaaaaga

SEQ ID NO: 6986756 - DNA, 22 bp, Homo sapiens
aaaggcatgcatggtctgctcc

SEQ ID NO: 6986757 - DNA, 22 bp, Homo sapiens
agtaaactgtgtgcctttgact

SEQ ID NO: 6986758 - DNA, 22 bp, Homo sapiens
cttgaagaaagtatgttgggat

SEQ ID NO: 6986759 - DNA, 22 bp, Homo sapiens
caggctgtctgaatggaggccc

SEQ ID NO: 6986760 - DNA, 22 bp, Homo sapiens
atgctcagagaaatataaagtt

SEQ ID NO: 6986761 - DNA, 22 bp, Homo sapiens
cagagcagtggagagtaggtct

SEQ ID NO: 6986762 - DNA, 21 bp, Homo sapiens
ggtcacacagctggtaaatag

SEQ ID NO: 6986763 - DNA, 22 bp, Homo sapiens
tttcatgtgttgaatgtgtaca

SEQ ID NO: 6986764 - DNA, 22 bp, Homo sapiens
atctggaggtcatcgtttgttc

SEQ ID NO: 6986765 - DNA, 22 bp, Homo sapiens
tagcatcagccacaccttgtac

SEQ ID NO: 6986766 - DNA, 22 bp, Homo sapiens
gggacaggcccctcgctagctt

SEQ ID NO: 6986767 - DNA, 22 bp, Homo sapiens
ctccaggatacctgttcctata

SEQ ID NO: 6986768 - DNA, 22 bp, Homo sapiens
aaggctgaaagaccttgaacct

SEQ ID NO: 6986769 - DNA, 22 bp, Homo sapiens
tcagatggatttatactatttc

SEQ ID NO: 6986770 - DNA, 22 bp, Homo sapiens
tgaataagaattattataatga

SEQ ID NO: 6986771 - DNA, 22 bp, Homo sapiens
actagattttggccattataca

SEQ ID NO: 6986772 - DNA, 22 bp, Homo sapiens
ttaagctagtgaagtccctcaa

SEQ ID NO: 6986773 - DNA, 23 bp, Homo sapiens
agaaggtgggcctgctgagttat

SEQ ID NO: 6986774 - DNA, 22 bp, Homo sapiens
gtgaatgtaaagtcatgtgact

SEQ ID NO: 6986775 - DNA, 22 bp, Homo sapiens
ggagctgctttgatctgaagaa

SEQ ID NO: 6986776 - DNA, 22 bp, Homo sapiens
attcagcattggcaccatggat

SEQ ID NO: 6986777 - DNA, 22 bp, Homo sapiens
agatggccccaggtgcccaggg

SEQ ID NO: 6986778 - DNA, 22 bp, Homo sapiens
tggaaatgtttcttgagctcag

SEQ ID NO: 6986779 - DNA, 22 bp, Homo sapiens
tgacactttgtgactctgagaa

SEQ ID NO: 6986780 - DNA, 22 bp, Homo sapiens
taaaggcctagtaagttgagac

SEQ ID NO: 6986781 - DNA, 22 bp, Homo sapiens
tggctgaactaatgtgctgttt

SEQ ID NO: 6986782 - DNA, 22 bp, Homo sapiens
ctcaggtcacaggatggccagg

SEQ ID NO: 6986783 - DNA, 19 bp, Homo sapiens
tcagaactcagaatgtgta

SEQ ID NO: 6986784 - DNA, 16 bp, Homo sapiens
ctcctctccttcagga

SEQ ID NO: 6986785 - DNA, 19 bp, Homo sapiens
ttgtgagctgaagaacagg

SEQ ID NO: 6986786 - DNA, 22 bp, Homo sapiens
ttgttttctccactgcatctta

SEQ ID NO: 6986787 - DNA, 22 bp, Homo sapiens
gtctggcctgccagctctggtg

SEQ ID NO: 6986788 - DNA, 22 bp, Homo sapiens
aaaaaggctaagcatcttgtgc

SEQ ID NO: 6986789 - DNA, 22 bp, Homo sapiens
caaatgctatgattttgagttt

SEQ ID NO: 6986790 - DNA, 22 bp, Homo sapiens
attacagttctgcaggtagttt

SEQ ID NO: 6986791 - DNA, 22 bp, Homo sapiens
cacatttacttttatcccttgg

SEQ ID NO: 6986792 - DNA, 22 bp, Homo sapiens
aaaactaaatacgctttgcctc

SEQ ID NO: 6986793 - DNA, 22 bp, Homo sapiens
ggccacactctggtagaggtga

SEQ ID NO: 6986794 - DNA, 22 bp, Homo sapiens
tatggcttttcattcctatgtg

SEQ ID NO: 6986795 - DNA, 22 bp, Homo sapiens
agggtcaacatttcattgattc

SEQ ID NO: 6986796 - DNA, 22 bp, Homo sapiens
ggtgtttagggaggggttataa

SEQ ID NO: 6986797 - DNA, 15 bp, Homo sapiens
tcactctggaaggga

SEQ ID NO: 6986798 - DNA, 22 bp, Homo sapiens
tcctgcagccactgcaggcaga

SEQ ID NO: 6986799 - DNA, 22 bp, Homo sapiens
atcaaatataataattttcgct

SEQ ID NO: 6986800 - DNA, 22 bp, Homo sapiens
gtcaagatgagaattcttttta

SEQ ID NO: 6986801 - DNA, 22 bp, Homo sapiens
agggctctgtgactatcactgc

SEQ ID NO: 6986802 - DNA, 22 bp, Homo sapiens
acctctgcaatgcaatgtcatg

SEQ ID NO: 6986803 - DNA, 22 bp, Homo sapiens
tgcctgcttgtgtacctggtga

SEQ ID NO: 6986804 - DNA, 22 bp, Homo sapiens
ttctacttgccaaatgacacat

SEQ ID NO: 6986805 - DNA, 22 bp, Homo sapiens
aagcagcttttgaagagtgagg

SEQ ID NO: 6986806 - DNA, 22 bp, Homo sapiens
taaagtgtctgcctcagctcag

SEQ ID NO: 6986807 - DNA, 22 bp, Homo sapiens
ttttatgattgagctggctaca

SEQ ID NO: 6986808 - DNA, 22 bp, Homo sapiens
actttgttctaatagtatctct

SEQ ID NO: 6986809 - DNA, 22 bp, Homo sapiens
aaatacataaaggttgtaccag

SEQ ID NO: 6986810 - DNA, 22 bp, Homo sapiens
aaagtctgagcagaatttctca

SEQ ID NO: 6986811 - DNA, 22 bp, Homo sapiens
agatatacagagaattattcac

SEQ ID NO: 6986812 - DNA, 22 bp, Homo sapiens
acccgatgttggtgctctagta

SEQ ID NO: 6986813 - DNA, 22 bp, Homo sapiens
tgggtaagtggaggacaaagta

SEQ ID NO: 6986814 - DNA, 22 bp, Homo sapiens
ttctgtcacttgcaatcaagag

SEQ ID NO: 6986815 - DNA, 22 bp, Homo sapiens
tggaggatgccatccaggatac

SEQ ID NO: 6986816 - DNA, 22 bp, Homo sapiens
ttacattgtccagaaattattg

SEQ ID NO: 6986817 - DNA, 22 bp, Homo sapiens
agcacaggtaatacagagtaac

SEQ ID NO: 6986818 - DNA, 22 bp, Homo sapiens
ggaccctgggcttgctcctggg

SEQ ID NO: 6986819 - DNA, 22 bp, Homo sapiens
tcctgatggaggggtcatcttt

SEQ ID NO: 6986820 - DNA, 22 bp, Homo sapiens
gaggctcagttattttagcctg

SEQ ID NO: 6986821 - DNA, 19 bp, Homo sapiens
gctcagtgatgccagacca

SEQ ID NO: 6986822 - DNA, 22 bp, Homo sapiens
acccccaagaggggccttcagc

SEQ ID NO: 6986823 - DNA, 22 bp, Homo sapiens
agtacaacattagagtatctta

SEQ ID NO: 6986824 - DNA, 22 bp, Homo sapiens
agtgtgagttacaaagtgtgaa

SEQ ID NO: 6986825 - DNA, 22 bp, Homo sapiens
caggaagtgtgagggtggtgta

SEQ ID NO: 6986826 - DNA, 22 bp, Homo sapiens
ggcactggagactgttatgaga

SEQ ID NO: 6986827 - DNA, 22 bp, Homo sapiens
ggctctgcagcttggggtcctg

SEQ ID NO: 6986828 - DNA, 22 bp, Homo sapiens
taattattgtctgaagagttat

SEQ ID NO: 6986829 - DNA, 22 bp, Homo sapiens
tacatagaatatttcacttaaa

SEQ ID NO: 6986830 - DNA, 22 bp, Homo sapiens
gccaggccactcccgggtcctg

SEQ ID NO: 6986831 - DNA, 20 bp, Homo sapiens
gaagggatcactgcatactt

SEQ ID NO: 6986832 - DNA, 22 bp, Homo sapiens
tagccctgtccttggcctgtgc

SEQ ID NO: 6986833 - DNA, 22 bp, Homo sapiens
aggttacataggctttaaaagt

SEQ ID NO: 6986834 - DNA, 23 bp, Homo sapiens
tccaggctgaaggagcagatttt

SEQ ID NO: 6986835 - DNA, 22 bp, Homo sapiens
tatagtaaaattttcatttatg

SEQ ID NO: 6986836 - DNA, 22 bp, Homo sapiens
atagtaaattatcgtggagaga

SEQ ID NO: 6986837 - DNA, 22 bp, Homo sapiens
catgagaaccaggtctgtgttt

SEQ ID NO: 6986838 - DNA, 22 bp, Homo sapiens
ctgcctgctacctgaaatgcca

SEQ ID NO: 6986839 - DNA, 22 bp, Homo sapiens
caatttgtctaatgaaactcag

SEQ ID NO: 6986840 - DNA, 22 bp, Homo sapiens
aagaggggtggtctgtgaggat

SEQ ID NO: 6986841 - DNA, 22 bp, Homo sapiens
cagctgtccaaacacattaact

SEQ ID NO: 6986842 - DNA, 22 bp, Homo sapiens
agtaaacatgtaattgttcatt

SEQ ID NO: 6986843 - DNA, 22 bp, Homo sapiens
atatgtcaagattttgagcaga

SEQ ID NO: 6986844 - DNA, 22 bp, Homo sapiens
aactaacagtcattaaaagaac

SEQ ID NO: 6986845 - DNA, 23 bp, Homo sapiens
cctggctgtggatttgggcctgc

SEQ ID NO: 6986846 - DNA, 22 bp, Homo sapiens
gttttgttttgagtcaactcca

SEQ ID NO: 6986847 - DNA, 22 bp, Homo sapiens
gatttcaaaggttctgcatgcc

SEQ ID NO: 6986848 - DNA, 19 bp, Homo sapiens
cactgagctctgttcacta

SEQ ID NO: 6986849 - DNA, 20 bp, Homo sapiens
ggggcagtggctcatgcctg

SEQ ID NO: 6986850 - DNA, 22 bp, Homo sapiens
aaggctttcctgtaggaagaca

SEQ ID NO: 6986851 - DNA, 22 bp, Homo sapiens
aaggctttgaaaaccaaaaggt

SEQ ID NO: 6986852 - DNA, 22 bp, Homo sapiens
acatgccagcactgcttttcag

SEQ ID NO: 6986853 - DNA, 22 bp, Homo sapiens
tttcaatgtaacatttccaggc

SEQ ID NO: 6986854 - DNA, 22 bp, Homo sapiens
aggcttgttttactaaaagcaa

SEQ ID NO: 6986855 - DNA, 22 bp, Homo sapiens
cctggcatccggaacctggaaa

SEQ ID NO: 6986856 - DNA, 22 bp, Homo sapiens
ttgagatgaggtagaagccaat

SEQ ID NO: 6986857 - DNA, 22 bp, Homo sapiens
tgccgcactcggctcctgattt

SEQ ID NO: 6986858 - DNA, 22 bp, Homo sapiens
aactctggaaatctacatggcc

SEQ ID NO: 6986859 - DNA, 23 bp, Homo sapiens
tcccattgccctatagtgcctca

SEQ ID NO: 6986860 - DNA, 22 bp, Homo sapiens
tcagaggacagcagctaaataa

SEQ ID NO: 6986861 - DNA, 22 bp, Homo sapiens
tcactcagatgttaaagggctt

SEQ ID NO: 6986862 - DNA, 22 bp, Homo sapiens
tctgctgttgccatgagtaata

SEQ ID NO: 6986863 - DNA, 22 bp, Homo sapiens
cttggaaggctggttctccctc

SEQ ID NO: 6986864 - DNA, 21 bp, Homo sapiens
gaaaccaggttatcaatcaca

SEQ ID NO: 6986865 - DNA, 22 bp, Homo sapiens
tatggacatgagtcaaggtgct

SEQ ID NO: 6986866 - DNA, 22 bp, Homo sapiens
tcctagtgcaaattggagcatg

SEQ ID NO: 6986867 - DNA, 22 bp, Homo sapiens
cctgtgctggacagggctgggc

SEQ ID NO: 6986868 - DNA, 22 bp, Homo sapiens
ctctggcaatggatttttgagg

SEQ ID NO: 6986869 - DNA, 20 bp, Homo sapiens
cacagagtcttgcagcgttc

SEQ ID NO: 6986870 - DNA, 22 bp, Homo sapiens
agtcacacttcgtatctctagc

SEQ ID NO: 6986871 - DNA, 22 bp, Homo sapiens
acgttgaatgtccatttgagat

SEQ ID NO: 6986872 - DNA, 21 bp, Homo sapiens
agatagttgggcatgcagctg

SEQ ID NO: 6986873 - DNA, 22 bp, Homo sapiens
tatgacaaatgatatatttggc

SEQ ID NO: 6986874 - DNA, 22 bp, Homo sapiens
agataggagccaggacttaaca

SEQ ID NO: 6986875 - DNA, 22 bp, Homo sapiens
agcagcttcaattttctaagtg

SEQ ID NO: 6986876 - DNA, 22 bp, Homo sapiens
tacatgagggcactctgcatct

SEQ ID NO: 6986877 - DNA, 22 bp, Homo sapiens
tcttagttagctcccttcttct

SEQ ID NO: 6986878 - DNA, 22 bp, Homo sapiens
tgctacagctgttcagtgccct

SEQ ID NO: 6986879 - DNA, 22 bp, Homo sapiens
aagattctcactgctcaacttt

SEQ ID NO: 6986880 - DNA, 22 bp, Homo sapiens
cttggtaaattgtcttataaat

SEQ ID NO: 6986881 - DNA, 22 bp, Homo sapiens
cattgttatagcattacacacc

SEQ ID NO: 6986882 - DNA, 22 bp, Homo sapiens
gccagtgttattcctggggctg

SEQ ID NO: 6986883 - DNA, 22 bp, Homo sapiens
ttccctggaacatcatggtcta

SEQ ID NO: 6986884 - DNA, 18 bp, Homo sapiens
gctggctgcacttctgct

SEQ ID NO: 6986885 - DNA, 22 bp, Homo sapiens
gcaaacaaggacatacatcctg

SEQ ID NO: 6986886 - DNA, 22 bp, Homo sapiens
caggctgcccggcaagttgcgc

SEQ ID NO: 6986887 - DNA, 19 bp, Homo sapiens
tgaacagagaggactctgg

SEQ ID NO: 6986888 - DNA, 22 bp, Homo sapiens
gcaggtggtccccgtggagtgg

SEQ ID NO: 6986889 - DNA, 22 bp, Homo sapiens
tagctggcaaaacattatttct

SEQ ID NO: 6986890 - DNA, 22 bp, Homo sapiens
accccttgaaggcagagaagct

SEQ ID NO: 6986891 - DNA, 22 bp, Homo sapiens
tgccatttaaaaatgaccaaat

SEQ ID NO: 6986892 - DNA, 22 bp, Homo sapiens
ccagggaaactttggagtggag

SEQ ID NO: 6986893 - DNA, 22 bp, Homo sapiens
gcatggctcctgtcttactccc

SEQ ID NO: 6986894 - DNA, 22 bp, Homo sapiens
acactttctggagctgcacata

SEQ ID NO: 6986895 - DNA, 22 bp, Homo sapiens
ctccagtgcacccagaggattt

SEQ ID NO: 6986896 - DNA, 23 bp, Homo sapiens
aggacagcaaaccccgcctcccc

SEQ ID NO: 6986897 - DNA, 22 bp, Homo sapiens
cttcttcagcacaatattgatg

SEQ ID NO: 6986898 - DNA, 22 bp, Homo sapiens
ttgatcatcttgtgctgacggc

SEQ ID NO: 6986899 - DNA, 22 bp, Homo sapiens
ttggaattaatatttgtataca

SEQ ID NO: 6986900 - DNA, 22 bp, Homo sapiens
caatgctttatttcctcccctt

SEQ ID NO: 6986901 - DNA, 22 bp, Homo sapiens
ggaggattagctctgcctgaaa

SEQ ID NO: 6986902 - DNA, 22 bp, Homo sapiens
taatgtgtcctgaaagcttctg

SEQ ID NO: 6986903 - DNA, 22 bp, Homo sapiens
acagagttagcagaaagttgga

SEQ ID NO: 6986904 - DNA, 22 bp, Homo sapiens
agctggtgcctgcttttgtgtg

SEQ ID NO: 6986905 - DNA, 22 bp, Homo sapiens
tagctctgacatttgcaattac

SEQ ID NO: 6986906 - DNA, 22 bp, Homo sapiens
tatgaacacactttggaagtga

SEQ ID NO: 6986907 - DNA, 22 bp, Homo sapiens
agcagccctatgtaattggact

SEQ ID NO: 6986908 - DNA, 22 bp, Homo sapiens
tgtcattttatgtatgtggtct

SEQ ID NO: 6986909 - DNA, 22 bp, Homo sapiens
agcgctggctggcgctccttcc

SEQ ID NO: 6986910 - DNA, 22 bp, Homo sapiens
aatgctctttgaatttgtcaga

SEQ ID NO: 6986911 - DNA, 22 bp, Homo sapiens
tggcaccaaaagcagacgtatt

SEQ ID NO: 6986912 - DNA, 22 bp, Homo sapiens
ttcttattatgtgctctgtgaa

SEQ ID NO: 6986913 - DNA, 22 bp, Homo sapiens
gtaaactcagagaatacttctt

SEQ ID NO: 6986914 - DNA, 22 bp, Homo sapiens
acctggctgttctcatttctag

SEQ ID NO: 6986915 - DNA, 22 bp, Homo sapiens
taagtagttccatccaaacagc

SEQ ID NO: 6986916 - DNA, 22 bp, Homo sapiens
gggtctctcatgcagttgctgt

SEQ ID NO: 6986917 - DNA, 22 bp, Homo sapiens
tgcacacacatgcagagggaga

SEQ ID NO: 6986918 - DNA, 20 bp, Homo sapiens
ggagctctgcatttatcttc

SEQ ID NO: 6986919 - DNA, 22 bp, Homo sapiens
tctcccaggtcatacacagaga

SEQ ID NO: 6986920 - DNA, 22 bp, Homo sapiens
cctcatgatttttagcccattg

SEQ ID NO: 6986921 - DNA, 22 bp, Homo sapiens
tccagccaatcaactattgttt

SEQ ID NO: 6986922 - DNA, 22 bp, Homo sapiens
acaaatgtctcctcttttgtta

SEQ ID NO: 6986923 - DNA, 22 bp, Homo sapiens
caatacactaaacttctctgaa

SEQ ID NO: 6986924 - DNA, 22 bp, Homo sapiens
ggaaggggtgggtgagcctcag

SEQ ID NO: 6986925 - DNA, 22 bp, Homo sapiens
ccagcagccctcttccaagact

SEQ ID NO: 6986926 - DNA, 22 bp, Homo sapiens
tgaaatcagtggtataatcggg

SEQ ID NO: 6986927 - DNA, 22 bp, Homo sapiens
agtatttgatacagtcttctag

SEQ ID NO: 6986928 - DNA, 18 bp, Homo sapiens
catgagctgcccctagac

SEQ ID NO: 6986929 - DNA, 22 bp, Homo sapiens
ataagagctagtcttttccttg

SEQ ID NO: 6986930 - DNA, 22 bp, Homo sapiens
aaatgcagattgtcattcagga

SEQ ID NO: 6986931 - DNA, 22 bp, Homo sapiens
tcctttaaacaaccagctctca

SEQ ID NO: 6986932 - DNA, 21 bp, Homo sapiens
ttacttctgcttgttattgtc

SEQ ID NO: 6986933 - DNA, 22 bp, Homo sapiens
acagcttgtagaggccctggca

SEQ ID NO: 6986934 - DNA, 22 bp, Homo sapiens
caaatgtatcagcccagggatt

SEQ ID NO: 6986935 - DNA, 22 bp, Homo sapiens
taaggcataaggaagatttgga

SEQ ID NO: 6986936 - DNA, 22 bp, Homo sapiens
atgggcagacagggagctcacg

SEQ ID NO: 6986937 - DNA, 22 bp, Homo sapiens
tgacatctagtaggtagagacc

SEQ ID NO: 6986938 - DNA, 22 bp, Homo sapiens
ttctccctggtatttacttagt

SEQ ID NO: 6986939 - DNA, 22 bp, Homo sapiens
acattgtaagcatattagctga

SEQ ID NO: 6986940 - DNA, 22 bp, Homo sapiens
acacttcacccctgctcccagt

SEQ ID NO: 6986941 - DNA, 22 bp, Homo sapiens
tgccagcctcctgatatcatcc

SEQ ID NO: 6986942 - DNA, 22 bp, Homo sapiens
accagcagcctagagcgttctt

SEQ ID NO: 6986943 - DNA, 22 bp, Homo sapiens
gctgagattacgggcatgagcc

SEQ ID NO: 6986944 - DNA, 22 bp, Homo sapiens
acagtgaatccaaattcctacc

SEQ ID NO: 6986945 - DNA, 22 bp, Homo sapiens
aatgagcaaatgaagacgctgt

SEQ ID NO: 6986946 - DNA, 21 bp, Homo sapiens
tttgaaagccctatgttttca

SEQ ID NO: 6986947 - DNA, 22 bp, Homo sapiens
aacatttcagcaaataagaaca

SEQ ID NO: 6986948 - DNA, 22 bp, Homo sapiens
ggccttgggctggctgcagtat

SEQ ID NO: 6986949 - DNA, 22 bp, Homo sapiens
ccctgccttggggtccacaccg

SEQ ID NO: 6986950 - DNA, 22 bp, Homo sapiens
gaggggctgtggagctctctgg

SEQ ID NO: 6986951 - DNA, 22 bp, Homo sapiens
gaggattctagtgacctcagag

SEQ ID NO: 6986952 - DNA, 22 bp, Homo sapiens
atttctcagtgtacattatgtt

SEQ ID NO: 6986953 - DNA, 22 bp, Homo sapiens
taaggcttttaaaggttcacca

SEQ ID NO: 6986954 - DNA, 22 bp, Homo sapiens
ccttccagggtttttgccaatc

SEQ ID NO: 6986955 - DNA, 22 bp, Homo sapiens
acagtgtctcactgctgaaatc

SEQ ID NO: 6986956 - DNA, 21 bp, Homo sapiens
ctgtcacctgctcagagaggg

SEQ ID NO: 6986957 - DNA, 22 bp, Homo sapiens
ttacatacttactagatctatg

SEQ ID NO: 6986958 - DNA, 22 bp, Homo sapiens
agcagctacttaaccttgtaca

SEQ ID NO: 6986959 - DNA, 22 bp, Homo sapiens
agaggattttaaaagcatatgt

SEQ ID NO: 6986960 - DNA, 22 bp, Homo sapiens
gctcccagggcagcgcagaaga

SEQ ID NO: 6986961 - DNA, 22 bp, Homo sapiens
ctcttcaacagagcagaaggct

SEQ ID NO: 6986962 - DNA, 18 bp, Homo sapiens
taagaaggtggctccagc

SEQ ID NO: 6986963 - DNA, 22 bp, Homo sapiens
tgcaaacaccacagagacaatt

SEQ ID NO: 6986964 - DNA, 22 bp, Homo sapiens
acacacatgcctttcctaagta

SEQ ID NO: 6986965 - DNA, 22 bp, Homo sapiens
ggctgctggccagcctaggagt

SEQ ID NO: 6986966 - DNA, 22 bp, Homo sapiens
ggtgcccaaggaaggttgccgt

SEQ ID NO: 6986967 - DNA, 22 bp, Homo sapiens
gtgacatgcatggtgctggtgg

SEQ ID NO: 6986968 - DNA, 22 bp, Homo sapiens
cacccattaaccaaagagtgaa

SEQ ID NO: 6986969 - DNA, 22 bp, Homo sapiens
tactggtctcagcagattgagg

SEQ ID NO: 6986970 - DNA, 22 bp, Homo sapiens
gtgccctgacacacctggtgtg

SEQ ID NO: 6986971 - DNA, 22 bp, Homo sapiens
gagtgtctgtattttgggcaag

SEQ ID NO: 6986972 - DNA, 22 bp, Homo sapiens
gtagatgagctcacatgacctt

SEQ ID NO: 6986973 - DNA, 22 bp, Homo sapiens
tacagatatgtatgcacttttt

SEQ ID NO: 6986974 - DNA, 22 bp, Homo sapiens
catgcattcctcctctgcctta

SEQ ID NO: 6986975 - DNA, 22 bp, Homo sapiens
atgcattcatgaagattgcaca

SEQ ID NO: 6986976 - DNA, 22 bp, Homo sapiens
ctgcgtggtaggactcagttct

SEQ ID NO: 6986977 - DNA, 22 bp, Homo sapiens
ccctgtctcattgatcacttgt

SEQ ID NO: 6986978 - DNA, 22 bp, Homo sapiens
agctcctggtctttgtccagag

SEQ ID NO: 6986979 - DNA, 21 bp, Homo sapiens
cactcaataaatgtcatatgc

SEQ ID NO: 6986980 - DNA, 22 bp, Homo sapiens
tggtaaaatattacaaggcact

SEQ ID NO: 6986981 - DNA, 22 bp, Homo sapiens
cagggtgcagtgtcgctgctag

SEQ ID NO: 6986982 - DNA, 22 bp, Homo sapiens
gcagaagcagaggagcctatga

SEQ ID NO: 6986983 - DNA, 22 bp, Homo sapiens
ccagttttgccatggtaacact

SEQ ID NO: 6986984 - DNA, 22 bp, Homo sapiens
gggaggtgttctgccaacgcgg

SEQ ID NO: 6986985 - DNA, 22 bp, Homo sapiens
ataggcaaattaataagtcata

SEQ ID NO: 6986986 - DNA, 22 bp, Homo sapiens
actgtgtttctgaaacaagagg

SEQ ID NO: 6986987 - DNA, 22 bp, Homo sapiens
ccatctcactcatgtttctaga

SEQ ID NO: 6986988 - DNA, 22 bp, Homo sapiens
gtcttcattctcatagccctgg

SEQ ID NO: 6986989 - DNA, 22 bp, Homo sapiens
aaaatactactgtcttcttccc

SEQ ID NO: 6986990 - DNA, 22 bp, Homo sapiens
ggtattgaggtaatcctatttt

SEQ ID NO: 6986991 - DNA, 22 bp, Homo sapiens
aatggctgttctctgtgattgg

SEQ ID NO: 6986992 - DNA, 22 bp, Homo sapiens
actgcttagtattattaatgtc

SEQ ID NO: 6986993 - DNA, 22 bp, Homo sapiens
gaggcctgcagcgtggtccctg

SEQ ID NO: 6986994 - DNA, 22 bp, Homo sapiens
caaatgaagagggcaacttctg

SEQ ID NO: 6986995 - DNA, 22 bp, Homo sapiens
gccaaaggcccttctgaaggca

SEQ ID NO: 6986996 - DNA, 22 bp, Homo sapiens
cagctacacaccagaactatta

SEQ ID NO: 6986997 - DNA, 22 bp, Homo sapiens
cacaggctcttctcacttgatt

SEQ ID NO: 6986998 - DNA, 22 bp, Homo sapiens
cacatgaaggctggggtcgtga

SEQ ID NO: 6986999 - DNA, 22 bp, Homo sapiens
acatgtatacaatgtgtaatga

SEQ ID NO: 6987000 - DNA, 22 bp, Homo sapiens
gcccatgcccctccttctggca

SEQ ID NO: 6987001 - DNA, 22 bp, Homo sapiens
gtcagcagaaacgccacatgca

SEQ ID NO: 6987002 - DNA, 22 bp, Homo sapiens
gaaaggagtgctttccaggtct

SEQ ID NO: 6987003 - DNA, 22 bp, Homo sapiens
atgctgtctctgctatccaaag

SEQ ID NO: 6987004 - DNA, 17 bp, Homo sapiens
tagagcccacccgctgg

SEQ ID NO: 6987005 - DNA, 22 bp, Homo sapiens
acagcattcaataaataataac

SEQ ID NO: 6987006 - DNA, 22 bp, Homo sapiens
gcggaagcggtagtcaccctcg

SEQ ID NO: 6987007 - DNA, 22 bp, Homo sapiens
atgatgcaccattataagagtt

SEQ ID NO: 6987008 - DNA, 22 bp, Homo sapiens
agtgtttgtcccgttagaaatg

SEQ ID NO: 6987009 - DNA, 22 bp, Homo sapiens
tgatggttgattataaatcagt

SEQ ID NO: 6987010 - DNA, 22 bp, Homo sapiens
cacaggaataagtcaaacttca

SEQ ID NO: 6987011 - DNA, 22 bp, Homo sapiens
tccgaggcgcaccggcgctcct

SEQ ID NO: 6987012 - DNA, 22 bp, Homo sapiens
tggaggccctcattgtagaagt

SEQ ID NO: 6987013 - DNA, 22 bp, Homo sapiens
aatacttatgtgacctcatttt

SEQ ID NO: 6987014 - DNA, 22 bp, Homo sapiens
ggtcagcaatttggactgggct

SEQ ID NO: 6987015 - DNA, 22 bp, Homo sapiens
tcttttgtcatagagcatggta

SEQ ID NO: 6987016 - DNA, 22 bp, Homo sapiens
caggagcctcctgattccaatt

SEQ ID NO: 6987017 - DNA, 22 bp, Homo sapiens
tctcctggcctttaggttaagg

SEQ ID NO: 6987018 - DNA, 22 bp, Homo sapiens
tgcttagcacaagaataaactg

SEQ ID NO: 6987019 - DNA, 22 bp, Homo sapiens
cagcatctcccaggcatttgcc

SEQ ID NO: 6987020 - DNA, 22 bp, Homo sapiens
gggccctggggcctgatttgca

SEQ ID NO: 6987021 - DNA, 22 bp, Homo sapiens
tactgcatgaaggcacctattt

SEQ ID NO: 6987022 - DNA, 22 bp, Homo sapiens
attgctggcagctggatctgca

SEQ ID NO: 6987023 - DNA, 22 bp, Homo sapiens
ctccctctgtccgaggccggct

SEQ ID NO: 6987024 - DNA, 22 bp, Homo sapiens
catggcaggaaaatgaacaggc

SEQ ID NO: 6987025 - DNA, 22 bp, Homo sapiens
gggatcgggcttgaggggccct

SEQ ID NO: 6987026 - DNA, 20 bp, Homo sapiens
tgtcaatagcactgaggctg

SEQ ID NO: 6987027 - DNA, 22 bp, Homo sapiens
tgagctgggaagagcagccaga

SEQ ID NO: 6987028 - DNA, 22 bp, Homo sapiens
ggctcctggggaggtgagcttg

SEQ ID NO: 6987029 - DNA, 22 bp, Homo sapiens
gtacataaaggaggctctttgc

SEQ ID NO: 6987030 - DNA, 21 bp, Homo sapiens
gtgtggatatgtgacaggtgg

SEQ ID NO: 6987031 - DNA, 22 bp, Homo sapiens
attcccatagccatccggagag

SEQ ID NO: 6987032 - DNA, 21 bp, Homo sapiens
agagactgtcactgcagtacc

SEQ ID NO: 6987033 - DNA, 22 bp, Homo sapiens
taggtagaatgcattttggatg

SEQ ID NO: 6987034 - DNA, 22 bp, Homo sapiens
gcaagtagtgggaaagaagatg

SEQ ID NO: 6987035 - DNA, 22 bp, Homo sapiens
tacagcttaaaagatgcattta

SEQ ID NO: 6987036 - DNA, 22 bp, Homo sapiens
agggctgtgtttgcaccctctg

SEQ ID NO: 6987037 - DNA, 22 bp, Homo sapiens
tggttagactcaccttatagtt

SEQ ID NO: 6987038 - DNA, 22 bp, Homo sapiens
gtctgggagtttggtgctgccg

SEQ ID NO: 6987039 - DNA, 22 bp, Homo sapiens
gaatgcaaactggggcaccgtt

SEQ ID NO: 6987040 - DNA, 22 bp, Homo sapiens
aaatgattgtcaaagttctgtt

SEQ ID NO: 6987041 - DNA, 22 bp, Homo sapiens
agctagagaatgacagagtctg

SEQ ID NO: 6987042 - DNA, 22 bp, Homo sapiens
gcatctaatccagtccagcatc

SEQ ID NO: 6987043 - DNA, 19 bp, Homo sapiens
atttgaaagctgtgcttgc

SEQ ID NO: 6987044 - DNA, 22 bp, Homo sapiens
attggcttccttcttattgtca

SEQ ID NO: 6987045 - DNA, 22 bp, Homo sapiens
cagcatctctgcaccctccccc

SEQ ID NO: 6987046 - DNA, 22 bp, Homo sapiens
tttcggccaactcttttcagtt

SEQ ID NO: 6987047 - DNA, 22 bp, Homo sapiens
agctttggggacagccaaggtt

SEQ ID NO: 6987048 - DNA, 22 bp, Homo sapiens
gctgaattcctgctcttggatt

SEQ ID NO: 6987049 - DNA, 22 bp, Homo sapiens
agctatatagatggtgtgtttg

SEQ ID NO: 6987050 - DNA, 22 bp, Homo sapiens
ttcttcagggaagcttgttaat

SEQ ID NO: 6987051 - DNA, 22 bp, Homo sapiens
gtcctgtggaaagctagccgct

SEQ ID NO: 6987052 - DNA, 20 bp, Homo sapiens
actgagctgcatggagagga

SEQ ID NO: 6987053 - DNA, 22 bp, Homo sapiens
acagggcttagtggaaattttt

SEQ ID NO: 6987054 - DNA, 22 bp, Homo sapiens
cctgagaagagcttatgagtga

SEQ ID NO: 6987055 - DNA, 22 bp, Homo sapiens
tgcaagtatgacagccccatgg

SEQ ID NO: 6987056 - DNA, 22 bp, Homo sapiens
gaacctggcagccctatatctg

SEQ ID NO: 6987057 - DNA, 20 bp, Homo sapiens
aggtcactgttagggcattc

SEQ ID NO: 6987058 - DNA, 23 bp, Homo sapiens
ggcgtcggtcaggagagctggag

SEQ ID NO: 6987059 - DNA, 22 bp, Homo sapiens
ggcaggcagaggctgagacagg

SEQ ID NO: 6987060 - DNA, 22 bp, Homo sapiens
acagttgagatgcaactttggg

SEQ ID NO: 6987061 - DNA, 22 bp, Homo sapiens
atcagatccataatgacctgtg

SEQ ID NO: 6987062 - DNA, 22 bp, Homo sapiens
tggcaatgaggtcagatgtctt

SEQ ID NO: 6987063 - DNA, 22 bp, Homo sapiens
tgtttactggctcctgtggttc

SEQ ID NO: 6987064 - DNA, 22 bp, Homo sapiens
atggctgggatgcttctagcaa

SEQ ID NO: 6987065 - DNA, 19 bp, Homo sapiens
agtatgtctatgagtcttt

SEQ ID NO: 6987066 - DNA, 22 bp, Homo sapiens
ctggtgggaagatggaaaacat

SEQ ID NO: 6987067 - DNA, 22 bp, Homo sapiens
ccatcttctcttgaacctcctt

SEQ ID NO: 6987068 - DNA, 17 bp, Homo sapiens
atccccagcatctagaa

SEQ ID NO: 6987069 - DNA, 22 bp, Homo sapiens
agatacattgagtttcctcctg

SEQ ID NO: 6987070 - DNA, 22 bp, Homo sapiens
tgaagctttcctgtggtcagga

SEQ ID NO: 6987071 - DNA, 17 bp, Homo sapiens
aatcagatttctgagga

SEQ ID NO: 6987072 - DNA, 22 bp, Homo sapiens
atttccaagaaagctttaggat

SEQ ID NO: 6987073 - DNA, 16 bp, Homo sapiens
aggagttgaggctatt

SEQ ID NO: 6987074 - DNA, 22 bp, Homo sapiens
tcagagaaataattgctgagtt

SEQ ID NO: 6987075 - DNA, 22 bp, Homo sapiens
ctctctttcattggtcgccttg

SEQ ID NO: 6987076 - DNA, 20 bp, Homo sapiens
ggagatgcctctcagtccat

SEQ ID NO: 6987077 - DNA, 22 bp, Homo sapiens
tcacttgagagatattagaagt

SEQ ID NO: 6987078 - DNA, 22 bp, Homo sapiens
ggcacagggaggccctggtgtg

SEQ ID NO: 6987079 - DNA, 23 bp, Homo sapiens
aagtgggtttagacagtcatttt

SEQ ID NO: 6987080 - DNA, 22 bp, Homo sapiens
gagtccagacaccatacctgat

SEQ ID NO: 6987081 - DNA, 22 bp, Homo sapiens
cctccagagggaagtactttct

SEQ ID NO: 6987082 - DNA, 22 bp, Homo sapiens
atgaattgaggaaaacagtcgt

SEQ ID NO: 6987083 - DNA, 22 bp, Homo sapiens
aacagcagggaaattccaagtc

SEQ ID NO: 6987084 - DNA, 22 bp, Homo sapiens
tttctatagctttcttgggagt

SEQ ID NO: 6987085 - DNA, 22 bp, Homo sapiens
tacaaatgaaccaactttgatg

SEQ ID NO: 6987086 - DNA, 22 bp, Homo sapiens
tgagtctctgcactaaggagag

SEQ ID NO: 6987087 - DNA, 22 bp, Homo sapiens
atctggagaataaatgtccaag

SEQ ID NO: 6987088 - DNA, 22 bp, Homo sapiens
caagttctggacaggggaatat

SEQ ID NO: 6987089 - DNA, 22 bp, Homo sapiens
gaggcagtgttgaaaaggagag

SEQ ID NO: 6987090 - DNA, 22 bp, Homo sapiens
tgactaggagaaatattaaaat

SEQ ID NO: 6987091 - DNA, 22 bp, Homo sapiens
aaaagtaattgatgcaatcgta

SEQ ID NO: 6987092 - DNA, 22 bp, Homo sapiens
agtctgtgctgttggtgaggat

SEQ ID NO: 6987093 - DNA, 22 bp, Homo sapiens
aatgtggattcacaagtgctca

SEQ ID NO: 6987094 - DNA, 22 bp, Homo sapiens
gttaacttggtagtctaagtgt

SEQ ID NO: 6987095 - DNA, 22 bp, Homo sapiens
gagaacattgggaaagctagac

SEQ ID NO: 6987096 - DNA, 22 bp, Homo sapiens
ccaggcagatgggccggcttca

SEQ ID NO: 6987097 - DNA, 22 bp, Homo sapiens
ttgctggacagcttcacggaga

SEQ ID NO: 6987098 - DNA, 22 bp, Homo sapiens
gtgagctggaatagtggagaaa

SEQ ID NO: 6987099 - DNA, 22 bp, Homo sapiens
gggaagggctccttttattgca

SEQ ID NO: 6987100 - DNA, 22 bp, Homo sapiens
ctgctgtgggcagggtagctgg

SEQ ID NO: 6987101 - DNA, 22 bp, Homo sapiens
cagggcacggagaagtcacccc

SEQ ID NO: 6987102 - DNA, 22 bp, Homo sapiens
tctgtcatccaggctggaatat

SEQ ID NO: 6987103 - DNA, 22 bp, Homo sapiens
gggtccaggcggcatagttgta

SEQ ID NO: 6987104 - DNA, 22 bp, Homo sapiens
tccagctgttgatattctaggt

SEQ ID NO: 6987105 - DNA, 15 bp, Homo sapiens
gcaggtggatcactt

SEQ ID NO: 6987106 - DNA, 22 bp, Homo sapiens
gatgaaaaaagacgagcatata

SEQ ID NO: 6987107 - DNA, 20 bp, Homo sapiens
taggtgtctttgccagcttt

SEQ ID NO: 6987108 - DNA, 22 bp, Homo sapiens
cacgagtaacacattaacatgg

SEQ ID NO: 6987109 - DNA, 22 bp, Homo sapiens
tgcactggtggtgagtgaggga

SEQ ID NO: 6987110 - DNA, 22 bp, Homo sapiens
tgcctgtcttggagtcctggcc

SEQ ID NO: 6987111 - DNA, 22 bp, Homo sapiens
caggggcgggtaaaaggcctcc

SEQ ID NO: 6987112 - DNA, 22 bp, Homo sapiens
cagcatagctgattaaggcaaa

SEQ ID NO: 6987113 - DNA, 22 bp, Homo sapiens
gtgtagagtagctgaatgctaa

SEQ ID NO: 6987114 - DNA, 19 bp, Homo sapiens
taaagttgaaatcaagtcc

SEQ ID NO: 6987115 - DNA, 22 bp, Homo sapiens
tgctgtgttactgagatccggc

SEQ ID NO: 6987116 - DNA, 19 bp, Homo sapiens
tacttattagaaatatggg

SEQ ID NO: 6987117 - DNA, 22 bp, Homo sapiens
ttctacaatatgaataatgaag

SEQ ID NO: 6987118 - DNA, 22 bp, Homo sapiens
atccttccagagttattctcaa

SEQ ID NO: 6987119 - DNA, 22 bp, Homo sapiens
aacagcagctgcctgaatttgc

SEQ ID NO: 6987120 - DNA, 22 bp, Homo sapiens
atggtttacagaactcctagca

SEQ ID NO: 6987121 - DNA, 22 bp, Homo sapiens
agaatgatcctgttcagtcggt

SEQ ID NO: 6987122 - DNA, 22 bp, Homo sapiens
aaggcagagggctggatcagag

SEQ ID NO: 6987123 - DNA, 22 bp, Homo sapiens
tcagcccagttttatcatctgt

SEQ ID NO: 6987124 - DNA, 17 bp, Homo sapiens
gacaggctcagtgacga

SEQ ID NO: 6987125 - DNA, 22 bp, Homo sapiens
tgagaatagcagactggtaact

SEQ ID NO: 6987126 - DNA, 18 bp, Homo sapiens
accctggcatgctcttcc

SEQ ID NO: 6987127 - DNA, 22 bp, Homo sapiens
catgcactggaatctgattaca

SEQ ID NO: 6987128 - DNA, 22 bp, Homo sapiens
tcagcagatgtggtgaaaagtc

SEQ ID NO: 6987129 - DNA, 22 bp, Homo sapiens
ttgcccagagtccacagcgtac

SEQ ID NO: 6987130 - DNA, 22 bp, Homo sapiens
gttgatatttgcagagtgtacc

SEQ ID NO: 6987131 - DNA, 20 bp, Homo sapiens
acagtgtaatattcacattc

SEQ ID NO: 6987132 - DNA, 22 bp, Homo sapiens
ctacatcaagtaatcttcaaaa

SEQ ID NO: 6987133 - DNA, 22 bp, Homo sapiens
tcagctcggcctaggcccacgg

SEQ ID NO: 6987134 - DNA, 22 bp, Homo sapiens
caattgcttttccaagggcaga

SEQ ID NO: 6987135 - DNA, 22 bp, Homo sapiens
ataaatctattggacatgtgtg

SEQ ID NO: 6987136 - DNA, 22 bp, Homo sapiens
ccctcagttttccagtgtgggc

SEQ ID NO: 6987137 - DNA, 16 bp, Homo sapiens
gggagggagttggtgg

SEQ ID NO: 6987138 - DNA, 22 bp, Homo sapiens
agaccacttggataagaaacag

SEQ ID NO: 6987139 - DNA, 22 bp, Homo sapiens
atcctgggtaagttccttttaa

SEQ ID NO: 6987140 - DNA, 22 bp, Homo sapiens
tagaggaaatttccaaggtgag

SEQ ID NO: 6987141 - DNA, 22 bp, Homo sapiens
gggtcgggcaggcgccctcgtc

SEQ ID NO: 6987142 - DNA, 22 bp, Homo sapiens
gcttagtcaattataaataggc

SEQ ID NO: 6987143 - DNA, 22 bp, Homo sapiens
taatctctttatgagaagaagg

SEQ ID NO: 6987144 - DNA, 22 bp, Homo sapiens
acactgtaaagtgatgcttaaa

SEQ ID NO: 6987145 - DNA, 22 bp, Homo sapiens
tttgactcattgattttctctg

SEQ ID NO: 6987146 - DNA, 21 bp, Homo sapiens
agcccttaggacataagagag

SEQ ID NO: 6987147 - DNA, 22 bp, Homo sapiens
cagatcataacagatacataga

SEQ ID NO: 6987148 - DNA, 22 bp, Homo sapiens
agagggctgcctcagtcagcta

SEQ ID NO: 6987149 - DNA, 22 bp, Homo sapiens
ccagcagcgatagggtgagtgc

SEQ ID NO: 6987150 - DNA, 22 bp, Homo sapiens
taatacacactctcattcctaa

SEQ ID NO: 6987151 - DNA, 22 bp, Homo sapiens
tgcttatttatagtcaatagag

SEQ ID NO: 6987152 - DNA, 22 bp, Homo sapiens
ctacccttgcctgccaggtgac

SEQ ID NO: 6987153 - DNA, 22 bp, Homo sapiens
caccctcccgtcagcccctggg

SEQ ID NO: 6987154 - DNA, 22 bp, Homo sapiens
caccatgcttgatttgtaatgt

SEQ ID NO: 6987155 - DNA, 22 bp, Homo sapiens
cccaccagattctcaaatatct

SEQ ID NO: 6987156 - DNA, 22 bp, Homo sapiens
cagcaccttccttaactccagg

SEQ ID NO: 6987157 - DNA, 22 bp, Homo sapiens
gctcttgtcaaaaattagttga

SEQ ID NO: 6987158 - DNA, 22 bp, Homo sapiens
gcatgaggggggttaggaagtt

SEQ ID NO: 6987159 - DNA, 22 bp, Homo sapiens
ccagggcttaacttttcaggag

SEQ ID NO: 6987160 - DNA, 22 bp, Homo sapiens
aggtgctctaggtatctacttt

SEQ ID NO: 6987161 - DNA, 22 bp, Homo sapiens
taaatgtctcccgtgagcctca

SEQ ID NO: 6987162 - DNA, 22 bp, Homo sapiens
caggatctgcccaggcctttgg

SEQ ID NO: 6987163 - DNA, 22 bp, Homo sapiens
atgcgtgtgtgcaaaccattgc

SEQ ID NO: 6987164 - DNA, 22 bp, Homo sapiens
tctctacagacactgttgactt

SEQ ID NO: 6987165 - DNA, 22 bp, Homo sapiens
agcatctaaactatcagtttga

SEQ ID NO: 6987166 - DNA, 22 bp, Homo sapiens
aaacagctaatggccaggaata

SEQ ID NO: 6987167 - DNA, 22 bp, Homo sapiens
ttaggcaccttcattcaatcca

SEQ ID NO: 6987168 - DNA, 18 bp, Homo sapiens
cacaggagatgacctgac

SEQ ID NO: 6987169 - DNA, 22 bp, Homo sapiens
aggccacaatttgatttggttt

SEQ ID NO: 6987170 - DNA, 22 bp, Homo sapiens
gcaggtgtgggtggctgccagg

SEQ ID NO: 6987171 - DNA, 23 bp, Homo sapiens
ctcctcgtaactctgtggtgggt

SEQ ID NO: 6987172 - DNA, 22 bp, Homo sapiens
tagcaactgcctttactatatt

SEQ ID NO: 6987173 - DNA, 22 bp, Homo sapiens
aagtctggaagtctcagttttc

SEQ ID NO: 6987174 - DNA, 20 bp, Homo sapiens
cagaacagtctgagaggcca

SEQ ID NO: 6987175 - DNA, 22 bp, Homo sapiens
acatttattactcaggttgttg

SEQ ID NO: 6987176 - DNA, 22 bp, Homo sapiens
acatgttttgtgccttgactag

SEQ ID NO: 6987177 - DNA, 22 bp, Homo sapiens
gtatttttcagttaggagctta

SEQ ID NO: 6987178 - DNA, 19 bp, Homo sapiens
tttgtgccaggaaggttgt

SEQ ID NO: 6987179 - DNA, 22 bp, Homo sapiens
ctagtgtgtctatgtctgttcc

SEQ ID NO: 6987180 - DNA, 22 bp, Homo sapiens
gggcttcttgcaggggcaacat

SEQ ID NO: 6987181 - DNA, 22 bp, Homo sapiens
atgcatatgcatggacactcag

SEQ ID NO: 6987182 - DNA, 22 bp, Homo sapiens
gacaggaaaggggtctgttttc

SEQ ID NO: 6987183 - DNA, 22 bp, Homo sapiens
tataagcatgcttcatatggat

SEQ ID NO: 6987184 - DNA, 22 bp, Homo sapiens
cagtggctgagagtggacactg

SEQ ID NO: 6987185 - DNA, 22 bp, Homo sapiens
ctgtgtgtgagaagcaggttga

SEQ ID NO: 6987186 - DNA, 22 bp, Homo sapiens
agcctgctgggaagggaggctt

SEQ ID NO: 6987187 - DNA, 22 bp, Homo sapiens
aaatacatttacagtcgtggct

SEQ ID NO: 6987188 - DNA, 22 bp, Homo sapiens
tggctctgttgtgctgagccag

SEQ ID NO: 6987189 - DNA, 22 bp, Homo sapiens
taaatcacattttctttgtgtt

SEQ ID NO: 6987190 - DNA, 22 bp, Homo sapiens
cagcaccttcctatccaggaga

SEQ ID NO: 6987191 - DNA, 22 bp, Homo sapiens
tggtttacctggaaaagcgcat

SEQ ID NO: 6987192 - DNA, 22 bp, Homo sapiens
gatgaaatagcaaaggcatttg

SEQ ID NO: 6987193 - DNA, 22 bp, Homo sapiens
taacatttagaaagtgtccatt

SEQ ID NO: 6987194 - DNA, 22 bp, Homo sapiens
tgtgtcatgtgtgaggctccct

SEQ ID NO: 6987195 - DNA, 22 bp, Homo sapiens
ccaggagcaggagctggacaga

SEQ ID NO: 6987196 - DNA, 22 bp, Homo sapiens
attaggatgtgtatattgtgtt

SEQ ID NO: 6987197 - DNA, 22 bp, Homo sapiens
cacatctcagggctacaggcag

SEQ ID NO: 6987198 - DNA, 22 bp, Homo sapiens
tccgggtgactggctacccccc

SEQ ID NO: 6987199 - DNA, 22 bp, Homo sapiens
tagattgagcttgacagtgttg

SEQ ID NO: 6987200 - DNA, 22 bp, Homo sapiens
ccgtggtcacctgagctccttg

SEQ ID NO: 6987201 - DNA, 22 bp, Homo sapiens
aatgcacatatatttccttatt

SEQ ID NO: 6987202 - DNA, 22 bp, Homo sapiens
ttctgtgggtaatacctcatac

SEQ ID NO: 6987203 - DNA, 22 bp, Homo sapiens
tcatgaatcgtggaatgattta

SEQ ID NO: 6987204 - DNA, 22 bp, Homo sapiens
acaaactaaaattctttattga

SEQ ID NO: 6987205 - DNA, 21 bp, Homo sapiens
aatcaggaagtgtgtgtcctg

SEQ ID NO: 6987206 - DNA, 22 bp, Homo sapiens
ggagtgctcagcgccaacctgg

SEQ ID NO: 6987207 - DNA, 22 bp, Homo sapiens
cattgctgtagtccagatgagg

SEQ ID NO: 6987208 - DNA, 22 bp, Homo sapiens
cagacctggaaaacaggcttgc

SEQ ID NO: 6987209 - DNA, 22 bp, Homo sapiens
ggcacgttatagtaacgcgcat

SEQ ID NO: 6987210 - DNA, 21 bp, Homo sapiens
gacctttacatttttcactgt

SEQ ID NO: 6987211 - DNA, 22 bp, Homo sapiens
acagctgtattcaagttgcaag

SEQ ID NO: 6987212 - DNA, 22 bp, Homo sapiens
tcacagaagagatattgacaga

SEQ ID NO: 6987213 - DNA, 22 bp, Homo sapiens
acttatagaataatgtttttag

SEQ ID NO: 6987214 - DNA, 22 bp, Homo sapiens
tcaaggttaagccagggcctca

SEQ ID NO: 6987215 - DNA, 22 bp, Homo sapiens
gcaggagccaggccgagctggt

SEQ ID NO: 6987216 - DNA, 22 bp, Homo sapiens
tgctgctctcagccaccaggaa

SEQ ID NO: 6987217 - DNA, 22 bp, Homo sapiens
ccctggcagaaggtgtagaagc

SEQ ID NO: 6987218 - DNA, 22 bp, Homo sapiens
agagagttgtatgtttctaaaa

SEQ ID NO: 6987219 - DNA, 22 bp, Homo sapiens
taccttctctagatctttattc

SEQ ID NO: 6987220 - DNA, 22 bp, Homo sapiens
tatggcttgtccctggtcagtc

SEQ ID NO: 6987221 - DNA, 22 bp, Homo sapiens
acttgacacctaattagtcatc

SEQ ID NO: 6987222 - DNA, 22 bp, Homo sapiens
ttgtgaatagtgccgctataaa

SEQ ID NO: 6987223 - DNA, 22 bp, Homo sapiens
attaggcttcctcaagaggagt

SEQ ID NO: 6987224 - DNA, 22 bp, Homo sapiens
attgctggcccagatgctttag

SEQ ID NO: 6987225 - DNA, 22 bp, Homo sapiens
ttgagtctgcccaaattaagaa

SEQ ID NO: 6987226 - DNA, 22 bp, Homo sapiens
gacagctgcttatgaaccaacg

SEQ ID NO: 6987227 - DNA, 22 bp, Homo sapiens
gattcagcctctgcttccctga

SEQ ID NO: 6987228 - DNA, 22 bp, Homo sapiens
tcttgacattgttgttagcagg

SEQ ID NO: 6987229 - DNA, 22 bp, Homo sapiens
tattcccattccacttatcaag

SEQ ID NO: 6987230 - DNA, 22 bp, Homo sapiens
gctccctcatctgtgctgtttt

SEQ ID NO: 6987231 - DNA, 22 bp, Homo sapiens
acagatggggcacaaagccaca

SEQ ID NO: 6987232 - DNA, 22 bp, Homo sapiens
ttcatgttcatatgtgtatatc

SEQ ID NO: 6987233 - DNA, 22 bp, Homo sapiens
cacaggaaggccttctcacaat

SEQ ID NO: 6987234 - DNA, 22 bp, Homo sapiens
actcaaatttgtcaactgaagc

SEQ ID NO: 6987235 - DNA, 19 bp, Homo sapiens
caagtgaagcctgggatgg

SEQ ID NO: 6987236 - DNA, 22 bp, Homo sapiens
aagaggtagcagtcacaaaaga

SEQ ID NO: 6987237 - DNA, 22 bp, Homo sapiens
gtgctgagcacaccttggagca

SEQ ID NO: 6987238 - DNA, 22 bp, Homo sapiens
tgcctggcatgttatagacaca

SEQ ID NO: 6987239 - DNA, 20 bp, Homo sapiens
tacaagtacattatagttat

SEQ ID NO: 6987240 - DNA, 22 bp, Homo sapiens
cctagagtgctattaaaaattc

SEQ ID NO: 6987241 - DNA, 22 bp, Homo sapiens
ggcctgaggccaccagcagccc

SEQ ID NO: 6987242 - DNA, 20 bp, Homo sapiens
tctcaattgtggcatcactg

SEQ ID NO: 6987243 - DNA, 22 bp, Homo sapiens
ggggccagagaggacccaggtg

SEQ ID NO: 6987244 - DNA, 22 bp, Homo sapiens
gatggcttccttctcactgtgt

SEQ ID NO: 6987245 - DNA, 22 bp, Homo sapiens
tcctccttgtattctatttcac

SEQ ID NO: 6987246 - DNA, 22 bp, Homo sapiens
catctcatcctgccctaaaaca

SEQ ID NO: 6987247 - DNA, 22 bp, Homo sapiens
tcccacaggtggagcttgcagt

SEQ ID NO: 6987248 - DNA, 22 bp, Homo sapiens
tcatttggaagcctgagagtgt

SEQ ID NO: 6987249 - DNA, 22 bp, Homo sapiens
agctgcctctgaactttaattc

SEQ ID NO: 6987250 - DNA, 22 bp, Homo sapiens
tctccacaccagaaggagctga

SEQ ID NO: 6987251 - DNA, 21 bp, Homo sapiens
ctgagacctgcattagagagg

SEQ ID NO: 6987252 - DNA, 22 bp, Homo sapiens
tttcaaatggagtcgtgaaatg

SEQ ID NO: 6987253 - DNA, 21 bp, Homo sapiens
aaaaggaaggtctgtttgggg

SEQ ID NO: 6987254 - DNA, 22 bp, Homo sapiens
ttctccagaggtggctagagtt

SEQ ID NO: 6987255 - DNA, 22 bp, Homo sapiens
tactgcctagatattaaaagct

SEQ ID NO: 6987256 - DNA, 22 bp, Homo sapiens
gggctcaggagtttgaggctgc

SEQ ID NO: 6987257 - DNA, 17 bp, Homo sapiens
ccagatcccagtcctta

SEQ ID NO: 6987258 - DNA, 22 bp, Homo sapiens
cagtggtttctgaacagtgtgc

SEQ ID NO: 6987259 - DNA, 22 bp, Homo sapiens
cagctgtgattcctgctgtcca

SEQ ID NO: 6987260 - DNA, 22 bp, Homo sapiens
aacactgcctacactttatgaa

SEQ ID NO: 6987261 - DNA, 22 bp, Homo sapiens
acagtggtggctttgctatgct

SEQ ID NO: 6987262 - DNA, 22 bp, Homo sapiens
tctagaagatacctgctgccaa

SEQ ID NO: 6987263 - DNA, 22 bp, Homo sapiens
gtttagatgagattttagaaca

SEQ ID NO: 6987264 - DNA, 22 bp, Homo sapiens
cagtgccaaggatggcctggga

SEQ ID NO: 6987265 - DNA, 22 bp, Homo sapiens
ataatttaaattagtatgtgat

SEQ ID NO: 6987266 - DNA, 22 bp, Homo sapiens
ttagtgtacttagtgctctaag

SEQ ID NO: 6987267 - DNA, 22 bp, Homo sapiens
aggacccacgcacaggaacccc

SEQ ID NO: 6987268 - DNA, 23 bp, Homo sapiens
cacaggtgtttcatcttctcagt

SEQ ID NO: 6987269 - DNA, 22 bp, Homo sapiens
cccagggtccggataaccctgg

SEQ ID NO: 6987270 - DNA, 22 bp, Homo sapiens
cctgggctgttgcatcatcctt

SEQ ID NO: 6987271 - DNA, 22 bp, Homo sapiens
tgctcgctgactcaacaagctt

SEQ ID NO: 6987272 - DNA, 22 bp, Homo sapiens
aggatgagattgctgtgttgta

SEQ ID NO: 6987273 - DNA, 22 bp, Homo sapiens
tgtacaatgccagggaacacca

SEQ ID NO: 6987274 - DNA, 22 bp, Homo sapiens
tctggagttgagagtgtgcgag

SEQ ID NO: 6987275 - DNA, 22 bp, Homo sapiens
ttcaggatgcagaggttgtagt

SEQ ID NO: 6987276 - DNA, 22 bp, Homo sapiens
ttccactttgggtctgtgcagg

SEQ ID NO: 6987277 - DNA, 17 bp, Homo sapiens
agccaggtacaagtcca

SEQ ID NO: 6987278 - DNA, 22 bp, Homo sapiens
taatgtttgagatgttggattt

SEQ ID NO: 6987279 - DNA, 22 bp, Homo sapiens
agaacctcaattatttttgcac

SEQ ID NO: 6987280 - DNA, 22 bp, Homo sapiens
tcagctattgagggtggtgagt

SEQ ID NO: 6987281 - DNA, 22 bp, Homo sapiens
ttggggtgttcagggtacttct

SEQ ID NO: 6987282 - DNA, 22 bp, Homo sapiens
catgagatctgcagggatgggc

SEQ ID NO: 6987283 - DNA, 22 bp, Homo sapiens
gtgtcagatgtccagggcagca

SEQ ID NO: 6987284 - DNA, 22 bp, Homo sapiens
ccttggcttaccttctgtgtgg

SEQ ID NO: 6987285 - DNA, 22 bp, Homo sapiens
ggggtgaggtttatgttctggg

SEQ ID NO: 6987286 - DNA, 22 bp, Homo sapiens
atgcagttagtatacttccagt

SEQ ID NO: 6987287 - DNA, 22 bp, Homo sapiens
tctgcttcacttccccaagctt

SEQ ID NO: 6987288 - DNA, 16 bp, Homo sapiens
tggggaagctcgtgag

SEQ ID NO: 6987289 - DNA, 22 bp, Homo sapiens
cttattgggatgagaggatgca

SEQ ID NO: 6987290 - DNA, 22 bp, Homo sapiens
ggcccacatggaagcatcgagg

SEQ ID NO: 6987291 - DNA, 20 bp, Homo sapiens
aatctgaatcccagtcctag

SEQ ID NO: 6987292 - DNA, 22 bp, Homo sapiens
tttctaggatactctaaatgta

SEQ ID NO: 6987293 - DNA, 22 bp, Homo sapiens
aagatgttgcaagggactcttc

SEQ ID NO: 6987294 - DNA, 22 bp, Homo sapiens
cagcagcaacaatagcggtcac

SEQ ID NO: 6987295 - DNA, 22 bp, Homo sapiens
ccagaacgtttgtgcgaggcag

SEQ ID NO: 6987296 - DNA, 22 bp, Homo sapiens
ggacatgtgcaacttctttgga

SEQ ID NO: 6987297 - DNA, 22 bp, Homo sapiens
tacattaaggatatggacatga

SEQ ID NO: 6987298 - DNA, 22 bp, Homo sapiens
aggagtgctgcaagttgacaga

SEQ ID NO: 6987299 - DNA, 22 bp, Homo sapiens
ccatccctgggccatgtcccct

SEQ ID NO: 6987300 - DNA, 20 bp, Homo sapiens
ctagaagtgcctcatctaga

SEQ ID NO: 6987301 - DNA, 22 bp, Homo sapiens
tgtctgtgacagacctttgcta

SEQ ID NO: 6987302 - DNA, 22 bp, Homo sapiens
atttgctgagctcaaagaaaag

SEQ ID NO: 6987303 - DNA, 22 bp, Homo sapiens
tccccctccaattgccatgtta

SEQ ID NO: 6987304 - DNA, 20 bp, Homo sapiens
ggaggtcaaatgatgagaag

SEQ ID NO: 6987305 - DNA, 17 bp, Homo sapiens
gccagcttgagggccat

SEQ ID NO: 6987306 - DNA, 19 bp, Homo sapiens
acctctgcagagatgttta

SEQ ID NO: 6987307 - DNA, 22 bp, Homo sapiens
cttttgcaccttttaagtaatg

SEQ ID NO: 6987308 - DNA, 22 bp, Homo sapiens
gaagtcattgagttttaaacag

SEQ ID NO: 6987309 - DNA, 22 bp, Homo sapiens
agggtctttatagaggtactta

SEQ ID NO: 6987310 - DNA, 22 bp, Homo sapiens
ttggtcatattaattcaatcgg

SEQ ID NO: 6987311 - DNA, 22 bp, Homo sapiens
atgcagttttaggggaagggtt

SEQ ID NO: 6987312 - DNA, 22 bp, Homo sapiens
gacctcttgcaccctggctctt

SEQ ID NO: 6987313 - DNA, 18 bp, Homo sapiens
tgagaaactgacacatgg

SEQ ID NO: 6987314 - DNA, 19 bp, Homo sapiens
gagggcttgatggacccga

SEQ ID NO: 6987315 - DNA, 22 bp, Homo sapiens
tgtgggacagggacagtgatat

SEQ ID NO: 6987316 - DNA, 22 bp, Homo sapiens
ggaatctcagcttctgccctga

SEQ ID NO: 6987317 - DNA, 22 bp, Homo sapiens
aatatcacaggaggagaccaag

SEQ ID NO: 6987318 - DNA, 22 bp, Homo sapiens
ctgcagtttgctaagagacaaa

SEQ ID NO: 6987319 - DNA, 22 bp, Homo sapiens
aggcaggccctgggccatcccg

SEQ ID NO: 6987320 - DNA, 22 bp, Homo sapiens
gcaacagcattctcattgacat

SEQ ID NO: 6987321 - DNA, 22 bp, Homo sapiens
acatcttttactctggttcggg

SEQ ID NO: 6987322 - DNA, 22 bp, Homo sapiens
catgtccacagttctgagaggc

SEQ ID NO: 6987323 - DNA, 22 bp, Homo sapiens
caaggccagttcaccaagggca

SEQ ID NO: 6987324 - DNA, 22 bp, Homo sapiens
cgatgaatatttaacgctgtga

SEQ ID NO: 6987325 - DNA, 22 bp, Homo sapiens
agatggttggtccataggccta

SEQ ID NO: 6987326 - DNA, 22 bp, Homo sapiens
gatgctttggccccatcatgag

SEQ ID NO: 6987327 - DNA, 22 bp, Homo sapiens
gtgtgctccctctgtcgtcata

SEQ ID NO: 6987328 - DNA, 22 bp, Homo sapiens
cgtgagcagctctgtgtctctg

SEQ ID NO: 6987329 - DNA, 22 bp, Homo sapiens
tatacaagtaatgctgaatgat

SEQ ID NO: 6987330 - DNA, 22 bp, Homo sapiens
ggcagcaaagtcacatggaaaa

SEQ ID NO: 6987331 - DNA, 22 bp, Homo sapiens
tgtatgtgcttgagaaggtggg

SEQ ID NO: 6987332 - DNA, 22 bp, Homo sapiens
aggtgctggagtagaagaaaaa

SEQ ID NO: 6987333 - DNA, 22 bp, Homo sapiens
ccagaagacaagaatgttctta

SEQ ID NO: 6987334 - DNA, 22 bp, Homo sapiens
ctgtggcttctgggtcagttca

SEQ ID NO: 6987335 - DNA, 20 bp, Homo sapiens
ttcttttgataagcttgaca

SEQ ID NO: 6987336 - DNA, 22 bp, Homo sapiens
gggggccagtcatctcccaaga

SEQ ID NO: 6987337 - DNA, 22 bp, Homo sapiens
cagggcattacttcaggtcctt

SEQ ID NO: 6987338 - DNA, 18 bp, Homo sapiens
agctgccctgggctggag

SEQ ID NO: 6987339 - DNA, 21 bp, Homo sapiens
tgtgttcttctaggtcagcta

SEQ ID NO: 6987340 - DNA, 22 bp, Homo sapiens
gacccctagagataggaggaac

SEQ ID NO: 6987341 - DNA, 22 bp, Homo sapiens
gcattgatttaaacatctctct

SEQ ID NO: 6987342 - DNA, 22 bp, Homo sapiens
tgggaagaggcgggaggctgtt

SEQ ID NO: 6987343 - DNA, 22 bp, Homo sapiens
tacactgaaagagaggattgaa

SEQ ID NO: 6987344 - DNA, 20 bp, Homo sapiens
tgggtctgcttggcttcagt

SEQ ID NO: 6987345 - DNA, 22 bp, Homo sapiens
ttgctgagtctctaggtatgat

SEQ ID NO: 6987346 - DNA, 22 bp, Homo sapiens
aggggatgcctgaggatctgta

SEQ ID NO: 6987347 - DNA, 22 bp, Homo sapiens
tctctgtaatatcttttacaac

SEQ ID NO: 6987348 - DNA, 22 bp, Homo sapiens
ctctgcaacttctagcagtgtc

SEQ ID NO: 6987349 - DNA, 22 bp, Homo sapiens
caatttcactaatgatgtgggg

SEQ ID NO: 6987350 - DNA, 22 bp, Homo sapiens
agtcagcaccccagcggggtca

SEQ ID NO: 6987351 - DNA, 20 bp, Homo sapiens
gtttatggacagtccaaaca

SEQ ID NO: 6987352 - DNA, 22 bp, Homo sapiens
gtgggcagaacatttgtaggct

SEQ ID NO: 6987353 - DNA, 22 bp, Homo sapiens
taacatgaaactccaaatggta

SEQ ID NO: 6987354 - DNA, 20 bp, Homo sapiens
tgtcattcttctttcacagg

SEQ ID NO: 6987355 - DNA, 22 bp, Homo sapiens
aagcacattgcctggcacatag

SEQ ID NO: 6987356 - DNA, 22 bp, Homo sapiens
aggaaggcatgaggtgttcaca

SEQ ID NO: 6987357 - DNA, 17 bp, Homo sapiens
ctgtttgttctgggagc

SEQ ID NO: 6987358 - DNA, 22 bp, Homo sapiens
gtcagctcctagcaccccccaa

SEQ ID NO: 6987359 - DNA, 23 bp, Homo sapiens
ccctgcccattgagcaggacgtc

SEQ ID NO: 6987360 - DNA, 22 bp, Homo sapiens
tctcacagtatgaattgttcac

SEQ ID NO: 6987361 - DNA, 18 bp, Homo sapiens
tttcacagattcatgact

SEQ ID NO: 6987362 - DNA, 18 bp, Homo sapiens
cctctgggttttgttccc

SEQ ID NO: 6987363 - DNA, 22 bp, Homo sapiens
agcttcttcccagcctcacccg

SEQ ID NO: 6987364 - DNA, 23 bp, Homo sapiens
tggaagtgtcttgggtattccag

SEQ ID NO: 6987365 - DNA, 22 bp, Homo sapiens
ggacagctgctttcaggccaca

SEQ ID NO: 6987366 - DNA, 22 bp, Homo sapiens
agaatattcatctgtattctta

SEQ ID NO: 6987367 - DNA, 22 bp, Homo sapiens
tcagagctcctaagggctgatt

SEQ ID NO: 6987368 - DNA, 22 bp, Homo sapiens
agaaagtctgctttctggatgg

SEQ ID NO: 6987369 - DNA, 22 bp, Homo sapiens
tcgtcaactgtagtgacttaga

SEQ ID NO: 6987370 - DNA, 22 bp, Homo sapiens
aaggccagattcactttacaat

SEQ ID NO: 6987371 - DNA, 22 bp, Homo sapiens
agagaggatttgtttttctcct

SEQ ID NO: 6987372 - DNA, 22 bp, Homo sapiens
ccctggagaaggggacgcggag

SEQ ID NO: 6987373 - DNA, 22 bp, Homo sapiens
agtgaatatgcagcaagaagtt

SEQ ID NO: 6987374 - DNA, 22 bp, Homo sapiens
aagttcaaggcaggtcctgagg

SEQ ID NO: 6987375 - DNA, 22 bp, Homo sapiens
aaacaatgttcctatattagag

SEQ ID NO: 6987376 - DNA, 22 bp, Homo sapiens
taaatcagcttatgccttttga

SEQ ID NO: 6987377 - DNA, 22 bp, Homo sapiens
aactcagcatcctgcacagaga

SEQ ID NO: 6987378 - DNA, 22 bp, Homo sapiens
ggcaaggtgatgaatgtctaca

SEQ ID NO: 6987379 - DNA, 22 bp, Homo sapiens
ctggggccagtgaggaggcttt

SEQ ID NO: 6987380 - DNA, 22 bp, Homo sapiens
ggagtgaataagtagggggaaa

SEQ ID NO: 6987381 - DNA, 22 bp, Homo sapiens
tgagaacacattcgtgccctac

SEQ ID NO: 6987382 - DNA, 22 bp, Homo sapiens
acttccaaaacacagcatggca

SEQ ID NO: 6987383 - DNA, 22 bp, Homo sapiens
tctcaaactacactgtaaattg

SEQ ID NO: 6987384 - DNA, 22 bp, Homo sapiens
ctgttggcttcagtgcagagaa

SEQ ID NO: 6987385 - DNA, 23 bp, Homo sapiens
gcagtggaatgtctctgtttgga

SEQ ID NO: 6987386 - DNA, 22 bp, Homo sapiens
ctctctggtcccagattccaga

SEQ ID NO: 6987387 - DNA, 22 bp, Homo sapiens
tttatgctatactgctgacatg

SEQ ID NO: 6987388 - DNA, 22 bp, Homo sapiens
gacagcagggaaagtccagacc

SEQ ID NO: 6987389 - DNA, 22 bp, Homo sapiens
tgacagagcatgtagtgacagc

SEQ ID NO: 6987390 - DNA, 22 bp, Homo sapiens
tagatactgttcaatgatgata

SEQ ID NO: 6987391 - DNA, 22 bp, Homo sapiens
ataaatccaaggcggccatcat

SEQ ID NO: 6987392 - DNA, 21 bp, Homo sapiens
ttggacactccctgtgctgtg

SEQ ID NO: 6987393 - DNA, 22 bp, Homo sapiens
agttaacatttgagctaaaagg

SEQ ID NO: 6987394 - DNA, 23 bp, Homo sapiens
tccagcctcttgctctcacatgc

SEQ ID NO: 6987395 - DNA, 22 bp, Homo sapiens
tactgtactcaacatgtgagtt

SEQ ID NO: 6987396 - DNA, 22 bp, Homo sapiens
tggggatcataaattgatggag

SEQ ID NO: 6987397 - DNA, 23 bp, Homo sapiens
aactcctgaatcgtgagccatct

SEQ ID NO: 6987398 - DNA, 22 bp, Homo sapiens
tctaccattgcttttcctccag

SEQ ID NO: 6987399 - DNA, 22 bp, Homo sapiens
ctggagaagaggtagtatgtag

SEQ ID NO: 6987400 - DNA, 16 bp, Homo sapiens
cagatggatctaactc

SEQ ID NO: 6987401 - DNA, 22 bp, Homo sapiens
aagtgacttaatctcctctcag

SEQ ID NO: 6987402 - DNA, 22 bp, Homo sapiens
actctgtcacctactcactgta

SEQ ID NO: 6987403 - DNA, 22 bp, Homo sapiens
gcacacagactaaccatatttc

SEQ ID NO: 6987404 - DNA, 22 bp, Homo sapiens
agaggtcagaacaggaaagtgt

SEQ ID NO: 6987405 - DNA, 22 bp, Homo sapiens
accactgtatctccagcacatt

SEQ ID NO: 6987406 - DNA, 22 bp, Homo sapiens
agccagagaacagcaggaaatg

SEQ ID NO: 6987407 - DNA, 22 bp, Homo sapiens
tttcttgtctttagtatctggc

SEQ ID NO: 6987408 - DNA, 22 bp, Homo sapiens
tggagggaacccaggctgctct

SEQ ID NO: 6987409 - DNA, 22 bp, Homo sapiens
gggatgaggatcaatcagggag

SEQ ID NO: 6987410 - DNA, 21 bp, Homo sapiens
caggcttgaccctagtgggaa

SEQ ID NO: 6987411 - DNA, 22 bp, Homo sapiens
tttgtgtttatgaagttattct

SEQ ID NO: 6987412 - DNA, 22 bp, Homo sapiens
agcctggggcacttctccaaac

SEQ ID NO: 6987413 - DNA, 22 bp, Homo sapiens
agaatgataatgccatgatgga

SEQ ID NO: 6987414 - DNA, 22 bp, Homo sapiens
agggaagaaaatccatcgctgc

SEQ ID NO: 6987415 - DNA, 22 bp, Homo sapiens
ccagtcctgtgtgaccctgcac

SEQ ID NO: 6987416 - DNA, 22 bp, Homo sapiens
ttccacactttcacacgaggtc

SEQ ID NO: 6987417 - DNA, 22 bp, Homo sapiens
ttgttctatggggtgaagtcta

SEQ ID NO: 6987418 - DNA, 20 bp, Homo sapiens
agtgtctggattttgtaacc

SEQ ID NO: 6987419 - DNA, 22 bp, Homo sapiens
tgtgtgtgtttataaatctaaa

SEQ ID NO: 6987420 - DNA, 22 bp, Homo sapiens
acagaatgcgtagtgcatgttg

SEQ ID NO: 6987421 - DNA, 22 bp, Homo sapiens
ttccttatcttctgaaatgggc

SEQ ID NO: 6987422 - DNA, 22 bp, Homo sapiens
atcacattatgtagtgaaaagg

SEQ ID NO: 6987423 - DNA, 22 bp, Homo sapiens
agtcaggtggttctgctccact

SEQ ID NO: 6987424 - DNA, 22 bp, Homo sapiens
acagactggaggagaatagttt

SEQ ID NO: 6987425 - DNA, 22 bp, Homo sapiens
gaggaagtctctctacaagaaa

SEQ ID NO: 6987426 - DNA, 22 bp, Homo sapiens
gacctgggtaaggggctgacaa

SEQ ID NO: 6987427 - DNA, 20 bp, Homo sapiens
agcaggaaaagtgccagtct

SEQ ID NO: 6987428 - DNA, 19 bp, Homo sapiens
agaactcagtatcttttct

SEQ ID NO: 6987429 - DNA, 22 bp, Homo sapiens
ccacagggaacatgacagcctt

SEQ ID NO: 6987430 - DNA, 22 bp, Homo sapiens
tcagtccttggcatttaggagc

SEQ ID NO: 6987431 - DNA, 23 bp, Homo sapiens
tgctggaacccagggcctaacac

SEQ ID NO: 6987432 - DNA, 22 bp, Homo sapiens
gttattctacagtcattgaagt

SEQ ID NO: 6987433 - DNA, 22 bp, Homo sapiens
gcttgctgaacaggaacctggc

SEQ ID NO: 6987434 - DNA, 22 bp, Homo sapiens
ggaggagaccctgtgtcagttt

SEQ ID NO: 6987435 - DNA, 22 bp, Homo sapiens
tggcatctgtgttgcggttgtc

SEQ ID NO: 6987436 - DNA, 22 bp, Homo sapiens
ccctgtgatgtagctagagtag

SEQ ID NO: 6987437 - DNA, 22 bp, Homo sapiens
agtggcggggattagcagtgtt

SEQ ID NO: 6987438 - DNA, 22 bp, Homo sapiens
gtgcaaaagtaattgctgtttt

SEQ ID NO: 6987439 - DNA, 22 bp, Homo sapiens
gaaatcaatttcttggttgata

SEQ ID NO: 6987440 - DNA, 17 bp, Homo sapiens
tcctggcagtcccctgg

SEQ ID NO: 6987441 - DNA, 22 bp, Homo sapiens
cggagccagaggctggagaggc

SEQ ID NO: 6987442 - DNA, 22 bp, Homo sapiens
gtggccaatttccatctgtaag

SEQ ID NO: 6987443 - DNA, 22 bp, Homo sapiens
tcacaacaggaaggaccagctg

SEQ ID NO: 6987444 - DNA, 22 bp, Homo sapiens
ctgctctaggtccattgcggga

SEQ ID NO: 6987445 - DNA, 22 bp, Homo sapiens
cctgtgggttttcaagatgcta

SEQ ID NO: 6987446 - DNA, 22 bp, Homo sapiens
atagaacagggcactgtcatga

SEQ ID NO: 6987447 - DNA, 22 bp, Homo sapiens
gggaagtgtgcagagttctctt

SEQ ID NO: 6987448 - DNA, 22 bp, Homo sapiens
tctgagtgtcttaataggctct

SEQ ID NO: 6987449 - DNA, 22 bp, Homo sapiens
agctgcagattctctacttcat

SEQ ID NO: 6987450 - DNA, 22 bp, Homo sapiens
ccaggctctatccctccttctt

SEQ ID NO: 6987451 - DNA, 23 bp, Homo sapiens
ctgtgtgtgccgagggtggccac

SEQ ID NO: 6987452 - DNA, 22 bp, Homo sapiens
accctgaagcaggcactcagct

SEQ ID NO: 6987453 - DNA, 22 bp, Homo sapiens
tctgtaatcaagatatttgaga

SEQ ID NO: 6987454 - DNA, 22 bp, Homo sapiens
cgaggtgactttggtttagaca

SEQ ID NO: 6987455 - DNA, 22 bp, Homo sapiens
ttagtgaaatgactgcataggt

SEQ ID NO: 6987456 - DNA, 22 bp, Homo sapiens
acagcaggaagctggagggaaa

SEQ ID NO: 6987457 - DNA, 22 bp, Homo sapiens
acttttctaagcaatggtcttg

SEQ ID NO: 6987458 - DNA, 22 bp, Homo sapiens
cctgggtgacagagtgagacct

SEQ ID NO: 6987459 - DNA, 22 bp, Homo sapiens
cataacttggtgttggaaactg

SEQ ID NO: 6987460 - DNA, 22 bp, Homo sapiens
ggctagcttagagtcatgctag

SEQ ID NO: 6987461 - DNA, 22 bp, Homo sapiens
cttcaataggaactgcatggca

SEQ ID NO: 6987462 - DNA, 22 bp, Homo sapiens
cgatgccaatagttttacaggc

SEQ ID NO: 6987463 - DNA, 22 bp, Homo sapiens
agcatttaagcttctgcaaagc

SEQ ID NO: 6987464 - DNA, 22 bp, Homo sapiens
gtgctcaggttcccatgagtgc

SEQ ID NO: 6987465 - DNA, 22 bp, Homo sapiens
cagagcttggctgtggttgtga

SEQ ID NO: 6987466 - DNA, 22 bp, Homo sapiens
gcactgagctttggaggagcag

SEQ ID NO: 6987467 - DNA, 22 bp, Homo sapiens
gacatgcagttctcaagggtag

SEQ ID NO: 6987468 - DNA, 22 bp, Homo sapiens
attgtactagaaattgtattca

SEQ ID NO: 6987469 - DNA, 22 bp, Homo sapiens
atgttaacagctgcttctggtg

SEQ ID NO: 6987470 - DNA, 22 bp, Homo sapiens
atatggacttaaaatttgatgt

SEQ ID NO: 6987471 - DNA, 22 bp, Homo sapiens
ctttggaaaaatacctggcata

SEQ ID NO: 6987472 - DNA, 22 bp, Homo sapiens
ccaggtgttacacgagtgttaa

SEQ ID NO: 6987473 - DNA, 21 bp, Homo sapiens
ttgtacacccacagatcagcc

SEQ ID NO: 6987474 - DNA, 22 bp, Homo sapiens
atagattatttgctcattactt

SEQ ID NO: 6987475 - DNA, 22 bp, Homo sapiens
tcacagcaggcagatattgttg

SEQ ID NO: 6987476 - DNA, 22 bp, Homo sapiens
ttgaacaatttggtatacaaac

SEQ ID NO: 6987477 - DNA, 22 bp, Homo sapiens
gctgttataatattctgtttgt

SEQ ID NO: 6987478 - DNA, 22 bp, Homo sapiens
gtttcagagtagaacctcaagg

SEQ ID NO: 6987479 - DNA, 22 bp, Homo sapiens
ggaaatcatgggagagttggaa

SEQ ID NO: 6987480 - DNA, 22 bp, Homo sapiens
ctgtacagattgcacacgggga

SEQ ID NO: 6987481 - DNA, 22 bp, Homo sapiens
agtggccaccatgccagctctc

SEQ ID NO: 6987482 - DNA, 23 bp, Homo sapiens
ggaatgtttacctgtgaatgtca

SEQ ID NO: 6987483 - DNA, 22 bp, Homo sapiens
gtaaaacatgttttaactagga

SEQ ID NO: 6987484 - DNA, 22 bp, Homo sapiens
gagaaagcttcagaaatggcct

SEQ ID NO: 6987485 - DNA, 22 bp, Homo sapiens
ttctgtaagggatttattctga

SEQ ID NO: 6987486 - DNA, 22 bp, Homo sapiens
acaggaggagcagctgtgtgcc

SEQ ID NO: 6987487 - DNA, 22 bp, Homo sapiens
gttattgcacagtgggtgaggt

SEQ ID NO: 6987488 - DNA, 21 bp, Homo sapiens
tggaatccccaagaaagcagc

SEQ ID NO: 6987489 - DNA, 22 bp, Homo sapiens
ggcagcttctcccaggctgttt

SEQ ID NO: 6987490 - DNA, 22 bp, Homo sapiens
tgtgtgggtggtaaggaaggcc

SEQ ID NO: 6987491 - DNA, 22 bp, Homo sapiens
gtattcagtttgattgtctaca

SEQ ID NO: 6987492 - DNA, 22 bp, Homo sapiens
ggtaccatggggaggcagaggt

SEQ ID NO: 6987493 - DNA, 22 bp, Homo sapiens
agagtcatagtttaacttttgt

SEQ ID NO: 6987494 - DNA, 22 bp, Homo sapiens
tgcttttgcacaggtgagttcc

SEQ ID NO: 6987495 - DNA, 22 bp, Homo sapiens
ttctgtccaggcgcccagctat

SEQ ID NO: 6987496 - DNA, 22 bp, Homo sapiens
ctgattaactgaactgaattta

SEQ ID NO: 6987497 - DNA, 22 bp, Homo sapiens
actccaaaacctgcggcttggt

SEQ ID NO: 6987498 - DNA, 22 bp, Homo sapiens
tggcttctagcagtgttgattt

SEQ ID NO: 6987499 - DNA, 22 bp, Homo sapiens
tacagttctagtcaaaaatcac

SEQ ID NO: 6987500 - DNA, 22 bp, Homo sapiens
aagaaagctgaatattctgtgt

SEQ ID NO: 6987501 - DNA, 22 bp, Homo sapiens
agagctggctgtgggtgacttt

SEQ ID NO: 6987502 - DNA, 23 bp, Homo sapiens
aaatacctgaattagatattatc

SEQ ID NO: 6987503 - DNA, 22 bp, Homo sapiens
ggagactgatctgagtgataac

SEQ ID NO: 6987504 - DNA, 22 bp, Homo sapiens
gtgacgtgaggggctcctgttg

SEQ ID NO: 6987505 - DNA, 22 bp, Homo sapiens
gctctggagcactggaaacact

SEQ ID NO: 6987506 - DNA, 22 bp, Homo sapiens
gaagatgtgggaactgctgaaa

SEQ ID NO: 6987507 - DNA, 22 bp, Homo sapiens
gtctgcctgctagtggctgcct

SEQ ID NO: 6987508 - DNA, 22 bp, Homo sapiens
tcctctactcgcttgccctttg

SEQ ID NO: 6987509 - DNA, 20 bp, Homo sapiens
tacagcagaaatgttttgct

SEQ ID NO: 6987510 - DNA, 20 bp, Homo sapiens
tatttgtatttgggaaagtt

SEQ ID NO: 6987511 - DNA, 22 bp, Homo sapiens
atatatggtcaccttaaacata

SEQ ID NO: 6987512 - DNA, 22 bp, Homo sapiens
caggccctggcagggctgagtc

SEQ ID NO: 6987513 - DNA, 22 bp, Homo sapiens
ccatggagcgggtgagtgagtg

SEQ ID NO: 6987514 - DNA, 22 bp, Homo sapiens
ccgcggggtcatggctgggccg

SEQ ID NO: 6987515 - DNA, 22 bp, Homo sapiens
tcatctttaccccttgcttcaa

SEQ ID NO: 6987516 - DNA, 22 bp, Homo sapiens
ctgtgtgctgaaatgcagtgag

SEQ ID NO: 6987517 - DNA, 22 bp, Homo sapiens
atgaactgtccaatcttagagg

SEQ ID NO: 6987518 - DNA, 22 bp, Homo sapiens
gtttccaggaggctacacctga

SEQ ID NO: 6987519 - DNA, 22 bp, Homo sapiens
cacacctgtaataccagctact

SEQ ID NO: 6987520 - DNA, 18 bp, Homo sapiens
gtgttacaggagtgcagc

SEQ ID NO: 6987521 - DNA, 22 bp, Homo sapiens
acttagcaaatcttttggattc

SEQ ID NO: 6987522 - DNA, 22 bp, Homo sapiens
gtaagatttaaaatagcaattg

SEQ ID NO: 6987523 - DNA, 21 bp, Homo sapiens
tagagatgtttgctaagtagc

SEQ ID NO: 6987524 - DNA, 22 bp, Homo sapiens
gcacagggcctggcacataaga

SEQ ID NO: 6987525 - DNA, 22 bp, Homo sapiens
gaagtcagtcatctcctgtctc

SEQ ID NO: 6987526 - DNA, 22 bp, Homo sapiens
tcaggaggtaaggtaaaacaga

SEQ ID NO: 6987527 - DNA, 22 bp, Homo sapiens
acagactggggtggggaatagg

SEQ ID NO: 6987528 - DNA, 22 bp, Homo sapiens
acacattcctgcagacatgatg

SEQ ID NO: 6987529 - DNA, 22 bp, Homo sapiens
gagattcagtaaccaatatggt

SEQ ID NO: 6987530 - DNA, 22 bp, Homo sapiens
gtgagcaggatttcatggtgta

SEQ ID NO: 6987531 - DNA, 21 bp, Homo sapiens
atactggagccatccccaaag

SEQ ID NO: 6987532 - DNA, 22 bp, Homo sapiens
gctgtcgtgtgcaagtgacaga

SEQ ID NO: 6987533 - DNA, 16 bp, Homo sapiens
aggctccaagagctgt

SEQ ID NO: 6987534 - DNA, 22 bp, Homo sapiens
agctaatgtatgttgaaagcac

SEQ ID NO: 6987535 - DNA, 21 bp, Homo sapiens
tgcaggcaggcagagatgctg

SEQ ID NO: 6987536 - DNA, 22 bp, Homo sapiens
tttcagggtacatggagcaaat

SEQ ID NO: 6987537 - DNA, 22 bp, Homo sapiens
acggaatgagtcttgaaaagtg

SEQ ID NO: 6987538 - DNA, 22 bp, Homo sapiens
agcacatgcacagtgctacact

SEQ ID NO: 6987539 - DNA, 22 bp, Homo sapiens
tcactgcaagctccacctcccg

SEQ ID NO: 6987540 - DNA, 22 bp, Homo sapiens
tagaacctcataagaatcgaaa

SEQ ID NO: 6987541 - DNA, 23 bp, Homo sapiens
ttctctttagatttacattactc

SEQ ID NO: 6987542 - DNA, 22 bp, Homo sapiens
ttctcagggcatctcatgaccc

SEQ ID NO: 6987543 - DNA, 22 bp, Homo sapiens
gaaattgtgcatttagcaacac

SEQ ID NO: 6987544 - DNA, 22 bp, Homo sapiens
ctgtggctgcgccctgggggag

SEQ ID NO: 6987545 - DNA, 22 bp, Homo sapiens
tagcaaagaacctgatacccca

SEQ ID NO: 6987546 - DNA, 22 bp, Homo sapiens
ggtctgggtttccccaccacac

SEQ ID NO: 6987547 - DNA, 22 bp, Homo sapiens
cctgcctggggacaaaggaggg

SEQ ID NO: 6987548 - DNA, 22 bp, Homo sapiens
ggatgtctttactttgggattt

SEQ ID NO: 6987549 - DNA, 22 bp, Homo sapiens
cttctccgacaaccgacgccgg

SEQ ID NO: 6987550 - DNA, 22 bp, Homo sapiens
aatgtgaccttatttcaaaata

SEQ ID NO: 6987551 - DNA, 22 bp, Homo sapiens
tgctgggcatcgtaggaggtac

SEQ ID NO: 6987552 - DNA, 22 bp, Homo sapiens
gatgctgagctgtatggctggt

SEQ ID NO: 6987553 - DNA, 20 bp, Homo sapiens
agtctaggagagggtaaagc

SEQ ID NO: 6987554 - DNA, 22 bp, Homo sapiens
ggacttgctaaggtggctgaac

SEQ ID NO: 6987555 - DNA, 22 bp, Homo sapiens
ctgctttagctagtgctcttag

SEQ ID NO: 6987556 - DNA, 22 bp, Homo sapiens
aaattgcttgagattagtctcc

SEQ ID NO: 6987557 - DNA, 23 bp, Homo sapiens
tgaggcaggcggatcacgaggtc

SEQ ID NO: 6987558 - DNA, 22 bp, Homo sapiens
aacaaacattacctggtgctgg

SEQ ID NO: 6987559 - DNA, 22 bp, Homo sapiens
agttacaaacactatcagttct

SEQ ID NO: 6987560 - DNA, 19 bp, Homo sapiens
ttgaattgttttgagtagg

SEQ ID NO: 6987561 - DNA, 22 bp, Homo sapiens
gttgtctgtgtcagttagcgtc

SEQ ID NO: 6987562 - DNA, 22 bp, Homo sapiens
tgatcgtaccacttcactcaag

SEQ ID NO: 6987563 - DNA, 22 bp, Homo sapiens
gctcaggtgttacctcctctag

SEQ ID NO: 6987564 - DNA, 22 bp, Homo sapiens
aatcagagaagtttcctatgcc

SEQ ID NO: 6987565 - DNA, 22 bp, Homo sapiens
ctgggcacagcgttgggctctt

SEQ ID NO: 6987566 - DNA, 22 bp, Homo sapiens
agcccctgtttttccagtcaga

SEQ ID NO: 6987567 - DNA, 22 bp, Homo sapiens
aattctgtaaagcttgtcatgc

SEQ ID NO: 6987568 - DNA, 22 bp, Homo sapiens
aaggccagccttggaaccctga

SEQ ID NO: 6987569 - DNA, 22 bp, Homo sapiens
aggaactgggctcagcaaacat

SEQ ID NO: 6987570 - DNA, 22 bp, Homo sapiens
gctccctgactcagttcctgag

SEQ ID NO: 6987571 - DNA, 22 bp, Homo sapiens
aagatccttgggaaattgacct

SEQ ID NO: 6987572 - DNA, 22 bp, Homo sapiens
tttcacaggagttgtaccattt

SEQ ID NO: 6987573 - DNA, 22 bp, Homo sapiens
gctgggagttactgtctccttt

SEQ ID NO: 6987574 - DNA, 22 bp, Homo sapiens
ccctgtggcaggaggaggagca

SEQ ID NO: 6987575 - DNA, 22 bp, Homo sapiens
agataactcattttgtatatcc

SEQ ID NO: 6987576 - DNA, 20 bp, Homo sapiens
cagagacctgtcttcacaga

SEQ ID NO: 6987577 - DNA, 22 bp, Homo sapiens
gcaaaacagtcgatgcctccca

SEQ ID NO: 6987578 - DNA, 22 bp, Homo sapiens
tcttgctaggagctatggaaga

SEQ ID NO: 6987579 - DNA, 22 bp, Homo sapiens
agacaatgtttggtctacactt

SEQ ID NO: 6987580 - DNA, 22 bp, Homo sapiens
taagttctgagtaaatactgtt

SEQ ID NO: 6987581 - DNA, 21 bp, Homo sapiens
cattcacagtctggctcttga

SEQ ID NO: 6987582 - DNA, 22 bp, Homo sapiens
taggaaacaaagtggatgaaat

SEQ ID NO: 6987583 - DNA, 22 bp, Homo sapiens
tccagggctacaaggcaccaga

SEQ ID NO: 6987584 - DNA, 22 bp, Homo sapiens
tcccacagagtggctcacctag

SEQ ID NO: 6987585 - DNA, 22 bp, Homo sapiens
ttggctggcttctcgacttgtt

SEQ ID NO: 6987586 - DNA, 22 bp, Homo sapiens
agacaagttctgtgggtcacct

SEQ ID NO: 6987587 - DNA, 22 bp, Homo sapiens
tgttccatgtctttgtaggact

SEQ ID NO: 6987588 - DNA, 22 bp, Homo sapiens
attattaaaatgtgtttctctt

SEQ ID NO: 6987589 - DNA, 22 bp, Homo sapiens
tagaacatgggatagagttttt

SEQ ID NO: 6987590 - DNA, 22 bp, Homo sapiens
agaatacagtaggagcctgggc

SEQ ID NO: 6987591 - DNA, 22 bp, Homo sapiens
gacagcagagcagactaatgga

SEQ ID NO: 6987592 - DNA, 22 bp, Homo sapiens
gagcccagattggaatttccca

SEQ ID NO: 6987593 - DNA, 22 bp, Homo sapiens
ctccctgccctgtgagttggcc

SEQ ID NO: 6987594 - DNA, 20 bp, Homo sapiens
aaagtgtaaggcaaagttgt

SEQ ID NO: 6987595 - DNA, 22 bp, Homo sapiens
catgtgtgaagactgcgggcca

SEQ ID NO: 6987596 - DNA, 22 bp, Homo sapiens
ccacaggggcccacgagccgct

SEQ ID NO: 6987597 - DNA, 18 bp, Homo sapiens
acttaggaggtacctcaa

SEQ ID NO: 6987598 - DNA, 22 bp, Homo sapiens
ctgggacagttcaggtagggca

SEQ ID NO: 6987599 - DNA, 22 bp, Homo sapiens
gcagaacatttcacagtatctt

SEQ ID NO: 6987600 - DNA, 21 bp, Homo sapiens
gtccagagagccggctcctga

SEQ ID NO: 6987601 - DNA, 22 bp, Homo sapiens
atacagaacaagcctcacctcc

SEQ ID NO: 6987602 - DNA, 22 bp, Homo sapiens
aaggcagaaattcaactactgg

SEQ ID NO: 6987603 - DNA, 22 bp, Homo sapiens
tcctcagggaagatgagcctca

SEQ ID NO: 6987604 - DNA, 22 bp, Homo sapiens
tctctgggtatggtaacgttgg

SEQ ID NO: 6987605 - DNA, 22 bp, Homo sapiens
ggctgccccatgggctgggctg

SEQ ID NO: 6987606 - DNA, 17 bp, Homo sapiens
tgtacaacagtaccttc

SEQ ID NO: 6987607 - DNA, 22 bp, Homo sapiens
tgtgcccattccacttgagtac

SEQ ID NO: 6987608 - DNA, 22 bp, Homo sapiens
tggaccggcagtggctatacag

SEQ ID NO: 6987609 - DNA, 19 bp, Homo sapiens
gtcctggcgccgccacacc

SEQ ID NO: 6987610 - DNA, 22 bp, Homo sapiens
aatatctgtctctaatgcatat

SEQ ID NO: 6987611 - DNA, 22 bp, Homo sapiens
gggatgggagagcatttagaga

SEQ ID NO: 6987612 - DNA, 22 bp, Homo sapiens
ctactgtagtggcctatttacc

SEQ ID NO: 6987613 - DNA, 22 bp, Homo sapiens
cggcagagacggcgctttgaac

SEQ ID NO: 6987614 - DNA, 17 bp, Homo sapiens
gctgaacaaggaaaata

SEQ ID NO: 6987615 - DNA, 22 bp, Homo sapiens
ttgggttgctttgtttcccgga

SEQ ID NO: 6987616 - DNA, 22 bp, Homo sapiens
ttggcatttttcctcagctgga

SEQ ID NO: 6987617 - DNA, 22 bp, Homo sapiens
agtggtgctaggtggaatatag

SEQ ID NO: 6987618 - DNA, 22 bp, Homo sapiens
tttcacagagaatattgccttg

SEQ ID NO: 6987619 - DNA, 22 bp, Homo sapiens
tatatccataggctgtgcctag

SEQ ID NO: 6987620 - DNA, 22 bp, Homo sapiens
tcctgggattctgcatttctaa

SEQ ID NO: 6987621 - DNA, 19 bp, Homo sapiens
tctcacaagactgctgctc

SEQ ID NO: 6987622 - DNA, 20 bp, Homo sapiens
tgaacactggggtgtttcag

SEQ ID NO: 6987623 - DNA, 22 bp, Homo sapiens
agttcagagtaaatgttgaagg

SEQ ID NO: 6987624 - DNA, 22 bp, Homo sapiens
tgcattccatgtgtttcctgag

SEQ ID NO: 6987625 - DNA, 22 bp, Homo sapiens
tggtccagggtgtagtacagag

SEQ ID NO: 6987626 - DNA, 22 bp, Homo sapiens
ctgctacaccggaatagtgaca

SEQ ID NO: 6987627 - DNA, 18 bp, Homo sapiens
tacatgccagagagttac

SEQ ID NO: 6987628 - DNA, 22 bp, Homo sapiens
atatatatcgagttcatgtctc

SEQ ID NO: 6987629 - DNA, 22 bp, Homo sapiens
tcagggcattcaagaggcctgg

SEQ ID NO: 6987630 - DNA, 22 bp, Homo sapiens
cttattgtgagatgcgataatt

SEQ ID NO: 6987631 - DNA, 22 bp, Homo sapiens
cactgccctgggggttgccatc

SEQ ID NO: 6987632 - DNA, 22 bp, Homo sapiens
atgcagaagactgaaaagctga

SEQ ID NO: 6987633 - DNA, 22 bp, Homo sapiens
atacagtatgtaggcttttcag

SEQ ID NO: 6987634 - DNA, 22 bp, Homo sapiens
cccagctcccaagttgctatgg

SEQ ID NO: 6987635 - DNA, 22 bp, Homo sapiens
gtgatgcacaactaatatttca

SEQ ID NO: 6987636 - DNA, 22 bp, Homo sapiens
agttacattctgagctgagtag

SEQ ID NO: 6987637 - DNA, 21 bp, Homo sapiens
gggcaggtctctgatgtcaac

SEQ ID NO: 6987638 - DNA, 22 bp, Homo sapiens
acatgcacggcaccatcttctg

SEQ ID NO: 6987639 - DNA, 21 bp, Homo sapiens
agcatctgaggcagtttccta

SEQ ID NO: 6987640 - DNA, 23 bp, Homo sapiens
ctgggcctatggtctgaatccaa

SEQ ID NO: 6987641 - DNA, 22 bp, Homo sapiens
ccacagtccgggctggcaggac

SEQ ID NO: 6987642 - DNA, 22 bp, Homo sapiens
gtttcagggccttttatgtgtt

SEQ ID NO: 6987643 - DNA, 16 bp, Homo sapiens
caatacatggcatttc

SEQ ID NO: 6987644 - DNA, 22 bp, Homo sapiens
gcaggtgtgaatgtgaattaag

SEQ ID NO: 6987645 - DNA, 22 bp, Homo sapiens
gttcctgagaaataaagagaga

SEQ ID NO: 6987646 - DNA, 22 bp, Homo sapiens
cctgggtttggagcctgcagaa

SEQ ID NO: 6987647 - DNA, 22 bp, Homo sapiens
accttcttccaccaaaaacgtc

SEQ ID NO: 6987648 - DNA, 22 bp, Homo sapiens
aggtggggaaaccagcgatccc

SEQ ID NO: 6987649 - DNA, 22 bp, Homo sapiens
aggtttcatgggagacaactca

SEQ ID NO: 6987650 - DNA, 22 bp, Homo sapiens
tagaagaaagtgaagctgggga

SEQ ID NO: 6987651 - DNA, 17 bp, Homo sapiens
aatagctgctcagagag

SEQ ID NO: 6987652 - DNA, 22 bp, Homo sapiens
tggcttaatatttcatatttaa

SEQ ID NO: 6987653 - DNA, 22 bp, Homo sapiens
agtgctgtaacaacttatttgg

SEQ ID NO: 6987654 - DNA, 22 bp, Homo sapiens
tctgctgcctgcagggcagaga

SEQ ID NO: 6987655 - DNA, 22 bp, Homo sapiens
tcccacaggggctctgtgggtt

SEQ ID NO: 6987656 - DNA, 22 bp, Homo sapiens
tcacagcatttttagaaagatt

SEQ ID NO: 6987657 - DNA, 22 bp, Homo sapiens
aaaggccaataaagacaagctg

SEQ ID NO: 6987658 - DNA, 21 bp, Homo sapiens
aaatggtctcaagtgtttcat

SEQ ID NO: 6987659 - DNA, 17 bp, Homo sapiens
ctgttccccactactca

SEQ ID NO: 6987660 - DNA, 22 bp, Homo sapiens
tacagctccaaaaatcactgtt

SEQ ID NO: 6987661 - DNA, 22 bp, Homo sapiens
aagatgtgtgattaagctctga

SEQ ID NO: 6987662 - DNA, 22 bp, Homo sapiens
cttcctggatgaagcccagcat

SEQ ID NO: 6987663 - DNA, 22 bp, Homo sapiens
ctgcaagctggtaataagcaga

SEQ ID NO: 6987664 - DNA, 22 bp, Homo sapiens
acacagtatgaaaagtctagtt

SEQ ID NO: 6987665 - DNA, 22 bp, Homo sapiens
ctggatcatgggaaagggatca

SEQ ID NO: 6987666 - DNA, 22 bp, Homo sapiens
acagagtcttacgtggtgataa

SEQ ID NO: 6987667 - DNA, 22 bp, Homo sapiens
atgtccaagtcacagattttca

SEQ ID NO: 6987668 - DNA, 22 bp, Homo sapiens
tgggttgttcccatccaggccc

SEQ ID NO: 6987669 - DNA, 22 bp, Homo sapiens
gtcagagatggcatgaaagatt

SEQ ID NO: 6987670 - DNA, 22 bp, Homo sapiens
aagtcctttaatatcacatagt

SEQ ID NO: 6987671 - DNA, 22 bp, Homo sapiens
gtacatgtgcacaatgtgcagg

SEQ ID NO: 6987672 - DNA, 22 bp, Homo sapiens
attttgtttcctttggagtaga

SEQ ID NO: 6987673 - DNA, 22 bp, Homo sapiens
atccaggcctgagtctggtcct

SEQ ID NO: 6987674 - DNA, 22 bp, Homo sapiens
aggaacctgagtctgatcattt

SEQ ID NO: 6987675 - DNA, 22 bp, Homo sapiens
actaggagaaaacttacactga

SEQ ID NO: 6987676 - DNA, 22 bp, Homo sapiens
aaagtatttgtgatttttacca

SEQ ID NO: 6987677 - DNA, 17 bp, Homo sapiens
gaaagcatcacatgctc

SEQ ID NO: 6987678 - DNA, 22 bp, Homo sapiens
tcctgagtggttgttttcttcc

SEQ ID NO: 6987679 - DNA, 22 bp, Homo sapiens
gtaacttaccattgtagcatca

SEQ ID NO: 6987680 - DNA, 22 bp, Homo sapiens
tgcctttagggaaaagcaagct

SEQ ID NO: 6987681 - DNA, 22 bp, Homo sapiens
gaaagcagctaagtcttatgat

SEQ ID NO: 6987682 - DNA, 22 bp, Homo sapiens
ccagggcagcagaattggggca

SEQ ID NO: 6987683 - DNA, 22 bp, Homo sapiens
cagtagacacattaatatggaa

SEQ ID NO: 6987684 - DNA, 22 bp, Homo sapiens
cagattaacacggagcttaaca

SEQ ID NO: 6987685 - DNA, 22 bp, Homo sapiens
tagctgtccagtgagtcccttt

SEQ ID NO: 6987686 - DNA, 22 bp, Homo sapiens
ttcctggtaaattatgtccagg

SEQ ID NO: 6987687 - DNA, 20 bp, Homo sapiens
agtgcaagaaagcacagctg

SEQ ID NO: 6987688 - DNA, 21 bp, Homo sapiens
ccatccactgagtggttccct

SEQ ID NO: 6987689 - DNA, 17 bp, Homo sapiens
cctgcctgagccatagc

SEQ ID NO: 6987690 - DNA, 22 bp, Homo sapiens
tgctgtagggagaaagagttga

SEQ ID NO: 6987691 - DNA, 22 bp, Homo sapiens
accccactaccccggcagatgg

SEQ ID NO: 6987692 - DNA, 22 bp, Homo sapiens
ttagccattaatgtcctgtgca

SEQ ID NO: 6987693 - DNA, 22 bp, Homo sapiens
acatttctcattctcccctaac

SEQ ID NO: 6987694 - DNA, 17 bp, Homo sapiens
ggcaacatgttcttctg

SEQ ID NO: 6987695 - DNA, 22 bp, Homo sapiens
tcatttgtggaagtgattgtgg

SEQ ID NO: 6987696 - DNA, 22 bp, Homo sapiens
ctcctgggagctgtggcagagc

SEQ ID NO: 6987697 - DNA, 22 bp, Homo sapiens
taaacatctgtagccttcagtc

SEQ ID NO: 6987698 - DNA, 22 bp, Homo sapiens
tgtgacttctttttgagttcaa

SEQ ID NO: 6987699 - DNA, 22 bp, Homo sapiens
tagtatctttctatatttccca

SEQ ID NO: 6987700 - DNA, 22 bp, Homo sapiens
tttcaaaggaggctgagaggat

SEQ ID NO: 6987701 - DNA, 22 bp, Homo sapiens
tctgaggttctgttttcaactg

SEQ ID NO: 6987702 - DNA, 22 bp, Homo sapiens
agctgtagggtattatcatttt

SEQ ID NO: 6987703 - DNA, 22 bp, Homo sapiens
aagtccagtgaaatagaatgca

SEQ ID NO: 6987704 - DNA, 22 bp, Homo sapiens
acaggacaggctgggctagact

SEQ ID NO: 6987705 - DNA, 22 bp, Homo sapiens
gtacaaaagttattgcggtttt

SEQ ID NO: 6987706 - DNA, 22 bp, Homo sapiens
tctccagggcagagaatagcaa

SEQ ID NO: 6987707 - DNA, 22 bp, Homo sapiens
tcctgggctgtggccccgggca

SEQ ID NO: 6987708 - DNA, 23 bp, Homo sapiens
tgtgggcgcattgtaagggtagc

SEQ ID NO: 6987709 - DNA, 22 bp, Homo sapiens
gttggctttgctctctgtccta

SEQ ID NO: 6987710 - DNA, 22 bp, Homo sapiens
cctggctctgaagtccacatca

SEQ ID NO: 6987711 - DNA, 22 bp, Homo sapiens
tcttcaatatgtgtttaatatt

SEQ ID NO: 6987712 - DNA, 22 bp, Homo sapiens
tctgtgcagatgtagaccagtt

SEQ ID NO: 6987713 - DNA, 22 bp, Homo sapiens
agtcaggctgacaggctaggag

SEQ ID NO: 6987714 - DNA, 22 bp, Homo sapiens
gactttggcatctagacattgt

SEQ ID NO: 6987715 - DNA, 22 bp, Homo sapiens
tgagacagggtcttgctctgtt

SEQ ID NO: 6987716 - DNA, 21 bp, Homo sapiens
aagtggtttaggttaccgggg

SEQ ID NO: 6987717 - DNA, 22 bp, Homo sapiens
tcagagaattgtttaatggaat

SEQ ID NO: 6987718 - DNA, 22 bp, Homo sapiens
ttcaacactgaggttgctgcag

SEQ ID NO: 6987719 - DNA, 22 bp, Homo sapiens
cggggctggcacaggtgaccac

SEQ ID NO: 6987720 - DNA, 23 bp, Homo sapiens
tgtctaggatcagtcaggatgag

SEQ ID NO: 6987721 - DNA, 22 bp, Homo sapiens
gcagaatgtaggccttcagtgt

SEQ ID NO: 6987722 - DNA, 22 bp, Homo sapiens
atgagtaagtgaatctccaaag

SEQ ID NO: 6987723 - DNA, 22 bp, Homo sapiens
gatccccaggactagggggtgg

SEQ ID NO: 6987724 - DNA, 21 bp, Homo sapiens
tgaatgagcatctggactttt

SEQ ID NO: 6987725 - DNA, 20 bp, Homo sapiens
ctaattacagattttggaca

SEQ ID NO: 6987726 - DNA, 22 bp, Homo sapiens
ggtgtcctcggattcagggcag

SEQ ID NO: 6987727 - DNA, 22 bp, Homo sapiens
ggctttgcaaaatcggcttctg

SEQ ID NO: 6987728 - DNA, 22 bp, Homo sapiens
gcctggcacgggctcggcccac

SEQ ID NO: 6987729 - DNA, 22 bp, Homo sapiens
aaagacctgaaatataatctag

SEQ ID NO: 6987730 - DNA, 22 bp, Homo sapiens
acactcaccctcccactgcctg

SEQ ID NO: 6987731 - DNA, 22 bp, Homo sapiens
tccccaggaaggcccttcctgg

SEQ ID NO: 6987732 - DNA, 22 bp, Homo sapiens
gcagtgctgatcccatggcaga

SEQ ID NO: 6987733 - DNA, 22 bp, Homo sapiens
ggtacagggcttcctggacaag

SEQ ID NO: 6987734 - DNA, 22 bp, Homo sapiens
aagtggaagagaagttatctta

SEQ ID NO: 6987735 - DNA, 22 bp, Homo sapiens
gagaggtgaaaggatagtttga

SEQ ID NO: 6987736 - DNA, 22 bp, Homo sapiens
ctctggagtcaggcagccctgg

SEQ ID NO: 6987737 - DNA, 22 bp, Homo sapiens
catgccacgctgctgcaaggac

SEQ ID NO: 6987738 - DNA, 22 bp, Homo sapiens
gttcagctcaagcaataatttt

SEQ ID NO: 6987739 - DNA, 22 bp, Homo sapiens
aagggtggtgtaggagatcaaa

SEQ ID NO: 6987740 - DNA, 22 bp, Homo sapiens
aactagcagctaagacataatt

SEQ ID NO: 6987741 - DNA, 22 bp, Homo sapiens
ttaaccaggtcctttgaaaaca

SEQ ID NO: 6987742 - DNA, 22 bp, Homo sapiens
attgatgttagaatctactcct

SEQ ID NO: 6987743 - DNA, 22 bp, Homo sapiens
ggaagtgtggctaagccaagaa

SEQ ID NO: 6987744 - DNA, 22 bp, Homo sapiens
aactaaagtaaccaaggatatc

SEQ ID NO: 6987745 - DNA, 22 bp, Homo sapiens
aaacttcaagattcaagcctgg

SEQ ID NO: 6987746 - DNA, 22 bp, Homo sapiens
ggcaggtgtgagatcgaggcca

SEQ ID NO: 6987747 - DNA, 22 bp, Homo sapiens
gcaaattagtggccaagcccaa

SEQ ID NO: 6987748 - DNA, 22 bp, Homo sapiens
tgctctgaaggaagagccccat

SEQ ID NO: 6987749 - DNA, 22 bp, Homo sapiens
aatatatgagggagctatttga

SEQ ID NO: 6987750 - DNA, 22 bp, Homo sapiens
aggctgctttttatttacaggt

SEQ ID NO: 6987751 - DNA, 23 bp, Homo sapiens
tatgtgcatatgtgtaagaatac

SEQ ID NO: 6987752 - DNA, 22 bp, Homo sapiens
atgtgctttccaatgctgtagg

SEQ ID NO: 6987753 - DNA, 22 bp, Homo sapiens
atgatcagggcagaagcagaag

SEQ ID NO: 6987754 - DNA, 22 bp, Homo sapiens
tacacatcatacactgggatta

SEQ ID NO: 6987755 - DNA, 23 bp, Homo sapiens
ttcaaagatcttctgaaatctgt

SEQ ID NO: 6987756 - DNA, 22 bp, Homo sapiens
ggagcagggcagtgaattctgg

SEQ ID NO: 6987757 - DNA, 22 bp, Homo sapiens
gatgggcgtggcgcgtttggtg

SEQ ID NO: 6987758 - DNA, 22 bp, Homo sapiens
ctggctgtaacattttgccata

SEQ ID NO: 6987759 - DNA, 22 bp, Homo sapiens
tgtccccagagcctgttcctgc

SEQ ID NO: 6987760 - DNA, 22 bp, Homo sapiens
aggccctgcccagagctcctcg

SEQ ID NO: 6987761 - DNA, 22 bp, Homo sapiens
cagggcctgcttccttcttgtt

SEQ ID NO: 6987762 - DNA, 22 bp, Homo sapiens
agtacagggagtttgttgtgtt

SEQ ID NO: 6987763 - DNA, 22 bp, Homo sapiens
acaacaaaatcactagtcttcc

SEQ ID NO: 6987764 - DNA, 22 bp, Homo sapiens
gatgagaaatggacaggagtgg

SEQ ID NO: 6987765 - DNA, 22 bp, Homo sapiens
gcgtaaggcctctggtctcgga

SEQ ID NO: 6987766 - DNA, 18 bp, Homo sapiens
tgctgcccaactctcccc

SEQ ID NO: 6987767 - DNA, 23 bp, Homo sapiens
tctcagggtggctgggcccatcc

SEQ ID NO: 6987768 - DNA, 22 bp, Homo sapiens
actgggaaattgccctagttct

SEQ ID NO: 6987769 - DNA, 22 bp, Homo sapiens
gctgttcacattttgggccaaa

SEQ ID NO: 6987770 - DNA, 22 bp, Homo sapiens
atctcagtcaggttgaatttgg

SEQ ID NO: 6987771 - DNA, 22 bp, Homo sapiens
agggctttctttgtaaaagaag

SEQ ID NO: 6987772 - DNA, 22 bp, Homo sapiens
cacaggagggagcgggcagcca

SEQ ID NO: 6987773 - DNA, 22 bp, Homo sapiens
tgaggaaaatgtcttatagatt

SEQ ID NO: 6987774 - DNA, 22 bp, Homo sapiens
caggggctctaatgcatgatca

SEQ ID NO: 6987775 - DNA, 22 bp, Homo sapiens
cagcccagctgggatcacactc

SEQ ID NO: 6987776 - DNA, 22 bp, Homo sapiens
tagtacagaaaacctcagggtc

SEQ ID NO: 6987777 - DNA, 22 bp, Homo sapiens
gctttattttgtgagggattac

SEQ ID NO: 6987778 - DNA, 18 bp, Homo sapiens
ctgcctgttgctgagagg

SEQ ID NO: 6987779 - DNA, 22 bp, Homo sapiens
ggtggcactcaaccttttatta

SEQ ID NO: 6987780 - DNA, 22 bp, Homo sapiens
tgtggaagtgccaatgacaaat

SEQ ID NO: 6987781 - DNA, 22 bp, Homo sapiens
gggaccctcaacatctgcttct

SEQ ID NO: 6987782 - DNA, 22 bp, Homo sapiens
gagcaccaaggctctgccatgg

SEQ ID NO: 6987783 - DNA, 22 bp, Homo sapiens
ctccagtctaggtcctacttat

SEQ ID NO: 6987784 - DNA, 22 bp, Homo sapiens
gagcttaaaacatagccagact

SEQ ID NO: 6987785 - DNA, 22 bp, Homo sapiens
aagggggcgaagacgtgattga

SEQ ID NO: 6987786 - DNA, 22 bp, Homo sapiens
tgggcagaatgtgggatccaga

SEQ ID NO: 6987787 - DNA, 22 bp, Homo sapiens
gaactacagtaagaattgatgt

SEQ ID NO: 6987788 - DNA, 22 bp, Homo sapiens
agcagagtttctcaacatcagc

SEQ ID NO: 6987789 - DNA, 22 bp, Homo sapiens
acaaggcttcacacagtatgaa

SEQ ID NO: 6987790 - DNA, 22 bp, Homo sapiens
attgagaaaataagtatggata

SEQ ID NO: 6987791 - DNA, 22 bp, Homo sapiens
tgaaggaatggaggatcagagc

SEQ ID NO: 6987792 - DNA, 22 bp, Homo sapiens
cctgcagcagctgaaatcacag

SEQ ID NO: 6987793 - DNA, 22 bp, Homo sapiens
gactggcttgccacccaggatc

SEQ ID NO: 6987794 - DNA, 22 bp, Homo sapiens
gtgcaaggtacatccttgatgt

SEQ ID NO: 6987795 - DNA, 22 bp, Homo sapiens
agtgcaaagaaatcagctttgt

SEQ ID NO: 6987796 - DNA, 22 bp, Homo sapiens
agctgatgtgtccggagcagct

SEQ ID NO: 6987797 - DNA, 22 bp, Homo sapiens
agcaatagataaaacatttacc

SEQ ID NO: 6987798 - DNA, 22 bp, Homo sapiens
ggagtatatcgtgtatcatatg

SEQ ID NO: 6987799 - DNA, 22 bp, Homo sapiens
gacactgaggcatgcagagccg

SEQ ID NO: 6987800 - DNA, 22 bp, Homo sapiens
cctggctccctggacctcatta

SEQ ID NO: 6987801 - DNA, 22 bp, Homo sapiens
ctgctttaacaaggctgatcag

SEQ ID NO: 6987802 - DNA, 22 bp, Homo sapiens
gtgaccaatattatgctaatta

SEQ ID NO: 6987803 - DNA, 22 bp, Homo sapiens
atgcacactgggattcaactgg

SEQ ID NO: 6987804 - DNA, 22 bp, Homo sapiens
aaacagtgcctggcatggagga

SEQ ID NO: 6987805 - DNA, 22 bp, Homo sapiens
ctccagagatccattgaatgta

SEQ ID NO: 6987806 - DNA, 22 bp, Homo sapiens
ttggagatatgtgaaaaaaaca

SEQ ID NO: 6987807 - DNA, 22 bp, Homo sapiens
tgcttctgtattttgggcttga

SEQ ID NO: 6987808 - DNA, 22 bp, Homo sapiens
gactcctgggcctctgagaggc

SEQ ID NO: 6987809 - DNA, 22 bp, Homo sapiens
gagctgctggctcctcaggtta

SEQ ID NO: 6987810 - DNA, 20 bp, Homo sapiens
gaatctttccccatgcaatg

SEQ ID NO: 6987811 - DNA, 19 bp, Homo sapiens
agggttacccgctgccacc

SEQ ID NO: 6987812 - DNA, 21 bp, Homo sapiens
acaaaagaagctgccttttaa

SEQ ID NO: 6987813 - DNA, 22 bp, Homo sapiens
gggcacaggagaaggatctggc

SEQ ID NO: 6987814 - DNA, 22 bp, Homo sapiens
tggatgaacagttttggagaga

SEQ ID NO: 6987815 - DNA, 23 bp, Homo sapiens
aggcccaactctgtgagggctgc

SEQ ID NO: 6987816 - DNA, 22 bp, Homo sapiens
tagcccagcatgagcagagctg

SEQ ID NO: 6987817 - DNA, 22 bp, Homo sapiens
gctctatgaacctgaatctcac

SEQ ID NO: 6987818 - DNA, 22 bp, Homo sapiens
aaacttgacagtagacagatta

SEQ ID NO: 6987819 - DNA, 22 bp, Homo sapiens
ccatgtggcaggaaggtgtttc

SEQ ID NO: 6987820 - DNA, 17 bp, Homo sapiens
ttacacaggagagctct

SEQ ID NO: 6987821 - DNA, 20 bp, Homo sapiens
cgattcagtggagtttgaaa

SEQ ID NO: 6987822 - DNA, 22 bp, Homo sapiens
ttgtttctggaaaaggcgagaa

SEQ ID NO: 6987823 - DNA, 22 bp, Homo sapiens
gatggctggagccagtgctttg

SEQ ID NO: 6987824 - DNA, 22 bp, Homo sapiens
agctctgtctttctcttagtaa

SEQ ID NO: 6987825 - DNA, 22 bp, Homo sapiens
cggctggagctgagaaaggagc

SEQ ID NO: 6987826 - DNA, 22 bp, Homo sapiens
aagttacagtctgcttgctgac

SEQ ID NO: 6987827 - DNA, 22 bp, Homo sapiens
tcctttaaagaactgtgctttt

SEQ ID NO: 6987828 - DNA, 22 bp, Homo sapiens
tgtactaaggctgtgtagatgt

SEQ ID NO: 6987829 - DNA, 22 bp, Homo sapiens
ttgcaggttcaagaaactgatt

SEQ ID NO: 6987830 - DNA, 22 bp, Homo sapiens
actgctgatataagaaaagatt

SEQ ID NO: 6987831 - DNA, 22 bp, Homo sapiens
ctggcctgctgggtgaggtcct

SEQ ID NO: 6987832 - DNA, 22 bp, Homo sapiens
agatatacacccatatcacata

SEQ ID NO: 6987833 - DNA, 22 bp, Homo sapiens
ttatttggatttagcttatcaa

SEQ ID NO: 6987834 - DNA, 22 bp, Homo sapiens
gagggacctttacacagacatt

SEQ ID NO: 6987835 - DNA, 22 bp, Homo sapiens
cagataacacaaagaaatgggc

SEQ ID NO: 6987836 - DNA, 22 bp, Homo sapiens
ggagctgttcaggactgcttca

SEQ ID NO: 6987837 - DNA, 22 bp, Homo sapiens
gcctccctgtagaggccagcct

SEQ ID NO: 6987838 - DNA, 22 bp, Homo sapiens
ctagctcttacactctgaatag

SEQ ID NO: 6987839 - DNA, 22 bp, Homo sapiens
tttgtaaagtctgttctgagtt

SEQ ID NO: 6987840 - DNA, 22 bp, Homo sapiens
atggaactgctaataatagttg

SEQ ID NO: 6987841 - DNA, 22 bp, Homo sapiens
ctggcagcttcaggacactcgg

SEQ ID NO: 6987842 - DNA, 22 bp, Homo sapiens
gctgctccgcagagtgtgtgtg

SEQ ID NO: 6987843 - DNA, 22 bp, Homo sapiens
cagcagggcccccgggtgcgcc

SEQ ID NO: 6987844 - DNA, 22 bp, Homo sapiens
tttcagaggagagctggaccaa

SEQ ID NO: 6987845 - DNA, 22 bp, Homo sapiens
attctgtatggggaaactagag

SEQ ID NO: 6987846 - DNA, 22 bp, Homo sapiens
ggggaaagccagccctgcttcc

SEQ ID NO: 6987847 - DNA, 22 bp, Homo sapiens
gtctgcactgtggagtactgtg

SEQ ID NO: 6987848 - DNA, 22 bp, Homo sapiens
gctggctgtgttccttctgcca

SEQ ID NO: 6987849 - DNA, 22 bp, Homo sapiens
gcagaatttgggggtaaccttt

SEQ ID NO: 6987850 - DNA, 22 bp, Homo sapiens
gaatatgaactattcctagccc

SEQ ID NO: 6987851 - DNA, 22 bp, Homo sapiens
atttggcaaataatttgagggt

SEQ ID NO: 6987852 - DNA, 22 bp, Homo sapiens
tgtcacttggagaagctgatcc

SEQ ID NO: 6987853 - DNA, 22 bp, Homo sapiens
acctgtgcacagtcagccctgg

SEQ ID NO: 6987854 - DNA, 22 bp, Homo sapiens
gagagaaaacaagttctccatt

SEQ ID NO: 6987855 - DNA, 22 bp, Homo sapiens
caaacctgctgctattttatcc

SEQ ID NO: 6987856 - DNA, 22 bp, Homo sapiens
tatgtacatatacacgtgtgtg

SEQ ID NO: 6987857 - DNA, 22 bp, Homo sapiens
gactttcttgtagtgtctgatg

SEQ ID NO: 6987858 - DNA, 22 bp, Homo sapiens
tccagaaggccacccggggatg

SEQ ID NO: 6987859 - DNA, 22 bp, Homo sapiens
ggcactgggaatgcagtgatga

SEQ ID NO: 6987860 - DNA, 22 bp, Homo sapiens
actagtttttcctctgtcctgt

SEQ ID NO: 6987861 - DNA, 22 bp, Homo sapiens
aaacttgtgagctaaataaatg

SEQ ID NO: 6987862 - DNA, 22 bp, Homo sapiens
gaacagggagtacggcacattt

SEQ ID NO: 6987863 - DNA, 22 bp, Homo sapiens
ccaggactcagtggggaaaggg

SEQ ID NO: 6987864 - DNA, 22 bp, Homo sapiens
cagtgatttttacagtaaggaa

SEQ ID NO: 6987865 - DNA, 22 bp, Homo sapiens
tgcaatcttgtggtttcaagga

SEQ ID NO: 6987866 - DNA, 22 bp, Homo sapiens
tttctagatgagttttgaagat

SEQ ID NO: 6987867 - DNA, 22 bp, Homo sapiens
gctctgccttctcactgggttc

SEQ ID NO: 6987868 - DNA, 22 bp, Homo sapiens
gtgcagtgaaaaaagaatgtcc

SEQ ID NO: 6987869 - DNA, 22 bp, Homo sapiens
gggctgagagctggaatctgag

SEQ ID NO: 6987870 - DNA, 23 bp, Homo sapiens
tgcgtgtgtgctgaggggcgtcc

SEQ ID NO: 6987871 - DNA, 23 bp, Homo sapiens
atgaaatgctggctcagggaggt

SEQ ID NO: 6987872 - DNA, 20 bp, Homo sapiens
ttcatcagcaaagcacagca

SEQ ID NO: 6987873 - DNA, 22 bp, Homo sapiens
gagttcttctatatagtatgag

SEQ ID NO: 6987874 - DNA, 23 bp, Homo sapiens
tcatggaactgggcaatcttgaa

SEQ ID NO: 6987875 - DNA, 20 bp, Homo sapiens
tctcagtttctagagtcagg

SEQ ID NO: 6987876 - DNA, 22 bp, Homo sapiens
ccaggctcaggtgcgagagaca

SEQ ID NO: 6987877 - DNA, 20 bp, Homo sapiens
agattccttggggatagtgc

SEQ ID NO: 6987878 - DNA, 22 bp, Homo sapiens
tattatagactgagggtcaggc

SEQ ID NO: 6987879 - DNA, 22 bp, Homo sapiens
ttttggcttttcctcagcaagc

SEQ ID NO: 6987880 - DNA, 22 bp, Homo sapiens
tggcagggtgccagttgcgagt

SEQ ID NO: 6987881 - DNA, 22 bp, Homo sapiens
accagtttatagcgatctgtca

SEQ ID NO: 6987882 - DNA, 21 bp, Homo sapiens
tgcacttcagtggctaaattc

SEQ ID NO: 6987883 - DNA, 22 bp, Homo sapiens
agcccaggtggagtgtgtgggg

SEQ ID NO: 6987884 - DNA, 22 bp, Homo sapiens
taatcagaagttacattagggt

SEQ ID NO: 6987885 - DNA, 22 bp, Homo sapiens
tggttccactaacctgagagcc

SEQ ID NO: 6987886 - DNA, 21 bp, Homo sapiens
aggaaaattgagggttgttgt

SEQ ID NO: 6987887 - DNA, 22 bp, Homo sapiens
gctgtttctgagtagctaggct

SEQ ID NO: 6987888 - DNA, 22 bp, Homo sapiens
tcacagttgagcaggttgtgca

SEQ ID NO: 6987889 - DNA, 22 bp, Homo sapiens
atccatgaccctctcaacaacc

SEQ ID NO: 6987890 - DNA, 22 bp, Homo sapiens
tctggggtggagccctggagtc

SEQ ID NO: 6987891 - DNA, 22 bp, Homo sapiens
catgatttactaaaatttgttt

SEQ ID NO: 6987892 - DNA, 23 bp, Homo sapiens
taggggaaaaatcttctgcaatt

SEQ ID NO: 6987893 - DNA, 22 bp, Homo sapiens
atttcctgttgcttttgccact

SEQ ID NO: 6987894 - DNA, 22 bp, Homo sapiens
tcagctggagatccttgttgtg

SEQ ID NO: 6987895 - DNA, 22 bp, Homo sapiens
cctagaatgtacttaatagatg

SEQ ID NO: 6987896 - DNA, 22 bp, Homo sapiens
gctgtgctatatctctgagtgt

SEQ ID NO: 6987897 - DNA, 22 bp, Homo sapiens
acagcaggttattgttatggca

SEQ ID NO: 6987898 - DNA, 22 bp, Homo sapiens
gatgcttacatagcccaagtgt

SEQ ID NO: 6987899 - DNA, 22 bp, Homo sapiens
agggctcataattcctgacttc

SEQ ID NO: 6987900 - DNA, 22 bp, Homo sapiens
agatttaaatttgctacaattc

SEQ ID NO: 6987901 - DNA, 22 bp, Homo sapiens
gcagagaaggattgaaaccaga

SEQ ID NO: 6987902 - DNA, 22 bp, Homo sapiens
tggttctaaaggactatacaga

SEQ ID NO: 6987903 - DNA, 22 bp, Homo sapiens
tcagacaagtaaaataatgtaa

SEQ ID NO: 6987904 - DNA, 22 bp, Homo sapiens
aatgtttgtgcataaatatgtt

SEQ ID NO: 6987905 - DNA, 21 bp, Homo sapiens
tgtgtgcatatgcatgtacat

SEQ ID NO: 6987906 - DNA, 22 bp, Homo sapiens
tagtcctcagctgaactgctgc

SEQ ID NO: 6987907 - DNA, 22 bp, Homo sapiens
tcaggctacttgctttaaagta

SEQ ID NO: 6987908 - DNA, 22 bp, Homo sapiens
gcagtgtggccccagtatcacg

SEQ ID NO: 6987909 - DNA, 22 bp, Homo sapiens
gtattatgaatgccgaggcggc

SEQ ID NO: 6987910 - DNA, 22 bp, Homo sapiens
gcctccctgagtcacccaagca

SEQ ID NO: 6987911 - DNA, 22 bp, Homo sapiens
gatcttggggggatcaccatgg

SEQ ID NO: 6987912 - DNA, 22 bp, Homo sapiens
atggggctctgcggctgctccc

SEQ ID NO: 6987913 - DNA, 22 bp, Homo sapiens
gttcaaattttggctgtactgc

SEQ ID NO: 6987914 - DNA, 22 bp, Homo sapiens
agactagagagatataatatgg

SEQ ID NO: 6987915 - DNA, 23 bp, Homo sapiens
tatcttacctcccttctttcctg

SEQ ID NO: 6987916 - DNA, 22 bp, Homo sapiens
ctaaagcaactgagacacatag

SEQ ID NO: 6987917 - DNA, 22 bp, Homo sapiens
gctgaggccagtttaatgagga

SEQ ID NO: 6987918 - DNA, 22 bp, Homo sapiens
cgtgcggcctcggggcccggct

SEQ ID NO: 6987919 - DNA, 22 bp, Homo sapiens
ttcaggatgacaccatgtccag

SEQ ID NO: 6987920 - DNA, 22 bp, Homo sapiens
agtgggagagaagcaagtagta

SEQ ID NO: 6987921 - DNA, 18 bp, Homo sapiens
tgtggtggagctgccttc

SEQ ID NO: 6987922 - DNA, 22 bp, Homo sapiens
ctggctctgaccgcgctggcct

SEQ ID NO: 6987923 - DNA, 22 bp, Homo sapiens
tcacagacaccttggccacagt

SEQ ID NO: 6987924 - DNA, 16 bp, Homo sapiens
accctcagaaactgct

SEQ ID NO: 6987925 - DNA, 22 bp, Homo sapiens
tccagggcatgctcagactcag

SEQ ID NO: 6987926 - DNA, 22 bp, Homo sapiens
gctgctagacagcatgtgagct

SEQ ID NO: 6987927 - DNA, 22 bp, Homo sapiens
aatggcagtagttgcatgagag

SEQ ID NO: 6987928 - DNA, 22 bp, Homo sapiens
accctgagtcactgtctgtctg

SEQ ID NO: 6987929 - DNA, 22 bp, Homo sapiens
agggctgccatttctggcccaa

SEQ ID NO: 6987930 - DNA, 22 bp, Homo sapiens
ggcagcttacgttttgctagtg

SEQ ID NO: 6987931 - DNA, 23 bp, Homo sapiens
ccagttctcctttgaacagtgac

SEQ ID NO: 6987932 - DNA, 22 bp, Homo sapiens
cgcctgctgatcttgttctctt

SEQ ID NO: 6987933 - DNA, 22 bp, Homo sapiens
gtggtccttacaggaggcttac

SEQ ID NO: 6987934 - DNA, 22 bp, Homo sapiens
tctgtggctggtaattgcatgt

SEQ ID NO: 6987935 - DNA, 21 bp, Homo sapiens
agtatcgtacctttaaggcag

SEQ ID NO: 6987936 - DNA, 22 bp, Homo sapiens
ttctgttagcattctgatctcc

SEQ ID NO: 6987937 - DNA, 22 bp, Homo sapiens
acagcgagaaactaaacagggg

SEQ ID NO: 6987938 - DNA, 22 bp, Homo sapiens
tgtgtgcacgctgggagctgga

SEQ ID NO: 6987939 - DNA, 19 bp, Homo sapiens
tctagtcagtcagtcattc

SEQ ID NO: 6987940 - DNA, 22 bp, Homo sapiens
caagttatcagggcagttagag

SEQ ID NO: 6987941 - DNA, 22 bp, Homo sapiens
agctcctgagtagctttactca

SEQ ID NO: 6987942 - DNA, 20 bp, Homo sapiens
atgtgtcttagagcatcagg

SEQ ID NO: 6987943 - DNA, 20 bp, Homo sapiens
tacaaacctccacactggtg

SEQ ID NO: 6987944 - DNA, 22 bp, Homo sapiens
gtttccaactagtatgatcagg

SEQ ID NO: 6987945 - DNA, 22 bp, Homo sapiens
tactgtatttagaaagaactcc

SEQ ID NO: 6987946 - DNA, 22 bp, Homo sapiens
tcctgggctgcagggaagagca

SEQ ID NO: 6987947 - DNA, 22 bp, Homo sapiens
ttgcatgtcctacatctgtgtc

SEQ ID NO: 6987948 - DNA, 22 bp, Homo sapiens
gttagcatgacttagaatcagg

SEQ ID NO: 6987949 - DNA, 22 bp, Homo sapiens
ctgctgagcatttgcagggaca

SEQ ID NO: 6987950 - DNA, 22 bp, Homo sapiens
ctgctgcccctgagctcagcct

SEQ ID NO: 6987951 - DNA, 22 bp, Homo sapiens
gtgaggtccagtaacttgtcca

SEQ ID NO: 6987952 - DNA, 22 bp, Homo sapiens
attgtatcttgtcattatgcat

SEQ ID NO: 6987953 - DNA, 22 bp, Homo sapiens
gcccatggttacttttctggct

SEQ ID NO: 6987954 - DNA, 22 bp, Homo sapiens
cctgctcagagcgtcttgtgtg

SEQ ID NO: 6987955 - DNA, 22 bp, Homo sapiens
tgagccagtgtggtaaagctga

SEQ ID NO: 6987956 - DNA, 18 bp, Homo sapiens
atcctagaccatacacag

SEQ ID NO: 6987957 - DNA, 22 bp, Homo sapiens
gggctctcaaggcagggcccca

SEQ ID NO: 6987958 - DNA, 22 bp, Homo sapiens
cacaggaagcaagcctggggcc

SEQ ID NO: 6987959 - DNA, 22 bp, Homo sapiens
gaagatttgcccatgcactttt

SEQ ID NO: 6987960 - DNA, 18 bp, Homo sapiens
taatgataagccttgaag

SEQ ID NO: 6987961 - DNA, 22 bp, Homo sapiens
tgtaattttacgtgacacagtt

SEQ ID NO: 6987962 - DNA, 22 bp, Homo sapiens
taaggaggttggtgggttggat

SEQ ID NO: 6987963 - DNA, 22 bp, Homo sapiens
tctgaaagtatctggatctttt

SEQ ID NO: 6987964 - DNA, 22 bp, Homo sapiens
aagacatcagtgatgacatttg

SEQ ID NO: 6987965 - DNA, 22 bp, Homo sapiens
gtgaggtcctgagaggcttgtg

SEQ ID NO: 6987966 - DNA, 22 bp, Homo sapiens
gcctggaggggacagtctctgg

SEQ ID NO: 6987967 - DNA, 22 bp, Homo sapiens
cactccagatcacaccccttgg

SEQ ID NO: 6987968 - DNA, 22 bp, Homo sapiens
atgccaagaatcatatgccagg

SEQ ID NO: 6987969 - DNA, 22 bp, Homo sapiens
taatgcttgcaaattatgggac

SEQ ID NO: 6987970 - DNA, 22 bp, Homo sapiens
aagttgaatgcgtacgtgacat

SEQ ID NO: 6987971 - DNA, 22 bp, Homo sapiens
agtctcttattccctattgctg

SEQ ID NO: 6987972 - DNA, 22 bp, Homo sapiens
cctttctcattttaagcattag

SEQ ID NO: 6987973 - DNA, 22 bp, Homo sapiens
atgtccttctctggggcccaga

SEQ ID NO: 6987974 - DNA, 22 bp, Homo sapiens
tgttaaatgttttgctagtgtc

SEQ ID NO: 6987975 - DNA, 22 bp, Homo sapiens
aatggcttagctcagcgctcag

SEQ ID NO: 6987976 - DNA, 22 bp, Homo sapiens
tacagcagcccaccttcttctg

SEQ ID NO: 6987977 - DNA, 22 bp, Homo sapiens
gtagaggacatttgacatgatg

SEQ ID NO: 6987978 - DNA, 22 bp, Homo sapiens
tcacccttagtgtactatcatg

SEQ ID NO: 6987979 - DNA, 22 bp, Homo sapiens
aaatgctaacaaggaatgctgc

SEQ ID NO: 6987980 - DNA, 22 bp, Homo sapiens
cacatcaggtagacctacagag

SEQ ID NO: 6987981 - DNA, 22 bp, Homo sapiens
cgtccgcaatgcaagcctttta

SEQ ID NO: 6987982 - DNA, 22 bp, Homo sapiens
tccttgaatgaatgttctctcc

SEQ ID NO: 6987983 - DNA, 22 bp, Homo sapiens
caatgctaaaaattctgtacat

SEQ ID NO: 6987984 - DNA, 22 bp, Homo sapiens
taatctgtttcccaaggtgata

SEQ ID NO: 6987985 - DNA, 18 bp, Homo sapiens
gtgattcttatttgtaca

SEQ ID NO: 6987986 - DNA, 22 bp, Homo sapiens
acagagcttaggatgactccca

SEQ ID NO: 6987987 - DNA, 21 bp, Homo sapiens
tttcaagggaccctggggatc

SEQ ID NO: 6987988 - DNA, 19 bp, Homo sapiens
atgaatgtgttcttacctc

SEQ ID NO: 6987989 - DNA, 22 bp, Homo sapiens
tgtgggacagggacagcaagag

SEQ ID NO: 6987990 - DNA, 22 bp, Homo sapiens
aagtgctttaaaatttcctgag

SEQ ID NO: 6987991 - DNA, 22 bp, Homo sapiens
atatgcatatacacacatgcgt

SEQ ID NO: 6987992 - DNA, 22 bp, Homo sapiens
tccagctttcacgctcctgcct

SEQ ID NO: 6987993 - DNA, 22 bp, Homo sapiens
ttggcttccaggatctcagcag

SEQ ID NO: 6987994 - DNA, 22 bp, Homo sapiens
ttcccaagtctccaatgtggga

SEQ ID NO: 6987995 - DNA, 22 bp, Homo sapiens
caggagctcacagtctttgggt

SEQ ID NO: 6987996 - DNA, 22 bp, Homo sapiens
actgcacacacagaatttaggg

SEQ ID NO: 6987997 - DNA, 22 bp, Homo sapiens
tggttttagatgcctttactgc

SEQ ID NO: 6987998 - DNA, 22 bp, Homo sapiens
tagatataaggtccttagaaca

SEQ ID NO: 6987999 - DNA, 22 bp, Homo sapiens
aagtcacattctgaggtattgg

SEQ ID NO: 6988000 - DNA, 22 bp, Homo sapiens
gtgaaaaatgatttgttaactg

SEQ ID NO: 6988001 - DNA, 22 bp, Homo sapiens
agcttctggaagcctggcagca

SEQ ID NO: 6988002 - DNA, 22 bp, Homo sapiens
aatcctgtgtgactctggggag

SEQ ID NO: 6988003 - DNA, 22 bp, Homo sapiens
ggcctgagaaccatggggccaa

SEQ ID NO: 6988004 - DNA, 17 bp, Homo sapiens
tcaggatccagggttct

SEQ ID NO: 6988005 - DNA, 22 bp, Homo sapiens
ttatcttgtagagatattttcg

SEQ ID NO: 6988006 - DNA, 22 bp, Homo sapiens
ccacagggtcagccactctgca

SEQ ID NO: 6988007 - DNA, 22 bp, Homo sapiens
agtgagtcaaaaaacttagata

SEQ ID NO: 6988008 - DNA, 19 bp, Homo sapiens
tcattgattgtagttacat

SEQ ID NO: 6988009 - DNA, 22 bp, Homo sapiens
tcccaagacctggcatccaagt

SEQ ID NO: 6988010 - DNA, 22 bp, Homo sapiens
ctgagatactgtggcgaatgca

SEQ ID NO: 6988011 - DNA, 22 bp, Homo sapiens
accctcccatttccatgtagca

SEQ ID NO: 6988012 - DNA, 22 bp, Homo sapiens
atctccttggtctcgttccagg

SEQ ID NO: 6988013 - DNA, 22 bp, Homo sapiens
gcatgtaatcactctaggaagg

SEQ ID NO: 6988014 - DNA, 22 bp, Homo sapiens
atgttcttccaaatctgtaaca

SEQ ID NO: 6988015 - DNA, 20 bp, Homo sapiens
gggcatctttgctcctgttt

SEQ ID NO: 6988016 - DNA, 22 bp, Homo sapiens
ggcagcagtggctgctattgtc

SEQ ID NO: 6988017 - DNA, 23 bp, Homo sapiens
ctttcctttctttgacacccagc

SEQ ID NO: 6988018 - DNA, 22 bp, Homo sapiens
tccacttctattgggtcttggt

SEQ ID NO: 6988019 - DNA, 22 bp, Homo sapiens
gagtctctgctatgttttctct

SEQ ID NO: 6988020 - DNA, 22 bp, Homo sapiens
ttaattttaacctgtttgtgtc

SEQ ID NO: 6988021 - DNA, 22 bp, Homo sapiens
gggcactctgctcccagtgttt

SEQ ID NO: 6988022 - DNA, 22 bp, Homo sapiens
ttcctgtgatattagccactgt

SEQ ID NO: 6988023 - DNA, 22 bp, Homo sapiens
cctttcccgctttgagggcaag

SEQ ID NO: 6988024 - DNA, 22 bp, Homo sapiens
aggtaagccttgcctgagaaaa

SEQ ID NO: 6988025 - DNA, 22 bp, Homo sapiens
cctgcccagagcccctttcact

SEQ ID NO: 6988026 - DNA, 22 bp, Homo sapiens
tgcttctgggcctggtgttccc

SEQ ID NO: 6988027 - DNA, 22 bp, Homo sapiens
gtcctgggaaggaagccaggga

SEQ ID NO: 6988028 - DNA, 22 bp, Homo sapiens
agaatcaggacctgtggctgtc

SEQ ID NO: 6988029 - DNA, 22 bp, Homo sapiens
caccactggaggtcttggcttt

SEQ ID NO: 6988030 - DNA, 20 bp, Homo sapiens
gaaatgtatctcttgattct

SEQ ID NO: 6988031 - DNA, 23 bp, Homo sapiens
taggaagacagcaaaagaatgga

SEQ ID NO: 6988032 - DNA, 22 bp, Homo sapiens
gtttacattaagtattagcatc

SEQ ID NO: 6988033 - DNA, 22 bp, Homo sapiens
agggacttgtgtcctatgtatg

SEQ ID NO: 6988034 - DNA, 22 bp, Homo sapiens
cactgtccaatagatacataat

SEQ ID NO: 6988035 - DNA, 22 bp, Homo sapiens
ccctgtgagcggctggatgcct

SEQ ID NO: 6988036 - DNA, 22 bp, Homo sapiens
ttcatgctcctgccctttttgg

SEQ ID NO: 6988037 - DNA, 22 bp, Homo sapiens
aggggcctggttggcctctgtt

SEQ ID NO: 6988038 - DNA, 22 bp, Homo sapiens
aggcatctgcctcctctacccc

SEQ ID NO: 6988039 - DNA, 22 bp, Homo sapiens
tgtgtgtcatttagggtggagc

SEQ ID NO: 6988040 - DNA, 18 bp, Homo sapiens
taggttacagccagccag

SEQ ID NO: 6988041 - DNA, 20 bp, Homo sapiens
gtcaggattagtaaactctg

SEQ ID NO: 6988042 - DNA, 22 bp, Homo sapiens
cacagtgcatgatgggcagaag

SEQ ID NO: 6988043 - DNA, 22 bp, Homo sapiens
tctctgagaaacatgttcaaag

SEQ ID NO: 6988044 - DNA, 22 bp, Homo sapiens
gggctgaggggtatctcatggg

SEQ ID NO: 6988045 - DNA, 22 bp, Homo sapiens
tgctggctgtgtaccatctcaa

SEQ ID NO: 6988046 - DNA, 22 bp, Homo sapiens
tacagttactgcatttctaata

SEQ ID NO: 6988047 - DNA, 22 bp, Homo sapiens
tctgtgacttgcgggaggagaa

SEQ ID NO: 6988048 - DNA, 22 bp, Homo sapiens
atgctccttggcttcaaagcca

SEQ ID NO: 6988049 - DNA, 22 bp, Homo sapiens
tgccaggaggggacacctcctc

SEQ ID NO: 6988050 - DNA, 22 bp, Homo sapiens
ggcttcttgtgtgtcaggctct

SEQ ID NO: 6988051 - DNA, 17 bp, Homo sapiens
ataaaggcaagtattat

SEQ ID NO: 6988052 - DNA, 22 bp, Homo sapiens
gtgagcagctcagggtggtctc

SEQ ID NO: 6988053 - DNA, 22 bp, Homo sapiens
aagctctgtctcttgggagtta

SEQ ID NO: 6988054 - DNA, 22 bp, Homo sapiens
aaataattgagttggtcaatat

SEQ ID NO: 6988055 - DNA, 22 bp, Homo sapiens
tacatcccagccagcagaatca

SEQ ID NO: 6988056 - DNA, 20 bp, Homo sapiens
tctcacaggggcttttctct

SEQ ID NO: 6988057 - DNA, 22 bp, Homo sapiens
tctgaggtgtagctgggcttca

SEQ ID NO: 6988058 - DNA, 22 bp, Homo sapiens
tagtaagcctctccagagacag

SEQ ID NO: 6988059 - DNA, 22 bp, Homo sapiens
taatggagcaagccactgaatg

SEQ ID NO: 6988060 - DNA, 22 bp, Homo sapiens
aggctgagtttctcattctcgc

SEQ ID NO: 6988061 - DNA, 22 bp, Homo sapiens
gcagagcagcaaatggaaagga

SEQ ID NO: 6988062 - DNA, 23 bp, Homo sapiens
ctgcaaggtacaagatgctggat

SEQ ID NO: 6988063 - DNA, 22 bp, Homo sapiens
atgcagtgtttggaagcttaag

SEQ ID NO: 6988064 - DNA, 22 bp, Homo sapiens
tcaaacttctattctctgtttt

SEQ ID NO: 6988065 - DNA, 22 bp, Homo sapiens
tccaggaagcagtgtttggagc

SEQ ID NO: 6988066 - DNA, 22 bp, Homo sapiens
ttcagtttgaattctgtagaac

SEQ ID NO: 6988067 - DNA, 22 bp, Homo sapiens
tccagatggatttaagacctaa

SEQ ID NO: 6988068 - DNA, 22 bp, Homo sapiens
cagcagggtatacagggaattt

SEQ ID NO: 6988069 - DNA, 22 bp, Homo sapiens
ttctttatatctgctagtgggt

SEQ ID NO: 6988070 - DNA, 20 bp, Homo sapiens
caccaggcgctctgagaaca

SEQ ID NO: 6988071 - DNA, 22 bp, Homo sapiens
atttcctttgcaaagactgtgc

SEQ ID NO: 6988072 - DNA, 22 bp, Homo sapiens
atgtctttctcatacaagccca

SEQ ID NO: 6988073 - DNA, 22 bp, Homo sapiens
aaacaggcttttaagtcaatag

SEQ ID NO: 6988074 - DNA, 22 bp, Homo sapiens
gccttcagtagtgtcagctgta

SEQ ID NO: 6988075 - DNA, 22 bp, Homo sapiens
tggctggataatattctgttgt

SEQ ID NO: 6988076 - DNA, 22 bp, Homo sapiens
tcaaacctgctgtcttgttcat

SEQ ID NO: 6988077 - DNA, 22 bp, Homo sapiens
tccatatacctgcagcctggtt

SEQ ID NO: 6988078 - DNA, 22 bp, Homo sapiens
cagcacataatcagtgattgtg

SEQ ID NO: 6988079 - DNA, 22 bp, Homo sapiens
gatttcagggtgtcttccagct

SEQ ID NO: 6988080 - DNA, 17 bp, Homo sapiens
gctcagagtacacgtgt

SEQ ID NO: 6988081 - DNA, 22 bp, Homo sapiens
ggagaagaggagctggaagcct

SEQ ID NO: 6988082 - DNA, 23 bp, Homo sapiens
aatcagtgcagttttatgccaag

SEQ ID NO: 6988083 - DNA, 22 bp, Homo sapiens
ccaggactgcagggggcgagga

SEQ ID NO: 6988084 - DNA, 22 bp, Homo sapiens
atgaggctatgaatggggagat

SEQ ID NO: 6988085 - DNA, 22 bp, Homo sapiens
attttttcccagttagccagga

SEQ ID NO: 6988086 - DNA, 22 bp, Homo sapiens
tagggaagagcattcaaccttt

SEQ ID NO: 6988087 - DNA, 22 bp, Homo sapiens
gccctgtgatggagactagagg

SEQ ID NO: 6988088 - DNA, 20 bp, Homo sapiens
tttcaagttgtaaggtatca

SEQ ID NO: 6988089 - DNA, 22 bp, Homo sapiens
caggaaatcactctgattttgg

SEQ ID NO: 6988090 - DNA, 22 bp, Homo sapiens
ggtgactagataagccccatgg

SEQ ID NO: 6988091 - DNA, 22 bp, Homo sapiens
taaggaaagtacatgttttgac

SEQ ID NO: 6988092 - DNA, 22 bp, Homo sapiens
tgctttatttataaaatagcaa

SEQ ID NO: 6988093 - DNA, 22 bp, Homo sapiens
tgcaatttggcttccattttct

SEQ ID NO: 6988094 - DNA, 20 bp, Homo sapiens
ttagcagtagagtgtgcttc

SEQ ID NO: 6988095 - DNA, 22 bp, Homo sapiens
gattcctgattccagcacaacc

SEQ ID NO: 6988096 - DNA, 18 bp, Homo sapiens
ggcagcctacccacttgt

SEQ ID NO: 6988097 - DNA, 22 bp, Homo sapiens
acactgtgtgacttctgagact

SEQ ID NO: 6988098 - DNA, 22 bp, Homo sapiens
acaggtgtagaaaacagattat

SEQ ID NO: 6988099 - DNA, 22 bp, Homo sapiens
ctccccattatgcagtcattat

SEQ ID NO: 6988100 - DNA, 22 bp, Homo sapiens
tacaaagagtttggtctctaga

SEQ ID NO: 6988101 - DNA, 22 bp, Homo sapiens
tgactttggataagaaaatgag

SEQ ID NO: 6988102 - DNA, 22 bp, Homo sapiens
agacagcaggggagtctggttt

SEQ ID NO: 6988103 - DNA, 22 bp, Homo sapiens
aaggaactagcatgatgtgtag

SEQ ID NO: 6988104 - DNA, 22 bp, Homo sapiens
agatgcagacttggttcaggca

SEQ ID NO: 6988105 - DNA, 22 bp, Homo sapiens
gaggcactgagagtgggggatg

SEQ ID NO: 6988106 - DNA, 22 bp, Homo sapiens
ataaaccagaagtaaaagctac

SEQ ID NO: 6988107 - DNA, 22 bp, Homo sapiens
gttgtactctgaccattcagac

SEQ ID NO: 6988108 - DNA, 22 bp, Homo sapiens
gaggcctgaaaggggacctatg

SEQ ID NO: 6988109 - DNA, 22 bp, Homo sapiens
aggctacaaataagcatgtaat

SEQ ID NO: 6988110 - DNA, 22 bp, Homo sapiens
atagttcactaatagcaaaagc

SEQ ID NO: 6988111 - DNA, 22 bp, Homo sapiens
ttctggaagtggaatttttgta

SEQ ID NO: 6988112 - DNA, 22 bp, Homo sapiens
agtgtgaccttatttggaaaca

SEQ ID NO: 6988113 - DNA, 22 bp, Homo sapiens
tacagaaatacagtcaggccta

SEQ ID NO: 6988114 - DNA, 22 bp, Homo sapiens
taggcatgtggcatacctatgg

SEQ ID NO: 6988115 - DNA, 22 bp, Homo sapiens
aacctgggcttgaacagtgcct

SEQ ID NO: 6988116 - DNA, 22 bp, Homo sapiens
gcagagtcccagcaggtggtgg

SEQ ID NO: 6988117 - DNA, 22 bp, Homo sapiens
attgaggagcagagatggggta

SEQ ID NO: 6988118 - DNA, 22 bp, Homo sapiens
ggggagaccatctgaaggtgat

SEQ ID NO: 6988119 - DNA, 22 bp, Homo sapiens
acagccagtcatctcagcaggg

SEQ ID NO: 6988120 - DNA, 22 bp, Homo sapiens
ccgtgctaggtgatgtgatccc

SEQ ID NO: 6988121 - DNA, 22 bp, Homo sapiens
gttaagtgagggcttttgagtc

SEQ ID NO: 6988122 - DNA, 23 bp, Homo sapiens
ttccagaggaagaagtcatgact

SEQ ID NO: 6988123 - DNA, 22 bp, Homo sapiens
gaagaggatgacaggagccggt

SEQ ID NO: 6988124 - DNA, 22 bp, Homo sapiens
gccacctggacagctgtgccct

SEQ ID NO: 6988125 - DNA, 22 bp, Homo sapiens
tacttgtctcttctgacaaagt

SEQ ID NO: 6988126 - DNA, 21 bp, Homo sapiens
acacccacttatgcccgcttg

SEQ ID NO: 6988127 - DNA, 22 bp, Homo sapiens
tcagaggaactggactaaagcc

SEQ ID NO: 6988128 - DNA, 22 bp, Homo sapiens
tagaaacccaggatttgtattt

SEQ ID NO: 6988129 - DNA, 22 bp, Homo sapiens
gagcctggattgtcaccgactt

SEQ ID NO: 6988130 - DNA, 22 bp, Homo sapiens
acacccagctgggccacctcca

SEQ ID NO: 6988131 - DNA, 22 bp, Homo sapiens
tccctgtagttcgtggtctttg

SEQ ID NO: 6988132 - DNA, 22 bp, Homo sapiens
cagcagcatgaattcgagccac

SEQ ID NO: 6988133 - DNA, 22 bp, Homo sapiens
atcctgaaaacttacgaagtgg

SEQ ID NO: 6988134 - DNA, 22 bp, Homo sapiens
ccaggctggaatcaatattctg

SEQ ID NO: 6988135 - DNA, 22 bp, Homo sapiens
aaggagctttcattacagcctt

SEQ ID NO: 6988136 - DNA, 22 bp, Homo sapiens
aatctcttcccagtaaaaatgg

SEQ ID NO: 6988137 - DNA, 22 bp, Homo sapiens
tgattatgcatgagacagtact

SEQ ID NO: 6988138 - DNA, 22 bp, Homo sapiens
tgtgaggagtaggctgagggtg

SEQ ID NO: 6988139 - DNA, 22 bp, Homo sapiens
aaaccttaaaccaagctcttga

SEQ ID NO: 6988140 - DNA, 22 bp, Homo sapiens
ttcaatgttaagaagaatatgt

SEQ ID NO: 6988141 - DNA, 22 bp, Homo sapiens
ctctgagaagagttcaagtaaa

SEQ ID NO: 6988142 - DNA, 22 bp, Homo sapiens
aatgtggatccttacagatacc

SEQ ID NO: 6988143 - DNA, 22 bp, Homo sapiens
gatggtctttgtctctgataag

SEQ ID NO: 6988144 - DNA, 22 bp, Homo sapiens
acattttaatatgcttagtgtg

SEQ ID NO: 6988145 - DNA, 22 bp, Homo sapiens
aagttagtggataaacagcaaa

SEQ ID NO: 6988146 - DNA, 22 bp, Homo sapiens
agaggggcagggtctccggatt

SEQ ID NO: 6988147 - DNA, 22 bp, Homo sapiens
aggagctcaaagatgccaggag

SEQ ID NO: 6988148 - DNA, 22 bp, Homo sapiens
ctgtatgaacccatatacttat

SEQ ID NO: 6988149 - DNA, 22 bp, Homo sapiens
gaagctacagttgtcaaaggta

SEQ ID NO: 6988150 - DNA, 21 bp, Homo sapiens
tctctggaattagaccatgtt

SEQ ID NO: 6988151 - DNA, 22 bp, Homo sapiens
tgggccaagttaaatgccaggg

SEQ ID NO: 6988152 - DNA, 22 bp, Homo sapiens
agacagtgattcttcacatttc

SEQ ID NO: 6988153 - DNA, 22 bp, Homo sapiens
ttattacactgaaagaattgcg

SEQ ID NO: 6988154 - DNA, 22 bp, Homo sapiens
ttgccatttaggctggctgtgg

SEQ ID NO: 6988155 - DNA, 22 bp, Homo sapiens
cgcagagaaatgccgggggtac

SEQ ID NO: 6988156 - DNA, 17 bp, Homo sapiens
tagctgtgtttcagcta

SEQ ID NO: 6988157 - DNA, 22 bp, Homo sapiens
aataccttttcagtgcacaaaa

SEQ ID NO: 6988158 - DNA, 22 bp, Homo sapiens
gtactgaacttaaaaatcccct

SEQ ID NO: 6988159 - DNA, 23 bp, Homo sapiens
catgtgtgtgtgaagaaggcgac

SEQ ID NO: 6988160 - DNA, 22 bp, Homo sapiens
atttagacatgtatctgatagc

SEQ ID NO: 6988161 - DNA, 22 bp, Homo sapiens
ttgctcaggcttagagctacta

SEQ ID NO: 6988162 - DNA, 22 bp, Homo sapiens
atgtatttactgagaaggaaac

SEQ ID NO: 6988163 - DNA, 22 bp, Homo sapiens
tggcaccatcaaggctgagaac

SEQ ID NO: 6988164 - DNA, 22 bp, Homo sapiens
gactgtgggctccttgagggca

SEQ ID NO: 6988165 - DNA, 22 bp, Homo sapiens
tccagaggctctgagggagagt

SEQ ID NO: 6988166 - DNA, 22 bp, Homo sapiens
gagtgtaatctgaaaacttgaa

SEQ ID NO: 6988167 - DNA, 22 bp, Homo sapiens
gcagctgagcgtgaggaagagt

SEQ ID NO: 6988168 - DNA, 22 bp, Homo sapiens
ttaaaatttccccaccatgtat

SEQ ID NO: 6988169 - DNA, 22 bp, Homo sapiens
gcaagcagttgtggcttctgag

SEQ ID NO: 6988170 - DNA, 22 bp, Homo sapiens
gagttaaaaatgcctccatgga

SEQ ID NO: 6988171 - DNA, 22 bp, Homo sapiens
gaggcccagcattcagggcagg

SEQ ID NO: 6988172 - DNA, 22 bp, Homo sapiens
ctaggaccactgtaacaaagta

SEQ ID NO: 6988173 - DNA, 22 bp, Homo sapiens
caggtgttctaagccgggcagt

SEQ ID NO: 6988174 - DNA, 17 bp, Homo sapiens
tcctggatccatggtgg

SEQ ID NO: 6988175 - DNA, 22 bp, Homo sapiens
tctttatgtttgaaagtacaat

SEQ ID NO: 6988176 - DNA, 22 bp, Homo sapiens
cagcagggggcagcgcagatca

SEQ ID NO: 6988177 - DNA, 22 bp, Homo sapiens
accaggagccatagagtcaggc

SEQ ID NO: 6988178 - DNA, 22 bp, Homo sapiens
gcacccagcccagggcgtgatg

SEQ ID NO: 6988179 - DNA, 22 bp, Homo sapiens
gaaattgaaaccgatctgtgtt

SEQ ID NO: 6988180 - DNA, 20 bp, Homo sapiens
ggcgcctggcctcatggctg

SEQ ID NO: 6988181 - DNA, 22 bp, Homo sapiens
tcttgtatgtgtattttgctgt

SEQ ID NO: 6988182 - DNA, 22 bp, Homo sapiens
ggggagatgcttaggtccgggg

SEQ ID NO: 6988183 - DNA, 22 bp, Homo sapiens
agccagcctgatctcttcttgc

SEQ ID NO: 6988184 - DNA, 22 bp, Homo sapiens
attcgcgggcctggagggtggg

SEQ ID NO: 6988185 - DNA, 22 bp, Homo sapiens
agaagccatggtatgcaactac

SEQ ID NO: 6988186 - DNA, 22 bp, Homo sapiens
aatgacagtgttgggccagatg

SEQ ID NO: 6988187 - DNA, 19 bp, Homo sapiens
tccaggcatccttcaggct

SEQ ID NO: 6988188 - DNA, 22 bp, Homo sapiens
cccctcattcatgtccttgctt

SEQ ID NO: 6988189 - DNA, 22 bp, Homo sapiens
tctgtgttgagaaggatcatga

SEQ ID NO: 6988190 - DNA, 22 bp, Homo sapiens
tttccaggagaaagagagcctt

SEQ ID NO: 6988191 - DNA, 22 bp, Homo sapiens
cagttatcaaatactatgaagg

SEQ ID NO: 6988192 - DNA, 18 bp, Homo sapiens
tttggctgttcaagagca

SEQ ID NO: 6988193 - DNA, 22 bp, Homo sapiens
aaggcaatgttagcaacataat

SEQ ID NO: 6988194 - DNA, 22 bp, Homo sapiens
cagctgtgaattgtcttatcta

SEQ ID NO: 6988195 - DNA, 22 bp, Homo sapiens
tttggagatagggcctagcaat

SEQ ID NO: 6988196 - DNA, 22 bp, Homo sapiens
tggaggaggatgcatttgttgt

SEQ ID NO: 6988197 - DNA, 22 bp, Homo sapiens
aacattctcattgggatatgtg

SEQ ID NO: 6988198 - DNA, 22 bp, Homo sapiens
cctgatcaaaaatgtattgttg

SEQ ID NO: 6988199 - DNA, 21 bp, Homo sapiens
tggcagagttgagtagttatg

SEQ ID NO: 6988200 - DNA, 22 bp, Homo sapiens
aatgcaacctgctgatctgaca

SEQ ID NO: 6988201 - DNA, 22 bp, Homo sapiens
atttcatgaattccagaagctt

SEQ ID NO: 6988202 - DNA, 22 bp, Homo sapiens
gacatgcaacaatttggcattt

SEQ ID NO: 6988203 - DNA, 22 bp, Homo sapiens
gctatagaaagtaatcactatc

SEQ ID NO: 6988204 - DNA, 22 bp, Homo sapiens
atctgtggctggtgagaggcag

SEQ ID NO: 6988205 - DNA, 22 bp, Homo sapiens
tcctcctgcctttgcttcttgt

SEQ ID NO: 6988206 - DNA, 22 bp, Homo sapiens
gtggacagagactaaatgttgt

SEQ ID NO: 6988207 - DNA, 22 bp, Homo sapiens
attgaagcatacacaatgagga

SEQ ID NO: 6988208 - DNA, 22 bp, Homo sapiens
agggttgaagtctggtcctcat

SEQ ID NO: 6988209 - DNA, 22 bp, Homo sapiens
cagctgcttactagctgtgtga

SEQ ID NO: 6988210 - DNA, 22 bp, Homo sapiens
aacccacaaaggatttcagctc

SEQ ID NO: 6988211 - DNA, 22 bp, Homo sapiens
tttcataatatccagagatttt

SEQ ID NO: 6988212 - DNA, 22 bp, Homo sapiens
gttgcaaatgggaagatggtta

SEQ ID NO: 6988213 - DNA, 20 bp, Homo sapiens
agaacctaagttaaaacaca

SEQ ID NO: 6988214 - DNA, 22 bp, Homo sapiens
atggcttctagcattgtcacaa

SEQ ID NO: 6988215 - DNA, 22 bp, Homo sapiens
tctgggcctgtctcagagctgg

SEQ ID NO: 6988216 - DNA, 22 bp, Homo sapiens
agataataaatgttttaggttt

SEQ ID NO: 6988217 - DNA, 22 bp, Homo sapiens
ttgaggcaaaatcaacgggaag

SEQ ID NO: 6988218 - DNA, 20 bp, Homo sapiens
ttccctggaaggagaagcag

SEQ ID NO: 6988219 - DNA, 22 bp, Homo sapiens
tccctgagcttcatcaggcttt

SEQ ID NO: 6988220 - DNA, 22 bp, Homo sapiens
atggcatctcaacttacaaaag

SEQ ID NO: 6988221 - DNA, 22 bp, Homo sapiens
tgggtcagattgagcccctggt

SEQ ID NO: 6988222 - DNA, 22 bp, Homo sapiens
tttccaggaagtaaggataatc

SEQ ID NO: 6988223 - DNA, 22 bp, Homo sapiens
aggtgtctgggctttggagtca

SEQ ID NO: 6988224 - DNA, 22 bp, Homo sapiens
ctgggcagtggtggcccttccc

SEQ ID NO: 6988225 - DNA, 22 bp, Homo sapiens
attgcaggttgtagcccattag

SEQ ID NO: 6988226 - DNA, 22 bp, Homo sapiens
acactgaaggctacaaggttga

SEQ ID NO: 6988227 - DNA, 22 bp, Homo sapiens
ctccaaatacagtcatcttggg

SEQ ID NO: 6988228 - DNA, 22 bp, Homo sapiens
gcactgagcattgttatttcca

SEQ ID NO: 6988229 - DNA, 22 bp, Homo sapiens
ttagtggggatgtatgggaggc

SEQ ID NO: 6988230 - DNA, 22 bp, Homo sapiens
cacagcagcatcatttatctgg

SEQ ID NO: 6988231 - DNA, 22 bp, Homo sapiens
caaggctgcttcagactagtga

SEQ ID NO: 6988232 - DNA, 22 bp, Homo sapiens
atgcacacacattatgtctgtg

SEQ ID NO: 6988233 - DNA, 22 bp, Homo sapiens
gtttgggtaatatcagtagagt

SEQ ID NO: 6988234 - DNA, 22 bp, Homo sapiens
cctcattagctgttatttattg

SEQ ID NO: 6988235 - DNA, 22 bp, Homo sapiens
ctccctggcagccgcactcctg

SEQ ID NO: 6988236 - DNA, 23 bp, Homo sapiens
tatcatttcagctctctgcctgg

SEQ ID NO: 6988237 - DNA, 22 bp, Homo sapiens
gctctagcccatttcctgcttg

SEQ ID NO: 6988238 - DNA, 22 bp, Homo sapiens
agattcatgggtctaaccagtg

SEQ ID NO: 6988239 - DNA, 22 bp, Homo sapiens
gtgcacagaagcagaagctaga

SEQ ID NO: 6988240 - DNA, 23 bp, Homo sapiens
gcaaagactctgccaaaaactgc

SEQ ID NO: 6988241 - DNA, 22 bp, Homo sapiens
cctctatgtacacatttccagc

SEQ ID NO: 6988242 - DNA, 22 bp, Homo sapiens
caaggaaaagaagtatttcaga

SEQ ID NO: 6988243 - DNA, 22 bp, Homo sapiens
aaatggctttgagggtaggaca

SEQ ID NO: 6988244 - DNA, 22 bp, Homo sapiens
catcacagatgttgtgtggagt

SEQ ID NO: 6988245 - DNA, 22 bp, Homo sapiens
ggccaggaacgatcctaccctt

SEQ ID NO: 6988246 - DNA, 23 bp, Homo sapiens
caaacctgtttctctcacctgtc

SEQ ID NO: 6988247 - DNA, 22 bp, Homo sapiens
tgtccaggaccctattctcact

SEQ ID NO: 6988248 - DNA, 22 bp, Homo sapiens
tgaggtattttttaaagcacaa

SEQ ID NO: 6988249 - DNA, 22 bp, Homo sapiens
ttgcatgttatttaatctgtat

SEQ ID NO: 6988250 - DNA, 22 bp, Homo sapiens
ggagctggccctctgagtttgt

SEQ ID NO: 6988251 - DNA, 22 bp, Homo sapiens
aactttcagaatcctatgcatt

SEQ ID NO: 6988252 - DNA, 22 bp, Homo sapiens
aatactgtgatatcgagcgatt

SEQ ID NO: 6988253 - DNA, 22 bp, Homo sapiens
actctgctatcttagcaaaagg

SEQ ID NO: 6988254 - DNA, 22 bp, Homo sapiens
gttcacagtttctaatcccagc

SEQ ID NO: 6988255 - DNA, 22 bp, Homo sapiens
actgtggataagtcagagatgt

SEQ ID NO: 6988256 - DNA, 22 bp, Homo sapiens
tttggaaaattttctaagtctg

SEQ ID NO: 6988257 - DNA, 22 bp, Homo sapiens
gctttggaaatatagactcaag

SEQ ID NO: 6988258 - DNA, 22 bp, Homo sapiens
taactctttactatacatttat

SEQ ID NO: 6988259 - DNA, 22 bp, Homo sapiens
gcaggcgtgtttcacgtgccag

SEQ ID NO: 6988260 - DNA, 22 bp, Homo sapiens
cccagcactttgaatatgtcac

SEQ ID NO: 6988261 - DNA, 22 bp, Homo sapiens
caggggccaggctgtctgctgt

SEQ ID NO: 6988262 - DNA, 22 bp, Homo sapiens
catcctgaagaagccgcactgt

SEQ ID NO: 6988263 - DNA, 22 bp, Homo sapiens
tatcacctgagacttagaactg

SEQ ID NO: 6988264 - DNA, 22 bp, Homo sapiens
ctttaggttttgcctgagatct

SEQ ID NO: 6988265 - DNA, 22 bp, Homo sapiens
aggtagattacttaccttttct

SEQ ID NO: 6988266 - DNA, 22 bp, Homo sapiens
aaggcagttaatttggctagaa

SEQ ID NO: 6988267 - DNA, 22 bp, Homo sapiens
aactcacacaagtattgcctgc

SEQ ID NO: 6988268 - DNA, 22 bp, Homo sapiens
ggcagagctagtggcttctctt

SEQ ID NO: 6988269 - DNA, 22 bp, Homo sapiens
tacaggacattgtgcatttgtc

SEQ ID NO: 6988270 - DNA, 22 bp, Homo sapiens
agctgaaattttactgagtata

SEQ ID NO: 6988271 - DNA, 22 bp, Homo sapiens
atcacagagctcccttccactg

SEQ ID NO: 6988272 - DNA, 22 bp, Homo sapiens
aggagatagtcaaagcttcttg

SEQ ID NO: 6988273 - DNA, 22 bp, Homo sapiens
tccaggaagccacactgggcct

SEQ ID NO: 6988274 - DNA, 22 bp, Homo sapiens
ggacaaaatccaaacttcttag

SEQ ID NO: 6988275 - DNA, 22 bp, Homo sapiens
tctgtgccttctcccagactta

SEQ ID NO: 6988276 - DNA, 22 bp, Homo sapiens
aatagtgccttgtcttcttgct

SEQ ID NO: 6988277 - DNA, 22 bp, Homo sapiens
acacttgaggtttttaggtgcg

SEQ ID NO: 6988278 - DNA, 19 bp, Homo sapiens
cctgggtctgcagcattca

SEQ ID NO: 6988279 - DNA, 22 bp, Homo sapiens
tggagaagctgtaggtggactc

SEQ ID NO: 6988280 - DNA, 22 bp, Homo sapiens
ggcgccccatgatgagggctag

SEQ ID NO: 6988281 - DNA, 22 bp, Homo sapiens
gttttgaaatgaaagaaccaag

SEQ ID NO: 6988282 - DNA, 22 bp, Homo sapiens
caggacaagagggaatcgataa

SEQ ID NO: 6988283 - DNA, 22 bp, Homo sapiens
agccagctggagaccactgttt

SEQ ID NO: 6988284 - DNA, 22 bp, Homo sapiens
tcattaaaatgcagattctgac

SEQ ID NO: 6988285 - DNA, 22 bp, Homo sapiens
cccaactactctcaggcagctt

SEQ ID NO: 6988286 - DNA, 18 bp, Homo sapiens
cctctgccatagccagca

SEQ ID NO: 6988287 - DNA, 22 bp, Homo sapiens
cagggcagccaggccccgtggg

SEQ ID NO: 6988288 - DNA, 22 bp, Homo sapiens
tggaagaatgtttgccttataa

SEQ ID NO: 6988289 - DNA, 22 bp, Homo sapiens
gaagtacaggttgtgagagaat

SEQ ID NO: 6988290 - DNA, 22 bp, Homo sapiens
tatactatgcttctgatccaat

SEQ ID NO: 6988291 - DNA, 22 bp, Homo sapiens
tccacgttttcaacacagccaa

SEQ ID NO: 6988292 - DNA, 22 bp, Homo sapiens
tgagtcacagccttgccttggt

SEQ ID NO: 6988293 - DNA, 22 bp, Homo sapiens
gtctggaaatattgacttcaga

SEQ ID NO: 6988294 - DNA, 22 bp, Homo sapiens
tgtggcacttgcaaatattttg

SEQ ID NO: 6988295 - DNA, 22 bp, Homo sapiens
cagcagctgcctcagctgggga

SEQ ID NO: 6988296 - DNA, 22 bp, Homo sapiens
acattgaagtgtctggcctcct

SEQ ID NO: 6988297 - DNA, 22 bp, Homo sapiens
aaatggctgacttttcatggga

SEQ ID NO: 6988298 - DNA, 22 bp, Homo sapiens
agacaggtgttttacaacttcg

SEQ ID NO: 6988299 - DNA, 23 bp, Homo sapiens
aagctgaacttgtttgctgggag

SEQ ID NO: 6988300 - DNA, 22 bp, Homo sapiens
ttcttaactcaaatatatatcc

SEQ ID NO: 6988301 - DNA, 22 bp, Homo sapiens
gcattgcaactgacagatcatt

SEQ ID NO: 6988302 - DNA, 22 bp, Homo sapiens
aaggacatgttttggtaaatgc

SEQ ID NO: 6988303 - DNA, 22 bp, Homo sapiens
gaagtcttgaagagcactgtaa

SEQ ID NO: 6988304 - DNA, 22 bp, Homo sapiens
agttggcttcaaaggcagagag

SEQ ID NO: 6988305 - DNA, 22 bp, Homo sapiens
agcaattggaatttagacaaga

SEQ ID NO: 6988306 - DNA, 22 bp, Homo sapiens
tttcaaactgcccagcacacct

SEQ ID NO: 6988307 - DNA, 22 bp, Homo sapiens
agttttaagatgcgcttctgtt

SEQ ID NO: 6988308 - DNA, 21 bp, Homo sapiens
tgctccttagctgcccctgcc

SEQ ID NO: 6988309 - DNA, 22 bp, Homo sapiens
tcacaggagtcaaggaatagta

SEQ ID NO: 6988310 - DNA, 22 bp, Homo sapiens
caactgccatacagctccatgg

SEQ ID NO: 6988311 - DNA, 22 bp, Homo sapiens
accagctgtgtcctggctgcag

SEQ ID NO: 6988312 - DNA, 22 bp, Homo sapiens
ggcaggcacatttgggggccgt

SEQ ID NO: 6988313 - DNA, 23 bp, Homo sapiens
ttccaggcagagcagggattaga

SEQ ID NO: 6988314 - DNA, 22 bp, Homo sapiens
agcccttgagtgtatctcaaat

SEQ ID NO: 6988315 - DNA, 22 bp, Homo sapiens
ctgtaaatatgaagaatatatg

SEQ ID NO: 6988316 - DNA, 22 bp, Homo sapiens
ttggaacaggattcaattaaag

SEQ ID NO: 6988317 - DNA, 22 bp, Homo sapiens
aacaagttagggtcttttactt

SEQ ID NO: 6988318 - DNA, 22 bp, Homo sapiens
tgggggtggttcttgcctccag

SEQ ID NO: 6988319 - DNA, 22 bp, Homo sapiens
tagtaaaagtttagttgaaagt

SEQ ID NO: 6988320 - DNA, 19 bp, Homo sapiens
aatgtctctatctgttctc

SEQ ID NO: 6988321 - DNA, 22 bp, Homo sapiens
cagctgtggctgccactgctcc

SEQ ID NO: 6988322 - DNA, 22 bp, Homo sapiens
tctgagggttcttggtagttgg

SEQ ID NO: 6988323 - DNA, 22 bp, Homo sapiens
tctgactttggacagtggcgaa

SEQ ID NO: 6988324 - DNA, 22 bp, Homo sapiens
ctctgagctcctaggtaaaact

SEQ ID NO: 6988325 - DNA, 19 bp, Homo sapiens
gctgcagagtattcttggg

SEQ ID NO: 6988326 - DNA, 22 bp, Homo sapiens
ttctagattgacagagagcaca

SEQ ID NO: 6988327 - DNA, 22 bp, Homo sapiens
gaggcagcttagggtactgact

SEQ ID NO: 6988328 - DNA, 22 bp, Homo sapiens
aactagaacctgcattttaaca

SEQ ID NO: 6988329 - DNA, 22 bp, Homo sapiens
aaattgctaaattgtaagaggg

SEQ ID NO: 6988330 - DNA, 22 bp, Homo sapiens
gctggccttctgcagagttctg

SEQ ID NO: 6988331 - DNA, 22 bp, Homo sapiens
tattaacattttatgaaaataa

SEQ ID NO: 6988332 - DNA, 23 bp, Homo sapiens
aagggtccatagctatcattaca

SEQ ID NO: 6988333 - DNA, 22 bp, Homo sapiens
tatgtttctgggcttgatattt

SEQ ID NO: 6988334 - DNA, 22 bp, Homo sapiens
agaattctcttccattgaaaca

SEQ ID NO: 6988335 - DNA, 22 bp, Homo sapiens
gatgaaaaattgctgtgtcata

SEQ ID NO: 6988336 - DNA, 22 bp, Homo sapiens
agtggtgctgcgcgcggagctc

SEQ ID NO: 6988337 - DNA, 22 bp, Homo sapiens
cacataatcaccaagtcctttc

SEQ ID NO: 6988338 - DNA, 22 bp, Homo sapiens
tgcaggaactcgaaaactatag

SEQ ID NO: 6988339 - DNA, 22 bp, Homo sapiens
tggggaagaataatgtatgtac

SEQ ID NO: 6988340 - DNA, 22 bp, Homo sapiens
atccacaggagggtttggaaaa

SEQ ID NO: 6988341 - DNA, 22 bp, Homo sapiens
tctgggttcttgatgctacctt

SEQ ID NO: 6988342 - DNA, 22 bp, Homo sapiens
ttgaaagaactcttcagagata

SEQ ID NO: 6988343 - DNA, 22 bp, Homo sapiens
agtgcaaattatttacctgatt

SEQ ID NO: 6988344 - DNA, 22 bp, Homo sapiens
tatttctgggagttcagaaatt

SEQ ID NO: 6988345 - DNA, 22 bp, Homo sapiens
cagcacctctgggtcttgtctt

SEQ ID NO: 6988346 - DNA, 18 bp, Homo sapiens
cagcaggtagagtttggt

SEQ ID NO: 6988347 - DNA, 22 bp, Homo sapiens
ccccttctgtgtcctgtcagcc

SEQ ID NO: 6988348 - DNA, 22 bp, Homo sapiens
tgtcctagagtacattccactg

SEQ ID NO: 6988349 - DNA, 22 bp, Homo sapiens
tttgtaagcaaaaagtccattc

SEQ ID NO: 6988350 - DNA, 22 bp, Homo sapiens
ggctcttgttcgtaccatggct

SEQ ID NO: 6988351 - DNA, 21 bp, Homo sapiens
actgatattaaccttataaca

SEQ ID NO: 6988352 - DNA, 23 bp, Homo sapiens
ttatgctttggcactcttgttag

SEQ ID NO: 6988353 - DNA, 18 bp, Homo sapiens
cctaatatgaggggtcct

SEQ ID NO: 6988354 - DNA, 22 bp, Homo sapiens
accttgggcaagttggaaactg

SEQ ID NO: 6988355 - DNA, 22 bp, Homo sapiens
aacatgctatgtgtctgaatca

SEQ ID NO: 6988356 - DNA, 22 bp, Homo sapiens
ctcatttatttctcccaaaaca

SEQ ID NO: 6988357 - DNA, 16 bp, Homo sapiens
gacctcagtgctggct

SEQ ID NO: 6988358 - DNA, 22 bp, Homo sapiens
ccttctgatactgacatcattt

SEQ ID NO: 6988359 - DNA, 22 bp, Homo sapiens
gcaaggaagagcaggtggtgct

SEQ ID NO: 6988360 - DNA, 22 bp, Homo sapiens
ctactcttttgagtcttcagat

SEQ ID NO: 6988361 - DNA, 22 bp, Homo sapiens
atgtcacaggcaacaagattgc

SEQ ID NO: 6988362 - DNA, 22 bp, Homo sapiens
aacatttatggtagtcattgca

SEQ ID NO: 6988363 - DNA, 22 bp, Homo sapiens
tggggacacagagccaaactat

SEQ ID NO: 6988364 - DNA, 22 bp, Homo sapiens
tcaatgatatcagcaggatgtg

SEQ ID NO: 6988365 - DNA, 23 bp, Homo sapiens
tccaagaagtagggcctggactt

SEQ ID NO: 6988366 - DNA, 20 bp, Homo sapiens
tcatattgatgtagagcagc

SEQ ID NO: 6988367 - DNA, 22 bp, Homo sapiens
ttgggacatgtaagctggaagt

SEQ ID NO: 6988368 - DNA, 22 bp, Homo sapiens
gtttagcaataaaaacacatga

SEQ ID NO: 6988369 - DNA, 22 bp, Homo sapiens
gtatggatcacctgaggtcagc

SEQ ID NO: 6988370 - DNA, 19 bp, Homo sapiens
ggatgagggtcaggcatag

SEQ ID NO: 6988371 - DNA, 23 bp, Homo sapiens
tctggctgtaatatgaaagttag

SEQ ID NO: 6988372 - DNA, 22 bp, Homo sapiens
atgagggcagctatgtaagtgt

SEQ ID NO: 6988373 - DNA, 22 bp, Homo sapiens
tagtaaatacacagtggaaaaa

SEQ ID NO: 6988374 - DNA, 22 bp, Homo sapiens
gaagttgtaagcctgggaaggt

SEQ ID NO: 6988375 - DNA, 23 bp, Homo sapiens
agcctggcacctgcagatcggag

SEQ ID NO: 6988376 - DNA, 19 bp, Homo sapiens
tttgccttgcagctgtgtg

SEQ ID NO: 6988377 - DNA, 22 bp, Homo sapiens
ccaccagaaagactctgtgtga

SEQ ID NO: 6988378 - DNA, 22 bp, Homo sapiens
ccaatactctttctccctgtgt

SEQ ID NO: 6988379 - DNA, 22 bp, Homo sapiens
attggaaataggccttgtacag

SEQ ID NO: 6988380 - DNA, 22 bp, Homo sapiens
gcagggtacattgggatgggat

SEQ ID NO: 6988381 - DNA, 22 bp, Homo sapiens
tgaaatgtacataaaaacgcac

SEQ ID NO: 6988382 - DNA, 22 bp, Homo sapiens
gctgcctacgcttgagccctgg

SEQ ID NO: 6988383 - DNA, 22 bp, Homo sapiens
gagaattcttcaacaaagtatt

SEQ ID NO: 6988384 - DNA, 22 bp, Homo sapiens
gcatttattatctgccaggcac

SEQ ID NO: 6988385 - DNA, 22 bp, Homo sapiens
aaagatcagtctgaagcaacat

SEQ ID NO: 6988386 - DNA, 21 bp, Homo sapiens
tatctactggtgtctttcaga

SEQ ID NO: 6988387 - DNA, 22 bp, Homo sapiens
gctccaggtgtcccaggtaaaa

SEQ ID NO: 6988388 - DNA, 22 bp, Homo sapiens
aatgttttctgactgctaactt

SEQ ID NO: 6988389 - DNA, 23 bp, Homo sapiens
agggctgaatgcagagaagcaga

SEQ ID NO: 6988390 - DNA, 19 bp, Homo sapiens
tgctagaaattctgtgact

SEQ ID NO: 6988391 - DNA, 22 bp, Homo sapiens
catctgtctgctgttagctgca

SEQ ID NO: 6988392 - DNA, 22 bp, Homo sapiens
cctggagggcagcccattctgg

SEQ ID NO: 6988393 - DNA, 20 bp, Homo sapiens
tcagagaaggagctttcctg

SEQ ID NO: 6988394 - DNA, 22 bp, Homo sapiens
atttagacaacaagccttctcc

SEQ ID NO: 6988395 - DNA, 22 bp, Homo sapiens
ccagggcatgggaagaactgaa

SEQ ID NO: 6988396 - DNA, 22 bp, Homo sapiens
tctttcattctagtctgaggtt

SEQ ID NO: 6988397 - DNA, 22 bp, Homo sapiens
atgctgtccattaactaggatg

SEQ ID NO: 6988398 - DNA, 22 bp, Homo sapiens
aagaatgagctcaaagatctta

SEQ ID NO: 6988399 - DNA, 22 bp, Homo sapiens
ttcaagcagggattggtgatgg

SEQ ID NO: 6988400 - DNA, 19 bp, Homo sapiens
gaagtcctctagtaaattt

SEQ ID NO: 6988401 - DNA, 22 bp, Homo sapiens
ggcagccccatcagagacgctg

SEQ ID NO: 6988402 - DNA, 22 bp, Homo sapiens
ttcatgtgataaatgtgtgact

SEQ ID NO: 6988403 - DNA, 22 bp, Homo sapiens
cagggaagaatagttagcaaag

SEQ ID NO: 6988404 - DNA, 22 bp, Homo sapiens
aagagctgtatgccatatgatt

SEQ ID NO: 6988405 - DNA, 22 bp, Homo sapiens
caagtccaggtgggcaaataaa

SEQ ID NO: 6988406 - DNA, 22 bp, Homo sapiens
aggaagcctggcattaaaaagc

SEQ ID NO: 6988407 - DNA, 22 bp, Homo sapiens
atgactcagaagatattttcca

SEQ ID NO: 6988408 - DNA, 22 bp, Homo sapiens
catgctactgaacaagtccatg

SEQ ID NO: 6988409 - DNA, 20 bp, Homo sapiens
tgtaggaaggaccctgtctg

SEQ ID NO: 6988410 - DNA, 22 bp, Homo sapiens
ctggcctaggaatggttttccg

SEQ ID NO: 6988411 - DNA, 22 bp, Homo sapiens
tgggccactgagggtggtcatt

SEQ ID NO: 6988412 - DNA, 22 bp, Homo sapiens
ctacaaagtaccacagactggg

SEQ ID NO: 6988413 - DNA, 22 bp, Homo sapiens
gctgaggattgaagagttgcca

SEQ ID NO: 6988414 - DNA, 22 bp, Homo sapiens
cttgtaaactttctaggcctat

SEQ ID NO: 6988415 - DNA, 22 bp, Homo sapiens
acccatggtctggtggggccct

SEQ ID NO: 6988416 - DNA, 22 bp, Homo sapiens
atgctgagaaacagacgtgttg

SEQ ID NO: 6988417 - DNA, 22 bp, Homo sapiens
cagggacagggatcatttgctt

SEQ ID NO: 6988418 - DNA, 22 bp, Homo sapiens
agggctgcaatgggagataact

SEQ ID NO: 6988419 - DNA, 22 bp, Homo sapiens
ttactagtatatgtcaagcaac

SEQ ID NO: 6988420 - DNA, 22 bp, Homo sapiens
tgtatgctttccaaaaatgctg

SEQ ID NO: 6988421 - DNA, 22 bp, Homo sapiens
ctctgagggtctaaggagtcac

SEQ ID NO: 6988422 - DNA, 22 bp, Homo sapiens
tccagactgttcacattggcat

SEQ ID NO: 6988423 - DNA, 22 bp, Homo sapiens
tcagaggccttggttatggtat

SEQ ID NO: 6988424 - DNA, 22 bp, Homo sapiens
cctgcctggcacatagtactct

SEQ ID NO: 6988425 - DNA, 22 bp, Homo sapiens
ccaggaaaataccaagctttaa

SEQ ID NO: 6988426 - DNA, 22 bp, Homo sapiens
tctgtaaacaccatgttagagt

SEQ ID NO: 6988427 - DNA, 20 bp, Homo sapiens
cacctggatatgacccagct

SEQ ID NO: 6988428 - DNA, 22 bp, Homo sapiens
gttacaaaggaagcttcactgc

SEQ ID NO: 6988429 - DNA, 22 bp, Homo sapiens
attcagtaggtctagaataaga

SEQ ID NO: 6988430 - DNA, 22 bp, Homo sapiens
ccaggcacttgtttgccaggca

SEQ ID NO: 6988431 - DNA, 20 bp, Homo sapiens
gggcagtggcgctatctcag

SEQ ID NO: 6988432 - DNA, 22 bp, Homo sapiens
ttgcagctgttactgatagata

SEQ ID NO: 6988433 - DNA, 22 bp, Homo sapiens
agaagagcctggggaccatggc

SEQ ID NO: 6988434 - DNA, 22 bp, Homo sapiens
tagaatctttaaaattcatagt

SEQ ID NO: 6988435 - DNA, 16 bp, Homo sapiens
ccaggaggctgacacc

SEQ ID NO: 6988436 - DNA, 22 bp, Homo sapiens
agtcttcagcatagcatatggc

SEQ ID NO: 6988437 - DNA, 22 bp, Homo sapiens
tcataagattgaaacttggaag

SEQ ID NO: 6988438 - DNA, 18 bp, Homo sapiens
cccagtgctcactgcctc

SEQ ID NO: 6988439 - DNA, 22 bp, Homo sapiens
tagtagcagggggtacctctca

SEQ ID NO: 6988440 - DNA, 22 bp, Homo sapiens
tcacagctctgtcaattttata

SEQ ID NO: 6988441 - DNA, 22 bp, Homo sapiens
gtgctgccggcatagcagtgaa

SEQ ID NO: 6988442 - DNA, 22 bp, Homo sapiens
tgtcaagtgattagccataatg

SEQ ID NO: 6988443 - DNA, 21 bp, Homo sapiens
tgcacagccataccctccttg

SEQ ID NO: 6988444 - DNA, 22 bp, Homo sapiens
tatgttctaggaatggttgatg

SEQ ID NO: 6988445 - DNA, 22 bp, Homo sapiens
tgatgcatcattttcataaatt

SEQ ID NO: 6988446 - DNA, 22 bp, Homo sapiens
ccccagccttccatgggaattg

SEQ ID NO: 6988447 - DNA, 22 bp, Homo sapiens
atgttcccagcactgagtaaca

SEQ ID NO: 6988448 - DNA, 21 bp, Homo sapiens
ccagaggcctctcttggccac

SEQ ID NO: 6988449 - DNA, 22 bp, Homo sapiens
gacatcatgtcactaactgcta

SEQ ID NO: 6988450 - DNA, 22 bp, Homo sapiens
gctggctgcctggttatgcctt

SEQ ID NO: 6988451 - DNA, 22 bp, Homo sapiens
taattcagggccagaatcccca

SEQ ID NO: 6988452 - DNA, 17 bp, Homo sapiens
ttatctactgctactgt

SEQ ID NO: 6988453 - DNA, 22 bp, Homo sapiens
ctctaagtgttcctttatctat

SEQ ID NO: 6988454 - DNA, 22 bp, Homo sapiens
ctattattatgttaactggact

SEQ ID NO: 6988455 - DNA, 22 bp, Homo sapiens
tcaggaggcggtgctgcctttg

SEQ ID NO: 6988456 - DNA, 22 bp, Homo sapiens
ctgtctgccaataatctatggc

SEQ ID NO: 6988457 - DNA, 22 bp, Homo sapiens
ctcttaattaagctgagatctg

SEQ ID NO: 6988458 - DNA, 22 bp, Homo sapiens
tgtacaaagccagaactcccaa

SEQ ID NO: 6988459 - DNA, 22 bp, Homo sapiens
cctccagctgcctcagtctctt

SEQ ID NO: 6988460 - DNA, 22 bp, Homo sapiens
cccagggctgtagaatgtccaa

SEQ ID NO: 6988461 - DNA, 22 bp, Homo sapiens
aggcaggccctctggaaaggta

SEQ ID NO: 6988462 - DNA, 22 bp, Homo sapiens
tcagggaggtgtctgccagaga

SEQ ID NO: 6988463 - DNA, 22 bp, Homo sapiens
cagcgctgtgggaacagggcta

SEQ ID NO: 6988464 - DNA, 22 bp, Homo sapiens
cagcatcaacattctcagctct

SEQ ID NO: 6988465 - DNA, 19 bp, Homo sapiens
acttctgaggaactgcaca

SEQ ID NO: 6988466 - DNA, 22 bp, Homo sapiens
agcttcttcttggtctttccca

SEQ ID NO: 6988467 - DNA, 22 bp, Homo sapiens
cttcaaggcttattccagttgt

SEQ ID NO: 6988468 - DNA, 19 bp, Homo sapiens
catgtgcatgagcacagga

SEQ ID NO: 6988469 - DNA, 22 bp, Homo sapiens
ggagcagccacgtctcagggca

SEQ ID NO: 6988470 - DNA, 22 bp, Homo sapiens
atcctgtgagggagcatagtta

SEQ ID NO: 6988471 - DNA, 22 bp, Homo sapiens
ccgatgctgcgctggtggatgt

SEQ ID NO: 6988472 - DNA, 22 bp, Homo sapiens
tagtgcttctaccctaggcagg

SEQ ID NO: 6988473 - DNA, 22 bp, Homo sapiens
aggaattggcacggccttctca

SEQ ID NO: 6988474 - DNA, 22 bp, Homo sapiens
aacaggaccccgcgtggtgtct

SEQ ID NO: 6988475 - DNA, 22 bp, Homo sapiens
gtggtgaagcattgagaagtca

SEQ ID NO: 6988476 - DNA, 22 bp, Homo sapiens
aactacagaatcatagaaaata

SEQ ID NO: 6988477 - DNA, 18 bp, Homo sapiens
ctctagaatgggagattt

SEQ ID NO: 6988478 - DNA, 22 bp, Homo sapiens
gacaagattaaccatagttaag

SEQ ID NO: 6988479 - DNA, 22 bp, Homo sapiens
ttctcagtgaagtttagaacat

SEQ ID NO: 6988480 - DNA, 22 bp, Homo sapiens
tcctggcctccgttctctgcat

SEQ ID NO: 6988481 - DNA, 20 bp, Homo sapiens
tcctagcttctctctgtaca

SEQ ID NO: 6988482 - DNA, 23 bp, Homo sapiens
attcagaattgtgtgtttgtata

SEQ ID NO: 6988483 - DNA, 22 bp, Homo sapiens
tagaaacagcatatattagccc

SEQ ID NO: 6988484 - DNA, 22 bp, Homo sapiens
ctgccaaggctggggaggacaa

SEQ ID NO: 6988485 - DNA, 23 bp, Homo sapiens
gctaagaacctgggtacgcaact

SEQ ID NO: 6988486 - DNA, 22 bp, Homo sapiens
gagctaggatatcatgagggta

SEQ ID NO: 6988487 - DNA, 22 bp, Homo sapiens
aaatgataccgaaactgcccgg

SEQ ID NO: 6988488 - DNA, 22 bp, Homo sapiens
gaaaggctcagaagtttgtatt

SEQ ID NO: 6988489 - DNA, 22 bp, Homo sapiens
tggccaggcaggtagaacggcc

SEQ ID NO: 6988490 - DNA, 22 bp, Homo sapiens
aaggaggaatttcagggtgaat

SEQ ID NO: 6988491 - DNA, 22 bp, Homo sapiens
cactggttgcctctttctgttc

SEQ ID NO: 6988492 - DNA, 22 bp, Homo sapiens
aagtggagctataggctcagat

SEQ ID NO: 6988493 - DNA, 22 bp, Homo sapiens
tatgcatatgtgttcattggag

SEQ ID NO: 6988494 - DNA, 22 bp, Homo sapiens
ggtcctgaggggagctgaaggt

SEQ ID NO: 6988495 - DNA, 22 bp, Homo sapiens
ccctaagaagcaaagtgatacc

SEQ ID NO: 6988496 - DNA, 22 bp, Homo sapiens
agaataaatcaaatgtcctgag

SEQ ID NO: 6988497 - DNA, 22 bp, Homo sapiens
cctgtgggctgagaacaagggc

SEQ ID NO: 6988498 - DNA, 22 bp, Homo sapiens
caccaggggcagagaccaaagt

SEQ ID NO: 6988499 - DNA, 22 bp, Homo sapiens
ggcttcttcctggctcctatta

SEQ ID NO: 6988500 - DNA, 22 bp, Homo sapiens
acgtgtgtgacattgggaacgt

SEQ ID NO: 6988501 - DNA, 22 bp, Homo sapiens
gcctcatcgctgctcggcccgg

SEQ ID NO: 6988502 - DNA, 22 bp, Homo sapiens
tatactgagtgtgttaatgatg

SEQ ID NO: 6988503 - DNA, 22 bp, Homo sapiens
gtggctctggctttccaggcgg

SEQ ID NO: 6988504 - DNA, 22 bp, Homo sapiens
cctgaggctcgcgcgcccctgg

SEQ ID NO: 6988505 - DNA, 22 bp, Homo sapiens
ttcatgaaattctcgtgtacct

SEQ ID NO: 6988506 - DNA, 19 bp, Homo sapiens
gcatccatggaggccgctt

SEQ ID NO: 6988507 - DNA, 22 bp, Homo sapiens
tgggtactcctattagttcagt

SEQ ID NO: 6988508 - DNA, 22 bp, Homo sapiens
tgaactgtacatccctaaccta

SEQ ID NO: 6988509 - DNA, 23 bp, Homo sapiens
tatgagaacccatacgctgtctt

SEQ ID NO: 6988510 - DNA, 22 bp, Homo sapiens
catattaaggtctgtaaggggt

SEQ ID NO: 6988511 - DNA, 22 bp, Homo sapiens
actctgaggagtgactagaggt

SEQ ID NO: 6988512 - DNA, 22 bp, Homo sapiens
aaagcactggagtcatcatcta

SEQ ID NO: 6988513 - DNA, 22 bp, Homo sapiens
ctgacacccagcagaactggga

SEQ ID NO: 6988514 - DNA, 22 bp, Homo sapiens
gggcttaaggtgcaaagtcata

SEQ ID NO: 6988515 - DNA, 22 bp, Homo sapiens
gagcttttcttccagttaatga

SEQ ID NO: 6988516 - DNA, 22 bp, Homo sapiens
actgagcactcacttttgttat

SEQ ID NO: 6988517 - DNA, 22 bp, Homo sapiens
ctgaaggacttggtgatagttg

SEQ ID NO: 6988518 - DNA, 22 bp, Homo sapiens
aaatttgttcaatgtctatttg

SEQ ID NO: 6988519 - DNA, 22 bp, Homo sapiens
gtccctctcaaatttatatgct

SEQ ID NO: 6988520 - DNA, 23 bp, Homo sapiens
tgagaccctaatttagcaagtgt

SEQ ID NO: 6988521 - DNA, 23 bp, Homo sapiens
attctgagtcagaaagtttgggg

SEQ ID NO: 6988522 - DNA, 22 bp, Homo sapiens
atgttgtactgagaattaggag

SEQ ID NO: 6988523 - DNA, 22 bp, Homo sapiens
atggtctgctgagtcatgaggc

SEQ ID NO: 6988524 - DNA, 22 bp, Homo sapiens
tagtgcattcatctgatcctgt

SEQ ID NO: 6988525 - DNA, 23 bp, Homo sapiens
aatgagcttcattcttggaagac

SEQ ID NO: 6988526 - DNA, 22 bp, Homo sapiens
ccaggagtttgaggctgcagtg

SEQ ID NO: 6988527 - DNA, 22 bp, Homo sapiens
taccatttacttgaaaataaaa

SEQ ID NO: 6988528 - DNA, 22 bp, Homo sapiens
cataagaatattccatcctttg

SEQ ID NO: 6988529 - DNA, 23 bp, Homo sapiens
atttcccattgtgtcagcagagc

SEQ ID NO: 6988530 - DNA, 22 bp, Homo sapiens
ccccagcaggaatacaggggtc

SEQ ID NO: 6988531 - DNA, 22 bp, Homo sapiens
tcattgcagcttcaggtgttca

SEQ ID NO: 6988532 - DNA, 22 bp, Homo sapiens
ctcctagatgtcttcagagaaa

SEQ ID NO: 6988533 - DNA, 22 bp, Homo sapiens
gccctagcgccagctcagcacc

SEQ ID NO: 6988534 - DNA, 22 bp, Homo sapiens
ctctgatttatattataaagtg

SEQ ID NO: 6988535 - DNA, 22 bp, Homo sapiens
ctgcagtctacctggattttta

SEQ ID NO: 6988536 - DNA, 22 bp, Homo sapiens
tcagtttttaagagttatgcga

SEQ ID NO: 6988537 - DNA, 22 bp, Homo sapiens
ctgtgtccatgttctaatttgg

SEQ ID NO: 6988538 - DNA, 22 bp, Homo sapiens
gccaaagtcctccagccatgca

SEQ ID NO: 6988539 - DNA, 22 bp, Homo sapiens
agccatcgccgcaggcatctgc

SEQ ID NO: 6988540 - DNA, 23 bp, Homo sapiens
atcccacttcccttatagtttct

SEQ ID NO: 6988541 - DNA, 22 bp, Homo sapiens
ctctggagatggttctcaattg

SEQ ID NO: 6988542 - DNA, 19 bp, Homo sapiens
tttcaggagctatgcaggg

SEQ ID NO: 6988543 - DNA, 20 bp, Homo sapiens
tcttccagcttctggtagaa

SEQ ID NO: 6988544 - DNA, 22 bp, Homo sapiens
aggctgctgaggccaccacgct

SEQ ID NO: 6988545 - DNA, 22 bp, Homo sapiens
tacactggacaggagtaggaag

SEQ ID NO: 6988546 - DNA, 22 bp, Homo sapiens
tggatttagttcttcacaggcc

SEQ ID NO: 6988547 - DNA, 22 bp, Homo sapiens
ggcaggagctcaggttggttcc

SEQ ID NO: 6988548 - DNA, 22 bp, Homo sapiens
gtacatttactgatgaaaagta

SEQ ID NO: 6988549 - DNA, 16 bp, Homo sapiens
ttgagaaatgaagttt

SEQ ID NO: 6988550 - DNA, 22 bp, Homo sapiens
ctgaggtggcctctgccgggga

SEQ ID NO: 6988551 - DNA, 22 bp, Homo sapiens
acatgtcaatttagtactctta

SEQ ID NO: 6988552 - DNA, 22 bp, Homo sapiens
atgtgtgcatgttagagagagt

SEQ ID NO: 6988553 - DNA, 22 bp, Homo sapiens
caaaggcaatcttgttctctgg

SEQ ID NO: 6988554 - DNA, 22 bp, Homo sapiens
cctgcacagttctttttgccaa

SEQ ID NO: 6988555 - DNA, 22 bp, Homo sapiens
aacaggggtgggtgctactgga

SEQ ID NO: 6988556 - DNA, 18 bp, Homo sapiens
ttttggtgaggaagtgag

SEQ ID NO: 6988557 - DNA, 22 bp, Homo sapiens
ctgtgatgttagctctgtgtta

SEQ ID NO: 6988558 - DNA, 21 bp, Homo sapiens
tggaggaataaagcacagaag

SEQ ID NO: 6988559 - DNA, 22 bp, Homo sapiens
gtctggaaccaatatttgaggg

SEQ ID NO: 6988560 - DNA, 22 bp, Homo sapiens
agcccggcttccccggttgcta

SEQ ID NO: 6988561 - DNA, 22 bp, Homo sapiens
gtctggagtggggcctgagaat

SEQ ID NO: 6988562 - DNA, 22 bp, Homo sapiens
agaatgtgttattagagaagga

SEQ ID NO: 6988563 - DNA, 22 bp, Homo sapiens
gagctttgatcgctaagcctca

SEQ ID NO: 6988564 - DNA, 22 bp, Homo sapiens
cagcacaggaagtgggccttca

SEQ ID NO: 6988565 - DNA, 22 bp, Homo sapiens
gctcaggcaccatatgatgtgt

SEQ ID NO: 6988566 - DNA, 22 bp, Homo sapiens
ataaactttagcggaaggagga

SEQ ID NO: 6988567 - DNA, 21 bp, Homo sapiens
ggcagcctctgtggaagggga

SEQ ID NO: 6988568 - DNA, 22 bp, Homo sapiens
aatcttcataaaaatctagtag

SEQ ID NO: 6988569 - DNA, 22 bp, Homo sapiens
gcaaggaacaaatgctctgctt

SEQ ID NO: 6988570 - DNA, 22 bp, Homo sapiens
gatgatgggcgctgtttactgg

SEQ ID NO: 6988571 - DNA, 22 bp, Homo sapiens
ggagaaaattgatgaagttggc

SEQ ID NO: 6988572 - DNA, 22 bp, Homo sapiens
gaaggccagttttgagataggt

SEQ ID NO: 6988573 - DNA, 22 bp, Homo sapiens
ctgcccggagctggcaaaggct

SEQ ID NO: 6988574 - DNA, 20 bp, Homo sapiens
tcaaaataggtgtgggcgga

SEQ ID NO: 6988575 - DNA, 22 bp, Homo sapiens
ccagggagggtcctgtggcttc

SEQ ID NO: 6988576 - DNA, 22 bp, Homo sapiens
aacgtcctcacctgtaacttgg

SEQ ID NO: 6988577 - DNA, 21 bp, Homo sapiens
agctgaggtaaggcaagagag

SEQ ID NO: 6988578 - DNA, 22 bp, Homo sapiens
ctctgagatgcttgaagaggat

SEQ ID NO: 6988579 - DNA, 22 bp, Homo sapiens
gtccttgaagccatttcagggc

SEQ ID NO: 6988580 - DNA, 22 bp, Homo sapiens
agccacctctatcttgggctcc

SEQ ID NO: 6988581 - DNA, 22 bp, Homo sapiens
aagacatttatgaaaagtgctg

SEQ ID NO: 6988582 - DNA, 22 bp, Homo sapiens
gagcgatgtgggtatgtagaag

SEQ ID NO: 6988583 - DNA, 22 bp, Homo sapiens
tgttgcagagctggggagggtg

SEQ ID NO: 6988584 - DNA, 22 bp, Homo sapiens
tgccaggccacgtagcttcaag

SEQ ID NO: 6988585 - DNA, 22 bp, Homo sapiens
aggaggataagttagttgggta

SEQ ID NO: 6988586 - DNA, 22 bp, Homo sapiens
gctggcagtgtgaatgacaagc

SEQ ID NO: 6988587 - DNA, 22 bp, Homo sapiens
tttgccaggtaagtactatgct

SEQ ID NO: 6988588 - DNA, 22 bp, Homo sapiens
catgagataatttttctccagt

SEQ ID NO: 6988589 - DNA, 22 bp, Homo sapiens
gagaggccctgtggtcccagct

SEQ ID NO: 6988590 - DNA, 22 bp, Homo sapiens
gccaggtctgcaggcatcctga

SEQ ID NO: 6988591 - DNA, 22 bp, Homo sapiens
ggaaatctcttttgtggtgttt

SEQ ID NO: 6988592 - DNA, 22 bp, Homo sapiens
attcaccatggaccaggggcct

SEQ ID NO: 6988593 - DNA, 22 bp, Homo sapiens
tgatcaaaacattactccacca

SEQ ID NO: 6988594 - DNA, 18 bp, Homo sapiens
aaatgtactgtccatggc

SEQ ID NO: 6988595 - DNA, 22 bp, Homo sapiens
tttctcagagcacggggagtga

SEQ ID NO: 6988596 - DNA, 22 bp, Homo sapiens
ctcccaggactggctctaactg

SEQ ID NO: 6988597 - DNA, 22 bp, Homo sapiens
tcagaatctaaataggctccag

SEQ ID NO: 6988598 - DNA, 19 bp, Homo sapiens
gcaggaaatgagtgattgc

SEQ ID NO: 6988599 - DNA, 22 bp, Homo sapiens
cagtttcttagtgacacaaatc

SEQ ID NO: 6988600 - DNA, 22 bp, Homo sapiens
ttcatgcactatttcttctagc

SEQ ID NO: 6988601 - DNA, 22 bp, Homo sapiens
tccatccagattttaagtgctg

SEQ ID NO: 6988602 - DNA, 22 bp, Homo sapiens
aatgggaggtagtatgggaggt

SEQ ID NO: 6988603 - DNA, 22 bp, Homo sapiens
caatctgttagaaatgcagaca

SEQ ID NO: 6988604 - DNA, 22 bp, Homo sapiens
tgaatgtatggtcctgtgaatt

SEQ ID NO: 6988605 - DNA, 22 bp, Homo sapiens
cagaaaacaaacctatcctgag

SEQ ID NO: 6988606 - DNA, 20 bp, Homo sapiens
tttctcagaacagtggctgc

SEQ ID NO: 6988607 - DNA, 22 bp, Homo sapiens
ctcagatgtttgatattgttat

SEQ ID NO: 6988608 - DNA, 22 bp, Homo sapiens
gtttcaatttgacccaaatctt

SEQ ID NO: 6988609 - DNA, 22 bp, Homo sapiens
tttgaagttggagatgggagat

SEQ ID NO: 6988610 - DNA, 22 bp, Homo sapiens
ttggtcagatgtgtctcctcct

SEQ ID NO: 6988611 - DNA, 22 bp, Homo sapiens
gatgtctgtctgagccgctgga

SEQ ID NO: 6988612 - DNA, 22 bp, Homo sapiens
aatgttgacagtggtgatctca

SEQ ID NO: 6988613 - DNA, 22 bp, Homo sapiens
gtaaatcagtgtcattttagaa

SEQ ID NO: 6988614 - DNA, 22 bp, Homo sapiens
tcataggctcctctgcttctgc

SEQ ID NO: 6988615 - DNA, 22 bp, Homo sapiens
ttacagtttctagtaatacttg

SEQ ID NO: 6988616 - DNA, 22 bp, Homo sapiens
ggtaggagtgaagacttaagat

SEQ ID NO: 6988617 - DNA, 22 bp, Homo sapiens
gctgggctccaggccagggtga

SEQ ID NO: 6988618 - DNA, 22 bp, Homo sapiens
tttacaagaaatcatgatgcta

SEQ ID NO: 6988619 - DNA, 22 bp, Homo sapiens
gtgaaggccagtagggtcctgg

SEQ ID NO: 6988620 - DNA, 22 bp, Homo sapiens
catggcttagaagttccagccc

SEQ ID NO: 6988621 - DNA, 18 bp, Homo sapiens
gcttcctgaaagctgccc

SEQ ID NO: 6988622 - DNA, 22 bp, Homo sapiens
aatgcaatgcagcacctccttg

SEQ ID NO: 6988623 - DNA, 22 bp, Homo sapiens
cctgggtctcctcctgctggct

SEQ ID NO: 6988624 - DNA, 22 bp, Homo sapiens
ctgccgtgtttttcatgttaaa

SEQ ID NO: 6988625 - DNA, 23 bp, Homo sapiens
catatgaattttagaggcagttt

SEQ ID NO: 6988626 - DNA, 22 bp, Homo sapiens
ggtctcatgtcctatgtgctta

SEQ ID NO: 6988627 - DNA, 22 bp, Homo sapiens
atgggctgacccagtcgtggca

SEQ ID NO: 6988628 - DNA, 22 bp, Homo sapiens
cagaggtaccagcagcctctgg

SEQ ID NO: 6988629 - DNA, 22 bp, Homo sapiens
tcctgtgaccagcttccatgct

SEQ ID NO: 6988630 - DNA, 22 bp, Homo sapiens
tcggtacctacatcctctcgac

SEQ ID NO: 6988631 - DNA, 22 bp, Homo sapiens
ctgccattggattttcacattt

SEQ ID NO: 6988632 - DNA, 17 bp, Homo sapiens
ttctgcatgtgaagatg

SEQ ID NO: 6988633 - DNA, 22 bp, Homo sapiens
tcctggctaacacggtgacacc

SEQ ID NO: 6988634 - DNA, 22 bp, Homo sapiens
atagcagaaaccaagcttcttc

SEQ ID NO: 6988635 - DNA, 19 bp, Homo sapiens
gttcaaacactgattcagc

SEQ ID NO: 6988636 - DNA, 22 bp, Homo sapiens
agacatcctgtgtgcgtgagta

SEQ ID NO: 6988637 - DNA, 22 bp, Homo sapiens
tcagctggggccccctctgtcc

SEQ ID NO: 6988638 - DNA, 22 bp, Homo sapiens
acaatgctgcagggaaattagg

SEQ ID NO: 6988639 - DNA, 20 bp, Homo sapiens
gataaattgtctcttaagtg

SEQ ID NO: 6988640 - DNA, 22 bp, Homo sapiens
tcagccttgtggccctgctcca

SEQ ID NO: 6988641 - DNA, 22 bp, Homo sapiens
ctgggagaggaacctcgagggt

SEQ ID NO: 6988642 - DNA, 22 bp, Homo sapiens
tgggcctggagccctggagagt

SEQ ID NO: 6988643 - DNA, 22 bp, Homo sapiens
gctggcacctatttggacctgg

SEQ ID NO: 6988644 - DNA, 22 bp, Homo sapiens
cgcgctcatttccgcctccttc

SEQ ID NO: 6988645 - DNA, 22 bp, Homo sapiens
gctgtgttgggaatcatgtggg

SEQ ID NO: 6988646 - DNA, 22 bp, Homo sapiens
ttacccacctttctcatgccaa

SEQ ID NO: 6988647 - DNA, 21 bp, Homo sapiens
gcctttggtttcttgtcctgc

SEQ ID NO: 6988648 - DNA, 22 bp, Homo sapiens
tacctggagcaggaggcagaat

SEQ ID NO: 6988649 - DNA, 19 bp, Homo sapiens
tgcctcagggctttgagga

SEQ ID NO: 6988650 - DNA, 22 bp, Homo sapiens
gctgtgaagaacctagtgaacc

SEQ ID NO: 6988651 - DNA, 22 bp, Homo sapiens
gaaaagagtcctgtgtgaggag

SEQ ID NO: 6988652 - DNA, 22 bp, Homo sapiens
catgaatacggatgctcggaga

SEQ ID NO: 6988653 - DNA, 22 bp, Homo sapiens
gtacaaatgagagttctgtttt

SEQ ID NO: 6988654 - DNA, 22 bp, Homo sapiens
ttctgaaataggagatagctgt

SEQ ID NO: 6988655 - DNA, 22 bp, Homo sapiens
tcaaacagaaattgttcatgct

SEQ ID NO: 6988656 - DNA, 22 bp, Homo sapiens
gacatttaggtagcttccagtt

SEQ ID NO: 6988657 - DNA, 22 bp, Homo sapiens
ttgtcattggggttatttgtta

SEQ ID NO: 6988658 - DNA, 22 bp, Homo sapiens
taaactcttctgtagaatcaga

SEQ ID NO: 6988659 - DNA, 22 bp, Homo sapiens
ttccagcaggcagacaggagat

SEQ ID NO: 6988660 - DNA, 22 bp, Homo sapiens
tggagagcacagttcctgcttc

SEQ ID NO: 6988661 - DNA, 19 bp, Homo sapiens
taactctttccttttcccc

SEQ ID NO: 6988662 - DNA, 22 bp, Homo sapiens
ttagttcatagaatgtaacagg

SEQ ID NO: 6988663 - DNA, 22 bp, Homo sapiens
gaaggccattgcgtcctgggat

SEQ ID NO: 6988664 - DNA, 22 bp, Homo sapiens
attgaaagattttgggctcatg

SEQ ID NO: 6988665 - DNA, 22 bp, Homo sapiens
cttgcagatgtgactaaattaa

SEQ ID NO: 6988666 - DNA, 22 bp, Homo sapiens
ctgggagtgtccctctggtaat

SEQ ID NO: 6988667 - DNA, 22 bp, Homo sapiens
tctggctgctgcgtgagtgctt

SEQ ID NO: 6988668 - DNA, 22 bp, Homo sapiens
ctttggctgcattcgagttgct

SEQ ID NO: 6988669 - DNA, 17 bp, Homo sapiens
ccagtgcctgtggcaac

SEQ ID NO: 6988670 - DNA, 22 bp, Homo sapiens
taggggaattgcagtgtgtcca

SEQ ID NO: 6988671 - DNA, 22 bp, Homo sapiens
caggagatgtaagacttctgtt

SEQ ID NO: 6988672 - DNA, 22 bp, Homo sapiens
tctctgaggcaggatgcgtagg

SEQ ID NO: 6988673 - DNA, 22 bp, Homo sapiens
gcagagtctggtaggtgctggt

SEQ ID NO: 6988674 - DNA, 22 bp, Homo sapiens
cagtatttcattcagaattgtt

SEQ ID NO: 6988675 - DNA, 22 bp, Homo sapiens
ccagatgtatgtatgagtgcat

SEQ ID NO: 6988676 - DNA, 18 bp, Homo sapiens
tctcctgggtaggggcct

SEQ ID NO: 6988677 - DNA, 22 bp, Homo sapiens
ttccactcctcctggtggggtg

SEQ ID NO: 6988678 - DNA, 22 bp, Homo sapiens
ttcttgcctgccctgtgtcgta

SEQ ID NO: 6988679 - DNA, 22 bp, Homo sapiens
ctcacaggtcatgtggtggctt

SEQ ID NO: 6988680 - DNA, 22 bp, Homo sapiens
agggacagttacatcatcagac

SEQ ID NO: 6988681 - DNA, 22 bp, Homo sapiens
acagaaagaccttgtaacactt

SEQ ID NO: 6988682 - DNA, 22 bp, Homo sapiens
actagataattataaaaggtag

SEQ ID NO: 6988683 - DNA, 22 bp, Homo sapiens
tacatgaagatgaatgtatggc

SEQ ID NO: 6988684 - DNA, 22 bp, Homo sapiens
aaagatgttttacatagcacct

SEQ ID NO: 6988685 - DNA, 22 bp, Homo sapiens
ccatggagcacctcacagaggc

SEQ ID NO: 6988686 - DNA, 22 bp, Homo sapiens
tatcagcgtgcaaatctttgga

SEQ ID NO: 6988687 - DNA, 22 bp, Homo sapiens
ttaaggcattgatatggtgcta

SEQ ID NO: 6988688 - DNA, 22 bp, Homo sapiens
tgtgaagagtagacatgtggtg

SEQ ID NO: 6988689 - DNA, 22 bp, Homo sapiens
tgctccaccctcacactcttcc

SEQ ID NO: 6988690 - DNA, 22 bp, Homo sapiens
cattgcactcctgcctgggcaa

SEQ ID NO: 6988691 - DNA, 22 bp, Homo sapiens
ggtctctggccttggagattga

SEQ ID NO: 6988692 - DNA, 22 bp, Homo sapiens
cagtttaggtcatccttgcttt

SEQ ID NO: 6988693 - DNA, 22 bp, Homo sapiens
tatcagatatagcattcactgg

SEQ ID NO: 6988694 - DNA, 22 bp, Homo sapiens
ctgccttttaaagccagtgtta

SEQ ID NO: 6988695 - DNA, 22 bp, Homo sapiens
agcatacaaacatttgaggcag

SEQ ID NO: 6988696 - DNA, 22 bp, Homo sapiens
agtgactcactagctctcagtg

SEQ ID NO: 6988697 - DNA, 22 bp, Homo sapiens
ctattgtttctatgctctgagg

SEQ ID NO: 6988698 - DNA, 22 bp, Homo sapiens
tctgaaatgcaaatttgactga

SEQ ID NO: 6988699 - DNA, 22 bp, Homo sapiens
acaatgaagctccactgagctt

SEQ ID NO: 6988700 - DNA, 22 bp, Homo sapiens
aagtcactggaggaactctact

SEQ ID NO: 6988701 - DNA, 23 bp, Homo sapiens
ttgaggcaaactcttttctgaaa

SEQ ID NO: 6988702 - DNA, 18 bp, Homo sapiens
tagaatcaaatattttac

SEQ ID NO: 6988703 - DNA, 22 bp, Homo sapiens
ggcccacactgacagctgagct

SEQ ID NO: 6988704 - DNA, 22 bp, Homo sapiens
atataagtgtgtggctgttagt

SEQ ID NO: 6988705 - DNA, 22 bp, Homo sapiens
gcagggacctatgacgatggaa

SEQ ID NO: 6988706 - DNA, 22 bp, Homo sapiens
tctgtgctaggcagcctggccc

SEQ ID NO: 6988707 - DNA, 22 bp, Homo sapiens
atagagatgggtttagttataa

SEQ ID NO: 6988708 - DNA, 22 bp, Homo sapiens
gcagggctgactcagccaccct

SEQ ID NO: 6988709 - DNA, 22 bp, Homo sapiens
gcctcaaatgtggagcactatt

SEQ ID NO: 6988710 - DNA, 22 bp, Homo sapiens
gggtggaagccagagaggtcat

SEQ ID NO: 6988711 - DNA, 22 bp, Homo sapiens
tgagggaatcctcacatcaatc

SEQ ID NO: 6988712 - DNA, 22 bp, Homo sapiens
tgggagtgcacctgggacacga

SEQ ID NO: 6988713 - DNA, 22 bp, Homo sapiens
cctgccagaaaagagggagttc

SEQ ID NO: 6988714 - DNA, 22 bp, Homo sapiens
ctgggcacagaccccctgggcc

SEQ ID NO: 6988715 - DNA, 22 bp, Homo sapiens
cttagcagaagcttcagcttca

SEQ ID NO: 6988716 - DNA, 22 bp, Homo sapiens
cacaggaaatattaggagggat

SEQ ID NO: 6988717 - DNA, 19 bp, Homo sapiens
aagccagctgccagctcgg

SEQ ID NO: 6988718 - DNA, 22 bp, Homo sapiens
gtggtgagttcaggctggggtg

SEQ ID NO: 6988719 - DNA, 22 bp, Homo sapiens
tgttttatttctccaagaggga

SEQ ID NO: 6988720 - DNA, 17 bp, Homo sapiens
agcacctgtccagtccc

SEQ ID NO: 6988721 - DNA, 22 bp, Homo sapiens
agcttgtcacagacgtcaggca

SEQ ID NO: 6988722 - DNA, 22 bp, Homo sapiens
ttctagacaaatgtgttcattc

SEQ ID NO: 6988723 - DNA, 18 bp, Homo sapiens
ttacactagccttggttc

SEQ ID NO: 6988724 - DNA, 22 bp, Homo sapiens
tttgtacactgtctactatgaa

SEQ ID NO: 6988725 - DNA, 22 bp, Homo sapiens
gtgggcctttcaggcgatctgg

SEQ ID NO: 6988726 - DNA, 22 bp, Homo sapiens
gtaatgataagcagccattcac

SEQ ID NO: 6988727 - DNA, 23 bp, Homo sapiens
tgtatacaccctgtgcatctggg

SEQ ID NO: 6988728 - DNA, 22 bp, Homo sapiens
tggatcctgcactgagtggagt

SEQ ID NO: 6988729 - DNA, 22 bp, Homo sapiens
atgtcaccagtttccaaatttg

SEQ ID NO: 6988730 - DNA, 22 bp, Homo sapiens
tgtaagtgctcagctgatggtt

SEQ ID NO: 6988731 - DNA, 22 bp, Homo sapiens
atgaaagtagggtaaaatcaca

SEQ ID NO: 6988732 - DNA, 19 bp, Homo sapiens
attcacatccctgggaagg

SEQ ID NO: 6988733 - DNA, 22 bp, Homo sapiens
tgtcactgtgctctgttcattt

SEQ ID NO: 6988734 - DNA, 18 bp, Homo sapiens
agattttgagaaatacaa

SEQ ID NO: 6988735 - DNA, 22 bp, Homo sapiens
aacattctttagctcttcctgc

SEQ ID NO: 6988736 - DNA, 22 bp, Homo sapiens
agggtccatgtttccagttaat

SEQ ID NO: 6988737 - DNA, 22 bp, Homo sapiens
tacagataaattttaagtagaa

SEQ ID NO: 6988738 - DNA, 22 bp, Homo sapiens
ccagcagctgcaaagcctgggt

SEQ ID NO: 6988739 - DNA, 22 bp, Homo sapiens
tgctgcacttatggctctgagg

SEQ ID NO: 6988740 - DNA, 22 bp, Homo sapiens
tctgccttgatggcattgagaa

SEQ ID NO: 6988741 - DNA, 22 bp, Homo sapiens
cactgcaagctccgcctcccgg

SEQ ID NO: 6988742 - DNA, 22 bp, Homo sapiens
ttgactgttgctgccattctgg

SEQ ID NO: 6988743 - DNA, 22 bp, Homo sapiens
aactttctggctttggggagag

SEQ ID NO: 6988744 - DNA, 22 bp, Homo sapiens
actggctgtgtaacctcaggca

SEQ ID NO: 6988745 - DNA, 22 bp, Homo sapiens
tattcctaatttgcagggcatg

SEQ ID NO: 6988746 - DNA, 22 bp, Homo sapiens
tcccccaactcttagcactgta

SEQ ID NO: 6988747 - DNA, 22 bp, Homo sapiens
ggaaggctcgaggatgcttctg

SEQ ID NO: 6988748 - DNA, 22 bp, Homo sapiens
cattacatctttgatgcagtat

SEQ ID NO: 6988749 - DNA, 22 bp, Homo sapiens
aaagcagggaaatctatttgca

SEQ ID NO: 6988750 - DNA, 22 bp, Homo sapiens
aatagcaaagttatcaaattaa

SEQ ID NO: 6988751 - DNA, 19 bp, Homo sapiens
tgctaatcaagaaaacctt

SEQ ID NO: 6988752 - DNA, 22 bp, Homo sapiens
ctcaggacccaccttattagga

SEQ ID NO: 6988753 - DNA, 22 bp, Homo sapiens
tggtgccacaagaatacaaagc

SEQ ID NO: 6988754 - DNA, 22 bp, Homo sapiens
agcatataggaaatgttgaatc

SEQ ID NO: 6988755 - DNA, 21 bp, Homo sapiens
tctgtctctccactgccctgc

SEQ ID NO: 6988756 - DNA, 22 bp, Homo sapiens
ttcctcatctgtgcacctcact

SEQ ID NO: 6988757 - DNA, 22 bp, Homo sapiens
tcttccaggagggtgggcaaac

SEQ ID NO: 6988758 - DNA, 20 bp, Homo sapiens
acaatttcctcactatatgc

SEQ ID NO: 6988759 - DNA, 22 bp, Homo sapiens
tgtctttgtgtacaggatcgcc

SEQ ID NO: 6988760 - DNA, 22 bp, Homo sapiens
ccaagccgcggctcctcctgcg

SEQ ID NO: 6988761 - DNA, 20 bp, Homo sapiens
agggttcccttgttcagcag

SEQ ID NO: 6988762 - DNA, 22 bp, Homo sapiens
tttcaaactttactcttgaatc

SEQ ID NO: 6988763 - DNA, 22 bp, Homo sapiens
cagttccatcttcatctttccc

SEQ ID NO: 6988764 - DNA, 22 bp, Homo sapiens
gtgcttcccattagaactgtga

SEQ ID NO: 6988765 - DNA, 22 bp, Homo sapiens
tctctcagatggggcactagta

SEQ ID NO: 6988766 - DNA, 22 bp, Homo sapiens
gagtgatgtctgtagtgaagaa

SEQ ID NO: 6988767 - DNA, 22 bp, Homo sapiens
ttccagcttgacttctacttaa

SEQ ID NO: 6988768 - DNA, 22 bp, Homo sapiens
gtggcttcttcttgggagctgc

SEQ ID NO: 6988769 - DNA, 22 bp, Homo sapiens
aaacagagggccactgaggctc

SEQ ID NO: 6988770 - DNA, 21 bp, Homo sapiens
aactgcaaatcttagactgca

SEQ ID NO: 6988771 - DNA, 22 bp, Homo sapiens
attgaactaaataagcagtcat

SEQ ID NO: 6988772 - DNA, 22 bp, Homo sapiens
tatgtagcaatagcatcatact

SEQ ID NO: 6988773 - DNA, 22 bp, Homo sapiens
ttcgctgggagtggccaggcac

SEQ ID NO: 6988774 - DNA, 22 bp, Homo sapiens
ggaagaggctgaggccatgctg

SEQ ID NO: 6988775 - DNA, 22 bp, Homo sapiens
tgtctaagggaagatgcaatgt

SEQ ID NO: 6988776 - DNA, 21 bp, Homo sapiens
tcagcaggcaccagaaggctg

SEQ ID NO: 6988777 - DNA, 22 bp, Homo sapiens
tttggaataatcagatcctagt

SEQ ID NO: 6988778 - DNA, 22 bp, Homo sapiens
tgttggaattaggatacagagg

SEQ ID NO: 6988779 - DNA, 20 bp, Homo sapiens
tctgtgcacctgctacaagg

SEQ ID NO: 6988780 - DNA, 22 bp, Homo sapiens
tgaagtatacggaaattgtgga

SEQ ID NO: 6988781 - DNA, 22 bp, Homo sapiens
cttcagaagaaaagcagtgtgt

SEQ ID NO: 6988782 - DNA, 22 bp, Homo sapiens
tattcttgactgcttactatgt

SEQ ID NO: 6988783 - DNA, 22 bp, Homo sapiens
tggcctcaagtctgagggcctt

SEQ ID NO: 6988784 - DNA, 22 bp, Homo sapiens
atttccagtacccagaacagag

SEQ ID NO: 6988785 - DNA, 22 bp, Homo sapiens
aatccacgggattattctaact

SEQ ID NO: 6988786 - DNA, 19 bp, Homo sapiens
tggctattccttggacaca

SEQ ID NO: 6988787 - DNA, 22 bp, Homo sapiens
tgggtgggagcaccctgtctgg

SEQ ID NO: 6988788 - DNA, 22 bp, Homo sapiens
aattatgcaaccaatgaccacg

SEQ ID NO: 6988789 - DNA, 22 bp, Homo sapiens
gcctcctattaaaatttacctt

SEQ ID NO: 6988790 - DNA, 22 bp, Homo sapiens
gctagcagaaagcaggctgctc

SEQ ID NO: 6988791 - DNA, 18 bp, Homo sapiens
tggagccattgccaccat

SEQ ID NO: 6988792 - DNA, 22 bp, Homo sapiens
gctcagggagcgatttaccatg

SEQ ID NO: 6988793 - DNA, 22 bp, Homo sapiens
ccaggcccgttcccttctccag

SEQ ID NO: 6988794 - DNA, 20 bp, Homo sapiens
tggcaggactggctccaccc

SEQ ID NO: 6988795 - DNA, 23 bp, Homo sapiens
ctggactcaggggatgtgaagga

SEQ ID NO: 6988796 - DNA, 22 bp, Homo sapiens
tgtttgtccccatccctcagca

SEQ ID NO: 6988797 - DNA, 22 bp, Homo sapiens
gcaggcttatggggagacagag

SEQ ID NO: 6988798 - DNA, 22 bp, Homo sapiens
atgccttaaggcgagatactta

SEQ ID NO: 6988799 - DNA, 22 bp, Homo sapiens
ctccagtcatagcctcttgagt

SEQ ID NO: 6988800 - DNA, 22 bp, Homo sapiens
gcctggcaatggcctcaggaag

SEQ ID NO: 6988801 - DNA, 22 bp, Homo sapiens
tcactgaaagaatgacattatg

SEQ ID NO: 6988802 - DNA, 22 bp, Homo sapiens
gttcttcaggccatcctcccag

SEQ ID NO: 6988803 - DNA, 22 bp, Homo sapiens
tgagctgcagtgagctgagatg

SEQ ID NO: 6988804 - DNA, 22 bp, Homo sapiens
ctggtaaagaagacaaacaggg

SEQ ID NO: 6988805 - DNA, 22 bp, Homo sapiens
tatgtgaagagattaaaaaata

SEQ ID NO: 6988806 - DNA, 22 bp, Homo sapiens
tagtccaggttaatccctgcct

SEQ ID NO: 6988807 - DNA, 22 bp, Homo sapiens
tgatttccacgtgcacccaggt

SEQ ID NO: 6988808 - DNA, 22 bp, Homo sapiens
gagtgactctagaaagtttctt

SEQ ID NO: 6988809 - DNA, 22 bp, Homo sapiens
aaagacttggcttatgatttgc

SEQ ID NO: 6988810 - DNA, 18 bp, Homo sapiens
tagcagcactggccgctt

SEQ ID NO: 6988811 - DNA, 22 bp, Homo sapiens
attagctttggattcagaagat

SEQ ID NO: 6988812 - DNA, 22 bp, Homo sapiens
ctggcagcagttatgaaacaat

SEQ ID NO: 6988813 - DNA, 19 bp, Homo sapiens
cctatggcaggatggaggc

SEQ ID NO: 6988814 - DNA, 22 bp, Homo sapiens
tccctcagagggcaagcgcaga

SEQ ID NO: 6988815 - DNA, 22 bp, Homo sapiens
atgctgacttctctctgcagtg

SEQ ID NO: 6988816 - DNA, 22 bp, Homo sapiens
gaattgctagcgcaccaattct

SEQ ID NO: 6988817 - DNA, 21 bp, Homo sapiens
ggaaagaaggcaaggctcagg

SEQ ID NO: 6988818 - DNA, 22 bp, Homo sapiens
ttcttctgttgaaagggtagag

SEQ ID NO: 6988819 - DNA, 22 bp, Homo sapiens
tgcgtggctggtccctgtgacc

SEQ ID NO: 6988820 - DNA, 22 bp, Homo sapiens
tgatacagaattgatatctgag

SEQ ID NO: 6988821 - DNA, 22 bp, Homo sapiens
aggcaaccctggtgagcagatg

SEQ ID NO: 6988822 - DNA, 22 bp, Homo sapiens
tcatctcagggcgacatcatgt

SEQ ID NO: 6988823 - DNA, 22 bp, Homo sapiens
tcatgcagagccagtcaggata

SEQ ID NO: 6988824 - DNA, 22 bp, Homo sapiens
agagcacagaagaataggtgct

SEQ ID NO: 6988825 - DNA, 22 bp, Homo sapiens
ttctagactgtgtacagattca

SEQ ID NO: 6988826 - DNA, 22 bp, Homo sapiens
aattactgggtctgagattaat

SEQ ID NO: 6988827 - DNA, 22 bp, Homo sapiens
aaaattctaacatgcagccaag

SEQ ID NO: 6988828 - DNA, 22 bp, Homo sapiens
gtgattaagcatttcagaattt

SEQ ID NO: 6988829 - DNA, 22 bp, Homo sapiens
aacaatctgttcgatagaaaat

SEQ ID NO: 6988830 - DNA, 22 bp, Homo sapiens
ctggaagggtctacttagcaga

SEQ ID NO: 6988831 - DNA, 22 bp, Homo sapiens
ctgccctggccactgtgcccag

SEQ ID NO: 6988832 - DNA, 22 bp, Homo sapiens
gtcatattggctccacttcctc

SEQ ID NO: 6988833 - DNA, 22 bp, Homo sapiens
cctcccacttcttgctgaggtc

SEQ ID NO: 6988834 - DNA, 22 bp, Homo sapiens
caggcagctcaaccttgggagc

SEQ ID NO: 6988835 - DNA, 22 bp, Homo sapiens
aagtagtgtgctccagcggtga

SEQ ID NO: 6988836 - DNA, 22 bp, Homo sapiens
tctaaatgtcagtacagaatga

SEQ ID NO: 6988837 - DNA, 22 bp, Homo sapiens
tggaaaacatgcacattggatt

SEQ ID NO: 6988838 - DNA, 22 bp, Homo sapiens
gttgttcttctcatccagcttg

SEQ ID NO: 6988839 - DNA, 22 bp, Homo sapiens
aactcttaaaattttggcttgc

SEQ ID NO: 6988840 - DNA, 19 bp, Homo sapiens
tgaggcaagatggctctgg

SEQ ID NO: 6988841 - DNA, 23 bp, Homo sapiens
ttctttcaagaagttcacagtgc

SEQ ID NO: 6988842 - DNA, 22 bp, Homo sapiens
tttggtccattatatgctgtca

SEQ ID NO: 6988843 - DNA, 22 bp, Homo sapiens
ctcattgttgggctttgctgga

SEQ ID NO: 6988844 - DNA, 22 bp, Homo sapiens
tgctgccttctaggcgtgccct

SEQ ID NO: 6988845 - DNA, 22 bp, Homo sapiens
tttcatattattccttgagtct

SEQ ID NO: 6988846 - DNA, 22 bp, Homo sapiens
ctattgaggacataaggactct

SEQ ID NO: 6988847 - DNA, 23 bp, Homo sapiens
aataatgtcttgtgctctcactt

SEQ ID NO: 6988848 - DNA, 20 bp, Homo sapiens
agctggccaattctattact

SEQ ID NO: 6988849 - DNA, 22 bp, Homo sapiens
acctgaattttaatccttgctc

SEQ ID NO: 6988850 - DNA, 22 bp, Homo sapiens
atgccagtgttataaatagata

SEQ ID NO: 6988851 - DNA, 17 bp, Homo sapiens
tcttcgggcgctaggta

SEQ ID NO: 6988852 - DNA, 22 bp, Homo sapiens
caggttctggggctccactgtg

SEQ ID NO: 6988853 - DNA, 22 bp, Homo sapiens
aaggaagaagggaagttactta

SEQ ID NO: 6988854 - DNA, 22 bp, Homo sapiens
aatcctggctgcgttggccagc

SEQ ID NO: 6988855 - DNA, 22 bp, Homo sapiens
gcagcatgagctatacaaagta

SEQ ID NO: 6988856 - DNA, 22 bp, Homo sapiens
ataaaggcagagtagggaggaa

SEQ ID NO: 6988857 - DNA, 22 bp, Homo sapiens
gctctatgaatcacacgagggt

SEQ ID NO: 6988858 - DNA, 23 bp, Homo sapiens
atctaaagtgttaaatagctggg

SEQ ID NO: 6988859 - DNA, 22 bp, Homo sapiens
ctacattttaataagctgctta

SEQ ID NO: 6988860 - DNA, 22 bp, Homo sapiens
gtgagtctgcctagcacatcac

SEQ ID NO: 6988861 - DNA, 22 bp, Homo sapiens
aaccagatattatgaccatgga

SEQ ID NO: 6988862 - DNA, 22 bp, Homo sapiens
tgtaatcccagctactcgggag

SEQ ID NO: 6988863 - DNA, 22 bp, Homo sapiens
gggtcacttttgctatgttggc

SEQ ID NO: 6988864 - DNA, 22 bp, Homo sapiens
aggtctgatatttgttgtatga

SEQ ID NO: 6988865 - DNA, 22 bp, Homo sapiens
gcttctattactactttgagat

SEQ ID NO: 6988866 - DNA, 22 bp, Homo sapiens
aggcaaagcgataccagagcta

SEQ ID NO: 6988867 - DNA, 22 bp, Homo sapiens
ggtgctgatgttattgatgctg

SEQ ID NO: 6988868 - DNA, 22 bp, Homo sapiens
cagggcagtaccgccctctggc

SEQ ID NO: 6988869 - DNA, 22 bp, Homo sapiens
gctgggctcgttcccacacgcg

SEQ ID NO: 6988870 - DNA, 22 bp, Homo sapiens
atgaggcaggagtgcagtggca

SEQ ID NO: 6988871 - DNA, 22 bp, Homo sapiens
cagctcctcagccctgccttgg

SEQ ID NO: 6988872 - DNA, 22 bp, Homo sapiens
tatgtgcatgctgacttgagga

SEQ ID NO: 6988873 - DNA, 14 bp, Homo sapiens
ggctaaggggacag

SEQ ID NO: 6988874 - DNA, 22 bp, Homo sapiens
tggaggggcaatggagcgcgga

SEQ ID NO: 6988875 - DNA, 22 bp, Homo sapiens
tggcgagctttgttctccagga

SEQ ID NO: 6988876 - DNA, 17 bp, Homo sapiens
cacatgtctacatggat

SEQ ID NO: 6988877 - DNA, 23 bp, Homo sapiens
tggcagctgtgtaagagaaagca

SEQ ID NO: 6988878 - DNA, 16 bp, Homo sapiens
gggggtgagagagagt

SEQ ID NO: 6988879 - DNA, 22 bp, Homo sapiens
atgcatgtcagctgtgcccatg

SEQ ID NO: 6988880 - DNA, 22 bp, Homo sapiens
ttcccaggaagcctctccaagc

SEQ ID NO: 6988881 - DNA, 23 bp, Homo sapiens
agcttcattattttccatgatct

SEQ ID NO: 6988882 - DNA, 23 bp, Homo sapiens
ggccatttcatttggttcaaact

SEQ ID NO: 6988883 - DNA, 22 bp, Homo sapiens
gtggatctactgtatgggatag

SEQ ID NO: 6988884 - DNA, 22 bp, Homo sapiens
atgtctttgctgtgtgctgggc

SEQ ID NO: 6988885 - DNA, 22 bp, Homo sapiens
ttcactataaagtttcaacttt

SEQ ID NO: 6988886 - DNA, 22 bp, Homo sapiens
aatgcacctaccttgattctgc

SEQ ID NO: 6988887 - DNA, 22 bp, Homo sapiens
gggtatgatagggaggtgaaat

SEQ ID NO: 6988888 - DNA, 22 bp, Homo sapiens
tcactttacctcattcaggcag

SEQ ID NO: 6988889 - DNA, 22 bp, Homo sapiens
ctttgcttctccaacctgctca

SEQ ID NO: 6988890 - DNA, 22 bp, Homo sapiens
gacctgctccacgacaagtggt

SEQ ID NO: 6988891 - DNA, 22 bp, Homo sapiens
ggcagctttggattcgcggctg

SEQ ID NO: 6988892 - DNA, 22 bp, Homo sapiens
gaggcctcatgaggtgagcatt

SEQ ID NO: 6988893 - DNA, 22 bp, Homo sapiens
caggccctgccttggcatgtgt

SEQ ID NO: 6988894 - DNA, 22 bp, Homo sapiens
ggcaagttgctattctttaatg

SEQ ID NO: 6988895 - DNA, 22 bp, Homo sapiens
cataattataaacgcaagttca

SEQ ID NO: 6988896 - DNA, 22 bp, Homo sapiens
ccacactccccgcaggcgtagg

SEQ ID NO: 6988897 - DNA, 21 bp, Homo sapiens
ctctggagtttgaaggctggg

SEQ ID NO: 6988898 - DNA, 22 bp, Homo sapiens
tatgtcacattgtaacagtgtg

SEQ ID NO: 6988899 - DNA, 22 bp, Homo sapiens
gcttccagcaaacactggctgc

SEQ ID NO: 6988900 - DNA, 23 bp, Homo sapiens
attattaaggacatggactttgt

SEQ ID NO: 6988901 - DNA, 22 bp, Homo sapiens
agcaagctgttcttggagagta

SEQ ID NO: 6988902 - DNA, 22 bp, Homo sapiens
gaggggcgctgtcgggtcacct

SEQ ID NO: 6988903 - DNA, 22 bp, Homo sapiens
gagtcctttgttccttgccaca

SEQ ID NO: 6988904 - DNA, 22 bp, Homo sapiens
gtttgttagaagagcagaatct

SEQ ID NO: 6988905 - DNA, 22 bp, Homo sapiens
tctttgtaactgtctattgaga

SEQ ID NO: 6988906 - DNA, 22 bp, Homo sapiens
gccttactgagggcaattttga

SEQ ID NO: 6988907 - DNA, 21 bp, Homo sapiens
tccaagtctggggcatgtgtg

SEQ ID NO: 6988908 - DNA, 22 bp, Homo sapiens
aagctgggagggagcccagagt

SEQ ID NO: 6988909 - DNA, 22 bp, Homo sapiens
tgggtagagtgctgacaatgcc

SEQ ID NO: 6988910 - DNA, 22 bp, Homo sapiens
ccaccattcaaggtcttcacag

SEQ ID NO: 6988911 - DNA, 22 bp, Homo sapiens
ggcaggcaggtcttcatggccc

SEQ ID NO: 6988912 - DNA, 22 bp, Homo sapiens
gctattgtacatttcttgtttg

SEQ ID NO: 6988913 - DNA, 22 bp, Homo sapiens
cacttactgtttattgactggc

SEQ ID NO: 6988914 - DNA, 19 bp, Homo sapiens
ctgggcttgatgttgagtt

SEQ ID NO: 6988915 - DNA, 22 bp, Homo sapiens
tgcctccattcctgggtcattg

SEQ ID NO: 6988916 - DNA, 22 bp, Homo sapiens
tcttaatgctagccaatagaga

SEQ ID NO: 6988917 - DNA, 22 bp, Homo sapiens
gagacagcttaattggtggtca

SEQ ID NO: 6988918 - DNA, 22 bp, Homo sapiens
ggcaaacagacttgaccatctt

SEQ ID NO: 6988919 - DNA, 22 bp, Homo sapiens
atttctgtggcttcattctcct

SEQ ID NO: 6988920 - DNA, 22 bp, Homo sapiens
gaactattcattctcattagcg

SEQ ID NO: 6988921 - DNA, 22 bp, Homo sapiens
gtccagctccagggaggcaggc

SEQ ID NO: 6988922 - DNA, 19 bp, Homo sapiens
agtcttcatctgccaggcc

SEQ ID NO: 6988923 - DNA, 23 bp, Homo sapiens
tgctggctgaaacagccaaagga

SEQ ID NO: 6988924 - DNA, 22 bp, Homo sapiens
agaagtgctccagtgagttggg

SEQ ID NO: 6988925 - DNA, 22 bp, Homo sapiens
atgttttatattttgcagcagt

SEQ ID NO: 6988926 - DNA, 22 bp, Homo sapiens
ctgctgggtttgcctttcacca

SEQ ID NO: 6988927 - DNA, 22 bp, Homo sapiens
gcagatgcagagatggctgggg

SEQ ID NO: 6988928 - DNA, 22 bp, Homo sapiens
aaagtttgaatgatatattagt

SEQ ID NO: 6988929 - DNA, 23 bp, Homo sapiens
gtgcatgtgtctttacagtagca

SEQ ID NO: 6988930 - DNA, 22 bp, Homo sapiens
aaggcctttgccccgatacagg

SEQ ID NO: 6988931 - DNA, 22 bp, Homo sapiens
cacatctagcttacaaaacagg

SEQ ID NO: 6988932 - DNA, 21 bp, Homo sapiens
aaaaagctggggcatgcatgc

SEQ ID NO: 6988933 - DNA, 22 bp, Homo sapiens
atggcacacaggtctgcaaggg

SEQ ID NO: 6988934 - DNA, 22 bp, Homo sapiens
atatacactcaccatggtattt

SEQ ID NO: 6988935 - DNA, 22 bp, Homo sapiens
tgcacagacatacacatatatg

SEQ ID NO: 6988936 - DNA, 22 bp, Homo sapiens
tcctaaggcaccagcttcctgt

SEQ ID NO: 6988937 - DNA, 22 bp, Homo sapiens
gctcatgggcccagagcagccc

SEQ ID NO: 6988938 - DNA, 22 bp, Homo sapiens
gtgagcaggataggggctccct

SEQ ID NO: 6988939 - DNA, 22 bp, Homo sapiens
attcacatttacaaagcactca

SEQ ID NO: 6988940 - DNA, 22 bp, Homo sapiens
tgctgcctggagccttttgttt

SEQ ID NO: 6988941 - DNA, 22 bp, Homo sapiens
tgaaaagtcttatattgtctga

SEQ ID NO: 6988942 - DNA, 22 bp, Homo sapiens
ttgccattaaaacatgttatct

SEQ ID NO: 6988943 - DNA, 22 bp, Homo sapiens
gtggcacagtctgaaattttga

SEQ ID NO: 6988944 - DNA, 22 bp, Homo sapiens
atgggccaggcttgggatgaca

SEQ ID NO: 6988945 - DNA, 22 bp, Homo sapiens
atgggacagcatcttggtatta

SEQ ID NO: 6988946 - DNA, 22 bp, Homo sapiens
tgacaaagcctcatccttcaga

SEQ ID NO: 6988947 - DNA, 22 bp, Homo sapiens
aggctgtctcagcctgcttgca

SEQ ID NO: 6988948 - DNA, 22 bp, Homo sapiens
gagcctgtgagccccaactcca

SEQ ID NO: 6988949 - DNA, 22 bp, Homo sapiens
tgaccttttagctgagtcccca

SEQ ID NO: 6988950 - DNA, 22 bp, Homo sapiens
ggcgggcagcgtcttgctggcc

SEQ ID NO: 6988951 - DNA, 22 bp, Homo sapiens
ctggcagcggtttgcagcctgg

SEQ ID NO: 6988952 - DNA, 22 bp, Homo sapiens
gcttcacaggcaagttaagcct

SEQ ID NO: 6988953 - DNA, 22 bp, Homo sapiens
tagtccattaaattagattcaa

SEQ ID NO: 6988954 - DNA, 22 bp, Homo sapiens
agcaacagggtggtcttcagaa

SEQ ID NO: 6988955 - DNA, 22 bp, Homo sapiens
atgtgcccctgttttgaattgt

SEQ ID NO: 6988956 - DNA, 22 bp, Homo sapiens
tttcttctcacccaggacagag

SEQ ID NO: 6988957 - DNA, 21 bp, Homo sapiens
gcagactgccctgctgtcccc

SEQ ID NO: 6988958 - DNA, 22 bp, Homo sapiens
tcacaggaagaggtgtctatct

SEQ ID NO: 6988959 - DNA, 22 bp, Homo sapiens
gagctctgactgctgggtgaca

SEQ ID NO: 6988960 - DNA, 22 bp, Homo sapiens
ggtcccaggttgacagggagac

SEQ ID NO: 6988961 - DNA, 22 bp, Homo sapiens
gtttggcaagaagaggagtaag

SEQ ID NO: 6988962 - DNA, 18 bp, Homo sapiens
tggctgctggagtagggt

SEQ ID NO: 6988963 - DNA, 22 bp, Homo sapiens
gcctgagtaaatatgcggcagg

SEQ ID NO: 6988964 - DNA, 22 bp, Homo sapiens
aaatttctaagtcaagaagaac

SEQ ID NO: 6988965 - DNA, 22 bp, Homo sapiens
cattgcttatctagttcacata

SEQ ID NO: 6988966 - DNA, 22 bp, Homo sapiens
cagtaataggtaacattgccct

SEQ ID NO: 6988967 - DNA, 22 bp, Homo sapiens
aaattagtcatgttgtattact

SEQ ID NO: 6988968 - DNA, 22 bp, Homo sapiens
tgcatttgttcagtgaaatgtt

SEQ ID NO: 6988969 - DNA, 22 bp, Homo sapiens
ctctgcatgccttgctcagaca

SEQ ID NO: 6988970 - DNA, 22 bp, Homo sapiens
agaaactgacaggaaatgaatt

SEQ ID NO: 6988971 - DNA, 22 bp, Homo sapiens
gcacagcctgtccctgtcctgg

SEQ ID NO: 6988972 - DNA, 22 bp, Homo sapiens
ccagatggtatagtagggagag

SEQ ID NO: 6988973 - DNA, 22 bp, Homo sapiens
accagttctactcacctcgccc

SEQ ID NO: 6988974 - DNA, 22 bp, Homo sapiens
tttgctagtacacagctgtttc

SEQ ID NO: 6988975 - DNA, 22 bp, Homo sapiens
agtgtgggggctttggtgtcac

SEQ ID NO: 6988976 - DNA, 22 bp, Homo sapiens
aaatggcactttgacagcctgc

SEQ ID NO: 6988977 - DNA, 23 bp, Homo sapiens
atacatggccggatatgatgttc

SEQ ID NO: 6988978 - DNA, 22 bp, Homo sapiens
aattccagtctctgctctattt

SEQ ID NO: 6988979 - DNA, 22 bp, Homo sapiens
ctgtccttactgcttctggctt

SEQ ID NO: 6988980 - DNA, 22 bp, Homo sapiens
tgattcaaatattgtgtatgat

SEQ ID NO: 6988981 - DNA, 22 bp, Homo sapiens
ccttggggtgttggaggcagcc

SEQ ID NO: 6988982 - DNA, 22 bp, Homo sapiens
gcctggtctctttcatgtcagt

SEQ ID NO: 6988983 - DNA, 22 bp, Homo sapiens
cagctgacctggctaagggagc

SEQ ID NO: 6988984 - DNA, 22 bp, Homo sapiens
caggaatgtgagggttccctgc

SEQ ID NO: 6988985 - DNA, 22 bp, Homo sapiens
ctgtgcatgcgcggagctgaaa

SEQ ID NO: 6988986 - DNA, 22 bp, Homo sapiens
agataatgaatgccatgacatt

SEQ ID NO: 6988987 - DNA, 22 bp, Homo sapiens
ccatgagtagcgatttcatttt

SEQ ID NO: 6988988 - DNA, 22 bp, Homo sapiens
ctgcccactatgttgtcatggg

SEQ ID NO: 6988989 - DNA, 22 bp, Homo sapiens
ctggctgacaaaataaatttta

SEQ ID NO: 6988990 - DNA, 21 bp, Homo sapiens
tgaaagaaggtgcagtctgaa

SEQ ID NO: 6988991 - DNA, 22 bp, Homo sapiens
caggcctgcaggaaaggctccc

SEQ ID NO: 6988992 - DNA, 22 bp, Homo sapiens
gtcaaaacactggggaatgttg

SEQ ID NO: 6988993 - DNA, 22 bp, Homo sapiens
aactttgaggtcactgaattcc

SEQ ID NO: 6988994 - DNA, 22 bp, Homo sapiens
tgctgagcccagaacggcctgg

SEQ ID NO: 6988995 - DNA, 22 bp, Homo sapiens
agccagtgcagctggaaattca

SEQ ID NO: 6988996 - DNA, 22 bp, Homo sapiens
tgcaagagacagacatgactca

SEQ ID NO: 6988997 - DNA, 22 bp, Homo sapiens
tccccagcattgagggtctctc

SEQ ID NO: 6988998 - DNA, 19 bp, Homo sapiens
agcttacctggcaggaatg

SEQ ID NO: 6988999 - DNA, 22 bp, Homo sapiens
accatgctaaaacatgctgcta

SEQ ID NO: 6989000 - DNA, 22 bp, Homo sapiens
tcagtgcagaatagtgatgcat

SEQ ID NO: 6989001 - DNA, 22 bp, Homo sapiens
aatttctcactctcttgatcac

SEQ ID NO: 6989002 - DNA, 22 bp, Homo sapiens
ctcaaagacaaaaatctgaggt

SEQ ID NO: 6989003 - DNA, 22 bp, Homo sapiens
ggacctgagaacgccttggctt

SEQ ID NO: 6989004 - DNA, 22 bp, Homo sapiens
acagaatagttggccctgctat

SEQ ID NO: 6989005 - DNA, 22 bp, Homo sapiens
atgggaggaaggaggcccttga

SEQ ID NO: 6989006 - DNA, 22 bp, Homo sapiens
cggctgggtagaggtgccgggt

SEQ ID NO: 6989007 - DNA, 21 bp, Homo sapiens
aggtccagttctgtcttggac

SEQ ID NO: 6989008 - DNA, 22 bp, Homo sapiens
cctgtaggatattgtagaatac

SEQ ID NO: 6989009 - DNA, 22 bp, Homo sapiens
ttgggccaaggcagatctccaa

SEQ ID NO: 6989010 - DNA, 22 bp, Homo sapiens
ccaggaggttgaggctgcagtg

SEQ ID NO: 6989011 - DNA, 22 bp, Homo sapiens
tactgtttcctgaagcagatgc

SEQ ID NO: 6989012 - DNA, 22 bp, Homo sapiens
tgtcctgtgtctaggggtcttc

SEQ ID NO: 6989013 - DNA, 22 bp, Homo sapiens
tggccctgaatcaaggccagca

SEQ ID NO: 6989014 - DNA, 22 bp, Homo sapiens
tgggggagagtgcaagcatgaa

SEQ ID NO: 6989015 - DNA, 22 bp, Homo sapiens
acctggcacattctaccacagt

SEQ ID NO: 6989016 - DNA, 22 bp, Homo sapiens
ctctgagggctgtcaggaaagg

SEQ ID NO: 6989017 - DNA, 20 bp, Homo sapiens
gtaaaatatggtctttgggt

SEQ ID NO: 6989018 - DNA, 22 bp, Homo sapiens
catgctattttccaataatgta

SEQ ID NO: 6989019 - DNA, 22 bp, Homo sapiens
aggatttatcaggaactctctt

SEQ ID NO: 6989020 - DNA, 22 bp, Homo sapiens
aatgtgtacatgacagatagaa

SEQ ID NO: 6989021 - DNA, 22 bp, Homo sapiens
ctgccctgagggcctgtgtgtt

SEQ ID NO: 6989022 - DNA, 22 bp, Homo sapiens
atcccaagtagcaatcctggta

SEQ ID NO: 6989023 - DNA, 22 bp, Homo sapiens
agggctcccgcggtgtccggga

SEQ ID NO: 6989024 - DNA, 22 bp, Homo sapiens
tgagcccagaagcccactcggc

SEQ ID NO: 6989025 - DNA, 23 bp, Homo sapiens
cttcatgagagccctgaggaaaa

SEQ ID NO: 6989026 - DNA, 22 bp, Homo sapiens
aaactagctcttagtttagagg

SEQ ID NO: 6989027 - DNA, 21 bp, Homo sapiens
atcttcaactgattggaggag

SEQ ID NO: 6989028 - DNA, 22 bp, Homo sapiens
ggtgggacaggtaggagtggct

SEQ ID NO: 6989029 - DNA, 22 bp, Homo sapiens
gctgccaggacggagaggagcg

SEQ ID NO: 6989030 - DNA, 22 bp, Homo sapiens
tctcaggtctcatgccaggcct

SEQ ID NO: 6989031 - DNA, 22 bp, Homo sapiens
ttgcaaatggaggcctggcagc

SEQ ID NO: 6989032 - DNA, 22 bp, Homo sapiens
tttaaatgttcatgatactgaa

SEQ ID NO: 6989033 - DNA, 21 bp, Homo sapiens
accagtttggggggcttcctg

SEQ ID NO: 6989034 - DNA, 22 bp, Homo sapiens
tgttcttacggaacttatcttt

SEQ ID NO: 6989035 - DNA, 22 bp, Homo sapiens
ggcagactttttctctgaaggg

SEQ ID NO: 6989036 - DNA, 22 bp, Homo sapiens
gcatgtggtgggctggccactc

SEQ ID NO: 6989037 - DNA, 22 bp, Homo sapiens
caggggcctgtcctggcttctg

SEQ ID NO: 6989038 - DNA, 22 bp, Homo sapiens
ctctctgaggaaggagcatctg

SEQ ID NO: 6989039 - DNA, 22 bp, Homo sapiens
cttcacattagtttggatcaaa

SEQ ID NO: 6989040 - DNA, 22 bp, Homo sapiens
atttcatccattaagagtactc

SEQ ID NO: 6989041 - DNA, 22 bp, Homo sapiens
taactgcaccatcaaattagag

SEQ ID NO: 6989042 - DNA, 22 bp, Homo sapiens
tgagcagaggagtgacgtaggt

SEQ ID NO: 6989043 - DNA, 22 bp, Homo sapiens
cctaagttgagaagccagtagc

SEQ ID NO: 6989044 - DNA, 22 bp, Homo sapiens
cctctgtgtctccaagaggcct

SEQ ID NO: 6989045 - DNA, 22 bp, Homo sapiens
aaatggaagctatttatgattc

SEQ ID NO: 6989046 - DNA, 22 bp, Homo sapiens
atggaacatcaggttaagaaat

SEQ ID NO: 6989047 - DNA, 22 bp, Homo sapiens
gattcttaagacattatgtatt

SEQ ID NO: 6989048 - DNA, 22 bp, Homo sapiens
tggtctctgagccttcctgtgg

SEQ ID NO: 6989049 - DNA, 22 bp, Homo sapiens
tccttcaagtgcagtacctgag

SEQ ID NO: 6989050 - DNA, 22 bp, Homo sapiens
gtcaacttgcaagatgctgggc

SEQ ID NO: 6989051 - DNA, 22 bp, Homo sapiens
agctccagcccatctgctcgtg

SEQ ID NO: 6989052 - DNA, 22 bp, Homo sapiens
atgttatcttcggaagcaagtg

SEQ ID NO: 6989053 - DNA, 22 bp, Homo sapiens
tttcttcacagggtattgggtg

SEQ ID NO: 6989054 - DNA, 22 bp, Homo sapiens
gaccacagctacaagggcaagg

SEQ ID NO: 6989055 - DNA, 22 bp, Homo sapiens
ccaggccagggctgcagcgagc

SEQ ID NO: 6989056 - DNA, 22 bp, Homo sapiens
gtcatcactggtagcaaagatt

SEQ ID NO: 6989057 - DNA, 22 bp, Homo sapiens
aagtccttaggaagcagtcgtt

SEQ ID NO: 6989058 - DNA, 22 bp, Homo sapiens
tgcagcaaaaggtcagagggag

SEQ ID NO: 6989059 - DNA, 22 bp, Homo sapiens
attcatacaggctttgctctta

SEQ ID NO: 6989060 - DNA, 21 bp, Homo sapiens
gcaaggcaatgccatgatttc

SEQ ID NO: 6989061 - DNA, 19 bp, Homo sapiens
tgaagcgtcgctcctcttc

SEQ ID NO: 6989062 - DNA, 22 bp, Homo sapiens
tattagggttttgaaggtttgt

SEQ ID NO: 6989063 - DNA, 23 bp, Homo sapiens
actctcaggttctttccagcagg

SEQ ID NO: 6989064 - DNA, 19 bp, Homo sapiens
aaagcagtgcatcctcttt

SEQ ID NO: 6989065 - DNA, 22 bp, Homo sapiens
atatacacagagcttatggtga

SEQ ID NO: 6989066 - DNA, 22 bp, Homo sapiens
aggatctcgcctcctgagctat

SEQ ID NO: 6989067 - DNA, 22 bp, Homo sapiens
gggttaaagcaggaagcatctt

SEQ ID NO: 6989068 - DNA, 22 bp, Homo sapiens
gaaccccaacttataagacaga

SEQ ID NO: 6989069 - DNA, 22 bp, Homo sapiens
atcagaaactcttagagcaggg

SEQ ID NO: 6989070 - DNA, 22 bp, Homo sapiens
gttaatatttacctgtcaagaa

SEQ ID NO: 6989071 - DNA, 22 bp, Homo sapiens
ggcgagaagttgttagtggctt

SEQ ID NO: 6989072 - DNA, 22 bp, Homo sapiens
tcctccctgagtggggacagct

SEQ ID NO: 6989073 - DNA, 22 bp, Homo sapiens
agcatccagaaaactctcagaa

SEQ ID NO: 6989074 - DNA, 22 bp, Homo sapiens
cagaggtgacccatagtacctc

SEQ ID NO: 6989075 - DNA, 22 bp, Homo sapiens
aatgacaagacatagtctctga

SEQ ID NO: 6989076 - DNA, 22 bp, Homo sapiens
tactgcaaaccatttacagtag

SEQ ID NO: 6989077 - DNA, 22 bp, Homo sapiens
ctgtggctttggggcggaggac

SEQ ID NO: 6989078 - DNA, 22 bp, Homo sapiens
tttcaaacatatcttcattact

SEQ ID NO: 6989079 - DNA, 20 bp, Homo sapiens
aagtggtcacagtccttggc

SEQ ID NO: 6989080 - DNA, 22 bp, Homo sapiens
agagggccataggtgcatagtt

SEQ ID NO: 6989081 - DNA, 22 bp, Homo sapiens
gtggggctgcttaggctgcgca

SEQ ID NO: 6989082 - DNA, 22 bp, Homo sapiens
tgcatctgtagtggaaacctta

SEQ ID NO: 6989083 - DNA, 22 bp, Homo sapiens
tctgggagttagaatacatggg

SEQ ID NO: 6989084 - DNA, 22 bp, Homo sapiens
tgttctctaagaaaagaagcat

SEQ ID NO: 6989085 - DNA, 22 bp, Homo sapiens
tttagtgcatcagacaccctct

SEQ ID NO: 6989086 - DNA, 22 bp, Homo sapiens
tttgtaaggctaaataatattc

SEQ ID NO: 6989087 - DNA, 22 bp, Homo sapiens
aaatactagaattcagagttga

SEQ ID NO: 6989088 - DNA, 22 bp, Homo sapiens
gggatgccagtcctggccctgc

SEQ ID NO: 6989089 - DNA, 19 bp, Homo sapiens
tatttcaggctcagagtct

SEQ ID NO: 6989090 - DNA, 22 bp, Homo sapiens
attgcttttaagcaccacctaa

SEQ ID NO: 6989091 - DNA, 22 bp, Homo sapiens
tagattctgtgagagtcaaagt

SEQ ID NO: 6989092 - DNA, 22 bp, Homo sapiens
cctggccacccagccttggcca

SEQ ID NO: 6989093 - DNA, 22 bp, Homo sapiens
tgttatcctcagctcacctcta

SEQ ID NO: 6989094 - DNA, 22 bp, Homo sapiens
cagcccagacaccatcattcta

SEQ ID NO: 6989095 - DNA, 22 bp, Homo sapiens
ggtcccaggctgcgggctggtg

SEQ ID NO: 6989096 - DNA, 22 bp, Homo sapiens
gggaaccagccgcttccgcctc

SEQ ID NO: 6989097 - DNA, 22 bp, Homo sapiens
tttctttctcgtaaacttagtt

SEQ ID NO: 6989098 - DNA, 22 bp, Homo sapiens
tcttttctgccagctgagccct

SEQ ID NO: 6989099 - DNA, 18 bp, Homo sapiens
caatagaaacagtaggaa

SEQ ID NO: 6989100 - DNA, 17 bp, Homo sapiens
gggactcaagatggggt

SEQ ID NO: 6989101 - DNA, 22 bp, Homo sapiens
aggaagcaccggaatgatgact

SEQ ID NO: 6989102 - DNA, 22 bp, Homo sapiens
ttagaagcactaattactcaca

SEQ ID NO: 6989103 - DNA, 22 bp, Homo sapiens
tggtccctttctactgagcaca

SEQ ID NO: 6989104 - DNA, 22 bp, Homo sapiens
cctggtttgtatttttaacacc

SEQ ID NO: 6989105 - DNA, 22 bp, Homo sapiens
ttgcggctgcagcagagaatag

SEQ ID NO: 6989106 - DNA, 22 bp, Homo sapiens
ctaaattatttgcacattagag

SEQ ID NO: 6989107 - DNA, 22 bp, Homo sapiens
ctctgtcccagacccacctctc

SEQ ID NO: 6989108 - DNA, 22 bp, Homo sapiens
ctgtgaggcctttggccagata

SEQ ID NO: 6989109 - DNA, 22 bp, Homo sapiens
cagtggcagttagaaaatattc

SEQ ID NO: 6989110 - DNA, 22 bp, Homo sapiens
acagcagcttgtctgttcttta

SEQ ID NO: 6989111 - DNA, 22 bp, Homo sapiens
agccctgtgtgcttgtgttcct

SEQ ID NO: 6989112 - DNA, 22 bp, Homo sapiens
cctgagaagactgtttctttga

SEQ ID NO: 6989113 - DNA, 23 bp, Homo sapiens
tggtggtcagccctttctggagg

SEQ ID NO: 6989114 - DNA, 22 bp, Homo sapiens
aatggcttagcagagttagaag

SEQ ID NO: 6989115 - DNA, 22 bp, Homo sapiens
tctgagagctctggggcccctt

SEQ ID NO: 6989116 - DNA, 22 bp, Homo sapiens
agagcaccccgggaagagcaag

SEQ ID NO: 6989117 - DNA, 22 bp, Homo sapiens
gtgttaatgaaaaacaactcat

SEQ ID NO: 6989118 - DNA, 22 bp, Homo sapiens
ttgtcctgaggactgttatcag

SEQ ID NO: 6989119 - DNA, 22 bp, Homo sapiens
ggacataacactttgaaagaga

SEQ ID NO: 6989120 - DNA, 22 bp, Homo sapiens
tcacttcgtaaacccctcccat

SEQ ID NO: 6989121 - DNA, 22 bp, Homo sapiens
ttccaggcacatcccaactcca

SEQ ID NO: 6989122 - DNA, 22 bp, Homo sapiens
ttgcagcaaggtcatgaaatgt

SEQ ID NO: 6989123 - DNA, 22 bp, Homo sapiens
aatatactatactactttctgg

SEQ ID NO: 6989124 - DNA, 22 bp, Homo sapiens
cattcctacatgataagaatta

SEQ ID NO: 6989125 - DNA, 22 bp, Homo sapiens
tacaagtaaattgtagatacca

SEQ ID NO: 6989126 - DNA, 22 bp, Homo sapiens
tgctgcagggatttcagagaca

SEQ ID NO: 6989127 - DNA, 22 bp, Homo sapiens
tcacagaatttttgcttccagt

SEQ ID NO: 6989128 - DNA, 22 bp, Homo sapiens
tctggagttgtgcagtggacct

SEQ ID NO: 6989129 - DNA, 22 bp, Homo sapiens
tcctggccacacattaatagtg

SEQ ID NO: 6989130 - DNA, 18 bp, Homo sapiens
ccctgaggctagcatgct

SEQ ID NO: 6989131 - DNA, 22 bp, Homo sapiens
atctcagaaggcatttccaaga

SEQ ID NO: 6989132 - DNA, 22 bp, Homo sapiens
cagttcaggccggctgactcag

SEQ ID NO: 6989133 - DNA, 22 bp, Homo sapiens
cttaagaaattgcattctaatc

SEQ ID NO: 6989134 - DNA, 22 bp, Homo sapiens
acccccacggaaggccgtacgc

SEQ ID NO: 6989135 - DNA, 22 bp, Homo sapiens
ttctctagcaaaaccagctagt

SEQ ID NO: 6989136 - DNA, 22 bp, Homo sapiens
taggaccacccctgttggcagc

SEQ ID NO: 6989137 - DNA, 22 bp, Homo sapiens
atcctaaggagaaagttattat

SEQ ID NO: 6989138 - DNA, 22 bp, Homo sapiens
actatagactgagtttgttcta

SEQ ID NO: 6989139 - DNA, 20 bp, Homo sapiens
atgtgctgggcaatatgtta

SEQ ID NO: 6989140 - DNA, 22 bp, Homo sapiens
acacaatgcatatttttccaga

SEQ ID NO: 6989141 - DNA, 22 bp, Homo sapiens
gctaattcttgataacataaca

SEQ ID NO: 6989142 - DNA, 22 bp, Homo sapiens
tggccggtgccgcgaagccggg

SEQ ID NO: 6989143 - DNA, 22 bp, Homo sapiens
ctctctggaattaaagcccaat

SEQ ID NO: 6989144 - DNA, 22 bp, Homo sapiens
gcatggctgttgaagtcagctc

SEQ ID NO: 6989145 - DNA, 22 bp, Homo sapiens
agggagctctaagtagagggac

SEQ ID NO: 6989146 - DNA, 22 bp, Homo sapiens
atgagtgcccttctcatgattt

SEQ ID NO: 6989147 - DNA, 22 bp, Homo sapiens
tggcttgtagcctacacctggt

SEQ ID NO: 6989148 - DNA, 22 bp, Homo sapiens
tgtttattgagtgcctactata

SEQ ID NO: 6989149 - DNA, 22 bp, Homo sapiens
tttgcaaatgctctgcagagct

SEQ ID NO: 6989150 - DNA, 22 bp, Homo sapiens
ggcctctctagcatccagcctg

SEQ ID NO: 6989151 - DNA, 22 bp, Homo sapiens
gactggcctggagatgcagctg

SEQ ID NO: 6989152 - DNA, 22 bp, Homo sapiens
ctgggcctggggctgttgagag

SEQ ID NO: 6989153 - DNA, 22 bp, Homo sapiens
acgcatttaaaatgtgctccca

SEQ ID NO: 6989154 - DNA, 22 bp, Homo sapiens
tcctctgaatgctgttgaagaa

SEQ ID NO: 6989155 - DNA, 22 bp, Homo sapiens
ttgagttccaggatggttgtta

SEQ ID NO: 6989156 - DNA, 22 bp, Homo sapiens
atttgtgatcgtgcgtgatgaa

SEQ ID NO: 6989157 - DNA, 22 bp, Homo sapiens
acatcactttacagttactagt

SEQ ID NO: 6989158 - DNA, 22 bp, Homo sapiens
tgtgattgtagtatacatatta

SEQ ID NO: 6989159 - DNA, 22 bp, Homo sapiens
ggctcctgataggagaatgcgg

SEQ ID NO: 6989160 - DNA, 22 bp, Homo sapiens
tatgttcatgtcaaacaaatgc

SEQ ID NO: 6989161 - DNA, 22 bp, Homo sapiens
agtgatgtctcagagacggaag

SEQ ID NO: 6989162 - DNA, 22 bp, Homo sapiens
gtcctgtgacctgcatcctgag

SEQ ID NO: 6989163 - DNA, 22 bp, Homo sapiens
gggctgcatcagcaggacccgg

SEQ ID NO: 6989164 - DNA, 22 bp, Homo sapiens
tggcagctgccatgtccacgtg

SEQ ID NO: 6989165 - DNA, 22 bp, Homo sapiens
tgaaaggttaaaagtagtattg

SEQ ID NO: 6989166 - DNA, 22 bp, Homo sapiens
attcttggatttggctctagtg

SEQ ID NO: 6989167 - DNA, 22 bp, Homo sapiens
gggcaccagcggccgcactgcc

SEQ ID NO: 6989168 - DNA, 22 bp, Homo sapiens
gaatgctgagactaaagagctt

SEQ ID NO: 6989169 - DNA, 22 bp, Homo sapiens
attgcctgaaaacagaaagtct

SEQ ID NO: 6989170 - DNA, 22 bp, Homo sapiens
tttggtccatttgctcttacat

SEQ ID NO: 6989171 - DNA, 22 bp, Homo sapiens
cacgacttgtggaggagcgcgg

SEQ ID NO: 6989172 - DNA, 22 bp, Homo sapiens
ggagggtccatcttgtgaaaag

SEQ ID NO: 6989173 - DNA, 22 bp, Homo sapiens
tttaaatgcagacgttgattca

SEQ ID NO: 6989174 - DNA, 22 bp, Homo sapiens
tctctaggcagtgtcagaatca

SEQ ID NO: 6989175 - DNA, 22 bp, Homo sapiens
atggcagctttcattgtccaca

SEQ ID NO: 6989176 - DNA, 20 bp, Homo sapiens
acctggcttcctcttggcat

SEQ ID NO: 6989177 - DNA, 23 bp, Homo sapiens
cagcacagtacatttcctgtctc

SEQ ID NO: 6989178 - DNA, 22 bp, Homo sapiens
atggacaatgtgaaactacaag

SEQ ID NO: 6989179 - DNA, 22 bp, Homo sapiens
atttttctctccactccattaa

SEQ ID NO: 6989180 - DNA, 22 bp, Homo sapiens
gaaggccatttttaggtagaat

SEQ ID NO: 6989181 - DNA, 22 bp, Homo sapiens
cctcccaggcattgccattttc

SEQ ID NO: 6989182 - DNA, 23 bp, Homo sapiens
tgtgaagccgctcataggggtcc

SEQ ID NO: 6989183 - DNA, 22 bp, Homo sapiens
agttaaggatggctggaggcgt

SEQ ID NO: 6989184 - DNA, 22 bp, Homo sapiens
tggtccttctctgcctgcagtg

SEQ ID NO: 6989185 - DNA, 22 bp, Homo sapiens
gtattttactgctcaaagctct

SEQ ID NO: 6989186 - DNA, 22 bp, Homo sapiens
ggcaggtgtgagctgtaaagga

SEQ ID NO: 6989187 - DNA, 22 bp, Homo sapiens
tgtggataatgcactatccata

SEQ ID NO: 6989188 - DNA, 22 bp, Homo sapiens
ttgttcagaaatttggactcct

SEQ ID NO: 6989189 - DNA, 22 bp, Homo sapiens
atgcatgagtcactcagtgcag

SEQ ID NO: 6989190 - DNA, 22 bp, Homo sapiens
actcagcatatggggccgcttg

SEQ ID NO: 6989191 - DNA, 22 bp, Homo sapiens
tcctgcctagcaggtgacctat

SEQ ID NO: 6989192 - DNA, 22 bp, Homo sapiens
tggcttctccctctgcctgatt

SEQ ID NO: 6989193 - DNA, 22 bp, Homo sapiens
tcagcagggcctccttgtgcag

SEQ ID NO: 6989194 - DNA, 22 bp, Homo sapiens
ggaagcttaatgcctaatttcc

SEQ ID NO: 6989195 - DNA, 22 bp, Homo sapiens
ttccaaagctgctttatttagt

SEQ ID NO: 6989196 - DNA, 22 bp, Homo sapiens
gagaagtgcagagtggttaagc

SEQ ID NO: 6989197 - DNA, 22 bp, Homo sapiens
aatgccgtagacttttacttat

SEQ ID NO: 6989198 - DNA, 22 bp, Homo sapiens
tggtgtaatcagtttctagctc

SEQ ID NO: 6989199 - DNA, 22 bp, Homo sapiens
tttaccttttgctatggtggaa

SEQ ID NO: 6989200 - DNA, 22 bp, Homo sapiens
tttaaaaggggtattaagtcca

SEQ ID NO: 6989201 - DNA, 22 bp, Homo sapiens
gagcagctaaaattctcatgca

SEQ ID NO: 6989202 - DNA, 19 bp, Homo sapiens
tgttctagcggcaccaggc

SEQ ID NO: 6989203 - DNA, 17 bp, Homo sapiens
ttgccttaagtatgtgc

SEQ ID NO: 6989204 - DNA, 22 bp, Homo sapiens
tgaatgctcacatgcctaggtc

SEQ ID NO: 6989205 - DNA, 22 bp, Homo sapiens
ctgggctgctcagccccctcgc

SEQ ID NO: 6989206 - DNA, 22 bp, Homo sapiens
agggccagaatccctcagtcta

SEQ ID NO: 6989207 - DNA, 22 bp, Homo sapiens
catgcaaaatgtattttattag

SEQ ID NO: 6989208 - DNA, 22 bp, Homo sapiens
atgattggtggtcagcagtatg

SEQ ID NO: 6989209 - DNA, 22 bp, Homo sapiens
gtggctgctacagagctggagg

SEQ ID NO: 6989210 - DNA, 20 bp, Homo sapiens
tggatgctgcacgtagatgg

SEQ ID NO: 6989211 - DNA, 22 bp, Homo sapiens
tggcaggaaataccctgcctag

SEQ ID NO: 6989212 - DNA, 22 bp, Homo sapiens
cctggggagagaaagcccagcc

SEQ ID NO: 6989213 - DNA, 22 bp, Homo sapiens
gcccaggataatgctgtccctg

SEQ ID NO: 6989214 - DNA, 22 bp, Homo sapiens
tgctggaaattcctaggaggta

SEQ ID NO: 6989215 - DNA, 22 bp, Homo sapiens
tgagttttttcaacatatgaag

SEQ ID NO: 6989216 - DNA, 22 bp, Homo sapiens
aggcctgggcaagaaggggcgt

SEQ ID NO: 6989217 - DNA, 22 bp, Homo sapiens
aatttatggccttcgtcttgat

SEQ ID NO: 6989218 - DNA, 22 bp, Homo sapiens
cagtaatgtcatggagccatat

SEQ ID NO: 6989219 - DNA, 22 bp, Homo sapiens
atgaacttatttctgaactttt

SEQ ID NO: 6989220 - DNA, 22 bp, Homo sapiens
atgtttattttgcagagtaggg

SEQ ID NO: 6989221 - DNA, 22 bp, Homo sapiens
acctttggtaagtttccaaaac

SEQ ID NO: 6989222 - DNA, 22 bp, Homo sapiens
taatgtcttgccttcctccccc

SEQ ID NO: 6989223 - DNA, 22 bp, Homo sapiens
ctgtccccacccaaatctcatc

SEQ ID NO: 6989224 - DNA, 20 bp, Homo sapiens
tttctgtgatagagaggtgt

SEQ ID NO: 6989225 - DNA, 22 bp, Homo sapiens
gtgccaaaagctataatttggt

SEQ ID NO: 6989226 - DNA, 20 bp, Homo sapiens
gcaatggcgtgctagttctg

SEQ ID NO: 6989227 - DNA, 22 bp, Homo sapiens
tctggagcttcctcatttacag

SEQ ID NO: 6989228 - DNA, 22 bp, Homo sapiens
tgcctcaggcacctggcaggtt

SEQ ID NO: 6989229 - DNA, 22 bp, Homo sapiens
catgtgggaagaggccagctgg

SEQ ID NO: 6989230 - DNA, 22 bp, Homo sapiens
acagactggagtgagagaaata

SEQ ID NO: 6989231 - DNA, 22 bp, Homo sapiens
tggcagtgtataggtggctcct

SEQ ID NO: 6989232 - DNA, 22 bp, Homo sapiens
ggcagccaccctgggaggcaga

SEQ ID NO: 6989233 - DNA, 22 bp, Homo sapiens
ctaaactttgtttatactctga

SEQ ID NO: 6989234 - DNA, 22 bp, Homo sapiens
aatgtgtaaatgaggagtcttg

SEQ ID NO: 6989235 - DNA, 22 bp, Homo sapiens
aggagaattaggaactcaagat

SEQ ID NO: 6989236 - DNA, 22 bp, Homo sapiens
tgagtgtgctaggtgtctcggt

SEQ ID NO: 6989237 - DNA, 22 bp, Homo sapiens
tggctcttttcacgtcccctct

SEQ ID NO: 6989238 - DNA, 21 bp, Homo sapiens
gactgggctgacttgtgctgg

SEQ ID NO: 6989239 - DNA, 22 bp, Homo sapiens
gggcagtgggaccaggcaccag

SEQ ID NO: 6989240 - DNA, 22 bp, Homo sapiens
ttaaaccactgagtggagacta

SEQ ID NO: 6989241 - DNA, 22 bp, Homo sapiens
cggctctgtcctcagcactgct

SEQ ID NO: 6989242 - DNA, 22 bp, Homo sapiens
ataatcaaagtcctatgacatc

SEQ ID NO: 6989243 - DNA, 22 bp, Homo sapiens
tcatacaaggagggtgttcaaa

SEQ ID NO: 6989244 - DNA, 22 bp, Homo sapiens
tttgagcaactctgagtcacag

SEQ ID NO: 6989245 - DNA, 22 bp, Homo sapiens
gttctaataggagaaaagacag

SEQ ID NO: 6989246 - DNA, 22 bp, Homo sapiens
gtgcctggaactgggtaggctg

SEQ ID NO: 6989247 - DNA, 22 bp, Homo sapiens
agatggctagattgcaagaact

SEQ ID NO: 6989248 - DNA, 22 bp, Homo sapiens
agactctgtgctccttgctttc

SEQ ID NO: 6989249 - DNA, 22 bp, Homo sapiens
agtgctgggtactgttcccatt

SEQ ID NO: 6989250 - DNA, 22 bp, Homo sapiens
agttaaggataccaggccaaaa

SEQ ID NO: 6989251 - DNA, 22 bp, Homo sapiens
aatttggcagtgtcttgaagta

SEQ ID NO: 6989252 - DNA, 22 bp, Homo sapiens
gctagcaagtggcatagcaggg

SEQ ID NO: 6989253 - DNA, 22 bp, Homo sapiens
aaaggtttattgctatggttgt

SEQ ID NO: 6989254 - DNA, 22 bp, Homo sapiens
gcacatacccactgtcaagcac

SEQ ID NO: 6989255 - DNA, 18 bp, Homo sapiens
ttgcaggtacctctatct

SEQ ID NO: 6989256 - DNA, 22 bp, Homo sapiens
gcagttctcagccaggcggcag

SEQ ID NO: 6989257 - DNA, 17 bp, Homo sapiens
ttgactgttaatgggtt

SEQ ID NO: 6989258 - DNA, 22 bp, Homo sapiens
ttggctcacctgtctacccaga

SEQ ID NO: 6989259 - DNA, 22 bp, Homo sapiens
ctgtcctcaacccatccttctc

SEQ ID NO: 6989260 - DNA, 22 bp, Homo sapiens
gtccagccaccctggaggcacg

SEQ ID NO: 6989261 - DNA, 22 bp, Homo sapiens
aatttctgctgagcactgggcc

SEQ ID NO: 6989262 - DNA, 22 bp, Homo sapiens
ttagccatgatgagtatatttg

SEQ ID NO: 6989263 - DNA, 19 bp, Homo sapiens
tcacaactgggggttgagg

SEQ ID NO: 6989264 - DNA, 22 bp, Homo sapiens
ggtaacagttacagtaacagta

SEQ ID NO: 6989265 - DNA, 22 bp, Homo sapiens
tcatcagagccattgttaagaa

SEQ ID NO: 6989266 - DNA, 22 bp, Homo sapiens
gtacacagagtggtggaagaaa

SEQ ID NO: 6989267 - DNA, 22 bp, Homo sapiens
gcttgtctctcagccccagtca

SEQ ID NO: 6989268 - DNA, 21 bp, Homo sapiens
ttcacaacctgctttagtggg

SEQ ID NO: 6989269 - DNA, 22 bp, Homo sapiens
acacatgattaatgccaagcat

SEQ ID NO: 6989270 - DNA, 22 bp, Homo sapiens
ttgaactctggacccatgccag

SEQ ID NO: 6989271 - DNA, 22 bp, Homo sapiens
acagtgtatgatatttcacagt

SEQ ID NO: 6989272 - DNA, 22 bp, Homo sapiens
attgtcagtttaatatagtcaa

SEQ ID NO: 6989273 - DNA, 22 bp, Homo sapiens
ggggcagagcatagctccaatt

SEQ ID NO: 6989274 - DNA, 22 bp, Homo sapiens
catgtctgagtcatggtacttc

SEQ ID NO: 6989275 - DNA, 22 bp, Homo sapiens
gctgtgcagaggtgagaatcca

SEQ ID NO: 6989276 - DNA, 22 bp, Homo sapiens
atggttgaagaccagtggaaaa

SEQ ID NO: 6989277 - DNA, 22 bp, Homo sapiens
gggatatgtttaggtgttggag

SEQ ID NO: 6989278 - DNA, 22 bp, Homo sapiens
agagcctgtgattgtcatcacc

SEQ ID NO: 6989279 - DNA, 23 bp, Homo sapiens
tgacgctcagtgtgacagtgagg

SEQ ID NO: 6989280 - DNA, 22 bp, Homo sapiens
acatggattgttttaaaagatg

SEQ ID NO: 6989281 - DNA, 19 bp, Homo sapiens
agatggggaagagtgtgag

SEQ ID NO: 6989282 - DNA, 22 bp, Homo sapiens
ggtgctctttctcagacaagat

SEQ ID NO: 6989283 - DNA, 21 bp, Homo sapiens
tggtgttgacatcaagttata

SEQ ID NO: 6989284 - DNA, 22 bp, Homo sapiens
tctgtgggggtgtcttaaccta

SEQ ID NO: 6989285 - DNA, 22 bp, Homo sapiens
tgtgtgtaatgtttctctcttc

SEQ ID NO: 6989286 - DNA, 22 bp, Homo sapiens
ggtggctgcaatggctaacttc

SEQ ID NO: 6989287 - DNA, 22 bp, Homo sapiens
cttatttcagccctgggcaccc

SEQ ID NO: 6989288 - DNA, 22 bp, Homo sapiens
gcacacagaattgattcactgt

SEQ ID NO: 6989289 - DNA, 22 bp, Homo sapiens
ttaagcttcagaacgcaatgat

SEQ ID NO: 6989290 - DNA, 22 bp, Homo sapiens
atcagctagataagtcaagcaa

SEQ ID NO: 6989291 - DNA, 22 bp, Homo sapiens
ttccaaggtgggactggggtgc

SEQ ID NO: 6989292 - DNA, 22 bp, Homo sapiens
tttgcacacattcttagaaatg

SEQ ID NO: 6989293 - DNA, 22 bp, Homo sapiens
atctaaactgtttactctctgc

SEQ ID NO: 6989294 - DNA, 23 bp, Homo sapiens
tctgggccacttgtctgcacttc

SEQ ID NO: 6989295 - DNA, 22 bp, Homo sapiens
cagttaaatttggctgttttct

SEQ ID NO: 6989296 - DNA, 22 bp, Homo sapiens
gctgctcttgaggggctcactg

SEQ ID NO: 6989297 - DNA, 22 bp, Homo sapiens
cacacagggagaaagaaagcct

SEQ ID NO: 6989298 - DNA, 22 bp, Homo sapiens
atctgtcttttattcatgagct

SEQ ID NO: 6989299 - DNA, 22 bp, Homo sapiens
cggtccagggaacgcccccgcc

SEQ ID NO: 6989300 - DNA, 22 bp, Homo sapiens
agtcagtttccctggaaagcag

SEQ ID NO: 6989301 - DNA, 22 bp, Homo sapiens
tatggccacagcttgtttgcaa

SEQ ID NO: 6989302 - DNA, 23 bp, Homo sapiens
aactttactattttgaataatgc

SEQ ID NO: 6989303 - DNA, 22 bp, Homo sapiens
cagatcttgtactcattattga

SEQ ID NO: 6989304 - DNA, 22 bp, Homo sapiens
ttggcctctcccatactgtcca

SEQ ID NO: 6989305 - DNA, 22 bp, Homo sapiens
aggttctttgtagtgtcattgg

SEQ ID NO: 6989306 - DNA, 22 bp, Homo sapiens
tgtaaagcatctctgtcatata

SEQ ID NO: 6989307 - DNA, 22 bp, Homo sapiens
gtgcaataaataaatagattgt

SEQ ID NO: 6989308 - DNA, 22 bp, Homo sapiens
cctggaggagcgctgaccagct

SEQ ID NO: 6989309 - DNA, 22 bp, Homo sapiens
tgagtttggtatctagggggtc

SEQ ID NO: 6989310 - DNA, 22 bp, Homo sapiens
atagccagcatatagcagggag

SEQ ID NO: 6989311 - DNA, 22 bp, Homo sapiens
atttctgtatcctgctgtcaga

SEQ ID NO: 6989312 - DNA, 22 bp, Homo sapiens
tcaacaaatacttaaagcagag

SEQ ID NO: 6989313 - DNA, 22 bp, Homo sapiens
cctctcggcagcccatcttgtc

SEQ ID NO: 6989314 - DNA, 22 bp, Homo sapiens
tggactgaagttacagatgaca

SEQ ID NO: 6989315 - DNA, 22 bp, Homo sapiens
aattcttcaagtgctttggaga

SEQ ID NO: 6989316 - DNA, 22 bp, Homo sapiens
ttgaagagacgatttttccacc

SEQ ID NO: 6989317 - DNA, 21 bp, Homo sapiens
agcaggcccaatggagggggc

SEQ ID NO: 6989318 - DNA, 22 bp, Homo sapiens
gagctgtggaaggcagggacca

SEQ ID NO: 6989319 - DNA, 22 bp, Homo sapiens
atgtgtgcctgagtgatggact

SEQ ID NO: 6989320 - DNA, 22 bp, Homo sapiens
cccagacagtgatttacttaat

SEQ ID NO: 6989321 - DNA, 22 bp, Homo sapiens
tacattttctaggggaccaaga

SEQ ID NO: 6989322 - DNA, 22 bp, Homo sapiens
agtcatctatgggccacacgga

SEQ ID NO: 6989323 - DNA, 22 bp, Homo sapiens
tttccatgttatcttgcagact

SEQ ID NO: 6989324 - DNA, 21 bp, Homo sapiens
tgaaggggccatcacaaaggc

SEQ ID NO: 6989325 - DNA, 22 bp, Homo sapiens
gtgtttaatgcagatgtgggtg

SEQ ID NO: 6989326 - DNA, 22 bp, Homo sapiens
atgaggcagcacatgggattgt

SEQ ID NO: 6989327 - DNA, 22 bp, Homo sapiens
tgacctttctttgagattcctg

SEQ ID NO: 6989328 - DNA, 22 bp, Homo sapiens
aaggcaattgagaagaaacaga

SEQ ID NO: 6989329 - DNA, 22 bp, Homo sapiens
gaacatttatattagatagcta

SEQ ID NO: 6989330 - DNA, 22 bp, Homo sapiens
gctccgtgggcattgctaggtg

SEQ ID NO: 6989331 - DNA, 22 bp, Homo sapiens
tattaggctagtcaatagagat

SEQ ID NO: 6989332 - DNA, 22 bp, Homo sapiens
tcttgggcatgcacagactgca

SEQ ID NO: 6989333 - DNA, 22 bp, Homo sapiens
ccagggtttttccagttgctca

SEQ ID NO: 6989334 - DNA, 22 bp, Homo sapiens
tttctccacttctcttgccaac

SEQ ID NO: 6989335 - DNA, 21 bp, Homo sapiens
gttctattttgcaaacttctg

SEQ ID NO: 6989336 - DNA, 19 bp, Homo sapiens
gtgtttactgtgtgcagaa

SEQ ID NO: 6989337 - DNA, 22 bp, Homo sapiens
ttacattttagttaacctgtga

SEQ ID NO: 6989338 - DNA, 23 bp, Homo sapiens
ctggccaccatctttctggcttc

SEQ ID NO: 6989339 - DNA, 21 bp, Homo sapiens
tatcacagtagaataggatct

SEQ ID NO: 6989340 - DNA, 22 bp, Homo sapiens
caggaggtggagctcaagtggt

SEQ ID NO: 6989341 - DNA, 22 bp, Homo sapiens
atgaactttctttacagttttg

SEQ ID NO: 6989342 - DNA, 22 bp, Homo sapiens
tcagacattattttcaagataa

SEQ ID NO: 6989343 - DNA, 19 bp, Homo sapiens
ctaaggcaagaaactggac

SEQ ID NO: 6989344 - DNA, 22 bp, Homo sapiens
tggagtctgtgatgctctgggt

SEQ ID NO: 6989345 - DNA, 18 bp, Homo sapiens
cagtctaattcccttccc

SEQ ID NO: 6989346 - DNA, 22 bp, Homo sapiens
atctctctgcccaggggctgtg

SEQ ID NO: 6989347 - DNA, 22 bp, Homo sapiens
gagtgtcagtgcctggcttgtt

SEQ ID NO: 6989348 - DNA, 22 bp, Homo sapiens
ctggctccatccttgagctctg

SEQ ID NO: 6989349 - DNA, 22 bp, Homo sapiens
aatgtctttcttggttctggtt

SEQ ID NO: 6989350 - DNA, 22 bp, Homo sapiens
agaaatcctgatggagtctgaa

SEQ ID NO: 6989351 - DNA, 22 bp, Homo sapiens
tcttcctatgccaacattctgt

SEQ ID NO: 6989352 - DNA, 22 bp, Homo sapiens
acataataggtacctgaataat

SEQ ID NO: 6989353 - DNA, 22 bp, Homo sapiens
ttggagaggcagtcttgctctg

SEQ ID NO: 6989354 - DNA, 22 bp, Homo sapiens
tgtggagcagcgtcacagcctt

SEQ ID NO: 6989355 - DNA, 22 bp, Homo sapiens
tcttgtttcttctaagcagcag

SEQ ID NO: 6989356 - DNA, 22 bp, Homo sapiens
tcgcggggaagtggtgggctaa

SEQ ID NO: 6989357 - DNA, 22 bp, Homo sapiens
atcatttacaatgaaagcctga

SEQ ID NO: 6989358 - DNA, 22 bp, Homo sapiens
gctctaactattaagaggtcat

SEQ ID NO: 6989359 - DNA, 22 bp, Homo sapiens
tgttcttaggtatttgacagtc

SEQ ID NO: 6989360 - DNA, 22 bp, Homo sapiens
gacagccatcagcacacgctgc

SEQ ID NO: 6989361 - DNA, 22 bp, Homo sapiens
ctgcgttctgcctggcggccta

SEQ ID NO: 6989362 - DNA, 22 bp, Homo sapiens
tcagggaaaggggagagtcatt

SEQ ID NO: 6989363 - DNA, 22 bp, Homo sapiens
tagcagcacagaaagcctggag

SEQ ID NO: 6989364 - DNA, 22 bp, Homo sapiens
aggcaagattaggaccagaaga

SEQ ID NO: 6989365 - DNA, 22 bp, Homo sapiens
tggaaggcttggaatacttcca

SEQ ID NO: 6989366 - DNA, 22 bp, Homo sapiens
ggctttgcaaactcattccaca

SEQ ID NO: 6989367 - DNA, 22 bp, Homo sapiens
ggggcatcagaaccctgtggga

SEQ ID NO: 6989368 - DNA, 22 bp, Homo sapiens
caaactgaacacgaaagtcttt

SEQ ID NO: 6989369 - DNA, 22 bp, Homo sapiens
tttagctatggataacaaccac

SEQ ID NO: 6989370 - DNA, 22 bp, Homo sapiens
gtggcttgaccatccctgctac

SEQ ID NO: 6989371 - DNA, 22 bp, Homo sapiens
ttcaaacactgttggcactggg

SEQ ID NO: 6989372 - DNA, 22 bp, Homo sapiens
ttgtgcccgggcccgggcctct

SEQ ID NO: 6989373 - DNA, 22 bp, Homo sapiens
taacagtgacctgaatgtcaat

SEQ ID NO: 6989374 - DNA, 22 bp, Homo sapiens
gaaacaatacttgtcctcacta

SEQ ID NO: 6989375 - DNA, 22 bp, Homo sapiens
acagtgaggaagcagctgtgct

SEQ ID NO: 6989376 - DNA, 22 bp, Homo sapiens
actgggccttgtgtgtctcatc

SEQ ID NO: 6989377 - DNA, 22 bp, Homo sapiens
gctgcctgctcacccggcctgg

SEQ ID NO: 6989378 - DNA, 23 bp, Homo sapiens
ttgatttagctgggattgcatgc

SEQ ID NO: 6989379 - DNA, 21 bp, Homo sapiens
tggatctgtgatctggggcac

SEQ ID NO: 6989380 - DNA, 20 bp, Homo sapiens
catgacactgttcctctgcc

SEQ ID NO: 6989381 - DNA, 22 bp, Homo sapiens
tccgggtgtttcaacttcccga

SEQ ID NO: 6989382 - DNA, 22 bp, Homo sapiens
tcagactgtcttagctttatac

SEQ ID NO: 6989383 - DNA, 22 bp, Homo sapiens
atgatggaaaaagatcagtcaa

SEQ ID NO: 6989384 - DNA, 21 bp, Homo sapiens
tctgagactgggttagaatgt

SEQ ID NO: 6989385 - DNA, 22 bp, Homo sapiens
gttgtataaggaatgttgttta

SEQ ID NO: 6989386 - DNA, 22 bp, Homo sapiens
aaactgtgtatgcagagagcat

SEQ ID NO: 6989387 - DNA, 22 bp, Homo sapiens
aatgtatcagtgatttgcttgc

SEQ ID NO: 6989388 - DNA, 22 bp, Homo sapiens
tggactctatgatgcgccagca

SEQ ID NO: 6989389 - DNA, 22 bp, Homo sapiens
ttctgtccttttgaattccaaa

SEQ ID NO: 6989390 - DNA, 22 bp, Homo sapiens
cttggtcatttggggctgctat

SEQ ID NO: 6989391 - DNA, 22 bp, Homo sapiens
ctgtaggagtgggaatttattg

SEQ ID NO: 6989392 - DNA, 22 bp, Homo sapiens
atgctataaactctaggtcatt

SEQ ID NO: 6989393 - DNA, 22 bp, Homo sapiens
attaaagttgaaattgaactga

SEQ ID NO: 6989394 - DNA, 22 bp, Homo sapiens
accagtcttgttgccatgtctg

SEQ ID NO: 6989395 - DNA, 22 bp, Homo sapiens
tgcaggctgtaatctgaggcta

SEQ ID NO: 6989396 - DNA, 22 bp, Homo sapiens
gatcctcttttcctaggaaggt

SEQ ID NO: 6989397 - DNA, 22 bp, Homo sapiens
gctgaaggtatgagttttatct

SEQ ID NO: 6989398 - DNA, 18 bp, Homo sapiens
agagtatacagacaacaa

SEQ ID NO: 6989399 - DNA, 22 bp, Homo sapiens
tgtctttagaaagaagcagaca

SEQ ID NO: 6989400 - DNA, 22 bp, Homo sapiens
taggggtgtttcgagagaggtt

SEQ ID NO: 6989401 - DNA, 22 bp, Homo sapiens
tgtgtctgaactagttgctctc

SEQ ID NO: 6989402 - DNA, 18 bp, Homo sapiens
ccagccctgcagcacctg

SEQ ID NO: 6989403 - DNA, 22 bp, Homo sapiens
ggtcattgaaatcagaagggtt

SEQ ID NO: 6989404 - DNA, 22 bp, Homo sapiens
agtgctcagtagctgcatgtgg

SEQ ID NO: 6989405 - DNA, 22 bp, Homo sapiens
tctcatgatgcctatgcagggt

SEQ ID NO: 6989406 - DNA, 22 bp, Homo sapiens
attgtacataaaatgtatgtct

SEQ ID NO: 6989407 - DNA, 22 bp, Homo sapiens
ctgacaaggttgaattgtccca

SEQ ID NO: 6989408 - DNA, 21 bp, Homo sapiens
ggcagagctggggcctccagc

SEQ ID NO: 6989409 - DNA, 22 bp, Homo sapiens
ccataatcatgtaagtaaattc

SEQ ID NO: 6989410 - DNA, 22 bp, Homo sapiens
catttctaagaaggctgcacat

SEQ ID NO: 6989411 - DNA, 22 bp, Homo sapiens
aaatgccttcaaacacttaagg

SEQ ID NO: 6989412 - DNA, 22 bp, Homo sapiens
acattcaccacacttatagggc

SEQ ID NO: 6989413 - DNA, 22 bp, Homo sapiens
tgccctggtatcatgtggaatt

SEQ ID NO: 6989414 - DNA, 22 bp, Homo sapiens
tttggtcctgagcaaaactatg

SEQ ID NO: 6989415 - DNA, 22 bp, Homo sapiens
gactttgctgtgtcagcttcag

SEQ ID NO: 6989416 - DNA, 22 bp, Homo sapiens
tttggaatgcccatggactggt

SEQ ID NO: 6989417 - DNA, 22 bp, Homo sapiens
caatttcattaatagatataga

SEQ ID NO: 6989418 - DNA, 22 bp, Homo sapiens
cagggagctgacaaccaaggag

SEQ ID NO: 6989419 - DNA, 22 bp, Homo sapiens
aagccctgttctttctctcacc

SEQ ID NO: 6989420 - DNA, 20 bp, Homo sapiens
gatacacagcacagagggcc

SEQ ID NO: 6989421 - DNA, 22 bp, Homo sapiens
ttcttcagagagtagaagcaag

SEQ ID NO: 6989422 - DNA, 22 bp, Homo sapiens
ccccagcatatcatggtttcgt

SEQ ID NO: 6989423 - DNA, 19 bp, Homo sapiens
ggcaggtgtgcttatgctt

SEQ ID NO: 6989424 - DNA, 22 bp, Homo sapiens
ttgaaattttaggccttgcaat

SEQ ID NO: 6989425 - DNA, 22 bp, Homo sapiens
acctggcatgaagcatgcctta

SEQ ID NO: 6989426 - DNA, 22 bp, Homo sapiens
ggcccagccttggggtttcttt

SEQ ID NO: 6989427 - DNA, 22 bp, Homo sapiens
gggccttctagttagccccaat

SEQ ID NO: 6989428 - DNA, 22 bp, Homo sapiens
ctctcctttactgcagagagcg

SEQ ID NO: 6989429 - DNA, 22 bp, Homo sapiens
cctcagagacagtaactggaat

SEQ ID NO: 6989430 - DNA, 22 bp, Homo sapiens
ggtgacagttccggaggtacag

SEQ ID NO: 6989431 - DNA, 22 bp, Homo sapiens
gattctgctgtccctaagtgcc

SEQ ID NO: 6989432 - DNA, 22 bp, Homo sapiens
ctgcgggctgtcaggcgtgcca

SEQ ID NO: 6989433 - DNA, 22 bp, Homo sapiens
agcggtggtgtcggcagcggct

SEQ ID NO: 6989434 - DNA, 22 bp, Homo sapiens
tgtgcagtgtgaccagggctgc

SEQ ID NO: 6989435 - DNA, 22 bp, Homo sapiens
caggacccatcagccaggcact

SEQ ID NO: 6989436 - DNA, 22 bp, Homo sapiens
tcaaagttggaaaagctggccc

SEQ ID NO: 6989437 - DNA, 22 bp, Homo sapiens
atgcaacagctgggaatatgta

SEQ ID NO: 6989438 - DNA, 23 bp, Homo sapiens
ctctgggtccgatgtcctgacag

SEQ ID NO: 6989439 - DNA, 22 bp, Homo sapiens
tcacatgctgtgtgtggagatc

SEQ ID NO: 6989440 - DNA, 22 bp, Homo sapiens
cctcactgtcatcagtagttat

SEQ ID NO: 6989441 - DNA, 22 bp, Homo sapiens
ctgtatttagttaaaatgctaa

SEQ ID NO: 6989442 - DNA, 22 bp, Homo sapiens
gtcagcttggaaataagggtgg

SEQ ID NO: 6989443 - DNA, 22 bp, Homo sapiens
ccaaggccttgaaggcgcgggg

SEQ ID NO: 6989444 - DNA, 22 bp, Homo sapiens
ctcctgtatgttgggcttcaca

SEQ ID NO: 6989445 - DNA, 22 bp, Homo sapiens
tggagccataaccctttcgtac

SEQ ID NO: 6989446 - DNA, 22 bp, Homo sapiens
ctgtggggaaagggtcctgctc

SEQ ID NO: 6989447 - DNA, 22 bp, Homo sapiens
gtctggaggaggaagaaggcac

SEQ ID NO: 6989448 - DNA, 22 bp, Homo sapiens
caagctggctcttatgcaaaaa

SEQ ID NO: 6989449 - DNA, 22 bp, Homo sapiens
acctggtaacctgcctgactaa

SEQ ID NO: 6989450 - DNA, 22 bp, Homo sapiens
ctgaggggtatccaaggggtaa

SEQ ID NO: 6989451 - DNA, 22 bp, Homo sapiens
tcagtgtgtaattctttgtttc

SEQ ID NO: 6989452 - DNA, 22 bp, Homo sapiens
ttccatgagctctgagttcaca

SEQ ID NO: 6989453 - DNA, 22 bp, Homo sapiens
agccaagaagtgagtaatagta

SEQ ID NO: 6989454 - DNA, 22 bp, Homo sapiens
gtatacgtgcaggtcacagggg

SEQ ID NO: 6989455 - DNA, 22 bp, Homo sapiens
atgcccctccttgtggtcgccc

SEQ ID NO: 6989456 - DNA, 22 bp, Homo sapiens
gggctctgtggttgtgctttgt

SEQ ID NO: 6989457 - DNA, 22 bp, Homo sapiens
gctctgctggaagttctctgga

SEQ ID NO: 6989458 - DNA, 22 bp, Homo sapiens
caagcgtggctgctctgatgga

SEQ ID NO: 6989459 - DNA, 22 bp, Homo sapiens
gcatacatacaatagctgccac

SEQ ID NO: 6989460 - DNA, 22 bp, Homo sapiens
acccagagcactgggtgtgggc

SEQ ID NO: 6989461 - DNA, 22 bp, Homo sapiens
gatttctgttgagaaacatggg

SEQ ID NO: 6989462 - DNA, 22 bp, Homo sapiens
agatacatcttgaacttctaga

SEQ ID NO: 6989463 - DNA, 22 bp, Homo sapiens
cgaaataccacaaactctgttg

SEQ ID NO: 6989464 - DNA, 22 bp, Homo sapiens
aatggttacagaaatgaaagta

SEQ ID NO: 6989465 - DNA, 22 bp, Homo sapiens
ctaagggcttgctggagccagg

SEQ ID NO: 6989466 - DNA, 22 bp, Homo sapiens
tgcagggagctctggggtgcag

SEQ ID NO: 6989467 - DNA, 22 bp, Homo sapiens
cctgctcggggtgcagtgggct

SEQ ID NO: 6989468 - DNA, 22 bp, Homo sapiens
ggagcaggagtctcttgaattt

SEQ ID NO: 6989469 - DNA, 22 bp, Homo sapiens
attgctggcatcagtgacaata

SEQ ID NO: 6989470 - DNA, 22 bp, Homo sapiens
ctgcagctgctcatgttacttg

SEQ ID NO: 6989471 - DNA, 22 bp, Homo sapiens
ggagacagtgacttagagactg

SEQ ID NO: 6989472 - DNA, 22 bp, Homo sapiens
aggctgtgtggtcatggtggct

SEQ ID NO: 6989473 - DNA, 18 bp, Homo sapiens
agcagctgtcagaatgcc

SEQ ID NO: 6989474 - DNA, 22 bp, Homo sapiens
cctgagtctttcccattgcgct

SEQ ID NO: 6989475 - DNA, 22 bp, Homo sapiens
ataaactcatgctgaaaaccca

SEQ ID NO: 6989476 - DNA, 22 bp, Homo sapiens
tcctgttgttcgcctgcgatgg

SEQ ID NO: 6989477 - DNA, 22 bp, Homo sapiens
ctctctgaggcaggcctgtggg

SEQ ID NO: 6989478 - DNA, 22 bp, Homo sapiens
gcattggttcaaggttgtgcag

SEQ ID NO: 6989479 - DNA, 23 bp, Homo sapiens
tgcatcctcatttttcacacgag

SEQ ID NO: 6989480 - DNA, 22 bp, Homo sapiens
atgtgactccaggcagttttgt

SEQ ID NO: 6989481 - DNA, 23 bp, Homo sapiens
tggtaatagggagcagaaggtag

SEQ ID NO: 6989482 - DNA, 22 bp, Homo sapiens
actcaagatctcatatcctaat

SEQ ID NO: 6989483 - DNA, 22 bp, Homo sapiens
tgaagtttgaactgtgttgctg

SEQ ID NO: 6989484 - DNA, 22 bp, Homo sapiens
aactccatggttctcagattct

SEQ ID NO: 6989485 - DNA, 22 bp, Homo sapiens
aaggcagaggaaggtctagttt

SEQ ID NO: 6989486 - DNA, 22 bp, Homo sapiens
ctcgggtaccatgctaggcact

SEQ ID NO: 6989487 - DNA, 22 bp, Homo sapiens
tttcctaagggatgcggctcaa

SEQ ID NO: 6989488 - DNA, 22 bp, Homo sapiens
gccacctgtttcagatgtggtt

SEQ ID NO: 6989489 - DNA, 22 bp, Homo sapiens
atttggaaggcgtttctctgta

SEQ ID NO: 6989490 - DNA, 22 bp, Homo sapiens
ttatgcttccctgaggatctta

SEQ ID NO: 6989491 - DNA, 22 bp, Homo sapiens
attgatgtgtaatgaaggagtt

SEQ ID NO: 6989492 - DNA, 22 bp, Homo sapiens
aatgtgttttatgagagaatat

SEQ ID NO: 6989493 - DNA, 22 bp, Homo sapiens
tggaaacttaccgtttggggaa

SEQ ID NO: 6989494 - DNA, 18 bp, Homo sapiens
atggcacagtctttccct

SEQ ID NO: 6989495 - DNA, 22 bp, Homo sapiens
ttgggagctggaagcaaggcct

SEQ ID NO: 6989496 - DNA, 22 bp, Homo sapiens
agagaaacaggtcagctgggag

SEQ ID NO: 6989497 - DNA, 22 bp, Homo sapiens
aatctgtttccattagagtcat

SEQ ID NO: 6989498 - DNA, 22 bp, Homo sapiens
tagtttccttggctattaggca

SEQ ID NO: 6989499 - DNA, 22 bp, Homo sapiens
tgtattttcttctggaagctta

SEQ ID NO: 6989500 - DNA, 22 bp, Homo sapiens
aggcaactaggcctctgcctca

SEQ ID NO: 6989501 - DNA, 17 bp, Homo sapiens
atctgctgacattctgt

SEQ ID NO: 6989502 - DNA, 22 bp, Homo sapiens
tcagcaatatgataggctttgt

SEQ ID NO: 6989503 - DNA, 22 bp, Homo sapiens
ggctcaccatggcctccctgct

SEQ ID NO: 6989504 - DNA, 22 bp, Homo sapiens
ggaatatagccagtaacagtca

SEQ ID NO: 6989505 - DNA, 22 bp, Homo sapiens
ccctgatagcccctatcatcag

SEQ ID NO: 6989506 - DNA, 22 bp, Homo sapiens
ggaatcagaattactgaatgga

SEQ ID NO: 6989507 - DNA, 23 bp, Homo sapiens
ttgcatcctgacgtctattttct

SEQ ID NO: 6989508 - DNA, 22 bp, Homo sapiens
ttggttactaaaaactgtttgg

SEQ ID NO: 6989509 - DNA, 22 bp, Homo sapiens
ggaagccagttgcttggtgtgg

SEQ ID NO: 6989510 - DNA, 20 bp, Homo sapiens
tccagttacatagaggaaag

SEQ ID NO: 6989511 - DNA, 22 bp, Homo sapiens
tcaagatgtccagtgcctataa

SEQ ID NO: 6989512 - DNA, 20 bp, Homo sapiens
ccaccctgtccggggcggag

SEQ ID NO: 6989513 - DNA, 22 bp, Homo sapiens
ataatcagaattcatgaaagat

SEQ ID NO: 6989514 - DNA, 19 bp, Homo sapiens
ttattcttaaagtagctta

SEQ ID NO: 6989515 - DNA, 22 bp, Homo sapiens
gattgctgaagaaagtgagtga

SEQ ID NO: 6989516 - DNA, 22 bp, Homo sapiens
ccagtgccttttgtgggtttgt

SEQ ID NO: 6989517 - DNA, 22 bp, Homo sapiens
tttaccatacatcaaaatattt

SEQ ID NO: 6989518 - DNA, 22 bp, Homo sapiens
ttttagtttggatttctaaagc

SEQ ID NO: 6989519 - DNA, 22 bp, Homo sapiens
caaggcagtgggctaggaacct

SEQ ID NO: 6989520 - DNA, 22 bp, Homo sapiens
accaggaggccttggttctgag

SEQ ID NO: 6989521 - DNA, 22 bp, Homo sapiens
gcatgcaaatagtcatgcttcc

SEQ ID NO: 6989522 - DNA, 22 bp, Homo sapiens
aaacactttagaaagggacttg

SEQ ID NO: 6989523 - DNA, 22 bp, Homo sapiens
gaagtcctcctatcttgctctt

SEQ ID NO: 6989524 - DNA, 22 bp, Homo sapiens
tcctggcttaggtttccagaac

SEQ ID NO: 6989525 - DNA, 22 bp, Homo sapiens
tttcctgtcctggtacttggca

SEQ ID NO: 6989526 - DNA, 22 bp, Homo sapiens
aaggatgttctagtttgctgag

SEQ ID NO: 6989527 - DNA, 22 bp, Homo sapiens
ttttctgtgccctgctagctgg

SEQ ID NO: 6989528 - DNA, 21 bp, Homo sapiens
ggccccagcccatgggttctc

SEQ ID NO: 6989529 - DNA, 22 bp, Homo sapiens
ctggagtcggcgccccaacaga

SEQ ID NO: 6989530 - DNA, 22 bp, Homo sapiens
atgtgcatgcacctggactgtg

SEQ ID NO: 6989531 - DNA, 22 bp, Homo sapiens
tttctccttgtgtctcctttga

SEQ ID NO: 6989532 - DNA, 22 bp, Homo sapiens
atagtttaaggaactatgcgat

SEQ ID NO: 6989533 - DNA, 22 bp, Homo sapiens
ttgccctagggtcttatcctcc

SEQ ID NO: 6989534 - DNA, 19 bp, Homo sapiens
tggaggtccaggagtaggg

SEQ ID NO: 6989535 - DNA, 22 bp, Homo sapiens
agcattactattctcaaaaaca

SEQ ID NO: 6989536 - DNA, 22 bp, Homo sapiens
atccatttgtttactgatggac

SEQ ID NO: 6989537 - DNA, 22 bp, Homo sapiens
tggaacttcatgagattatgga

SEQ ID NO: 6989538 - DNA, 22 bp, Homo sapiens
acttcaaattctgggggaagag

SEQ ID NO: 6989539 - DNA, 23 bp, Homo sapiens
tcctgcagataagctggttgaca

SEQ ID NO: 6989540 - DNA, 22 bp, Homo sapiens
aatgtatttgatgtattagcct

SEQ ID NO: 6989541 - DNA, 22 bp, Homo sapiens
caggaatagtggagcaacaaga

SEQ ID NO: 6989542 - DNA, 22 bp, Homo sapiens
cttggactggacccgaggaatg

SEQ ID NO: 6989543 - DNA, 22 bp, Homo sapiens
tctttgtgttcaggagccacgt

SEQ ID NO: 6989544 - DNA, 18 bp, Homo sapiens
tttgctgatgagcatcat

SEQ ID NO: 6989545 - DNA, 20 bp, Homo sapiens
tcagattttgggtcactgat

SEQ ID NO: 6989546 - DNA, 22 bp, Homo sapiens
gagaaaatagcatgtgtagtat

SEQ ID NO: 6989547 - DNA, 22 bp, Homo sapiens
tgtgaagatcagggtcctagag

SEQ ID NO: 6989548 - DNA, 22 bp, Homo sapiens
agtttggaatatggtgaatttt

SEQ ID NO: 6989549 - DNA, 22 bp, Homo sapiens
agctgctgagccatgtcctgct

SEQ ID NO: 6989550 - DNA, 22 bp, Homo sapiens
tttggaatattaaaatgtctca

SEQ ID NO: 6989551 - DNA, 22 bp, Homo sapiens
cagagcctttgtgtccacattt

SEQ ID NO: 6989552 - DNA, 22 bp, Homo sapiens
tgacaaagcatgatggtgacag

SEQ ID NO: 6989553 - DNA, 22 bp, Homo sapiens
agccatttcatacacctgcagc

SEQ ID NO: 6989554 - DNA, 22 bp, Homo sapiens
cactgggatttggggtgtctta

SEQ ID NO: 6989555 - DNA, 22 bp, Homo sapiens
ttcaagagtccaggagagtctg

SEQ ID NO: 6989556 - DNA, 22 bp, Homo sapiens
ggcacaaaggaataaagagaac

SEQ ID NO: 6989557 - DNA, 22 bp, Homo sapiens
gtgagagctcagctgccctggg

SEQ ID NO: 6989558 - DNA, 22 bp, Homo sapiens
cagaatctcgacttctggcccc

SEQ ID NO: 6989559 - DNA, 22 bp, Homo sapiens
tcaaggttgttgaggcctgact

SEQ ID NO: 6989560 - DNA, 22 bp, Homo sapiens
ttctaaatggggatcctttctg

SEQ ID NO: 6989561 - DNA, 19 bp, Homo sapiens
gctgaaatcaaatttggaa

SEQ ID NO: 6989562 - DNA, 22 bp, Homo sapiens
tccatacacattgaattttagt

SEQ ID NO: 6989563 - DNA, 22 bp, Homo sapiens
gcctctgcaggtgcggttatcc

SEQ ID NO: 6989564 - DNA, 22 bp, Homo sapiens
tcagtgtgttcaattggatagg

SEQ ID NO: 6989565 - DNA, 22 bp, Homo sapiens
gcctgtttctaatctcatttct

SEQ ID NO: 6989566 - DNA, 22 bp, Homo sapiens
ggggctgacgggcatgtggctt

SEQ ID NO: 6989567 - DNA, 22 bp, Homo sapiens
ggtgaagccagggcatcaatat

SEQ ID NO: 6989568 - DNA, 22 bp, Homo sapiens
cctccacaggagctgcagtgct

SEQ ID NO: 6989569 - DNA, 22 bp, Homo sapiens
agcttaaagccgccatctagta

SEQ ID NO: 6989570 - DNA, 22 bp, Homo sapiens
tttctctctacagtactttcat

SEQ ID NO: 6989571 - DNA, 22 bp, Homo sapiens
tacagtgtctgcaactgcacac

SEQ ID NO: 6989572 - DNA, 22 bp, Homo sapiens
ggcattgtctatttgcattcat

SEQ ID NO: 6989573 - DNA, 22 bp, Homo sapiens
catatcttctgacatgatcagg

SEQ ID NO: 6989574 - DNA, 22 bp, Homo sapiens
catgcttattcattctgctaac

SEQ ID NO: 6989575 - DNA, 22 bp, Homo sapiens
atgaaactctaacttaacaagt

SEQ ID NO: 6989576 - DNA, 22 bp, Homo sapiens
agtgtttcaccgtatgttctca

SEQ ID NO: 6989577 - DNA, 22 bp, Homo sapiens
tgaaaccttggatgtgtagaaa

SEQ ID NO: 6989578 - DNA, 22 bp, Homo sapiens
ggtagtgttgagcagtgcaaat

SEQ ID NO: 6989579 - DNA, 23 bp, Homo sapiens
actacagatactcctgctgtttg

SEQ ID NO: 6989580 - DNA, 22 bp, Homo sapiens
gccctgcgccgtcccgctggtg

SEQ ID NO: 6989581 - DNA, 22 bp, Homo sapiens
aaagatgtcacaagatgtgatg

SEQ ID NO: 6989582 - DNA, 22 bp, Homo sapiens
gtcaacagtattaggacatttg

SEQ ID NO: 6989583 - DNA, 22 bp, Homo sapiens
agagcagctgtgacatggacag

SEQ ID NO: 6989584 - DNA, 22 bp, Homo sapiens
ggtaacacatggaacatttaca

SEQ ID NO: 6989585 - DNA, 22 bp, Homo sapiens
actgaggatggataggtcatat

SEQ ID NO: 6989586 - DNA, 22 bp, Homo sapiens
aaacaacttctgcactatgggt

SEQ ID NO: 6989587 - DNA, 22 bp, Homo sapiens
attattcttaatgcagggatta

SEQ ID NO: 6989588 - DNA, 20 bp, Homo sapiens
actgcctttaggtatccttg

SEQ ID NO: 6989589 - DNA, 22 bp, Homo sapiens
gttcattcaatctatttgcttc

SEQ ID NO: 6989590 - DNA, 22 bp, Homo sapiens
atctgggagcggaggttgcagt

SEQ ID NO: 6989591 - DNA, 22 bp, Homo sapiens
cgtcccagttccagccgcgctg

SEQ ID NO: 6989592 - DNA, 18 bp, Homo sapiens
tctggctcaggactgaac

SEQ ID NO: 6989593 - DNA, 22 bp, Homo sapiens
tcaaatgaggctgatgaatgtg

SEQ ID NO: 6989594 - DNA, 22 bp, Homo sapiens
atgtagttgaagtgctataaag

SEQ ID NO: 6989595 - DNA, 22 bp, Homo sapiens
caatttctaacattccatggat

SEQ ID NO: 6989596 - DNA, 22 bp, Homo sapiens
ggagggctgccaggtggagcgg

SEQ ID NO: 6989597 - DNA, 22 bp, Homo sapiens
tcctgggcttagtggctaggtc

SEQ ID NO: 6989598 - DNA, 22 bp, Homo sapiens
agctgagaatcttccccagtgt

SEQ ID NO: 6989599 - DNA, 22 bp, Homo sapiens
aagagcatggaatggagatcca

SEQ ID NO: 6989600 - DNA, 22 bp, Homo sapiens
acaatctggaaaagttaactat

SEQ ID NO: 6989601 - DNA, 22 bp, Homo sapiens
aagaggctagccggctcactaa

SEQ ID NO: 6989602 - DNA, 22 bp, Homo sapiens
tcctgtggaagacagtgttggg

SEQ ID NO: 6989603 - DNA, 22 bp, Homo sapiens
catcatctggcttttagaaaaa

SEQ ID NO: 6989604 - DNA, 22 bp, Homo sapiens
atttagacaccagcttgtaagg

SEQ ID NO: 6989605 - DNA, 22 bp, Homo sapiens
attaatatcccccgccgttctg

SEQ ID NO: 6989606 - DNA, 22 bp, Homo sapiens
cagagctctgacagctacagcc

SEQ ID NO: 6989607 - DNA, 22 bp, Homo sapiens
aggctgggaaatgtattccagc

SEQ ID NO: 6989608 - DNA, 20 bp, Homo sapiens
aagcacatttctacaataat

SEQ ID NO: 6989609 - DNA, 23 bp, Homo sapiens
atgttgtcatctgcattccactg

SEQ ID NO: 6989610 - DNA, 22 bp, Homo sapiens
tgctcagggagcatagtgaatt

SEQ ID NO: 6989611 - DNA, 22 bp, Homo sapiens
tcaggaaatggtgatttggttg

SEQ ID NO: 6989612 - DNA, 22 bp, Homo sapiens
agcagcaaaagagaatagtttg

SEQ ID NO: 6989613 - DNA, 22 bp, Homo sapiens
aaaaccacaatgacttttgcac

SEQ ID NO: 6989614 - DNA, 22 bp, Homo sapiens
tcttctcaaaaaatgtaggtgg

SEQ ID NO: 6989615 - DNA, 22 bp, Homo sapiens
ctccctgtgtcttcacttggcc

SEQ ID NO: 6989616 - DNA, 22 bp, Homo sapiens
aatgttgtacctatgctgagag

SEQ ID NO: 6989617 - DNA, 22 bp, Homo sapiens
actatacagtatgtacgtgcac

SEQ ID NO: 6989618 - DNA, 20 bp, Homo sapiens
agcaaggctggagcttatgg

SEQ ID NO: 6989619 - DNA, 21 bp, Homo sapiens
gtccttcagcaagttagtggc

SEQ ID NO: 6989620 - DNA, 22 bp, Homo sapiens
cagctgccatgacatgtcctgc

SEQ ID NO: 6989621 - DNA, 19 bp, Homo sapiens
tggaaatggaagctcagcc

SEQ ID NO: 6989622 - DNA, 22 bp, Homo sapiens
ctacagtagagtaggcctctga

SEQ ID NO: 6989623 - DNA, 22 bp, Homo sapiens
ttgggctggagatgatctgctg

SEQ ID NO: 6989624 - DNA, 22 bp, Homo sapiens
ttcatataccttgcgtttcaca

SEQ ID NO: 6989625 - DNA, 22 bp, Homo sapiens
ccgtggttgagttgggctacag

SEQ ID NO: 6989626 - DNA, 22 bp, Homo sapiens
ggtctgtctttcttgtccccag

SEQ ID NO: 6989627 - DNA, 19 bp, Homo sapiens
tggctataattccagagct

SEQ ID NO: 6989628 - DNA, 22 bp, Homo sapiens
ttaaatgacttttattattctc

SEQ ID NO: 6989629 - DNA, 22 bp, Homo sapiens
acatgtctccacccatcttaaa

SEQ ID NO: 6989630 - DNA, 19 bp, Homo sapiens
agcaccatagccctgaaag

SEQ ID NO: 6989631 - DNA, 22 bp, Homo sapiens
ctaggcatccagactgggcttg

SEQ ID NO: 6989632 - DNA, 22 bp, Homo sapiens
cctgagggatctgtggaatagc

SEQ ID NO: 6989633 - DNA, 22 bp, Homo sapiens
gagctgggcacacgccacttga

SEQ ID NO: 6989634 - DNA, 22 bp, Homo sapiens
ctgtgaaatcaaccttgagccc

SEQ ID NO: 6989635 - DNA, 20 bp, Homo sapiens
gagattaactgagaatctag

SEQ ID NO: 6989636 - DNA, 22 bp, Homo sapiens
ctccaggagtggcctggacacc

SEQ ID NO: 6989637 - DNA, 22 bp, Homo sapiens
cgaggcagaggctgaaacggct

SEQ ID NO: 6989638 - DNA, 23 bp, Homo sapiens
atgtccagtttacttcaggatga

SEQ ID NO: 6989639 - DNA, 20 bp, Homo sapiens
tggtggactttggcatggct

SEQ ID NO: 6989640 - DNA, 22 bp, Homo sapiens
agttgctgattctgtctgtgat

SEQ ID NO: 6989641 - DNA, 22 bp, Homo sapiens
agtctccacttgacatcagcag

SEQ ID NO: 6989642 - DNA, 22 bp, Homo sapiens
gacaaggcaaccagggaggctt

SEQ ID NO: 6989643 - DNA, 22 bp, Homo sapiens
ctacaacaccaggcacggagtg

SEQ ID NO: 6989644 - DNA, 22 bp, Homo sapiens
gttaggaagtggtaaggttctg

SEQ ID NO: 6989645 - DNA, 22 bp, Homo sapiens
tgcacaggtatgcaaagcatgt

SEQ ID NO: 6989646 - DNA, 22 bp, Homo sapiens
atgcatcaccgagttgcccacc

SEQ ID NO: 6989647 - DNA, 22 bp, Homo sapiens
ctttaagagatcaccaatcaca

SEQ ID NO: 6989648 - DNA, 22 bp, Homo sapiens
gggctccaacggtgagcatgga

SEQ ID NO: 6989649 - DNA, 22 bp, Homo sapiens
aaagccagctctgagctgcacc

SEQ ID NO: 6989650 - DNA, 22 bp, Homo sapiens
gctcaagatgtggcctctgaag

SEQ ID NO: 6989651 - DNA, 23 bp, Homo sapiens
aaattattgctcttcaattgcct

SEQ ID NO: 6989652 - DNA, 22 bp, Homo sapiens
atggggcagaggttaaaggtgg

SEQ ID NO: 6989653 - DNA, 21 bp, Homo sapiens
atgtggctcccttcctcagga

SEQ ID NO: 6989654 - DNA, 22 bp, Homo sapiens
ggctgaaaccgttatccactga

SEQ ID NO: 6989655 - DNA, 22 bp, Homo sapiens
atcatgcaggtttctcctttct

SEQ ID NO: 6989656 - DNA, 22 bp, Homo sapiens
aaccttgaatacttaaatacat

SEQ ID NO: 6989657 - DNA, 22 bp, Homo sapiens
gaggagggctttgttgatgtta

SEQ ID NO: 6989658 - DNA, 22 bp, Homo sapiens
agggactccgtgcacagtggtt

SEQ ID NO: 6989659 - DNA, 22 bp, Homo sapiens
cactgctttttctcctcactgg

SEQ ID NO: 6989660 - DNA, 22 bp, Homo sapiens
gcccagcagctccacttggctt

SEQ ID NO: 6989661 - DNA, 20 bp, Homo sapiens
tcacacataagtgaacgcac

SEQ ID NO: 6989662 - DNA, 22 bp, Homo sapiens
gggagtccaaattggtacaata

SEQ ID NO: 6989663 - DNA, 22 bp, Homo sapiens
catacattacctaacttaatgc

SEQ ID NO: 6989664 - DNA, 22 bp, Homo sapiens
cacaggtgttcttgcagtgaaa

SEQ ID NO: 6989665 - DNA, 22 bp, Homo sapiens
cctgaccagagtgagggcttag

SEQ ID NO: 6989666 - DNA, 23 bp, Homo sapiens
tctccaggccttactccaggcct

SEQ ID NO: 6989667 - DNA, 22 bp, Homo sapiens
tcaggggctgtgcatttcccag

SEQ ID NO: 6989668 - DNA, 22 bp, Homo sapiens
tgtattcatgtgagcctaggaa

SEQ ID NO: 6989669 - DNA, 22 bp, Homo sapiens
ggaggaaatgaaaggagggttt

SEQ ID NO: 6989670 - DNA, 22 bp, Homo sapiens
atgaactgcatgtattttagtg

SEQ ID NO: 6989671 - DNA, 22 bp, Homo sapiens
gaactctaggtaaatgagatat

SEQ ID NO: 6989672 - DNA, 22 bp, Homo sapiens
aacttgtttcttccattcaaca

SEQ ID NO: 6989673 - DNA, 22 bp, Homo sapiens
tgctagggatgtagcagtgaag

SEQ ID NO: 6989674 - DNA, 21 bp, Homo sapiens
tgaataaagctgctgtcgata

SEQ ID NO: 6989675 - DNA, 22 bp, Homo sapiens
ttggccaacagcgacagggcca

SEQ ID NO: 6989676 - DNA, 22 bp, Homo sapiens
atggaaggtcctacagagcgca

SEQ ID NO: 6989677 - DNA, 22 bp, Homo sapiens
tcagctgcataacaaagtatga

SEQ ID NO: 6989678 - DNA, 22 bp, Homo sapiens
aaaagacatctatttcaggcag

SEQ ID NO: 6989679 - DNA, 22 bp, Homo sapiens
gtgtggccaattatgggcattc

SEQ ID NO: 6989680 - DNA, 22 bp, Homo sapiens
caatttctgggcctcacacaag

SEQ ID NO: 6989681 - DNA, 22 bp, Homo sapiens
aataggactttggtcctagctc

SEQ ID NO: 6989682 - DNA, 22 bp, Homo sapiens
gtgcagctgtgtgagagctcca

SEQ ID NO: 6989683 - DNA, 20 bp, Homo sapiens
gccttccagttcagtggcac

SEQ ID NO: 6989684 - DNA, 22 bp, Homo sapiens
tataagtgtgtcagcttccaac

SEQ ID NO: 6989685 - DNA, 22 bp, Homo sapiens
aagattttcagctaatggtgca

SEQ ID NO: 6989686 - DNA, 22 bp, Homo sapiens
gaggaggttccgggtggagaag

SEQ ID NO: 6989687 - DNA, 22 bp, Homo sapiens
gtcctggattgaacataggcag

SEQ ID NO: 6989688 - DNA, 22 bp, Homo sapiens
cctgcagaaagggtccccagga

SEQ ID NO: 6989689 - DNA, 22 bp, Homo sapiens
tattttgaggtatttttgagct

SEQ ID NO: 6989690 - DNA, 22 bp, Homo sapiens
tcaatttctcagaaatggtctt

SEQ ID NO: 6989691 - DNA, 22 bp, Homo sapiens
atggaaatgttaagtcagtccg

SEQ ID NO: 6989692 - DNA, 19 bp, Homo sapiens
accaggagacagtgagctt

SEQ ID NO: 6989693 - DNA, 22 bp, Homo sapiens
gcctaataactagctgtgtaac

SEQ ID NO: 6989694 - DNA, 22 bp, Homo sapiens
tgtttaatcttcaggacagtct

SEQ ID NO: 6989695 - DNA, 22 bp, Homo sapiens
tatcagtagataaacggattgc

SEQ ID NO: 6989696 - DNA, 22 bp, Homo sapiens
ctctgctactgttaaaccattt

SEQ ID NO: 6989697 - DNA, 22 bp, Homo sapiens
cagcttctccattcttctggct

SEQ ID NO: 6989698 - DNA, 22 bp, Homo sapiens
gagtcaggctagaggtgagtct

SEQ ID NO: 6989699 - DNA, 22 bp, Homo sapiens
gcagcagctccctatccaggct

SEQ ID NO: 6989700 - DNA, 22 bp, Homo sapiens
tctgtacttacaacggagttca

SEQ ID NO: 6989701 - DNA, 22 bp, Homo sapiens
agacatgcaataatgtgcactc

SEQ ID NO: 6989702 - DNA, 22 bp, Homo sapiens
gggaaggacacagccatgactg

SEQ ID NO: 6989703 - DNA, 22 bp, Homo sapiens
aagccaagtgctggccatgggc

SEQ ID NO: 6989704 - DNA, 22 bp, Homo sapiens
cctggagtggggtccgtgcatg

SEQ ID NO: 6989705 - DNA, 22 bp, Homo sapiens
cttccaaatgtaaataagtttc

SEQ ID NO: 6989706 - DNA, 22 bp, Homo sapiens
ctgaaggcatttttgctgattt

SEQ ID NO: 6989707 - DNA, 22 bp, Homo sapiens
taagaacttcggacatgttatc

SEQ ID NO: 6989708 - DNA, 22 bp, Homo sapiens
ctgtgtttgacaggcggtctcc

SEQ ID NO: 6989709 - DNA, 22 bp, Homo sapiens
caggaaagaaatgagaacacca

SEQ ID NO: 6989710 - DNA, 22 bp, Homo sapiens
gcttcattactgacagtctgtg

SEQ ID NO: 6989711 - DNA, 22 bp, Homo sapiens
atgtatacgtgcaggtcacagg

SEQ ID NO: 6989712 - DNA, 21 bp, Homo sapiens
gaattgtgccccttggtgttg

SEQ ID NO: 6989713 - DNA, 22 bp, Homo sapiens
gggctgattcgatgggggtaga

SEQ ID NO: 6989714 - DNA, 22 bp, Homo sapiens
tatgacttatttcatcagttct

SEQ ID NO: 6989715 - DNA, 22 bp, Homo sapiens
tgagggtctggaatctgggctt

SEQ ID NO: 6989716 - DNA, 22 bp, Homo sapiens
ctaatactcatttctgtaactc

SEQ ID NO: 6989717 - DNA, 22 bp, Homo sapiens
tgaagaacgtgagatccagaaa

SEQ ID NO: 6989718 - DNA, 22 bp, Homo sapiens
agacctgcagggccaggcctgc

SEQ ID NO: 6989719 - DNA, 22 bp, Homo sapiens
ttggctgtcactgtcagttcag

SEQ ID NO: 6989720 - DNA, 23 bp, Homo sapiens
cctccccaccagactctaacata

SEQ ID NO: 6989721 - DNA, 22 bp, Homo sapiens
ggtgggtggaaacagcatgtac

SEQ ID NO: 6989722 - DNA, 22 bp, Homo sapiens
gttatattggcagaagagaaga

SEQ ID NO: 6989723 - DNA, 22 bp, Homo sapiens
ttcagagatggaaggcagaatg

SEQ ID NO: 6989724 - DNA, 22 bp, Homo sapiens
tgtgtataattagaccatttac

SEQ ID NO: 6989725 - DNA, 22 bp, Homo sapiens
ccatgctgtgacacagtagtta

SEQ ID NO: 6989726 - DNA, 22 bp, Homo sapiens
gagaacagtgttgtattttttc

SEQ ID NO: 6989727 - DNA, 22 bp, Homo sapiens
aaagtcatacatggtgcttact

SEQ ID NO: 6989728 - DNA, 22 bp, Homo sapiens
ggatgtctggtctatttcaagt

SEQ ID NO: 6989729 - DNA, 22 bp, Homo sapiens
ccagagtcccttgcagctcagt

SEQ ID NO: 6989730 - DNA, 22 bp, Homo sapiens
tgagacatgctgtccaagaagt

SEQ ID NO: 6989731 - DNA, 22 bp, Homo sapiens
atgcagtccacaggccacagtg

SEQ ID NO: 6989732 - DNA, 22 bp, Homo sapiens
cctggaatctggagttggaatc

SEQ ID NO: 6989733 - DNA, 22 bp, Homo sapiens
gaaaagtacacagcccaaacat

SEQ ID NO: 6989734 - DNA, 22 bp, Homo sapiens
acttagtggctatgtgacctta

SEQ ID NO: 6989735 - DNA, 22 bp, Homo sapiens
tagaggcttctactgctcactt

SEQ ID NO: 6989736 - DNA, 22 bp, Homo sapiens
cacagtaaggtatcccagtgaa

SEQ ID NO: 6989737 - DNA, 22 bp, Homo sapiens
aggacagagccctagtttcata

SEQ ID NO: 6989738 - DNA, 22 bp, Homo sapiens
ctcttgggatttgcaggctcag

SEQ ID NO: 6989739 - DNA, 22 bp, Homo sapiens
gaggggtgtggagccatcagtt

SEQ ID NO: 6989740 - DNA, 22 bp, Homo sapiens
tccaagggcagccatagaactt

SEQ ID NO: 6989741 - DNA, 22 bp, Homo sapiens
taaaaaacattactctgtcctg

SEQ ID NO: 6989742 - DNA, 22 bp, Homo sapiens
ccagcagagctggaagtgtgct

SEQ ID NO: 6989743 - DNA, 22 bp, Homo sapiens
caggtgggctgcctctccagct

SEQ ID NO: 6989744 - DNA, 17 bp, Homo sapiens
ctcttttgtcttcttcc

SEQ ID NO: 6989745 - DNA, 22 bp, Homo sapiens
agtctggattttctacccttct

SEQ ID NO: 6989746 - DNA, 22 bp, Homo sapiens
ccagggtgtgggcgtcggcacg

SEQ ID NO: 6989747 - DNA, 22 bp, Homo sapiens
cattatctcttctatatgctag

SEQ ID NO: 6989748 - DNA, 22 bp, Homo sapiens
aagaaaggatatatgggaggta

SEQ ID NO: 6989749 - DNA, 22 bp, Homo sapiens
acagatgagaagctgcattcaa

SEQ ID NO: 6989750 - DNA, 22 bp, Homo sapiens
tgctgctgtttcctacatctca

SEQ ID NO: 6989751 - DNA, 22 bp, Homo sapiens
acagctgccaagacagagcagg

SEQ ID NO: 6989752 - DNA, 22 bp, Homo sapiens
atgacagcattcaagacataga

SEQ ID NO: 6989753 - DNA, 22 bp, Homo sapiens
atgacttttaggagcagtgctc

SEQ ID NO: 6989754 - DNA, 22 bp, Homo sapiens
taggacagttatgggttttatt

SEQ ID NO: 6989755 - DNA, 22 bp, Homo sapiens
gatttcttcatttgtggtgaat

SEQ ID NO: 6989756 - DNA, 22 bp, Homo sapiens
tctgtttcttcctagccatgct

SEQ ID NO: 6989757 - DNA, 22 bp, Homo sapiens
tgacagaactttttcacatctc

SEQ ID NO: 6989758 - DNA, 20 bp, Homo sapiens
ggcaatgccagatgacagga

SEQ ID NO: 6989759 - DNA, 22 bp, Homo sapiens
gcagggccttagcagcggctgc

SEQ ID NO: 6989760 - DNA, 22 bp, Homo sapiens
cagtgaagttctactgaatggt

SEQ ID NO: 6989761 - DNA, 22 bp, Homo sapiens
actttagaaaagcatccataga

SEQ ID NO: 6989762 - DNA, 22 bp, Homo sapiens
ctgtagctccagcctgtctaca

SEQ ID NO: 6989763 - DNA, 22 bp, Homo sapiens
tcctggtgttactaaattgaaa

SEQ ID NO: 6989764 - DNA, 22 bp, Homo sapiens
tggctctgccactaacttggta

SEQ ID NO: 6989765 - DNA, 22 bp, Homo sapiens
aaggctggcaatatatttgtta

SEQ ID NO: 6989766 - DNA, 22 bp, Homo sapiens
ttcagaggctctgccaatgtgt

SEQ ID NO: 6989767 - DNA, 22 bp, Homo sapiens
agaatcattagagagaaaactt

SEQ ID NO: 6989768 - DNA, 22 bp, Homo sapiens
tctgatgtggcagctgcatcta

SEQ ID NO: 6989769 - DNA, 22 bp, Homo sapiens
ttaaggccttaacccccaatat

SEQ ID NO: 6989770 - DNA, 22 bp, Homo sapiens
ggcctctcttgggacagctgtc

SEQ ID NO: 6989771 - DNA, 22 bp, Homo sapiens
tgttaaaaccacaggtgaggac

SEQ ID NO: 6989772 - DNA, 22 bp, Homo sapiens
ctattttccgcagcaggaagta

SEQ ID NO: 6989773 - DNA, 22 bp, Homo sapiens
gatgtctttagggcaaaatatt

SEQ ID NO: 6989774 - DNA, 22 bp, Homo sapiens
cttggagcccagcaggcctgga

SEQ ID NO: 6989775 - DNA, 22 bp, Homo sapiens
ctgggtgattcctgtccaggca

SEQ ID NO: 6989776 - DNA, 21 bp, Homo sapiens
tgacatttggattcatagtaa

SEQ ID NO: 6989777 - DNA, 22 bp, Homo sapiens
acctgtgttttccctcagtttc

SEQ ID NO: 6989778 - DNA, 22 bp, Homo sapiens
tgcatggacgtgacttggccaa

SEQ ID NO: 6989779 - DNA, 22 bp, Homo sapiens
tgggacctgaagcaggttggca

SEQ ID NO: 6989780 - DNA, 22 bp, Homo sapiens
aggagtcattgagaggggtcct

SEQ ID NO: 6989781 - DNA, 22 bp, Homo sapiens
agacctctggatagatgtgagg

SEQ ID NO: 6989782 - DNA, 22 bp, Homo sapiens
gacagacttcatatccttcctc

SEQ ID NO: 6989783 - DNA, 22 bp, Homo sapiens
gggacactcaatgagacctgca

SEQ ID NO: 6989784 - DNA, 22 bp, Homo sapiens
aaagactcactttcagctctgg

SEQ ID NO: 6989785 - DNA, 19 bp, Homo sapiens
acaaattggcaaaatgcaa

SEQ ID NO: 6989786 - DNA, 22 bp, Homo sapiens
atcatcttaaggtatctcaagc

SEQ ID NO: 6989787 - DNA, 22 bp, Homo sapiens
gttactagggactgagagtaaa

SEQ ID NO: 6989788 - DNA, 22 bp, Homo sapiens
agttttataaaggcacctcagt

SEQ ID NO: 6989789 - DNA, 22 bp, Homo sapiens
ataacctggtagtattaaatgt

SEQ ID NO: 6989790 - DNA, 22 bp, Homo sapiens
cctctaggatgtggctggagga

SEQ ID NO: 6989791 - DNA, 22 bp, Homo sapiens
aatagacaattctagccaacat

SEQ ID NO: 6989792 - DNA, 22 bp, Homo sapiens
aggtggagacccagagaaggcg

SEQ ID NO: 6989793 - DNA, 22 bp, Homo sapiens
gtgcattagtttcctattgctg

SEQ ID NO: 6989794 - DNA, 22 bp, Homo sapiens
caatgttttgttgaatgaatag

SEQ ID NO: 6989795 - DNA, 22 bp, Homo sapiens
aagaataacacttaggttttgc

SEQ ID NO: 6989796 - DNA, 22 bp, Homo sapiens
ctctccccggtacgagcggccg

SEQ ID NO: 6989797 - DNA, 22 bp, Homo sapiens
aaggacaggcacagtggtggag

SEQ ID NO: 6989798 - DNA, 20 bp, Homo sapiens
agattcactgaaggatttta

SEQ ID NO: 6989799 - DNA, 19 bp, Homo sapiens
atagagtagagtatctgtt

SEQ ID NO: 6989800 - DNA, 22 bp, Homo sapiens
tattatatttagtaatgtggag

SEQ ID NO: 6989801 - DNA, 22 bp, Homo sapiens
gtgggatgcagtggtgagtggc

SEQ ID NO: 6989802 - DNA, 22 bp, Homo sapiens
tctttccctgtgttagcctgta

SEQ ID NO: 6989803 - DNA, 22 bp, Homo sapiens
catgaagtcactggagctttca

SEQ ID NO: 6989804 - DNA, 22 bp, Homo sapiens
tggaattaataggggatataca

SEQ ID NO: 6989805 - DNA, 22 bp, Homo sapiens
tcttcatgataccctaagccac

SEQ ID NO: 6989806 - DNA, 22 bp, Homo sapiens
aggcaggggagctggaagggta

SEQ ID NO: 6989807 - DNA, 22 bp, Homo sapiens
actcacagactgcaggtttatt

SEQ ID NO: 6989808 - DNA, 22 bp, Homo sapiens
taagagattctaaagctactgg

SEQ ID NO: 6989809 - DNA, 22 bp, Homo sapiens
tctttggatggaaaatgtattc

SEQ ID NO: 6989810 - DNA, 22 bp, Homo sapiens
aattcctagttgtacttagtga

SEQ ID NO: 6989811 - DNA, 22 bp, Homo sapiens
actcccagaacatgctcttctt

SEQ ID NO: 6989812 - DNA, 23 bp, Homo sapiens
ggacacaggccttgtctgcgcct

SEQ ID NO: 6989813 - DNA, 22 bp, Homo sapiens
acatgagaagctgcaacatgac

SEQ ID NO: 6989814 - DNA, 22 bp, Homo sapiens
tgcagctgtgggagaatctctg

SEQ ID NO: 6989815 - DNA, 22 bp, Homo sapiens
aagtgcatggtatggtctccat

SEQ ID NO: 6989816 - DNA, 22 bp, Homo sapiens
tattgaggattgaggaaagcac

SEQ ID NO: 6989817 - DNA, 22 bp, Homo sapiens
gtgcagggtagcgacggcagga

SEQ ID NO: 6989818 - DNA, 22 bp, Homo sapiens
caaatagacttaagcatctgta

SEQ ID NO: 6989819 - DNA, 22 bp, Homo sapiens
gtgctgtgtgatccatgctggc

SEQ ID NO: 6989820 - DNA, 22 bp, Homo sapiens
aaagaaacctatcagccacatg

SEQ ID NO: 6989821 - DNA, 18 bp, Homo sapiens
tctctaccagaagtgacg

SEQ ID NO: 6989822 - DNA, 22 bp, Homo sapiens
ttataattgcttattagaccca

SEQ ID NO: 6989823 - DNA, 22 bp, Homo sapiens
taatccacggaccggcagcatt

SEQ ID NO: 6989824 - DNA, 22 bp, Homo sapiens
tgctgagacacctaaggtaaat

SEQ ID NO: 6989825 - DNA, 22 bp, Homo sapiens
atttggcagccacagcaatctt

SEQ ID NO: 6989826 - DNA, 23 bp, Homo sapiens
cacaactaatcagaatctctagg

SEQ ID NO: 6989827 - DNA, 22 bp, Homo sapiens
aggtccaggagatttggcaatt

SEQ ID NO: 6989828 - DNA, 22 bp, Homo sapiens
ctgttttatctcaagagttcaa

SEQ ID NO: 6989829 - DNA, 22 bp, Homo sapiens
ggctttgtggggtgaagtaaag

SEQ ID NO: 6989830 - DNA, 22 bp, Homo sapiens
cggttctcgcctctgctgctcc

SEQ ID NO: 6989831 - DNA, 22 bp, Homo sapiens
gaaaatttaattctcttctgtg

SEQ ID NO: 6989832 - DNA, 22 bp, Homo sapiens
tagatcctgcataggttgtgct

SEQ ID NO: 6989833 - DNA, 22 bp, Homo sapiens
ttgggctgcagcaattattagt

SEQ ID NO: 6989834 - DNA, 22 bp, Homo sapiens
aaaggagagtaggttactccat

SEQ ID NO: 6989835 - DNA, 22 bp, Homo sapiens
caccataaccaacatgtcagtt

SEQ ID NO: 6989836 - DNA, 22 bp, Homo sapiens
tggcatttcacctttcatttcc

SEQ ID NO: 6989837 - DNA, 22 bp, Homo sapiens
tgaggtagtagatttttgtcca

SEQ ID NO: 6989838 - DNA, 22 bp, Homo sapiens
cttccctgataagagcctcaga

SEQ ID NO: 6989839 - DNA, 22 bp, Homo sapiens
actgtgccttcagttttggggt

SEQ ID NO: 6989840 - DNA, 21 bp, Homo sapiens
tttcttcccttggcttctgag

SEQ ID NO: 6989841 - DNA, 22 bp, Homo sapiens
cctactctgtgagccactttgc

SEQ ID NO: 6989842 - DNA, 22 bp, Homo sapiens
gagtaaatcgtcattgcagcat

SEQ ID NO: 6989843 - DNA, 22 bp, Homo sapiens
tcagtgtccaaaaagaggcaag

SEQ ID NO: 6989844 - DNA, 22 bp, Homo sapiens
tctggctcacttcaggcttcac

SEQ ID NO: 6989845 - DNA, 22 bp, Homo sapiens
attaaaactaaaatgcctgatt

SEQ ID NO: 6989846 - DNA, 22 bp, Homo sapiens
gtacataagaaattactacaga

SEQ ID NO: 6989847 - DNA, 22 bp, Homo sapiens
gtcctctgaagttgtgcaatgc

SEQ ID NO: 6989848 - DNA, 22 bp, Homo sapiens
tggctaggaaagagttctggga

SEQ ID NO: 6989849 - DNA, 22 bp, Homo sapiens
ttagccaggggagcagcttgtc

SEQ ID NO: 6989850 - DNA, 22 bp, Homo sapiens
tctgagctgggggcctggcatg

SEQ ID NO: 6989851 - DNA, 22 bp, Homo sapiens
cacgcttggcttatacagagaa

SEQ ID NO: 6989852 - DNA, 22 bp, Homo sapiens
aatagagacctagatgccatga

SEQ ID NO: 6989853 - DNA, 23 bp, Homo sapiens
agagttttctgttttctgtaggg

SEQ ID NO: 6989854 - DNA, 22 bp, Homo sapiens
ttctcagggtctggatggcctg

SEQ ID NO: 6989855 - DNA, 22 bp, Homo sapiens
ctatgagaagaaaacaagatta

SEQ ID NO: 6989856 - DNA, 22 bp, Homo sapiens
tagctggcaaaggggaattagg

SEQ ID NO: 6989857 - DNA, 22 bp, Homo sapiens
aggaaactgggcctcaggttag

SEQ ID NO: 6989858 - DNA, 22 bp, Homo sapiens
tcctgaacagctcctgagcatg

SEQ ID NO: 6989859 - DNA, 23 bp, Homo sapiens
acaggaggggacaggtggccgtg

SEQ ID NO: 6989860 - DNA, 23 bp, Homo sapiens
aggaagaggcaatttctcttaga

SEQ ID NO: 6989861 - DNA, 22 bp, Homo sapiens
agtttagaagaggaacttgtta

SEQ ID NO: 6989862 - DNA, 22 bp, Homo sapiens
atatgtattttaacgtgtaagg

SEQ ID NO: 6989863 - DNA, 22 bp, Homo sapiens
tggcttcaagtctaggttctac

SEQ ID NO: 6989864 - DNA, 22 bp, Homo sapiens
tgctataagtagacattcaaca

SEQ ID NO: 6989865 - DNA, 22 bp, Homo sapiens
gtgtacatagaattgtgctttg

SEQ ID NO: 6989866 - DNA, 22 bp, Homo sapiens
aaagtacagccacatccaagta

SEQ ID NO: 6989867 - DNA, 22 bp, Homo sapiens
ggccttgagcagggagaaacca

SEQ ID NO: 6989868 - DNA, 22 bp, Homo sapiens
ttgaagagaaccgcggcttatt

SEQ ID NO: 6989869 - DNA, 19 bp, Homo sapiens
ggctggcaagtgacagtgt

SEQ ID NO: 6989870 - DNA, 22 bp, Homo sapiens
actatacataaaacatttgggt

SEQ ID NO: 6989871 - DNA, 22 bp, Homo sapiens
gactggaaagcctgtcctcaga

SEQ ID NO: 6989872 - DNA, 22 bp, Homo sapiens
tccagcatgaaggggcttttat

SEQ ID NO: 6989873 - DNA, 22 bp, Homo sapiens
acagatatcctcagtctccaac

SEQ ID NO: 6989874 - DNA, 22 bp, Homo sapiens
atactacattattagagcctgg

SEQ ID NO: 6989875 - DNA, 22 bp, Homo sapiens
aactggattaactggctcaaat

SEQ ID NO: 6989876 - DNA, 22 bp, Homo sapiens
ttgtaacactcccactcttctt

SEQ ID NO: 6989877 - DNA, 22 bp, Homo sapiens
ctcagctctttatactagctgt

SEQ ID NO: 6989878 - DNA, 22 bp, Homo sapiens
agtttcagttctgtcatttata

SEQ ID NO: 6989879 - DNA, 17 bp, Homo sapiens
gcgcagctcctggcgcg

SEQ ID NO: 6989880 - DNA, 22 bp, Homo sapiens
tccagggatgccagccatgttg

SEQ ID NO: 6989881 - DNA, 22 bp, Homo sapiens
tttttcccatatagaaagccaa

SEQ ID NO: 6989882 - DNA, 22 bp, Homo sapiens
ctttgcaggagtatgtgataat

SEQ ID NO: 6989883 - DNA, 22 bp, Homo sapiens
aaggtcattgttgcatgttctc

SEQ ID NO: 6989884 - DNA, 23 bp, Homo sapiens
tagatgtttggggaactttgccc

SEQ ID NO: 6989885 - DNA, 22 bp, Homo sapiens
caggaaactgtgggcttaaatc

SEQ ID NO: 6989886 - DNA, 22 bp, Homo sapiens
gcaggtggagcagtagtctggt

SEQ ID NO: 6989887 - DNA, 22 bp, Homo sapiens
gcaggcaggagcccaactgcct

SEQ ID NO: 6989888 - DNA, 22 bp, Homo sapiens
cataacattaagcctctatttc

SEQ ID NO: 6989889 - DNA, 22 bp, Homo sapiens
tctaaactctgattaatccaca

SEQ ID NO: 6989890 - DNA, 18 bp, Homo sapiens
agggctgatgagtttggg

SEQ ID NO: 6989891 - DNA, 22 bp, Homo sapiens
gtccagggctaaatcaggttcc

SEQ ID NO: 6989892 - DNA, 22 bp, Homo sapiens
gcctgggagattaattaggaag

SEQ ID NO: 6989893 - DNA, 22 bp, Homo sapiens
ttctaagtgattctagctggac

SEQ ID NO: 6989894 - DNA, 23 bp, Homo sapiens
tggaagactcctctcttggctgc

SEQ ID NO: 6989895 - DNA, 16 bp, Homo sapiens
gggagtgaaggagggt

SEQ ID NO: 6989896 - DNA, 23 bp, Homo sapiens
tggggctgatggagacggaccag

SEQ ID NO: 6989897 - DNA, 22 bp, Homo sapiens
gagctgctggcctcctgcggga

SEQ ID NO: 6989898 - DNA, 21 bp, Homo sapiens
tccagacctccctctcctagc

SEQ ID NO: 6989899 - DNA, 22 bp, Homo sapiens
ggtgacctcacctggtcccacc

SEQ ID NO: 6989900 - DNA, 22 bp, Homo sapiens
tccaggtgacagagacaggata

SEQ ID NO: 6989901 - DNA, 22 bp, Homo sapiens
cagtctgatgttcgcaggtgaa

SEQ ID NO: 6989902 - DNA, 22 bp, Homo sapiens
aaagacattgaagaaggactta

SEQ ID NO: 6989903 - DNA, 22 bp, Homo sapiens
tctgcccaccagcggttgcata

SEQ ID NO: 6989904 - DNA, 21 bp, Homo sapiens
gtgaggtattaggacctacat

SEQ ID NO: 6989905 - DNA, 22 bp, Homo sapiens
taaatgacattcttaagtcttg

SEQ ID NO: 6989906 - DNA, 22 bp, Homo sapiens
ttctgtacaagttgtggctgct

SEQ ID NO: 6989907 - DNA, 22 bp, Homo sapiens
agctaaggacagttgatttaga

SEQ ID NO: 6989908 - DNA, 22 bp, Homo sapiens
aagcagcatcctgggcagacct

SEQ ID NO: 6989909 - DNA, 22 bp, Homo sapiens
gccacgcttactgcccaggtgt

SEQ ID NO: 6989910 - DNA, 22 bp, Homo sapiens
gagagctggagttatttctctg

SEQ ID NO: 6989911 - DNA, 22 bp, Homo sapiens
cacatgggtggatggatgcatg

SEQ ID NO: 6989912 - DNA, 22 bp, Homo sapiens
agagtgtcagccccagagtatg

SEQ ID NO: 6989913 - DNA, 21 bp, Homo sapiens
agcagaggctgcctggtgact

SEQ ID NO: 6989914 - DNA, 22 bp, Homo sapiens
ttataaagatccttccagagtt

SEQ ID NO: 6989915 - DNA, 22 bp, Homo sapiens
aagatacattttcttcagagaa

SEQ ID NO: 6989916 - DNA, 22 bp, Homo sapiens
cattttacgacatagggcaggc

SEQ ID NO: 6989917 - DNA, 22 bp, Homo sapiens
caggctgccctagcttggacat

SEQ ID NO: 6989918 - DNA, 22 bp, Homo sapiens
cagtttctttccattgttacct

SEQ ID NO: 6989919 - DNA, 21 bp, Homo sapiens
tgtgagtccatctgagcagaa

SEQ ID NO: 6989920 - DNA, 20 bp, Homo sapiens
ctttgggtttctcatgtaca

SEQ ID NO: 6989921 - DNA, 22 bp, Homo sapiens
tcccaccccggtcaagggctga

SEQ ID NO: 6989922 - DNA, 20 bp, Homo sapiens
ttccacatctttgcacatgc

SEQ ID NO: 6989923 - DNA, 22 bp, Homo sapiens
accctgagggtgctgggtttct

SEQ ID NO: 6989924 - DNA, 22 bp, Homo sapiens
ggcacttggatcttagttgggg

SEQ ID NO: 6989925 - DNA, 22 bp, Homo sapiens
tccctctccctattgcctggag

SEQ ID NO: 6989926 - DNA, 22 bp, Homo sapiens
gggctcttctcaggagctatct

SEQ ID NO: 6989927 - DNA, 22 bp, Homo sapiens
gcattgatcacagttgaggttt

SEQ ID NO: 6989928 - DNA, 22 bp, Homo sapiens
ccagcaggagagaacatttccc

SEQ ID NO: 6989929 - DNA, 19 bp, Homo sapiens
ctctggcctctggatgctg

SEQ ID NO: 6989930 - DNA, 22 bp, Homo sapiens
gtgcagggtcctaattgttaag

SEQ ID NO: 6989931 - DNA, 22 bp, Homo sapiens
ttacaagattgatttgcttggc

SEQ ID NO: 6989932 - DNA, 22 bp, Homo sapiens
ttttattgcaataaagtgtgta

SEQ ID NO: 6989933 - DNA, 22 bp, Homo sapiens
caaggtgattgggatagctggt

SEQ ID NO: 6989934 - DNA, 22 bp, Homo sapiens
atgcatgtgtacatgcatagca

SEQ ID NO: 6989935 - DNA, 22 bp, Homo sapiens
gcagctgtgtaatgagcccaca

SEQ ID NO: 6989936 - DNA, 22 bp, Homo sapiens
cagggagctggctggcgtgagt

SEQ ID NO: 6989937 - DNA, 23 bp, Homo sapiens
acagattggccatgagtcaccaa

SEQ ID NO: 6989938 - DNA, 21 bp, Homo sapiens
atgcattcctcccctttcctc

SEQ ID NO: 6989939 - DNA, 22 bp, Homo sapiens
gggctcatcaagcctctccgcc

SEQ ID NO: 6989940 - DNA, 22 bp, Homo sapiens
tctgttcctggtctctggagct

SEQ ID NO: 6989941 - DNA, 22 bp, Homo sapiens
tttgacaaataggggaataagg

SEQ ID NO: 6989942 - DNA, 22 bp, Homo sapiens
tgttaacaataagtccaggcat

SEQ ID NO: 6989943 - DNA, 22 bp, Homo sapiens
attgagcacctacagtattacc

SEQ ID NO: 6989944 - DNA, 22 bp, Homo sapiens
cagaagtggtattaattagatt

SEQ ID NO: 6989945 - DNA, 22 bp, Homo sapiens
gttaggcaaataactgtggagc

SEQ ID NO: 6989946 - DNA, 22 bp, Homo sapiens
tagctgccaaaagggtgggcta

SEQ ID NO: 6989947 - DNA, 20 bp, Homo sapiens
tacattgtagaaatattcaa

SEQ ID NO: 6989948 - DNA, 22 bp, Homo sapiens
tggtcagtgtgacattttttaa

SEQ ID NO: 6989949 - DNA, 22 bp, Homo sapiens
gcagtgttgtgatccaggtctt

SEQ ID NO: 6989950 - DNA, 22 bp, Homo sapiens
cattaggacgccccgcccatac

SEQ ID NO: 6989951 - DNA, 22 bp, Homo sapiens
agtgcgtggtttacagctagtt

SEQ ID NO: 6989952 - DNA, 22 bp, Homo sapiens
tgagtaggaaaggaaatgtttt

SEQ ID NO: 6989953 - DNA, 22 bp, Homo sapiens
aggaagccatggtggacgtcta

SEQ ID NO: 6989954 - DNA, 22 bp, Homo sapiens
acatggaagcaaagttctattt

SEQ ID NO: 6989955 - DNA, 22 bp, Homo sapiens
agaatcaattcactgctgcagc

SEQ ID NO: 6989956 - DNA, 22 bp, Homo sapiens
agagctggccagggatcactct

SEQ ID NO: 6989957 - DNA, 22 bp, Homo sapiens
tctgcaagtttatcacttggga

SEQ ID NO: 6989958 - DNA, 22 bp, Homo sapiens
gcaggagtggagaccatgggga

SEQ ID NO: 6989959 - DNA, 22 bp, Homo sapiens
gtggcacacaggagagagctca

SEQ ID NO: 6989960 - DNA, 22 bp, Homo sapiens
caaaattgttgatgctgctttg

SEQ ID NO: 6989961 - DNA, 22 bp, Homo sapiens
ttgctgctcccaagaggcagct

SEQ ID NO: 6989962 - DNA, 22 bp, Homo sapiens
ttcagtctctccctatgtttct

SEQ ID NO: 6989963 - DNA, 22 bp, Homo sapiens
tttcagatgtgtgtctctgaag

SEQ ID NO: 6989964 - DNA, 22 bp, Homo sapiens
attccatttgtgtggaatggct

SEQ ID NO: 6989965 - DNA, 22 bp, Homo sapiens
caagtcaatacctgtggacaaa

SEQ ID NO: 6989966 - DNA, 22 bp, Homo sapiens
ctgacccttgctcgggccctgt

SEQ ID NO: 6989967 - DNA, 22 bp, Homo sapiens
tccagtactgaagctccttcaa

SEQ ID NO: 6989968 - DNA, 22 bp, Homo sapiens
ccacagttcatgcactggggct

SEQ ID NO: 6989969 - DNA, 22 bp, Homo sapiens
attgtgaatttcagttagagcc

SEQ ID NO: 6989970 - DNA, 20 bp, Homo sapiens
cagagccaagagcagcatct

SEQ ID NO: 6989971 - DNA, 22 bp, Homo sapiens
agtgacatcatgtcagcaaagt

SEQ ID NO: 6989972 - DNA, 22 bp, Homo sapiens
ccagtctggcaggagggggaac

SEQ ID NO: 6989973 - DNA, 22 bp, Homo sapiens
gtgggccttgcagggtgcaggg

SEQ ID NO: 6989974 - DNA, 22 bp, Homo sapiens
tgggagtctgaggcgggtcgat

SEQ ID NO: 6989975 - DNA, 22 bp, Homo sapiens
aagtttagtcttgtcttagtaa

SEQ ID NO: 6989976 - DNA, 22 bp, Homo sapiens
actgactgtcagtggaaggcta

SEQ ID NO: 6989977 - DNA, 22 bp, Homo sapiens
aagtactgacagagaagaatga

SEQ ID NO: 6989978 - DNA, 22 bp, Homo sapiens
tgtggctgttgaggaccccaag

SEQ ID NO: 6989979 - DNA, 22 bp, Homo sapiens
agctggtccttggcagttctca

SEQ ID NO: 6989980 - DNA, 22 bp, Homo sapiens
tttctgcattgtcctcttggtt

SEQ ID NO: 6989981 - DNA, 22 bp, Homo sapiens
gaaacagctttaagtgatactg

SEQ ID NO: 6989982 - DNA, 22 bp, Homo sapiens
tggcatgtacccaggaatggac

SEQ ID NO: 6989983 - DNA, 19 bp, Homo sapiens
tgcaaatgctgttgagaat

SEQ ID NO: 6989984 - DNA, 22 bp, Homo sapiens
acttcccaacgtgggcctccca

SEQ ID NO: 6989985 - DNA, 22 bp, Homo sapiens
aggctcagagagctgtgtccat

SEQ ID NO: 6989986 - DNA, 22 bp, Homo sapiens
taaaatagcatgtgcagtgaaa

SEQ ID NO: 6989987 - DNA, 22 bp, Homo sapiens
aagccactatggtgattctcaa

SEQ ID NO: 6989988 - DNA, 22 bp, Homo sapiens
ggcagggtggccctccagtgag

SEQ ID NO: 6989989 - DNA, 22 bp, Homo sapiens
accagccaagactgcctggaat

SEQ ID NO: 6989990 - DNA, 22 bp, Homo sapiens
taaatgatttatgtatgtgaaa

SEQ ID NO: 6989991 - DNA, 22 bp, Homo sapiens
caaatggatacaggcaaacatt

SEQ ID NO: 6989992 - DNA, 22 bp, Homo sapiens
aaggccatgcttgagttgaagg

SEQ ID NO: 6989993 - DNA, 22 bp, Homo sapiens
agtgggatgcaataaagatata

SEQ ID NO: 6989994 - DNA, 22 bp, Homo sapiens
gacccagggtttctgcacaggg

SEQ ID NO: 6989995 - DNA, 22 bp, Homo sapiens
acactggtgccctttctggccc

SEQ ID NO: 6989996 - DNA, 22 bp, Homo sapiens
actgaaaaagtatgattcactg

SEQ ID NO: 6989997 - DNA, 22 bp, Homo sapiens
aatagtacaatctacagacata

SEQ ID NO: 6989998 - DNA, 22 bp, Homo sapiens
ttacaatgggtatacttccatt

SEQ ID NO: 6989999 - DNA, 22 bp, Homo sapiens
ctgttacaagagagagacatga

SEQ ID NO: 6990000 - DNA, 22 bp, Homo sapiens
ctccagagagaaaggaggccgc

SEQ ID NO: 6990001 - DNA, 22 bp, Homo sapiens
agcagaacattatctaggtctt

SEQ ID NO: 6990002 - DNA, 21 bp, Homo sapiens
gtttatgaatcttgtcctgct

SEQ ID NO: 6990003 - DNA, 22 bp, Homo sapiens
ggggagcaggctgggctgtctg

SEQ ID NO: 6990004 - DNA, 22 bp, Homo sapiens
ggaaggctaataatgcaagaaa

SEQ ID NO: 6990005 - DNA, 22 bp, Homo sapiens
agtctggaataaaactacttac

SEQ ID NO: 6990006 - DNA, 22 bp, Homo sapiens
tccaagggaatttaaagttgct

SEQ ID NO: 6990007 - DNA, 22 bp, Homo sapiens
ttctgtgaaactaaagagagga

SEQ ID NO: 6990008 - DNA, 22 bp, Homo sapiens
aagagtatgcatgcatgtttgt

SEQ ID NO: 6990009 - DNA, 22 bp, Homo sapiens
gtacttccctgggaggcaagca

SEQ ID NO: 6990010 - DNA, 22 bp, Homo sapiens
gggcttggagtaggctgatgaa

SEQ ID NO: 6990011 - DNA, 22 bp, Homo sapiens
gacatgaacctaccataatgat

SEQ ID NO: 6990012 - DNA, 21 bp, Homo sapiens
gctgtgcacatagtagaagtg

SEQ ID NO: 6990013 - DNA, 17 bp, Homo sapiens
tgtgagcatctatagaa

SEQ ID NO: 6990014 - DNA, 22 bp, Homo sapiens
ctgaggagctgaaggccctcca

SEQ ID NO: 6990015 - DNA, 22 bp, Homo sapiens
gaccatttcaggggcagggact

SEQ ID NO: 6990016 - DNA, 22 bp, Homo sapiens
ccagagaggggaagggcttgcc

SEQ ID NO: 6990017 - DNA, 22 bp, Homo sapiens
cactgaaggctaggattagatg

SEQ ID NO: 6990018 - DNA, 22 bp, Homo sapiens
ctgcgtgtttgcaccctgtctg

SEQ ID NO: 6990019 - DNA, 22 bp, Homo sapiens
cagttcaggtgcattagtaatc

SEQ ID NO: 6990020 - DNA, 17 bp, Homo sapiens
tgactttatttgcttgg

SEQ ID NO: 6990021 - DNA, 18 bp, Homo sapiens
ctctgggagaggcataca

SEQ ID NO: 6990022 - DNA, 22 bp, Homo sapiens
aggagaaatccatcgagaatgg

SEQ ID NO: 6990023 - DNA, 22 bp, Homo sapiens
agctgaggcatggacaggctgc

SEQ ID NO: 6990024 - DNA, 22 bp, Homo sapiens
acaggcctgtgtgcacacgagg

SEQ ID NO: 6990025 - DNA, 22 bp, Homo sapiens
cccctgtgttgttcaagggtca

SEQ ID NO: 6990026 - DNA, 18 bp, Homo sapiens
taagttcttaggcagctt

SEQ ID NO: 6990027 - DNA, 20 bp, Homo sapiens
cctgagggtttgtgttcttt

SEQ ID NO: 6990028 - DNA, 22 bp, Homo sapiens
tgaactttgtagtaatggagat

SEQ ID NO: 6990029 - DNA, 22 bp, Homo sapiens
accagcagttatgaggccagga

SEQ ID NO: 6990030 - DNA, 22 bp, Homo sapiens
agtgtgtgcatgcattcgtgca

SEQ ID NO: 6990031 - DNA, 22 bp, Homo sapiens
tttagtctgactattacctcca

SEQ ID NO: 6990032 - DNA, 22 bp, Homo sapiens
tcagatctaattggattattat

SEQ ID NO: 6990033 - DNA, 22 bp, Homo sapiens
atttctagatatggagagtggt

SEQ ID NO: 6990034 - DNA, 21 bp, Homo sapiens
ccattgagaccatggaggagt

SEQ ID NO: 6990035 - DNA, 21 bp, Homo sapiens
atgcatattttaagttgtgtc

SEQ ID NO: 6990036 - DNA, 22 bp, Homo sapiens
tggcttctgagtctcctgacat

SEQ ID NO: 6990037 - DNA, 19 bp, Homo sapiens
ggctctcccttgagagagc

SEQ ID NO: 6990038 - DNA, 19 bp, Homo sapiens
tctgcccagttgtctgccc

SEQ ID NO: 6990039 - DNA, 22 bp, Homo sapiens
ttctagttgagggagacaaata

SEQ ID NO: 6990040 - DNA, 22 bp, Homo sapiens
ggagtaggccccgggagagagt

SEQ ID NO: 6990041 - DNA, 22 bp, Homo sapiens
ctgctgtgggttaagacactgt

SEQ ID NO: 6990042 - DNA, 22 bp, Homo sapiens
tgtcattattagagttgtgctt

SEQ ID NO: 6990043 - DNA, 22 bp, Homo sapiens
tttcacagatataagatttcac

SEQ ID NO: 6990044 - DNA, 22 bp, Homo sapiens
acaatttctgatcagtgaattt

SEQ ID NO: 6990045 - DNA, 22 bp, Homo sapiens
taacatgttaagaaattagata

SEQ ID NO: 6990046 - DNA, 22 bp, Homo sapiens
ctccagtgtctcagagcagatg

SEQ ID NO: 6990047 - DNA, 22 bp, Homo sapiens
tgggcctgaaggagctgcgccc

SEQ ID NO: 6990048 - DNA, 22 bp, Homo sapiens
tcacccaggctggtgcgcagtg

SEQ ID NO: 6990049 - DNA, 19 bp, Homo sapiens
tgggaacttgttagacatg

SEQ ID NO: 6990050 - DNA, 22 bp, Homo sapiens
cagtgatgtttctgcatcagag

SEQ ID NO: 6990051 - DNA, 22 bp, Homo sapiens
gtgaataattttttagtataag

SEQ ID NO: 6990052 - DNA, 22 bp, Homo sapiens
cctgagcctggctcatgcactc

SEQ ID NO: 6990053 - DNA, 22 bp, Homo sapiens
agtccattaactgtgttaacag

SEQ ID NO: 6990054 - DNA, 22 bp, Homo sapiens
aaggtggccctgagcatgacaa

SEQ ID NO: 6990055 - DNA, 22 bp, Homo sapiens
tcttagatgttagctctgtgtg

SEQ ID NO: 6990056 - DNA, 22 bp, Homo sapiens
agcaggtgccaggtgtacccgc

SEQ ID NO: 6990057 - DNA, 22 bp, Homo sapiens
ggacctgccagaactcaggcta

SEQ ID NO: 6990058 - DNA, 22 bp, Homo sapiens
ccttgggaggcataattacttg

SEQ ID NO: 6990059 - DNA, 21 bp, Homo sapiens
tccttcagtctagatgattgt

SEQ ID NO: 6990060 - DNA, 22 bp, Homo sapiens
gcaggacctggcagatggggca

SEQ ID NO: 6990061 - DNA, 22 bp, Homo sapiens
tcagcagagcgagaccaagtca

SEQ ID NO: 6990062 - DNA, 22 bp, Homo sapiens
ctgggtggagcctggtcatctg

SEQ ID NO: 6990063 - DNA, 22 bp, Homo sapiens
gcggagaggcagagactccgcg

SEQ ID NO: 6990064 - DNA, 22 bp, Homo sapiens
tgggggaagagcttgttaaagt

SEQ ID NO: 6990065 - DNA, 22 bp, Homo sapiens
acggatttgggttaggtcacca

SEQ ID NO: 6990066 - DNA, 22 bp, Homo sapiens
tcaggcccagagtcacggatcc

SEQ ID NO: 6990067 - DNA, 22 bp, Homo sapiens
tccataaaccatgcttccaggt

SEQ ID NO: 6990068 - DNA, 22 bp, Homo sapiens
agtccctgtactttccactgcc

SEQ ID NO: 6990069 - DNA, 22 bp, Homo sapiens
tcagagaaggctgagtcacggc

SEQ ID NO: 6990070 - DNA, 22 bp, Homo sapiens
acagttggttaacacaaatatt

SEQ ID NO: 6990071 - DNA, 20 bp, Homo sapiens
agtacaatgtatgattcaga

SEQ ID NO: 6990072 - DNA, 22 bp, Homo sapiens
actttagaagtaaggatgagtt

SEQ ID NO: 6990073 - DNA, 22 bp, Homo sapiens
aaagtgcaaggattacaggcat

SEQ ID NO: 6990074 - DNA, 22 bp, Homo sapiens
aaactgaagttctggaggggta

SEQ ID NO: 6990075 - DNA, 22 bp, Homo sapiens
tgctcttcggggccactgcttg

SEQ ID NO: 6990076 - DNA, 22 bp, Homo sapiens
gagacagtggttgcagaagctc

SEQ ID NO: 6990077 - DNA, 22 bp, Homo sapiens
gtggtaatcggattcttaccgg

SEQ ID NO: 6990078 - DNA, 22 bp, Homo sapiens
tatggcttaggagagtttaact

SEQ ID NO: 6990079 - DNA, 22 bp, Homo sapiens
tcagctctacctgggagctgtc

SEQ ID NO: 6990080 - DNA, 19 bp, Homo sapiens
gggctctactctcagtctt

SEQ ID NO: 6990081 - DNA, 22 bp, Homo sapiens
ataaagaccagtatcttatgtt

SEQ ID NO: 6990082 - DNA, 22 bp, Homo sapiens
tggatctgctctatgaactgct

SEQ ID NO: 6990083 - DNA, 22 bp, Homo sapiens
caggaggcagaggttgcagtga

SEQ ID NO: 6990084 - DNA, 22 bp, Homo sapiens
tagtgccaagctaatgccagaa

SEQ ID NO: 6990085 - DNA, 22 bp, Homo sapiens
ccttggcaggggagaaatatat

SEQ ID NO: 6990086 - DNA, 22 bp, Homo sapiens
tcacatgttaggtcgggcaagg

SEQ ID NO: 6990087 - DNA, 22 bp, Homo sapiens
attgctttctttggggaactgt

SEQ ID NO: 6990088 - DNA, 22 bp, Homo sapiens
agtacaaactgtttcaaagtag

SEQ ID NO: 6990089 - DNA, 22 bp, Homo sapiens
gctggtcactctgggagctgct

SEQ ID NO: 6990090 - DNA, 22 bp, Homo sapiens
tgctggcatatgaaaatcctta

SEQ ID NO: 6990091 - DNA, 22 bp, Homo sapiens
ggcagattcaagggtggagagg

SEQ ID NO: 6990092 - DNA, 21 bp, Homo sapiens
tgaaacaatcagacagagtct

SEQ ID NO: 6990093 - DNA, 22 bp, Homo sapiens
tatgtgcttaatacatggtgtt

SEQ ID NO: 6990094 - DNA, 22 bp, Homo sapiens
atttactactgctatctagaag

SEQ ID NO: 6990095 - DNA, 22 bp, Homo sapiens
tctccgggtgcatgtgtgtgcc

SEQ ID NO: 6990096 - DNA, 22 bp, Homo sapiens
attcagggaggaaaggggcctc

SEQ ID NO: 6990097 - DNA, 22 bp, Homo sapiens
ggaggctcagtgaggaaatgga

SEQ ID NO: 6990098 - DNA, 22 bp, Homo sapiens
gtagctctgtttaaagttcttt

SEQ ID NO: 6990099 - DNA, 22 bp, Homo sapiens
tgggaaccaggactggctgagg

SEQ ID NO: 6990100 - DNA, 22 bp, Homo sapiens
ctagagaggcagatgtcctgtg

SEQ ID NO: 6990101 - DNA, 22 bp, Homo sapiens
agtgcttttgtcattgaatctt

SEQ ID NO: 6990102 - DNA, 18 bp, Homo sapiens
taggaagcttaatgtttt

SEQ ID NO: 6990103 - DNA, 22 bp, Homo sapiens
acatgaacactgcttgccacat

SEQ ID NO: 6990104 - DNA, 22 bp, Homo sapiens
aaatgctcatagatggcaatga

SEQ ID NO: 6990105 - DNA, 22 bp, Homo sapiens
attggaagtatttcatcaaaag

SEQ ID NO: 6990106 - DNA, 22 bp, Homo sapiens
tcaggaagctgctctgggtggt

SEQ ID NO: 6990107 - DNA, 22 bp, Homo sapiens
gctgcggtcactgcgggggctg

SEQ ID NO: 6990108 - DNA, 22 bp, Homo sapiens
taatgccacctacctgctttat

SEQ ID NO: 6990109 - DNA, 22 bp, Homo sapiens
aatagcatcctaaaacatactt

SEQ ID NO: 6990110 - DNA, 23 bp, Homo sapiens
atctcctgagaacccacagtggt

SEQ ID NO: 6990111 - DNA, 22 bp, Homo sapiens
tctaggaatgttcttagggatt

SEQ ID NO: 6990112 - DNA, 22 bp, Homo sapiens
ctgtgcaagacttactttaata

SEQ ID NO: 6990113 - DNA, 20 bp, Homo sapiens
agtttcagggagtcccatct

SEQ ID NO: 6990114 - DNA, 20 bp, Homo sapiens
cctgtctcacgttccgcccc

SEQ ID NO: 6990115 - DNA, 22 bp, Homo sapiens
gtggtaagactaacatttctca

SEQ ID NO: 6990116 - DNA, 22 bp, Homo sapiens
acttcctggcgtagctgacatt

SEQ ID NO: 6990117 - DNA, 20 bp, Homo sapiens
acaatagatttgagcaaagt

SEQ ID NO: 6990118 - DNA, 22 bp, Homo sapiens
acctggtttgtctcatcaccac

SEQ ID NO: 6990119 - DNA, 22 bp, Homo sapiens
agatcaaggtgtcagcaggctt

SEQ ID NO: 6990120 - DNA, 22 bp, Homo sapiens
aggcttcaattccttacccagt

SEQ ID NO: 6990121 - DNA, 22 bp, Homo sapiens
aaaacatgtccatacagaaact

SEQ ID NO: 6990122 - DNA, 22 bp, Homo sapiens
ttgttttgagccctggacttgc

SEQ ID NO: 6990123 - DNA, 22 bp, Homo sapiens
tggagccaggagcctgggagtc

SEQ ID NO: 6990124 - DNA, 22 bp, Homo sapiens
tgccatcttctctggggatgtt

SEQ ID NO: 6990125 - DNA, 22 bp, Homo sapiens
tagaaaggatattgagatgaat

SEQ ID NO: 6990126 - DNA, 22 bp, Homo sapiens
tagtttagcatacatcttcagg

SEQ ID NO: 6990127 - DNA, 22 bp, Homo sapiens
aaatgaggttaatacagtgctt

SEQ ID NO: 6990128 - DNA, 22 bp, Homo sapiens
acagagatgcaagtgtgtattt

SEQ ID NO: 6990129 - DNA, 22 bp, Homo sapiens
tctgccacttttgcttactggg

SEQ ID NO: 6990130 - DNA, 21 bp, Homo sapiens
taatcttcgaaaatgtattag

SEQ ID NO: 6990131 - DNA, 22 bp, Homo sapiens
gaagcagcagctggggacagtt

SEQ ID NO: 6990132 - DNA, 22 bp, Homo sapiens
tttattgtcttcgtggtgccta

SEQ ID NO: 6990133 - DNA, 22 bp, Homo sapiens
gccaggcagatatgtgagctta

SEQ ID NO: 6990134 - DNA, 22 bp, Homo sapiens
aaaggcagagttgttggaggca

SEQ ID NO: 6990135 - DNA, 22 bp, Homo sapiens
cacagctggaatggggtacctg

SEQ ID NO: 6990136 - DNA, 22 bp, Homo sapiens
aattaggaaattcagccatttt

SEQ ID NO: 6990137 - DNA, 22 bp, Homo sapiens
tcacagttatagtctgtagaat

SEQ ID NO: 6990138 - DNA, 22 bp, Homo sapiens
tggatgaaaaatgagaattttc

SEQ ID NO: 6990139 - DNA, 22 bp, Homo sapiens
gaacttataattattaagattg

SEQ ID NO: 6990140 - DNA, 22 bp, Homo sapiens
atgtccagggctttagcggggc

SEQ ID NO: 6990141 - DNA, 22 bp, Homo sapiens
ctggctctcgctgggagtactt

SEQ ID NO: 6990142 - DNA, 22 bp, Homo sapiens
gctttatgctacgatttctagt

SEQ ID NO: 6990143 - DNA, 22 bp, Homo sapiens
cattcctggcccgggcgccgtc

SEQ ID NO: 6990144 - DNA, 22 bp, Homo sapiens
cgtggggcgggtggacacttgc

SEQ ID NO: 6990145 - DNA, 22 bp, Homo sapiens
tttgttctagatcgtgtttgtg

SEQ ID NO: 6990146 - DNA, 18 bp, Homo sapiens
agaagcaggttctcccag

SEQ ID NO: 6990147 - DNA, 22 bp, Homo sapiens
acaccagtccttactcattttt

SEQ ID NO: 6990148 - DNA, 20 bp, Homo sapiens
tgaggtatcaattcaaggca

SEQ ID NO: 6990149 - DNA, 22 bp, Homo sapiens
aattccaagagcttcctaagtg

SEQ ID NO: 6990150 - DNA, 22 bp, Homo sapiens
agccaggcagactctctttctt

SEQ ID NO: 6990151 - DNA, 22 bp, Homo sapiens
ctttttatagctatgtcctatg

SEQ ID NO: 6990152 - DNA, 22 bp, Homo sapiens
ggtgtgtggttttgatacagtc

SEQ ID NO: 6990153 - DNA, 22 bp, Homo sapiens
gaagcctcaacatctctgcgtc

SEQ ID NO: 6990154 - DNA, 17 bp, Homo sapiens
cagtttggtggatataa

SEQ ID NO: 6990155 - DNA, 22 bp, Homo sapiens
gagctttacttctgactggtgc

SEQ ID NO: 6990156 - DNA, 22 bp, Homo sapiens
ggctgctggtggaatggtaggc

SEQ ID NO: 6990157 - DNA, 22 bp, Homo sapiens
cacagaatcggccgatggtgct

SEQ ID NO: 6990158 - DNA, 22 bp, Homo sapiens
aactgctctgcatgcaatggaa

SEQ ID NO: 6990159 - DNA, 22 bp, Homo sapiens
tgaaagttcaataccaatttgg

SEQ ID NO: 6990160 - DNA, 22 bp, Homo sapiens
gcttctggtgaggcctcaggaa

SEQ ID NO: 6990161 - DNA, 22 bp, Homo sapiens
aacatctttgtagtgttctcct

SEQ ID NO: 6990162 - DNA, 22 bp, Homo sapiens
ccctggtggtacggcactggca

SEQ ID NO: 6990163 - DNA, 22 bp, Homo sapiens
ctgatgagtcggctgccaccag

SEQ ID NO: 6990164 - DNA, 22 bp, Homo sapiens
atataagttagtggtcatgttt

SEQ ID NO: 6990165 - DNA, 22 bp, Homo sapiens
aaagttcactatgtagcagcgt

SEQ ID NO: 6990166 - DNA, 22 bp, Homo sapiens
ttgctgttttacttacaagctc

SEQ ID NO: 6990167 - DNA, 23 bp, Homo sapiens
agtgccagggagatcaggacgga

SEQ ID NO: 6990168 - DNA, 22 bp, Homo sapiens
tcttccagaatgcattctcttt

SEQ ID NO: 6990169 - DNA, 22 bp, Homo sapiens
gaatttcaagcagtgcaatgtt

SEQ ID NO: 6990170 - DNA, 22 bp, Homo sapiens
agtcctggtgacactcctcttc

SEQ ID NO: 6990171 - DNA, 22 bp, Homo sapiens
tgagtgaccagaagtccccctc

SEQ ID NO: 6990172 - DNA, 22 bp, Homo sapiens
ggaaatctgcattttgaacaca

SEQ ID NO: 6990173 - DNA, 20 bp, Homo sapiens
tcagtccaagcgaatgcccc

SEQ ID NO: 6990174 - DNA, 22 bp, Homo sapiens
ttccttcctgtcttccttactg

SEQ ID NO: 6990175 - DNA, 22 bp, Homo sapiens
aagccaggaccaaactcatcct

SEQ ID NO: 6990176 - DNA, 22 bp, Homo sapiens
gtaagggatttgaacataggtt

SEQ ID NO: 6990177 - DNA, 22 bp, Homo sapiens
gtctgtatcagaggagtgaatg

SEQ ID NO: 6990178 - DNA, 22 bp, Homo sapiens
taatggagtgacaaattggatt

SEQ ID NO: 6990179 - DNA, 22 bp, Homo sapiens
tagcaagtgttggtgaagatgt

SEQ ID NO: 6990180 - DNA, 22 bp, Homo sapiens
ctggccctgccagagatcaaca

SEQ ID NO: 6990181 - DNA, 22 bp, Homo sapiens
gactgtggatagaacactgcag

SEQ ID NO: 6990182 - DNA, 22 bp, Homo sapiens
gaacccaaacctggacctccct

SEQ ID NO: 6990183 - DNA, 22 bp, Homo sapiens
gtgtattgcacatcctgtagcc

SEQ ID NO: 6990184 - DNA, 22 bp, Homo sapiens
tatgcacacaggcttaattcat

SEQ ID NO: 6990185 - DNA, 22 bp, Homo sapiens
gggacctggtctagcactgagc

SEQ ID NO: 6990186 - DNA, 22 bp, Homo sapiens
tgagtccactttaaaatgtcag

SEQ ID NO: 6990187 - DNA, 22 bp, Homo sapiens
gggaaatagagctggaaccttg

SEQ ID NO: 6990188 - DNA, 22 bp, Homo sapiens
tctaagcctgtgtcctctgcag

SEQ ID NO: 6990189 - DNA, 22 bp, Homo sapiens
cacaccaaagtatttggtattt

SEQ ID NO: 6990190 - DNA, 23 bp, Homo sapiens
aatcaccagcagccaatgtgcag

SEQ ID NO: 6990191 - DNA, 22 bp, Homo sapiens
ggctggctcttaccgacagcgt

SEQ ID NO: 6990192 - DNA, 22 bp, Homo sapiens
tgtgaagagagtaataaagtca

SEQ ID NO: 6990193 - DNA, 21 bp, Homo sapiens
cttccccaggctggtctgtat

SEQ ID NO: 6990194 - DNA, 22 bp, Homo sapiens
acagtatacattgattaggacc

SEQ ID NO: 6990195 - DNA, 22 bp, Homo sapiens
tggctgtacattggaattatct

SEQ ID NO: 6990196 - DNA, 22 bp, Homo sapiens
caggcagagttagagcaactgg

SEQ ID NO: 6990197 - DNA, 22 bp, Homo sapiens
agaaggagtgtacaggtcatgc

SEQ ID NO: 6990198 - DNA, 22 bp, Homo sapiens
gcttggcattgaccattatcat

SEQ ID NO: 6990199 - DNA, 21 bp, Homo sapiens
tcatatttctcttgctattgt

SEQ ID NO: 6990200 - DNA, 21 bp, Homo sapiens
aggatattaggtgatttgggt

SEQ ID NO: 6990201 - DNA, 22 bp, Homo sapiens
ccctgatgttttctctgccttt

SEQ ID NO: 6990202 - DNA, 22 bp, Homo sapiens
agtctttacagaaaggcaggaa

SEQ ID NO: 6990203 - DNA, 22 bp, Homo sapiens
ccttcagaggtgtagattgcgt

SEQ ID NO: 6990204 - DNA, 22 bp, Homo sapiens
agaggagaatccgtttccttgc

SEQ ID NO: 6990205 - DNA, 22 bp, Homo sapiens
gctttgctgggtgcttcatgta

SEQ ID NO: 6990206 - DNA, 22 bp, Homo sapiens
taagtattggcctatagctaga

SEQ ID NO: 6990207 - DNA, 22 bp, Homo sapiens
atgtggcttttctaacccttcc

SEQ ID NO: 6990208 - DNA, 22 bp, Homo sapiens
gatcatctgggctccttgtagt

SEQ ID NO: 6990209 - DNA, 22 bp, Homo sapiens
gctcctggcatcctgcttttaa

SEQ ID NO: 6990210 - DNA, 22 bp, Homo sapiens
acctgctttattcctcctgcct

SEQ ID NO: 6990211 - DNA, 22 bp, Homo sapiens
agacatgacagatagttgctag

SEQ ID NO: 6990212 - DNA, 22 bp, Homo sapiens
atgtgtatatttattgtagttt

SEQ ID NO: 6990213 - DNA, 22 bp, Homo sapiens
gcacagaacactggtgagtccc

SEQ ID NO: 6990214 - DNA, 23 bp, Homo sapiens
tctgtgctcgggggagctctctg

SEQ ID NO: 6990215 - DNA, 22 bp, Homo sapiens
gccagtggtagaggggaggccg

SEQ ID NO: 6990216 - DNA, 22 bp, Homo sapiens
tcctggcctgtctggagtagct

SEQ ID NO: 6990217 - DNA, 22 bp, Homo sapiens
aatagaggaagaaacctgattg

SEQ ID NO: 6990218 - DNA, 22 bp, Homo sapiens
tggctcagcgcggcctggtctt

SEQ ID NO: 6990219 - DNA, 22 bp, Homo sapiens
gtttcctgcgtgtgccactcat

SEQ ID NO: 6990220 - DNA, 22 bp, Homo sapiens
caattctttcagctgcatttgt

SEQ ID NO: 6990221 - DNA, 22 bp, Homo sapiens
ctcagtttgaggggtaggtgtt

SEQ ID NO: 6990222 - DNA, 22 bp, Homo sapiens
aaagaacaaatgatatatggtt

SEQ ID NO: 6990223 - DNA, 22 bp, Homo sapiens
agaggtaaagagaggggaaatt

SEQ ID NO: 6990224 - DNA, 22 bp, Homo sapiens
gccagctgtaagctggggtgat

SEQ ID NO: 6990225 - DNA, 22 bp, Homo sapiens
cttggtctactagagaaaaaga

SEQ ID NO: 6990226 - DNA, 22 bp, Homo sapiens
atagtatttaatagttagctca

SEQ ID NO: 6990227 - DNA, 22 bp, Homo sapiens
tacagagtggttgtccaactct

SEQ ID NO: 6990228 - DNA, 18 bp, Homo sapiens
tccagagcagtctttggc

SEQ ID NO: 6990229 - DNA, 22 bp, Homo sapiens
ctgctagggttcagcagtgcct

SEQ ID NO: 6990230 - DNA, 22 bp, Homo sapiens
gactggatgttttgaacatgag

SEQ ID NO: 6990231 - DNA, 22 bp, Homo sapiens
tgcagagaccactgtgccttcc

SEQ ID NO: 6990232 - DNA, 22 bp, Homo sapiens
aaaaatgaattcttcagtggca

SEQ ID NO: 6990233 - DNA, 22 bp, Homo sapiens
tctagtcattcatgctatgatt

SEQ ID NO: 6990234 - DNA, 22 bp, Homo sapiens
atgcagtccaagctctagagtt

SEQ ID NO: 6990235 - DNA, 22 bp, Homo sapiens
ctcatttgttacaattcatact

SEQ ID NO: 6990236 - DNA, 22 bp, Homo sapiens
tccaggtgtatttactgaagta

SEQ ID NO: 6990237 - DNA, 18 bp, Homo sapiens
aagcagggtccattgtgc

SEQ ID NO: 6990238 - DNA, 22 bp, Homo sapiens
atccaagaatttgcactcctaa

SEQ ID NO: 6990239 - DNA, 22 bp, Homo sapiens
gaggaggctatcagcaatcagg

SEQ ID NO: 6990240 - DNA, 22 bp, Homo sapiens
tgctggaagggtcggcgtgggc

SEQ ID NO: 6990241 - DNA, 22 bp, Homo sapiens
cacttgatgttgtcactattgc

SEQ ID NO: 6990242 - DNA, 22 bp, Homo sapiens
agccctgctcatctggatcccg

SEQ ID NO: 6990243 - DNA, 22 bp, Homo sapiens
ctctcatgtagtatctgtatgg

SEQ ID NO: 6990244 - DNA, 22 bp, Homo sapiens
ggagcaccctgctcagccaagc

SEQ ID NO: 6990245 - DNA, 22 bp, Homo sapiens
agtgggctgtaatttaggaatg

SEQ ID NO: 6990246 - DNA, 22 bp, Homo sapiens
tactctggttctacctccctgt

SEQ ID NO: 6990247 - DNA, 22 bp, Homo sapiens
catgtgtgagtgagcagtcttc

SEQ ID NO: 6990248 - DNA, 22 bp, Homo sapiens
gtttcttagacatatgccatga

SEQ ID NO: 6990249 - DNA, 22 bp, Homo sapiens
atgagggaagctcacgtgtcca

SEQ ID NO: 6990250 - DNA, 22 bp, Homo sapiens
tactgaaaactgagtcttccgt

SEQ ID NO: 6990251 - DNA, 22 bp, Homo sapiens
agtacccttttcactgtcacaa

SEQ ID NO: 6990252 - DNA, 22 bp, Homo sapiens
agagccctcttcactgcccctt

SEQ ID NO: 6990253 - DNA, 21 bp, Homo sapiens
tgccatctctgtgggaccagg

SEQ ID NO: 6990254 - DNA, 22 bp, Homo sapiens
ctgtgtagtatttgtacacata

SEQ ID NO: 6990255 - DNA, 22 bp, Homo sapiens
gcatagctttgatgctgcctta

SEQ ID NO: 6990256 - DNA, 19 bp, Homo sapiens
attcttggtgcaccttgta

SEQ ID NO: 6990257 - DNA, 22 bp, Homo sapiens
ctcctgagaaataagcaagtaa

SEQ ID NO: 6990258 - DNA, 22 bp, Homo sapiens
taccattttgaggatggagaga

SEQ ID NO: 6990259 - DNA, 22 bp, Homo sapiens
tgcacatgtgcacatatatgtg

SEQ ID NO: 6990260 - DNA, 22 bp, Homo sapiens
aggcctggcatgagacctgaga

SEQ ID NO: 6990261 - DNA, 22 bp, Homo sapiens
gggaaatctcgtcctctattta

SEQ ID NO: 6990262 - DNA, 22 bp, Homo sapiens
gggttcctggctcctgtgtggt

SEQ ID NO: 6990263 - DNA, 22 bp, Homo sapiens
gagaatctttccccacagaagg

SEQ ID NO: 6990264 - DNA, 22 bp, Homo sapiens
acaacctgatcccgaggctgag

SEQ ID NO: 6990265 - DNA, 22 bp, Homo sapiens
tcccatcagctgggaagggtgt

SEQ ID NO: 6990266 - DNA, 22 bp, Homo sapiens
aagatgctggcaggaatagcta

SEQ ID NO: 6990267 - DNA, 22 bp, Homo sapiens
tgtagggcctaggggtatggat

SEQ ID NO: 6990268 - DNA, 22 bp, Homo sapiens
tccaggacttagtgacctaaaa

SEQ ID NO: 6990269 - DNA, 22 bp, Homo sapiens
tccataaaccagaaaatcaaga

SEQ ID NO: 6990270 - DNA, 20 bp, Homo sapiens
tcctggggtaagccatggtc

SEQ ID NO: 6990271 - DNA, 19 bp, Homo sapiens
tgcaaatgtaggaagaata

SEQ ID NO: 6990272 - DNA, 22 bp, Homo sapiens
tcctgaagtatgggtatggagt

SEQ ID NO: 6990273 - DNA, 22 bp, Homo sapiens
tcttgaagtcacacagaaagtg

SEQ ID NO: 6990274 - DNA, 22 bp, Homo sapiens
caggtgagaggcggtcctgcat

SEQ ID NO: 6990275 - DNA, 22 bp, Homo sapiens
ctgcagcatcctagggtctgtg

SEQ ID NO: 6990276 - DNA, 22 bp, Homo sapiens
gttattcttttatagcaataca

SEQ ID NO: 6990277 - DNA, 21 bp, Homo sapiens
attctgagtcttggggtctca

SEQ ID NO: 6990278 - DNA, 22 bp, Homo sapiens
aagtcctttatcctaaaaggtc

SEQ ID NO: 6990279 - DNA, 22 bp, Homo sapiens
ttctgagattgttaggcactaa

SEQ ID NO: 6990280 - DNA, 22 bp, Homo sapiens
gtagggaaggccaacttcatgt

SEQ ID NO: 6990281 - DNA, 17 bp, Homo sapiens
ggcaggtgcggggccgc

SEQ ID NO: 6990282 - DNA, 23 bp, Homo sapiens
cacatgacctgacctaggctagg

SEQ ID NO: 6990283 - DNA, 22 bp, Homo sapiens
tcctgaaaataatttcacaaga

SEQ ID NO: 6990284 - DNA, 22 bp, Homo sapiens
ggccttgtgtaagtaactttgg

SEQ ID NO: 6990285 - DNA, 22 bp, Homo sapiens
cttcccttcccctcacggagac

SEQ ID NO: 6990286 - DNA, 22 bp, Homo sapiens
ccctgctagtccttccttggct

SEQ ID NO: 6990287 - DNA, 22 bp, Homo sapiens
gacattaatggcaaattaatta

SEQ ID NO: 6990288 - DNA, 22 bp, Homo sapiens
atgagtgttgctcattgcagaa

SEQ ID NO: 6990289 - DNA, 22 bp, Homo sapiens
tcctgccccactgtttgaaaga

SEQ ID NO: 6990290 - DNA, 21 bp, Homo sapiens
gaagacaaatgggaatagctg

SEQ ID NO: 6990291 - DNA, 22 bp, Homo sapiens
atatagctgaggggtattataa

SEQ ID NO: 6990292 - DNA, 22 bp, Homo sapiens
gggagtcaggctccctcagaga

SEQ ID NO: 6990293 - DNA, 22 bp, Homo sapiens
agtgttaacatgaatggtttcc

SEQ ID NO: 6990294 - DNA, 22 bp, Homo sapiens
atgatgcataatttatacatgc

SEQ ID NO: 6990295 - DNA, 22 bp, Homo sapiens
aagatatagatggtggtataaa

SEQ ID NO: 6990296 - DNA, 22 bp, Homo sapiens
agagtaatgaacacattccaca

SEQ ID NO: 6990297 - DNA, 22 bp, Homo sapiens
ctgtccatgttaagccccttgc

SEQ ID NO: 6990298 - DNA, 22 bp, Homo sapiens
tctgcctggctcatggcagtga

SEQ ID NO: 6990299 - DNA, 22 bp, Homo sapiens
ttatggcttgaaactctaagga

SEQ ID NO: 6990300 - DNA, 22 bp, Homo sapiens
agctttgctcgggtctcccgcc

SEQ ID NO: 6990301 - DNA, 22 bp, Homo sapiens
tgtcctttgtgtatctatagta

SEQ ID NO: 6990302 - DNA, 22 bp, Homo sapiens
caggtgtgccgggagcagtttg

SEQ ID NO: 6990303 - DNA, 22 bp, Homo sapiens
tacagtcagagtgcctttctaa

SEQ ID NO: 6990304 - DNA, 22 bp, Homo sapiens
ccatcaatgactaataaaatag

SEQ ID NO: 6990305 - DNA, 19 bp, Homo sapiens
cctgcctgagctgtccctc

SEQ ID NO: 6990306 - DNA, 22 bp, Homo sapiens
gcatgggcaccagtctctaggt

SEQ ID NO: 6990307 - DNA, 22 bp, Homo sapiens
tggttacagaacatgaatgttg

SEQ ID NO: 6990308 - DNA, 22 bp, Homo sapiens
gccttgagaagtcctgcagtga

SEQ ID NO: 6990309 - DNA, 22 bp, Homo sapiens
atggaattgagcatcagttgtt

SEQ ID NO: 6990310 - DNA, 22 bp, Homo sapiens
tgagtactttatgttagttatt

SEQ ID NO: 6990311 - DNA, 22 bp, Homo sapiens
tgtaagtacattgaaacatctt

SEQ ID NO: 6990312 - DNA, 22 bp, Homo sapiens
ccaagttaccagcaatataagt

SEQ ID NO: 6990313 - DNA, 22 bp, Homo sapiens
agcacagagagctctaggtaaa

SEQ ID NO: 6990314 - DNA, 22 bp, Homo sapiens
gctcttccatttctcttgaact

SEQ ID NO: 6990315 - DNA, 22 bp, Homo sapiens
atggtattggagtaggacttgc

SEQ ID NO: 6990316 - DNA, 22 bp, Homo sapiens
tttatattacctggaatagctt

SEQ ID NO: 6990317 - DNA, 22 bp, Homo sapiens
aatgaacaacttgatttttgcc

SEQ ID NO: 6990318 - DNA, 22 bp, Homo sapiens
ttcctgagaccctcacagtgat

SEQ ID NO: 6990319 - DNA, 22 bp, Homo sapiens
tcctcatagactgactgcttgc

SEQ ID NO: 6990320 - DNA, 22 bp, Homo sapiens
ggcctatgagaggcagcatgtt

SEQ ID NO: 6990321 - DNA, 22 bp, Homo sapiens
cggttagttatttttcagatat

SEQ ID NO: 6990322 - DNA, 22 bp, Homo sapiens
taagatcagttcaaacatgtgt

SEQ ID NO: 6990323 - DNA, 22 bp, Homo sapiens
gctaaggagggtcttgcaaatt

SEQ ID NO: 6990324 - DNA, 22 bp, Homo sapiens
gtccagtgacaagtagctggcc

SEQ ID NO: 6990325 - DNA, 22 bp, Homo sapiens
agaagtttcacaatgggtttta

SEQ ID NO: 6990326 - DNA, 22 bp, Homo sapiens
tccaggagaaggccatccagcg

SEQ ID NO: 6990327 - DNA, 22 bp, Homo sapiens
taagctcactgtaagaactgat

SEQ ID NO: 6990328 - DNA, 22 bp, Homo sapiens
ctggtcctctccagcaggcatt

SEQ ID NO: 6990329 - DNA, 22 bp, Homo sapiens
ctgggagtctggcctctggtcc

SEQ ID NO: 6990330 - DNA, 22 bp, Homo sapiens
tgccttagtgactaaagcacac

SEQ ID NO: 6990331 - DNA, 22 bp, Homo sapiens
ctgtcttttcatactttccctc

SEQ ID NO: 6990332 - DNA, 22 bp, Homo sapiens
ctgcctgcatgctgccatagct

SEQ ID NO: 6990333 - DNA, 22 bp, Homo sapiens
attgtgaatagtgccgcagtaa

SEQ ID NO: 6990334 - DNA, 22 bp, Homo sapiens
tatcaggacttcattcctttta

SEQ ID NO: 6990335 - DNA, 22 bp, Homo sapiens
tgcttcttcctccatgtgttct

SEQ ID NO: 6990336 - DNA, 22 bp, Homo sapiens
atcaagctacttgtcttcgttt

SEQ ID NO: 6990337 - DNA, 22 bp, Homo sapiens
tccttacatagtgctgaaatat

SEQ ID NO: 6990338 - DNA, 22 bp, Homo sapiens
ttacacaggcacttaaaatgca

SEQ ID NO: 6990339 - DNA, 22 bp, Homo sapiens
gaaagaatgctatagtgacttc

SEQ ID NO: 6990340 - DNA, 22 bp, Homo sapiens
gctcagtctttgtggggtacgg

SEQ ID NO: 6990341 - DNA, 22 bp, Homo sapiens
agtgttccttgctttcccagag

SEQ ID NO: 6990342 - DNA, 18 bp, Homo sapiens
tgaataggggtttgcaga

SEQ ID NO: 6990343 - DNA, 23 bp, Homo sapiens
tggcttaacctcttcctatgtct

SEQ ID NO: 6990344 - DNA, 22 bp, Homo sapiens
agggaaggaaaagctgtcgctt

SEQ ID NO: 6990345 - DNA, 22 bp, Homo sapiens
agcaatgcaatcttaaccttga

SEQ ID NO: 6990346 - DNA, 22 bp, Homo sapiens
aaggaacactacaaggctggga

SEQ ID NO: 6990347 - DNA, 22 bp, Homo sapiens
aagccctcatccccatgggcgt

SEQ ID NO: 6990348 - DNA, 22 bp, Homo sapiens
taaatcactgtactttattcct

SEQ ID NO: 6990349 - DNA, 22 bp, Homo sapiens
gggccacctggattccatgtgt

SEQ ID NO: 6990350 - DNA, 22 bp, Homo sapiens
cctttatgatagatgctttcag

SEQ ID NO: 6990351 - DNA, 22 bp, Homo sapiens
ctgtctgtactgagagttctgt

SEQ ID NO: 6990352 - DNA, 22 bp, Homo sapiens
tgtagcacactcataatctttc

SEQ ID NO: 6990353 - DNA, 22 bp, Homo sapiens
cagcctgctctcagatgttgag

SEQ ID NO: 6990354 - DNA, 22 bp, Homo sapiens
ttctgtacttcaggggctctgt

SEQ ID NO: 6990355 - DNA, 22 bp, Homo sapiens
atgccctgggagtgctgtacca

SEQ ID NO: 6990356 - DNA, 21 bp, Homo sapiens
actctgccagtctcctgcact

SEQ ID NO: 6990357 - DNA, 22 bp, Homo sapiens
agcacattcccacctgtacttc

SEQ ID NO: 6990358 - DNA, 22 bp, Homo sapiens
catatttcagtctaagatgtgt

SEQ ID NO: 6990359 - DNA, 21 bp, Homo sapiens
gggcagcagcagcaacaaggg

SEQ ID NO: 6990360 - DNA, 22 bp, Homo sapiens
atttcacagcgtggttgactgc

SEQ ID NO: 6990361 - DNA, 22 bp, Homo sapiens
ggaggccagaatctgtgttgga

SEQ ID NO: 6990362 - DNA, 22 bp, Homo sapiens
tttgcagttcatctgagaaaaa

SEQ ID NO: 6990363 - DNA, 22 bp, Homo sapiens
tcagccagttaaggcttagaca

SEQ ID NO: 6990364 - DNA, 18 bp, Homo sapiens
gacacatccccaggcctc

SEQ ID NO: 6990365 - DNA, 22 bp, Homo sapiens
tctgggaaccattggtggggat

SEQ ID NO: 6990366 - DNA, 22 bp, Homo sapiens
gaaatgctcaggggttttccag

SEQ ID NO: 6990367 - DNA, 22 bp, Homo sapiens
atatggctctggctctgccttg

SEQ ID NO: 6990368 - DNA, 22 bp, Homo sapiens
ttgcttcattttaaataaagac

SEQ ID NO: 6990369 - DNA, 22 bp, Homo sapiens
gtttcacagggccatggaggaa

SEQ ID NO: 6990370 - DNA, 22 bp, Homo sapiens
tattagcagttgtatgtgtctg

SEQ ID NO: 6990371 - DNA, 22 bp, Homo sapiens
ttgtgatagggcaatttttctc

SEQ ID NO: 6990372 - DNA, 18 bp, Homo sapiens
agtcttctgatccatttt

SEQ ID NO: 6990373 - DNA, 22 bp, Homo sapiens
gttattttcattggctcagact

SEQ ID NO: 6990374 - DNA, 20 bp, Homo sapiens
tcattcgccccagtttaaga

SEQ ID NO: 6990375 - DNA, 22 bp, Homo sapiens
gcccattgagtgcccgtgagcc

SEQ ID NO: 6990376 - DNA, 22 bp, Homo sapiens
ccctgaccctatcagagggcca

SEQ ID NO: 6990377 - DNA, 22 bp, Homo sapiens
atggtgtagctgtcagtcataa

SEQ ID NO: 6990378 - DNA, 22 bp, Homo sapiens
gagtctttctgggcttgttctt

SEQ ID NO: 6990379 - DNA, 22 bp, Homo sapiens
ataaaatgtctccactgggctc

SEQ ID NO: 6990380 - DNA, 22 bp, Homo sapiens
tagttttgaggattatatgtga

SEQ ID NO: 6990381 - DNA, 22 bp, Homo sapiens
aagacattgtcattttataatt

SEQ ID NO: 6990382 - DNA, 22 bp, Homo sapiens
gagagagagctaatattaagct

SEQ ID NO: 6990383 - DNA, 18 bp, Homo sapiens
tttattcctgcccccagc

SEQ ID NO: 6990384 - DNA, 22 bp, Homo sapiens
tcaaagtataattgcttttttg

SEQ ID NO: 6990385 - DNA, 22 bp, Homo sapiens
gaatagatagcttggatggttg

SEQ ID NO: 6990386 - DNA, 22 bp, Homo sapiens
tgtgaaacggagtcagggaagg

SEQ ID NO: 6990387 - DNA, 22 bp, Homo sapiens
agtgaacagtttggaacacatg

SEQ ID NO: 6990388 - DNA, 22 bp, Homo sapiens
ggagctattactgtaacgaaca

SEQ ID NO: 6990389 - DNA, 22 bp, Homo sapiens
tttctacagtactgatttcata

SEQ ID NO: 6990390 - DNA, 22 bp, Homo sapiens
atacatatccacaggagataaa

SEQ ID NO: 6990391 - DNA, 22 bp, Homo sapiens
gagttgaaagcaaaagttgata

SEQ ID NO: 6990392 - DNA, 22 bp, Homo sapiens
acatattaactgcactacacta

SEQ ID NO: 6990393 - DNA, 22 bp, Homo sapiens
agtgcaatggcgtgatcttggc

SEQ ID NO: 6990394 - DNA, 17 bp, Homo sapiens
aaggccatttccaccca

SEQ ID NO: 6990395 - DNA, 22 bp, Homo sapiens
tgcacatgtgcctgtggcacat

SEQ ID NO: 6990396 - DNA, 22 bp, Homo sapiens
aatgttcaaaagcatcagtgaa

SEQ ID NO: 6990397 - DNA, 22 bp, Homo sapiens
ttctgtgttctgtgcaatgagc

SEQ ID NO: 6990398 - DNA, 22 bp, Homo sapiens
agcattgcctgcctattgctaa

SEQ ID NO: 6990399 - DNA, 22 bp, Homo sapiens
acatatgatattgaggatctca

SEQ ID NO: 6990400 - DNA, 22 bp, Homo sapiens
ttgaaggacatcctatttctag

SEQ ID NO: 6990401 - DNA, 22 bp, Homo sapiens
gggcaggtgacctcttgtcctg

SEQ ID NO: 6990402 - DNA, 23 bp, Homo sapiens
ttttaatttggacataagaagat

SEQ ID NO: 6990403 - DNA, 22 bp, Homo sapiens
atttcatgagctaatggatctc

SEQ ID NO: 6990404 - DNA, 22 bp, Homo sapiens
tggctgagttctccaggagtag

SEQ ID NO: 6990405 - DNA, 22 bp, Homo sapiens
aatgtgattttctcactccctt

SEQ ID NO: 6990406 - DNA, 21 bp, Homo sapiens
tgaccctcccagccctgccaa

SEQ ID NO: 6990407 - DNA, 22 bp, Homo sapiens
gttgtcttagtcagaaatatgc

SEQ ID NO: 6990408 - DNA, 22 bp, Homo sapiens
cattcgctgttcaacattgagc

SEQ ID NO: 6990409 - DNA, 22 bp, Homo sapiens
tctgaaataggcttcttttggt

SEQ ID NO: 6990410 - DNA, 22 bp, Homo sapiens
acattgaagggctatccaatag

SEQ ID NO: 6990411 - DNA, 22 bp, Homo sapiens
tagcagtattccggaatacttt

SEQ ID NO: 6990412 - DNA, 22 bp, Homo sapiens
gaggagccaggaggtctccctg

SEQ ID NO: 6990413 - DNA, 22 bp, Homo sapiens
tactgtctgcttcttatagctt

SEQ ID NO: 6990414 - DNA, 22 bp, Homo sapiens
tatgtcaactgtgctggttaat

SEQ ID NO: 6990415 - DNA, 22 bp, Homo sapiens
aaaggtgttctcactgggggtc

SEQ ID NO: 6990416 - DNA, 22 bp, Homo sapiens
ttcagtgtggcccatgaagagg

SEQ ID NO: 6990417 - DNA, 22 bp, Homo sapiens
ttaaaaatatgtagggcccgat

SEQ ID NO: 6990418 - DNA, 22 bp, Homo sapiens
agtttgatctgacagattttaa

SEQ ID NO: 6990419 - DNA, 22 bp, Homo sapiens
agtacactcaagaaaccggtaa

SEQ ID NO: 6990420 - DNA, 22 bp, Homo sapiens
cctggaatttctattggttcac

SEQ ID NO: 6990421 - DNA, 22 bp, Homo sapiens
agggccagagtacatcagggct

SEQ ID NO: 6990422 - DNA, 22 bp, Homo sapiens
tagccatgttgttaaaagacaa

SEQ ID NO: 6990423 - DNA, 22 bp, Homo sapiens
tgctagatgagttttgagaagt

SEQ ID NO: 6990424 - DNA, 22 bp, Homo sapiens
tgccaaattgaattacataatt

SEQ ID NO: 6990425 - DNA, 21 bp, Homo sapiens
cttggcctctagctagagctg

SEQ ID NO: 6990426 - DNA, 22 bp, Homo sapiens
gaggagtggagttgctgggttg

SEQ ID NO: 6990427 - DNA, 22 bp, Homo sapiens
atcagcaggaagggcaccttta

SEQ ID NO: 6990428 - DNA, 22 bp, Homo sapiens
tctgaatagagagaggtccttt

SEQ ID NO: 6990429 - DNA, 22 bp, Homo sapiens
ttggtccctcatggacacatga

SEQ ID NO: 6990430 - DNA, 22 bp, Homo sapiens
tccatattgcagcatgtgtcag

SEQ ID NO: 6990431 - DNA, 23 bp, Homo sapiens
ttggaaatggggagaacagattc

SEQ ID NO: 6990432 - DNA, 22 bp, Homo sapiens
acacgcatgatgatgcacgtac

SEQ ID NO: 6990433 - DNA, 22 bp, Homo sapiens
gtgcccagtgcaggcccgcagg

SEQ ID NO: 6990434 - DNA, 22 bp, Homo sapiens
taacttgtgttacattactctt

SEQ ID NO: 6990435 - DNA, 22 bp, Homo sapiens
gcagcaggagagtaatagcggt

SEQ ID NO: 6990436 - DNA, 22 bp, Homo sapiens
gtcagaggggcagctgccaggc

SEQ ID NO: 6990437 - DNA, 22 bp, Homo sapiens
attttagcaaatgcaagatgga

SEQ ID NO: 6990438 - DNA, 22 bp, Homo sapiens
gtaatccaaagtaacattaaac

SEQ ID NO: 6990439 - DNA, 20 bp, Homo sapiens
ggtgctgataagaaagaagt

SEQ ID NO: 6990440 - DNA, 22 bp, Homo sapiens
tagcagaggtaagtgtggcaat

SEQ ID NO: 6990441 - DNA, 22 bp, Homo sapiens
atttgacaacttctggtggcat

SEQ ID NO: 6990442 - DNA, 22 bp, Homo sapiens
ggctgttcctctaacattgcag

SEQ ID NO: 6990443 - DNA, 22 bp, Homo sapiens
tgtgaccctctccgatgggcag

SEQ ID NO: 6990444 - DNA, 22 bp, Homo sapiens
agagtaatttctgctgaaaagg

SEQ ID NO: 6990445 - DNA, 22 bp, Homo sapiens
tacagtagaatgcggtgccagt

SEQ ID NO: 6990446 - DNA, 22 bp, Homo sapiens
cattagtggacttctggaagga

SEQ ID NO: 6990447 - DNA, 22 bp, Homo sapiens
tagaggtagagttacattagtc

SEQ ID NO: 6990448 - DNA, 22 bp, Homo sapiens
cacccagagggcttgctgaaca

SEQ ID NO: 6990449 - DNA, 22 bp, Homo sapiens
agccctcctttgttcatgctgc

SEQ ID NO: 6990450 - DNA, 22 bp, Homo sapiens
ttgtgatctgtgttgatggcct

SEQ ID NO: 6990451 - DNA, 22 bp, Homo sapiens
tccttctggaggctctaagggg

SEQ ID NO: 6990452 - DNA, 22 bp, Homo sapiens
tcatctgttatttatgcctgag

SEQ ID NO: 6990453 - DNA, 20 bp, Homo sapiens
aagttggctcctcctagcaa

SEQ ID NO: 6990454 - DNA, 22 bp, Homo sapiens
agttccttcctgagctattgct

SEQ ID NO: 6990455 - DNA, 17 bp, Homo sapiens
gagtctgtgttcatcag

SEQ ID NO: 6990456 - DNA, 22 bp, Homo sapiens
aataagacacacaactgtcaag

SEQ ID NO: 6990457 - DNA, 22 bp, Homo sapiens
tttacagtgtcttgttgactgt

SEQ ID NO: 6990458 - DNA, 22 bp, Homo sapiens
atcagtttgagtgctgtgtcaa

SEQ ID NO: 6990459 - DNA, 22 bp, Homo sapiens
cgtgcgcctcagcctcgtgcgc

SEQ ID NO: 6990460 - DNA, 22 bp, Homo sapiens
agtggcatctctctaatgacga

SEQ ID NO: 6990461 - DNA, 22 bp, Homo sapiens
ctgtgaatctgggtcagttgta

SEQ ID NO: 6990462 - DNA, 22 bp, Homo sapiens
ttagaaatatggtgctgccgcc

SEQ ID NO: 6990463 - DNA, 22 bp, Homo sapiens
ctggaactcctggggagctggt

SEQ ID NO: 6990464 - DNA, 22 bp, Homo sapiens
tcattactgtctaactgtccct

SEQ ID NO: 6990465 - DNA, 22 bp, Homo sapiens
ttcagggcagctagaaccagga

SEQ ID NO: 6990466 - DNA, 22 bp, Homo sapiens
acgcttttactattttgagctc

SEQ ID NO: 6990467 - DNA, 22 bp, Homo sapiens
caggctatgccttccatctgca

SEQ ID NO: 6990468 - DNA, 22 bp, Homo sapiens
ggctcactgcaacttccgcctc

SEQ ID NO: 6990469 - DNA, 22 bp, Homo sapiens
tccaggccgcatagttactctg

SEQ ID NO: 6990470 - DNA, 22 bp, Homo sapiens
ataagctctggacagccacatt

SEQ ID NO: 6990471 - DNA, 21 bp, Homo sapiens
tgtgagaagagtactgaggtc

SEQ ID NO: 6990472 - DNA, 22 bp, Homo sapiens
tgaggtgagtcagtttctgatg

SEQ ID NO: 6990473 - DNA, 22 bp, Homo sapiens
gagaaggagtagctgacctggg

SEQ ID NO: 6990474 - DNA, 22 bp, Homo sapiens
gtttattgggtattgtggagcc

SEQ ID NO: 6990475 - DNA, 22 bp, Homo sapiens
acttgacagaagtcagtacttt

SEQ ID NO: 6990476 - DNA, 22 bp, Homo sapiens
tcaatacacatgccgctgttct

SEQ ID NO: 6990477 - DNA, 17 bp, Homo sapiens
acagtttgtcattctaa

SEQ ID NO: 6990478 - DNA, 22 bp, Homo sapiens
tgcagtgattaaagtgttaaat

SEQ ID NO: 6990479 - DNA, 22 bp, Homo sapiens
tcttttgttgatggaattaatg

SEQ ID NO: 6990480 - DNA, 17 bp, Homo sapiens
acaatgcagtctctagt

SEQ ID NO: 6990481 - DNA, 22 bp, Homo sapiens
acatagcagaggactgagcaga

SEQ ID NO: 6990482 - DNA, 22 bp, Homo sapiens
tctgagaaggaagctctgtgta

SEQ ID NO: 6990483 - DNA, 22 bp, Homo sapiens
tctcatgttttacctgtcctca

SEQ ID NO: 6990484 - DNA, 22 bp, Homo sapiens
tagttaaaccaccattctggta

SEQ ID NO: 6990485 - DNA, 22 bp, Homo sapiens
tgagctggaggacaggagggta

SEQ ID NO: 6990486 - DNA, 22 bp, Homo sapiens
gtctgacttcctaatccatcac

SEQ ID NO: 6990487 - DNA, 22 bp, Homo sapiens
agtttcacatgcatggatgtgt

SEQ ID NO: 6990488 - DNA, 22 bp, Homo sapiens
tattcctacatctttcctggaa

SEQ ID NO: 6990489 - DNA, 22 bp, Homo sapiens
aatgttttagattactgctggg

SEQ ID NO: 6990490 - DNA, 22 bp, Homo sapiens
gacagttaggggctggatgcca

SEQ ID NO: 6990491 - DNA, 19 bp, Homo sapiens
cccaggaggcggaggttgc

SEQ ID NO: 6990492 - DNA, 22 bp, Homo sapiens
aaagctgatgtctactagagaa

SEQ ID NO: 6990493 - DNA, 19 bp, Homo sapiens
tttattcacctttaccttg

SEQ ID NO: 6990494 - DNA, 21 bp, Homo sapiens
cttgggcttgtagatggtgga

SEQ ID NO: 6990495 - DNA, 22 bp, Homo sapiens
acaggcagcactaatctctggt

SEQ ID NO: 6990496 - DNA, 22 bp, Homo sapiens
ggctgagaatcaacaacctgct

SEQ ID NO: 6990497 - DNA, 22 bp, Homo sapiens
gagcaagatcctgtttttctat

SEQ ID NO: 6990498 - DNA, 22 bp, Homo sapiens
tgtcctagatccagctgtgctg

SEQ ID NO: 6990499 - DNA, 22 bp, Homo sapiens
tgtctttatatatttggaaaat

SEQ ID NO: 6990500 - DNA, 22 bp, Homo sapiens
tggtttgacaatgaggactggt

SEQ ID NO: 6990501 - DNA, 21 bp, Homo sapiens
aggatttactattaactgtgt

SEQ ID NO: 6990502 - DNA, 22 bp, Homo sapiens
tgactcacttaatttacaagtc

SEQ ID NO: 6990503 - DNA, 22 bp, Homo sapiens
tcacctcttttttaacaggctt

SEQ ID NO: 6990504 - DNA, 22 bp, Homo sapiens
ccctcaggatgcagtggaagtg

SEQ ID NO: 6990505 - DNA, 22 bp, Homo sapiens
ggcttgctctctaaaagggctg

SEQ ID NO: 6990506 - DNA, 22 bp, Homo sapiens
ggcctctgccccagccacacct

SEQ ID NO: 6990507 - DNA, 22 bp, Homo sapiens
ttaaatctgttctcatgtctgt

SEQ ID NO: 6990508 - DNA, 22 bp, Homo sapiens
agacagtgacttagtgaccaga

SEQ ID NO: 6990509 - DNA, 18 bp, Homo sapiens
tttgcatggtaacattga

SEQ ID NO: 6990510 - DNA, 22 bp, Homo sapiens
tactgaaacttttcttcaactg

SEQ ID NO: 6990511 - DNA, 22 bp, Homo sapiens
tccaggggtaccggccaggcag

SEQ ID NO: 6990512 - DNA, 22 bp, Homo sapiens
gacaccagaagacataagcaga

SEQ ID NO: 6990513 - DNA, 22 bp, Homo sapiens
agctttgtatttgagcatacga

SEQ ID NO: 6990514 - DNA, 22 bp, Homo sapiens
tgccttggattgcagggaacct

SEQ ID NO: 6990515 - DNA, 22 bp, Homo sapiens
tggtttataacatgtctcatga

SEQ ID NO: 6990516 - DNA, 22 bp, Homo sapiens
taaatgagatttgttcttttgt

SEQ ID NO: 6990517 - DNA, 22 bp, Homo sapiens
ttgaaacagacaagtaaatgtc

SEQ ID NO: 6990518 - DNA, 22 bp, Homo sapiens
gaattgcttgtgaagtgtgtct

SEQ ID NO: 6990519 - DNA, 22 bp, Homo sapiens
acatttctgcatctcagagcta

SEQ ID NO: 6990520 - DNA, 22 bp, Homo sapiens
agagctgcagggtggacccagg

SEQ ID NO: 6990521 - DNA, 22 bp, Homo sapiens
ctgtcttctcctttgtttcagg

SEQ ID NO: 6990522 - DNA, 22 bp, Homo sapiens
accagttattagccctacaact

SEQ ID NO: 6990523 - DNA, 22 bp, Homo sapiens
aggacttctagtggtactgtga

SEQ ID NO: 6990524 - DNA, 22 bp, Homo sapiens
ttgccaggagagccacttgcag

SEQ ID NO: 6990525 - DNA, 22 bp, Homo sapiens
aagggccacatttgggtccctg

SEQ ID NO: 6990526 - DNA, 22 bp, Homo sapiens
cagctgagaagtgatagctgca

SEQ ID NO: 6990527 - DNA, 22 bp, Homo sapiens
atgcttctcctgaacatccctg

SEQ ID NO: 6990528 - DNA, 22 bp, Homo sapiens
ctgctcaacatttgtaggataa

SEQ ID NO: 6990529 - DNA, 22 bp, Homo sapiens
cacagttgttcatattttccca

SEQ ID NO: 6990530 - DNA, 22 bp, Homo sapiens
ttggcactgcattgaccacacc

SEQ ID NO: 6990531 - DNA, 18 bp, Homo sapiens
tgtagctggaggccaggc

SEQ ID NO: 6990532 - DNA, 20 bp, Homo sapiens
tcatatgtggttgtatacaa

SEQ ID NO: 6990533 - DNA, 22 bp, Homo sapiens
cacattcacttctctgtccacc

SEQ ID NO: 6990534 - DNA, 22 bp, Homo sapiens
gctggatccctgtgggagtggt

SEQ ID NO: 6990535 - DNA, 18 bp, Homo sapiens
agttagaaatgaaggcca

SEQ ID NO: 6990536 - DNA, 22 bp, Homo sapiens
ttgaaaatggtaagcatgatat

SEQ ID NO: 6990537 - DNA, 21 bp, Homo sapiens
ggctgagatggcagaatcacc

SEQ ID NO: 6990538 - DNA, 22 bp, Homo sapiens
tagcaggaccatgacaagaaaa

SEQ ID NO: 6990539 - DNA, 22 bp, Homo sapiens
tggagtcctagtattggaaaca

SEQ ID NO: 6990540 - DNA, 22 bp, Homo sapiens
atagacttgaggatataatgaa

SEQ ID NO: 6990541 - DNA, 22 bp, Homo sapiens
tcttggctgctgccaatttact

SEQ ID NO: 6990542 - DNA, 22 bp, Homo sapiens
aaggtgtcactgtttctggcct

SEQ ID NO: 6990543 - DNA, 22 bp, Homo sapiens
tgcagggacaggctctggggat

SEQ ID NO: 6990544 - DNA, 22 bp, Homo sapiens
tgtggaagcctgggccccaggg

SEQ ID NO: 6990545 - DNA, 22 bp, Homo sapiens
ataaggctgaaagcagggagct

SEQ ID NO: 6990546 - DNA, 18 bp, Homo sapiens
ctgggtctccaggctgcc

SEQ ID NO: 6990547 - DNA, 22 bp, Homo sapiens
agtcatatgacccttcacaaac

SEQ ID NO: 6990548 - DNA, 22 bp, Homo sapiens
tttgataacagtgaatatcatg

SEQ ID NO: 6990549 - DNA, 22 bp, Homo sapiens
tttcagactccaaattcataag

SEQ ID NO: 6990550 - DNA, 22 bp, Homo sapiens
taaatctcaataaagtctgtgg

SEQ ID NO: 6990551 - DNA, 22 bp, Homo sapiens
cattgtgtatttctgtagtact

SEQ ID NO: 6990552 - DNA, 22 bp, Homo sapiens
cagagacagtttcacagggtct

SEQ ID NO: 6990553 - DNA, 22 bp, Homo sapiens
attccttgggaattattgaatg

SEQ ID NO: 6990554 - DNA, 20 bp, Homo sapiens
tgtctctcggttttgtgact

SEQ ID NO: 6990555 - DNA, 23 bp, Homo sapiens
ccatatctctgtactgaatgtgg

SEQ ID NO: 6990556 - DNA, 19 bp, Homo sapiens
tctgtcagtgcatcacctc

SEQ ID NO: 6990557 - DNA, 22 bp, Homo sapiens
caggcactttgctgggggcgca

SEQ ID NO: 6990558 - DNA, 22 bp, Homo sapiens
tgccctgtgttgggaatccaca

SEQ ID NO: 6990559 - DNA, 22 bp, Homo sapiens
agggcagcagcccatggctctg

SEQ ID NO: 6990560 - DNA, 22 bp, Homo sapiens
gtgcaatgtctgtgatatgaaa

SEQ ID NO: 6990561 - DNA, 22 bp, Homo sapiens
aaaagtatagggtttggagtca

SEQ ID NO: 6990562 - DNA, 22 bp, Homo sapiens
gcgccactgcactcccacctgg

SEQ ID NO: 6990563 - DNA, 22 bp, Homo sapiens
tctaggcctggcttgggcccag

SEQ ID NO: 6990564 - DNA, 20 bp, Homo sapiens
cctctgtttacaacacaccc

SEQ ID NO: 6990565 - DNA, 22 bp, Homo sapiens
cttgtcagtgtactttcttttg

SEQ ID NO: 6990566 - DNA, 22 bp, Homo sapiens
tgtcatcaactcacagagccaa

SEQ ID NO: 6990567 - DNA, 22 bp, Homo sapiens
aaccatgaatgggttctggtgt

SEQ ID NO: 6990568 - DNA, 22 bp, Homo sapiens
cccaggtcccgccccagctcta

SEQ ID NO: 6990569 - DNA, 22 bp, Homo sapiens
tgccaggcatatggcctctttg

SEQ ID NO: 6990570 - DNA, 22 bp, Homo sapiens
gaggcccagtcctgcaagcacg

SEQ ID NO: 6990571 - DNA, 22 bp, Homo sapiens
ttgatggaaaatttcatggtga

SEQ ID NO: 6990572 - DNA, 22 bp, Homo sapiens
gtgggccactgggaggcaaggg

SEQ ID NO: 6990573 - DNA, 22 bp, Homo sapiens
gagctcattcattcattgcctg

SEQ ID NO: 6990574 - DNA, 22 bp, Homo sapiens
agctggccattgtgagtggcct

SEQ ID NO: 6990575 - DNA, 22 bp, Homo sapiens
gggcagtgggtggctgcagcct

SEQ ID NO: 6990576 - DNA, 22 bp, Homo sapiens
cttgggtctgtcctgctgtgca

SEQ ID NO: 6990577 - DNA, 20 bp, Homo sapiens
cttgttgattctaggaatga

SEQ ID NO: 6990578 - DNA, 22 bp, Homo sapiens
gtatttctgcaaagtgtgtgac

SEQ ID NO: 6990579 - DNA, 22 bp, Homo sapiens
ctacagagtatctaaagaggta

SEQ ID NO: 6990580 - DNA, 18 bp, Homo sapiens
accctctggcttctgagc

SEQ ID NO: 6990581 - DNA, 22 bp, Homo sapiens
tcttccagaatctcagagggct

SEQ ID NO: 6990582 - DNA, 22 bp, Homo sapiens
ccagagaaaggtttgattcatt

SEQ ID NO: 6990583 - DNA, 22 bp, Homo sapiens
cctccctccattgccatcgtct

SEQ ID NO: 6990584 - DNA, 22 bp, Homo sapiens
cttttgttgcccttgtcgcagg

SEQ ID NO: 6990585 - DNA, 22 bp, Homo sapiens
gtgagtaaaggttcattgaatt

SEQ ID NO: 6990586 - DNA, 22 bp, Homo sapiens
gcattcagcctaaagagaaaag

SEQ ID NO: 6990587 - DNA, 22 bp, Homo sapiens
atgttctgcctccattttgagt

SEQ ID NO: 6990588 - DNA, 23 bp, Homo sapiens
tttcccaccctctctcattgctg

SEQ ID NO: 6990589 - DNA, 22 bp, Homo sapiens
caggaaatttatgttctactta

SEQ ID NO: 6990590 - DNA, 22 bp, Homo sapiens
ctgagggagttcctgagcccac

SEQ ID NO: 6990591 - DNA, 22 bp, Homo sapiens
gaagtcttgaaacacaaactag

SEQ ID NO: 6990592 - DNA, 22 bp, Homo sapiens
agtagtcagcagataatatagg

SEQ ID NO: 6990593 - DNA, 22 bp, Homo sapiens
tgggacagtgtgccttgctcct

SEQ ID NO: 6990594 - DNA, 22 bp, Homo sapiens
gccctgctcctccgtcccacga

SEQ ID NO: 6990595 - DNA, 22 bp, Homo sapiens
aaggctaagtaaggctctttct

SEQ ID NO: 6990596 - DNA, 22 bp, Homo sapiens
gccctgcttctggcatgcagaa

SEQ ID NO: 6990597 - DNA, 22 bp, Homo sapiens
tcattcatgaggtgctagtgct

SEQ ID NO: 6990598 - DNA, 22 bp, Homo sapiens
ttttagaaatactgatttagtg

SEQ ID NO: 6990599 - DNA, 18 bp, Homo sapiens
tctatatggacatagaga

SEQ ID NO: 6990600 - DNA, 22 bp, Homo sapiens
tcatttcagtggcacagaagat

SEQ ID NO: 6990601 - DNA, 22 bp, Homo sapiens
actcagcttcctacagctagaa

SEQ ID NO: 6990602 - DNA, 22 bp, Homo sapiens
tgttgacaataaagtctaccat

SEQ ID NO: 6990603 - DNA, 22 bp, Homo sapiens
tggcacaggcggtaagggtgtg

SEQ ID NO: 6990604 - DNA, 22 bp, Homo sapiens
tatatgcatgcccatgtataca

SEQ ID NO: 6990605 - DNA, 22 bp, Homo sapiens
aagagatgtgggctgctgtgca

SEQ ID NO: 6990606 - DNA, 22 bp, Homo sapiens
aatctttcaaatttctttgggt

SEQ ID NO: 6990607 - DNA, 22 bp, Homo sapiens
taaatgtagtcaaaggagcctc

SEQ ID NO: 6990608 - DNA, 22 bp, Homo sapiens
acgtgacccgatccctgggacc

SEQ ID NO: 6990609 - DNA, 22 bp, Homo sapiens
gttccttgggaacaacgctgaa

SEQ ID NO: 6990610 - DNA, 22 bp, Homo sapiens
ctgcactgagctctcccagccc

SEQ ID NO: 6990611 - DNA, 22 bp, Homo sapiens
acttcatgctttagagagatga

SEQ ID NO: 6990612 - DNA, 22 bp, Homo sapiens
tgacctattagatttccttgcc

SEQ ID NO: 6990613 - DNA, 22 bp, Homo sapiens
tgagacctgcctctgcactagg

SEQ ID NO: 6990614 - DNA, 22 bp, Homo sapiens
atttgcttctgctaaacaactt

SEQ ID NO: 6990615 - DNA, 22 bp, Homo sapiens
agaaagctccccatgagatgat

SEQ ID NO: 6990616 - DNA, 22 bp, Homo sapiens
gaaatgtactttaaagccatcc

SEQ ID NO: 6990617 - DNA, 22 bp, Homo sapiens
gggctctgtttagaccagagat

SEQ ID NO: 6990618 - DNA, 22 bp, Homo sapiens
gaggtggcccttgctcagcctt

SEQ ID NO: 6990619 - DNA, 16 bp, Homo sapiens
ggcaccagtgaacaca

SEQ ID NO: 6990620 - DNA, 22 bp, Homo sapiens
agttcttgctataaaaacaaat

SEQ ID NO: 6990621 - DNA, 22 bp, Homo sapiens
aaggccagcagtttgagaccag

SEQ ID NO: 6990622 - DNA, 22 bp, Homo sapiens
tcactctgcctccatattacta

SEQ ID NO: 6990623 - DNA, 22 bp, Homo sapiens
caagggctctaagtcacaagat

SEQ ID NO: 6990624 - DNA, 21 bp, Homo sapiens
acattgtgacatgcagggtgc

SEQ ID NO: 6990625 - DNA, 22 bp, Homo sapiens
gccatgcctgtgtctccaggcc

SEQ ID NO: 6990626 - DNA, 22 bp, Homo sapiens
tctttaatcataaccaagatgg

SEQ ID NO: 6990627 - DNA, 22 bp, Homo sapiens
aaagggaggggcgataagccgg

SEQ ID NO: 6990628 - DNA, 22 bp, Homo sapiens
atcactatgcttatgtggcaca

SEQ ID NO: 6990629 - DNA, 22 bp, Homo sapiens
ttacacttgtaattatataacg

SEQ ID NO: 6990630 - DNA, 22 bp, Homo sapiens
tgtgatcattgctaacatccat

SEQ ID NO: 6990631 - DNA, 22 bp, Homo sapiens
agtgagccataagggctgccac

SEQ ID NO: 6990632 - DNA, 22 bp, Homo sapiens
tatactgatcactgaggtcatc

SEQ ID NO: 6990633 - DNA, 22 bp, Homo sapiens
agtgcctaaccccttgtatgaa

SEQ ID NO: 6990634 - DNA, 22 bp, Homo sapiens
tctgagctttagctgggatttt

SEQ ID NO: 6990635 - DNA, 22 bp, Homo sapiens
catttcacagtaaagtgatttc

SEQ ID NO: 6990636 - DNA, 22 bp, Homo sapiens
gacattgtggttattaaatgtt

SEQ ID NO: 6990637 - DNA, 22 bp, Homo sapiens
atctgtagtcactgcacagctc

SEQ ID NO: 6990638 - DNA, 18 bp, Homo sapiens
ggcatctgcacagcagcc

SEQ ID NO: 6990639 - DNA, 22 bp, Homo sapiens
tttggcatgggctatttgcttt

SEQ ID NO: 6990640 - DNA, 22 bp, Homo sapiens
ttccagttcttctgtaagcact

SEQ ID NO: 6990641 - DNA, 22 bp, Homo sapiens
gaggggcagaatgtgatcaggg

SEQ ID NO: 6990642 - DNA, 22 bp, Homo sapiens
ttatacacgtttatggagctac

SEQ ID NO: 6990643 - DNA, 22 bp, Homo sapiens
gccagggagtctgggccacaga

SEQ ID NO: 6990644 - DNA, 22 bp, Homo sapiens
catgtgtggtctgtggctatct

SEQ ID NO: 6990645 - DNA, 18 bp, Homo sapiens
gacccaggaaagagtcct

SEQ ID NO: 6990646 - DNA, 22 bp, Homo sapiens
ttagttgccagtgaggaggatt

SEQ ID NO: 6990647 - DNA, 22 bp, Homo sapiens
tggctccaggggacacgcagta

SEQ ID NO: 6990648 - DNA, 22 bp, Homo sapiens
tcctcagatataaatgagggtg

SEQ ID NO: 6990649 - DNA, 20 bp, Homo sapiens
gtattacaggcttagaacca

SEQ ID NO: 6990650 - DNA, 22 bp, Homo sapiens
gaggcctataggcaagtgctgc

SEQ ID NO: 6990651 - DNA, 22 bp, Homo sapiens
gctggagtccagtggcatgatc

SEQ ID NO: 6990652 - DNA, 22 bp, Homo sapiens
ctagaatctgggatttctgact

SEQ ID NO: 6990653 - DNA, 22 bp, Homo sapiens
aattagaagctgttagcaaaat

SEQ ID NO: 6990654 - DNA, 22 bp, Homo sapiens
gtgcctgaaagccatgctcact

SEQ ID NO: 6990655 - DNA, 18 bp, Homo sapiens
tggcatgctttgatacat

SEQ ID NO: 6990656 - DNA, 22 bp, Homo sapiens
tatgtgtattgagcattgttac

SEQ ID NO: 6990657 - DNA, 22 bp, Homo sapiens
atttaagattgcgtattcatgt

SEQ ID NO: 6990658 - DNA, 22 bp, Homo sapiens
tccagagctgagggtcagtaga

SEQ ID NO: 6990659 - DNA, 21 bp, Homo sapiens
gccctaggctacctggagcgc

SEQ ID NO: 6990660 - DNA, 22 bp, Homo sapiens
tgtggcttttgctagctttgca

SEQ ID NO: 6990661 - DNA, 22 bp, Homo sapiens
gactccaggtgtccaggcctcc

SEQ ID NO: 6990662 - DNA, 22 bp, Homo sapiens
ttgacttcagaatgttgatggt

SEQ ID NO: 6990663 - DNA, 20 bp, Homo sapiens
tagggatgccagtacttctc

SEQ ID NO: 6990664 - DNA, 22 bp, Homo sapiens
taggtataggattctaggttgg

SEQ ID NO: 6990665 - DNA, 22 bp, Homo sapiens
tcagagtgtgagacatattgga

SEQ ID NO: 6990666 - DNA, 22 bp, Homo sapiens
ctggtccagttgtctcctaagc

SEQ ID NO: 6990667 - DNA, 22 bp, Homo sapiens
cacagcttcccgtgcatggaga

SEQ ID NO: 6990668 - DNA, 23 bp, Homo sapiens
gctgtgcacgagccactgcctgt

SEQ ID NO: 6990669 - DNA, 22 bp, Homo sapiens
ttgaagatgctgtctcttccag

SEQ ID NO: 6990670 - DNA, 22 bp, Homo sapiens
ttccagggaagagcaaggcagt

SEQ ID NO: 6990671 - DNA, 22 bp, Homo sapiens
aatttaagagcatagctccaac

SEQ ID NO: 6990672 - DNA, 22 bp, Homo sapiens
ctcagaggcaagcaaggagctg

SEQ ID NO: 6990673 - DNA, 22 bp, Homo sapiens
ctgtttcctaccgtttttcatt

SEQ ID NO: 6990674 - DNA, 22 bp, Homo sapiens
agtacttttttgatatctgagt

SEQ ID NO: 6990675 - DNA, 23 bp, Homo sapiens
gtcacagtgggtggtgcctacat

SEQ ID NO: 6990676 - DNA, 22 bp, Homo sapiens
cacttgatatcttatatttaat

SEQ ID NO: 6990677 - DNA, 22 bp, Homo sapiens
taagtcatcccataacagtgct

SEQ ID NO: 6990678 - DNA, 22 bp, Homo sapiens
tttcacatgtatataggcatta

SEQ ID NO: 6990679 - DNA, 22 bp, Homo sapiens
tgggagtccattgtcccaggca

SEQ ID NO: 6990680 - DNA, 23 bp, Homo sapiens
gcttgtctagtgaattcatatct

SEQ ID NO: 6990681 - DNA, 22 bp, Homo sapiens
atggaagctgaaaaagacacgg

SEQ ID NO: 6990682 - DNA, 22 bp, Homo sapiens
ttgcatgctagaaagattgatt

SEQ ID NO: 6990683 - DNA, 22 bp, Homo sapiens
tagggaggctacttcttgtagg

SEQ ID NO: 6990684 - DNA, 22 bp, Homo sapiens
ttacaactctagagaaaagaaa

SEQ ID NO: 6990685 - DNA, 22 bp, Homo sapiens
ggcagtcaagagggagtctgaa

SEQ ID NO: 6990686 - DNA, 22 bp, Homo sapiens
cgcctgcttaacgaattgtgtt

SEQ ID NO: 6990687 - DNA, 22 bp, Homo sapiens
aggaattttacaagctggttgc

SEQ ID NO: 6990688 - DNA, 22 bp, Homo sapiens
tagctcacttgagctctgctag

SEQ ID NO: 6990689 - DNA, 22 bp, Homo sapiens
tgaataatccacagtcattcat

SEQ ID NO: 6990690 - DNA, 22 bp, Homo sapiens
ctttgtcattttgtctctcagt

SEQ ID NO: 6990691 - DNA, 22 bp, Homo sapiens
aaatcagaggtcagctgtacca

SEQ ID NO: 6990692 - DNA, 21 bp, Homo sapiens
tcagctcaaatgtcgcttcct

SEQ ID NO: 6990693 - DNA, 22 bp, Homo sapiens
tgtaaagtattcccaaccaggg

SEQ ID NO: 6990694 - DNA, 22 bp, Homo sapiens
ccatggcttctttctctgccag

SEQ ID NO: 6990695 - DNA, 22 bp, Homo sapiens
catcaggacagcttcttttcac

SEQ ID NO: 6990696 - DNA, 22 bp, Homo sapiens
ttcaagatggcaccagtgagtg

SEQ ID NO: 6990697 - DNA, 22 bp, Homo sapiens
gctggtgctctgggccctgagg

SEQ ID NO: 6990698 - DNA, 22 bp, Homo sapiens
aggcaatacacagcatttcaca

SEQ ID NO: 6990699 - DNA, 22 bp, Homo sapiens
cagcaacatgtggtagtgtagg

SEQ ID NO: 6990700 - DNA, 22 bp, Homo sapiens
cgctgcctccaggtgcagcagg

SEQ ID NO: 6990701 - DNA, 22 bp, Homo sapiens
agtccgtggccagactcaagag

SEQ ID NO: 6990702 - DNA, 22 bp, Homo sapiens
acagtgattattagttggtggt

SEQ ID NO: 6990703 - DNA, 22 bp, Homo sapiens
tcaggcaggaagcccctgcaca

SEQ ID NO: 6990704 - DNA, 22 bp, Homo sapiens
atgacaggaataactatgatgg

SEQ ID NO: 6990705 - DNA, 20 bp, Homo sapiens
atatgtgtacgtgtatacat

SEQ ID NO: 6990706 - DNA, 22 bp, Homo sapiens
actgggccgcgctgcagagggc

SEQ ID NO: 6990707 - DNA, 22 bp, Homo sapiens
tagtgccctcccctttgggata

SEQ ID NO: 6990708 - DNA, 19 bp, Homo sapiens
tagaagcactaggcaaact

SEQ ID NO: 6990709 - DNA, 23 bp, Homo sapiens
tgggccagggagtccggtttctt

SEQ ID NO: 6990710 - DNA, 23 bp, Homo sapiens
ttaaacactagttcgagtagcat

SEQ ID NO: 6990711 - DNA, 22 bp, Homo sapiens
taaggaagtcacaagaatcgct

SEQ ID NO: 6990712 - DNA, 22 bp, Homo sapiens
ggctcataaactcagttcagtt

SEQ ID NO: 6990713 - DNA, 22 bp, Homo sapiens
ttcacatggcaatagagaggga

SEQ ID NO: 6990714 - DNA, 22 bp, Homo sapiens
agtgcaggctcgcttgtgaggc

SEQ ID NO: 6990715 - DNA, 22 bp, Homo sapiens
gaacacatgattataaatgcta

SEQ ID NO: 6990716 - DNA, 22 bp, Homo sapiens
ttccagttggcactgcaattta

SEQ ID NO: 6990717 - DNA, 22 bp, Homo sapiens
acatgaagtggtcagatcaaac

SEQ ID NO: 6990718 - DNA, 22 bp, Homo sapiens
acagatggcacctttttgctgt

SEQ ID NO: 6990719 - DNA, 22 bp, Homo sapiens
cagtcctgggtgcagcaggaaa

SEQ ID NO: 6990720 - DNA, 22 bp, Homo sapiens
tagagcagatagtgaaacagaa

SEQ ID NO: 6990721 - DNA, 22 bp, Homo sapiens
ctgctgtgtcagagtccagggg

SEQ ID NO: 6990722 - DNA, 22 bp, Homo sapiens
ctggaattgcataatatgtcct

SEQ ID NO: 6990723 - DNA, 22 bp, Homo sapiens
cagacaggttgcaaaacttcaa

SEQ ID NO: 6990724 - DNA, 22 bp, Homo sapiens
tgttaatctttgagtcttcatc

SEQ ID NO: 6990725 - DNA, 22 bp, Homo sapiens
atactacacattgactatattt

SEQ ID NO: 6990726 - DNA, 22 bp, Homo sapiens
cccttagctccaaggggtttgg

SEQ ID NO: 6990727 - DNA, 22 bp, Homo sapiens
tccagctcaaagtgctcctgtc

SEQ ID NO: 6990728 - DNA, 22 bp, Homo sapiens
tcattacatcttggccaaaact

SEQ ID NO: 6990729 - DNA, 22 bp, Homo sapiens
ggaacagtagacgatctccttt

SEQ ID NO: 6990730 - DNA, 21 bp, Homo sapiens
cctgctgtgatcttagtgagt

SEQ ID NO: 6990731 - DNA, 22 bp, Homo sapiens
accctaataatcacagactagt

SEQ ID NO: 6990732 - DNA, 22 bp, Homo sapiens
ctattagttaggaagacaagca

SEQ ID NO: 6990733 - DNA, 22 bp, Homo sapiens
ctcctgcccacgtgctacttct

SEQ ID NO: 6990734 - DNA, 22 bp, Homo sapiens
tcactggactcactgtggccag

SEQ ID NO: 6990735 - DNA, 22 bp, Homo sapiens
aaagcaatggatgagaatctgt

SEQ ID NO: 6990736 - DNA, 18 bp, Homo sapiens
ccagggatgcatggtccc

SEQ ID NO: 6990737 - DNA, 23 bp, Homo sapiens
gggaagtgaggagcccctctgcc

SEQ ID NO: 6990738 - DNA, 22 bp, Homo sapiens
tgctttaacgctgagggtctca

SEQ ID NO: 6990739 - DNA, 22 bp, Homo sapiens
tacatagctcctagtgatgcat

SEQ ID NO: 6990740 - DNA, 22 bp, Homo sapiens
cagctggatccctgcagaactt

SEQ ID NO: 6990741 - DNA, 22 bp, Homo sapiens
tctgataatgtgcttcgtgacc

SEQ ID NO: 6990742 - DNA, 19 bp, Homo sapiens
cgcaggagccgaggtgacc

SEQ ID NO: 6990743 - DNA, 22 bp, Homo sapiens
agggaagctgctgggtccacct

SEQ ID NO: 6990744 - DNA, 22 bp, Homo sapiens
agaagctaattcatgtcttatg

SEQ ID NO: 6990745 - DNA, 22 bp, Homo sapiens
ctccaggagggggatggctgta

SEQ ID NO: 6990746 - DNA, 22 bp, Homo sapiens
tgcagcttctccatctccttgt

SEQ ID NO: 6990747 - DNA, 22 bp, Homo sapiens
agtcccagcccagtcctgtaag

SEQ ID NO: 6990748 - DNA, 21 bp, Homo sapiens
ctcagagaaatgtctgggagc

SEQ ID NO: 6990749 - DNA, 22 bp, Homo sapiens
gggagggaggtgatgcttggct

SEQ ID NO: 6990750 - DNA, 22 bp, Homo sapiens
aaaggatggctctgcatatttg

SEQ ID NO: 6990751 - DNA, 22 bp, Homo sapiens
tcccaggtgatgctgaggccac

SEQ ID NO: 6990752 - DNA, 22 bp, Homo sapiens
tcaatgtttgttcatgaaaata

SEQ ID NO: 6990753 - DNA, 22 bp, Homo sapiens
aaagctagagaagctgctgtca

SEQ ID NO: 6990754 - DNA, 22 bp, Homo sapiens
gagttttaacctcagctctctg

SEQ ID NO: 6990755 - DNA, 17 bp, Homo sapiens
tccattcctaaggccct

SEQ ID NO: 6990756 - DNA, 22 bp, Homo sapiens
tagcccatgtgcgtgttggggg

SEQ ID NO: 6990757 - DNA, 22 bp, Homo sapiens
agtttggcagagcttgggtggt

SEQ ID NO: 6990758 - DNA, 22 bp, Homo sapiens
ataaggcttctggctgctttct

SEQ ID NO: 6990759 - DNA, 22 bp, Homo sapiens
tataaagttggggctgaagtaa

SEQ ID NO: 6990760 - DNA, 22 bp, Homo sapiens
atgggctaaacttagaggatat

SEQ ID NO: 6990761 - DNA, 21 bp, Homo sapiens
aggtttctgtgagcagagcag

SEQ ID NO: 6990762 - DNA, 22 bp, Homo sapiens
ccacagggctctaggcgcttcc

SEQ ID NO: 6990763 - DNA, 19 bp, Homo sapiens
agctacagcatggcgaggt

SEQ ID NO: 6990764 - DNA, 22 bp, Homo sapiens
aacaggctagttttaaagcata

SEQ ID NO: 6990765 - DNA, 22 bp, Homo sapiens
cagctacagttccactgagcat

SEQ ID NO: 6990766 - DNA, 22 bp, Homo sapiens
gctttatgggccatgcggtgtc

SEQ ID NO: 6990767 - DNA, 22 bp, Homo sapiens
agctctttgctggcagtaggct

SEQ ID NO: 6990768 - DNA, 22 bp, Homo sapiens
gagtgcagaaattcccttcctg

SEQ ID NO: 6990769 - DNA, 22 bp, Homo sapiens
ggcctggccctcccgggttcaa

SEQ ID NO: 6990770 - DNA, 22 bp, Homo sapiens
atgtgaaactgaagcatccata

SEQ ID NO: 6990771 - DNA, 22 bp, Homo sapiens
ttgagatgacttaaatttggga

SEQ ID NO: 6990772 - DNA, 22 bp, Homo sapiens
tgagacagttggtgaaatctaa

SEQ ID NO: 6990773 - DNA, 22 bp, Homo sapiens
aggctctctctgcccctgggac

SEQ ID NO: 6990774 - DNA, 22 bp, Homo sapiens
ttgatcttttcttgctgcccca

SEQ ID NO: 6990775 - DNA, 22 bp, Homo sapiens
tagcaggaggcagttcctcgct

SEQ ID NO: 6990776 - DNA, 22 bp, Homo sapiens
tgcaggagaaagtacggagcgt

SEQ ID NO: 6990777 - DNA, 18 bp, Homo sapiens
gaagcatatttgttcttc

SEQ ID NO: 6990778 - DNA, 22 bp, Homo sapiens
gacactgaagtcactaagcagg

SEQ ID NO: 6990779 - DNA, 21 bp, Homo sapiens
attcacaggtatcctctccct

SEQ ID NO: 6990780 - DNA, 17 bp, Homo sapiens
gggaggccttggtttcc

SEQ ID NO: 6990781 - DNA, 22 bp, Homo sapiens
agtgatggcatatatagatgtg

SEQ ID NO: 6990782 - DNA, 22 bp, Homo sapiens
taggccacaaataagatcctgt

SEQ ID NO: 6990783 - DNA, 22 bp, Homo sapiens
aaaagagcttggttgattttgc

SEQ ID NO: 6990784 - DNA, 22 bp, Homo sapiens
aggaaactttcttttgcttcat

SEQ ID NO: 6990785 - DNA, 22 bp, Homo sapiens
agcacctggagggctgggacct

SEQ ID NO: 6990786 - DNA, 22 bp, Homo sapiens
taggcagatgttaacaggaaaa

SEQ ID NO: 6990787 - DNA, 22 bp, Homo sapiens
ccagtgttcataattttacact

SEQ ID NO: 6990788 - DNA, 22 bp, Homo sapiens
catagaggctaaaattatttgg

SEQ ID NO: 6990789 - DNA, 22 bp, Homo sapiens
catcagaatgaatgttctggag

SEQ ID NO: 6990790 - DNA, 22 bp, Homo sapiens
tccataaattttatgaacatat

SEQ ID NO: 6990791 - DNA, 22 bp, Homo sapiens
ctccaggcgggaggcggttcca

SEQ ID NO: 6990792 - DNA, 22 bp, Homo sapiens
gctggagcttgagaggacaggg

SEQ ID NO: 6990793 - DNA, 22 bp, Homo sapiens
tcctgctgacaaggaaagcatg

SEQ ID NO: 6990794 - DNA, 22 bp, Homo sapiens
gcacatgcatgcatattcctgg

SEQ ID NO: 6990795 - DNA, 22 bp, Homo sapiens
tgttgcagtagcagtagttgca

SEQ ID NO: 6990796 - DNA, 22 bp, Homo sapiens
tctcccacagccgtgcttcaag

SEQ ID NO: 6990797 - DNA, 22 bp, Homo sapiens
gccagctctgtggctgtacttg

SEQ ID NO: 6990798 - DNA, 21 bp, Homo sapiens
aacatgatatgtgtatggatt

SEQ ID NO: 6990799 - DNA, 22 bp, Homo sapiens
ccaggcttcctaatgtgtgcag

SEQ ID NO: 6990800 - DNA, 22 bp, Homo sapiens
agccagatgaagaggtccttaa

SEQ ID NO: 6990801 - DNA, 22 bp, Homo sapiens
gacagaggagaagatgctgtgg

SEQ ID NO: 6990802 - DNA, 23 bp, Homo sapiens
cgggtaggaacatcaggatgtga

SEQ ID NO: 6990803 - DNA, 22 bp, Homo sapiens
agtgcctggcacatggaaggtg

SEQ ID NO: 6990804 - DNA, 22 bp, Homo sapiens
ctttgtgtctgttaataattat

SEQ ID NO: 6990805 - DNA, 22 bp, Homo sapiens
gggagagaaattatagcaatga

SEQ ID NO: 6990806 - DNA, 22 bp, Homo sapiens
aaagtttcaatagaggaagtgg

SEQ ID NO: 6990807 - DNA, 23 bp, Homo sapiens
ttagtgtaaggcaggcacagttg

SEQ ID NO: 6990808 - DNA, 22 bp, Homo sapiens
taagtgagttcttgctagattt

SEQ ID NO: 6990809 - DNA, 22 bp, Homo sapiens
acattccaaaaactagcagata

SEQ ID NO: 6990810 - DNA, 17 bp, Homo sapiens
tgaaacaccaagactgt

SEQ ID NO: 6990811 - DNA, 22 bp, Homo sapiens
aaactcaaggatttagacgaag

SEQ ID NO: 6990812 - DNA, 22 bp, Homo sapiens
caggagtccctctggccagcat

SEQ ID NO: 6990813 - DNA, 22 bp, Homo sapiens
ttacaggtgggaaaactaagct

SEQ ID NO: 6990814 - DNA, 22 bp, Homo sapiens
atctggagtttcagttttctgg

SEQ ID NO: 6990815 - DNA, 22 bp, Homo sapiens
tggaaatatgctccattctttt

SEQ ID NO: 6990816 - DNA, 22 bp, Homo sapiens
ccaaggcaatgtgcagctggtg

SEQ ID NO: 6990817 - DNA, 22 bp, Homo sapiens
tgcaaagaaaacactgcaagac

SEQ ID NO: 6990818 - DNA, 22 bp, Homo sapiens
tggctcagcattcactggtctt

SEQ ID NO: 6990819 - DNA, 22 bp, Homo sapiens
cacccagtgaaggagcaagagg

SEQ ID NO: 6990820 - DNA, 22 bp, Homo sapiens
acagaatatttggcatgcgtct

SEQ ID NO: 6990821 - DNA, 22 bp, Homo sapiens
tcatataagtttaaaactatct

SEQ ID NO: 6990822 - DNA, 19 bp, Homo sapiens
tcctgaagatttcctcagc

SEQ ID NO: 6990823 - DNA, 22 bp, Homo sapiens
cagaggtctgacactgaatggt

SEQ ID NO: 6990824 - DNA, 22 bp, Homo sapiens
ctttcagggcaacacttctttt

SEQ ID NO: 6990825 - DNA, 22 bp, Homo sapiens
tgcatttgtcttgtctcatgaa

SEQ ID NO: 6990826 - DNA, 22 bp, Homo sapiens
ttcttgggctccaccccagact

SEQ ID NO: 6990827 - DNA, 22 bp, Homo sapiens
ccgtgctcgggaaaggccagtg

SEQ ID NO: 6990828 - DNA, 22 bp, Homo sapiens
atatgcacactctgcccacaga

SEQ ID NO: 6990829 - DNA, 22 bp, Homo sapiens
ctcagcccggtgctcgtgccac

SEQ ID NO: 6990830 - DNA, 20 bp, Homo sapiens
tgtgtgaatttcagagccgc

SEQ ID NO: 6990831 - DNA, 22 bp, Homo sapiens
atccagtagtgacttttacatt

SEQ ID NO: 6990832 - DNA, 22 bp, Homo sapiens
tgaggattcaagagggaacaag

SEQ ID NO: 6990833 - DNA, 22 bp, Homo sapiens
cataggtcactaaatcagcaaa

SEQ ID NO: 6990834 - DNA, 22 bp, Homo sapiens
aagtgggcggtttatgattctg

SEQ ID NO: 6990835 - DNA, 22 bp, Homo sapiens
tccttcagtcttctgagccata

SEQ ID NO: 6990836 - DNA, 22 bp, Homo sapiens
gtattgtagctacaatagacgt

SEQ ID NO: 6990837 - DNA, 22 bp, Homo sapiens
ctgcagctcctctctgtgcccc

SEQ ID NO: 6990838 - DNA, 22 bp, Homo sapiens
tatataagatgggtaggcttgt

SEQ ID NO: 6990839 - DNA, 22 bp, Homo sapiens
gaatctcaaggcttgtgaggat

SEQ ID NO: 6990840 - DNA, 22 bp, Homo sapiens
aattcactgaacttctctgaga

SEQ ID NO: 6990841 - DNA, 22 bp, Homo sapiens
gcagttttagagctttaagatg

SEQ ID NO: 6990842 - DNA, 22 bp, Homo sapiens
acttgtaaacaaatctaatgta

SEQ ID NO: 6990843 - DNA, 22 bp, Homo sapiens
gtgctttagttcttgcaactgg

SEQ ID NO: 6990844 - DNA, 22 bp, Homo sapiens
agcttcaaagctaggaagatct

SEQ ID NO: 6990845 - DNA, 23 bp, Homo sapiens
tgagtgtgaaaatcctggagatg

SEQ ID NO: 6990846 - DNA, 22 bp, Homo sapiens
aggcttattaatatgattctgc

SEQ ID NO: 6990847 - DNA, 22 bp, Homo sapiens
ttgggttttcccttgaaactga

SEQ ID NO: 6990848 - DNA, 22 bp, Homo sapiens
tcagaaaagactcaggggctga

SEQ ID NO: 6990849 - DNA, 22 bp, Homo sapiens
ttaatgatgaagtctggctgta

SEQ ID NO: 6990850 - DNA, 22 bp, Homo sapiens
atagacattataacacagagct

SEQ ID NO: 6990851 - DNA, 19 bp, Homo sapiens
tcactgaggctttgttggc

SEQ ID NO: 6990852 - DNA, 22 bp, Homo sapiens
ccttgaaatgagaaaaagttgg

SEQ ID NO: 6990853 - DNA, 22 bp, Homo sapiens
atgaactcatttattttcctct

SEQ ID NO: 6990854 - DNA, 22 bp, Homo sapiens
tttccccaggtagatagataat

SEQ ID NO: 6990855 - DNA, 22 bp, Homo sapiens
ctctccatctgtgtgacctccc

SEQ ID NO: 6990856 - DNA, 21 bp, Homo sapiens
aatgccagtcccagggaatgc

SEQ ID NO: 6990857 - DNA, 22 bp, Homo sapiens
gtgtaaggtgaaatcaacaaat

SEQ ID NO: 6990858 - DNA, 19 bp, Homo sapiens
tggctaaggccagcggaaa

SEQ ID NO: 6990859 - DNA, 22 bp, Homo sapiens
cataattaaattctgggcaaga

SEQ ID NO: 6990860 - DNA, 22 bp, Homo sapiens
ccagagggccctggtctcagct

SEQ ID NO: 6990861 - DNA, 22 bp, Homo sapiens
agcaatataaatgttgggtaga

SEQ ID NO: 6990862 - DNA, 22 bp, Homo sapiens
aatcttctacttgacagttctc

SEQ ID NO: 6990863 - DNA, 22 bp, Homo sapiens
tatttcacctcacccaggagaa

SEQ ID NO: 6990864 - DNA, 22 bp, Homo sapiens
ataagtgatatttagctataga

SEQ ID NO: 6990865 - DNA, 22 bp, Homo sapiens
tgatcccaatctttcctgctcc

SEQ ID NO: 6990866 - DNA, 22 bp, Homo sapiens
atgcagcactgatctttagcca

SEQ ID NO: 6990867 - DNA, 22 bp, Homo sapiens
aattcagagtcctggccccacg

SEQ ID NO: 6990868 - DNA, 22 bp, Homo sapiens
actgaaggaagcgggcaggggt

SEQ ID NO: 6990869 - DNA, 22 bp, Homo sapiens
ttctctctgttatggattttac

SEQ ID NO: 6990870 - DNA, 22 bp, Homo sapiens
gaacacagcggggcttacccgg

SEQ ID NO: 6990871 - DNA, 22 bp, Homo sapiens
tattattatgcatagcatgaaa

SEQ ID NO: 6990872 - DNA, 22 bp, Homo sapiens
ctgcacagtaagcttcagagat

SEQ ID NO: 6990873 - DNA, 22 bp, Homo sapiens
tggtgcagtagagctgtctggg

SEQ ID NO: 6990874 - DNA, 22 bp, Homo sapiens
acaatttcttatagttcaattc

SEQ ID NO: 6990875 - DNA, 22 bp, Homo sapiens
ccaggtgtctgtggccagccct

SEQ ID NO: 6990876 - DNA, 22 bp, Homo sapiens
attttcaccctgaatatattga

SEQ ID NO: 6990877 - DNA, 22 bp, Homo sapiens
tgctggctactgatggcaggcc

SEQ ID NO: 6990878 - DNA, 22 bp, Homo sapiens
acagccagaggtggtcctgggt

SEQ ID NO: 6990879 - DNA, 22 bp, Homo sapiens
gggagggaggtgctggttcacg

SEQ ID NO: 6990880 - DNA, 22 bp, Homo sapiens
ttgcatgaggccaaggggtgga

SEQ ID NO: 6990881 - DNA, 22 bp, Homo sapiens
cagcatggtgccagtgagtcca

SEQ ID NO: 6990882 - DNA, 22 bp, Homo sapiens
tatgtttggcctggcaatttca

SEQ ID NO: 6990883 - DNA, 22 bp, Homo sapiens
ccctgcagccggccagctcatt

SEQ ID NO: 6990884 - DNA, 22 bp, Homo sapiens
ttcagaatgtgaccttatttgg

SEQ ID NO: 6990885 - DNA, 22 bp, Homo sapiens
aattgctaaagattatgttttc

SEQ ID NO: 6990886 - DNA, 22 bp, Homo sapiens
acagaatgcattgacgtacgat

SEQ ID NO: 6990887 - DNA, 21 bp, Homo sapiens
gcctctccaaatcctgccttc

SEQ ID NO: 6990888 - DNA, 22 bp, Homo sapiens
cttaacagcaagatctgtgtca

SEQ ID NO: 6990889 - DNA, 22 bp, Homo sapiens
gtcaggatgtttattctccagt

SEQ ID NO: 6990890 - DNA, 22 bp, Homo sapiens
acagatgagactccaggacctt

SEQ ID NO: 6990891 - DNA, 20 bp, Homo sapiens
tcttagcatcacttgcttaa

SEQ ID NO: 6990892 - DNA, 22 bp, Homo sapiens
cagaaactgtggattcattaaa

SEQ ID NO: 6990893 - DNA, 20 bp, Homo sapiens
tattacacacaatgagcagt

SEQ ID NO: 6990894 - DNA, 22 bp, Homo sapiens
tcatgcaacggctcgctgagcc

SEQ ID NO: 6990895 - DNA, 22 bp, Homo sapiens
tggctgacaatgtagcagtaac

SEQ ID NO: 6990896 - DNA, 22 bp, Homo sapiens
gaccatttccaccatgggcaca

SEQ ID NO: 6990897 - DNA, 22 bp, Homo sapiens
cacagctggtgacagagcccag

SEQ ID NO: 6990898 - DNA, 22 bp, Homo sapiens
cgaggaaatatttacaactgat

SEQ ID NO: 6990899 - DNA, 23 bp, Homo sapiens
cagctccagtgcactcaggtagc

SEQ ID NO: 6990900 - DNA, 18 bp, Homo sapiens
ccagagggtgcgtcagct

SEQ ID NO: 6990901 - DNA, 22 bp, Homo sapiens
gagtgactgtatcattttacat

SEQ ID NO: 6990902 - DNA, 22 bp, Homo sapiens
tagatgataaccataggtctat

SEQ ID NO: 6990903 - DNA, 22 bp, Homo sapiens
gtgctgggctccaccccagagg

SEQ ID NO: 6990904 - DNA, 22 bp, Homo sapiens
tttagcaaattactcacagggt

SEQ ID NO: 6990905 - DNA, 22 bp, Homo sapiens
tcaggctgcctatcagactgtg

SEQ ID NO: 6990906 - DNA, 22 bp, Homo sapiens
ctgcattattggaacggctgaa

SEQ ID NO: 6990907 - DNA, 22 bp, Homo sapiens
atgtagtatctatatttcatgg

SEQ ID NO: 6990908 - DNA, 22 bp, Homo sapiens
gagctgtgtgcctggatggtct

SEQ ID NO: 6990909 - DNA, 22 bp, Homo sapiens
tagctttgcctgttaatcacaa

SEQ ID NO: 6990910 - DNA, 22 bp, Homo sapiens
caaaatgtgagtcccacctcaa

SEQ ID NO: 6990911 - DNA, 22 bp, Homo sapiens
taactttgatcacttgataagg

SEQ ID NO: 6990912 - DNA, 22 bp, Homo sapiens
ttggctggtaagccaaatgaaa

SEQ ID NO: 6990913 - DNA, 22 bp, Homo sapiens
ttattatgccattacctccctg

SEQ ID NO: 6990914 - DNA, 22 bp, Homo sapiens
cctttacaaagttcttcatggg

SEQ ID NO: 6990915 - DNA, 22 bp, Homo sapiens
aagttcagcctggttttaatgc

SEQ ID NO: 6990916 - DNA, 22 bp, Homo sapiens
acctgagcatgccaggagagtg

SEQ ID NO: 6990917 - DNA, 22 bp, Homo sapiens
ggtgccacagctacatcctaga

SEQ ID NO: 6990918 - DNA, 22 bp, Homo sapiens
tcttgaaggggggcagtgttga

SEQ ID NO: 6990919 - DNA, 22 bp, Homo sapiens
tttccaggcagaggagttgtga

SEQ ID NO: 6990920 - DNA, 18 bp, Homo sapiens
tcaggctggaagtttgcc

SEQ ID NO: 6990921 - DNA, 22 bp, Homo sapiens
aaagtagtataaaattcatgtg

SEQ ID NO: 6990922 - DNA, 22 bp, Homo sapiens
tagttctacagatggtttgtaa

SEQ ID NO: 6990923 - DNA, 22 bp, Homo sapiens
agagttgctatagaaggatgga

SEQ ID NO: 6990924 - DNA, 22 bp, Homo sapiens
tccatgagctagctttccaaag

SEQ ID NO: 6990925 - DNA, 22 bp, Homo sapiens
tcaatgaagagatttaaatcat

SEQ ID NO: 6990926 - DNA, 22 bp, Homo sapiens
ggccttggatccaagctgcggc

SEQ ID NO: 6990927 - DNA, 22 bp, Homo sapiens
gaaatagtacagcatagttctt

SEQ ID NO: 6990928 - DNA, 22 bp, Homo sapiens
acagccagcagagctgtttcct

SEQ ID NO: 6990929 - DNA, 22 bp, Homo sapiens
cagacgttggaggaaatatacc

SEQ ID NO: 6990930 - DNA, 20 bp, Homo sapiens
tctggactgtcagacaggga

SEQ ID NO: 6990931 - DNA, 22 bp, Homo sapiens
cagtgaggaagctgtctggacc

SEQ ID NO: 6990932 - DNA, 22 bp, Homo sapiens
accctggcagccttctgtcctg

SEQ ID NO: 6990933 - DNA, 22 bp, Homo sapiens
gcctgtgtggatgggcccctgg

SEQ ID NO: 6990934 - DNA, 22 bp, Homo sapiens
gaagcttagggataataggctg

SEQ ID NO: 6990935 - DNA, 22 bp, Homo sapiens
gcctttcagtgccttctgttca

SEQ ID NO: 6990936 - DNA, 22 bp, Homo sapiens
gctccaggcagcatagtggatg

SEQ ID NO: 6990937 - DNA, 19 bp, Homo sapiens
ttaggtattattgctttcc

SEQ ID NO: 6990938 - DNA, 22 bp, Homo sapiens
tccagtccttgaaaatccaaca

SEQ ID NO: 6990939 - DNA, 22 bp, Homo sapiens
caggaggaggtgaggtagaact

SEQ ID NO: 6990940 - DNA, 21 bp, Homo sapiens
cctcctgcccgcaagctaggg

SEQ ID NO: 6990941 - DNA, 22 bp, Homo sapiens
tacctctacttcagtgtcagct

SEQ ID NO: 6990942 - DNA, 22 bp, Homo sapiens
agctggttcagtttctgggcct

SEQ ID NO: 6990943 - DNA, 22 bp, Homo sapiens
tctggagaagcagtgagagtca

SEQ ID NO: 6990944 - DNA, 22 bp, Homo sapiens
tgtgggcccagattctgaggct

SEQ ID NO: 6990945 - DNA, 22 bp, Homo sapiens
tttgatttactataagcagcac

SEQ ID NO: 6990946 - DNA, 22 bp, Homo sapiens
attgcttgatgattcatagtaa

SEQ ID NO: 6990947 - DNA, 22 bp, Homo sapiens
cactgcaagcaagctccgcctc

SEQ ID NO: 6990948 - DNA, 22 bp, Homo sapiens
tttcagttaagtggctagtccc

SEQ ID NO: 6990949 - DNA, 22 bp, Homo sapiens
tagctgttttttgtgaggaaat

SEQ ID NO: 6990950 - DNA, 22 bp, Homo sapiens
tgagtcttttcattgtgtggat

SEQ ID NO: 6990951 - DNA, 22 bp, Homo sapiens
cctctggtcccagctctgctgc

SEQ ID NO: 6990952 - DNA, 22 bp, Homo sapiens
agtggaaggctgggaaatgcgg

SEQ ID NO: 6990953 - DNA, 22 bp, Homo sapiens
atctggagctctgcacacctgg

SEQ ID NO: 6990954 - DNA, 22 bp, Homo sapiens
atgctcacttcagagaagatga

SEQ ID NO: 6990955 - DNA, 22 bp, Homo sapiens
agtctagaatgtgcaccaagct

SEQ ID NO: 6990956 - DNA, 20 bp, Homo sapiens
aagagcccgcagggcagtgc

SEQ ID NO: 6990957 - DNA, 22 bp, Homo sapiens
tgaagttcaagggctacatttg

SEQ ID NO: 6990958 - DNA, 22 bp, Homo sapiens
ctgtcacttaaattcaggctga

SEQ ID NO: 6990959 - DNA, 19 bp, Homo sapiens
tctgttcacattgtttcgc

SEQ ID NO: 6990960 - DNA, 18 bp, Homo sapiens
gagtgatgaccgtgccag

SEQ ID NO: 6990961 - DNA, 22 bp, Homo sapiens
tggcaggcattgatgcgagttc

SEQ ID NO: 6990962 - DNA, 22 bp, Homo sapiens
gagggccattctgagggggtga

SEQ ID NO: 6990963 - DNA, 22 bp, Homo sapiens
aaatgcagaatgatttcatcta

SEQ ID NO: 6990964 - DNA, 22 bp, Homo sapiens
ctgaggtagggacgtgccgtag

SEQ ID NO: 6990965 - DNA, 22 bp, Homo sapiens
tctcttgatatattacatagag

SEQ ID NO: 6990966 - DNA, 22 bp, Homo sapiens
agggtccttctgttcctgagca

SEQ ID NO: 6990967 - DNA, 22 bp, Homo sapiens
tcacaagactgagcttgcttga

SEQ ID NO: 6990968 - DNA, 22 bp, Homo sapiens
gtgagtgccaggtgaagtatgt

SEQ ID NO: 6990969 - DNA, 22 bp, Homo sapiens
gttttccaggtaccttggtatt

SEQ ID NO: 6990970 - DNA, 22 bp, Homo sapiens
tggtggacctggcattgaacct

SEQ ID NO: 6990971 - DNA, 19 bp, Homo sapiens
ctgtgcaggccgggctgag

SEQ ID NO: 6990972 - DNA, 22 bp, Homo sapiens
tcacattctcagcatctataca

SEQ ID NO: 6990973 - DNA, 22 bp, Homo sapiens
aagtttgttttagtctaatgat

SEQ ID NO: 6990974 - DNA, 22 bp, Homo sapiens
gtggcagagagcaagtgtctga

SEQ ID NO: 6990975 - DNA, 22 bp, Homo sapiens
gttgcaggatgattttataagg

SEQ ID NO: 6990976 - DNA, 22 bp, Homo sapiens
tctgactagttgcagccaggag

SEQ ID NO: 6990977 - DNA, 22 bp, Homo sapiens
aagataatattcattaactaga

SEQ ID NO: 6990978 - DNA, 22 bp, Homo sapiens
tgcattgagattttaaaattca

SEQ ID NO: 6990979 - DNA, 22 bp, Homo sapiens
aattagagatcgcaataacggg

SEQ ID NO: 6990980 - DNA, 22 bp, Homo sapiens
tcacagggcattatggctccag

SEQ ID NO: 6990981 - DNA, 21 bp, Homo sapiens
tgcagcagatttgggggaaga

SEQ ID NO: 6990982 - DNA, 22 bp, Homo sapiens
attcatggcagtggtaacgttt

SEQ ID NO: 6990983 - DNA, 22 bp, Homo sapiens
ggccctgtccctggccgtctgt

SEQ ID NO: 6990984 - DNA, 22 bp, Homo sapiens
aagagcatttaattaggagagt

SEQ ID NO: 6990985 - DNA, 21 bp, Homo sapiens
acagcagggctggcatgacag

SEQ ID NO: 6990986 - DNA, 22 bp, Homo sapiens
gctattgtttattttgaatcta

SEQ ID NO: 6990987 - DNA, 22 bp, Homo sapiens
ctctgactttaaatacaggatg

SEQ ID NO: 6990988 - DNA, 23 bp, Homo sapiens
ggcttggccctcaagggccctgc

SEQ ID NO: 6990989 - DNA, 22 bp, Homo sapiens
acttgtgtcaaagctatacagg

SEQ ID NO: 6990990 - DNA, 22 bp, Homo sapiens
cagtaaatctctatctgccatt

SEQ ID NO: 6990991 - DNA, 22 bp, Homo sapiens
gcacaaatacaaagttgagaaa

SEQ ID NO: 6990992 - DNA, 18 bp, Homo sapiens
tgtccctgcaaataacat

SEQ ID NO: 6990993 - DNA, 22 bp, Homo sapiens
tgaggtggctagggaggcactc

SEQ ID NO: 6990994 - DNA, 22 bp, Homo sapiens
gccattttgaaaaccgttgcta

SEQ ID NO: 6990995 - DNA, 22 bp, Homo sapiens
cgtatcaaagcaaaacatattt

SEQ ID NO: 6990996 - DNA, 22 bp, Homo sapiens
ttctggaggctctaagggacaa

SEQ ID NO: 6990997 - DNA, 22 bp, Homo sapiens
ctgaaggagaaggccactgttc

SEQ ID NO: 6990998 - DNA, 22 bp, Homo sapiens
tgatgtgtgattcattctcaaa

SEQ ID NO: 6990999 - DNA, 22 bp, Homo sapiens
ctccctctgaggctttgagcct

SEQ ID NO: 6991000 - DNA, 22 bp, Homo sapiens
gtattcatattaaacatatcaa

SEQ ID NO: 6991001 - DNA, 22 bp, Homo sapiens
tttcacaaagcatagcacttta

SEQ ID NO: 6991002 - DNA, 22 bp, Homo sapiens
accctgatggccagattgtgga

SEQ ID NO: 6991003 - DNA, 22 bp, Homo sapiens
gagaaagacgtaggctgggagg

SEQ ID NO: 6991004 - DNA, 22 bp, Homo sapiens
tagtgtcttccaggacatggta

SEQ ID NO: 6991005 - DNA, 22 bp, Homo sapiens
gttaacaggaactagggctatg

SEQ ID NO: 6991006 - DNA, 20 bp, Homo sapiens
actgcactccagccttccag

SEQ ID NO: 6991007 - DNA, 22 bp, Homo sapiens
aaaatggctgtggtctggcaag

SEQ ID NO: 6991008 - DNA, 22 bp, Homo sapiens
atgcaaatgaacatgttgctag

SEQ ID NO: 6991009 - DNA, 22 bp, Homo sapiens
tgcaagcttggctgatgttgat

SEQ ID NO: 6991010 - DNA, 22 bp, Homo sapiens
cctggctctgcagccactccag

SEQ ID NO: 6991011 - DNA, 22 bp, Homo sapiens
tgctgaataataagattactca

SEQ ID NO: 6991012 - DNA, 22 bp, Homo sapiens
gctctggctactgtggctaccg

SEQ ID NO: 6991013 - DNA, 18 bp, Homo sapiens
tgggcctgcatcctagtc

SEQ ID NO: 6991014 - DNA, 22 bp, Homo sapiens
aatttacctctaaacaggagcc

SEQ ID NO: 6991015 - DNA, 22 bp, Homo sapiens
aacaaagtacttttcagtgctt

SEQ ID NO: 6991016 - DNA, 22 bp, Homo sapiens
ggggaaattgtggctgacagtg

SEQ ID NO: 6991017 - DNA, 22 bp, Homo sapiens
cacaggaagctgactgctggca

SEQ ID NO: 6991018 - DNA, 22 bp, Homo sapiens
gaagtagattcgttgcatcttg

SEQ ID NO: 6991019 - DNA, 22 bp, Homo sapiens
aaagacattagattaacgtaca

SEQ ID NO: 6991020 - DNA, 22 bp, Homo sapiens
tatgagtactgtgaacgagaat

SEQ ID NO: 6991021 - DNA, 22 bp, Homo sapiens
agtgatagcaaataaaatgtaa

SEQ ID NO: 6991022 - DNA, 22 bp, Homo sapiens
tgctccaggccgcctggggctg

SEQ ID NO: 6991023 - DNA, 22 bp, Homo sapiens
agggcctcagtgttctcatctg

SEQ ID NO: 6991024 - DNA, 22 bp, Homo sapiens
tgaaacaggcaaaactgcagat

SEQ ID NO: 6991025 - DNA, 22 bp, Homo sapiens
tgtcttccatggttttgacact

SEQ ID NO: 6991026 - DNA, 22 bp, Homo sapiens
tcctgagatgagacagtgctgc

SEQ ID NO: 6991027 - DNA, 22 bp, Homo sapiens
ccctggaggcggagcttgcagt

SEQ ID NO: 6991028 - DNA, 21 bp, Homo sapiens
ttttcccactgaaagctccca

SEQ ID NO: 6991029 - DNA, 22 bp, Homo sapiens
agacagggtcttgatcagagct

SEQ ID NO: 6991030 - DNA, 22 bp, Homo sapiens
aacaggcctcattccagctctc

SEQ ID NO: 6991031 - DNA, 22 bp, Homo sapiens
ctcaggatgcaattccatcaag

SEQ ID NO: 6991032 - DNA, 22 bp, Homo sapiens
gtctttctatgcatagagcaga

SEQ ID NO: 6991033 - DNA, 22 bp, Homo sapiens
gcctctcctcttaataccatta

SEQ ID NO: 6991034 - DNA, 22 bp, Homo sapiens
ataatggcttgtggtgttattc

SEQ ID NO: 6991035 - DNA, 22 bp, Homo sapiens
cccaagggatgcttgagtagtt

SEQ ID NO: 6991036 - DNA, 22 bp, Homo sapiens
taatacttgctttggatgtatg

SEQ ID NO: 6991037 - DNA, 21 bp, Homo sapiens
cagaccattgcatgagcaggt

SEQ ID NO: 6991038 - DNA, 22 bp, Homo sapiens
gacatctgaatattagagagaa

SEQ ID NO: 6991039 - DNA, 22 bp, Homo sapiens
ctgcagagcaagttctctgttg

SEQ ID NO: 6991040 - DNA, 22 bp, Homo sapiens
tgccaatgatgctttgatatgt

SEQ ID NO: 6991041 - DNA, 22 bp, Homo sapiens
caccctgctctgctgtgcggcc

SEQ ID NO: 6991042 - DNA, 23 bp, Homo sapiens
actgcagcctccgcctgccgggt

SEQ ID NO: 6991043 - DNA, 22 bp, Homo sapiens
gcttctaattttttacagaata

SEQ ID NO: 6991044 - DNA, 20 bp, Homo sapiens
gcaataagtaagtacaacag

SEQ ID NO: 6991045 - DNA, 22 bp, Homo sapiens
gcctccctgtttcctgctccaa

SEQ ID NO: 6991046 - DNA, 22 bp, Homo sapiens
tgtgtgcacatgatttgaaatg

SEQ ID NO: 6991047 - DNA, 22 bp, Homo sapiens
acaccttttattcgccaggcac

SEQ ID NO: 6991048 - DNA, 22 bp, Homo sapiens
ttactgaaaattcttcaggatt

SEQ ID NO: 6991049 - DNA, 22 bp, Homo sapiens
agtccttacacctggaacctat

SEQ ID NO: 6991050 - DNA, 22 bp, Homo sapiens
agtctggtggtattttgtagtg

SEQ ID NO: 6991051 - DNA, 22 bp, Homo sapiens
ccctggccagggcacagggagg

SEQ ID NO: 6991052 - DNA, 22 bp, Homo sapiens
atcaggaagcgtctggtatttt

SEQ ID NO: 6991053 - DNA, 22 bp, Homo sapiens
gagctgcctgttgcatagcaac

SEQ ID NO: 6991054 - DNA, 22 bp, Homo sapiens
tgagggagtcatgattaaggaa

SEQ ID NO: 6991055 - DNA, 22 bp, Homo sapiens
gcctggcagattgacatagcca

SEQ ID NO: 6991056 - DNA, 22 bp, Homo sapiens
tttgcagcctccctggcagaag

SEQ ID NO: 6991057 - DNA, 22 bp, Homo sapiens
tcatcagtgtccttatcactta

SEQ ID NO: 6991058 - DNA, 22 bp, Homo sapiens
aatctgtttgtttacacctttt

SEQ ID NO: 6991059 - DNA, 22 bp, Homo sapiens
cctgtctgcagatatctcaggt

SEQ ID NO: 6991060 - DNA, 22 bp, Homo sapiens
agtgaaaggttgagaatattct

SEQ ID NO: 6991061 - DNA, 22 bp, Homo sapiens
tttcaagaacaacattcattca

SEQ ID NO: 6991062 - DNA, 22 bp, Homo sapiens
ggttattattcatgtaactcag

SEQ ID NO: 6991063 - DNA, 22 bp, Homo sapiens
tgccaggctgccctccagtctg

SEQ ID NO: 6991064 - DNA, 22 bp, Homo sapiens
gggacccacgaaaggctttgga

SEQ ID NO: 6991065 - DNA, 22 bp, Homo sapiens
caagacattgattttgtacaga

SEQ ID NO: 6991066 - DNA, 22 bp, Homo sapiens
ccagggttggcaagcaaggctt

SEQ ID NO: 6991067 - DNA, 22 bp, Homo sapiens
ctatcccatccttctagctgac

SEQ ID NO: 6991068 - DNA, 22 bp, Homo sapiens
tacatagaacatgtttaatgtc

SEQ ID NO: 6991069 - DNA, 22 bp, Homo sapiens
gatgatatatatggaaagccta

SEQ ID NO: 6991070 - DNA, 22 bp, Homo sapiens
tgtcttaatttccctttgtcat

SEQ ID NO: 6991071 - DNA, 22 bp, Homo sapiens
tgggaacagtagctgctgagct

SEQ ID NO: 6991072 - DNA, 22 bp, Homo sapiens
acataatagcatttctaatttg

SEQ ID NO: 6991073 - DNA, 22 bp, Homo sapiens
ctggctgccacttcagggtctt

SEQ ID NO: 6991074 - DNA, 21 bp, Homo sapiens
tcctctgatcctggatccgca

SEQ ID NO: 6991075 - DNA, 22 bp, Homo sapiens
tggtattacttctagacacaag

SEQ ID NO: 6991076 - DNA, 22 bp, Homo sapiens
tggcagagtctctcctttccag

SEQ ID NO: 6991077 - DNA, 22 bp, Homo sapiens
taggaggcttaaagctgctcag

SEQ ID NO: 6991078 - DNA, 22 bp, Homo sapiens
taggacttggtttgaagatttt

SEQ ID NO: 6991079 - DNA, 19 bp, Homo sapiens
ctggctcttgggtggagga

SEQ ID NO: 6991080 - DNA, 22 bp, Homo sapiens
cctggctctgtcctcgcgcaaa

SEQ ID NO: 6991081 - DNA, 22 bp, Homo sapiens
tgtttgaactgaataacatagt

SEQ ID NO: 6991082 - DNA, 22 bp, Homo sapiens
ctggagtcagcaaggacgaggc

SEQ ID NO: 6991083 - DNA, 22 bp, Homo sapiens
gttctctatcattagtgaattt

SEQ ID NO: 6991084 - DNA, 22 bp, Homo sapiens
acagtctgtcccccaggtgcta

SEQ ID NO: 6991085 - DNA, 22 bp, Homo sapiens
atgcagctagattttccagtgt

SEQ ID NO: 6991086 - DNA, 22 bp, Homo sapiens
tatcttgtttaggtgcacaggt

SEQ ID NO: 6991087 - DNA, 22 bp, Homo sapiens
tagaaggtagcaatctgggaag

SEQ ID NO: 6991088 - DNA, 22 bp, Homo sapiens
tctggcctcttgggatgctccc

SEQ ID NO: 6991089 - DNA, 22 bp, Homo sapiens
agaagattatgaattagagcag

SEQ ID NO: 6991090 - DNA, 22 bp, Homo sapiens
aggtcattaaagttaaatgagg

SEQ ID NO: 6991091 - DNA, 22 bp, Homo sapiens
acaggtgtgttcccggaaagcc

SEQ ID NO: 6991092 - DNA, 22 bp, Homo sapiens
acttccttgtcaggtgcatcat

SEQ ID NO: 6991093 - DNA, 22 bp, Homo sapiens
cagtacatttcatatgattcta

SEQ ID NO: 6991094 - DNA, 22 bp, Homo sapiens
tccaaggaggctttgacgtcca

SEQ ID NO: 6991095 - DNA, 22 bp, Homo sapiens
tgactttagagatgggaggtca

SEQ ID NO: 6991096 - DNA, 22 bp, Homo sapiens
ctccagtcctagtctcttgctt

SEQ ID NO: 6991097 - DNA, 22 bp, Homo sapiens
gctctgacttcctgcgctccag

SEQ ID NO: 6991098 - DNA, 22 bp, Homo sapiens
gccagggtggcagaaggcccca

SEQ ID NO: 6991099 - DNA, 22 bp, Homo sapiens
gtcctgagcattaagcaattgt

SEQ ID NO: 6991100 - DNA, 22 bp, Homo sapiens
gataatccactctgctgacttt

SEQ ID NO: 6991101 - DNA, 22 bp, Homo sapiens
cctttctcttggataccgattg

SEQ ID NO: 6991102 - DNA, 19 bp, Homo sapiens
gtttttcccagacgaggca

SEQ ID NO: 6991103 - DNA, 22 bp, Homo sapiens
agtaaatgaaagcaattttaga

SEQ ID NO: 6991104 - DNA, 19 bp, Homo sapiens
tgatgctcactggtttggg

SEQ ID NO: 6991105 - DNA, 22 bp, Homo sapiens
gctctctttttccagtggtggt

SEQ ID NO: 6991106 - DNA, 22 bp, Homo sapiens
gctggagccttctgctctgttg

SEQ ID NO: 6991107 - DNA, 22 bp, Homo sapiens
cagtttctgtctgttcttatcc

SEQ ID NO: 6991108 - DNA, 22 bp, Homo sapiens
atgctacagagtttgaatatgt

SEQ ID NO: 6991109 - DNA, 22 bp, Homo sapiens
agaagaaagattgaaggttcct

SEQ ID NO: 6991110 - DNA, 22 bp, Homo sapiens
cctgggctctgtcagaattggg

SEQ ID NO: 6991111 - DNA, 22 bp, Homo sapiens
tgaaatgagataatttaagtgc

SEQ ID NO: 6991112 - DNA, 22 bp, Homo sapiens
cagacaggaattctggcgtggt

SEQ ID NO: 6991113 - DNA, 22 bp, Homo sapiens
cagaaagcgggatgcagcatgt

SEQ ID NO: 6991114 - DNA, 19 bp, Homo sapiens
tgcacccatgtatgcatgc

SEQ ID NO: 6991115 - DNA, 22 bp, Homo sapiens
cagaagaatggtgtctgagctc

SEQ ID NO: 6991116 - DNA, 22 bp, Homo sapiens
tcctaggcccagcctgagctgt

SEQ ID NO: 6991117 - DNA, 22 bp, Homo sapiens
cacaaggctgggacaagtgctg

SEQ ID NO: 6991118 - DNA, 22 bp, Homo sapiens
tcagggccacaacaccagagtc

SEQ ID NO: 6991119 - DNA, 22 bp, Homo sapiens
tggcatccagataccctgaggg

SEQ ID NO: 6991120 - DNA, 22 bp, Homo sapiens
agtttgaattgaaatgcagatg

SEQ ID NO: 6991121 - DNA, 22 bp, Homo sapiens
agcagcagtgtggtttggggaa

SEQ ID NO: 6991122 - DNA, 22 bp, Homo sapiens
tgagctcttgatatccttgttt

SEQ ID NO: 6991123 - DNA, 22 bp, Homo sapiens
tgttaacagaggtcattttggg

SEQ ID NO: 6991124 - DNA, 22 bp, Homo sapiens
gagaacattaatagttaatttt

SEQ ID NO: 6991125 - DNA, 22 bp, Homo sapiens
aggctagctgattgccttagaa

SEQ ID NO: 6991126 - DNA, 22 bp, Homo sapiens
tagcagcttccagagagggcag

SEQ ID NO: 6991127 - DNA, 22 bp, Homo sapiens
tttaagagcctgtacaaatatt

SEQ ID NO: 6991128 - DNA, 22 bp, Homo sapiens
ttcccacacccatattgtgatt

SEQ ID NO: 6991129 - DNA, 22 bp, Homo sapiens
gggctcagttctgcttcatgct

SEQ ID NO: 6991130 - DNA, 22 bp, Homo sapiens
ttctggctttaggcttttcaag

SEQ ID NO: 6991131 - DNA, 22 bp, Homo sapiens
acctgaaaattattatttccgc

SEQ ID NO: 6991132 - DNA, 22 bp, Homo sapiens
attgttaaagtaataaccatgg

SEQ ID NO: 6991133 - DNA, 22 bp, Homo sapiens
aggccagcatgcagttctaagg

SEQ ID NO: 6991134 - DNA, 22 bp, Homo sapiens
acacacatgcatgcttgccatt

SEQ ID NO: 6991135 - DNA, 22 bp, Homo sapiens
tgagacaggagaggcccctcct

SEQ ID NO: 6991136 - DNA, 22 bp, Homo sapiens
ggagatgctttccagtggggat

SEQ ID NO: 6991137 - DNA, 22 bp, Homo sapiens
ttactaggccagttttcacttt

SEQ ID NO: 6991138 - DNA, 22 bp, Homo sapiens
tattaatttaatctccatggta

SEQ ID NO: 6991139 - DNA, 22 bp, Homo sapiens
cttggaggaggtggtgcttgat

SEQ ID NO: 6991140 - DNA, 22 bp, Homo sapiens
ttctaaagtgcaatctgacaga

SEQ ID NO: 6991141 - DNA, 22 bp, Homo sapiens
ggcaacatgggaaaattaacct

SEQ ID NO: 6991142 - DNA, 22 bp, Homo sapiens
ggattaatgagggggttccggt

SEQ ID NO: 6991143 - DNA, 22 bp, Homo sapiens
atgccatttgctggaaggaagt

SEQ ID NO: 6991144 - DNA, 22 bp, Homo sapiens
taattttaactgtgctgtttgg

SEQ ID NO: 6991145 - DNA, 22 bp, Homo sapiens
gggtggtgtattagagctgcag

SEQ ID NO: 6991146 - DNA, 22 bp, Homo sapiens
atgaagattctatttatcactt

SEQ ID NO: 6991147 - DNA, 22 bp, Homo sapiens
ctgtagcagtgtgctctttttc

SEQ ID NO: 6991148 - DNA, 22 bp, Homo sapiens
agacatatgcctaatactggtt

SEQ ID NO: 6991149 - DNA, 22 bp, Homo sapiens
cctcttgagttctttaaaagct

SEQ ID NO: 6991150 - DNA, 19 bp, Homo sapiens
catacaattaccataggat

SEQ ID NO: 6991151 - DNA, 22 bp, Homo sapiens
ggagtgagcaaatagagatttg

SEQ ID NO: 6991152 - DNA, 22 bp, Homo sapiens
aattgatgtaaggaagacttag

SEQ ID NO: 6991153 - DNA, 22 bp, Homo sapiens
gctttacaagtggtgcagatta

SEQ ID NO: 6991154 - DNA, 22 bp, Homo sapiens
accaggcagagctgggccttaa

SEQ ID NO: 6991155 - DNA, 22 bp, Homo sapiens
tcaggctaagggagaggcgctc

SEQ ID NO: 6991156 - DNA, 22 bp, Homo sapiens
agaactgtgccaaaaattttgt

SEQ ID NO: 6991157 - DNA, 22 bp, Homo sapiens
cctgtgccctacacctttccag

SEQ ID NO: 6991158 - DNA, 22 bp, Homo sapiens
tagatttcaggctggcttgcgg

SEQ ID NO: 6991159 - DNA, 22 bp, Homo sapiens
cctcaggggtcactgtgaggag

SEQ ID NO: 6991160 - DNA, 22 bp, Homo sapiens
atgtcatattactaatgctggc

SEQ ID NO: 6991161 - DNA, 22 bp, Homo sapiens
gggacattgagatacctccaaa

SEQ ID NO: 6991162 - DNA, 22 bp, Homo sapiens
cacatgtgcaaatactgaggct

SEQ ID NO: 6991163 - DNA, 22 bp, Homo sapiens
atctgggcgtataggtgcaagt

SEQ ID NO: 6991164 - DNA, 22 bp, Homo sapiens
tcacacgatcaaaggtcaattg

SEQ ID NO: 6991165 - DNA, 22 bp, Homo sapiens
ttgctgtaagtatctttctacc

SEQ ID NO: 6991166 - DNA, 22 bp, Homo sapiens
cagcctggagccacagcccagg

SEQ ID NO: 6991167 - DNA, 22 bp, Homo sapiens
acttgcaaagtgagggagtgtt

SEQ ID NO: 6991168 - DNA, 21 bp, Homo sapiens
tcataagggtagggctctaat

SEQ ID NO: 6991169 - DNA, 22 bp, Homo sapiens
tcaagaaaatgcctgctggtgt

SEQ ID NO: 6991170 - DNA, 22 bp, Homo sapiens
ttcagctcaacgcacttctgag

SEQ ID NO: 6991171 - DNA, 18 bp, Homo sapiens
tacaggaaaagtgttaca

SEQ ID NO: 6991172 - DNA, 19 bp, Homo sapiens
cagaacagctgggaagaga

SEQ ID NO: 6991173 - DNA, 22 bp, Homo sapiens
gtgcagctgcaggagtcaggtc

SEQ ID NO: 6991174 - DNA, 22 bp, Homo sapiens
cccaggctgagttagaggtgtc

SEQ ID NO: 6991175 - DNA, 22 bp, Homo sapiens
ggaggctctgaccatttaccca

SEQ ID NO: 6991176 - DNA, 22 bp, Homo sapiens
gcaggcctctaattcaccgcag

SEQ ID NO: 6991177 - DNA, 17 bp, Homo sapiens
ctctgggtctcctgctt

SEQ ID NO: 6991178 - DNA, 22 bp, Homo sapiens
atggcagtgacttgaagggtag

SEQ ID NO: 6991179 - DNA, 22 bp, Homo sapiens
agagatatatatttgtttacca

SEQ ID NO: 6991180 - DNA, 19 bp, Homo sapiens
tagaactgaggacttgcat

SEQ ID NO: 6991181 - DNA, 22 bp, Homo sapiens
atcaggggagctgcgacctcag

SEQ ID NO: 6991182 - DNA, 22 bp, Homo sapiens
gttaagaacttgttgaaggtct

SEQ ID NO: 6991183 - DNA, 22 bp, Homo sapiens
aactgtcttatttatatttctg

SEQ ID NO: 6991184 - DNA, 22 bp, Homo sapiens
agttaggacacttgagggctaa

SEQ ID NO: 6991185 - DNA, 22 bp, Homo sapiens
atgcattgtatgaaaggaaata

SEQ ID NO: 6991186 - DNA, 20 bp, Homo sapiens
actctaccagggcagcagca

SEQ ID NO: 6991187 - DNA, 22 bp, Homo sapiens
cataattactgatatgctgatt

SEQ ID NO: 6991188 - DNA, 19 bp, Homo sapiens
atgatgcagagctgactca

SEQ ID NO: 6991189 - DNA, 19 bp, Homo sapiens
tggacttgagctgctttga

SEQ ID NO: 6991190 - DNA, 22 bp, Homo sapiens
ttcaaatgcaagttactacttt

SEQ ID NO: 6991191 - DNA, 22 bp, Homo sapiens
tggagctgggagtcctgggctg

SEQ ID NO: 6991192 - DNA, 22 bp, Homo sapiens
gctatcatccttgtcagtgact

SEQ ID NO: 6991193 - DNA, 22 bp, Homo sapiens
aatggggtagtgggcagcctgg

SEQ ID NO: 6991194 - DNA, 22 bp, Homo sapiens
accctagacattgaactagggt

SEQ ID NO: 6991195 - DNA, 22 bp, Homo sapiens
gaccctttggaggtagtcacca

SEQ ID NO: 6991196 - DNA, 22 bp, Homo sapiens
tgcatcctcctttgtcctcttg

SEQ ID NO: 6991197 - DNA, 22 bp, Homo sapiens
ggtcagtgcgatttcccactcc

SEQ ID NO: 6991198 - DNA, 22 bp, Homo sapiens
ggaagctttctctgtttcctta

SEQ ID NO: 6991199 - DNA, 22 bp, Homo sapiens
atcagaggtactttccattttt

SEQ ID NO: 6991200 - DNA, 23 bp, Homo sapiens
tgggcctggaaagccttagagag

SEQ ID NO: 6991201 - DNA, 22 bp, Homo sapiens
acagggagatgggtgaaagcgg

SEQ ID NO: 6991202 - DNA, 22 bp, Homo sapiens
agcacctgcctgcattggctat

SEQ ID NO: 6991203 - DNA, 22 bp, Homo sapiens
gtgaagtcccagtggattcacc

SEQ ID NO: 6991204 - DNA, 22 bp, Homo sapiens
acttaaagaggctacttttggt

SEQ ID NO: 6991205 - DNA, 18 bp, Homo sapiens
tgagaggctattttttgc

SEQ ID NO: 6991206 - DNA, 19 bp, Homo sapiens
aggtgacaggtgcacttgc

SEQ ID NO: 6991207 - DNA, 22 bp, Homo sapiens
tcagctatgaggtggtggttct

SEQ ID NO: 6991208 - DNA, 22 bp, Homo sapiens
tacacagtatatgggatcacag

SEQ ID NO: 6991209 - DNA, 22 bp, Homo sapiens
acactcatgctcagctggtgct

SEQ ID NO: 6991210 - DNA, 22 bp, Homo sapiens
gctataggaagaaatttgtttt

SEQ ID NO: 6991211 - DNA, 22 bp, Homo sapiens
tcatccagagcttcataagtaa

SEQ ID NO: 6991212 - DNA, 22 bp, Homo sapiens
cctgccctagagatgacacaat

SEQ ID NO: 6991213 - DNA, 22 bp, Homo sapiens
ggcaggcattgcaacatgtaca

SEQ ID NO: 6991214 - DNA, 22 bp, Homo sapiens
atggcagatccacagtttgaag

SEQ ID NO: 6991215 - DNA, 22 bp, Homo sapiens
ctgggctgttctgcccctgggt

SEQ ID NO: 6991216 - DNA, 22 bp, Homo sapiens
attggaatggctttgcatgtcc

SEQ ID NO: 6991217 - DNA, 22 bp, Homo sapiens
tgtaaagagaagaaacgtgagc

SEQ ID NO: 6991218 - DNA, 22 bp, Homo sapiens
tcaggatgtccaaaatccagcc

SEQ ID NO: 6991219 - DNA, 22 bp, Homo sapiens
gctggactcaggggactcaggg

SEQ ID NO: 6991220 - DNA, 22 bp, Homo sapiens
tagccaaaaagtagcaattatt

SEQ ID NO: 6991221 - DNA, 22 bp, Homo sapiens
ctttttataccgtgccagttga

SEQ ID NO: 6991222 - DNA, 22 bp, Homo sapiens
caaaggtttcacagtagcccat

SEQ ID NO: 6991223 - DNA, 22 bp, Homo sapiens
tgtcctgtgacctggcaccaca

SEQ ID NO: 6991224 - DNA, 22 bp, Homo sapiens
acgagtctgctcttgaaaaagt

SEQ ID NO: 6991225 - DNA, 22 bp, Homo sapiens
gtctggaaaggtatttgtctca

SEQ ID NO: 6991226 - DNA, 22 bp, Homo sapiens
cagcaagagaggcagggcaaat

SEQ ID NO: 6991227 - DNA, 22 bp, Homo sapiens
ttgcctgggcaacatagaactc

SEQ ID NO: 6991228 - DNA, 22 bp, Homo sapiens
gtctgcttttctgaattgcctg

SEQ ID NO: 6991229 - DNA, 22 bp, Homo sapiens
acctgcacagccccagaatgcc

SEQ ID NO: 6991230 - DNA, 22 bp, Homo sapiens
gcagtgctttagtctgtccttt

SEQ ID NO: 6991231 - DNA, 22 bp, Homo sapiens
tattctagtaccctgaaaacct

SEQ ID NO: 6991232 - DNA, 17 bp, Homo sapiens
tctgtccagggagtgtg

SEQ ID NO: 6991233 - DNA, 22 bp, Homo sapiens
acaagcttattaagttatctgt

SEQ ID NO: 6991234 - DNA, 22 bp, Homo sapiens
acaaatgtggacatggataatg

SEQ ID NO: 6991235 - DNA, 22 bp, Homo sapiens
cagtggaatatataggggattt

SEQ ID NO: 6991236 - DNA, 22 bp, Homo sapiens
gctgcaggatgaggctctgctc

SEQ ID NO: 6991237 - DNA, 19 bp, Homo sapiens
cacagtgcagccatttctc

SEQ ID NO: 6991238 - DNA, 22 bp, Homo sapiens
tggaataaagtgctttgatcag

SEQ ID NO: 6991239 - DNA, 22 bp, Homo sapiens
tggggagactggccgagatcct

SEQ ID NO: 6991240 - DNA, 22 bp, Homo sapiens
gagctcttttgatgaaggtagt

SEQ ID NO: 6991241 - DNA, 22 bp, Homo sapiens
ccagctgctaacacaaaggagt

SEQ ID NO: 6991242 - DNA, 22 bp, Homo sapiens
tcctctgccaaagggagttgcc

SEQ ID NO: 6991243 - DNA, 22 bp, Homo sapiens
tgcatatcagaattcaagagtg

SEQ ID NO: 6991244 - DNA, 22 bp, Homo sapiens
ctagatcatgaatgtcctcaaa

SEQ ID NO: 6991245 - DNA, 22 bp, Homo sapiens
ggcacctctgggctctgttagg

SEQ ID NO: 6991246 - DNA, 22 bp, Homo sapiens
agctccagaggcagtgatgaag

SEQ ID NO: 6991247 - DNA, 22 bp, Homo sapiens
tgtcagcatgtcagccaaagat

SEQ ID NO: 6991248 - DNA, 22 bp, Homo sapiens
agttgtaagagacagatataaa

SEQ ID NO: 6991249 - DNA, 22 bp, Homo sapiens
cttgctttgtccagaaattcag

SEQ ID NO: 6991250 - DNA, 22 bp, Homo sapiens
ctctcgccagcggggctgcgct

SEQ ID NO: 6991251 - DNA, 22 bp, Homo sapiens
agcacaatagagcagttaaaaa

SEQ ID NO: 6991252 - DNA, 22 bp, Homo sapiens
cctgttcactttgacttctcca

SEQ ID NO: 6991253 - DNA, 22 bp, Homo sapiens
acaggtggggcacttggagcct

SEQ ID NO: 6991254 - DNA, 22 bp, Homo sapiens
atgttattcaatttgaatccaa

SEQ ID NO: 6991255 - DNA, 22 bp, Homo sapiens
ggtcctggcagtctttggttgt

SEQ ID NO: 6991256 - DNA, 22 bp, Homo sapiens
tgcattataactgaatgttgtt

SEQ ID NO: 6991257 - DNA, 22 bp, Homo sapiens
atctggaacaaagcttaggaat

SEQ ID NO: 6991258 - DNA, 22 bp, Homo sapiens
ggcttgctgcatttcccaaaga

SEQ ID NO: 6991259 - DNA, 22 bp, Homo sapiens
gcaggaatctaacccaaggaga

SEQ ID NO: 6991260 - DNA, 22 bp, Homo sapiens
tgtccagcacctggatgtttgg

SEQ ID NO: 6991261 - DNA, 20 bp, Homo sapiens
cctctctgcatgctccctga

SEQ ID NO: 6991262 - DNA, 22 bp, Homo sapiens
agttggcagtctgcaacctgga

SEQ ID NO: 6991263 - DNA, 22 bp, Homo sapiens
ctcaggatggaagcctacagga

SEQ ID NO: 6991264 - DNA, 22 bp, Homo sapiens
tgtccttttccccaaattcact

SEQ ID NO: 6991265 - DNA, 22 bp, Homo sapiens
tttcttcctgctttgtcccatg

SEQ ID NO: 6991266 - DNA, 22 bp, Homo sapiens
ggggagttcatgcatttgtgga

SEQ ID NO: 6991267 - DNA, 22 bp, Homo sapiens
atgtaatgtagctgtgttagga

SEQ ID NO: 6991268 - DNA, 22 bp, Homo sapiens
caggacagctgggccaccacca

SEQ ID NO: 6991269 - DNA, 18 bp, Homo sapiens
gctccctggatgttactc

SEQ ID NO: 6991270 - DNA, 22 bp, Homo sapiens
ggatgccatttgggtctggctt

SEQ ID NO: 6991271 - DNA, 22 bp, Homo sapiens
tttgtgtggatggaaggcagta

SEQ ID NO: 6991272 - DNA, 19 bp, Homo sapiens
ccagcctttccagtgattg

SEQ ID NO: 6991273 - DNA, 22 bp, Homo sapiens
ttcaagttttatatccatggct

SEQ ID NO: 6991274 - DNA, 22 bp, Homo sapiens
gtggctagggacacagattgct

SEQ ID NO: 6991275 - DNA, 21 bp, Homo sapiens
agtaaagcggtatgggtggcc

SEQ ID NO: 6991276 - DNA, 22 bp, Homo sapiens
taggattttttggattctggat

SEQ ID NO: 6991277 - DNA, 22 bp, Homo sapiens
tcagtgcttttgagaagctcct

SEQ ID NO: 6991278 - DNA, 22 bp, Homo sapiens
cacattgattcagtcctgtgtg

SEQ ID NO: 6991279 - DNA, 22 bp, Homo sapiens
gaattcaagtgcaatggtatat

SEQ ID NO: 6991280 - DNA, 22 bp, Homo sapiens
ttggattcactgttggtagagt

SEQ ID NO: 6991281 - DNA, 17 bp, Homo sapiens
tggcttccctgggccac

SEQ ID NO: 6991282 - DNA, 22 bp, Homo sapiens
atgggcaaggggtaaggacact

SEQ ID NO: 6991283 - DNA, 22 bp, Homo sapiens
cccaatggctggatggagggat

SEQ ID NO: 6991284 - DNA, 22 bp, Homo sapiens
agggcctggttctgtgtaggga

SEQ ID NO: 6991285 - DNA, 22 bp, Homo sapiens
cagggcccatggctcaggtagg

SEQ ID NO: 6991286 - DNA, 22 bp, Homo sapiens
gttaaacaagctggacactgaa

SEQ ID NO: 6991287 - DNA, 22 bp, Homo sapiens
tggtctttgtccctccttgatc

SEQ ID NO: 6991288 - DNA, 22 bp, Homo sapiens
actaaactgttcatcagcatct

SEQ ID NO: 6991289 - DNA, 22 bp, Homo sapiens
tcatcagtccttttcattatga

SEQ ID NO: 6991290 - DNA, 22 bp, Homo sapiens
ctgggctcagatgagaggaagg

SEQ ID NO: 6991291 - DNA, 22 bp, Homo sapiens
ctgtgtagcctcatgtgggctt

SEQ ID NO: 6991292 - DNA, 22 bp, Homo sapiens
ggacttgcaggggagactgcgt

SEQ ID NO: 6991293 - DNA, 22 bp, Homo sapiens
agggcagagggtgcctcacctg

SEQ ID NO: 6991294 - DNA, 22 bp, Homo sapiens
ttcagcaacatttgttgagtgc

SEQ ID NO: 6991295 - DNA, 22 bp, Homo sapiens
gctgtcaggaacatgccttggt

SEQ ID NO: 6991296 - DNA, 22 bp, Homo sapiens
tgcttgaacaaggataaatttg

SEQ ID NO: 6991297 - DNA, 22 bp, Homo sapiens
ttgtgtgtttgtagaaaatcca

SEQ ID NO: 6991298 - DNA, 22 bp, Homo sapiens
tggcaggcatccggcaccttct

SEQ ID NO: 6991299 - DNA, 22 bp, Homo sapiens
acaaggttgattctggcatctg

SEQ ID NO: 6991300 - DNA, 22 bp, Homo sapiens
tctggagacctgcatttatatt

SEQ ID NO: 6991301 - DNA, 22 bp, Homo sapiens
tgtggggatcttctagcttttc

SEQ ID NO: 6991302 - DNA, 22 bp, Homo sapiens
ttgtgcatgcatacgtatgtgt

SEQ ID NO: 6991303 - DNA, 22 bp, Homo sapiens
tttaccagtgaggaaaatgagg

SEQ ID NO: 6991304 - DNA, 22 bp, Homo sapiens
tcacacatgagtaaatacaggg

SEQ ID NO: 6991305 - DNA, 23 bp, Homo sapiens
ccactagcacctgttcaacttct

SEQ ID NO: 6991306 - DNA, 22 bp, Homo sapiens
gaaaatctgcttatattatttt

SEQ ID NO: 6991307 - DNA, 22 bp, Homo sapiens
tcccaggaaaacactcgaggac

SEQ ID NO: 6991308 - DNA, 22 bp, Homo sapiens
tgtgacaagcattgtatattgg

SEQ ID NO: 6991309 - DNA, 22 bp, Homo sapiens
tcagaggcttctggccagtctg

SEQ ID NO: 6991310 - DNA, 22 bp, Homo sapiens
tttgtcagagaactccagcaaa

SEQ ID NO: 6991311 - DNA, 22 bp, Homo sapiens
gtggctgagtggtcgagtcaga

SEQ ID NO: 6991312 - DNA, 22 bp, Homo sapiens
cctgcattaaatcctgttctgc

SEQ ID NO: 6991313 - DNA, 20 bp, Homo sapiens
caatagaatgtggagataag

SEQ ID NO: 6991314 - DNA, 22 bp, Homo sapiens
atcagcacaacgtacagagaaa

SEQ ID NO: 6991315 - DNA, 22 bp, Homo sapiens
ctgagggtcaacttgattgtat

SEQ ID NO: 6991316 - DNA, 22 bp, Homo sapiens
ttgctgtagtgttctgatgtca

SEQ ID NO: 6991317 - DNA, 22 bp, Homo sapiens
tgaaatgttggcatcggtacct

SEQ ID NO: 6991318 - DNA, 22 bp, Homo sapiens
tgtcatggcactagagtggggt

SEQ ID NO: 6991319 - DNA, 22 bp, Homo sapiens
gtgtcttaatgaagtagattat

SEQ ID NO: 6991320 - DNA, 22 bp, Homo sapiens
atcaggtagatttaatattctg

SEQ ID NO: 6991321 - DNA, 22 bp, Homo sapiens
gccagcagggcccaaatgctgg

SEQ ID NO: 6991322 - DNA, 22 bp, Homo sapiens
accctcaggcagaatgtattct

SEQ ID NO: 6991323 - DNA, 22 bp, Homo sapiens
agccagttgtggggctagccct

SEQ ID NO: 6991324 - DNA, 22 bp, Homo sapiens
tctcagtgtggtgcttaggata

SEQ ID NO: 6991325 - DNA, 22 bp, Homo sapiens
tgtagcaccaacctgccttttt

SEQ ID NO: 6991326 - DNA, 22 bp, Homo sapiens
atttggaatgggagcctggcat

SEQ ID NO: 6991327 - DNA, 22 bp, Homo sapiens
cagaagcctaaatagtgcacca

SEQ ID NO: 6991328 - DNA, 22 bp, Homo sapiens
tcccagccttccttgtggtgaa

SEQ ID NO: 6991329 - DNA, 22 bp, Homo sapiens
atgaggcatgtgaggagaaggg

SEQ ID NO: 6991330 - DNA, 22 bp, Homo sapiens
gctctgctccctcaaatgacat

SEQ ID NO: 6991331 - DNA, 22 bp, Homo sapiens
ccagcatgagacgatgatgaag

SEQ ID NO: 6991332 - DNA, 22 bp, Homo sapiens
agttacagtgaccatttattta

SEQ ID NO: 6991333 - DNA, 22 bp, Homo sapiens
ctgggacccccactgcgtagct

SEQ ID NO: 6991334 - DNA, 19 bp, Homo sapiens
ccctcattcacttattctc

SEQ ID NO: 6991335 - DNA, 22 bp, Homo sapiens
ccttttgtacacttactatata

SEQ ID NO: 6991336 - DNA, 20 bp, Homo sapiens
ctgcccactagaactacctg

SEQ ID NO: 6991337 - DNA, 20 bp, Homo sapiens
ctctctccatctcagtggcc

SEQ ID NO: 6991338 - DNA, 22 bp, Homo sapiens
cctggtgcaccaagtaagggtg

SEQ ID NO: 6991339 - DNA, 22 bp, Homo sapiens
tttctgaggaattaatacagaa

SEQ ID NO: 6991340 - DNA, 19 bp, Homo sapiens
gggagtcaagagattagtt

SEQ ID NO: 6991341 - DNA, 22 bp, Homo sapiens
ggccccaggtctgaacacgctg

SEQ ID NO: 6991342 - DNA, 22 bp, Homo sapiens
gcacccaggcactttcctttct

SEQ ID NO: 6991343 - DNA, 22 bp, Homo sapiens
tcattttcacacataaatagca

SEQ ID NO: 6991344 - DNA, 22 bp, Homo sapiens
gtggcagggtgctcatcatgca

SEQ ID NO: 6991345 - DNA, 22 bp, Homo sapiens
agttctttgtgatggaaattta

SEQ ID NO: 6991346 - DNA, 22 bp, Homo sapiens
aaggtgttatagctgaggaata

SEQ ID NO: 6991347 - DNA, 22 bp, Homo sapiens
ggaaccagtaactggtcattgc

SEQ ID NO: 6991348 - DNA, 22 bp, Homo sapiens
actctgtttgcaggtagctcag

SEQ ID NO: 6991349 - DNA, 22 bp, Homo sapiens
acccacacatctctaattcagt

SEQ ID NO: 6991350 - DNA, 22 bp, Homo sapiens
agcaagtagtaccaagtagctc

SEQ ID NO: 6991351 - DNA, 22 bp, Homo sapiens
ccacttcatcccagctcagata

SEQ ID NO: 6991352 - DNA, 22 bp, Homo sapiens
gtacccagtgattccttcttca

SEQ ID NO: 6991353 - DNA, 22 bp, Homo sapiens
gctggatcatatggtggttcta

SEQ ID NO: 6991354 - DNA, 22 bp, Homo sapiens
tgtgtttctgagaatcccacct

SEQ ID NO: 6991355 - DNA, 22 bp, Homo sapiens
ctgcttggggttagggtgtcct

SEQ ID NO: 6991356 - DNA, 18 bp, Homo sapiens
tatatagagaaacccatt

SEQ ID NO: 6991357 - DNA, 22 bp, Homo sapiens
gaagcacattagatgtgtcttc

SEQ ID NO: 6991358 - DNA, 22 bp, Homo sapiens
atactcttcctagcgctgaaat

SEQ ID NO: 6991359 - DNA, 22 bp, Homo sapiens
acacatgtatgttttgtatttg

SEQ ID NO: 6991360 - DNA, 22 bp, Homo sapiens
tgcaaattgcatgatgtgtatc

SEQ ID NO: 6991361 - DNA, 22 bp, Homo sapiens
gtagctacttagagccgttctt

SEQ ID NO: 6991362 - DNA, 22 bp, Homo sapiens
gtcatttaaagaccattgtggg

SEQ ID NO: 6991363 - DNA, 22 bp, Homo sapiens
gccacagtcaggacggggagag

SEQ ID NO: 6991364 - DNA, 22 bp, Homo sapiens
agtctccttaaatatttcccag

SEQ ID NO: 6991365 - DNA, 22 bp, Homo sapiens
gtgcattgcgatgcagacgacc

SEQ ID NO: 6991366 - DNA, 22 bp, Homo sapiens
ggaaaggcaggggccctgccca

SEQ ID NO: 6991367 - DNA, 22 bp, Homo sapiens
ataggaacctgaaaagctgtgc

SEQ ID NO: 6991368 - DNA, 22 bp, Homo sapiens
aggggaaatgccttggtggtac

SEQ ID NO: 6991369 - DNA, 22 bp, Homo sapiens
atgtggatggaagtcagatagc

SEQ ID NO: 6991370 - DNA, 18 bp, Homo sapiens
tgagttcattagacttcc

SEQ ID NO: 6991371 - DNA, 22 bp, Homo sapiens
gttattcaatggcttataagga

SEQ ID NO: 6991372 - DNA, 22 bp, Homo sapiens
ttctaagttactgttatggtct

SEQ ID NO: 6991373 - DNA, 23 bp, Homo sapiens
cacatggaggaccgttcttataa

SEQ ID NO: 6991374 - DNA, 22 bp, Homo sapiens
cttttgtggcaatggttaagag

SEQ ID NO: 6991375 - DNA, 22 bp, Homo sapiens
agtatcattttggcattagtat

SEQ ID NO: 6991376 - DNA, 22 bp, Homo sapiens
atttccaggagttgaggtctga

SEQ ID NO: 6991377 - DNA, 22 bp, Homo sapiens
tttggactatctgtgtggcttt

SEQ ID NO: 6991378 - DNA, 22 bp, Homo sapiens
agaccatgacctgccactaagc

SEQ ID NO: 6991379 - DNA, 22 bp, Homo sapiens
gtttataaattctgcttttgtt

SEQ ID NO: 6991380 - DNA, 22 bp, Homo sapiens
ggtcagtggccaggaagcagtc

SEQ ID NO: 6991381 - DNA, 22 bp, Homo sapiens
tttcaaggtgcaggagggtttt

SEQ ID NO: 6991382 - DNA, 22 bp, Homo sapiens
gagccctgatttgcagcatttg

SEQ ID NO: 6991383 - DNA, 22 bp, Homo sapiens
ctatggctgcacttatctgagg

SEQ ID NO: 6991384 - DNA, 22 bp, Homo sapiens
cataatttgatatgcttgatgg

SEQ ID NO: 6991385 - DNA, 22 bp, Homo sapiens
aaactgtcattttatatagtta

SEQ ID NO: 6991386 - DNA, 17 bp, Homo sapiens
acatacactggtgaaca

SEQ ID NO: 6991387 - DNA, 22 bp, Homo sapiens
tggccctgcttatgtctctctt

SEQ ID NO: 6991388 - DNA, 22 bp, Homo sapiens
gttttcctactgtatcatcaaa

SEQ ID NO: 6991389 - DNA, 22 bp, Homo sapiens
gcgagcctctggagtcctctgg

SEQ ID NO: 6991390 - DNA, 22 bp, Homo sapiens
ggtgaattaatgatggtaaggc

SEQ ID NO: 6991391 - DNA, 22 bp, Homo sapiens
tctttcaatgtgaaaccatgta

SEQ ID NO: 6991392 - DNA, 22 bp, Homo sapiens
ctgtcctgtggacctgaggacg

SEQ ID NO: 6991393 - DNA, 22 bp, Homo sapiens
ccacaagatgcaaactctaaca

SEQ ID NO: 6991394 - DNA, 23 bp, Homo sapiens
tgtgggaatgttggagaggaaac

SEQ ID NO: 6991395 - DNA, 22 bp, Homo sapiens
gtgattttcatgccctgctagg

SEQ ID NO: 6991396 - DNA, 22 bp, Homo sapiens
gcacagctcagcatgggaggac

SEQ ID NO: 6991397 - DNA, 22 bp, Homo sapiens
aaagatgagtccggcagacata

SEQ ID NO: 6991398 - DNA, 22 bp, Homo sapiens
gctggtgagcaaaggagaagga

SEQ ID NO: 6991399 - DNA, 21 bp, Homo sapiens
taagctaaacattcagttaac

SEQ ID NO: 6991400 - DNA, 22 bp, Homo sapiens
tctcccaacatgtggaggtcag

SEQ ID NO: 6991401 - DNA, 22 bp, Homo sapiens
aagctacattaagcagatttac

SEQ ID NO: 6991402 - DNA, 22 bp, Homo sapiens
aagtaccaagtttgtttgacgc

SEQ ID NO: 6991403 - DNA, 22 bp, Homo sapiens
gcctctgcactgtggcacacca

SEQ ID NO: 6991404 - DNA, 22 bp, Homo sapiens
ccctccccagggtcatattgaa

SEQ ID NO: 6991405 - DNA, 22 bp, Homo sapiens
ctgtggcattgtgaggactgca

SEQ ID NO: 6991406 - DNA, 22 bp, Homo sapiens
tcttgattacttattttgtgcc

SEQ ID NO: 6991407 - DNA, 22 bp, Homo sapiens
gcttgggaaactggggaaacca

SEQ ID NO: 6991408 - DNA, 22 bp, Homo sapiens
tttgcttgattaggatatggaa

SEQ ID NO: 6991409 - DNA, 22 bp, Homo sapiens
ctgaaattctttggagttttct

SEQ ID NO: 6991410 - DNA, 22 bp, Homo sapiens
agcctgattttgataattatat

SEQ ID NO: 6991411 - DNA, 22 bp, Homo sapiens
agtcacaggttcttgggattag

SEQ ID NO: 6991412 - DNA, 22 bp, Homo sapiens
aggcatgcgccaatttattaga

SEQ ID NO: 6991413 - DNA, 22 bp, Homo sapiens
ggctagggacacagctctgctc

SEQ ID NO: 6991414 - DNA, 22 bp, Homo sapiens
tcatgcactacataacgatgtt

SEQ ID NO: 6991415 - DNA, 22 bp, Homo sapiens
atctagaacttaaagtcagtca

SEQ ID NO: 6991416 - DNA, 22 bp, Homo sapiens
gggaaagaagaagagccatttt

SEQ ID NO: 6991417 - DNA, 22 bp, Homo sapiens
tgaaataacttttgggtgagtt

SEQ ID NO: 6991418 - DNA, 22 bp, Homo sapiens
taacctctgagctccagcttct

SEQ ID NO: 6991419 - DNA, 22 bp, Homo sapiens
gtgtgtgtgcctgcacacacac

SEQ ID NO: 6991420 - DNA, 22 bp, Homo sapiens
gtgcatgtgtctttatagtagc

SEQ ID NO: 6991421 - DNA, 22 bp, Homo sapiens
ttccaaatggagaagatgagtt

SEQ ID NO: 6991422 - DNA, 22 bp, Homo sapiens
ttaatagatatgcctctagagt

SEQ ID NO: 6991423 - DNA, 22 bp, Homo sapiens
gcagtgattttgctcagataaa

SEQ ID NO: 6991424 - DNA, 22 bp, Homo sapiens
ccaaggcttcctgacctacatg

SEQ ID NO: 6991425 - DNA, 22 bp, Homo sapiens
atgttagtgaccaaatctttct

SEQ ID NO: 6991426 - DNA, 22 bp, Homo sapiens
agcaggtgtcggcgagggtctt

SEQ ID NO: 6991427 - DNA, 22 bp, Homo sapiens
ctgtgttttgagatattattaa

SEQ ID NO: 6991428 - DNA, 22 bp, Homo sapiens
agaggttcaaacttcataattt

SEQ ID NO: 6991429 - DNA, 22 bp, Homo sapiens
ttctttatgttaatgaatctat

SEQ ID NO: 6991430 - DNA, 18 bp, Homo sapiens
gcctttgcacaagcagct

SEQ ID NO: 6991431 - DNA, 22 bp, Homo sapiens
aaagtgtggcacaagtcacatc

SEQ ID NO: 6991432 - DNA, 22 bp, Homo sapiens
gaaggcacagatggcagtccac

SEQ ID NO: 6991433 - DNA, 22 bp, Homo sapiens
atatataatacttgctgtgggc

SEQ ID NO: 6991434 - DNA, 20 bp, Homo sapiens
agctttggttaagccagtgg

SEQ ID NO: 6991435 - DNA, 22 bp, Homo sapiens
ttcaaagttgcatgacagctta

SEQ ID NO: 6991436 - DNA, 22 bp, Homo sapiens
gagctgcctacattgccaagag

SEQ ID NO: 6991437 - DNA, 22 bp, Homo sapiens
tctatagacttggacatatagt

SEQ ID NO: 6991438 - DNA, 22 bp, Homo sapiens
ttcaccgtgaaccgattcctca

SEQ ID NO: 6991439 - DNA, 22 bp, Homo sapiens
atgcgtgtaggaacagtgtcta

SEQ ID NO: 6991440 - DNA, 22 bp, Homo sapiens
gacttcataatattgagcatgt

SEQ ID NO: 6991441 - DNA, 22 bp, Homo sapiens
atgcgagtgatgcagagtggct

SEQ ID NO: 6991442 - DNA, 22 bp, Homo sapiens
tggtcctggagagtgttccata

SEQ ID NO: 6991443 - DNA, 22 bp, Homo sapiens
tataggaaaggagtggtcacaa

SEQ ID NO: 6991444 - DNA, 22 bp, Homo sapiens
tgattgaagaggtgaggaagtt

SEQ ID NO: 6991445 - DNA, 21 bp, Homo sapiens
acccccacacctccttagttc

SEQ ID NO: 6991446 - DNA, 22 bp, Homo sapiens
ttccctctcctactcaggaaag

SEQ ID NO: 6991447 - DNA, 22 bp, Homo sapiens
gtaaatattaaaggctgctaga

SEQ ID NO: 6991448 - DNA, 22 bp, Homo sapiens
tatgcaaagtcctaagaaagaa

SEQ ID NO: 6991449 - DNA, 22 bp, Homo sapiens
gatacattttatctcctaacag

SEQ ID NO: 6991450 - DNA, 22 bp, Homo sapiens
atcattttgtgacaatgcctgt

SEQ ID NO: 6991451 - DNA, 22 bp, Homo sapiens
aactctggcctcagtcttctgc

SEQ ID NO: 6991452 - DNA, 22 bp, Homo sapiens
atgccagaattgttgaccttat

SEQ ID NO: 6991453 - DNA, 22 bp, Homo sapiens
attgcattacatgatgaaggag

SEQ ID NO: 6991454 - DNA, 22 bp, Homo sapiens
agagctgtttggacatctgagt

SEQ ID NO: 6991455 - DNA, 22 bp, Homo sapiens
caggtggatctctaaggactga

SEQ ID NO: 6991456 - DNA, 22 bp, Homo sapiens
aaagcagcacatggatatcagt

SEQ ID NO: 6991457 - DNA, 19 bp, Homo sapiens
cccagagcatcctgaactt

SEQ ID NO: 6991458 - DNA, 22 bp, Homo sapiens
ccagagcccgggacctggactt

SEQ ID NO: 6991459 - DNA, 22 bp, Homo sapiens
tctcagtgatggcccatttgga

SEQ ID NO: 6991460 - DNA, 22 bp, Homo sapiens
tgtatgtatacactgatcatca

SEQ ID NO: 6991461 - DNA, 22 bp, Homo sapiens
tttgtcttggccaaggttctga

SEQ ID NO: 6991462 - DNA, 22 bp, Homo sapiens
tgcaggtgcagcgatactgtga

SEQ ID NO: 6991463 - DNA, 22 bp, Homo sapiens
acctgcctctaagcagcaggtg

SEQ ID NO: 6991464 - DNA, 22 bp, Homo sapiens
tggcactgacagggtgctcaag

SEQ ID NO: 6991465 - DNA, 22 bp, Homo sapiens
gcactgttctaggtgcagagct

SEQ ID NO: 6991466 - DNA, 22 bp, Homo sapiens
tcttgctgagactggcaagttt

SEQ ID NO: 6991467 - DNA, 22 bp, Homo sapiens
gcacataaagggcatgggaggt

SEQ ID NO: 6991468 - DNA, 22 bp, Homo sapiens
ctgggactggacctctgcctgg

SEQ ID NO: 6991469 - DNA, 22 bp, Homo sapiens
gttcagtttgagattaccatgg

SEQ ID NO: 6991470 - DNA, 18 bp, Homo sapiens
tccaaaatcatgtatttt

SEQ ID NO: 6991471 - DNA, 22 bp, Homo sapiens
gacatgatgcttggaactacat

SEQ ID NO: 6991472 - DNA, 22 bp, Homo sapiens
ggcatttgagccattggcctgt

SEQ ID NO: 6991473 - DNA, 22 bp, Homo sapiens
tcattgttgcgttaatgtcttc

SEQ ID NO: 6991474 - DNA, 22 bp, Homo sapiens
cagcatgacagtctgcagcaga

SEQ ID NO: 6991475 - DNA, 22 bp, Homo sapiens
tattgcttataatttgttgcaa

SEQ ID NO: 6991476 - DNA, 22 bp, Homo sapiens
caggctggagtgcagtggggcg

SEQ ID NO: 6991477 - DNA, 22 bp, Homo sapiens
ggtagacaactttgtaatagcc

SEQ ID NO: 6991478 - DNA, 22 bp, Homo sapiens
ggtgcagatctttctcttcagg

SEQ ID NO: 6991479 - DNA, 21 bp, Homo sapiens
cccttctgctccagctttgcc

SEQ ID NO: 6991480 - DNA, 22 bp, Homo sapiens
agagctggggcccgtaaagcca

SEQ ID NO: 6991481 - DNA, 16 bp, Homo sapiens
acacagttttaaggca

SEQ ID NO: 6991482 - DNA, 21 bp, Homo sapiens
catgcaggatttaacctagaa

SEQ ID NO: 6991483 - DNA, 22 bp, Homo sapiens
accaatgcatgattttgtctgg

SEQ ID NO: 6991484 - DNA, 22 bp, Homo sapiens
tgcttatatttattgggcttag

SEQ ID NO: 6991485 - DNA, 22 bp, Homo sapiens
taatacttgtcataaaggcatt

SEQ ID NO: 6991486 - DNA, 22 bp, Homo sapiens
atgcaaacattcgcttgtctct

SEQ ID NO: 6991487 - DNA, 22 bp, Homo sapiens
gggcttcttgccatggggacgg

SEQ ID NO: 6991488 - DNA, 22 bp, Homo sapiens
ccaaaattattacatttgtagg

SEQ ID NO: 6991489 - DNA, 22 bp, Homo sapiens
ggaggcgcggctcggctgtgcc

SEQ ID NO: 6991490 - DNA, 22 bp, Homo sapiens
gcttctgcagggtcctcgctgt

SEQ ID NO: 6991491 - DNA, 22 bp, Homo sapiens
ttccttcctcctccagttctgg

SEQ ID NO: 6991492 - DNA, 22 bp, Homo sapiens
ggaggtatttgtcaatctgttt

SEQ ID NO: 6991493 - DNA, 23 bp, Homo sapiens
tgggatagaatttcatggctgct

SEQ ID NO: 6991494 - DNA, 22 bp, Homo sapiens
ccaccagctgcatatgcacgta

SEQ ID NO: 6991495 - DNA, 22 bp, Homo sapiens
ttagaaaaaggctgtggtctta

SEQ ID NO: 6991496 - DNA, 18 bp, Homo sapiens
ggctcctgtgatcacatt

SEQ ID NO: 6991497 - DNA, 22 bp, Homo sapiens
gaaatagatctctgggatgcaa

SEQ ID NO: 6991498 - DNA, 22 bp, Homo sapiens
aagtcactttcccattccttgc

SEQ ID NO: 6991499 - DNA, 22 bp, Homo sapiens
ggccaataagacctaagcacaa

SEQ ID NO: 6991500 - DNA, 22 bp, Homo sapiens
acactttatcaatattcaaaaa

SEQ ID NO: 6991501 - DNA, 22 bp, Homo sapiens
tgcttccagcatccctggcctg

SEQ ID NO: 6991502 - DNA, 22 bp, Homo sapiens
cattagctatctgtttacatta

SEQ ID NO: 6991503 - DNA, 22 bp, Homo sapiens
cagtccttccttgccccttggg

SEQ ID NO: 6991504 - DNA, 22 bp, Homo sapiens
ttgttactgttctacatacagt

SEQ ID NO: 6991505 - DNA, 22 bp, Homo sapiens
ctgtatatgtgcatacacacac

SEQ ID NO: 6991506 - DNA, 22 bp, Homo sapiens
cccggaggcagaggttgcagtg

SEQ ID NO: 6991507 - DNA, 22 bp, Homo sapiens
agtgctttgtggagaatttgta

SEQ ID NO: 6991508 - DNA, 19 bp, Homo sapiens
tgaggccttggatgaaagg

SEQ ID NO: 6991509 - DNA, 22 bp, Homo sapiens
tggcaactactaatcatttaac

SEQ ID NO: 6991510 - DNA, 22 bp, Homo sapiens
attctttagccagcaggtatat

SEQ ID NO: 6991511 - DNA, 22 bp, Homo sapiens
agctgtttatgcactcctgcct

SEQ ID NO: 6991512 - DNA, 22 bp, Homo sapiens
ctcagggacggaggcttgcgga

SEQ ID NO: 6991513 - DNA, 22 bp, Homo sapiens
atacagtgcacaacctgtgcag

SEQ ID NO: 6991514 - DNA, 22 bp, Homo sapiens
aatgttgtgtttcagttcaaga

SEQ ID NO: 6991515 - DNA, 22 bp, Homo sapiens
taggcaatgggtggccctagaa

SEQ ID NO: 6991516 - DNA, 22 bp, Homo sapiens
ctagtaggatgcatagttattt

SEQ ID NO: 6991517 - DNA, 22 bp, Homo sapiens
aatgtcatattagtttgtgcct

SEQ ID NO: 6991518 - DNA, 22 bp, Homo sapiens
ctggagcaaaagtgactcctct

SEQ ID NO: 6991519 - DNA, 22 bp, Homo sapiens
gctaaggcacaaatagctttgc

SEQ ID NO: 6991520 - DNA, 22 bp, Homo sapiens
tttggcaatgactgcatccatg

SEQ ID NO: 6991521 - DNA, 20 bp, Homo sapiens
taacagtaagtgatgttaca

SEQ ID NO: 6991522 - DNA, 22 bp, Homo sapiens
tttgtactgaccaattatttga

SEQ ID NO: 6991523 - DNA, 19 bp, Homo sapiens
taaagagaataccggtggc

SEQ ID NO: 6991524 - DNA, 20 bp, Homo sapiens
tcagggtttcccattcttgg

SEQ ID NO: 6991525 - DNA, 22 bp, Homo sapiens
tcccagggattaggacatggat

SEQ ID NO: 6991526 - DNA, 22 bp, Homo sapiens
tacaaactaacatgtctcatcc

SEQ ID NO: 6991527 - DNA, 22 bp, Homo sapiens
ctggcagtctggtggaaggcct

SEQ ID NO: 6991528 - DNA, 22 bp, Homo sapiens
gctctttagcgggggccaggcc

SEQ ID NO: 6991529 - DNA, 22 bp, Homo sapiens
gtgcatgtctttggaggcctcc

SEQ ID NO: 6991530 - DNA, 22 bp, Homo sapiens
aacactgacctctaccctcagt

SEQ ID NO: 6991531 - DNA, 22 bp, Homo sapiens
acccccaaacatgatcatggtg

SEQ ID NO: 6991532 - DNA, 22 bp, Homo sapiens
caggcaggagacatttggttgg

SEQ ID NO: 6991533 - DNA, 22 bp, Homo sapiens
tgctgctcgccacggcccaggg

SEQ ID NO: 6991534 - DNA, 22 bp, Homo sapiens
tgtggagcaattggtggtgtct

SEQ ID NO: 6991535 - DNA, 22 bp, Homo sapiens
aaaagagagttgccagtctgta

SEQ ID NO: 6991536 - DNA, 22 bp, Homo sapiens
aatgtacatctcagtgtagtac

SEQ ID NO: 6991537 - DNA, 22 bp, Homo sapiens
gcctaggagtggggatggcggt

SEQ ID NO: 6991538 - DNA, 22 bp, Homo sapiens
ttgcacatgttggttcttgaaa

SEQ ID NO: 6991539 - DNA, 22 bp, Homo sapiens
aggcctgacttgaatttagggc

SEQ ID NO: 6991540 - DNA, 22 bp, Homo sapiens
tgagcctggagcccagatgttt

SEQ ID NO: 6991541 - DNA, 22 bp, Homo sapiens
acttggctattttcattcatca

SEQ ID NO: 6991542 - DNA, 22 bp, Homo sapiens
catgaaacttccaaagctgacc

SEQ ID NO: 6991543 - DNA, 22 bp, Homo sapiens
agcagggaggcggtgtgctggc

SEQ ID NO: 6991544 - DNA, 19 bp, Homo sapiens
ttctggaaacccaggtaat

SEQ ID NO: 6991545 - DNA, 22 bp, Homo sapiens
atgtgctttctttgtttcataa

SEQ ID NO: 6991546 - DNA, 22 bp, Homo sapiens
gaccacagtccagtcatcatgg

SEQ ID NO: 6991547 - DNA, 22 bp, Homo sapiens
ctgaggaaggagttaggcagtt

SEQ ID NO: 6991548 - DNA, 22 bp, Homo sapiens
ggaagaaaatgggcaacaggtg

SEQ ID NO: 6991549 - DNA, 22 bp, Homo sapiens
aggatcaaatgaaatattttga

SEQ ID NO: 6991550 - DNA, 22 bp, Homo sapiens
caggacatctacccagtgtttc

SEQ ID NO: 6991551 - DNA, 22 bp, Homo sapiens
acatccagtatcagaagcatca

SEQ ID NO: 6991552 - DNA, 22 bp, Homo sapiens
ttgaagatggtagcaatttcct

SEQ ID NO: 6991553 - DNA, 22 bp, Homo sapiens
ttatagatctaaatgtgaaggg

SEQ ID NO: 6991554 - DNA, 22 bp, Homo sapiens
tcactgttgacctggaagtggg

SEQ ID NO: 6991555 - DNA, 22 bp, Homo sapiens
ttctgaagggctaagtgtctat

SEQ ID NO: 6991556 - DNA, 22 bp, Homo sapiens
tttggcactcacttatcattgg

SEQ ID NO: 6991557 - DNA, 22 bp, Homo sapiens
ttctttgcccatgtttcctaag

SEQ ID NO: 6991558 - DNA, 22 bp, Homo sapiens
agaagtgagttgtgactatggg

SEQ ID NO: 6991559 - DNA, 22 bp, Homo sapiens
agattaactctcagaaaagagg

SEQ ID NO: 6991560 - DNA, 20 bp, Homo sapiens
cagaaggtctaagctttaga

SEQ ID NO: 6991561 - DNA, 22 bp, Homo sapiens
ccaaagtccatagtttacataa

SEQ ID NO: 6991562 - DNA, 21 bp, Homo sapiens
tcagcttgcttcattattatg

SEQ ID NO: 6991563 - DNA, 22 bp, Homo sapiens
ccaggaggatgaggggcataga

SEQ ID NO: 6991564 - DNA, 22 bp, Homo sapiens
gaagagccaggtgtcgctgtgg

SEQ ID NO: 6991565 - DNA, 22 bp, Homo sapiens
atgcttaaaaggctgcgttaga

SEQ ID NO: 6991566 - DNA, 22 bp, Homo sapiens
ttacaagtgtcaggcgctggca

SEQ ID NO: 6991567 - DNA, 22 bp, Homo sapiens
tggctcctgcatttgtgctaac

SEQ ID NO: 6991568 - DNA, 22 bp, Homo sapiens
ttctctggacagtgaagagagg

SEQ ID NO: 6991569 - DNA, 19 bp, Homo sapiens
tggtcagatttcagaagtc

SEQ ID NO: 6991570 - DNA, 21 bp, Homo sapiens
ccacatggtgaaaccctatct

SEQ ID NO: 6991571 - DNA, 22 bp, Homo sapiens
tctcaggtggcccccatgagtg

SEQ ID NO: 6991572 - DNA, 22 bp, Homo sapiens
tttgtctgttattgttctcatg

SEQ ID NO: 6991573 - DNA, 22 bp, Homo sapiens
tacctataggtacaattacaag

SEQ ID NO: 6991574 - DNA, 22 bp, Homo sapiens
ggcctcggcccactgctgcggt

SEQ ID NO: 6991575 - DNA, 21 bp, Homo sapiens
gcctccagccagatggcctcc

SEQ ID NO: 6991576 - DNA, 22 bp, Homo sapiens
agattcgaaacctttaggtctt

SEQ ID NO: 6991577 - DNA, 19 bp, Homo sapiens
aagagcagggaaagaattg

SEQ ID NO: 6991578 - DNA, 22 bp, Homo sapiens
agtgatttcatcattttatcaa

SEQ ID NO: 6991579 - DNA, 21 bp, Homo sapiens
aactcccagtgccttcccagc

SEQ ID NO: 6991580 - DNA, 22 bp, Homo sapiens
caagtgacattcaatactagag

SEQ ID NO: 6991581 - DNA, 21 bp, Homo sapiens
tcatttctctatgtatttcac

SEQ ID NO: 6991582 - DNA, 22 bp, Homo sapiens
gaagtgacagaagggatgggca

SEQ ID NO: 6991583 - DNA, 23 bp, Homo sapiens
cccagcagagatgaggaggggtc

SEQ ID NO: 6991584 - DNA, 22 bp, Homo sapiens
cctgacgaaaggcgtgctggag

SEQ ID NO: 6991585 - DNA, 22 bp, Homo sapiens
tctctgggggtagaactcaggc

SEQ ID NO: 6991586 - DNA, 22 bp, Homo sapiens
atatcacagatgcagaaagaga

SEQ ID NO: 6991587 - DNA, 22 bp, Homo sapiens
tcctgccaccgggggtggcgat

SEQ ID NO: 6991588 - DNA, 21 bp, Homo sapiens
acagtaagacagggcatttgc

SEQ ID NO: 6991589 - DNA, 22 bp, Homo sapiens
gcagaggtgtcaccttccagga

SEQ ID NO: 6991590 - DNA, 22 bp, Homo sapiens
agggtagggccgtagggccatg

SEQ ID NO: 6991591 - DNA, 22 bp, Homo sapiens
gtttaattttaggttgtcaagc

SEQ ID NO: 6991592 - DNA, 22 bp, Homo sapiens
atatgaagaatctaggataggc

SEQ ID NO: 6991593 - DNA, 23 bp, Homo sapiens
aggctggcttcaggagcctctcc

SEQ ID NO: 6991594 - DNA, 22 bp, Homo sapiens
aacactgtactggaagatggac

SEQ ID NO: 6991595 - DNA, 22 bp, Homo sapiens
atataatagtttcataaaggct

SEQ ID NO: 6991596 - DNA, 19 bp, Homo sapiens
cttgtaaagggctgtttct

SEQ ID NO: 6991597 - DNA, 21 bp, Homo sapiens
cctgtgctccacacagggtcc

SEQ ID NO: 6991598 - DNA, 22 bp, Homo sapiens
gagtaaaataggtgagaatcaa

SEQ ID NO: 6991599 - DNA, 22 bp, Homo sapiens
tctattatggtacttatcatga

SEQ ID NO: 6991600 - DNA, 22 bp, Homo sapiens
tgagccaggcccagtggggtca

SEQ ID NO: 6991601 - DNA, 18 bp, Homo sapiens
atcatgctgaattaaaga

SEQ ID NO: 6991602 - DNA, 18 bp, Homo sapiens
tcacaattatggttcgtg

SEQ ID NO: 6991603 - DNA, 22 bp, Homo sapiens
cattatgtgagtgattaattca

SEQ ID NO: 6991604 - DNA, 22 bp, Homo sapiens
aatgggagtggcttggaaatca

SEQ ID NO: 6991605 - DNA, 22 bp, Homo sapiens
gggcagtagcttcgtaggcatc

SEQ ID NO: 6991606 - DNA, 22 bp, Homo sapiens
aaaggctatttttagatgtttg

SEQ ID NO: 6991607 - DNA, 22 bp, Homo sapiens
attcctgactgttagagtttgc

SEQ ID NO: 6991608 - DNA, 22 bp, Homo sapiens
tgggaatggatgctaagtgcta

SEQ ID NO: 6991609 - DNA, 22 bp, Homo sapiens
ttatggtaattaaaacatgtat

SEQ ID NO: 6991610 - DNA, 22 bp, Homo sapiens
tgcatggaacggtctcctggtc

SEQ ID NO: 6991611 - DNA, 22 bp, Homo sapiens
tcctggtggtgccagctgcagg

SEQ ID NO: 6991612 - DNA, 22 bp, Homo sapiens
cccagcctctgggctcacccaa

SEQ ID NO: 6991613 - DNA, 22 bp, Homo sapiens
agaggattcactgcagaagaca

SEQ ID NO: 6991614 - DNA, 22 bp, Homo sapiens
ctggtgcaaaagtaattgtggt

SEQ ID NO: 6991615 - DNA, 22 bp, Homo sapiens
tagagcattaagtattgttgtt

SEQ ID NO: 6991616 - DNA, 22 bp, Homo sapiens
agggctactgcctgccttcagg

SEQ ID NO: 6991617 - DNA, 22 bp, Homo sapiens
ataaagacatgcttacttgccc

SEQ ID NO: 6991618 - DNA, 22 bp, Homo sapiens
cctgctttgctggtaccatcag

SEQ ID NO: 6991619 - DNA, 22 bp, Homo sapiens
aatgaagattatggtgattaag

SEQ ID NO: 6991620 - DNA, 22 bp, Homo sapiens
ccagagatgtgaaaatgccgga

SEQ ID NO: 6991621 - DNA, 22 bp, Homo sapiens
ttccaaagttattcaagcagta

SEQ ID NO: 6991622 - DNA, 22 bp, Homo sapiens
atttccatcatcattaggccta

SEQ ID NO: 6991623 - DNA, 22 bp, Homo sapiens
ttttcatgttccttgttaagtg

SEQ ID NO: 6991624 - DNA, 22 bp, Homo sapiens
gcatgcagtaaaattcagcaac

SEQ ID NO: 6991625 - DNA, 22 bp, Homo sapiens
tcccagtgggaagcagcacgct

SEQ ID NO: 6991626 - DNA, 22 bp, Homo sapiens
tcatcctgaagaacctgcttcc

SEQ ID NO: 6991627 - DNA, 22 bp, Homo sapiens
ttctcatggtgtctttatacat

SEQ ID NO: 6991628 - DNA, 22 bp, Homo sapiens
cagcttgaaatattaggagatg

SEQ ID NO: 6991629 - DNA, 22 bp, Homo sapiens
tgaggccaactagggagatgga

SEQ ID NO: 6991630 - DNA, 22 bp, Homo sapiens
caaggcagtccctactccctgc

SEQ ID NO: 6991631 - DNA, 22 bp, Homo sapiens
aaaagccatgcatacctaagag

SEQ ID NO: 6991632 - DNA, 22 bp, Homo sapiens
ctagaattttaattgggtatat

SEQ ID NO: 6991633 - DNA, 22 bp, Homo sapiens
tccagctgctgccagccaagct

SEQ ID NO: 6991634 - DNA, 22 bp, Homo sapiens
agaacaggttcagggtataaaa

SEQ ID NO: 6991635 - DNA, 22 bp, Homo sapiens
tggccaccttatggctattgga

SEQ ID NO: 6991636 - DNA, 22 bp, Homo sapiens
gcccaggaaatgccccgtggtg

SEQ ID NO: 6991637 - DNA, 22 bp, Homo sapiens
cagagctgggatcccatgggcg

SEQ ID NO: 6991638 - DNA, 22 bp, Homo sapiens
agagttaaggccactgtcagta

SEQ ID NO: 6991639 - DNA, 22 bp, Homo sapiens
tcattattttggactggagtgt

SEQ ID NO: 6991640 - DNA, 22 bp, Homo sapiens
tggctgtgcctctttccaggcc

SEQ ID NO: 6991641 - DNA, 22 bp, Homo sapiens
ggtctctgctcagatgccactt

SEQ ID NO: 6991642 - DNA, 22 bp, Homo sapiens
gctgctttgacagtgggaacag

SEQ ID NO: 6991643 - DNA, 22 bp, Homo sapiens
agaaagggaccagttcttttga

SEQ ID NO: 6991644 - DNA, 22 bp, Homo sapiens
tgtttagacaaggatcaggtta

SEQ ID NO: 6991645 - DNA, 22 bp, Homo sapiens
tcagctttgcaagttagaaaat

SEQ ID NO: 6991646 - DNA, 22 bp, Homo sapiens
gtgaagcataactgaaggattt

SEQ ID NO: 6991647 - DNA, 22 bp, Homo sapiens
gtgagaaatgacaaatgtgtcg

SEQ ID NO: 6991648 - DNA, 22 bp, Homo sapiens
agggtctgttgtttgttctgga

SEQ ID NO: 6991649 - DNA, 22 bp, Homo sapiens
tctgatgtgtatcttagggccc

SEQ ID NO: 6991650 - DNA, 22 bp, Homo sapiens
ctgggagattcaggtgaagttt

SEQ ID NO: 6991651 - DNA, 22 bp, Homo sapiens
ggggcccagggcagcagtgcag

SEQ ID NO: 6991652 - DNA, 22 bp, Homo sapiens
gtccctgataagagccatcgat

SEQ ID NO: 6991653 - DNA, 19 bp, Homo sapiens
ggctgtggtggtgccttgc

SEQ ID NO: 6991654 - DNA, 22 bp, Homo sapiens
atctgagtcaaatatttcattt

SEQ ID NO: 6991655 - DNA, 22 bp, Homo sapiens
tattgctcctacagtcaatttc

SEQ ID NO: 6991656 - DNA, 22 bp, Homo sapiens
ctgttattcaagacaaaggcag

SEQ ID NO: 6991657 - DNA, 21 bp, Homo sapiens
ctctccaggtaggataaatgt

SEQ ID NO: 6991658 - DNA, 22 bp, Homo sapiens
ccctggggctgagggatggccg

SEQ ID NO: 6991659 - DNA, 23 bp, Homo sapiens
aggcttcatccatatttattgcc

SEQ ID NO: 6991660 - DNA, 22 bp, Homo sapiens
ctaaatactagccttcagattt

SEQ ID NO: 6991661 - DNA, 22 bp, Homo sapiens
ttgcaaatgttatactgccagt

SEQ ID NO: 6991662 - DNA, 22 bp, Homo sapiens
tcagacccaggtgccaagctgt

SEQ ID NO: 6991663 - DNA, 22 bp, Homo sapiens
agccctgggctgtagataagca

SEQ ID NO: 6991664 - DNA, 22 bp, Homo sapiens
gctctgagtaaatgaaagcatt

SEQ ID NO: 6991665 - DNA, 22 bp, Homo sapiens
tctgggaagttggcagccagct

SEQ ID NO: 6991666 - DNA, 22 bp, Homo sapiens
gacagtgcatttcctggcatgg

SEQ ID NO: 6991667 - DNA, 21 bp, Homo sapiens
ggatggatagggaagagattt

SEQ ID NO: 6991668 - DNA, 23 bp, Homo sapiens
gagaaacctcggtaagcaggagg

SEQ ID NO: 6991669 - DNA, 22 bp, Homo sapiens
cctttcctgtgtccttttaagg

SEQ ID NO: 6991670 - DNA, 22 bp, Homo sapiens
agtttcaattcttttcacaaag

SEQ ID NO: 6991671 - DNA, 23 bp, Homo sapiens
agatccatgtgggctggaaactg

SEQ ID NO: 6991672 - DNA, 22 bp, Homo sapiens
tcacagaatgtcagagttgggg

SEQ ID NO: 6991673 - DNA, 17 bp, Homo sapiens
ctaagggcccactcttc

SEQ ID NO: 6991674 - DNA, 22 bp, Homo sapiens
tggcttggactaaatggaccgt

SEQ ID NO: 6991675 - DNA, 22 bp, Homo sapiens
ttccacagcccaagctggtggc

SEQ ID NO: 6991676 - DNA, 22 bp, Homo sapiens
ccgtcatgcatttgcaggcagg

SEQ ID NO: 6991677 - DNA, 22 bp, Homo sapiens
tactttgtcatgctaagagtga

SEQ ID NO: 6991678 - DNA, 22 bp, Homo sapiens
acagcccaagtcacctgcagga

SEQ ID NO: 6991679 - DNA, 22 bp, Homo sapiens
gagggggctccctgaagccagt

SEQ ID NO: 6991680 - DNA, 22 bp, Homo sapiens
caactatatagaaattgattgt

SEQ ID NO: 6991681 - DNA, 22 bp, Homo sapiens
tattgctgttctttaaatgaag

SEQ ID NO: 6991682 - DNA, 22 bp, Homo sapiens
tggattagttaagaaatgttag

SEQ ID NO: 6991683 - DNA, 22 bp, Homo sapiens
agtaacatctttgacatttgtt

SEQ ID NO: 6991684 - DNA, 22 bp, Homo sapiens
atgaacagaggaatagaattct

SEQ ID NO: 6991685 - DNA, 22 bp, Homo sapiens
tcaaacagcaggtctttcatag

SEQ ID NO: 6991686 - DNA, 22 bp, Homo sapiens
tcacggtattcacgaacatgga

SEQ ID NO: 6991687 - DNA, 22 bp, Homo sapiens
acctggacctgccacctatgag

SEQ ID NO: 6991688 - DNA, 22 bp, Homo sapiens
ggctgcctgctcctcctgcacg

SEQ ID NO: 6991689 - DNA, 22 bp, Homo sapiens
gcctcagagctacacacacgca

SEQ ID NO: 6991690 - DNA, 22 bp, Homo sapiens
agtatactagtgcagcatgtat

SEQ ID NO: 6991691 - DNA, 22 bp, Homo sapiens
tagctttgtcctccaccctcag

SEQ ID NO: 6991692 - DNA, 22 bp, Homo sapiens
agcctgctggaccaagctcatg

SEQ ID NO: 6991693 - DNA, 22 bp, Homo sapiens
gtacttctcaaactagaaacta

SEQ ID NO: 6991694 - DNA, 22 bp, Homo sapiens
ttgtgtccaaggctatggtgat

SEQ ID NO: 6991695 - DNA, 22 bp, Homo sapiens
tctgaaatagaagtgtctttct

SEQ ID NO: 6991696 - DNA, 22 bp, Homo sapiens
gtgcacctgaataccacatact

SEQ ID NO: 6991697 - DNA, 22 bp, Homo sapiens
gtgcagaatcagtacagaacga

SEQ ID NO: 6991698 - DNA, 22 bp, Homo sapiens
tgtggggactgagtggaggctt

SEQ ID NO: 6991699 - DNA, 22 bp, Homo sapiens
tagaatgttcacctttaaatga

SEQ ID NO: 6991700 - DNA, 22 bp, Homo sapiens
tgctgaaagaccgtatttatct

SEQ ID NO: 6991701 - DNA, 22 bp, Homo sapiens
actattgtgtagtagaagcatc

SEQ ID NO: 6991702 - DNA, 22 bp, Homo sapiens
gatgtgacaaaccaagaggact

SEQ ID NO: 6991703 - DNA, 22 bp, Homo sapiens
gctgtttctttggcaaactgat

SEQ ID NO: 6991704 - DNA, 20 bp, Homo sapiens
agtcccaacattcagctctg

SEQ ID NO: 6991705 - DNA, 22 bp, Homo sapiens
gaggttgccatgcatcctggtt

SEQ ID NO: 6991706 - DNA, 22 bp, Homo sapiens
tgagcccagtctgtctgacatg

SEQ ID NO: 6991707 - DNA, 22 bp, Homo sapiens
ccatgtactactttctgagctc

SEQ ID NO: 6991708 - DNA, 22 bp, Homo sapiens
actccagaggcagctgtgctga

SEQ ID NO: 6991709 - DNA, 21 bp, Homo sapiens
tctggagccctaagctgagaa

SEQ ID NO: 6991710 - DNA, 22 bp, Homo sapiens
ttggagccatgcccagctctct

SEQ ID NO: 6991711 - DNA, 22 bp, Homo sapiens
tgtaaagcatttcctaaatcca

SEQ ID NO: 6991712 - DNA, 22 bp, Homo sapiens
aggaaactgaggttacgggact

SEQ ID NO: 6991713 - DNA, 22 bp, Homo sapiens
ggcctcactgtgcatcccttgg

SEQ ID NO: 6991714 - DNA, 22 bp, Homo sapiens
caggacagagcccagactgtgt

SEQ ID NO: 6991715 - DNA, 22 bp, Homo sapiens
tctagaatagattctgctgatc

SEQ ID NO: 6991716 - DNA, 22 bp, Homo sapiens
aaattgcaaccaggtctctgtc

SEQ ID NO: 6991717 - DNA, 22 bp, Homo sapiens
tgtctgggatgtaattcctgcc

SEQ ID NO: 6991718 - DNA, 22 bp, Homo sapiens
ttacatcagcaagagtgtatgt

SEQ ID NO: 6991719 - DNA, 22 bp, Homo sapiens
cttagtttctgtttctgattaa

SEQ ID NO: 6991720 - DNA, 20 bp, Homo sapiens
tttctgcagggagctgggct

SEQ ID NO: 6991721 - DNA, 20 bp, Homo sapiens
tgagtgagtttgtggcagga

SEQ ID NO: 6991722 - DNA, 22 bp, Homo sapiens
ccactttgaaccactgaggtgg

SEQ ID NO: 6991723 - DNA, 22 bp, Homo sapiens
caggaatggaggcatttatgaa

SEQ ID NO: 6991724 - DNA, 22 bp, Homo sapiens
ggtccctgggtcttcttacgtc

SEQ ID NO: 6991725 - DNA, 22 bp, Homo sapiens
ttccctttgttaaattggaaga

SEQ ID NO: 6991726 - DNA, 22 bp, Homo sapiens
ttaggaatcacctgcagatctt

SEQ ID NO: 6991727 - DNA, 22 bp, Homo sapiens
gcacggcctcgcccttggaacc

SEQ ID NO: 6991728 - DNA, 22 bp, Homo sapiens
tcaatgaggtgattgctgtcct

SEQ ID NO: 6991729 - DNA, 22 bp, Homo sapiens
ttaggaagatgctttttctggg

SEQ ID NO: 6991730 - DNA, 20 bp, Homo sapiens
tccagctttgcctctaactg

SEQ ID NO: 6991731 - DNA, 22 bp, Homo sapiens
aatgtcaaaggctatacattca

SEQ ID NO: 6991732 - DNA, 22 bp, Homo sapiens
tgctggagtgagattatgagtt

SEQ ID NO: 6991733 - DNA, 22 bp, Homo sapiens
tgtcctgccatttccatagcct

SEQ ID NO: 6991734 - DNA, 22 bp, Homo sapiens
tggaatgttgataaacataggc

SEQ ID NO: 6991735 - DNA, 22 bp, Homo sapiens
tttaccaaatgagactattgtt

SEQ ID NO: 6991736 - DNA, 22 bp, Homo sapiens
ttctcaggctctgagaccctat

SEQ ID NO: 6991737 - DNA, 22 bp, Homo sapiens
atgaggtaatactttcagtcct

SEQ ID NO: 6991738 - DNA, 22 bp, Homo sapiens
ttatacaccatcactgccttgg

SEQ ID NO: 6991739 - DNA, 18 bp, Homo sapiens
tatgaaagtccactctca

SEQ ID NO: 6991740 - DNA, 22 bp, Homo sapiens
gagagggccagggtgagaacta

SEQ ID NO: 6991741 - DNA, 22 bp, Homo sapiens
ttggtctgctctgatgttttct

SEQ ID NO: 6991742 - DNA, 22 bp, Homo sapiens
cacacatgacccacttttaccg

SEQ ID NO: 6991743 - DNA, 22 bp, Homo sapiens
ggccagggaggagaggcccctg

SEQ ID NO: 6991744 - DNA, 22 bp, Homo sapiens
gcatcattttcttcttcctgca

SEQ ID NO: 6991745 - DNA, 22 bp, Homo sapiens
tattattgaatcagttctttga

SEQ ID NO: 6991746 - DNA, 22 bp, Homo sapiens
aatccattaaaaacaagcgcat

SEQ ID NO: 6991747 - DNA, 19 bp, Homo sapiens
aagcccggctgctgagagg

SEQ ID NO: 6991748 - DNA, 20 bp, Homo sapiens
tgcagcttctcatcttcaaa

SEQ ID NO: 6991749 - DNA, 22 bp, Homo sapiens
gtttgtaagcagtctgcttgtg

SEQ ID NO: 6991750 - DNA, 22 bp, Homo sapiens
tgcagcattttataccatcatt

SEQ ID NO: 6991751 - DNA, 22 bp, Homo sapiens
ggattagtgcggtggccttggg

SEQ ID NO: 6991752 - DNA, 22 bp, Homo sapiens
gagggctgtggggcatgaccag

SEQ ID NO: 6991753 - DNA, 22 bp, Homo sapiens
acaggcctcccatccggagccc

SEQ ID NO: 6991754 - DNA, 22 bp, Homo sapiens
ataaactctgcctcagaagagc

SEQ ID NO: 6991755 - DNA, 22 bp, Homo sapiens
ataaggaagatgtcctcatctg

SEQ ID NO: 6991756 - DNA, 22 bp, Homo sapiens
gtttgcaggaactctggggaga

SEQ ID NO: 6991757 - DNA, 23 bp, Homo sapiens
gtgagaatcctgccctgcacttg

SEQ ID NO: 6991758 - DNA, 22 bp, Homo sapiens
tcatttacaggtgaagcaacta

SEQ ID NO: 6991759 - DNA, 22 bp, Homo sapiens
acagggccacatgtaaacagat

SEQ ID NO: 6991760 - DNA, 22 bp, Homo sapiens
actttcaacctgtcccccagag

SEQ ID NO: 6991761 - DNA, 22 bp, Homo sapiens
ccatctccaaataccatcacat

SEQ ID NO: 6991762 - DNA, 22 bp, Homo sapiens
gcatgtgttatttctctgtggg

SEQ ID NO: 6991763 - DNA, 22 bp, Homo sapiens
tgaaccacatgcaaagtgaata

SEQ ID NO: 6991764 - DNA, 22 bp, Homo sapiens
cgcggggcttcagccgcccagt

SEQ ID NO: 6991765 - DNA, 22 bp, Homo sapiens
atgggacacagtccgccctcta

SEQ ID NO: 6991766 - DNA, 20 bp, Homo sapiens
attcaccaaatcatcccagg

SEQ ID NO: 6991767 - DNA, 22 bp, Homo sapiens
gcagctttctgcaatgtcatcc

SEQ ID NO: 6991768 - DNA, 22 bp, Homo sapiens
ataatacatggttgatcttttc

SEQ ID NO: 6991769 - DNA, 22 bp, Homo sapiens
aggcattacatctaaatattta

SEQ ID NO: 6991770 - DNA, 22 bp, Homo sapiens
tggcatggcgtggcatcgtgtg

SEQ ID NO: 6991771 - DNA, 22 bp, Homo sapiens
acactgcagatgaaagcataag

SEQ ID NO: 6991772 - DNA, 22 bp, Homo sapiens
gtacatgcagattatagctaat

SEQ ID NO: 6991773 - DNA, 22 bp, Homo sapiens
tcagacatgggatatgaagctc

SEQ ID NO: 6991774 - DNA, 22 bp, Homo sapiens
agctgagctagtagttccagtg

SEQ ID NO: 6991775 - DNA, 22 bp, Homo sapiens
tctgggtcactgtgggagggca

SEQ ID NO: 6991776 - DNA, 22 bp, Homo sapiens
atcctgggcaagtcaatgtccc

SEQ ID NO: 6991777 - DNA, 22 bp, Homo sapiens
ttaataggcttctaacatagct

SEQ ID NO: 6991778 - DNA, 23 bp, Homo sapiens
cctggctcaccccttatgtccag

SEQ ID NO: 6991779 - DNA, 22 bp, Homo sapiens
cagctgacaagagtccttggag

SEQ ID NO: 6991780 - DNA, 22 bp, Homo sapiens
ggtctctgacttagagatggat

SEQ ID NO: 6991781 - DNA, 22 bp, Homo sapiens
tgaatgcaagaaggaacatgaa

SEQ ID NO: 6991782 - DNA, 22 bp, Homo sapiens
tttcctctgatgctgacttgga

SEQ ID NO: 6991783 - DNA, 22 bp, Homo sapiens
gatggtttggtaaaagtatgtt

SEQ ID NO: 6991784 - DNA, 22 bp, Homo sapiens
acttcctgtatttatccatagc

SEQ ID NO: 6991785 - DNA, 22 bp, Homo sapiens
tttccacaatttgagcagcaga

SEQ ID NO: 6991786 - DNA, 22 bp, Homo sapiens
tctgaatttatggcaaaacctg

SEQ ID NO: 6991787 - DNA, 22 bp, Homo sapiens
tcagctgcataagtcaccttgc

SEQ ID NO: 6991788 - DNA, 22 bp, Homo sapiens
ttatgcttcctgattggactct

SEQ ID NO: 6991789 - DNA, 22 bp, Homo sapiens
tctgttataaatcacactgcat

SEQ ID NO: 6991790 - DNA, 19 bp, Homo sapiens
cctctgtgggagtcagtga

SEQ ID NO: 6991791 - DNA, 22 bp, Homo sapiens
agggcccagcccttgctggtct

SEQ ID NO: 6991792 - DNA, 22 bp, Homo sapiens
tgagctacttctgatattggca

SEQ ID NO: 6991793 - DNA, 22 bp, Homo sapiens
aatgtgctggtaactgctttgc

SEQ ID NO: 6991794 - DNA, 22 bp, Homo sapiens
taattttccactctgtttatct

SEQ ID NO: 6991795 - DNA, 22 bp, Homo sapiens
ctggctttccctggacaacagc

SEQ ID NO: 6991796 - DNA, 22 bp, Homo sapiens
tttccttttggctaggtgtgaa

SEQ ID NO: 6991797 - DNA, 22 bp, Homo sapiens
tgaagaacctgatgagctgtgt

SEQ ID NO: 6991798 - DNA, 18 bp, Homo sapiens
ggtgccaagtctgggatc

SEQ ID NO: 6991799 - DNA, 22 bp, Homo sapiens
tctttatttaagtctgttgtaa

SEQ ID NO: 6991800 - DNA, 22 bp, Homo sapiens
ggccctcttgatatccagcggc

SEQ ID NO: 6991801 - DNA, 22 bp, Homo sapiens
gatctgaatagacttgctaagg

SEQ ID NO: 6991802 - DNA, 22 bp, Homo sapiens
cagcccagcagggtctggccct

SEQ ID NO: 6991803 - DNA, 22 bp, Homo sapiens
ttattaagtgcgtactgtatgc

SEQ ID NO: 6991804 - DNA, 22 bp, Homo sapiens
tcctgtctaaagacctgcaggc

SEQ ID NO: 6991805 - DNA, 18 bp, Homo sapiens
ctgcccagagcatttcat

SEQ ID NO: 6991806 - DNA, 22 bp, Homo sapiens
ctgaaataaagttgctaaaatt

SEQ ID NO: 6991807 - DNA, 22 bp, Homo sapiens
ggtgtggtttgaagggagatgg

SEQ ID NO: 6991808 - DNA, 23 bp, Homo sapiens
acagcaagaggaccagatgtgag

SEQ ID NO: 6991809 - DNA, 22 bp, Homo sapiens
tggctcctttccgggtctccag

SEQ ID NO: 6991810 - DNA, 22 bp, Homo sapiens
ggcctgtgtctgtgcctgtcct

SEQ ID NO: 6991811 - DNA, 22 bp, Homo sapiens
ctaagggcttaatgtgtgtcag

SEQ ID NO: 6991812 - DNA, 22 bp, Homo sapiens
ccttccccaggtgctcactgtc

SEQ ID NO: 6991813 - DNA, 22 bp, Homo sapiens
tcacactttatttatttcatgc

SEQ ID NO: 6991814 - DNA, 22 bp, Homo sapiens
ccttcattattcctgaactgtt

SEQ ID NO: 6991815 - DNA, 18 bp, Homo sapiens
agtggcttcctgctcata

SEQ ID NO: 6991816 - DNA, 22 bp, Homo sapiens
tctgcacatcccccaaagtatt

SEQ ID NO: 6991817 - DNA, 22 bp, Homo sapiens
ggtccttcagtaggttccagac

SEQ ID NO: 6991818 - DNA, 22 bp, Homo sapiens
agatacatagctgtgagcacac

SEQ ID NO: 6991819 - DNA, 22 bp, Homo sapiens
tggttccaagatggctgccaca

SEQ ID NO: 6991820 - DNA, 22 bp, Homo sapiens
agtgaggtaattagagctgctg

SEQ ID NO: 6991821 - DNA, 22 bp, Homo sapiens
ttcttcagtgtagcaactgtat

SEQ ID NO: 6991822 - DNA, 22 bp, Homo sapiens
tttcagggtcagcctgtatgtg

SEQ ID NO: 6991823 - DNA, 22 bp, Homo sapiens
ggatcagaacgtgatggctgtg

SEQ ID NO: 6991824 - DNA, 22 bp, Homo sapiens
atttgctgatcatctagctaat

SEQ ID NO: 6991825 - DNA, 22 bp, Homo sapiens
tagggatgcttagtaggaccca

SEQ ID NO: 6991826 - DNA, 22 bp, Homo sapiens
tccaataaccacaatcagatag

SEQ ID NO: 6991827 - DNA, 18 bp, Homo sapiens
tcctggtggagaagtggt

SEQ ID NO: 6991828 - DNA, 22 bp, Homo sapiens
atggtttcacaaacaaaaggtt

SEQ ID NO: 6991829 - DNA, 22 bp, Homo sapiens
aatcccagctactcaggaagtt

SEQ ID NO: 6991830 - DNA, 22 bp, Homo sapiens
agagctttagctgctggtctgg

SEQ ID NO: 6991831 - DNA, 20 bp, Homo sapiens
ggccttggcctctttgcagc

SEQ ID NO: 6991832 - DNA, 22 bp, Homo sapiens
cttccagtctagagctatctgt

SEQ ID NO: 6991833 - DNA, 22 bp, Homo sapiens
agggtctcagagcctgagaacc

SEQ ID NO: 6991834 - DNA, 22 bp, Homo sapiens
gctgactcagatgcagctggat

SEQ ID NO: 6991835 - DNA, 22 bp, Homo sapiens
agtgctataaaggtagaccaca

SEQ ID NO: 6991836 - DNA, 22 bp, Homo sapiens
tcactgcagagacctctagtca

SEQ ID NO: 6991837 - DNA, 22 bp, Homo sapiens
aaaacctgtgaatagttaactc

SEQ ID NO: 6991838 - DNA, 22 bp, Homo sapiens
cttgagagccactcctggggcc

SEQ ID NO: 6991839 - DNA, 22 bp, Homo sapiens
cataattagagaattcatgtta

SEQ ID NO: 6991840 - DNA, 22 bp, Homo sapiens
acaaaagcactgcagagtaagc

SEQ ID NO: 6991841 - DNA, 22 bp, Homo sapiens
gctccaggagagggaagcagat

SEQ ID NO: 6991842 - DNA, 22 bp, Homo sapiens
atgtcagtctttctgtctcaga

SEQ ID NO: 6991843 - DNA, 22 bp, Homo sapiens
cctcaaatctttagagttattt

SEQ ID NO: 6991844 - DNA, 18 bp, Homo sapiens
ttaagttttactgcttta

SEQ ID NO: 6991845 - DNA, 22 bp, Homo sapiens
cctccaggaacttgagagacac

SEQ ID NO: 6991846 - DNA, 22 bp, Homo sapiens
atgacagcattttcttctaagg

SEQ ID NO: 6991847 - DNA, 22 bp, Homo sapiens
atcattcaaatgatttggaggt

SEQ ID NO: 6991848 - DNA, 22 bp, Homo sapiens
tgggctgctgttacaggggctg

SEQ ID NO: 6991849 - DNA, 22 bp, Homo sapiens
ggcccaaacgggtccagtgaaa

SEQ ID NO: 6991850 - DNA, 22 bp, Homo sapiens
gtcccagaggctttggccacag

SEQ ID NO: 6991851 - DNA, 22 bp, Homo sapiens
tcgtatcctgcttcatgcccag

SEQ ID NO: 6991852 - DNA, 21 bp, Homo sapiens
tttgcttcaattccagaagct

SEQ ID NO: 6991853 - DNA, 21 bp, Homo sapiens
cagagctgaagggtgtagtgt

SEQ ID NO: 6991854 - DNA, 23 bp, Homo sapiens
gctcagaggtgaaatgttttggg

SEQ ID NO: 6991855 - DNA, 22 bp, Homo sapiens
gttacacaggaaaacattagca

SEQ ID NO: 6991856 - DNA, 22 bp, Homo sapiens
tgcatgcatgtgagcatgcata

SEQ ID NO: 6991857 - DNA, 22 bp, Homo sapiens
catgtgtacccttcctctgggg

SEQ ID NO: 6991858 - DNA, 22 bp, Homo sapiens
gagctgggcgagccggggaagt

SEQ ID NO: 6991859 - DNA, 22 bp, Homo sapiens
tccctctcttgggcgtggctca

SEQ ID NO: 6991860 - DNA, 22 bp, Homo sapiens
tttgtatgaactggtatgtagg

SEQ ID NO: 6991861 - DNA, 22 bp, Homo sapiens
ctcagtccacgcagcctcctga

SEQ ID NO: 6991862 - DNA, 22 bp, Homo sapiens
atctgctgcccagccacttgct

SEQ ID NO: 6991863 - DNA, 22 bp, Homo sapiens
gttgtcatcaccgttgttatca

SEQ ID NO: 6991864 - DNA, 22 bp, Homo sapiens
gggggagctagtccagctgagg

SEQ ID NO: 6991865 - DNA, 22 bp, Homo sapiens
atgcactatgatgagctagtct

SEQ ID NO: 6991866 - DNA, 22 bp, Homo sapiens
ttattccccatcttcctctggt

SEQ ID NO: 6991867 - DNA, 22 bp, Homo sapiens
tggctgggtgctatccagtact

SEQ ID NO: 6991868 - DNA, 22 bp, Homo sapiens
tttcgtttgcttatataataga

SEQ ID NO: 6991869 - DNA, 22 bp, Homo sapiens
gctcctggatgttcaagtcggc

SEQ ID NO: 6991870 - DNA, 22 bp, Homo sapiens
gtgtaaaggaatccaggtggtc

SEQ ID NO: 6991871 - DNA, 22 bp, Homo sapiens
tgtgcctggatctctgtgacaa

SEQ ID NO: 6991872 - DNA, 22 bp, Homo sapiens
ctggtccccagactgggcttag

SEQ ID NO: 6991873 - DNA, 22 bp, Homo sapiens
gtcatttaaaagggaacacatg

SEQ ID NO: 6991874 - DNA, 22 bp, Homo sapiens
ttctgaaggtcagcagcttggt

SEQ ID NO: 6991875 - DNA, 22 bp, Homo sapiens
aggctcagatccttgtgtcctg

SEQ ID NO: 6991876 - DNA, 22 bp, Homo sapiens
tgtcagatgtggtcggtttgat

SEQ ID NO: 6991877 - DNA, 22 bp, Homo sapiens
acaggaacccagaaacatttct

SEQ ID NO: 6991878 - DNA, 22 bp, Homo sapiens
aattgagtcatgctgtattgaa

SEQ ID NO: 6991879 - DNA, 22 bp, Homo sapiens
ggaggaaaggctccctccctct

SEQ ID NO: 6991880 - DNA, 22 bp, Homo sapiens
ttttggaacacagacattagaa

SEQ ID NO: 6991881 - DNA, 22 bp, Homo sapiens
ggttgctgggggtggcagagct

SEQ ID NO: 6991882 - DNA, 22 bp, Homo sapiens
tgtcaggtttctccaacttata

SEQ ID NO: 6991883 - DNA, 22 bp, Homo sapiens
ctgtcccacaagcagtgtgcac

SEQ ID NO: 6991884 - DNA, 22 bp, Homo sapiens
tgtaacaaatacccttgaagtt

SEQ ID NO: 6991885 - DNA, 22 bp, Homo sapiens
tggagcaaattcaagctcatct

SEQ ID NO: 6991886 - DNA, 22 bp, Homo sapiens
ttgtcacagcagcaaaggctct

SEQ ID NO: 6991887 - DNA, 22 bp, Homo sapiens
ttcacactttggaattccacct

SEQ ID NO: 6991888 - DNA, 22 bp, Homo sapiens
tgatatgtgaagctattagttc

SEQ ID NO: 6991889 - DNA, 21 bp, Homo sapiens
tcagctgtagagattacattc

SEQ ID NO: 6991890 - DNA, 22 bp, Homo sapiens
taattgctaaatgaaggagaag

SEQ ID NO: 6991891 - DNA, 22 bp, Homo sapiens
tggctcagtgacattcctccca

SEQ ID NO: 6991892 - DNA, 19 bp, Homo sapiens
tgcatggcagatttaactt

SEQ ID NO: 6991893 - DNA, 22 bp, Homo sapiens
agcaggtgtttgtatcataagg

SEQ ID NO: 6991894 - DNA, 22 bp, Homo sapiens
tcatattaacaatgaaactcag

SEQ ID NO: 6991895 - DNA, 22 bp, Homo sapiens
aaagcttaggatagggaatata

SEQ ID NO: 6991896 - DNA, 22 bp, Homo sapiens
tgatgacccaaggtgtcctctg

SEQ ID NO: 6991897 - DNA, 22 bp, Homo sapiens
acttagtagtggaattgctagg

SEQ ID NO: 6991898 - DNA, 22 bp, Homo sapiens
ttggaaaatgaggcacagagag

SEQ ID NO: 6991899 - DNA, 22 bp, Homo sapiens
aggtcagctgcactggtgtaat

SEQ ID NO: 6991900 - DNA, 22 bp, Homo sapiens
gacctggtccttgtactttgaa

SEQ ID NO: 6991901 - DNA, 22 bp, Homo sapiens
cagggagctggtgccagccgac

SEQ ID NO: 6991902 - DNA, 22 bp, Homo sapiens
caggggcttttcctctataagg

SEQ ID NO: 6991903 - DNA, 22 bp, Homo sapiens
acaggaagtttggaaagcctca

SEQ ID NO: 6991904 - DNA, 22 bp, Homo sapiens
agaaggggagaagctaccagga

SEQ ID NO: 6991905 - DNA, 22 bp, Homo sapiens
gctgccagtctaatgggaaaca

SEQ ID NO: 6991906 - DNA, 22 bp, Homo sapiens
acatgtctcatggcagaatttt

SEQ ID NO: 6991907 - DNA, 20 bp, Homo sapiens
atgattctgggctacactgg

SEQ ID NO: 6991908 - DNA, 22 bp, Homo sapiens
gccccagccaaggtgacacgaa

SEQ ID NO: 6991909 - DNA, 22 bp, Homo sapiens
cagctctgggtgacaggagggc

SEQ ID NO: 6991910 - DNA, 22 bp, Homo sapiens
tgttctggctccttttaaatgt

SEQ ID NO: 6991911 - DNA, 22 bp, Homo sapiens
gaatatttgtaattactgttga

SEQ ID NO: 6991912 - DNA, 22 bp, Homo sapiens
ggagagatggaaaacctcccag

SEQ ID NO: 6991913 - DNA, 19 bp, Homo sapiens
tgcagctgtatgagcttaa

SEQ ID NO: 6991914 - DNA, 22 bp, Homo sapiens
gacctgtgcagtgactggtggc

SEQ ID NO: 6991915 - DNA, 22 bp, Homo sapiens
ggctcaggacacagtggtttag

SEQ ID NO: 6991916 - DNA, 22 bp, Homo sapiens
tcaactaactctattatttgaa

SEQ ID NO: 6991917 - DNA, 22 bp, Homo sapiens
aggctggcctatttctttatcg

SEQ ID NO: 6991918 - DNA, 22 bp, Homo sapiens
tctgccagcaccatgatccttc

SEQ ID NO: 6991919 - DNA, 22 bp, Homo sapiens
aagcatgtacaatgagtgtctc

SEQ ID NO: 6991920 - DNA, 22 bp, Homo sapiens
aaggatgaacattaatacatca

SEQ ID NO: 6991921 - DNA, 22 bp, Homo sapiens
aggtggcagcagaatcagggag

SEQ ID NO: 6991922 - DNA, 22 bp, Homo sapiens
tttggaaggtgaggcatgaagg

SEQ ID NO: 6991923 - DNA, 22 bp, Homo sapiens
tattcacatgtacatatgctca

SEQ ID NO: 6991924 - DNA, 22 bp, Homo sapiens
catccatatgaggcacattggt

SEQ ID NO: 6991925 - DNA, 22 bp, Homo sapiens
tgtgtacatgtatcaactatcg

SEQ ID NO: 6991926 - DNA, 22 bp, Homo sapiens
tcaggagcagggggaagctctg

SEQ ID NO: 6991927 - DNA, 22 bp, Homo sapiens
tacacagaaattgtgtagggat

SEQ ID NO: 6991928 - DNA, 22 bp, Homo sapiens
cgcagctgccttgtcagccgtt

SEQ ID NO: 6991929 - DNA, 22 bp, Homo sapiens
ttggcagaattaaccactgaag

SEQ ID NO: 6991930 - DNA, 22 bp, Homo sapiens
tcttggccccaaccctctattt

SEQ ID NO: 6991931 - DNA, 22 bp, Homo sapiens
ttaaatggggatgagtagatgg

SEQ ID NO: 6991932 - DNA, 22 bp, Homo sapiens
ggcagtatgagttcaaataatt

SEQ ID NO: 6991933 - DNA, 21 bp, Homo sapiens
cccttgcctgcactcctcggc

SEQ ID NO: 6991934 - DNA, 22 bp, Homo sapiens
tccccatggaaggatgatggaa

SEQ ID NO: 6991935 - DNA, 17 bp, Homo sapiens
gaacttttattaaattc

SEQ ID NO: 6991936 - DNA, 22 bp, Homo sapiens
cctctgcctttagtgaaagttg

SEQ ID NO: 6991937 - DNA, 22 bp, Homo sapiens
acagcttcacccattatccctg

SEQ ID NO: 6991938 - DNA, 22 bp, Homo sapiens
tctgctgttctcatgctgattt

SEQ ID NO: 6991939 - DNA, 22 bp, Homo sapiens
tagcttcagtggccctagacac

SEQ ID NO: 6991940 - DNA, 22 bp, Homo sapiens
ttccttccagcttgtgacagtc

SEQ ID NO: 6991941 - DNA, 22 bp, Homo sapiens
gatttgtctaggtcatgacttt

SEQ ID NO: 6991942 - DNA, 22 bp, Homo sapiens
ttctgtttctggggtctctgac

SEQ ID NO: 6991943 - DNA, 22 bp, Homo sapiens
aaggccacacttgctggccagc

SEQ ID NO: 6991944 - DNA, 22 bp, Homo sapiens
atgcacagtaatgagctggttg

SEQ ID NO: 6991945 - DNA, 22 bp, Homo sapiens
cctggcttctataccaccaggt

SEQ ID NO: 6991946 - DNA, 22 bp, Homo sapiens
tttacacataaatgtgtagaca

SEQ ID NO: 6991947 - DNA, 22 bp, Homo sapiens
gtggctcagcggagctctgcac

SEQ ID NO: 6991948 - DNA, 22 bp, Homo sapiens
actgaggggctttcaggcccag

SEQ ID NO: 6991949 - DNA, 22 bp, Homo sapiens
atgctttgtggagtattactgt

SEQ ID NO: 6991950 - DNA, 22 bp, Homo sapiens
attattaaagcttaggtcttat

SEQ ID NO: 6991951 - DNA, 22 bp, Homo sapiens
aaagaacttatcctagaatttg

SEQ ID NO: 6991952 - DNA, 22 bp, Homo sapiens
ttcttttagaatttcctaaggt

SEQ ID NO: 6991953 - DNA, 22 bp, Homo sapiens
acatcattttcttcagtgtttg

SEQ ID NO: 6991954 - DNA, 22 bp, Homo sapiens
tccccaggggcctgggcacagt

SEQ ID NO: 6991955 - DNA, 22 bp, Homo sapiens
cagagtggagtttttcagcggg

SEQ ID NO: 6991956 - DNA, 22 bp, Homo sapiens
tacaggtaaaattatcagaaac

SEQ ID NO: 6991957 - DNA, 22 bp, Homo sapiens
cttcataattaccttgtctgcc

SEQ ID NO: 6991958 - DNA, 22 bp, Homo sapiens
ctgcaggattctcccagttgga

SEQ ID NO: 6991959 - DNA, 22 bp, Homo sapiens
ttcctggtttatacctgtatca

SEQ ID NO: 6991960 - DNA, 22 bp, Homo sapiens
ttggccagaatcttcctagtga

SEQ ID NO: 6991961 - DNA, 22 bp, Homo sapiens
tgcaaatgggtgagggttagga

SEQ ID NO: 6991962 - DNA, 22 bp, Homo sapiens
agctttgtgactttgagctagt

SEQ ID NO: 6991963 - DNA, 22 bp, Homo sapiens
tttccaaaggtggcaggaacaa

SEQ ID NO: 6991964 - DNA, 22 bp, Homo sapiens
tcttaggtgactctccaggcca

SEQ ID NO: 6991965 - DNA, 22 bp, Homo sapiens
tgctcctatcctcctgctgaca

SEQ ID NO: 6991966 - DNA, 22 bp, Homo sapiens
gagatacagttggctgcaggct

SEQ ID NO: 6991967 - DNA, 22 bp, Homo sapiens
gcaaggctcacattgaactgaa

SEQ ID NO: 6991968 - DNA, 19 bp, Homo sapiens
caactcttgatactgttag

SEQ ID NO: 6991969 - DNA, 22 bp, Homo sapiens
ggaggccagtcctggccgggct

SEQ ID NO: 6991970 - DNA, 22 bp, Homo sapiens
atctggactggacatagtcttt

SEQ ID NO: 6991971 - DNA, 22 bp, Homo sapiens
atgcacaagaggctagaaaaga

SEQ ID NO: 6991972 - DNA, 22 bp, Homo sapiens
tgtccagtgattctcatgagcc

SEQ ID NO: 6991973 - DNA, 16 bp, Homo sapiens
tgtaggataaccatac

SEQ ID NO: 6991974 - DNA, 22 bp, Homo sapiens
ctagggagactcgcaggactca

SEQ ID NO: 6991975 - DNA, 22 bp, Homo sapiens
atttgtaccatctggtatacag

SEQ ID NO: 6991976 - DNA, 22 bp, Homo sapiens
gtctaagtgggtggcactgaca

SEQ ID NO: 6991977 - DNA, 22 bp, Homo sapiens
tctattgggactctgcggtgag

SEQ ID NO: 6991978 - DNA, 22 bp, Homo sapiens
atgtgagcaggtgctggctgct

SEQ ID NO: 6991979 - DNA, 22 bp, Homo sapiens
agttgaagtcttcaataagctt

SEQ ID NO: 6991980 - DNA, 21 bp, Homo sapiens
caccttggaaggtggagagtt

SEQ ID NO: 6991981 - DNA, 22 bp, Homo sapiens
tcagcccacctggtgtggggct

SEQ ID NO: 6991982 - DNA, 22 bp, Homo sapiens
gcaggcatctctgtagccaggg

SEQ ID NO: 6991983 - DNA, 22 bp, Homo sapiens
ctgggagctgaggctgacgctg

SEQ ID NO: 6991984 - DNA, 19 bp, Homo sapiens
tgctgctacttctctctgt

SEQ ID NO: 6991985 - DNA, 22 bp, Homo sapiens
tcaagcaactgaattctaaaag

SEQ ID NO: 6991986 - DNA, 23 bp, Homo sapiens
agaattgttgttagggaaaagta

SEQ ID NO: 6991987 - DNA, 22 bp, Homo sapiens
tagctgtttctaagtgttgttt

SEQ ID NO: 6991988 - DNA, 22 bp, Homo sapiens
tattaacacgtataaagtgttt

SEQ ID NO: 6991989 - DNA, 22 bp, Homo sapiens
tgggagttgagacattttgccc

SEQ ID NO: 6991990 - DNA, 22 bp, Homo sapiens
cttccgtgtcagttccaggtgg

SEQ ID NO: 6991991 - DNA, 22 bp, Homo sapiens
cagtaactaggacaaggaggaa

SEQ ID NO: 6991992 - DNA, 22 bp, Homo sapiens
aggcttgggtcagaaggcttgt

SEQ ID NO: 6991993 - DNA, 22 bp, Homo sapiens
actctgctgtctgatggcagga

SEQ ID NO: 6991994 - DNA, 22 bp, Homo sapiens
ggcaccagcacttgggatggct

SEQ ID NO: 6991995 - DNA, 22 bp, Homo sapiens
tgagtctgatttttctagcatt

SEQ ID NO: 6991996 - DNA, 22 bp, Homo sapiens
gccaggcattctagaagtagtg

SEQ ID NO: 6991997 - DNA, 22 bp, Homo sapiens
tggtctctacggaggaaagctg

SEQ ID NO: 6991998 - DNA, 22 bp, Homo sapiens
ccagcatgctcagtctaaattg

SEQ ID NO: 6991999 - DNA, 22 bp, Homo sapiens
actgtcatgacgtttgtcaccc

SEQ ID NO: 6992000 - DNA, 22 bp, Homo sapiens
agggttttgtttcttgaagcac

SEQ ID NO: 6992001 - DNA, 22 bp, Homo sapiens
cccagaatgttatagtgcccct

SEQ ID NO: 6992002 - DNA, 22 bp, Homo sapiens
tcagcagggctgtggtgtggct

SEQ ID NO: 6992003 - DNA, 22 bp, Homo sapiens
tggctcctcttctgggtgtccc

SEQ ID NO: 6992004 - DNA, 22 bp, Homo sapiens
cttccttgctgtctgctccagg

SEQ ID NO: 6992005 - DNA, 22 bp, Homo sapiens
tgaatactatttcataatgtgg

SEQ ID NO: 6992006 - DNA, 22 bp, Homo sapiens
agtctacaacgcaagcaacatg

SEQ ID NO: 6992007 - DNA, 16 bp, Homo sapiens
tcagtgttccagaata

SEQ ID NO: 6992008 - DNA, 19 bp, Homo sapiens
cttggagaaggctatgacc

SEQ ID NO: 6992009 - DNA, 22 bp, Homo sapiens
gcagggtggatggcagggccag

SEQ ID NO: 6992010 - DNA, 22 bp, Homo sapiens
aaatatttgtctgaggcggttg

SEQ ID NO: 6992011 - DNA, 17 bp, Homo sapiens
gctgccacctttggagc

SEQ ID NO: 6992012 - DNA, 22 bp, Homo sapiens
gcacccagatattgccttgacc

SEQ ID NO: 6992013 - DNA, 20 bp, Homo sapiens
cgcccaggagggcccatgtg

SEQ ID NO: 6992014 - DNA, 22 bp, Homo sapiens
gcttctgcctcttccactttgc

SEQ ID NO: 6992015 - DNA, 22 bp, Homo sapiens
tataagaatgcttgtttggggt

SEQ ID NO: 6992016 - DNA, 20 bp, Homo sapiens
gccagcacagggagcagttc

SEQ ID NO: 6992017 - DNA, 22 bp, Homo sapiens
cagctcctatgagtatgattcc

SEQ ID NO: 6992018 - DNA, 22 bp, Homo sapiens
taaaggcaattcagcaagccac

SEQ ID NO: 6992019 - DNA, 22 bp, Homo sapiens
gagctggtattccagtttagtt

SEQ ID NO: 6992020 - DNA, 22 bp, Homo sapiens
agcagaattccatgtgagaggg

SEQ ID NO: 6992021 - DNA, 22 bp, Homo sapiens
caatcaggagaaagagcgtgtg

SEQ ID NO: 6992022 - DNA, 19 bp, Homo sapiens
caagggttgggtctgtcat

SEQ ID NO: 6992023 - DNA, 22 bp, Homo sapiens
gttcatccatgtcagcgtatat

SEQ ID NO: 6992024 - DNA, 22 bp, Homo sapiens
tatggatggaaagggccaagct

SEQ ID NO: 6992025 - DNA, 22 bp, Homo sapiens
atctagattaactggctgtctt

SEQ ID NO: 6992026 - DNA, 22 bp, Homo sapiens
tagcttaacagcaaaactgttg

SEQ ID NO: 6992027 - DNA, 22 bp, Homo sapiens
aagcatgtcccttgtgattcaa

SEQ ID NO: 6992028 - DNA, 22 bp, Homo sapiens
tcactgcaagctctgccttccg

SEQ ID NO: 6992029 - DNA, 22 bp, Homo sapiens
aagtacatcaaatgtttggcta

SEQ ID NO: 6992030 - DNA, 22 bp, Homo sapiens
ttccataataggcttaagtgaa

SEQ ID NO: 6992031 - DNA, 22 bp, Homo sapiens
aaccccaggctggaggagtctc

SEQ ID NO: 6992032 - DNA, 22 bp, Homo sapiens
catgtaaagcacttcataacag

SEQ ID NO: 6992033 - DNA, 22 bp, Homo sapiens
tatgggtatcaatgacaaacat

SEQ ID NO: 6992034 - DNA, 22 bp, Homo sapiens
ccactgttggcccgaaggggtc

SEQ ID NO: 6992035 - DNA, 22 bp, Homo sapiens
gagtgtatggaaggaagagatt

SEQ ID NO: 6992036 - DNA, 22 bp, Homo sapiens
ttttaagaaatgtatgactgtc

SEQ ID NO: 6992037 - DNA, 22 bp, Homo sapiens
tgcttgcaagagatgcaatgac

SEQ ID NO: 6992038 - DNA, 23 bp, Homo sapiens
tctgataagggagagggaagcag

SEQ ID NO: 6992039 - DNA, 22 bp, Homo sapiens
atacactaacagtgggtgagtc

SEQ ID NO: 6992040 - DNA, 22 bp, Homo sapiens
agagacctgagatcctcgacat

SEQ ID NO: 6992041 - DNA, 22 bp, Homo sapiens
gaggaggcagcctatcccttag

SEQ ID NO: 6992042 - DNA, 22 bp, Homo sapiens
agggggcattatgaggcttttc

SEQ ID NO: 6992043 - DNA, 23 bp, Homo sapiens
tgggagctcaagggaggctgccc

SEQ ID NO: 6992044 - DNA, 22 bp, Homo sapiens
ctcaaatccccgttcctcattc

SEQ ID NO: 6992045 - DNA, 22 bp, Homo sapiens
tgtatatgtttgtatgtacaca

SEQ ID NO: 6992046 - DNA, 22 bp, Homo sapiens
ctgggcagctgtgcaaacaata

SEQ ID NO: 6992047 - DNA, 22 bp, Homo sapiens
aatgttcagggcagccctgcta

SEQ ID NO: 6992048 - DNA, 22 bp, Homo sapiens
tgcattgagaatttctcaggga

SEQ ID NO: 6992049 - DNA, 22 bp, Homo sapiens
ctcttcctttcccttgagggtg

SEQ ID NO: 6992050 - DNA, 22 bp, Homo sapiens
ccaagataagagacaagattta

SEQ ID NO: 6992051 - DNA, 22 bp, Homo sapiens
gaagccagccttgtctgcctct

SEQ ID NO: 6992052 - DNA, 22 bp, Homo sapiens
gaagaccaccccctacagcaca

SEQ ID NO: 6992053 - DNA, 22 bp, Homo sapiens
tacttaaataattgctgctatt

SEQ ID NO: 6992054 - DNA, 22 bp, Homo sapiens
tgcataactagagtaattacag

SEQ ID NO: 6992055 - DNA, 22 bp, Homo sapiens
aagctatcagctactatcagct

SEQ ID NO: 6992056 - DNA, 22 bp, Homo sapiens
gagaacacttatggattattct

SEQ ID NO: 6992057 - DNA, 22 bp, Homo sapiens
gagggaaaataaaattgcagta

SEQ ID NO: 6992058 - DNA, 22 bp, Homo sapiens
attgagcagacggcactttggc

SEQ ID NO: 6992059 - DNA, 19 bp, Homo sapiens
tccagactgtccaggctat

SEQ ID NO: 6992060 - DNA, 22 bp, Homo sapiens
tggtacaattaaaataattttg

SEQ ID NO: 6992061 - DNA, 23 bp, Homo sapiens
tctctggcctttgatcaggttga

SEQ ID NO: 6992062 - DNA, 22 bp, Homo sapiens
ctgtgtgaatagtgaggtctat

SEQ ID NO: 6992063 - DNA, 22 bp, Homo sapiens
agttttgtaattctcaaaaata

SEQ ID NO: 6992064 - DNA, 22 bp, Homo sapiens
acatgaggaactcaggagtcac

SEQ ID NO: 6992065 - DNA, 20 bp, Homo sapiens
ctggcccaggatgatggcgc

SEQ ID NO: 6992066 - DNA, 22 bp, Homo sapiens
agacactttcagaagtgtttgc

SEQ ID NO: 6992067 - DNA, 22 bp, Homo sapiens
agtacatttttcagtggggagt

SEQ ID NO: 6992068 - DNA, 22 bp, Homo sapiens
ggctgtgtcctgtatgattatt

SEQ ID NO: 6992069 - DNA, 22 bp, Homo sapiens
attttctctttgtatatgctag

SEQ ID NO: 6992070 - DNA, 23 bp, Homo sapiens
agcagcccagatgccttccatcc

SEQ ID NO: 6992071 - DNA, 22 bp, Homo sapiens
tggaagacattattttgtttgt

SEQ ID NO: 6992072 - DNA, 22 bp, Homo sapiens
agcttcataattccttgactca

SEQ ID NO: 6992073 - DNA, 22 bp, Homo sapiens
ttttagtaccaaccagaagatg

SEQ ID NO: 6992074 - DNA, 17 bp, Homo sapiens
tcatttgggcctcacaa

SEQ ID NO: 6992075 - DNA, 22 bp, Homo sapiens
tcagactggcatctaagggctg

SEQ ID NO: 6992076 - DNA, 18 bp, Homo sapiens
gaaggcattcagtggctt

SEQ ID NO: 6992077 - DNA, 22 bp, Homo sapiens
atgaggcctatcttggcagagg

SEQ ID NO: 6992078 - DNA, 22 bp, Homo sapiens
agagacagggttttgccatgtt

SEQ ID NO: 6992079 - DNA, 22 bp, Homo sapiens
tgggttttgtgaccatagatta

SEQ ID NO: 6992080 - DNA, 22 bp, Homo sapiens
taatgcacatgactgaactatt

SEQ ID NO: 6992081 - DNA, 22 bp, Homo sapiens
acatttgataattataaagaca

SEQ ID NO: 6992082 - DNA, 20 bp, Homo sapiens
gcaggtccctggcatgcaga

SEQ ID NO: 6992083 - DNA, 22 bp, Homo sapiens
actggagttttaaaggaacttg

SEQ ID NO: 6992084 - DNA, 22 bp, Homo sapiens
agggctgtttttcagtgtgtga

SEQ ID NO: 6992085 - DNA, 21 bp, Homo sapiens
gagatgtgagctctgatagtc

SEQ ID NO: 6992086 - DNA, 22 bp, Homo sapiens
tgtgcctttcttcccaagtaga

SEQ ID NO: 6992087 - DNA, 22 bp, Homo sapiens
gccaggctgtggggaacttgaa

SEQ ID NO: 6992088 - DNA, 22 bp, Homo sapiens
gctctctgcagcctccttggag

SEQ ID NO: 6992089 - DNA, 22 bp, Homo sapiens
ccagtgtgtttttctctgactc

SEQ ID NO: 6992090 - DNA, 22 bp, Homo sapiens
ggcacagctgatgcagacacac

SEQ ID NO: 6992091 - DNA, 23 bp, Homo sapiens
ttagccattccactgacatttga

SEQ ID NO: 6992092 - DNA, 22 bp, Homo sapiens
tgtgaggagggtcaaactgagt

SEQ ID NO: 6992093 - DNA, 22 bp, Homo sapiens
attgaaagataggctactgtgg

SEQ ID NO: 6992094 - DNA, 21 bp, Homo sapiens
tgctgccatagacctgaggga

SEQ ID NO: 6992095 - DNA, 22 bp, Homo sapiens
actgtacaactgctgagcagaa

SEQ ID NO: 6992096 - DNA, 22 bp, Homo sapiens
gcttctggcagtgcagccacca

SEQ ID NO: 6992097 - DNA, 22 bp, Homo sapiens
tctcttaattcagaggcagtta

SEQ ID NO: 6992098 - DNA, 22 bp, Homo sapiens
taatggagatttagcacttacg

SEQ ID NO: 6992099 - DNA, 22 bp, Homo sapiens
cagcatgtaagccactgccctg

SEQ ID NO: 6992100 - DNA, 22 bp, Homo sapiens
cctgttcaccatggtcacgtgc

SEQ ID NO: 6992101 - DNA, 19 bp, Homo sapiens
tatgttatgttgtttactc

SEQ ID NO: 6992102 - DNA, 19 bp, Homo sapiens
agcaggccaggcaggtggc

SEQ ID NO: 6992103 - DNA, 22 bp, Homo sapiens
tcacaaggtcctggtggataga

SEQ ID NO: 6992104 - DNA, 22 bp, Homo sapiens
acgggcagacagagctactcgc

SEQ ID NO: 6992105 - DNA, 22 bp, Homo sapiens
ttacagtacctgtatggccact

SEQ ID NO: 6992106 - DNA, 21 bp, Homo sapiens
tggaaaaatgtggcctagtga

SEQ ID NO: 6992107 - DNA, 22 bp, Homo sapiens
ctgcgtgtctccttggggcaga

SEQ ID NO: 6992108 - DNA, 22 bp, Homo sapiens
tgaagtcttccagggaaacgtg

SEQ ID NO: 6992109 - DNA, 22 bp, Homo sapiens
ggaaaggcctgggtgtcctggg

SEQ ID NO: 6992110 - DNA, 22 bp, Homo sapiens
ttgctaggattcattctatact

SEQ ID NO: 6992111 - DNA, 22 bp, Homo sapiens
tctcagagtttacggggctgaa

SEQ ID NO: 6992112 - DNA, 19 bp, Homo sapiens
acagttctaatttctgtgg

SEQ ID NO: 6992113 - DNA, 22 bp, Homo sapiens
gagctttaagggcactggtctt

SEQ ID NO: 6992114 - DNA, 22 bp, Homo sapiens
ctgactgtaattctgttcttaa

SEQ ID NO: 6992115 - DNA, 22 bp, Homo sapiens
cattagcaatcataaaccttta

SEQ ID NO: 6992116 - DNA, 22 bp, Homo sapiens
gtcagctgcacaggtgggagct

SEQ ID NO: 6992117 - DNA, 22 bp, Homo sapiens
aattgtaactacattgagaaca

SEQ ID NO: 6992118 - DNA, 22 bp, Homo sapiens
ctgcagcctcctccagctacgt

SEQ ID NO: 6992119 - DNA, 22 bp, Homo sapiens
agctttggagctgggtgaaaga

SEQ ID NO: 6992120 - DNA, 22 bp, Homo sapiens
tactaaatgattaagcaggaat

SEQ ID NO: 6992121 - DNA, 22 bp, Homo sapiens
ctatacagtaaccacagtgatt

SEQ ID NO: 6992122 - DNA, 22 bp, Homo sapiens
accaccaggggattttcagaac

SEQ ID NO: 6992123 - DNA, 22 bp, Homo sapiens
ttactttggatggtcaagaaag

SEQ ID NO: 6992124 - DNA, 22 bp, Homo sapiens
tagcagtgccctgtggaataag

SEQ ID NO: 6992125 - DNA, 22 bp, Homo sapiens
gtgtctacaggatggagtggct

SEQ ID NO: 6992126 - DNA, 22 bp, Homo sapiens
agccggccatgtggtcttgtgc

SEQ ID NO: 6992127 - DNA, 22 bp, Homo sapiens
ggacactgtataagttagagta

SEQ ID NO: 6992128 - DNA, 21 bp, Homo sapiens
ttttctccagctgtgatttta

SEQ ID NO: 6992129 - DNA, 22 bp, Homo sapiens
cctggcaggtagcattgaggag

SEQ ID NO: 6992130 - DNA, 22 bp, Homo sapiens
aggtcacagctttctcgtgagg

SEQ ID NO: 6992131 - DNA, 23 bp, Homo sapiens
agggtgcatttcacttacagacc

SEQ ID NO: 6992132 - DNA, 22 bp, Homo sapiens
cccagaaggctaagcgtggatt

SEQ ID NO: 6992133 - DNA, 22 bp, Homo sapiens
tgccaagaggtccaggtgggaa

SEQ ID NO: 6992134 - DNA, 22 bp, Homo sapiens
ttcttaatacctattttctacc

SEQ ID NO: 6992135 - DNA, 22 bp, Homo sapiens
agtcagtcacaaaggaccacat

SEQ ID NO: 6992136 - DNA, 22 bp, Homo sapiens
ctgcatgtgttatatttggttc

SEQ ID NO: 6992137 - DNA, 22 bp, Homo sapiens
atttgttgttgctcccctaaga

SEQ ID NO: 6992138 - DNA, 22 bp, Homo sapiens
agttttcaatatatgatagtga

SEQ ID NO: 6992139 - DNA, 22 bp, Homo sapiens
gctctctttcacagaggtagga

SEQ ID NO: 6992140 - DNA, 22 bp, Homo sapiens
agcctgtgggagccgctcccgt

SEQ ID NO: 6992141 - DNA, 22 bp, Homo sapiens
aatgttagtaacttgagtattt

SEQ ID NO: 6992142 - DNA, 22 bp, Homo sapiens
aaacatagcacacacagctctt

SEQ ID NO: 6992143 - DNA, 20 bp, Homo sapiens
ccctgtgattggcaagtgtc

SEQ ID NO: 6992144 - DNA, 20 bp, Homo sapiens
aatgaagttattaatgatgt

SEQ ID NO: 6992145 - DNA, 22 bp, Homo sapiens
tcttgccttatgccatgaagca

SEQ ID NO: 6992146 - DNA, 16 bp, Homo sapiens
acagccttcttctttg

SEQ ID NO: 6992147 - DNA, 21 bp, Homo sapiens
gaacatttgggttgtttctac

SEQ ID NO: 6992148 - DNA, 22 bp, Homo sapiens
taccatttcagtaaaaacttag

SEQ ID NO: 6992149 - DNA, 21 bp, Homo sapiens
tgtttaagtactcctttctgg

SEQ ID NO: 6992150 - DNA, 22 bp, Homo sapiens
cacatgtttgctacatttttct

SEQ ID NO: 6992151 - DNA, 20 bp, Homo sapiens
ttcctggctctaggaccttg

SEQ ID NO: 6992152 - DNA, 21 bp, Homo sapiens
tctgggcagcccagtcctgag

SEQ ID NO: 6992153 - DNA, 22 bp, Homo sapiens
gtatttgatagatttcaaagga

SEQ ID NO: 6992154 - DNA, 22 bp, Homo sapiens
ttcaagtagaaagtattgatga

SEQ ID NO: 6992155 - DNA, 22 bp, Homo sapiens
atgagtgcttagagagtaatcc

SEQ ID NO: 6992156 - DNA, 22 bp, Homo sapiens
ggtcatgcagccttcaaaagag

SEQ ID NO: 6992157 - DNA, 22 bp, Homo sapiens
aattggcaagcagatttccact

SEQ ID NO: 6992158 - DNA, 22 bp, Homo sapiens
agcccagcactgggggcccagc

SEQ ID NO: 6992159 - DNA, 19 bp, Homo sapiens
tggtcagcattaggatttg

SEQ ID NO: 6992160 - DNA, 22 bp, Homo sapiens
aatgaattctgaagtcttccaa

SEQ ID NO: 6992161 - DNA, 22 bp, Homo sapiens
caaggaagttttaggagaggaa

SEQ ID NO: 6992162 - DNA, 22 bp, Homo sapiens
catggcattttttcatggagac

SEQ ID NO: 6992163 - DNA, 22 bp, Homo sapiens
tgctgcttcacctgttgtacag

SEQ ID NO: 6992164 - DNA, 22 bp, Homo sapiens
gaacacatgtcctccttggatt

SEQ ID NO: 6992165 - DNA, 22 bp, Homo sapiens
accaggagccacaggaggagcc

SEQ ID NO: 6992166 - DNA, 22 bp, Homo sapiens
gtgcaatgaaactgttttgtgg

SEQ ID NO: 6992167 - DNA, 22 bp, Homo sapiens
acacaattgactgttgtccctt

SEQ ID NO: 6992168 - DNA, 22 bp, Homo sapiens
tattagcagacaagctgctgga

SEQ ID NO: 6992169 - DNA, 22 bp, Homo sapiens
actcatggtagcacaggctgtg

SEQ ID NO: 6992170 - DNA, 22 bp, Homo sapiens
attaaggaatgtaggcaagaag

SEQ ID NO: 6992171 - DNA, 22 bp, Homo sapiens
ccccaggaagcctcagatttgc

SEQ ID NO: 6992172 - DNA, 22 bp, Homo sapiens
tcaaggtcctaattgtcctttt

SEQ ID NO: 6992173 - DNA, 22 bp, Homo sapiens
tatgatattctaaattgacacc

SEQ ID NO: 6992174 - DNA, 20 bp, Homo sapiens
cctcaggatgagggtgagca

SEQ ID NO: 6992175 - DNA, 22 bp, Homo sapiens
attctttacattggcttcttcc

SEQ ID NO: 6992176 - DNA, 22 bp, Homo sapiens
tgaagaataagatagatggagc

SEQ ID NO: 6992177 - DNA, 22 bp, Homo sapiens
taggtgcctcggagaaaggacc

SEQ ID NO: 6992178 - DNA, 22 bp, Homo sapiens
gcttctccctacagatgtcagt

SEQ ID NO: 6992179 - DNA, 22 bp, Homo sapiens
agacagtggctcagccccagtc

SEQ ID NO: 6992180 - DNA, 22 bp, Homo sapiens
tccttgggaaacatcatgtaat

SEQ ID NO: 6992181 - DNA, 22 bp, Homo sapiens
acacatctccagccagcaggag

SEQ ID NO: 6992182 - DNA, 22 bp, Homo sapiens
gaatttcaaagaggttaagagg

SEQ ID NO: 6992183 - DNA, 22 bp, Homo sapiens
tctgggcagaagcagtgcaaag

SEQ ID NO: 6992184 - DNA, 22 bp, Homo sapiens
tatgcactggtactattcgtgt

SEQ ID NO: 6992185 - DNA, 22 bp, Homo sapiens
agtgctcatgcacatttatagt

SEQ ID NO: 6992186 - DNA, 22 bp, Homo sapiens
agaagcagaaaagggcactttt

SEQ ID NO: 6992187 - DNA, 22 bp, Homo sapiens
ctggccagggtgcgatcgtggt

SEQ ID NO: 6992188 - DNA, 22 bp, Homo sapiens
acatttgaagacgacagtggaa

SEQ ID NO: 6992189 - DNA, 22 bp, Homo sapiens
ccaggtaacttgagaacatgag

SEQ ID NO: 6992190 - DNA, 22 bp, Homo sapiens
attggttaccactttaaatctt

SEQ ID NO: 6992191 - DNA, 19 bp, Homo sapiens
ttctctgtgctagactctg

SEQ ID NO: 6992192 - DNA, 20 bp, Homo sapiens
agtccaaagcctgtttactt

SEQ ID NO: 6992193 - DNA, 22 bp, Homo sapiens
tatgagtgtgtgtagaaggtac

SEQ ID NO: 6992194 - DNA, 22 bp, Homo sapiens
tcagactgctgtccctgcctgg

SEQ ID NO: 6992195 - DNA, 22 bp, Homo sapiens
aaacttttcctgctcttgtcct

SEQ ID NO: 6992196 - DNA, 22 bp, Homo sapiens
caaattcctcagaatcagaaaa

SEQ ID NO: 6992197 - DNA, 22 bp, Homo sapiens
gatgtctgggtgaggtctactg

SEQ ID NO: 6992198 - DNA, 20 bp, Homo sapiens
caccctacggcctcacctcc

SEQ ID NO: 6992199 - DNA, 17 bp, Homo sapiens
aaatatgacctcaaagt

SEQ ID NO: 6992200 - DNA, 22 bp, Homo sapiens
catgtgcagacggtgggctgga

SEQ ID NO: 6992201 - DNA, 22 bp, Homo sapiens
tgggtccacggaagacttaggg

SEQ ID NO: 6992202 - DNA, 22 bp, Homo sapiens
tttagagttgtagctctcagct

SEQ ID NO: 6992203 - DNA, 22 bp, Homo sapiens
aaacacattttaggaaaatcta

SEQ ID NO: 6992204 - DNA, 22 bp, Homo sapiens
catctgctgctgaagccagcat

SEQ ID NO: 6992205 - DNA, 22 bp, Homo sapiens
ccacagtgcctggaattctgca

SEQ ID NO: 6992206 - DNA, 22 bp, Homo sapiens
ccatcctgaatggtctcagcca

SEQ ID NO: 6992207 - DNA, 22 bp, Homo sapiens
tgatggtagggatactacagga

SEQ ID NO: 6992208 - DNA, 22 bp, Homo sapiens
aaagtacccaagaacagagtga

SEQ ID NO: 6992209 - DNA, 18 bp, Homo sapiens
acccagtttgaaggaaag

SEQ ID NO: 6992210 - DNA, 22 bp, Homo sapiens
tttgttgagttacagagatgaa

SEQ ID NO: 6992211 - DNA, 22 bp, Homo sapiens
aatgtgttatttcagaatccag

SEQ ID NO: 6992212 - DNA, 22 bp, Homo sapiens
gctgaatgaatgtattttaaaa

SEQ ID NO: 6992213 - DNA, 21 bp, Homo sapiens
atggtaccttagaagacatgc

SEQ ID NO: 6992214 - DNA, 22 bp, Homo sapiens
cactgatactatagagacctca

SEQ ID NO: 6992215 - DNA, 22 bp, Homo sapiens
ggtggcagttacaggggcaaat

SEQ ID NO: 6992216 - DNA, 22 bp, Homo sapiens
gtcataaaatttgtggattaga

SEQ ID NO: 6992217 - DNA, 22 bp, Homo sapiens
ggtcagtgagacaatttaagcc

SEQ ID NO: 6992218 - DNA, 22 bp, Homo sapiens
ttgatgatgcacatttataatt

SEQ ID NO: 6992219 - DNA, 22 bp, Homo sapiens
tgcacaaagcattctagacgca

SEQ ID NO: 6992220 - DNA, 19 bp, Homo sapiens
atgatggattaacggaagt

SEQ ID NO: 6992221 - DNA, 22 bp, Homo sapiens
aaatgcactgaacacatgttgt

SEQ ID NO: 6992222 - DNA, 22 bp, Homo sapiens
aagcatttggttctgaagactc

SEQ ID NO: 6992223 - DNA, 22 bp, Homo sapiens
tttctaaactggattcagcctg

SEQ ID NO: 6992224 - DNA, 22 bp, Homo sapiens
aggctgcttcttgtccttggca

SEQ ID NO: 6992225 - DNA, 21 bp, Homo sapiens
cccacggaatgatgaggcact

SEQ ID NO: 6992226 - DNA, 22 bp, Homo sapiens
agttagaaagtaaatcatttga

SEQ ID NO: 6992227 - DNA, 22 bp, Homo sapiens
gctagcctgcagtggctatggt

SEQ ID NO: 6992228 - DNA, 22 bp, Homo sapiens
tatttctattccccaggcaagt

SEQ ID NO: 6992229 - DNA, 22 bp, Homo sapiens
acagtggcagtattagggcaga

SEQ ID NO: 6992230 - DNA, 22 bp, Homo sapiens
atgttagagacagatgatgagt

SEQ ID NO: 6992231 - DNA, 22 bp, Homo sapiens
ttgcagttttctgcctcatttc

SEQ ID NO: 6992232 - DNA, 22 bp, Homo sapiens
cttagcttgttttcacctaaga

SEQ ID NO: 6992233 - DNA, 22 bp, Homo sapiens
ctcagcatggagggagaacaag

SEQ ID NO: 6992234 - DNA, 17 bp, Homo sapiens
tggcaagacagctcagg

SEQ ID NO: 6992235 - DNA, 22 bp, Homo sapiens
acagcaagccagcttgtcactg

SEQ ID NO: 6992236 - DNA, 22 bp, Homo sapiens
ccaggaggcagaagttgcagtg

SEQ ID NO: 6992237 - DNA, 22 bp, Homo sapiens
tgcctgcctcaggccgagtgct

SEQ ID NO: 6992238 - DNA, 22 bp, Homo sapiens
aagtgaaattgccattcttata

SEQ ID NO: 6992239 - DNA, 22 bp, Homo sapiens
aattgctcccattgtgcaccct

SEQ ID NO: 6992240 - DNA, 22 bp, Homo sapiens
tgcttccttcccgttcttctcc

SEQ ID NO: 6992241 - DNA, 22 bp, Homo sapiens
aattgttgggtattcctgtgac

SEQ ID NO: 6992242 - DNA, 23 bp, Homo sapiens
atgagcatttttaatttctgtgg

SEQ ID NO: 6992243 - DNA, 23 bp, Homo sapiens
gaagtgtctgagctgtatttttc

SEQ ID NO: 6992244 - DNA, 22 bp, Homo sapiens
gtaaatataaatgctagctgcc

SEQ ID NO: 6992245 - DNA, 22 bp, Homo sapiens
agctagttaaactatgaataca

SEQ ID NO: 6992246 - DNA, 22 bp, Homo sapiens
aaggcagcatgaatccctgtac

SEQ ID NO: 6992247 - DNA, 22 bp, Homo sapiens
atgctacatagatacaaaaatg

SEQ ID NO: 6992248 - DNA, 22 bp, Homo sapiens
ctccttccctaccatcaatgtt

SEQ ID NO: 6992249 - DNA, 22 bp, Homo sapiens
tcggaatgtagtaaatctttct

SEQ ID NO: 6992250 - DNA, 23 bp, Homo sapiens
gcctggcaaagcactaccgagag

SEQ ID NO: 6992251 - DNA, 22 bp, Homo sapiens
aataatgtgtgctgcagtctta

SEQ ID NO: 6992252 - DNA, 19 bp, Homo sapiens
gtgaacaaggagaatggga

SEQ ID NO: 6992253 - DNA, 22 bp, Homo sapiens
aaggtgtcaccagattggcagg

SEQ ID NO: 6992254 - DNA, 22 bp, Homo sapiens
tgtgccaatctgctgactgtct

SEQ ID NO: 6992255 - DNA, 22 bp, Homo sapiens
tgaggcacatccaggccagctc

SEQ ID NO: 6992256 - DNA, 22 bp, Homo sapiens
tcagagagttggaaagaattaa

SEQ ID NO: 6992257 - DNA, 22 bp, Homo sapiens
cctgattctgatgcctcatgga

SEQ ID NO: 6992258 - DNA, 21 bp, Homo sapiens
gacaggggccatgggtttcta

SEQ ID NO: 6992259 - DNA, 22 bp, Homo sapiens
taagaacagtgacagccaacat

SEQ ID NO: 6992260 - DNA, 22 bp, Homo sapiens
ggagtgtcccgattttccaggt

SEQ ID NO: 6992261 - DNA, 22 bp, Homo sapiens
gtagtcttttcaatgattgtgt

SEQ ID NO: 6992262 - DNA, 22 bp, Homo sapiens
aacagttaatgaagaggaagcc

SEQ ID NO: 6992263 - DNA, 22 bp, Homo sapiens
tctgggccagtgatttttccag

SEQ ID NO: 6992264 - DNA, 22 bp, Homo sapiens
cgtgggagtggtgggtgctcag

SEQ ID NO: 6992265 - DNA, 19 bp, Homo sapiens
gcagcaaacaaaacaggta

SEQ ID NO: 6992266 - DNA, 23 bp, Homo sapiens
acttttcaattagctatgcttaa

SEQ ID NO: 6992267 - DNA, 22 bp, Homo sapiens
tagtcctgaccttgccaccagc

SEQ ID NO: 6992268 - DNA, 22 bp, Homo sapiens
tgcaggaacataggttccttgg

SEQ ID NO: 6992269 - DNA, 22 bp, Homo sapiens
gggccagtgaacaatgagggaa

SEQ ID NO: 6992270 - DNA, 22 bp, Homo sapiens
gggatgtcgtgggtggcagctg

SEQ ID NO: 6992271 - DNA, 22 bp, Homo sapiens
tattttctggggagagtgaacc

SEQ ID NO: 6992272 - DNA, 20 bp, Homo sapiens
gccacctctctagcagtaga

SEQ ID NO: 6992273 - DNA, 22 bp, Homo sapiens
gagctcccaggccccagcaagg

SEQ ID NO: 6992274 - DNA, 22 bp, Homo sapiens
tgaaacaaaattaagattctcg

SEQ ID NO: 6992275 - DNA, 22 bp, Homo sapiens
taggggagctcgggtgcaatcg

SEQ ID NO: 6992276 - DNA, 20 bp, Homo sapiens
cctgtctcctcttacctggc

SEQ ID NO: 6992277 - DNA, 22 bp, Homo sapiens
atctggaaaacacagtgtagac

SEQ ID NO: 6992278 - DNA, 22 bp, Homo sapiens
ttgaagagcaccagcattttga

SEQ ID NO: 6992279 - DNA, 16 bp, Homo sapiens
ccttggcatcagctgt

SEQ ID NO: 6992280 - DNA, 22 bp, Homo sapiens
aggctgattgaagtttttgtgg

SEQ ID NO: 6992281 - DNA, 22 bp, Homo sapiens
cttggagatacaagtggtacct

SEQ ID NO: 6992282 - DNA, 17 bp, Homo sapiens
tgaattcaatctgcact

SEQ ID NO: 6992283 - DNA, 22 bp, Homo sapiens
agtgctcactctccacagtgcc

SEQ ID NO: 6992284 - DNA, 22 bp, Homo sapiens
ggaagggcaataaaatctcagg

SEQ ID NO: 6992285 - DNA, 22 bp, Homo sapiens
actttgttgaagaatatgttag

SEQ ID NO: 6992286 - DNA, 22 bp, Homo sapiens
cgcggtctctttaaggcgggtc

SEQ ID NO: 6992287 - DNA, 22 bp, Homo sapiens
caggccagaggctgttgttgcg

SEQ ID NO: 6992288 - DNA, 22 bp, Homo sapiens
tcctccaggcacctcactggct

SEQ ID NO: 6992289 - DNA, 22 bp, Homo sapiens
ttgaggagtgtgaggtctccca

SEQ ID NO: 6992290 - DNA, 20 bp, Homo sapiens
agctggagaagggcccttcc

SEQ ID NO: 6992291 - DNA, 22 bp, Homo sapiens
atgttgggaaggccgcaggcac

SEQ ID NO: 6992292 - DNA, 22 bp, Homo sapiens
tcaggcaggaagggaggacttg

SEQ ID NO: 6992293 - DNA, 22 bp, Homo sapiens
gggagggaaagcttgatctgtc

SEQ ID NO: 6992294 - DNA, 22 bp, Homo sapiens
aaatgtacgggagtagaattag

SEQ ID NO: 6992295 - DNA, 22 bp, Homo sapiens
atccagttaagatgaggtcata

SEQ ID NO: 6992296 - DNA, 22 bp, Homo sapiens
tttgatctcccagactaaggag

SEQ ID NO: 6992297 - DNA, 22 bp, Homo sapiens
caaataagcaattccattcttc

SEQ ID NO: 6992298 - DNA, 22 bp, Homo sapiens
tagatgtaagcagaagaacagc

SEQ ID NO: 6992299 - DNA, 22 bp, Homo sapiens
tccagagctctgggcatagctg

SEQ ID NO: 6992300 - DNA, 22 bp, Homo sapiens
attattctttgataaatggcag

SEQ ID NO: 6992301 - DNA, 22 bp, Homo sapiens
ttcctcaggctgctttcacata

SEQ ID NO: 6992302 - DNA, 20 bp, Homo sapiens
ttttcctgtggtttgatatg

SEQ ID NO: 6992303 - DNA, 22 bp, Homo sapiens
cccttgggccccagctcagggc

SEQ ID NO: 6992304 - DNA, 22 bp, Homo sapiens
ctgtggctggctcatcataggt

SEQ ID NO: 6992305 - DNA, 21 bp, Homo sapiens
caatgtctgctctctgcctag

SEQ ID NO: 6992306 - DNA, 22 bp, Homo sapiens
ataagtgcttgttgaataatag

SEQ ID NO: 6992307 - DNA, 20 bp, Homo sapiens
tgaaatagatactcagagat

SEQ ID NO: 6992308 - DNA, 22 bp, Homo sapiens
ggaaggagggcggcaatgatga

SEQ ID NO: 6992309 - DNA, 18 bp, Homo sapiens
agctcacagatctgtttt

SEQ ID NO: 6992310 - DNA, 22 bp, Homo sapiens
gaacagatgggctcagatcctg

SEQ ID NO: 6992311 - DNA, 22 bp, Homo sapiens
ctaatacaccctattgcttgtt

SEQ ID NO: 6992312 - DNA, 22 bp, Homo sapiens
gcacagtggagtgtgtccaggg

SEQ ID NO: 6992313 - DNA, 22 bp, Homo sapiens
cccagactcctctggctggtgg

SEQ ID NO: 6992314 - DNA, 22 bp, Homo sapiens
gtaataagaaacagcaattatt

SEQ ID NO: 6992315 - DNA, 22 bp, Homo sapiens
atttggtcatgttcagtgtaga

SEQ ID NO: 6992316 - DNA, 22 bp, Homo sapiens
taaatagaatctaaactgctca

SEQ ID NO: 6992317 - DNA, 22 bp, Homo sapiens
tggggagattgttaaatttaga

SEQ ID NO: 6992318 - DNA, 22 bp, Homo sapiens
ttcatggagttgagaaggctaa

SEQ ID NO: 6992319 - DNA, 22 bp, Homo sapiens
tctgggttcaaggggagtctgc

SEQ ID NO: 6992320 - DNA, 18 bp, Homo sapiens
agggatcatcactgcagc

SEQ ID NO: 6992321 - DNA, 17 bp, Homo sapiens
tgctacctttgggctcc

SEQ ID NO: 6992322 - DNA, 23 bp, Homo sapiens
aagtccacacgtagtgaaacagt

SEQ ID NO: 6992323 - DNA, 22 bp, Homo sapiens
aatcttcacagaaaaatgtctg

SEQ ID NO: 6992324 - DNA, 22 bp, Homo sapiens
tttgtacatcctaattctgagt

SEQ ID NO: 6992325 - DNA, 22 bp, Homo sapiens
aatctcatttacaacatgagga

SEQ ID NO: 6992326 - DNA, 19 bp, Homo sapiens
ttcaccatctcaccaaacc

SEQ ID NO: 6992327 - DNA, 22 bp, Homo sapiens
actttgttgatgaaatagtttt

SEQ ID NO: 6992328 - DNA, 22 bp, Homo sapiens
aaaggcttcacttatttatttt

SEQ ID NO: 6992329 - DNA, 22 bp, Homo sapiens
agaggcctgtgtgctccagtgg

SEQ ID NO: 6992330 - DNA, 22 bp, Homo sapiens
tatgtcttgcatttttcaaact

SEQ ID NO: 6992331 - DNA, 22 bp, Homo sapiens
attcacaattagaagtagataa

SEQ ID NO: 6992332 - DNA, 22 bp, Homo sapiens
tcctggagtggagtctgttgtt

SEQ ID NO: 6992333 - DNA, 22 bp, Homo sapiens
ggaggccatctggctggaggct

SEQ ID NO: 6992334 - DNA, 22 bp, Homo sapiens
tgtgtacaaactaacaacatat

SEQ ID NO: 6992335 - DNA, 22 bp, Homo sapiens
aggtgaatgctcacattctaat

SEQ ID NO: 6992336 - DNA, 22 bp, Homo sapiens
aagcgcaggactggctcacggc

SEQ ID NO: 6992337 - DNA, 21 bp, Homo sapiens
ctgtgggaccaagcactggga

SEQ ID NO: 6992338 - DNA, 20 bp, Homo sapiens
gcctggagttagttttcctt

SEQ ID NO: 6992339 - DNA, 22 bp, Homo sapiens
tctccaaatagttatatttaga

SEQ ID NO: 6992340 - DNA, 20 bp, Homo sapiens
agggtctgctgggtaggaca

SEQ ID NO: 6992341 - DNA, 22 bp, Homo sapiens
gtaagcctctgctctatctggt

SEQ ID NO: 6992342 - DNA, 22 bp, Homo sapiens
cagagtcatatcagagaatatg

SEQ ID NO: 6992343 - DNA, 22 bp, Homo sapiens
gcaggcagagtcaatttgatcc

SEQ ID NO: 6992344 - DNA, 22 bp, Homo sapiens
tgcagtgcctcggcagtgcagc

SEQ ID NO: 6992345 - DNA, 22 bp, Homo sapiens
ggcagggtgtggagttgggaca

SEQ ID NO: 6992346 - DNA, 22 bp, Homo sapiens
gcagtgtttcaaatcaaaggca

SEQ ID NO: 6992347 - DNA, 19 bp, Homo sapiens
ctaaacttatgtgaccaca

SEQ ID NO: 6992348 - DNA, 20 bp, Homo sapiens
ttctagcatacttacaagga

SEQ ID NO: 6992349 - DNA, 22 bp, Homo sapiens
tattggacagtccagtgagaat

SEQ ID NO: 6992350 - DNA, 22 bp, Homo sapiens
ctttcatgaacagacaaggaac

SEQ ID NO: 6992351 - DNA, 22 bp, Homo sapiens
tgtttacatatttggtctcaga

SEQ ID NO: 6992352 - DNA, 22 bp, Homo sapiens
caggctgattaggcctcgtcca

SEQ ID NO: 6992353 - DNA, 22 bp, Homo sapiens
gcctgttttagatgcattgatg

SEQ ID NO: 6992354 - DNA, 22 bp, Homo sapiens
tcctgaacagtgtagcagagag

SEQ ID NO: 6992355 - DNA, 22 bp, Homo sapiens
atgtcacagtctgactcagtga

SEQ ID NO: 6992356 - DNA, 22 bp, Homo sapiens
ggaaagagttttggtatatttg

SEQ ID NO: 6992357 - DNA, 22 bp, Homo sapiens
cactgcacttcagcctgggcga

SEQ ID NO: 6992358 - DNA, 22 bp, Homo sapiens
tgctgggcactgtctctgggga

SEQ ID NO: 6992359 - DNA, 22 bp, Homo sapiens
taaaggcttttagtgatggtaa

SEQ ID NO: 6992360 - DNA, 22 bp, Homo sapiens
cttcttgttttagccctcatac

SEQ ID NO: 6992361 - DNA, 20 bp, Homo sapiens
gttattgcgtaagactcgct

SEQ ID NO: 6992362 - DNA, 22 bp, Homo sapiens
ctctgagcccgctgcagcccca

SEQ ID NO: 6992363 - DNA, 22 bp, Homo sapiens
gcattcttgaggtgtggactca

SEQ ID NO: 6992364 - DNA, 22 bp, Homo sapiens
cttgtggacactcgtgatctcc

SEQ ID NO: 6992365 - DNA, 22 bp, Homo sapiens
gcactgtgacagcaagagtgag

SEQ ID NO: 6992366 - DNA, 22 bp, Homo sapiens
tgtagccaccaggctggatctg

SEQ ID NO: 6992367 - DNA, 21 bp, Homo sapiens
atctccccttccttgtaggtg

SEQ ID NO: 6992368 - DNA, 22 bp, Homo sapiens
ggcacttgcttgctgcctttat

SEQ ID NO: 6992369 - DNA, 20 bp, Homo sapiens
tttggcttcaagtgcattgc

SEQ ID NO: 6992370 - DNA, 22 bp, Homo sapiens
tgtctcagtacactccgatgtt

SEQ ID NO: 6992371 - DNA, 22 bp, Homo sapiens
gatgtttctgggaaggaaaagt

SEQ ID NO: 6992372 - DNA, 22 bp, Homo sapiens
tcaagctggctgttgctatttc

SEQ ID NO: 6992373 - DNA, 22 bp, Homo sapiens
tacctgagttatattaataatt

SEQ ID NO: 6992374 - DNA, 22 bp, Homo sapiens
gaccctcctactaccctggaaa

SEQ ID NO: 6992375 - DNA, 22 bp, Homo sapiens
tggctatgcaaacctgaggctg

SEQ ID NO: 6992376 - DNA, 22 bp, Homo sapiens
aggtcctgatgatctctgagag

SEQ ID NO: 6992377 - DNA, 22 bp, Homo sapiens
ggatctgttttgcctctgaggg

SEQ ID NO: 6992378 - DNA, 22 bp, Homo sapiens
tttagcttgaatcttgtttaaa

SEQ ID NO: 6992379 - DNA, 22 bp, Homo sapiens
tccaaatattatgattatagga

SEQ ID NO: 6992380 - DNA, 22 bp, Homo sapiens
tgaaaggggttgagttacagct

SEQ ID NO: 6992381 - DNA, 21 bp, Homo sapiens
agtttcctcatctgcatagga

SEQ ID NO: 6992382 - DNA, 18 bp, Homo sapiens
tggctctgccactcaccg

SEQ ID NO: 6992383 - DNA, 22 bp, Homo sapiens
ctttctgagtccaacccctgat

SEQ ID NO: 6992384 - DNA, 22 bp, Homo sapiens
tctttacatagtgtggactact

SEQ ID NO: 6992385 - DNA, 22 bp, Homo sapiens
tcagtgatttctggggtgaggg

SEQ ID NO: 6992386 - DNA, 22 bp, Homo sapiens
tttcatgtggcgatgtctctgg

SEQ ID NO: 6992387 - DNA, 22 bp, Homo sapiens
aaattgcattgagctgcttatt

SEQ ID NO: 6992388 - DNA, 22 bp, Homo sapiens
actggcttcagggggaaagtcc

SEQ ID NO: 6992389 - DNA, 22 bp, Homo sapiens
aggcagatcagtacagggttaa

SEQ ID NO: 6992390 - DNA, 22 bp, Homo sapiens
cccaggaggtggaggctgcagt

SEQ ID NO: 6992391 - DNA, 22 bp, Homo sapiens
tactttcttgttcctttcataa

SEQ ID NO: 6992392 - DNA, 18 bp, Homo sapiens
ttaaggataagcagacta

SEQ ID NO: 6992393 - DNA, 22 bp, Homo sapiens
ccagaactgggcaacagaaagt

SEQ ID NO: 6992394 - DNA, 22 bp, Homo sapiens
ccagggtgggaggctgaaggcg

SEQ ID NO: 6992395 - DNA, 23 bp, Homo sapiens
tttcatcagttgatctggacagc

SEQ ID NO: 6992396 - DNA, 22 bp, Homo sapiens
atctagaagtggcatgaattac

SEQ ID NO: 6992397 - DNA, 22 bp, Homo sapiens
tctgggagttgtagtccggtgg

SEQ ID NO: 6992398 - DNA, 20 bp, Homo sapiens
ttcagggtgagagttctagg

SEQ ID NO: 6992399 - DNA, 22 bp, Homo sapiens
taacactgtggtgttctttgtc

SEQ ID NO: 6992400 - DNA, 22 bp, Homo sapiens
gactcctcccgctcccatgccg

SEQ ID NO: 6992401 - DNA, 17 bp, Homo sapiens
aagtgacatcaggctgc

SEQ ID NO: 6992402 - DNA, 22 bp, Homo sapiens
tctgcaacgcactgcaaaacct

SEQ ID NO: 6992403 - DNA, 22 bp, Homo sapiens
gccctcagcatcctcagggcca

SEQ ID NO: 6992404 - DNA, 22 bp, Homo sapiens
aagctcattaattagaagctaa

SEQ ID NO: 6992405 - DNA, 22 bp, Homo sapiens
ggaggcccagagaggtgaagtg

SEQ ID NO: 6992406 - DNA, 22 bp, Homo sapiens
ggcagtctcctgccctctaacc

SEQ ID NO: 6992407 - DNA, 22 bp, Homo sapiens
cacaggttcacctcaggtaggt

SEQ ID NO: 6992408 - DNA, 22 bp, Homo sapiens
tgcagtggcgccatctcagctc

SEQ ID NO: 6992409 - DNA, 22 bp, Homo sapiens
tcagccagagggggcaaaggaa

SEQ ID NO: 6992410 - DNA, 22 bp, Homo sapiens
tttcaagctgtggtaactgaga

SEQ ID NO: 6992411 - DNA, 22 bp, Homo sapiens
catattttagttgctgaacagc

SEQ ID NO: 6992412 - DNA, 22 bp, Homo sapiens
ccagactcatctgccattgctg

SEQ ID NO: 6992413 - DNA, 22 bp, Homo sapiens
aaaggaggaatggagagatgct

SEQ ID NO: 6992414 - DNA, 19 bp, Homo sapiens
catcttggagtactccttt

SEQ ID NO: 6992415 - DNA, 22 bp, Homo sapiens
gcccagagtgagtcctgggccc

SEQ ID NO: 6992416 - DNA, 22 bp, Homo sapiens
aggatcctgtatggagaagctg

SEQ ID NO: 6992417 - DNA, 22 bp, Homo sapiens
acatttgggaccctctcttcac

SEQ ID NO: 6992418 - DNA, 22 bp, Homo sapiens
tggccagagtccagtgagcctt

SEQ ID NO: 6992419 - DNA, 22 bp, Homo sapiens
ctcctacataacccagcgaact

SEQ ID NO: 6992420 - DNA, 21 bp, Homo sapiens
ccaggcatgactgcagagagc

SEQ ID NO: 6992421 - DNA, 22 bp, Homo sapiens
ttactgatacacataagaattt

SEQ ID NO: 6992422 - DNA, 22 bp, Homo sapiens
caggtcctcgggggaggccggc

SEQ ID NO: 6992423 - DNA, 22 bp, Homo sapiens
gttaatgcctacatattaagca

SEQ ID NO: 6992424 - DNA, 22 bp, Homo sapiens
acagtgagcccactccaggaga

SEQ ID NO: 6992425 - DNA, 23 bp, Homo sapiens
aagtgctaccaaaagaattcctc

SEQ ID NO: 6992426 - DNA, 22 bp, Homo sapiens
taatagctttgttgtttgtgat

SEQ ID NO: 6992427 - DNA, 22 bp, Homo sapiens
acagggattatgactgacagcc

SEQ ID NO: 6992428 - DNA, 22 bp, Homo sapiens
acagctggcaggggggcatgaa

SEQ ID NO: 6992429 - DNA, 22 bp, Homo sapiens
gtgcgtttctttcccagcttcg

SEQ ID NO: 6992430 - DNA, 22 bp, Homo sapiens
tcaaagagctctatcttcaaaa

SEQ ID NO: 6992431 - DNA, 22 bp, Homo sapiens
gacatgcatgaatgcaggtctc

SEQ ID NO: 6992432 - DNA, 15 bp, Homo sapiens
ccaggctctgcactc

SEQ ID NO: 6992433 - DNA, 21 bp, Homo sapiens
acgggaatgaacatggtggag

SEQ ID NO: 6992434 - DNA, 22 bp, Homo sapiens
cagggccatatcttgtgcacca

SEQ ID NO: 6992435 - DNA, 22 bp, Homo sapiens
ctagtgtttggaagtcatagcc

SEQ ID NO: 6992436 - DNA, 22 bp, Homo sapiens
ggcttcctccttcctgctgtca

SEQ ID NO: 6992437 - DNA, 22 bp, Homo sapiens
tctacaagtcaagtctatcaag

SEQ ID NO: 6992438 - DNA, 22 bp, Homo sapiens
tagtaacttttgttataaatca

SEQ ID NO: 6992439 - DNA, 22 bp, Homo sapiens
ggagtccaacgtgcagccagga

SEQ ID NO: 6992440 - DNA, 22 bp, Homo sapiens
agcagcagagctctggtctgca

SEQ ID NO: 6992441 - DNA, 22 bp, Homo sapiens
ctgacccagaggaactgcaaag

SEQ ID NO: 6992442 - DNA, 22 bp, Homo sapiens
tttgtatttttcccagctagct

SEQ ID NO: 6992443 - DNA, 22 bp, Homo sapiens
ccagggcatgtaactaatggtg

SEQ ID NO: 6992444 - DNA, 22 bp, Homo sapiens
ccagggcccacggccagaatag

SEQ ID NO: 6992445 - DNA, 22 bp, Homo sapiens
aatccaatcctactcagaaagt

SEQ ID NO: 6992446 - DNA, 23 bp, Homo sapiens
aggagccatgagttggatatgtt

SEQ ID NO: 6992447 - DNA, 22 bp, Homo sapiens
tttatgtttgcattttcaaaga

SEQ ID NO: 6992448 - DNA, 21 bp, Homo sapiens
aggcagcatctgatttatatg

SEQ ID NO: 6992449 - DNA, 22 bp, Homo sapiens
gctggcttgacagaggcctggg

SEQ ID NO: 6992450 - DNA, 22 bp, Homo sapiens
aatagctgattagcctacaata

SEQ ID NO: 6992451 - DNA, 22 bp, Homo sapiens
ttgaactgtaagcatgtctgcc

SEQ ID NO: 6992452 - DNA, 22 bp, Homo sapiens
tcctggaggagatccaatctga

SEQ ID NO: 6992453 - DNA, 22 bp, Homo sapiens
cagaagctttgtctagtcttga

SEQ ID NO: 6992454 - DNA, 22 bp, Homo sapiens
tacattgacttggattgttaga

SEQ ID NO: 6992455 - DNA, 22 bp, Homo sapiens
tacagctttagcaaattaccta

SEQ ID NO: 6992456 - DNA, 22 bp, Homo sapiens
gaacgctgtcattgcagcatgg

SEQ ID NO: 6992457 - DNA, 22 bp, Homo sapiens
tctctgaattctgatgcaagtg

SEQ ID NO: 6992458 - DNA, 22 bp, Homo sapiens
atgagcatatgggaggagtact

SEQ ID NO: 6992459 - DNA, 22 bp, Homo sapiens
gacctagattaacattctgtga

SEQ ID NO: 6992460 - DNA, 20 bp, Homo sapiens
atcagcaactgccactcagt

SEQ ID NO: 6992461 - DNA, 22 bp, Homo sapiens
ctggagcctgcagttttcactt

SEQ ID NO: 6992462 - DNA, 20 bp, Homo sapiens
ccctggagagaagctccacg

SEQ ID NO: 6992463 - DNA, 22 bp, Homo sapiens
acgcaggagtgggtggagtgga

SEQ ID NO: 6992464 - DNA, 20 bp, Homo sapiens
ctggccagaacgcctacaca

SEQ ID NO: 6992465 - DNA, 22 bp, Homo sapiens
tgcacagcaaatattgactacc

SEQ ID NO: 6992466 - DNA, 20 bp, Homo sapiens
gcaggcagggaatgggggtg

SEQ ID NO: 6992467 - DNA, 22 bp, Homo sapiens
gactacaacaataagaacagct

SEQ ID NO: 6992468 - DNA, 15 bp, Homo sapiens
agctgcctgggtgct

SEQ ID NO: 6992469 - DNA, 22 bp, Homo sapiens
accccagggctgccagcctcct

SEQ ID NO: 6992470 - DNA, 22 bp, Homo sapiens
attggcagccagacccagttct

SEQ ID NO: 6992471 - DNA, 22 bp, Homo sapiens
tgcaagaggattgtatcaataa

SEQ ID NO: 6992472 - DNA, 22 bp, Homo sapiens
aaatagatttctctgggtttgt

SEQ ID NO: 6992473 - DNA, 22 bp, Homo sapiens
gtgggagaagccctgttcgtag

SEQ ID NO: 6992474 - DNA, 22 bp, Homo sapiens
actgtggatcaaagacttgggg

SEQ ID NO: 6992475 - DNA, 19 bp, Homo sapiens
tttgacgttgaatatcact

SEQ ID NO: 6992476 - DNA, 22 bp, Homo sapiens
cctggagctcactgggagccgg

SEQ ID NO: 6992477 - DNA, 22 bp, Homo sapiens
catagacattgataggttatat

SEQ ID NO: 6992478 - DNA, 22 bp, Homo sapiens
atcttttactacaaatcaggtg

SEQ ID NO: 6992479 - DNA, 22 bp, Homo sapiens
agtgccttggctgtgatgggga

SEQ ID NO: 6992480 - DNA, 20 bp, Homo sapiens
tggagccaaggtgtgtctgg

SEQ ID NO: 6992481 - DNA, 22 bp, Homo sapiens
atacagtggctgtgagctgggc

SEQ ID NO: 6992482 - DNA, 22 bp, Homo sapiens
attctgcttaagggaggctgtc

SEQ ID NO: 6992483 - DNA, 22 bp, Homo sapiens
cctaggtcctatatgacctagc

SEQ ID NO: 6992484 - DNA, 22 bp, Homo sapiens
tctgcaggctgtacaggaagca

SEQ ID NO: 6992485 - DNA, 22 bp, Homo sapiens
aaagtgcagcttgtgatcccta

SEQ ID NO: 6992486 - DNA, 22 bp, Homo sapiens
ggacatctgttgtggtagagga

SEQ ID NO: 6992487 - DNA, 22 bp, Homo sapiens
caggagccttaggaaatacatc

SEQ ID NO: 6992488 - DNA, 22 bp, Homo sapiens
agggtctcttgccatgcctcag

SEQ ID NO: 6992489 - DNA, 22 bp, Homo sapiens
ctcctggtgactcccagataaa

SEQ ID NO: 6992490 - DNA, 22 bp, Homo sapiens
tcataaactcactagtttatgt

SEQ ID NO: 6992491 - DNA, 22 bp, Homo sapiens
tctgtccatgtgaggttctctg

SEQ ID NO: 6992492 - DNA, 22 bp, Homo sapiens
taagctaacgtccatggaaatg

SEQ ID NO: 6992493 - DNA, 22 bp, Homo sapiens
aaaagagaaagtggcaggcttt

SEQ ID NO: 6992494 - DNA, 22 bp, Homo sapiens
cagctattccaggagtagaatc

SEQ ID NO: 6992495 - DNA, 22 bp, Homo sapiens
atgacagacagaagggattttt

SEQ ID NO: 6992496 - DNA, 22 bp, Homo sapiens
gctgaggattacttgaagtcag

SEQ ID NO: 6992497 - DNA, 23 bp, Homo sapiens
agtacattcgaaaaattctgtga

SEQ ID NO: 6992498 - DNA, 22 bp, Homo sapiens
tttgaagcagatggttaagctt

SEQ ID NO: 6992499 - DNA, 22 bp, Homo sapiens
ggctcctgggggtgctcctgcc

SEQ ID NO: 6992500 - DNA, 22 bp, Homo sapiens
tataccttgagcagggcggccc

SEQ ID NO: 6992501 - DNA, 22 bp, Homo sapiens
tccatacatatccaaagagaag

SEQ ID NO: 6992502 - DNA, 22 bp, Homo sapiens
gggctgggaatggctaagtatg

SEQ ID NO: 6992503 - DNA, 22 bp, Homo sapiens
aagagctggatgaagaaatcaa

SEQ ID NO: 6992504 - DNA, 22 bp, Homo sapiens
ctctgaaggtttctgttactgt

SEQ ID NO: 6992505 - DNA, 22 bp, Homo sapiens
gaaaggcttgcttttgctcggt

SEQ ID NO: 6992506 - DNA, 22 bp, Homo sapiens
gatccacagctgcggtaggaga

SEQ ID NO: 6992507 - DNA, 22 bp, Homo sapiens
gcttcctccagggaggggcctg

SEQ ID NO: 6992508 - DNA, 22 bp, Homo sapiens
tttggaaagtgtgatttcaagg

SEQ ID NO: 6992509 - DNA, 22 bp, Homo sapiens
accaccctcagcagagctgaaa

SEQ ID NO: 6992510 - DNA, 22 bp, Homo sapiens
tttctgtaattaaaagggcagg

SEQ ID NO: 6992511 - DNA, 22 bp, Homo sapiens
tgaggtagaagcctgggttgag

SEQ ID NO: 6992512 - DNA, 22 bp, Homo sapiens
gctccctgaagagatttggtct

SEQ ID NO: 6992513 - DNA, 22 bp, Homo sapiens
acaaaggtggaccatgtggctt

SEQ ID NO: 6992514 - DNA, 22 bp, Homo sapiens
atctctgctagccttcttcagg

SEQ ID NO: 6992515 - DNA, 18 bp, Homo sapiens
agtgttattgggagacag

SEQ ID NO: 6992516 - DNA, 22 bp, Homo sapiens
gaggtcaggctcaagctgggcc

SEQ ID NO: 6992517 - DNA, 18 bp, Homo sapiens
ctgtcaactcaacaagag

SEQ ID NO: 6992518 - DNA, 22 bp, Homo sapiens
atgtttgtcaggattgtaatta

SEQ ID NO: 6992519 - DNA, 22 bp, Homo sapiens
caacactgacaatggactgatt

SEQ ID NO: 6992520 - DNA, 22 bp, Homo sapiens
gtgggcagtgtgtcagtatctt

SEQ ID NO: 6992521 - DNA, 22 bp, Homo sapiens
tatgtatatgtatacacacaca

SEQ ID NO: 6992522 - DNA, 22 bp, Homo sapiens
ccacctctcagggtttcctaat

SEQ ID NO: 6992523 - DNA, 22 bp, Homo sapiens
gggcctccgtgtgctggtgctc

SEQ ID NO: 6992524 - DNA, 22 bp, Homo sapiens
ttgaatgaaattgctgtgttat

SEQ ID NO: 6992525 - DNA, 21 bp, Homo sapiens
gatacagagggccactgattg

SEQ ID NO: 6992526 - DNA, 22 bp, Homo sapiens
tcattctcctctggaaaaggca

SEQ ID NO: 6992527 - DNA, 22 bp, Homo sapiens
tagtactacgttttctactatc

SEQ ID NO: 6992528 - DNA, 22 bp, Homo sapiens
tgtgactctggcacatggtgag

SEQ ID NO: 6992529 - DNA, 22 bp, Homo sapiens
cagctttgccaagtaaggtctt

SEQ ID NO: 6992530 - DNA, 22 bp, Homo sapiens
ttattccaaatcatggttgcat

SEQ ID NO: 6992531 - DNA, 22 bp, Homo sapiens
agtggggtctcctccagccccc

SEQ ID NO: 6992532 - DNA, 22 bp, Homo sapiens
aaatgtctttgagtttttataa

SEQ ID NO: 6992533 - DNA, 22 bp, Homo sapiens
cttcagtccttaagccaagcaa

SEQ ID NO: 6992534 - DNA, 22 bp, Homo sapiens
tccaataaagagaggaatgtct

SEQ ID NO: 6992535 - DNA, 22 bp, Homo sapiens
attgtcttagtcagctcggact

SEQ ID NO: 6992536 - DNA, 22 bp, Homo sapiens
gttaaacagttacatgtgctgg

SEQ ID NO: 6992537 - DNA, 22 bp, Homo sapiens
gatgaggcagctcagggggaaa

SEQ ID NO: 6992538 - DNA, 22 bp, Homo sapiens
caaaaaacacctgtgtgagtat

SEQ ID NO: 6992539 - DNA, 22 bp, Homo sapiens
gagacaggcagctagtgggtca

SEQ ID NO: 6992540 - DNA, 23 bp, Homo sapiens
ccatcccttggaagctggtttta

SEQ ID NO: 6992541 - DNA, 22 bp, Homo sapiens
taggttccatttaaacaaagaa

SEQ ID NO: 6992542 - DNA, 22 bp, Homo sapiens
ttgtgcttaagcaagctttctt

SEQ ID NO: 6992543 - DNA, 22 bp, Homo sapiens
ttggtccattctggaagaaggg

SEQ ID NO: 6992544 - DNA, 22 bp, Homo sapiens
gggcccagcactggctgggatc

SEQ ID NO: 6992545 - DNA, 22 bp, Homo sapiens
atcagtgacctgaaatgttttt

SEQ ID NO: 6992546 - DNA, 22 bp, Homo sapiens
cttagatacagtagaaagactc

SEQ ID NO: 6992547 - DNA, 22 bp, Homo sapiens
acatggggcccaaagagaggtc

SEQ ID NO: 6992548 - DNA, 22 bp, Homo sapiens
acataaagtactgagagactct

SEQ ID NO: 6992549 - DNA, 22 bp, Homo sapiens
aaagccttgagatcctatagtt

SEQ ID NO: 6992550 - DNA, 22 bp, Homo sapiens
ctgaggtctagacaccccaggg

SEQ ID NO: 6992551 - DNA, 22 bp, Homo sapiens
tctttggatcccaactggctgg

SEQ ID NO: 6992552 - DNA, 22 bp, Homo sapiens
ttagaatcaggtgttataatca

SEQ ID NO: 6992553 - DNA, 22 bp, Homo sapiens
tagaaacccatgtttattcagt

SEQ ID NO: 6992554 - DNA, 21 bp, Homo sapiens
aggagctctccaaggacaaag

SEQ ID NO: 6992555 - DNA, 22 bp, Homo sapiens
acagctaatccccctagattct

SEQ ID NO: 6992556 - DNA, 22 bp, Homo sapiens
gattcctatccctgaaacagtg

SEQ ID NO: 6992557 - DNA, 22 bp, Homo sapiens
caggattgaatgcttctccctg

SEQ ID NO: 6992558 - DNA, 22 bp, Homo sapiens
gctgtagggtgtcatatgaagc

SEQ ID NO: 6992559 - DNA, 22 bp, Homo sapiens
tatgtgtaaccttgtgatttat

SEQ ID NO: 6992560 - DNA, 22 bp, Homo sapiens
ctgctgcctcgacattgggaca

SEQ ID NO: 6992561 - DNA, 22 bp, Homo sapiens
ttccctggttaaccattttctg

SEQ ID NO: 6992562 - DNA, 23 bp, Homo sapiens
agaggcaggagtggcttgcccgg

SEQ ID NO: 6992563 - DNA, 22 bp, Homo sapiens
cttcccagttctgcttgagggg

SEQ ID NO: 6992564 - DNA, 22 bp, Homo sapiens
cagacaactggactaagatcac

SEQ ID NO: 6992565 - DNA, 22 bp, Homo sapiens
gggctggtgaggctgccctgca

SEQ ID NO: 6992566 - DNA, 22 bp, Homo sapiens
gggcagtgtcggggcccaggga

SEQ ID NO: 6992567 - DNA, 22 bp, Homo sapiens
ttgagccctacctcagactttc

SEQ ID NO: 6992568 - DNA, 22 bp, Homo sapiens
tggacaggatagtgcagtacgc

SEQ ID NO: 6992569 - DNA, 18 bp, Homo sapiens
accaggaagcttcttgtc

SEQ ID NO: 6992570 - DNA, 22 bp, Homo sapiens
actgagactgagaatgtttctt

SEQ ID NO: 6992571 - DNA, 22 bp, Homo sapiens
gaagaggctttcctagggcaag

SEQ ID NO: 6992572 - DNA, 22 bp, Homo sapiens
agcctctgcttatgcaaaggta

SEQ ID NO: 6992573 - DNA, 22 bp, Homo sapiens
ctacactagagttgcaatggaa

SEQ ID NO: 6992574 - DNA, 22 bp, Homo sapiens
agctgtgtcatcctggaaaatg

SEQ ID NO: 6992575 - DNA, 22 bp, Homo sapiens
gtgggagcatggtcccagtgcc

SEQ ID NO: 6992576 - DNA, 22 bp, Homo sapiens
aagtgtatatatgacttataaa

SEQ ID NO: 6992577 - DNA, 22 bp, Homo sapiens
ttgtttctgagttttcatgtat

SEQ ID NO: 6992578 - DNA, 22 bp, Homo sapiens
ggcagcaaaaagcctggttgaa

SEQ ID NO: 6992579 - DNA, 22 bp, Homo sapiens
ggctggaggagaatgggtgtga

SEQ ID NO: 6992580 - DNA, 21 bp, Homo sapiens
ttacatggacatggaggcctt

SEQ ID NO: 6992581 - DNA, 22 bp, Homo sapiens
ttcaagtttactttgaagttta

SEQ ID NO: 6992582 - DNA, 19 bp, Homo sapiens
ccttcgcaagttttcttta

SEQ ID NO: 6992583 - DNA, 22 bp, Homo sapiens
atattattttccctggagttgt

SEQ ID NO: 6992584 - DNA, 22 bp, Homo sapiens
aaatctgggagcagctcggcca

SEQ ID NO: 6992585 - DNA, 22 bp, Homo sapiens
actgggcttatttcttgtgaac

SEQ ID NO: 6992586 - DNA, 22 bp, Homo sapiens
gaacagaagaggctggtgccac

SEQ ID NO: 6992587 - DNA, 22 bp, Homo sapiens
attaagtgtcaggcagggagtg

SEQ ID NO: 6992588 - DNA, 22 bp, Homo sapiens
ttcacagctccttttactcaac

SEQ ID NO: 6992589 - DNA, 22 bp, Homo sapiens
atcagtgccccatggctaatgc

SEQ ID NO: 6992590 - DNA, 22 bp, Homo sapiens
tttctagactcaaagaggatat

SEQ ID NO: 6992591 - DNA, 22 bp, Homo sapiens
tcttgcctcttcccctttccat

SEQ ID NO: 6992592 - DNA, 22 bp, Homo sapiens
acaggcagggacctcttgagtt

SEQ ID NO: 6992593 - DNA, 20 bp, Homo sapiens
gcaactcacccacagcagct

SEQ ID NO: 6992594 - DNA, 22 bp, Homo sapiens
agacttaaggcatttccaagaa

SEQ ID NO: 6992595 - DNA, 22 bp, Homo sapiens
agacagactttgatctggatgt

SEQ ID NO: 6992596 - DNA, 22 bp, Homo sapiens
ctccaggactcaggcccctggg

SEQ ID NO: 6992597 - DNA, 22 bp, Homo sapiens
caagagctcaccggagagcatt

SEQ ID NO: 6992598 - DNA, 22 bp, Homo sapiens
ggctaggcaggctcagagccta

SEQ ID NO: 6992599 - DNA, 19 bp, Homo sapiens
tgacaatgggcacctgtgt

SEQ ID NO: 6992600 - DNA, 22 bp, Homo sapiens
ctgttactaatcttttctgcta

SEQ ID NO: 6992601 - DNA, 22 bp, Homo sapiens
tatggcttcattgtgctccgca

SEQ ID NO: 6992602 - DNA, 22 bp, Homo sapiens
aaggtggcatgtcccctggcca

SEQ ID NO: 6992603 - DNA, 22 bp, Homo sapiens
tcagaaattttctcagtagttc

SEQ ID NO: 6992604 - DNA, 22 bp, Homo sapiens
tatgatgtgtacctaagtcacc

SEQ ID NO: 6992605 - DNA, 23 bp, Homo sapiens
atgcagggttacagggctgactt

SEQ ID NO: 6992606 - DNA, 22 bp, Homo sapiens
gcactggtgtgaaacagtagat

SEQ ID NO: 6992607 - DNA, 22 bp, Homo sapiens
ccctagagagatcagatgggga

SEQ ID NO: 6992608 - DNA, 23 bp, Homo sapiens
actgggccagctacttagcactg

SEQ ID NO: 6992609 - DNA, 22 bp, Homo sapiens
tctgcatcgaagggcttttggt

SEQ ID NO: 6992610 - DNA, 22 bp, Homo sapiens
tgccttgacagttgtaagacct

SEQ ID NO: 6992611 - DNA, 22 bp, Homo sapiens
gagagaggcctccatgtactga

SEQ ID NO: 6992612 - DNA, 22 bp, Homo sapiens
agctcaggctctgcagggacta

SEQ ID NO: 6992613 - DNA, 22 bp, Homo sapiens
cagagcagaaacctgggtgatt

SEQ ID NO: 6992614 - DNA, 22 bp, Homo sapiens
caggcttgacagttttcatctt

SEQ ID NO: 6992615 - DNA, 22 bp, Homo sapiens
caagaagcaaggtcagggccca

SEQ ID NO: 6992616 - DNA, 22 bp, Homo sapiens
taaagctagaaggtgctgtaca

SEQ ID NO: 6992617 - DNA, 22 bp, Homo sapiens
acacagttctttcactgttggt

SEQ ID NO: 6992618 - DNA, 22 bp, Homo sapiens
ggcccaaggtgccaaggcctcc

SEQ ID NO: 6992619 - DNA, 22 bp, Homo sapiens
cacttgaaaatcagaggaaatt

SEQ ID NO: 6992620 - DNA, 23 bp, Homo sapiens
gtgaggtatattgaaatcatgct

SEQ ID NO: 6992621 - DNA, 23 bp, Homo sapiens
acaacaggaaatcagacctgaac

SEQ ID NO: 6992622 - DNA, 22 bp, Homo sapiens
ctagggcactaggactcatgtg

SEQ ID NO: 6992623 - DNA, 22 bp, Homo sapiens
ttacaagttttcatgaaattga

SEQ ID NO: 6992624 - DNA, 22 bp, Homo sapiens
agtgggtgacagttaacaggtt

SEQ ID NO: 6992625 - DNA, 22 bp, Homo sapiens
ttgaagacaagggcaggggttc

SEQ ID NO: 6992626 - DNA, 22 bp, Homo sapiens
tggtcagaactcagcgtgcttg

SEQ ID NO: 6992627 - DNA, 22 bp, Homo sapiens
atgcctttttatcatggatgat

SEQ ID NO: 6992628 - DNA, 22 bp, Homo sapiens
tgagtgatgagcatgattttag

SEQ ID NO: 6992629 - DNA, 22 bp, Homo sapiens
caaatgtgtagagcttttgggg

SEQ ID NO: 6992630 - DNA, 22 bp, Homo sapiens
acagaagtgacaatttcttggg

SEQ ID NO: 6992631 - DNA, 22 bp, Homo sapiens
gccagtgggtagttggagctgg

SEQ ID NO: 6992632 - DNA, 22 bp, Homo sapiens
aactttgagtcattgcctcttt

SEQ ID NO: 6992633 - DNA, 22 bp, Homo sapiens
agatcgttggtccatgccagtg

SEQ ID NO: 6992634 - DNA, 22 bp, Homo sapiens
caggccaaaattcaggcattct

SEQ ID NO: 6992635 - DNA, 22 bp, Homo sapiens
aatgtgtagatgttgcattcct

SEQ ID NO: 6992636 - DNA, 22 bp, Homo sapiens
tcactcaatatcccagtggggc

SEQ ID NO: 6992637 - DNA, 22 bp, Homo sapiens
ctctgtgggtatttatatgtat

SEQ ID NO: 6992638 - DNA, 18 bp, Homo sapiens
gcataatgtgtatattga

SEQ ID NO: 6992639 - DNA, 22 bp, Homo sapiens
tgtaatggttttcttccttctt

SEQ ID NO: 6992640 - DNA, 22 bp, Homo sapiens
cgccgcttgccgtagggagccg

SEQ ID NO: 6992641 - DNA, 22 bp, Homo sapiens
gggctctgactgaatattgaat

SEQ ID NO: 6992642 - DNA, 22 bp, Homo sapiens
ggaggggatggtttgaccctgg

SEQ ID NO: 6992643 - DNA, 22 bp, Homo sapiens
ttccaggaggaaagtttgggtg

SEQ ID NO: 6992644 - DNA, 22 bp, Homo sapiens
acttagcagtttagaatatgtc

SEQ ID NO: 6992645 - DNA, 22 bp, Homo sapiens
tggaaaaaaattggctagcttc

SEQ ID NO: 6992646 - DNA, 22 bp, Homo sapiens
tgggcctgggttcctcctgggc

SEQ ID NO: 6992647 - DNA, 22 bp, Homo sapiens
acagtagaggcttgatcgcagc

SEQ ID NO: 6992648 - DNA, 22 bp, Homo sapiens
tgtgtttgaggcatgttgcaga

SEQ ID NO: 6992649 - DNA, 22 bp, Homo sapiens
gatgtcttcccatgttcatgtg

SEQ ID NO: 6992650 - DNA, 22 bp, Homo sapiens
gccctgagcctatgagcctctc

SEQ ID NO: 6992651 - DNA, 22 bp, Homo sapiens
acagtgtttatgtacagattgt

SEQ ID NO: 6992652 - DNA, 20 bp, Homo sapiens
tgcacacagaaatttgcatt

SEQ ID NO: 6992653 - DNA, 22 bp, Homo sapiens
gaatagatcctcatttattgat

SEQ ID NO: 6992654 - DNA, 22 bp, Homo sapiens
cactttctgtgtatcttccatt

SEQ ID NO: 6992655 - DNA, 22 bp, Homo sapiens
agtaacttaggagatacatggg

SEQ ID NO: 6992656 - DNA, 21 bp, Homo sapiens
atgtgtgctagaggactactg

SEQ ID NO: 6992657 - DNA, 22 bp, Homo sapiens
agtaaatgattattttgccaac

SEQ ID NO: 6992658 - DNA, 20 bp, Homo sapiens
taggaaatatgtttttaccc

SEQ ID NO: 6992659 - DNA, 22 bp, Homo sapiens
tgcctggtatttgaataaagag

SEQ ID NO: 6992660 - DNA, 22 bp, Homo sapiens
ctcctgagctctgaggaagctt

SEQ ID NO: 6992661 - DNA, 22 bp, Homo sapiens
tgctgggcaccagtgcctgcag

SEQ ID NO: 6992662 - DNA, 22 bp, Homo sapiens
gtgtgtccctacaacagcttca

SEQ ID NO: 6992663 - DNA, 20 bp, Homo sapiens
agcactgtctgaccagtggc

SEQ ID NO: 6992664 - DNA, 22 bp, Homo sapiens
taaggccagccagcaaatctgt

SEQ ID NO: 6992665 - DNA, 22 bp, Homo sapiens
tggaggcactaaatggccacaa

SEQ ID NO: 6992666 - DNA, 22 bp, Homo sapiens
agcagcgagccagctctgcggg

SEQ ID NO: 6992667 - DNA, 22 bp, Homo sapiens
tatgtgtacatctggttgagca

SEQ ID NO: 6992668 - DNA, 22 bp, Homo sapiens
gagttgactacatagatgcaga

SEQ ID NO: 6992669 - DNA, 22 bp, Homo sapiens
agaatttaggatgcatgtgaat

SEQ ID NO: 6992670 - DNA, 22 bp, Homo sapiens
catcttttggtaggagccgggc

SEQ ID NO: 6992671 - DNA, 22 bp, Homo sapiens
caggcccattctaggcttgcta

SEQ ID NO: 6992672 - DNA, 22 bp, Homo sapiens
tatgacaatgtgggcctaaggg

SEQ ID NO: 6992673 - DNA, 22 bp, Homo sapiens
gtttcacagatggtgttcatat

SEQ ID NO: 6992674 - DNA, 22 bp, Homo sapiens
gtgtccccacccaaatctcatc

SEQ ID NO: 6992675 - DNA, 22 bp, Homo sapiens
cattcatccactgttggaaatt

SEQ ID NO: 6992676 - DNA, 22 bp, Homo sapiens
atggcatttttagacagtcctt

SEQ ID NO: 6992677 - DNA, 22 bp, Homo sapiens
aagttgatttaaactactagtc

SEQ ID NO: 6992678 - DNA, 22 bp, Homo sapiens
tagtagtaattgttatcttatt

SEQ ID NO: 6992679 - DNA, 22 bp, Homo sapiens
ggagtggcactctgaggcgggg

SEQ ID NO: 6992680 - DNA, 19 bp, Homo sapiens
tgtgggctgggaaatgtct

SEQ ID NO: 6992681 - DNA, 22 bp, Homo sapiens
gcaggagctttgcttactgctg

SEQ ID NO: 6992682 - DNA, 22 bp, Homo sapiens
gctggagacctcagagaaccca

SEQ ID NO: 6992683 - DNA, 22 bp, Homo sapiens
ggagtccctgtccccatacgag

SEQ ID NO: 6992684 - DNA, 22 bp, Homo sapiens
gatgtctttgccatgcatgtgt

SEQ ID NO: 6992685 - DNA, 22 bp, Homo sapiens
tcactggttagaagaagtaagc

SEQ ID NO: 6992686 - DNA, 22 bp, Homo sapiens
ctgggataggaaggtttccagc

SEQ ID NO: 6992687 - DNA, 22 bp, Homo sapiens
atgattgggaccttgaaatagg

SEQ ID NO: 6992688 - DNA, 22 bp, Homo sapiens
tttctctcttaaggagtttaaa

SEQ ID NO: 6992689 - DNA, 22 bp, Homo sapiens
agccagagactgtgtctgtaat

SEQ ID NO: 6992690 - DNA, 22 bp, Homo sapiens
agcagcacccagagccatgtct

SEQ ID NO: 6992691 - DNA, 22 bp, Homo sapiens
tctgtagcatcttaaatgtagt

SEQ ID NO: 6992692 - DNA, 22 bp, Homo sapiens
agtatgaagctgaatgatttta

SEQ ID NO: 6992693 - DNA, 20 bp, Homo sapiens
aggaaggaagtttgcatgga

SEQ ID NO: 6992694 - DNA, 22 bp, Homo sapiens
aggctgtgtaaagtgctttccc

SEQ ID NO: 6992695 - DNA, 22 bp, Homo sapiens
tggtctgcattatctgtaatgg

SEQ ID NO: 6992696 - DNA, 22 bp, Homo sapiens
tggtaaagtggcttcacagtgt

SEQ ID NO: 6992697 - DNA, 22 bp, Homo sapiens
atctgcttagaattcattgtcc

SEQ ID NO: 6992698 - DNA, 22 bp, Homo sapiens
atttccagaccaggtctcaccc

SEQ ID NO: 6992699 - DNA, 22 bp, Homo sapiens
aggaccctgaggtctcctgtga

SEQ ID NO: 6992700 - DNA, 22 bp, Homo sapiens
ggaaagatgtaatattatctaa

SEQ ID NO: 6992701 - DNA, 22 bp, Homo sapiens
cagggccagggctatggtgaag

SEQ ID NO: 6992702 - DNA, 22 bp, Homo sapiens
atattcttgtgattataaagta

SEQ ID NO: 6992703 - DNA, 22 bp, Homo sapiens
gccggtggcttttgtctcccct

SEQ ID NO: 6992704 - DNA, 20 bp, Homo sapiens
agagcctggaaaaagacatc

SEQ ID NO: 6992705 - DNA, 22 bp, Homo sapiens
aggtcacttcacacgttaatgt

SEQ ID NO: 6992706 - DNA, 22 bp, Homo sapiens
gatctggtacaggcctgcagcc

SEQ ID NO: 6992707 - DNA, 22 bp, Homo sapiens
aggctgttgagccccagcaagt

SEQ ID NO: 6992708 - DNA, 22 bp, Homo sapiens
ttctgcaatcgctctgaccatt

SEQ ID NO: 6992709 - DNA, 22 bp, Homo sapiens
atcggcaagccccacaccgtcc

SEQ ID NO: 6992710 - DNA, 22 bp, Homo sapiens
actagttttcaggcatgtctgg

SEQ ID NO: 6992711 - DNA, 22 bp, Homo sapiens
tagatggcaccttctgtgtgtc

SEQ ID NO: 6992712 - DNA, 22 bp, Homo sapiens
cttcccaggtgctcttagcatg

SEQ ID NO: 6992713 - DNA, 22 bp, Homo sapiens
tcccaggttccaccatccaggg

SEQ ID NO: 6992714 - DNA, 22 bp, Homo sapiens
ttctatttcttaatcttggctg

SEQ ID NO: 6992715 - DNA, 22 bp, Homo sapiens
tccatgggtagccctggttgag

SEQ ID NO: 6992716 - DNA, 22 bp, Homo sapiens
cctggcattttttgcttaaggt

SEQ ID NO: 6992717 - DNA, 22 bp, Homo sapiens
atgtagatgttcacttgatttt

SEQ ID NO: 6992718 - DNA, 22 bp, Homo sapiens
cttctctctgcataggcatggg

SEQ ID NO: 6992719 - DNA, 22 bp, Homo sapiens
gttgttttataattgattgcaa

SEQ ID NO: 6992720 - DNA, 22 bp, Homo sapiens
ctgcagggttttaacaatggac

SEQ ID NO: 6992721 - DNA, 22 bp, Homo sapiens
ttctcaggtcaccagggtgcca

SEQ ID NO: 6992722 - DNA, 22 bp, Homo sapiens
tgaacagtgtgagggtgtgacc

SEQ ID NO: 6992723 - DNA, 22 bp, Homo sapiens
agattctaaacttgattctgct

SEQ ID NO: 6992724 - DNA, 22 bp, Homo sapiens
aaacatgagttaaaagtaactg

SEQ ID NO: 6992725 - DNA, 22 bp, Homo sapiens
tttatctcttttgaccaagatt

SEQ ID NO: 6992726 - DNA, 22 bp, Homo sapiens
ttgtttctcctggtgcctgata

SEQ ID NO: 6992727 - DNA, 22 bp, Homo sapiens
gatgtgactaacttggtaccag

SEQ ID NO: 6992728 - DNA, 22 bp, Homo sapiens
ctgtacctcagctttgctccca

SEQ ID NO: 6992729 - DNA, 22 bp, Homo sapiens
aaagtgctgtgattacaggcat

SEQ ID NO: 6992730 - DNA, 22 bp, Homo sapiens
atgaaactgggataactatagc

SEQ ID NO: 6992731 - DNA, 20 bp, Homo sapiens
gccactgggcaccagcaggg

SEQ ID NO: 6992732 - DNA, 22 bp, Homo sapiens
aggctggaaagggaccagagtg

SEQ ID NO: 6992733 - DNA, 22 bp, Homo sapiens
ggcttagtgtttctgctcagcc

SEQ ID NO: 6992734 - DNA, 22 bp, Homo sapiens
taagtcagtagaactgtggtca

SEQ ID NO: 6992735 - DNA, 22 bp, Homo sapiens
gatgggattttttatgtgttca

SEQ ID NO: 6992736 - DNA, 22 bp, Homo sapiens
aagaatgttcattaaactgttg

SEQ ID NO: 6992737 - DNA, 22 bp, Homo sapiens
aaaaactgtaattacttttgca

SEQ ID NO: 6992738 - DNA, 22 bp, Homo sapiens
atgtcattgccaagatgctaat

SEQ ID NO: 6992739 - DNA, 19 bp, Homo sapiens
ttgtgtgtcagtcagagtt

SEQ ID NO: 6992740 - DNA, 22 bp, Homo sapiens
gcagccagtatcctctgagatt

SEQ ID NO: 6992741 - DNA, 21 bp, Homo sapiens
agcagagtgctttgactttgt

SEQ ID NO: 6992742 - DNA, 22 bp, Homo sapiens
acagtcagtatcccaggcaaat

SEQ ID NO: 6992743 - DNA, 22 bp, Homo sapiens
actctcccttggagcctcaggc

SEQ ID NO: 6992744 - DNA, 22 bp, Homo sapiens
agtgggcccttgtcacactgat

SEQ ID NO: 6992745 - DNA, 22 bp, Homo sapiens
acactgctaaacagtaaagatg

SEQ ID NO: 6992746 - DNA, 22 bp, Homo sapiens
agaaaggtggatgctctggaat

SEQ ID NO: 6992747 - DNA, 22 bp, Homo sapiens
ttggtcatacattgtcctatag

SEQ ID NO: 6992748 - DNA, 22 bp, Homo sapiens
tacaactgtgtgaaggaatctg

SEQ ID NO: 6992749 - DNA, 22 bp, Homo sapiens
cagcctgcaggaggccgtcagc

SEQ ID NO: 6992750 - DNA, 22 bp, Homo sapiens
cactgagttagtacgcaaacat

SEQ ID NO: 6992751 - DNA, 22 bp, Homo sapiens
tggtcattaattcttaccttta

SEQ ID NO: 6992752 - DNA, 22 bp, Homo sapiens
agggctatgattaatgatggtg

SEQ ID NO: 6992753 - DNA, 18 bp, Homo sapiens
gctcctggttggaaagaa

SEQ ID NO: 6992754 - DNA, 22 bp, Homo sapiens
tgggagatcttgaggcttattt

SEQ ID NO: 6992755 - DNA, 22 bp, Homo sapiens
actcttcaagggcctagaggtg

SEQ ID NO: 6992756 - DNA, 22 bp, Homo sapiens
tcacacatgctaagccagagat

SEQ ID NO: 6992757 - DNA, 22 bp, Homo sapiens
atattgtgtgtacaagtagtta

SEQ ID NO: 6992758 - DNA, 22 bp, Homo sapiens
agtgcatgtatctacagtcaca

SEQ ID NO: 6992759 - DNA, 22 bp, Homo sapiens
aattactgtctgtaaagggaat

SEQ ID NO: 6992760 - DNA, 22 bp, Homo sapiens
tgggccacctgctctgtttcta

SEQ ID NO: 6992761 - DNA, 22 bp, Homo sapiens
tgcaataacccatgagatagaa

SEQ ID NO: 6992762 - DNA, 21 bp, Homo sapiens
tccctcagaagctcttggtca

SEQ ID NO: 6992763 - DNA, 22 bp, Homo sapiens
gaggtggtcgaggaggggtacc

SEQ ID NO: 6992764 - DNA, 22 bp, Homo sapiens
tgaggtcacagctggggatgga

SEQ ID NO: 6992765 - DNA, 22 bp, Homo sapiens
tgccttgggtcaacctttgagt

SEQ ID NO: 6992766 - DNA, 22 bp, Homo sapiens
tacttaaaactgatagaatctc

SEQ ID NO: 6992767 - DNA, 22 bp, Homo sapiens
ctgctgtgtggattcaatggct

SEQ ID NO: 6992768 - DNA, 22 bp, Homo sapiens
gaggaacctatgatttagagca

SEQ ID NO: 6992769 - DNA, 22 bp, Homo sapiens
agccctaaattatctttatttt

SEQ ID NO: 6992770 - DNA, 22 bp, Homo sapiens
caggctctgctgctacagctgt

SEQ ID NO: 6992771 - DNA, 22 bp, Homo sapiens
gaaggtcacctcccctctctgg

SEQ ID NO: 6992772 - DNA, 22 bp, Homo sapiens
ctgaagagaaagggagctcttc

SEQ ID NO: 6992773 - DNA, 22 bp, Homo sapiens
gtattagctgaattatttccat

SEQ ID NO: 6992774 - DNA, 22 bp, Homo sapiens
gtccaggagctcagggcttatt

SEQ ID NO: 6992775 - DNA, 22 bp, Homo sapiens
gcaaacataatatgaagacact

SEQ ID NO: 6992776 - DNA, 22 bp, Homo sapiens
ccctgtgtcttcttgcctttgt

SEQ ID NO: 6992777 - DNA, 22 bp, Homo sapiens
gccctctgccacaggacgccag

SEQ ID NO: 6992778 - DNA, 23 bp, Homo sapiens
ggatgggcaagcctagtgcctac

SEQ ID NO: 6992779 - DNA, 22 bp, Homo sapiens
gctgcctgtcccaggatgagga

SEQ ID NO: 6992780 - DNA, 22 bp, Homo sapiens
ttgtctctgtgtggcttcccta

SEQ ID NO: 6992781 - DNA, 22 bp, Homo sapiens
ctcttggtaagacattagaggt

SEQ ID NO: 6992782 - DNA, 22 bp, Homo sapiens
tttaggcaaactcattgtcaga

SEQ ID NO: 6992783 - DNA, 22 bp, Homo sapiens
gctgccttttgctcctcccacc

SEQ ID NO: 6992784 - DNA, 22 bp, Homo sapiens
aatgaacacgctggtggtgcaa

SEQ ID NO: 6992785 - DNA, 22 bp, Homo sapiens
aagttatctttgattagaaata

SEQ ID NO: 6992786 - DNA, 18 bp, Homo sapiens
atggtctcatactgggag

SEQ ID NO: 6992787 - DNA, 22 bp, Homo sapiens
tcctcacacccataccactgac

SEQ ID NO: 6992788 - DNA, 22 bp, Homo sapiens
gcagggtaggtgacaggtagtc

SEQ ID NO: 6992789 - DNA, 22 bp, Homo sapiens
tacccagattcacaagccaagg

SEQ ID NO: 6992790 - DNA, 22 bp, Homo sapiens
cctggatctttctgactgacaa

SEQ ID NO: 6992791 - DNA, 22 bp, Homo sapiens
tggattcaaatttcagctctgt

SEQ ID NO: 6992792 - DNA, 22 bp, Homo sapiens
aaacactgaagacctatctggt

SEQ ID NO: 6992793 - DNA, 22 bp, Homo sapiens
gtttccaggctttggtatggtt

SEQ ID NO: 6992794 - DNA, 22 bp, Homo sapiens
aagtttcattgttcatgtaaca

SEQ ID NO: 6992795 - DNA, 22 bp, Homo sapiens
caatttctggaactaattctga

SEQ ID NO: 6992796 - DNA, 19 bp, Homo sapiens
tgggcaggttcagtaatgg

SEQ ID NO: 6992797 - DNA, 22 bp, Homo sapiens
gcagacacttcccactgcagcg

SEQ ID NO: 6992798 - DNA, 22 bp, Homo sapiens
aggcagtgtgggccaagcttcc

SEQ ID NO: 6992799 - DNA, 22 bp, Homo sapiens
aggccaattgctccccactccc

SEQ ID NO: 6992800 - DNA, 18 bp, Homo sapiens
ttgctttgtaagcttgca

SEQ ID NO: 6992801 - DNA, 21 bp, Homo sapiens
tgtctttggcctcattcccag

SEQ ID NO: 6992802 - DNA, 17 bp, Homo sapiens
gcttcctcatgcagttc

SEQ ID NO: 6992803 - DNA, 22 bp, Homo sapiens
atgactctgctgaggcacccgg

SEQ ID NO: 6992804 - DNA, 22 bp, Homo sapiens
aagagcaacttggaaacactca

SEQ ID NO: 6992805 - DNA, 22 bp, Homo sapiens
attatacaaggctggtgcctaa

SEQ ID NO: 6992806 - DNA, 22 bp, Homo sapiens
taaagtaatccttcataaggag

SEQ ID NO: 6992807 - DNA, 22 bp, Homo sapiens
aaattgctgaccaagtatattc

SEQ ID NO: 6992808 - DNA, 22 bp, Homo sapiens
cctaggtcccaagtcatgtttc

SEQ ID NO: 6992809 - DNA, 22 bp, Homo sapiens
tccagggccacagaggatgcta

SEQ ID NO: 6992810 - DNA, 22 bp, Homo sapiens
aaactggattaccaggctggtg

SEQ ID NO: 6992811 - DNA, 22 bp, Homo sapiens
acactgggttacctgtactatt

SEQ ID NO: 6992812 - DNA, 22 bp, Homo sapiens
ttctgccagtgatcaataattg

SEQ ID NO: 6992813 - DNA, 22 bp, Homo sapiens
atgaagccagaagaagactggc

SEQ ID NO: 6992814 - DNA, 16 bp, Homo sapiens
cgcctccctccctcgc

SEQ ID NO: 6992815 - DNA, 19 bp, Homo sapiens
tccattaagctcagagctc

SEQ ID NO: 6992816 - DNA, 22 bp, Homo sapiens
atgtccaggaagtcttaactca

SEQ ID NO: 6992817 - DNA, 22 bp, Homo sapiens
gagtctggaaactttgacaaaa

SEQ ID NO: 6992818 - DNA, 22 bp, Homo sapiens
tctttggtttctgtctctgtaa

SEQ ID NO: 6992819 - DNA, 18 bp, Homo sapiens
atgcaagctatggatttg

SEQ ID NO: 6992820 - DNA, 22 bp, Homo sapiens
atgctagaagggagcactatgt

SEQ ID NO: 6992821 - DNA, 20 bp, Homo sapiens
aatgttcagtaattgtttta

SEQ ID NO: 6992822 - DNA, 16 bp, Homo sapiens
gctgttagtagataga

SEQ ID NO: 6992823 - DNA, 22 bp, Homo sapiens
tcagtattcctggaaatacaag

SEQ ID NO: 6992824 - DNA, 22 bp, Homo sapiens
atggagtgtcaccttcctggtt

SEQ ID NO: 6992825 - DNA, 21 bp, Homo sapiens
tgtttatggaaaagagacaaa

SEQ ID NO: 6992826 - DNA, 22 bp, Homo sapiens
ctgggctctaggaaccattcct

SEQ ID NO: 6992827 - DNA, 22 bp, Homo sapiens
cagtactttgaagatattttag

SEQ ID NO: 6992828 - DNA, 22 bp, Homo sapiens
cagtagaagcttgtttttcaga

SEQ ID NO: 6992829 - DNA, 22 bp, Homo sapiens
agtcaggctccttgcctttccc

SEQ ID NO: 6992830 - DNA, 22 bp, Homo sapiens
gctgccttcagttctgattcat

SEQ ID NO: 6992831 - DNA, 20 bp, Homo sapiens
tggctggcttgtatttcctt

SEQ ID NO: 6992832 - DNA, 22 bp, Homo sapiens
ctcccattgcttcaaagatcct

SEQ ID NO: 6992833 - DNA, 22 bp, Homo sapiens
gggaaactcacaggtgcagggg

SEQ ID NO: 6992834 - DNA, 22 bp, Homo sapiens
ttagtaatgtgttaatatgaat

SEQ ID NO: 6992835 - DNA, 22 bp, Homo sapiens
ttcagtgtatcttgtcagggag

SEQ ID NO: 6992836 - DNA, 22 bp, Homo sapiens
tcattgcatttattcactggca

SEQ ID NO: 6992837 - DNA, 22 bp, Homo sapiens
gtagggcagaagttcaatgtgg

SEQ ID NO: 6992838 - DNA, 22 bp, Homo sapiens
caggttacaatgaaaccattaa

SEQ ID NO: 6992839 - DNA, 22 bp, Homo sapiens
gagatgctgtcaggctatctgt

SEQ ID NO: 6992840 - DNA, 22 bp, Homo sapiens
gatcaatggtgtaacttgtcct

SEQ ID NO: 6992841 - DNA, 22 bp, Homo sapiens
cccaaagcagttgatgtaccag

SEQ ID NO: 6992842 - DNA, 22 bp, Homo sapiens
agtctggagtgattatgtggga

SEQ ID NO: 6992843 - DNA, 22 bp, Homo sapiens
atttgttgctagcagcactgat

SEQ ID NO: 6992844 - DNA, 19 bp, Homo sapiens
tcctggcatttgtaggaaa

SEQ ID NO: 6992845 - DNA, 22 bp, Homo sapiens
ctccgttttgtgggacacggat

SEQ ID NO: 6992846 - DNA, 22 bp, Homo sapiens
tttagcttaaattgtaagtgaa

SEQ ID NO: 6992847 - DNA, 22 bp, Homo sapiens
attattagattcttaattgtaa

SEQ ID NO: 6992848 - DNA, 22 bp, Homo sapiens
gctgggcaacgggcagaaagat

SEQ ID NO: 6992849 - DNA, 22 bp, Homo sapiens
tgagctggaatcttcttgactg

SEQ ID NO: 6992850 - DNA, 22 bp, Homo sapiens
aacttgaagttgcagaaagtac

SEQ ID NO: 6992851 - DNA, 22 bp, Homo sapiens
agttcttattttggaactgagg

SEQ ID NO: 6992852 - DNA, 22 bp, Homo sapiens
tgaggcctgggcacataacctc

SEQ ID NO: 6992853 - DNA, 22 bp, Homo sapiens
gacccttagaatgtgatcttat

SEQ ID NO: 6992854 - DNA, 23 bp, Homo sapiens
tctccctgaggttgttagcatta

SEQ ID NO: 6992855 - DNA, 22 bp, Homo sapiens
gccagtgttgaactttccctgg

SEQ ID NO: 6992856 - DNA, 22 bp, Homo sapiens
tgtacgcatgtgcatgcacacg

SEQ ID NO: 6992857 - DNA, 22 bp, Homo sapiens
tatgtacatacatgtgcatacg

SEQ ID NO: 6992858 - DNA, 22 bp, Homo sapiens
agtcaattatctctaggtcatc

SEQ ID NO: 6992859 - DNA, 22 bp, Homo sapiens
cccaggaattcagggctcaagg

SEQ ID NO: 6992860 - DNA, 22 bp, Homo sapiens
actctgaggggtatgttcctat

SEQ ID NO: 6992861 - DNA, 18 bp, Homo sapiens
tagaatctgttattgcct

SEQ ID NO: 6992862 - DNA, 22 bp, Homo sapiens
cactgtactgggttgaaggacg

SEQ ID NO: 6992863 - DNA, 22 bp, Homo sapiens
tatgtcaaaaaagattatgttt

SEQ ID NO: 6992864 - DNA, 22 bp, Homo sapiens
tgcttttagctagtaactagta

SEQ ID NO: 6992865 - DNA, 22 bp, Homo sapiens
ttatgtaatttgtttgctcttc

SEQ ID NO: 6992866 - DNA, 22 bp, Homo sapiens
tacttacttgcattttaagttg

SEQ ID NO: 6992867 - DNA, 22 bp, Homo sapiens
tacgcctgtaatcccagcactt

SEQ ID NO: 6992868 - DNA, 22 bp, Homo sapiens
gctgctgagaattgcaggcaag

SEQ ID NO: 6992869 - DNA, 22 bp, Homo sapiens
agcacctatagaagttgtgttc

SEQ ID NO: 6992870 - DNA, 21 bp, Homo sapiens
tggtttatttcactcagcata

SEQ ID NO: 6992871 - DNA, 22 bp, Homo sapiens
agaactctcgctggatcagact

SEQ ID NO: 6992872 - DNA, 22 bp, Homo sapiens
aggcagcctttagacagtctgc

SEQ ID NO: 6992873 - DNA, 22 bp, Homo sapiens
gctgaataagagtctactttgc

SEQ ID NO: 6992874 - DNA, 22 bp, Homo sapiens
tactgaaagtggtcaacagtgg

SEQ ID NO: 6992875 - DNA, 22 bp, Homo sapiens
tgtggttggaatgcagccatgc

SEQ ID NO: 6992876 - DNA, 22 bp, Homo sapiens
gatcccctattcttttcctcag

SEQ ID NO: 6992877 - DNA, 22 bp, Homo sapiens
ggtctaaaatgagtcttcctag

SEQ ID NO: 6992878 - DNA, 22 bp, Homo sapiens
agtcaaaacatgtactttcctt

SEQ ID NO: 6992879 - DNA, 18 bp, Homo sapiens
tgggctcaaaggatcctc

SEQ ID NO: 6992880 - DNA, 22 bp, Homo sapiens
aagcaggaaggagcccagggca

SEQ ID NO: 6992881 - DNA, 22 bp, Homo sapiens
gagctgccagtgtatgaattct

SEQ ID NO: 6992882 - DNA, 22 bp, Homo sapiens
gttaagaagctagagatgaaca

SEQ ID NO: 6992883 - DNA, 22 bp, Homo sapiens
ggtggcagagaggaggtagttt

SEQ ID NO: 6992884 - DNA, 23 bp, Homo sapiens
aggagcccctaattctgggcagc

SEQ ID NO: 6992885 - DNA, 22 bp, Homo sapiens
tgtgtctgaacatgctttgtaa

SEQ ID NO: 6992886 - DNA, 22 bp, Homo sapiens
acagcagctgggttcccaccat

SEQ ID NO: 6992887 - DNA, 22 bp, Homo sapiens
atgttatttctgaaagatcatt

SEQ ID NO: 6992888 - DNA, 22 bp, Homo sapiens
ttcagagaaactgaggtttaga

SEQ ID NO: 6992889 - DNA, 22 bp, Homo sapiens
aaaggcttctttgctccatgtc

SEQ ID NO: 6992890 - DNA, 22 bp, Homo sapiens
ggctctctccttggctttcaga

SEQ ID NO: 6992891 - DNA, 22 bp, Homo sapiens
tcagccctggcactgtctccca

SEQ ID NO: 6992892 - DNA, 22 bp, Homo sapiens
ggaagagctgcttagttttgat

SEQ ID NO: 6992893 - DNA, 22 bp, Homo sapiens
agtacacaagacacatttaaaa

SEQ ID NO: 6992894 - DNA, 20 bp, Homo sapiens
agacatggtagtgattcagg

SEQ ID NO: 6992895 - DNA, 22 bp, Homo sapiens
tagatagactaatccagcaact

SEQ ID NO: 6992896 - DNA, 23 bp, Homo sapiens
caagttattctgacactcatcaa

SEQ ID NO: 6992897 - DNA, 22 bp, Homo sapiens
gagctgggagttatagcatgtt

SEQ ID NO: 6992898 - DNA, 22 bp, Homo sapiens
tggcttctcccgacaccctggc

SEQ ID NO: 6992899 - DNA, 22 bp, Homo sapiens
ctctccactcagcgtcatgtcc

SEQ ID NO: 6992900 - DNA, 22 bp, Homo sapiens
gccagctcagtgccaggcccct

SEQ ID NO: 6992901 - DNA, 22 bp, Homo sapiens
gccagggtgtgcagggacagga

SEQ ID NO: 6992902 - DNA, 22 bp, Homo sapiens
gattatgactgtcctagaaaaa

SEQ ID NO: 6992903 - DNA, 22 bp, Homo sapiens
ctttacacatcctaaccagtgt

SEQ ID NO: 6992904 - DNA, 22 bp, Homo sapiens
ccagcagcaggccaggccctcc

SEQ ID NO: 6992905 - DNA, 22 bp, Homo sapiens
agcctttaagcagcgcagcatt

SEQ ID NO: 6992906 - DNA, 22 bp, Homo sapiens
agggaatctaggctcagagtgc

SEQ ID NO: 6992907 - DNA, 22 bp, Homo sapiens
ttggcttctcttaaccctaaag

SEQ ID NO: 6992908 - DNA, 22 bp, Homo sapiens
gtcataatcacagttttatgca

SEQ ID NO: 6992909 - DNA, 22 bp, Homo sapiens
tctgcagaaactgtgactatgt

SEQ ID NO: 6992910 - DNA, 22 bp, Homo sapiens
aggcaagcttgaaattggctct

SEQ ID NO: 6992911 - DNA, 22 bp, Homo sapiens
ttaaatagctcttgtagaagaa

SEQ ID NO: 6992912 - DNA, 19 bp, Homo sapiens
acttgttttggaggtgatg

SEQ ID NO: 6992913 - DNA, 19 bp, Homo sapiens
agggtcaggacaaggactt

SEQ ID NO: 6992914 - DNA, 22 bp, Homo sapiens
tatagactagcagcagaattta

SEQ ID NO: 6992915 - DNA, 22 bp, Homo sapiens
tagccctgctgtgatgtgaagt

SEQ ID NO: 6992916 - DNA, 22 bp, Homo sapiens
taaatacagtcatttgagccat

SEQ ID NO: 6992917 - DNA, 22 bp, Homo sapiens
aaggcatctggatggaggagga

SEQ ID NO: 6992918 - DNA, 22 bp, Homo sapiens
caaaagtaccttgtgtgctttg

SEQ ID NO: 6992919 - DNA, 22 bp, Homo sapiens
ttatggaaaatacaattataag

SEQ ID NO: 6992920 - DNA, 22 bp, Homo sapiens
aacccaggaggcggaggttgtg

SEQ ID NO: 6992921 - DNA, 22 bp, Homo sapiens
tctgaggcccagttcaactctt

SEQ ID NO: 6992922 - DNA, 22 bp, Homo sapiens
ctgacaggctgagatccctggt

SEQ ID NO: 6992923 - DNA, 22 bp, Homo sapiens
gtgcatttaggtcacatgatgt

SEQ ID NO: 6992924 - DNA, 22 bp, Homo sapiens
gtagacatctagatttatgtgt

SEQ ID NO: 6992925 - DNA, 22 bp, Homo sapiens
aattcacatgttgaagtcctaa

SEQ ID NO: 6992926 - DNA, 22 bp, Homo sapiens
cttatgatcctaaattgcaggt

SEQ ID NO: 6992927 - DNA, 22 bp, Homo sapiens
ccaggcatccattgcttcctct

SEQ ID NO: 6992928 - DNA, 22 bp, Homo sapiens
tacctggaaatggctttagtta

SEQ ID NO: 6992929 - DNA, 21 bp, Homo sapiens
atgaagatgacaatttgagag

SEQ ID NO: 6992930 - DNA, 23 bp, Homo sapiens
tcctgggtttgaattctagtctt

SEQ ID NO: 6992931 - DNA, 22 bp, Homo sapiens
tcaccaggctcctgttaagatg

SEQ ID NO: 6992932 - DNA, 22 bp, Homo sapiens
attggcagttggctgtggttca

SEQ ID NO: 6992933 - DNA, 22 bp, Homo sapiens
tgcatagttctccttcctcctc

SEQ ID NO: 6992934 - DNA, 22 bp, Homo sapiens
cagggaaggctgcaaatgttaa

SEQ ID NO: 6992935 - DNA, 22 bp, Homo sapiens
caggctttactttctctctgaa

SEQ ID NO: 6992936 - DNA, 22 bp, Homo sapiens
aggcgactgttgatttgaaatt

SEQ ID NO: 6992937 - DNA, 22 bp, Homo sapiens
aagggcccattctctcagaaaa

SEQ ID NO: 6992938 - DNA, 23 bp, Homo sapiens
tgtgcgtgatgctttgttgaagg

SEQ ID NO: 6992939 - DNA, 22 bp, Homo sapiens
ctggctcccgaagccctcagtg

SEQ ID NO: 6992940 - DNA, 22 bp, Homo sapiens
gcaagtgtctgaggttttgtat

SEQ ID NO: 6992941 - DNA, 22 bp, Homo sapiens
cagggtggccctgtggtctcat

SEQ ID NO: 6992942 - DNA, 22 bp, Homo sapiens
gaggcttctggaaagcctggca

SEQ ID NO: 6992943 - DNA, 22 bp, Homo sapiens
tgtgctattacacatttattta

SEQ ID NO: 6992944 - DNA, 22 bp, Homo sapiens
taatctagaacatatgagagca

SEQ ID NO: 6992945 - DNA, 22 bp, Homo sapiens
gaggatgtccacatggacggtg

SEQ ID NO: 6992946 - DNA, 22 bp, Homo sapiens
ggctgaaagcgcgacttgcccc

SEQ ID NO: 6992947 - DNA, 22 bp, Homo sapiens
atctggaatgtctcattgggaa

SEQ ID NO: 6992948 - DNA, 22 bp, Homo sapiens
ttgtgcatgatgcatacatggt

SEQ ID NO: 6992949 - DNA, 22 bp, Homo sapiens
tagaaagactgtccagatttca

SEQ ID NO: 6992950 - DNA, 22 bp, Homo sapiens
tttgtaactctccctttgtata

SEQ ID NO: 6992951 - DNA, 22 bp, Homo sapiens
tgtcccagcactttgggagtct

SEQ ID NO: 6992952 - DNA, 22 bp, Homo sapiens
atggcctctagctgagaccaat

SEQ ID NO: 6992953 - DNA, 22 bp, Homo sapiens
gcacactgcggtgatgtgagtc

SEQ ID NO: 6992954 - DNA, 22 bp, Homo sapiens
agcttctttgtgggctccagaa

SEQ ID NO: 6992955 - DNA, 22 bp, Homo sapiens
gaggccagatactctcttctgc

SEQ ID NO: 6992956 - DNA, 22 bp, Homo sapiens
gggcatgagatggtagtagctt

SEQ ID NO: 6992957 - DNA, 22 bp, Homo sapiens
cttcatgaggaagatttcacaa

SEQ ID NO: 6992958 - DNA, 22 bp, Homo sapiens
ccaggctggagtgcagtagtgt

SEQ ID NO: 6992959 - DNA, 22 bp, Homo sapiens
ccctggagtcaggttggcctgg

SEQ ID NO: 6992960 - DNA, 22 bp, Homo sapiens
tcaggaaccctggtctcctgct

SEQ ID NO: 6992961 - DNA, 22 bp, Homo sapiens
catgcatgccgggctgacagag

SEQ ID NO: 6992962 - DNA, 22 bp, Homo sapiens
agggagaacagttgcagcagac

SEQ ID NO: 6992963 - DNA, 22 bp, Homo sapiens
ttaggaaacagtagcctttgct

SEQ ID NO: 6992964 - DNA, 22 bp, Homo sapiens
caatgacaggttcatgactcct

SEQ ID NO: 6992965 - DNA, 22 bp, Homo sapiens
cagcccattcctgccatgccgc

SEQ ID NO: 6992966 - DNA, 22 bp, Homo sapiens
taacacagacagccactagtaa

SEQ ID NO: 6992967 - DNA, 22 bp, Homo sapiens
gctttggaaactggccctgcgc

SEQ ID NO: 6992968 - DNA, 22 bp, Homo sapiens
ctggccaggcatcccctgatcc

SEQ ID NO: 6992969 - DNA, 23 bp, Homo sapiens
cggctgctcggccgagtcctcgg

SEQ ID NO: 6992970 - DNA, 22 bp, Homo sapiens
cgaggaggaaacgcggagaact

SEQ ID NO: 6992971 - DNA, 20 bp, Homo sapiens
gaaatgtgacctcttctgtg

SEQ ID NO: 6992972 - DNA, 22 bp, Homo sapiens
agtacaagtattagagttattc

SEQ ID NO: 6992973 - DNA, 22 bp, Homo sapiens
taagcgtcctgtaaatgttagt

SEQ ID NO: 6992974 - DNA, 22 bp, Homo sapiens
tcctgtttatctgtgtgactcg

SEQ ID NO: 6992975 - DNA, 22 bp, Homo sapiens
ttctgtatgctctgggtccaga

SEQ ID NO: 6992976 - DNA, 22 bp, Homo sapiens
tgtgcatgtaccttattctgga

SEQ ID NO: 6992977 - DNA, 22 bp, Homo sapiens
tgctgctcatcagattttaaaa

SEQ ID NO: 6992978 - DNA, 22 bp, Homo sapiens
ctgcagtcatctgaagattttg

SEQ ID NO: 6992979 - DNA, 22 bp, Homo sapiens
aagcattttgccacttgaagtt

SEQ ID NO: 6992980 - DNA, 22 bp, Homo sapiens
agcaataatttaggcctttcct

SEQ ID NO: 6992981 - DNA, 22 bp, Homo sapiens
tttgtgtgtgctcacatagatg

SEQ ID NO: 6992982 - DNA, 22 bp, Homo sapiens
attggaaccctaggcaggcaga

SEQ ID NO: 6992983 - DNA, 22 bp, Homo sapiens
ttttttgcacactctgctaaat

SEQ ID NO: 6992984 - DNA, 19 bp, Homo sapiens
gatcaggagccgacaactg

SEQ ID NO: 6992985 - DNA, 22 bp, Homo sapiens
ttgcaggttttgccattagaag

SEQ ID NO: 6992986 - DNA, 22 bp, Homo sapiens
gccaggaagtgcagccctgcca

SEQ ID NO: 6992987 - DNA, 22 bp, Homo sapiens
caggtaggtatggtgcagtctt

SEQ ID NO: 6992988 - DNA, 22 bp, Homo sapiens
ttttatcttcattcctatctac

SEQ ID NO: 6992989 - DNA, 22 bp, Homo sapiens
acagagtagctcaagaagattg

SEQ ID NO: 6992990 - DNA, 22 bp, Homo sapiens
ggctgcctgccgcccacttggc

SEQ ID NO: 6992991 - DNA, 22 bp, Homo sapiens
cacttgcagactttgcctggtt

SEQ ID NO: 6992992 - DNA, 22 bp, Homo sapiens
cactgccacctgcatgccctga

SEQ ID NO: 6992993 - DNA, 22 bp, Homo sapiens
atgtgtcctgctgtgtcacaca

SEQ ID NO: 6992994 - DNA, 17 bp, Homo sapiens
agctacaaggcagttca

SEQ ID NO: 6992995 - DNA, 22 bp, Homo sapiens
aggccttgaaccttgctgggtg

SEQ ID NO: 6992996 - DNA, 20 bp, Homo sapiens
aaactctacctcaatcgtca

SEQ ID NO: 6992997 - DNA, 22 bp, Homo sapiens
ggtagcagggctgtgagtcaga

SEQ ID NO: 6992998 - DNA, 22 bp, Homo sapiens
gctgtgaagctgcctggggctg

SEQ ID NO: 6992999 - DNA, 22 bp, Homo sapiens
aaatgcacaggagaaccaattc

SEQ ID NO: 6993000 - DNA, 22 bp, Homo sapiens
gcagcatccttggcctccaccc

SEQ ID NO: 6993001 - DNA, 22 bp, Homo sapiens
tgagtgaaaaatttgcctggag

SEQ ID NO: 6993002 - DNA, 22 bp, Homo sapiens
acaggcctgacacacagagggc

SEQ ID NO: 6993003 - DNA, 22 bp, Homo sapiens
tgtgcagctactgaataaatag

SEQ ID NO: 6993004 - DNA, 22 bp, Homo sapiens
acttgtatggagacttggaacc

SEQ ID NO: 6993005 - DNA, 22 bp, Homo sapiens
atgagctgtaaggtggcttcct

SEQ ID NO: 6993006 - DNA, 22 bp, Homo sapiens
gctgcctccactggctcccagt

SEQ ID NO: 6993007 - DNA, 22 bp, Homo sapiens
gcacaaagatgaatacagaatg

SEQ ID NO: 6993008 - DNA, 22 bp, Homo sapiens
ctgagctattttccactactat

SEQ ID NO: 6993009 - DNA, 22 bp, Homo sapiens
tatgttcatagaaatcatgacc

SEQ ID NO: 6993010 - DNA, 22 bp, Homo sapiens
gagtagacattaaattacactg

SEQ ID NO: 6993011 - DNA, 22 bp, Homo sapiens
ttggaccatcagctcctcctgg

SEQ ID NO: 6993012 - DNA, 22 bp, Homo sapiens
gtgcaggggatcaggttgcagc

SEQ ID NO: 6993013 - DNA, 22 bp, Homo sapiens
gccttgctaatttctcctcaac

SEQ ID NO: 6993014 - DNA, 22 bp, Homo sapiens
tacattgtgatgtttcaataca

SEQ ID NO: 6993015 - DNA, 22 bp, Homo sapiens
tgggaagggagtttcttggagt

SEQ ID NO: 6993016 - DNA, 22 bp, Homo sapiens
cctggctctggttccctcagct

SEQ ID NO: 6993017 - DNA, 22 bp, Homo sapiens
ggcctcaagctaccctctcacc

SEQ ID NO: 6993018 - DNA, 22 bp, Homo sapiens
catgcaggttatatgtgcttct

SEQ ID NO: 6993019 - DNA, 23 bp, Homo sapiens
agcagctggggtgctcttttgtc

SEQ ID NO: 6993020 - DNA, 22 bp, Homo sapiens
gccatcctgtatcacaagatgt

SEQ ID NO: 6993021 - DNA, 22 bp, Homo sapiens
ctcctccctgcgattgctctgc

SEQ ID NO: 6993022 - DNA, 22 bp, Homo sapiens
ctgtgaatcttgatgttatttc

SEQ ID NO: 6993023 - DNA, 22 bp, Homo sapiens
atgcattgtctggtttcatttt

SEQ ID NO: 6993024 - DNA, 22 bp, Homo sapiens
atatgtactgaaactgcttttc

SEQ ID NO: 6993025 - DNA, 22 bp, Homo sapiens
tgctttgcacatagaagctcag

SEQ ID NO: 6993026 - DNA, 22 bp, Homo sapiens
ggaaggggagctaaatctactg

SEQ ID NO: 6993027 - DNA, 22 bp, Homo sapiens
taatccacaatagagattatct

SEQ ID NO: 6993028 - DNA, 22 bp, Homo sapiens
gctcaggaaggctcaaccagga

SEQ ID NO: 6993029 - DNA, 22 bp, Homo sapiens
tcttgctagaatcatttggaga

SEQ ID NO: 6993030 - DNA, 22 bp, Homo sapiens
tattgtgcacccttgcgttctg

SEQ ID NO: 6993031 - DNA, 21 bp, Homo sapiens
gctgaagacaaattctcttag

SEQ ID NO: 6993032 - DNA, 19 bp, Homo sapiens
cttgaaactactgttgaga

SEQ ID NO: 6993033 - DNA, 22 bp, Homo sapiens
tgcttgaaaggggtttcccagt

SEQ ID NO: 6993034 - DNA, 22 bp, Homo sapiens
gcctttatcagtttcatggctt

SEQ ID NO: 6993035 - DNA, 22 bp, Homo sapiens
ctcacagcacttgtgtcattgg

SEQ ID NO: 6993036 - DNA, 22 bp, Homo sapiens
tgatgacatgtgggctgtggct

SEQ ID NO: 6993037 - DNA, 22 bp, Homo sapiens
agtgaccaatcactgaatgatt

SEQ ID NO: 6993038 - DNA, 22 bp, Homo sapiens
atgctctacttacggctttcag

SEQ ID NO: 6993039 - DNA, 22 bp, Homo sapiens
ttaaaagtctgatgatttacat

SEQ ID NO: 6993040 - DNA, 19 bp, Homo sapiens
atcccatctggtttttccc

SEQ ID NO: 6993041 - DNA, 22 bp, Homo sapiens
gatgaagcctgacttctcggtg

SEQ ID NO: 6993042 - DNA, 22 bp, Homo sapiens
gggatcaataatggcaggtgtt

SEQ ID NO: 6993043 - DNA, 22 bp, Homo sapiens
gggtaggcccctcttgcttggg

SEQ ID NO: 6993044 - DNA, 22 bp, Homo sapiens
gcatcattctggctctttccat

SEQ ID NO: 6993045 - DNA, 22 bp, Homo sapiens
atgtttcatgactgagcaaaat

SEQ ID NO: 6993046 - DNA, 22 bp, Homo sapiens
ctgcagctttttgtgcttgtaa

SEQ ID NO: 6993047 - DNA, 22 bp, Homo sapiens
acaagaatttacatgtagtgga

SEQ ID NO: 6993048 - DNA, 22 bp, Homo sapiens
atgcagtttaaggcacaattag

SEQ ID NO: 6993049 - DNA, 22 bp, Homo sapiens
gaagatttttcttaatgctccg

SEQ ID NO: 6993050 - DNA, 19 bp, Homo sapiens
cctttggtttccatgacat

SEQ ID NO: 6993051 - DNA, 22 bp, Homo sapiens
gcaggcttctctcttccctacc

SEQ ID NO: 6993052 - DNA, 22 bp, Homo sapiens
ttcctgtggccttacatctgtg

SEQ ID NO: 6993053 - DNA, 22 bp, Homo sapiens
tcacagttgattgaaacacagc

SEQ ID NO: 6993054 - DNA, 22 bp, Homo sapiens
aagccctggattaaagatgcca

SEQ ID NO: 6993055 - DNA, 22 bp, Homo sapiens
aacagtcttcctacggccatta

SEQ ID NO: 6993056 - DNA, 22 bp, Homo sapiens
gctgtggccaacaaaccacttt

SEQ ID NO: 6993057 - DNA, 22 bp, Homo sapiens
tctcgctctgtcgcccaggctg

SEQ ID NO: 6993058 - DNA, 22 bp, Homo sapiens
ttgcaggttgaatcagcagact

SEQ ID NO: 6993059 - DNA, 22 bp, Homo sapiens
cctgctggtgtccaggctttgg

SEQ ID NO: 6993060 - DNA, 22 bp, Homo sapiens
agagggaatgtgattgcaccat

SEQ ID NO: 6993061 - DNA, 22 bp, Homo sapiens
ggagggctgccacccgctcacg

SEQ ID NO: 6993062 - DNA, 22 bp, Homo sapiens
caatagataactgagatagact

SEQ ID NO: 6993063 - DNA, 22 bp, Homo sapiens
cagttttagctagagcaaacca

SEQ ID NO: 6993064 - DNA, 22 bp, Homo sapiens
gggggctagagagatgaaatat

SEQ ID NO: 6993065 - DNA, 22 bp, Homo sapiens
aactgagttataactagaggta

SEQ ID NO: 6993066 - DNA, 22 bp, Homo sapiens
atgtcttgatattttactgttt

SEQ ID NO: 6993067 - DNA, 22 bp, Homo sapiens
cagacatggaaatttagtgtta

SEQ ID NO: 6993068 - DNA, 22 bp, Homo sapiens
gcctgtaatcccagcactttgg

SEQ ID NO: 6993069 - DNA, 22 bp, Homo sapiens
tcttgcatttaaggagctcata

SEQ ID NO: 6993070 - DNA, 22 bp, Homo sapiens
tggggcaaagtaggtatttagt

SEQ ID NO: 6993071 - DNA, 22 bp, Homo sapiens
taccttgggctattatctttga

SEQ ID NO: 6993072 - DNA, 22 bp, Homo sapiens
aaaggcttgtacagcagccttc

SEQ ID NO: 6993073 - DNA, 22 bp, Homo sapiens
tcacagtgaggagttacagttt

SEQ ID NO: 6993074 - DNA, 22 bp, Homo sapiens
ggcctctggtgcctgaagcgcc

SEQ ID NO: 6993075 - DNA, 22 bp, Homo sapiens
ggcagaggaggggtgaatttgc

SEQ ID NO: 6993076 - DNA, 22 bp, Homo sapiens
gactttctgtccagtgatttct

SEQ ID NO: 6993077 - DNA, 22 bp, Homo sapiens
cagggctgagtcatatagcctt

SEQ ID NO: 6993078 - DNA, 21 bp, Homo sapiens
tgaaagttggagtcaaatgta

SEQ ID NO: 6993079 - DNA, 22 bp, Homo sapiens
caggaaataaatggtaatgcat

SEQ ID NO: 6993080 - DNA, 22 bp, Homo sapiens
ctacttggtacctgaagatcgg

SEQ ID NO: 6993081 - DNA, 22 bp, Homo sapiens
ttacttgattgtggagtctgag

SEQ ID NO: 6993082 - DNA, 22 bp, Homo sapiens
tccatcagattccctcctgaga

SEQ ID NO: 6993083 - DNA, 16 bp, Homo sapiens
tttccaaagggcagct

SEQ ID NO: 6993084 - DNA, 20 bp, Homo sapiens
tttgtcaactgcatccagca

SEQ ID NO: 6993085 - DNA, 22 bp, Homo sapiens
ctggcttcctcaggagcagtgg

SEQ ID NO: 6993086 - DNA, 22 bp, Homo sapiens
ctgcccctcgaccaagcgcgtc

SEQ ID NO: 6993087 - DNA, 22 bp, Homo sapiens
tattggtcaatttcaccttgat

SEQ ID NO: 6993088 - DNA, 22 bp, Homo sapiens
tgggcaggggccctgcttccgt

SEQ ID NO: 6993089 - DNA, 22 bp, Homo sapiens
ctgttttccctggagttcagca

SEQ ID NO: 6993090 - DNA, 22 bp, Homo sapiens
tgcaggctctggtttatagtgc

SEQ ID NO: 6993091 - DNA, 22 bp, Homo sapiens
cgtctaggccgtgccctgaggt

SEQ ID NO: 6993092 - DNA, 22 bp, Homo sapiens
gcaccctgagtgttcagctcca

SEQ ID NO: 6993093 - DNA, 23 bp, Homo sapiens
tagtgtcatcctcagcttctgtt

SEQ ID NO: 6993094 - DNA, 22 bp, Homo sapiens
tctgcccttggctctcttgttg

SEQ ID NO: 6993095 - DNA, 22 bp, Homo sapiens
agtttagtataccagtacatct

SEQ ID NO: 6993096 - DNA, 22 bp, Homo sapiens
agatggttctcagaaactcaac

SEQ ID NO: 6993097 - DNA, 21 bp, Homo sapiens
ctgagctggggtgaaggttgc

SEQ ID NO: 6993098 - DNA, 22 bp, Homo sapiens
actgagactgcccctgtaacaa

SEQ ID NO: 6993099 - DNA, 22 bp, Homo sapiens
tgctcaaatgtggacaactgat

SEQ ID NO: 6993100 - DNA, 22 bp, Homo sapiens
aggattgttgcagggcttcgtt

SEQ ID NO: 6993101 - DNA, 22 bp, Homo sapiens
tacagcttgatgagagcgcgag

SEQ ID NO: 6993102 - DNA, 22 bp, Homo sapiens
gtgtcaggccctgcattatgtg

SEQ ID NO: 6993103 - DNA, 22 bp, Homo sapiens
aagagagaactcccttcgccag

SEQ ID NO: 6993104 - DNA, 22 bp, Homo sapiens
tcttttgtcatcccttgtacat

SEQ ID NO: 6993105 - DNA, 22 bp, Homo sapiens
acacttgttaagaagaggatat

SEQ ID NO: 6993106 - DNA, 19 bp, Homo sapiens
agctcaggcccatcgtccc

SEQ ID NO: 6993107 - DNA, 22 bp, Homo sapiens
catgcctgtaatcccagctctt

SEQ ID NO: 6993108 - DNA, 22 bp, Homo sapiens
tctccactattttctagctctt

SEQ ID NO: 6993109 - DNA, 22 bp, Homo sapiens
aggctgagctggcccttgaaat

SEQ ID NO: 6993110 - DNA, 22 bp, Homo sapiens
agtgacaggggaggcaggtgtg

SEQ ID NO: 6993111 - DNA, 22 bp, Homo sapiens
atgtactactacttgagtgagc

SEQ ID NO: 6993112 - DNA, 22 bp, Homo sapiens
tagatggcgtccatggccgcag

SEQ ID NO: 6993113 - DNA, 22 bp, Homo sapiens
gccatgctggaggcttcgattt

SEQ ID NO: 6993114 - DNA, 22 bp, Homo sapiens
tccaggcagggttaagggtcct

SEQ ID NO: 6993115 - DNA, 22 bp, Homo sapiens
ccttctctaccatgtgaggaaa

SEQ ID NO: 6993116 - DNA, 22 bp, Homo sapiens
agtcttggctgccgccgtctcc

SEQ ID NO: 6993117 - DNA, 22 bp, Homo sapiens
tgcttgattagggaagtcacat

SEQ ID NO: 6993118 - DNA, 22 bp, Homo sapiens
tctgtgttgataattttggaga

SEQ ID NO: 6993119 - DNA, 22 bp, Homo sapiens
atttcctgatatatcctgtagt

SEQ ID NO: 6993120 - DNA, 22 bp, Homo sapiens
aaggaggcctggcagatgaaga

SEQ ID NO: 6993121 - DNA, 22 bp, Homo sapiens
aaacctcttttaaggagttgtt

SEQ ID NO: 6993122 - DNA, 22 bp, Homo sapiens
tggagcagcacaagaaagggga

SEQ ID NO: 6993123 - DNA, 22 bp, Homo sapiens
ttctaattaaatctacgctagg

SEQ ID NO: 6993124 - DNA, 23 bp, Homo sapiens
agcagcagcaattaagtggatat

SEQ ID NO: 6993125 - DNA, 22 bp, Homo sapiens
ataagtaccactactgccttca

SEQ ID NO: 6993126 - DNA, 22 bp, Homo sapiens
gtggccatttggaaggcaagta

SEQ ID NO: 6993127 - DNA, 22 bp, Homo sapiens
acattgtactcttagcgttgtt

SEQ ID NO: 6993128 - DNA, 22 bp, Homo sapiens
tatgtgcattatctagttcatt

SEQ ID NO: 6993129 - DNA, 22 bp, Homo sapiens
cttgatgaatgacctgggtggt

SEQ ID NO: 6993130 - DNA, 22 bp, Homo sapiens
cagaaggtttacactggactgt

SEQ ID NO: 6993131 - DNA, 23 bp, Homo sapiens
aaggggatacttccactttcttt

SEQ ID NO: 6993132 - DNA, 22 bp, Homo sapiens
agtggcttatgtttagaatcat

SEQ ID NO: 6993133 - DNA, 22 bp, Homo sapiens
aaaagctttgccagatgagttg

SEQ ID NO: 6993134 - DNA, 19 bp, Homo sapiens
atgtgcccaggggaaagaa

SEQ ID NO: 6993135 - DNA, 22 bp, Homo sapiens
cagtacaatgttgaaaaggagt

SEQ ID NO: 6993136 - DNA, 23 bp, Homo sapiens
gttgaagtggtcggggaggcaga

SEQ ID NO: 6993137 - DNA, 22 bp, Homo sapiens
attcacatttagcctctgacat

SEQ ID NO: 6993138 - DNA, 22 bp, Homo sapiens
tcattataaacatatgctaaag

SEQ ID NO: 6993139 - DNA, 22 bp, Homo sapiens
agtaacttaagcaattgtgtat

SEQ ID NO: 6993140 - DNA, 22 bp, Homo sapiens
cataccctgaagggagttgcca

SEQ ID NO: 6993141 - DNA, 22 bp, Homo sapiens
tggtgagctctttagactggga

SEQ ID NO: 6993142 - DNA, 22 bp, Homo sapiens
caaagatatgacatggaaaatg

SEQ ID NO: 6993143 - DNA, 22 bp, Homo sapiens
caaggccagagccagcgataag

SEQ ID NO: 6993144 - DNA, 22 bp, Homo sapiens
ctagctagtccagaaacctctc

SEQ ID NO: 6993145 - DNA, 22 bp, Homo sapiens
tggtcacagtgtattgatcagg

SEQ ID NO: 6993146 - DNA, 22 bp, Homo sapiens
gttatttataaggtgtaactcc

SEQ ID NO: 6993147 - DNA, 22 bp, Homo sapiens
aggaaacagtgaacttggcagg

SEQ ID NO: 6993148 - DNA, 22 bp, Homo sapiens
aaaaggctaattaagttttgga

SEQ ID NO: 6993149 - DNA, 22 bp, Homo sapiens
ctctgctggccatgaagagaga

SEQ ID NO: 6993150 - DNA, 22 bp, Homo sapiens
tcgtggaatatggatgcttgtc

SEQ ID NO: 6993151 - DNA, 22 bp, Homo sapiens
agtgtgagtaattgagtctgtc

SEQ ID NO: 6993152 - DNA, 22 bp, Homo sapiens
cgcctggctgcagccggcgagg

SEQ ID NO: 6993153 - DNA, 22 bp, Homo sapiens
gggagggatctgctaggcaatg

SEQ ID NO: 6993154 - DNA, 22 bp, Homo sapiens
ctgctcagaggaaggaatgtct

SEQ ID NO: 6993155 - DNA, 22 bp, Homo sapiens
attattaggtgctctctgacaa

SEQ ID NO: 6993156 - DNA, 18 bp, Homo sapiens
tgctggggtagaatccac

SEQ ID NO: 6993157 - DNA, 21 bp, Homo sapiens
agctgcagtcaagccagaggt

SEQ ID NO: 6993158 - DNA, 22 bp, Homo sapiens
gtggcttccatgtgcatctgac

SEQ ID NO: 6993159 - DNA, 22 bp, Homo sapiens
ttcttttaaaagagagcagaaa

SEQ ID NO: 6993160 - DNA, 22 bp, Homo sapiens
tagctctgaccaagagactgag

SEQ ID NO: 6993161 - DNA, 22 bp, Homo sapiens
acccagagtcatgtttattccc

SEQ ID NO: 6993162 - DNA, 22 bp, Homo sapiens
actgcgctccagcctgggtgac

SEQ ID NO: 6993163 - DNA, 22 bp, Homo sapiens
gatcatgcttaaagttggagtc

SEQ ID NO: 6993164 - DNA, 22 bp, Homo sapiens
gtcttattatgaggttagactt

SEQ ID NO: 6993165 - DNA, 22 bp, Homo sapiens
cacagacccagaagggatgaag

SEQ ID NO: 6993166 - DNA, 22 bp, Homo sapiens
gtttggcactatgatgaggcta

SEQ ID NO: 6993167 - DNA, 22 bp, Homo sapiens
gccctggcctggcgcgttgtca

SEQ ID NO: 6993168 - DNA, 22 bp, Homo sapiens
agatggaggaaggctgaactca

SEQ ID NO: 6993169 - DNA, 22 bp, Homo sapiens
gccagctgaagccctggtggaa

SEQ ID NO: 6993170 - DNA, 22 bp, Homo sapiens
ctgtattttcatgcctacgtac

SEQ ID NO: 6993171 - DNA, 22 bp, Homo sapiens
tgagacaggcttccttcttggg

SEQ ID NO: 6993172 - DNA, 22 bp, Homo sapiens
gtctggggtactttcatctgat

SEQ ID NO: 6993173 - DNA, 22 bp, Homo sapiens
attggcagttagtgacgaggct

SEQ ID NO: 6993174 - DNA, 22 bp, Homo sapiens
tggagcattcaggtttcccttt

SEQ ID NO: 6993175 - DNA, 22 bp, Homo sapiens
aagatacataaaggtagagtct

SEQ ID NO: 6993176 - DNA, 22 bp, Homo sapiens
aacttgaaactgttccagaaaa

SEQ ID NO: 6993177 - DNA, 18 bp, Homo sapiens
gtgactgccccaaaaggc

SEQ ID NO: 6993178 - DNA, 22 bp, Homo sapiens
tgttcttagcaggagcatctat

SEQ ID NO: 6993179 - DNA, 22 bp, Homo sapiens
ttgtgctctgtgttatttaagg

SEQ ID NO: 6993180 - DNA, 22 bp, Homo sapiens
ctttaccacaaggacagaactt

SEQ ID NO: 6993181 - DNA, 22 bp, Homo sapiens
aactggtctttagaatattctg

SEQ ID NO: 6993182 - DNA, 22 bp, Homo sapiens
attaggaagaggatgtcagcat

SEQ ID NO: 6993183 - DNA, 20 bp, Homo sapiens
cggtgcagacagcccctcgt

SEQ ID NO: 6993184 - DNA, 22 bp, Homo sapiens
aaaagttcattagtgagcttct

SEQ ID NO: 6993185 - DNA, 22 bp, Homo sapiens
cctctaaattgtttgaagttgg

SEQ ID NO: 6993186 - DNA, 22 bp, Homo sapiens
ctatttctacacagggtcggcg

SEQ ID NO: 6993187 - DNA, 22 bp, Homo sapiens
gtttggggtctgcagagcggcg

SEQ ID NO: 6993188 - DNA, 20 bp, Homo sapiens
ctctggctccgcgtgaccgc

SEQ ID NO: 6993189 - DNA, 19 bp, Homo sapiens
aggaatttctcagggaggc

SEQ ID NO: 6993190 - DNA, 22 bp, Homo sapiens
aggagaagtaaggctagatgat

SEQ ID NO: 6993191 - DNA, 22 bp, Homo sapiens
gtttttctaggaccatgtgatt

SEQ ID NO: 6993192 - DNA, 22 bp, Homo sapiens
aatgatttcccctacacagaag

SEQ ID NO: 6993193 - DNA, 22 bp, Homo sapiens
atttcactctccctgccactta

SEQ ID NO: 6993194 - DNA, 22 bp, Homo sapiens
attgaggactggtggggagagc

SEQ ID NO: 6993195 - DNA, 22 bp, Homo sapiens
tggtaactgtgtggtgctcgat

SEQ ID NO: 6993196 - DNA, 22 bp, Homo sapiens
tgtgagaagggtgaggctttta

SEQ ID NO: 6993197 - DNA, 19 bp, Homo sapiens
actggcaaaaaaggttaat

SEQ ID NO: 6993198 - DNA, 22 bp, Homo sapiens
aggaagctgctggagtagtgtg

SEQ ID NO: 6993199 - DNA, 19 bp, Homo sapiens
tctgcagaggaattcttca

SEQ ID NO: 6993200 - DNA, 17 bp, Homo sapiens
ctctgggcagcctgggg

SEQ ID NO: 6993201 - DNA, 23 bp, Homo sapiens
ccacgtctgcactgtagctgttg

SEQ ID NO: 6993202 - DNA, 22 bp, Homo sapiens
ttggtaaataacaatcacagtg

SEQ ID NO: 6993203 - DNA, 22 bp, Homo sapiens
aaagtttagtgtcctctaccac

SEQ ID NO: 6993204 - DNA, 22 bp, Homo sapiens
gcacagggcaacaggtctgtta

SEQ ID NO: 6993205 - DNA, 22 bp, Homo sapiens
atctttggtgcatgatactttg

SEQ ID NO: 6993206 - DNA, 22 bp, Homo sapiens
taggtaatggataatgaagtga

SEQ ID NO: 6993207 - DNA, 22 bp, Homo sapiens
ccagaacagacctgcctgacct

SEQ ID NO: 6993208 - DNA, 22 bp, Homo sapiens
caggctcagctctggccagtgc

SEQ ID NO: 6993209 - DNA, 22 bp, Homo sapiens
taattataacatgctttctggc

SEQ ID NO: 6993210 - DNA, 22 bp, Homo sapiens
cagcatctttctcttctggagt

SEQ ID NO: 6993211 - DNA, 22 bp, Homo sapiens
cagattcttctgtatttttgct

SEQ ID NO: 6993212 - DNA, 23 bp, Homo sapiens
acacctgtgctgtagtcactaca

SEQ ID NO: 6993213 - DNA, 22 bp, Homo sapiens
tctttccacagcatgtccatgc

SEQ ID NO: 6993214 - DNA, 22 bp, Homo sapiens
tttggctcccacagattgcttt

SEQ ID NO: 6993215 - DNA, 22 bp, Homo sapiens
acccagagcacagatgcaacgt

SEQ ID NO: 6993216 - DNA, 21 bp, Homo sapiens
aggtaccaaaagcctgcatga

SEQ ID NO: 6993217 - DNA, 22 bp, Homo sapiens
tggtcagttgatcaggcagcag

SEQ ID NO: 6993218 - DNA, 22 bp, Homo sapiens
agcagctggtgcaactctaaga

SEQ ID NO: 6993219 - DNA, 22 bp, Homo sapiens
ctgacagtgtacactgacagct

SEQ ID NO: 6993220 - DNA, 22 bp, Homo sapiens
tcagagaggattttaataagtg

SEQ ID NO: 6993221 - DNA, 22 bp, Homo sapiens
agttattgaggtcccttccagt

SEQ ID NO: 6993222 - DNA, 22 bp, Homo sapiens
gctaggagtgggatggaagtcg

SEQ ID NO: 6993223 - DNA, 22 bp, Homo sapiens
atgaaatgtattcagatatgta

SEQ ID NO: 6993224 - DNA, 22 bp, Homo sapiens
tggctgcctagtgtctgagcag

SEQ ID NO: 6993225 - DNA, 22 bp, Homo sapiens
aagtgagtgaaaatgcagaata

SEQ ID NO: 6993226 - DNA, 22 bp, Homo sapiens
tggaacactggctttccactgt

SEQ ID NO: 6993227 - DNA, 22 bp, Homo sapiens
ctattcagcctctaagacaagt

SEQ ID NO: 6993228 - DNA, 22 bp, Homo sapiens
tatgctattcttcagagtgttc

SEQ ID NO: 6993229 - DNA, 22 bp, Homo sapiens
cccagctctggaaggtggggga

SEQ ID NO: 6993230 - DNA, 22 bp, Homo sapiens
tttcagaacataatgtgagcat

SEQ ID NO: 6993231 - DNA, 22 bp, Homo sapiens
tgttcctaaatatgaatggaga

SEQ ID NO: 6993232 - DNA, 22 bp, Homo sapiens
tagcagagtatcttgcaaatta

SEQ ID NO: 6993233 - DNA, 22 bp, Homo sapiens
gaggggagtgtcctccgggccc

SEQ ID NO: 6993234 - DNA, 22 bp, Homo sapiens
agggtgctctggaaaatgtagt

SEQ ID NO: 6993235 - DNA, 22 bp, Homo sapiens
atgcctttatcaggaggtaaat

SEQ ID NO: 6993236 - DNA, 22 bp, Homo sapiens
gcagcgtgatcccgcatttagg

SEQ ID NO: 6993237 - DNA, 22 bp, Homo sapiens
agctttgggccactggctggat

SEQ ID NO: 6993238 - DNA, 22 bp, Homo sapiens
tcattgtagggcatttagagag

SEQ ID NO: 6993239 - DNA, 22 bp, Homo sapiens
tgctgcagcggcatggtctttg

SEQ ID NO: 6993240 - DNA, 22 bp, Homo sapiens
tagagctgggcagtgctctgag

SEQ ID NO: 6993241 - DNA, 21 bp, Homo sapiens
tattagcttctggtgctgttt

SEQ ID NO: 6993242 - DNA, 21 bp, Homo sapiens
aattgaagatgtggagccatt

SEQ ID NO: 6993243 - DNA, 22 bp, Homo sapiens
tgctcctttcatccaattctca

SEQ ID NO: 6993244 - DNA, 22 bp, Homo sapiens
tttgttaaggagtattgcttct

SEQ ID NO: 6993245 - DNA, 22 bp, Homo sapiens
gcacaggagccaggtccttcac

SEQ ID NO: 6993246 - DNA, 21 bp, Homo sapiens
aagttttatgttgccatttgt

SEQ ID NO: 6993247 - DNA, 22 bp, Homo sapiens
tcgcgggctcccagctccgggt

SEQ ID NO: 6993248 - DNA, 22 bp, Homo sapiens
tggactcagaagtgttctttta

SEQ ID NO: 6993249 - DNA, 22 bp, Homo sapiens
cactgcaacctccgcctcctgg

SEQ ID NO: 6993250 - DNA, 22 bp, Homo sapiens
ttacagaaaagggctttaagag

SEQ ID NO: 6993251 - DNA, 22 bp, Homo sapiens
atccattctatgtgaaatgtcc

SEQ ID NO: 6993252 - DNA, 22 bp, Homo sapiens
aatagtgttgttcactcaggag

SEQ ID NO: 6993253 - DNA, 22 bp, Homo sapiens
agccaaggagtgcaggtggctt

SEQ ID NO: 6993254 - DNA, 22 bp, Homo sapiens
gtgcagaggtcacaaaagtgaa

SEQ ID NO: 6993255 - DNA, 20 bp, Homo sapiens
ttgagcaatcagtaaaggat

SEQ ID NO: 6993256 - DNA, 22 bp, Homo sapiens
gatgccttccaggattttggct

SEQ ID NO: 6993257 - DNA, 22 bp, Homo sapiens
acagaacaagacctgcttattg

SEQ ID NO: 6993258 - DNA, 20 bp, Homo sapiens
ggggcccaagccctcttgcc

SEQ ID NO: 6993259 - DNA, 23 bp, Homo sapiens
cctgcagctgccacgccctgctc

SEQ ID NO: 6993260 - DNA, 22 bp, Homo sapiens
tgatccatatgtgttacttctc

SEQ ID NO: 6993261 - DNA, 22 bp, Homo sapiens
tttacatggaatattgtcttgt

SEQ ID NO: 6993262 - DNA, 22 bp, Homo sapiens
gaggagacagtggagccgctac

SEQ ID NO: 6993263 - DNA, 22 bp, Homo sapiens
atcatcttcgaaaaaagtcaga

SEQ ID NO: 6993264 - DNA, 16 bp, Homo sapiens
gcagtaaaatggttag

SEQ ID NO: 6993265 - DNA, 22 bp, Homo sapiens
tgaggtgacacaatttactcca

SEQ ID NO: 6993266 - DNA, 22 bp, Homo sapiens
tcatgcaatgagtcaggaggca

SEQ ID NO: 6993267 - DNA, 22 bp, Homo sapiens
tgacagagcaagatctagataa

SEQ ID NO: 6993268 - DNA, 22 bp, Homo sapiens
gctctgggaactgactgccttc

SEQ ID NO: 6993269 - DNA, 22 bp, Homo sapiens
ccacttttcactaagatgaatt

SEQ ID NO: 6993270 - DNA, 22 bp, Homo sapiens
tacaaagtgattttggaattga

SEQ ID NO: 6993271 - DNA, 22 bp, Homo sapiens
atcagtgtttgcatgggagctt

SEQ ID NO: 6993272 - DNA, 22 bp, Homo sapiens
agaggtgaaagaatttggctct

SEQ ID NO: 6993273 - DNA, 22 bp, Homo sapiens
ttatgtgcttcaactgagccta

SEQ ID NO: 6993274 - DNA, 22 bp, Homo sapiens
gagtcgagcagaaagccgtcgg

SEQ ID NO: 6993275 - DNA, 23 bp, Homo sapiens
tctctgtgtgcctcagtttcttc

SEQ ID NO: 6993276 - DNA, 22 bp, Homo sapiens
acagatactcagctctatgctt

SEQ ID NO: 6993277 - DNA, 22 bp, Homo sapiens
ctgcctgcgccaccaccacgtc

SEQ ID NO: 6993278 - DNA, 22 bp, Homo sapiens
atctggctcacctgggtaaata

SEQ ID NO: 6993279 - DNA, 22 bp, Homo sapiens
aagataacaggaggagtttgta

SEQ ID NO: 6993280 - DNA, 22 bp, Homo sapiens
tttggctggatgatagaactaa

SEQ ID NO: 6993281 - DNA, 18 bp, Homo sapiens
tgtgtgcacctgccttga

SEQ ID NO: 6993282 - DNA, 22 bp, Homo sapiens
tcagaaatgtaagctgatgact

SEQ ID NO: 6993283 - DNA, 17 bp, Homo sapiens
tctgtttctcctttctt

SEQ ID NO: 6993284 - DNA, 22 bp, Homo sapiens
gaggggaagacttctggacagt

SEQ ID NO: 6993285 - DNA, 22 bp, Homo sapiens
ctgaaaggaataaggctctttg

SEQ ID NO: 6993286 - DNA, 22 bp, Homo sapiens
ggctgcagttgtgtgaaggccg

SEQ ID NO: 6993287 - DNA, 22 bp, Homo sapiens
ctgcaggtttattttcttacct

SEQ ID NO: 6993288 - DNA, 22 bp, Homo sapiens
cagaagacgcctgggtgctgta

SEQ ID NO: 6993289 - DNA, 22 bp, Homo sapiens
cacatactattttggttgggtt

SEQ ID NO: 6993290 - DNA, 22 bp, Homo sapiens
ccatccttgtcatcttcatgtt

SEQ ID NO: 6993291 - DNA, 22 bp, Homo sapiens
gagaggtttgtacactccgagg

SEQ ID NO: 6993292 - DNA, 22 bp, Homo sapiens
aaagcagtagttttcaaatagt

SEQ ID NO: 6993293 - DNA, 22 bp, Homo sapiens
atatgacgatatttttcgatga

SEQ ID NO: 6993294 - DNA, 22 bp, Homo sapiens
ggccttggagtcagccttgagc

SEQ ID NO: 6993295 - DNA, 22 bp, Homo sapiens
agcttatattctagtgatgcca

SEQ ID NO: 6993296 - DNA, 22 bp, Homo sapiens
gggcctgagctactaggtaggt

SEQ ID NO: 6993297 - DNA, 22 bp, Homo sapiens
ttatattgggtctggtatcagg

SEQ ID NO: 6993298 - DNA, 22 bp, Homo sapiens
tgtggaagaaacaagacacttt

SEQ ID NO: 6993299 - DNA, 22 bp, Homo sapiens
attatttctcactcacataata

SEQ ID NO: 6993300 - DNA, 22 bp, Homo sapiens
gaggtagggaagacaaatatgc

SEQ ID NO: 6993301 - DNA, 22 bp, Homo sapiens
cacctgcctgctagagcctgac

SEQ ID NO: 6993302 - DNA, 22 bp, Homo sapiens
acttcatattgtttccactaga

SEQ ID NO: 6993303 - DNA, 17 bp, Homo sapiens
ttttggtgagttgtttc

SEQ ID NO: 6993304 - DNA, 22 bp, Homo sapiens
ctctgtatgggatttactggtt

SEQ ID NO: 6993305 - DNA, 22 bp, Homo sapiens
tcacacgtccttgctactcctc

SEQ ID NO: 6993306 - DNA, 22 bp, Homo sapiens
tccatgagaacccttggagata

SEQ ID NO: 6993307 - DNA, 22 bp, Homo sapiens
cttaagcaaaatattctttcac

SEQ ID NO: 6993308 - DNA, 22 bp, Homo sapiens
tcctggagaaactcagagatct

SEQ ID NO: 6993309 - DNA, 22 bp, Homo sapiens
tttcctcttctggcaggcaggg

SEQ ID NO: 6993310 - DNA, 21 bp, Homo sapiens
gcaacttatcgcattctgcag

SEQ ID NO: 6993311 - DNA, 22 bp, Homo sapiens
caagcaacgactttcaagctgt

SEQ ID NO: 6993312 - DNA, 21 bp, Homo sapiens
gtatgctgggggttagggctt

SEQ ID NO: 6993313 - DNA, 18 bp, Homo sapiens
accagagccctgttctgg

SEQ ID NO: 6993314 - DNA, 22 bp, Homo sapiens
tgtcctgttatatgttgggtag

SEQ ID NO: 6993315 - DNA, 22 bp, Homo sapiens
tctgaattaactggggttgcca

SEQ ID NO: 6993316 - DNA, 19 bp, Homo sapiens
ttccaaaatcaggatttga

SEQ ID NO: 6993317 - DNA, 22 bp, Homo sapiens
ccctcgggtcgcggactgcgct

SEQ ID NO: 6993318 - DNA, 22 bp, Homo sapiens
tgtgttcattagcattgccttg

SEQ ID NO: 6993319 - DNA, 22 bp, Homo sapiens
atatctttgtttttgccaagat

SEQ ID NO: 6993320 - DNA, 22 bp, Homo sapiens
attgttatgaaaataagatgtt

SEQ ID NO: 6993321 - DNA, 22 bp, Homo sapiens
ttttcttatggtgaagcacaaa

SEQ ID NO: 6993322 - DNA, 22 bp, Homo sapiens
gcaatactcaacacttttgctt

SEQ ID NO: 6993323 - DNA, 22 bp, Homo sapiens
taaaatagaggatgtcatgcta

SEQ ID NO: 6993324 - DNA, 22 bp, Homo sapiens
tgcaaagtgctagcccacacca

SEQ ID NO: 6993325 - DNA, 22 bp, Homo sapiens
ttgattcatatagatatgcgtg

SEQ ID NO: 6993326 - DNA, 22 bp, Homo sapiens
agaggtcagagcaggaaaggca

SEQ ID NO: 6993327 - DNA, 19 bp, Homo sapiens
tccttgactgtattcagag

SEQ ID NO: 6993328 - DNA, 17 bp, Homo sapiens
tgccacttacctataca

SEQ ID NO: 6993329 - DNA, 22 bp, Homo sapiens
gcctggagcagacgtgtcccgg

SEQ ID NO: 6993330 - DNA, 22 bp, Homo sapiens
tggcagtttacagagttctgaa

SEQ ID NO: 6993331 - DNA, 22 bp, Homo sapiens
gtctcagagtcctacttattcc

SEQ ID NO: 6993332 - DNA, 22 bp, Homo sapiens
cgggcactccagcagaaatctt

SEQ ID NO: 6993333 - DNA, 22 bp, Homo sapiens
cagtgaaatagtggacatcaaa

SEQ ID NO: 6993334 - DNA, 22 bp, Homo sapiens
gccaggctccaggccctcctga

SEQ ID NO: 6993335 - DNA, 22 bp, Homo sapiens
tttacagtccccaggtgaggat

SEQ ID NO: 6993336 - DNA, 22 bp, Homo sapiens
gtggtatctgtctcccccactg

SEQ ID NO: 6993337 - DNA, 22 bp, Homo sapiens
ttgagttctggtcttttaaaag

SEQ ID NO: 6993338 - DNA, 22 bp, Homo sapiens
agtatacatagagatggctgtt

SEQ ID NO: 6993339 - DNA, 22 bp, Homo sapiens
tcaatgaaagagcatgcatttt

SEQ ID NO: 6993340 - DNA, 22 bp, Homo sapiens
cagcctttctgtttcctaaggt

SEQ ID NO: 6993341 - DNA, 21 bp, Homo sapiens
tctctggttctgaaatggttt

SEQ ID NO: 6993342 - DNA, 22 bp, Homo sapiens
tttgtatgaatgcatattttca

SEQ ID NO: 6993343 - DNA, 22 bp, Homo sapiens
tagcatctttttctgtcttcta

SEQ ID NO: 6993344 - DNA, 22 bp, Homo sapiens
ttctgacaattcagtaacagca

SEQ ID NO: 6993345 - DNA, 22 bp, Homo sapiens
gcgtggggtaggtagacatgga

SEQ ID NO: 6993346 - DNA, 22 bp, Homo sapiens
tactatctagctctttgcagag

SEQ ID NO: 6993347 - DNA, 22 bp, Homo sapiens
ggacatggaagtatggagtgga

SEQ ID NO: 6993348 - DNA, 22 bp, Homo sapiens
tgtggaaaattggaacgttcct

SEQ ID NO: 6993349 - DNA, 22 bp, Homo sapiens
gcttctcatgtttatttttaca

SEQ ID NO: 6993350 - DNA, 22 bp, Homo sapiens
agatatctgcaatataatttaa

SEQ ID NO: 6993351 - DNA, 20 bp, Homo sapiens
tggctgtgggcatctgtttc

SEQ ID NO: 6993352 - DNA, 22 bp, Homo sapiens
ttagtcctggatctcagagttc

SEQ ID NO: 6993353 - DNA, 22 bp, Homo sapiens
aaaggacatgtcaatatcaggc

SEQ ID NO: 6993354 - DNA, 18 bp, Homo sapiens
agttgctagatgctgtag

SEQ ID NO: 6993355 - DNA, 22 bp, Homo sapiens
gttggaaatgcagagtctcaga

SEQ ID NO: 6993356 - DNA, 20 bp, Homo sapiens
ggcagcttgggcagcagtta

SEQ ID NO: 6993357 - DNA, 22 bp, Homo sapiens
tctttcccttagaacattaaca

SEQ ID NO: 6993358 - DNA, 22 bp, Homo sapiens
tggagcagctgaacagagttga

SEQ ID NO: 6993359 - DNA, 17 bp, Homo sapiens
ttgggagagaaaggtat

SEQ ID NO: 6993360 - DNA, 17 bp, Homo sapiens
acacagggagagggagc

SEQ ID NO: 6993361 - DNA, 22 bp, Homo sapiens
gcccaaagtcactcagctagga

SEQ ID NO: 6993362 - DNA, 20 bp, Homo sapiens
atgtggctttttgacctgct

SEQ ID NO: 6993363 - DNA, 22 bp, Homo sapiens
catgcacacacgtgcatgtacg

SEQ ID NO: 6993364 - DNA, 18 bp, Homo sapiens
ggctcaggctatcctaac

SEQ ID NO: 6993365 - DNA, 22 bp, Homo sapiens
cagctgtctgctgaaggaagct

SEQ ID NO: 6993366 - DNA, 22 bp, Homo sapiens
aaatgcacagaaaggatgtgga

SEQ ID NO: 6993367 - DNA, 22 bp, Homo sapiens
tagcaccaaaactgaagaacat

SEQ ID NO: 6993368 - DNA, 22 bp, Homo sapiens
gaagttcaatgtcagcatctat

SEQ ID NO: 6993369 - DNA, 22 bp, Homo sapiens
ggccaggccaagagggttggaa

SEQ ID NO: 6993370 - DNA, 22 bp, Homo sapiens
ttcctggctctctgttgcacag

SEQ ID NO: 6993371 - DNA, 22 bp, Homo sapiens
ctttctcttgagcaagagctgt

SEQ ID NO: 6993372 - DNA, 22 bp, Homo sapiens
caggaggaaatgtgaccctgct

SEQ ID NO: 6993373 - DNA, 22 bp, Homo sapiens
tgtgatttcatctgaggccagg

SEQ ID NO: 6993374 - DNA, 22 bp, Homo sapiens
agtcagatttaaagctgtttga

SEQ ID NO: 6993375 - DNA, 22 bp, Homo sapiens
attaatttccaggcactgtgct

SEQ ID NO: 6993376 - DNA, 22 bp, Homo sapiens
gttcagtcacgtgcccaagttc

SEQ ID NO: 6993377 - DNA, 22 bp, Homo sapiens
gtacagtgggtgtagggaccag

SEQ ID NO: 6993378 - DNA, 22 bp, Homo sapiens
aaatgttaggttgtactgagtc

SEQ ID NO: 6993379 - DNA, 21 bp, Homo sapiens
ctttgcatacagatgccaatt

SEQ ID NO: 6993380 - DNA, 22 bp, Homo sapiens
caagggagttactgagggcggg

SEQ ID NO: 6993381 - DNA, 22 bp, Homo sapiens
gcccatggtcagggaggcaggg

SEQ ID NO: 6993382 - DNA, 22 bp, Homo sapiens
atttctcttagcaagacattac

SEQ ID NO: 6993383 - DNA, 22 bp, Homo sapiens
ctgcaagtatctaccattctct

SEQ ID NO: 6993384 - DNA, 16 bp, Homo sapiens
cagccctgaggaagaa

SEQ ID NO: 6993385 - DNA, 23 bp, Homo sapiens
ggcacagatgctgagcatgtgca

SEQ ID NO: 6993386 - DNA, 22 bp, Homo sapiens
gcctgccttcggtgcgcagcgg

SEQ ID NO: 6993387 - DNA, 22 bp, Homo sapiens
tcccaccttccgtggaacccgt

SEQ ID NO: 6993388 - DNA, 22 bp, Homo sapiens
agcaaagcaccatatggcagtt

SEQ ID NO: 6993389 - DNA, 22 bp, Homo sapiens
tcacatacactaggatattttt

SEQ ID NO: 6993390 - DNA, 22 bp, Homo sapiens
ttcagtgcttacaggtttcttt

SEQ ID NO: 6993391 - DNA, 22 bp, Homo sapiens
aaggccagactctggaatgaca

SEQ ID NO: 6993392 - DNA, 22 bp, Homo sapiens
ttggttcaaaacatggaagggt

SEQ ID NO: 6993393 - DNA, 22 bp, Homo sapiens
aatcacatgcagggcctccacc

SEQ ID NO: 6993394 - DNA, 23 bp, Homo sapiens
aatggtcttcctccacccctctg

SEQ ID NO: 6993395 - DNA, 22 bp, Homo sapiens
catgcactgagagggtctcggc

SEQ ID NO: 6993396 - DNA, 22 bp, Homo sapiens
aggttattttgctcagggaact

SEQ ID NO: 6993397 - DNA, 19 bp, Homo sapiens
atggctctgatttaatgtg

SEQ ID NO: 6993398 - DNA, 22 bp, Homo sapiens
agctgtctgtgaacacagcatt

SEQ ID NO: 6993399 - DNA, 23 bp, Homo sapiens
tggtctgaagcctcaggttcctc

SEQ ID NO: 6993400 - DNA, 22 bp, Homo sapiens
ttgcaggtggtttggccataga

SEQ ID NO: 6993401 - DNA, 17 bp, Homo sapiens
gagatggcattggcagc

SEQ ID NO: 6993402 - DNA, 20 bp, Homo sapiens
agctcctcatcactggaggt

SEQ ID NO: 6993403 - DNA, 22 bp, Homo sapiens
attagcagctttctggtctcta

SEQ ID NO: 6993404 - DNA, 22 bp, Homo sapiens
tgaagaaacgcagagaggtagg

SEQ ID NO: 6993405 - DNA, 22 bp, Homo sapiens
acagcaggcacacaaggataga

SEQ ID NO: 6993406 - DNA, 22 bp, Homo sapiens
tgttggaataagtgcttgaagg

SEQ ID NO: 6993407 - DNA, 22 bp, Homo sapiens
taaaccatccatcccacctgtg

SEQ ID NO: 6993408 - DNA, 22 bp, Homo sapiens
gtctttagttgaaacatgtggt

SEQ ID NO: 6993409 - DNA, 19 bp, Homo sapiens
tctctgtgtctctgtttat

SEQ ID NO: 6993410 - DNA, 22 bp, Homo sapiens
gtacagaaagtacccatagaag

SEQ ID NO: 6993411 - DNA, 23 bp, Homo sapiens
cggcttctgaaatcccatctgtt

SEQ ID NO: 6993412 - DNA, 22 bp, Homo sapiens
aggagccatgagtgacatcaca

SEQ ID NO: 6993413 - DNA, 22 bp, Homo sapiens
actgaaggctttcccaaggtca

SEQ ID NO: 6993414 - DNA, 22 bp, Homo sapiens
tcccagggctctagagtgctgg

SEQ ID NO: 6993415 - DNA, 22 bp, Homo sapiens
ctagagaatggcaaagattaga

SEQ ID NO: 6993416 - DNA, 22 bp, Homo sapiens
tcatccatactattgagaggca

SEQ ID NO: 6993417 - DNA, 22 bp, Homo sapiens
tggctcacttccgtggagaggt

SEQ ID NO: 6993418 - DNA, 22 bp, Homo sapiens
gtgctgaaatggacctcaggaa

SEQ ID NO: 6993419 - DNA, 22 bp, Homo sapiens
gaatacatttgccgtggttctc

SEQ ID NO: 6993420 - DNA, 22 bp, Homo sapiens
tgagtctttccaaagccgtcat

SEQ ID NO: 6993421 - DNA, 22 bp, Homo sapiens
cagagtttaaacaaatgaaata

SEQ ID NO: 6993422 - DNA, 23 bp, Homo sapiens
aggccagcgcagacaccgagcac

SEQ ID NO: 6993423 - DNA, 22 bp, Homo sapiens
actgtactccagcctcggtgac

SEQ ID NO: 6993424 - DNA, 17 bp, Homo sapiens
tggaagcttcatgttgg

SEQ ID NO: 6993425 - DNA, 22 bp, Homo sapiens
cagggctgaaatcaaggtgtag

SEQ ID NO: 6993426 - DNA, 22 bp, Homo sapiens
tgacacccatctgtgccagtcc

SEQ ID NO: 6993427 - DNA, 19 bp, Homo sapiens
agctcctgggctctgggcc

SEQ ID NO: 6993428 - DNA, 22 bp, Homo sapiens
tgcccagcacccagcatgatgc

SEQ ID NO: 6993429 - DNA, 22 bp, Homo sapiens
tgcagagaaagtgtagacaggc

SEQ ID NO: 6993430 - DNA, 22 bp, Homo sapiens
actcactttccattcaagcacc

SEQ ID NO: 6993431 - DNA, 22 bp, Homo sapiens
agagtctgcctttttctcctgc

SEQ ID NO: 6993432 - DNA, 22 bp, Homo sapiens
atgttatgtctgggaaggggta

SEQ ID NO: 6993433 - DNA, 22 bp, Homo sapiens
tggagccaaaaagggaaggaga

SEQ ID NO: 6993434 - DNA, 22 bp, Homo sapiens
agccctctgagcctgggttgta

SEQ ID NO: 6993435 - DNA, 22 bp, Homo sapiens
ataggcttgagctaagagagaa

SEQ ID NO: 6993436 - DNA, 22 bp, Homo sapiens
gtcacagatggggaaacggagg

SEQ ID NO: 6993437 - DNA, 22 bp, Homo sapiens
taggagaggtgaatggcacact

SEQ ID NO: 6993438 - DNA, 21 bp, Homo sapiens
aaattcacctagtaaaacttc

SEQ ID NO: 6993439 - DNA, 22 bp, Homo sapiens
tgccaccccggaccccgaagtg

SEQ ID NO: 6993440 - DNA, 20 bp, Homo sapiens
ttgtgtaggtctaatgcata

SEQ ID NO: 6993441 - DNA, 22 bp, Homo sapiens
attcaactgtaaacttgttcac

SEQ ID NO: 6993442 - DNA, 22 bp, Homo sapiens
tcagaagagctggtgctgcctg

SEQ ID NO: 6993443 - DNA, 22 bp, Homo sapiens
tctctccttatcattgtgttta

SEQ ID NO: 6993444 - DNA, 22 bp, Homo sapiens
agggcagttcaacttcatagtg

SEQ ID NO: 6993445 - DNA, 22 bp, Homo sapiens
tttgcctgattctaagagctca

SEQ ID NO: 6993446 - DNA, 22 bp, Homo sapiens
tcagggagggacctgaggctgg

SEQ ID NO: 6993447 - DNA, 22 bp, Homo sapiens
ataaagcaagcataccattaag

SEQ ID NO: 6993448 - DNA, 22 bp, Homo sapiens
tgctgctcacacacagtgaatg

SEQ ID NO: 6993449 - DNA, 22 bp, Homo sapiens
acgggccttctcttcaggcgag

SEQ ID NO: 6993450 - DNA, 22 bp, Homo sapiens
gaggtaagggcaggagagtgaa

SEQ ID NO: 6993451 - DNA, 22 bp, Homo sapiens
actcaccacacccttgcacttg

SEQ ID NO: 6993452 - DNA, 22 bp, Homo sapiens
gtttctcagaggcccccaaaca

SEQ ID NO: 6993453 - DNA, 22 bp, Homo sapiens
tgcagcccagccccagaacctt

SEQ ID NO: 6993454 - DNA, 22 bp, Homo sapiens
tgccattcatttttaaggaagg

SEQ ID NO: 6993455 - DNA, 22 bp, Homo sapiens
gcctggctgcttagcctacttc

SEQ ID NO: 6993456 - DNA, 22 bp, Homo sapiens
gcttctatcctaccatgtcttg

SEQ ID NO: 6993457 - DNA, 22 bp, Homo sapiens
atttaataccacttggtgcttt

SEQ ID NO: 6993458 - DNA, 22 bp, Homo sapiens
ttgccatttagaggttaaacct

SEQ ID NO: 6993459 - DNA, 22 bp, Homo sapiens
cttctcaaactgagactgtcta

SEQ ID NO: 6993460 - DNA, 22 bp, Homo sapiens
gcagatggtggaggcaagaggc

SEQ ID NO: 6993461 - DNA, 22 bp, Homo sapiens
ctgccaagtaatgcctgggctc

SEQ ID NO: 6993462 - DNA, 22 bp, Homo sapiens
atcttggtctttgggaaagctg

SEQ ID NO: 6993463 - DNA, 22 bp, Homo sapiens
tcagggccctggacaaccctcc

SEQ ID NO: 6993464 - DNA, 22 bp, Homo sapiens
ggcagcatcttgatattggttt

SEQ ID NO: 6993465 - DNA, 22 bp, Homo sapiens
gtcagagctgtgcaaggctgag

SEQ ID NO: 6993466 - DNA, 22 bp, Homo sapiens
tatgttctagacttttgctgtg

SEQ ID NO: 6993467 - DNA, 22 bp, Homo sapiens
actgtctgtcctgctctccgtg

SEQ ID NO: 6993468 - DNA, 22 bp, Homo sapiens
ctgaatagtgttatatgggtga

SEQ ID NO: 6993469 - DNA, 19 bp, Homo sapiens
tagcagagatgactccagc

SEQ ID NO: 6993470 - DNA, 22 bp, Homo sapiens
acaggcacaccttcctgcaggc

SEQ ID NO: 6993471 - DNA, 22 bp, Homo sapiens
tggctggcagtaggctagtggc

SEQ ID NO: 6993472 - DNA, 22 bp, Homo sapiens
gatctcctggacgtcttgttaa

SEQ ID NO: 6993473 - DNA, 22 bp, Homo sapiens
acttagcacagagccaggtagg

SEQ ID NO: 6993474 - DNA, 22 bp, Homo sapiens
gcaattatatcaccagagatct

SEQ ID NO: 6993475 - DNA, 22 bp, Homo sapiens
agttctcacttcagagctgccc

SEQ ID NO: 6993476 - DNA, 22 bp, Homo sapiens
aaactctaggacgatgggatag

SEQ ID NO: 6993477 - DNA, 22 bp, Homo sapiens
actggaagccagttgacaatca

SEQ ID NO: 6993478 - DNA, 21 bp, Homo sapiens
aggctctcatccagggaccca

SEQ ID NO: 6993479 - DNA, 23 bp, Homo sapiens
ctgggcacccagtacctaggccc

SEQ ID NO: 6993480 - DNA, 22 bp, Homo sapiens
tacattagcaaacatcttggtg

SEQ ID NO: 6993481 - DNA, 22 bp, Homo sapiens
caagatttagctcccttatctc

SEQ ID NO: 6993482 - DNA, 20 bp, Homo sapiens
tatgacaacgcagcaaggca

SEQ ID NO: 6993483 - DNA, 22 bp, Homo sapiens
cagctggcagaacctgcatcca

SEQ ID NO: 6993484 - DNA, 22 bp, Homo sapiens
tccttcagggttgaggccgact

SEQ ID NO: 6993485 - DNA, 22 bp, Homo sapiens
ataatttttgtttgatgtccaa

SEQ ID NO: 6993486 - DNA, 22 bp, Homo sapiens
aacactctctgttggtaaggct

SEQ ID NO: 6993487 - DNA, 22 bp, Homo sapiens
tcacattgtaggatagcagaga

SEQ ID NO: 6993488 - DNA, 22 bp, Homo sapiens
ctgtcccttcccaagcccagcc

SEQ ID NO: 6993489 - DNA, 22 bp, Homo sapiens
atgctgatgctgcttttgccct

SEQ ID NO: 6993490 - DNA, 22 bp, Homo sapiens
gtgtataacccaaatatgctgc

SEQ ID NO: 6993491 - DNA, 22 bp, Homo sapiens
gaccaacagaatttcctgtttt

SEQ ID NO: 6993492 - DNA, 22 bp, Homo sapiens
tttcagccagtgatgctgaaga

SEQ ID NO: 6993493 - DNA, 22 bp, Homo sapiens
tctggtagaagaagtgaagctg

SEQ ID NO: 6993494 - DNA, 22 bp, Homo sapiens
ttggaaggccctgcctagcagg

SEQ ID NO: 6993495 - DNA, 22 bp, Homo sapiens
ttgtaagagagaattgcaaatt

SEQ ID NO: 6993496 - DNA, 17 bp, Homo sapiens
atacaaagccataaacc

SEQ ID NO: 6993497 - DNA, 22 bp, Homo sapiens
ttacaacatatgataggagtct

SEQ ID NO: 6993498 - DNA, 19 bp, Homo sapiens
tgttttgttaaagcagtcc

SEQ ID NO: 6993499 - DNA, 22 bp, Homo sapiens
gatttacaggttaggtcctgta

SEQ ID NO: 6993500 - DNA, 22 bp, Homo sapiens
ggctgtggggaccaacaggact

SEQ ID NO: 6993501 - DNA, 22 bp, Homo sapiens
agaggccacaccagcctcccgt

SEQ ID NO: 6993502 - DNA, 22 bp, Homo sapiens
aatctgttcctgaggcaccaga

SEQ ID NO: 6993503 - DNA, 22 bp, Homo sapiens
cagtttagtaggtgatatcaat

SEQ ID NO: 6993504 - DNA, 22 bp, Homo sapiens
agctgcctctcttgaggttacg

SEQ ID NO: 6993505 - DNA, 22 bp, Homo sapiens
caacagagcagttgatcaggaa

SEQ ID NO: 6993506 - DNA, 22 bp, Homo sapiens
agtgctgtcccgacaactgagg

SEQ ID NO: 6993507 - DNA, 22 bp, Homo sapiens
agaagttttcattacctataca

SEQ ID NO: 6993508 - DNA, 19 bp, Homo sapiens
ccagaagggcagctatgga

SEQ ID NO: 6993509 - DNA, 22 bp, Homo sapiens
tgagtgggattaaatgaggtga

SEQ ID NO: 6993510 - DNA, 21 bp, Homo sapiens
gctgcctgcccctcgggggct

SEQ ID NO: 6993511 - DNA, 16 bp, Homo sapiens
ggctccagaatagcga

SEQ ID NO: 6993512 - DNA, 22 bp, Homo sapiens
tgggctgaacttcatctgatga

SEQ ID NO: 6993513 - DNA, 17 bp, Homo sapiens
acagcagggaagtgttg

SEQ ID NO: 6993514 - DNA, 23 bp, Homo sapiens
ttgcaaagggcaaaggtcatgtg

SEQ ID NO: 6993515 - DNA, 22 bp, Homo sapiens
cagggctcatctgtgtgaccag

SEQ ID NO: 6993516 - DNA, 22 bp, Homo sapiens
ttgcatgtgccagtggcatgtc

SEQ ID NO: 6993517 - DNA, 22 bp, Homo sapiens
ttggtttccttaacagcctaaa

SEQ ID NO: 6993518 - DNA, 22 bp, Homo sapiens
tccaggcaaaaaccaactacag

SEQ ID NO: 6993519 - DNA, 22 bp, Homo sapiens
ggcggtcagcgtgggagaggct

SEQ ID NO: 6993520 - DNA, 22 bp, Homo sapiens
ggtagaattcacattcagttct

SEQ ID NO: 6993521 - DNA, 22 bp, Homo sapiens
ttctttgtaacctttgggaact

SEQ ID NO: 6993522 - DNA, 22 bp, Homo sapiens
caggacagtttgctttgccctg

SEQ ID NO: 6993523 - DNA, 22 bp, Homo sapiens
ctgaaatggttgcctggagaat

SEQ ID NO: 6993524 - DNA, 18 bp, Homo sapiens
attatgctcattacagtg

SEQ ID NO: 6993525 - DNA, 22 bp, Homo sapiens
tctgagctttcttgtgctcaag

SEQ ID NO: 6993526 - DNA, 22 bp, Homo sapiens
gcacagctggactctgcctggc

SEQ ID NO: 6993527 - DNA, 22 bp, Homo sapiens
gcctggcctgaactaggaggtg

SEQ ID NO: 6993528 - DNA, 22 bp, Homo sapiens
tcctgggagtaattgagtcatg

SEQ ID NO: 6993529 - DNA, 22 bp, Homo sapiens
gcgtccagggaaggcccagctg

SEQ ID NO: 6993530 - DNA, 22 bp, Homo sapiens
ggagccctccatcccttgcggc

SEQ ID NO: 6993531 - DNA, 22 bp, Homo sapiens
aagtctctgactcacacaatgt

SEQ ID NO: 6993532 - DNA, 22 bp, Homo sapiens
aatcagagcaagacatggaaca

SEQ ID NO: 6993533 - DNA, 22 bp, Homo sapiens
aaactgccaaaagaccttggat

SEQ ID NO: 6993534 - DNA, 21 bp, Homo sapiens
ggagaaggacaatgttgagta

SEQ ID NO: 6993535 - DNA, 22 bp, Homo sapiens
gttttacaaatgacggcattca

SEQ ID NO: 6993536 - DNA, 22 bp, Homo sapiens
actgtccggcacaagtgccacc

SEQ ID NO: 6993537 - DNA, 22 bp, Homo sapiens
gcctttattttcaacggagtgt

SEQ ID NO: 6993538 - DNA, 21 bp, Homo sapiens
tgcaagcagcagagatatggg

SEQ ID NO: 6993539 - DNA, 22 bp, Homo sapiens
tacaatgttaaggaaagagaga

SEQ ID NO: 6993540 - DNA, 22 bp, Homo sapiens
tcagtatttctaaacattggct

SEQ ID NO: 6993541 - DNA, 22 bp, Homo sapiens
agtgtgcttaagtttatcagga

SEQ ID NO: 6993542 - DNA, 22 bp, Homo sapiens
aggtcaaaagcaaggccaggtt

SEQ ID NO: 6993543 - DNA, 22 bp, Homo sapiens
agacataagcgagcatcacagg

SEQ ID NO: 6993544 - DNA, 22 bp, Homo sapiens
aggccgaggcgggcggatcacc

SEQ ID NO: 6993545 - DNA, 22 bp, Homo sapiens
cttctgggtattccagatacct

SEQ ID NO: 6993546 - DNA, 22 bp, Homo sapiens
tcaaggtcaaagctcctgtcct

SEQ ID NO: 6993547 - DNA, 22 bp, Homo sapiens
ggacaggccctctggtcagctt

SEQ ID NO: 6993548 - DNA, 20 bp, Homo sapiens
cctgggctccaggagccccg

SEQ ID NO: 6993549 - DNA, 22 bp, Homo sapiens
gccaggacggtgaatgggctac

SEQ ID NO: 6993550 - DNA, 22 bp, Homo sapiens
cgtaagaaatagcttgtcaaag

SEQ ID NO: 6993551 - DNA, 22 bp, Homo sapiens
tctgacttcctccacatctgtt

SEQ ID NO: 6993552 - DNA, 22 bp, Homo sapiens
ggagcatgtggggtgagcaggg

SEQ ID NO: 6993553 - DNA, 22 bp, Homo sapiens
gctttgcagacaaaattccagc

SEQ ID NO: 6993554 - DNA, 22 bp, Homo sapiens
ttctgggggaatacagctatga

SEQ ID NO: 6993555 - DNA, 22 bp, Homo sapiens
tggctggacagtgggcagtgga

SEQ ID NO: 6993556 - DNA, 22 bp, Homo sapiens
gtatttctttatctggtcagaa

SEQ ID NO: 6993557 - DNA, 22 bp, Homo sapiens
ggctgtctgtggtggagcgttg

SEQ ID NO: 6993558 - DNA, 22 bp, Homo sapiens
gaggggcagaggtagagaacaa

SEQ ID NO: 6993559 - DNA, 17 bp, Homo sapiens
tgtttcacttggggaaa

SEQ ID NO: 6993560 - DNA, 22 bp, Homo sapiens
agtctttaatgatcatgtattt

SEQ ID NO: 6993561 - DNA, 22 bp, Homo sapiens
gatttctacttgaacttgctaa

SEQ ID NO: 6993562 - DNA, 22 bp, Homo sapiens
ggaggtgctggcggccagctct

SEQ ID NO: 6993563 - DNA, 22 bp, Homo sapiens
gtatttggtctatttggcatcc

SEQ ID NO: 6993564 - DNA, 22 bp, Homo sapiens
aatgtcatagcaaagagagtga

SEQ ID NO: 6993565 - DNA, 22 bp, Homo sapiens
agtcagtatgacttatagttct

SEQ ID NO: 6993566 - DNA, 22 bp, Homo sapiens
tctggagtgccctgctctgccc

SEQ ID NO: 6993567 - DNA, 22 bp, Homo sapiens
atgcagggacctttgctttggt

SEQ ID NO: 6993568 - DNA, 22 bp, Homo sapiens
gaggctgttggctgatctgagt

SEQ ID NO: 6993569 - DNA, 22 bp, Homo sapiens
ggcagctctgctccttggctcc

SEQ ID NO: 6993570 - DNA, 22 bp, Homo sapiens
agcacactggcattgggaagct

SEQ ID NO: 6993571 - DNA, 22 bp, Homo sapiens
cattggctcctgtgggacatga

SEQ ID NO: 6993572 - DNA, 22 bp, Homo sapiens
aagcacaggatcttgaggagcg

SEQ ID NO: 6993573 - DNA, 22 bp, Homo sapiens
ctgggctcctaaccatccaggt

SEQ ID NO: 6993574 - DNA, 22 bp, Homo sapiens
aaagctcttggattttagactc

SEQ ID NO: 6993575 - DNA, 22 bp, Homo sapiens
gagctgccggcccacagtacta

SEQ ID NO: 6993576 - DNA, 22 bp, Homo sapiens
agcaccaggctgttggaagccc

SEQ ID NO: 6993577 - DNA, 22 bp, Homo sapiens
ctgggctgaaggctccccacac

SEQ ID NO: 6993578 - DNA, 22 bp, Homo sapiens
gcgtttgtaggggtgttttgcc

SEQ ID NO: 6993579 - DNA, 22 bp, Homo sapiens
ccaagatgagctggctccatgg

SEQ ID NO: 6993580 - DNA, 20 bp, Homo sapiens
gtggatgatcagtgtagtgg

SEQ ID NO: 6993581 - DNA, 22 bp, Homo sapiens
agcaattttctaagcaaaatac

SEQ ID NO: 6993582 - DNA, 22 bp, Homo sapiens
attttaataagatccatttggt

SEQ ID NO: 6993583 - DNA, 16 bp, Homo sapiens
tggcacagagcagata

SEQ ID NO: 6993584 - DNA, 22 bp, Homo sapiens
atctggacagtgttactatgac

SEQ ID NO: 6993585 - DNA, 22 bp, Homo sapiens
ttttattctaagtatgatggga

SEQ ID NO: 6993586 - DNA, 22 bp, Homo sapiens
agttctttggcagctgggctgg

SEQ ID NO: 6993587 - DNA, 22 bp, Homo sapiens
gccccctctttggagccagcca

SEQ ID NO: 6993588 - DNA, 22 bp, Homo sapiens
ttataccctccatacctggcct

SEQ ID NO: 6993589 - DNA, 23 bp, Homo sapiens
caattgtataaagcaaatggttt

SEQ ID NO: 6993590 - DNA, 23 bp, Homo sapiens
ctacaagagcaagcatggacaag

SEQ ID NO: 6993591 - DNA, 22 bp, Homo sapiens
agtcttatatcactatgctctg

SEQ ID NO: 6993592 - DNA, 22 bp, Homo sapiens
ccagtccatggattcccaaggt

SEQ ID NO: 6993593 - DNA, 22 bp, Homo sapiens
ggcagtggctgtagtctcttgg

SEQ ID NO: 6993594 - DNA, 22 bp, Homo sapiens
tcttacgaattcttagaggaca

SEQ ID NO: 6993595 - DNA, 22 bp, Homo sapiens
gtttggcataaatattttcacc

SEQ ID NO: 6993596 - DNA, 22 bp, Homo sapiens
aaacaatgttgtctccaagagg

SEQ ID NO: 6993597 - DNA, 22 bp, Homo sapiens
gtgttttaagaaagaagctcag

SEQ ID NO: 6993598 - DNA, 22 bp, Homo sapiens
ctctgtttggcgctgctccttc

SEQ ID NO: 6993599 - DNA, 22 bp, Homo sapiens
cttttagtattctgatttgcca

SEQ ID NO: 6993600 - DNA, 22 bp, Homo sapiens
tttgtgctgaagatccagagca

SEQ ID NO: 6993601 - DNA, 22 bp, Homo sapiens
gagtttaggttcatgaacgagt

SEQ ID NO: 6993602 - DNA, 22 bp, Homo sapiens
aggaaacatgaatctgccttga

SEQ ID NO: 6993603 - DNA, 22 bp, Homo sapiens
aaatttgccagatcaattctga

SEQ ID NO: 6993604 - DNA, 22 bp, Homo sapiens
cctgtgaatgcattaatgagtg

SEQ ID NO: 6993605 - DNA, 22 bp, Homo sapiens
catccagtgggacagagaaacc

SEQ ID NO: 6993606 - DNA, 17 bp, Homo sapiens
gggaagtggagaaagct

SEQ ID NO: 6993607 - DNA, 22 bp, Homo sapiens
agattatctcctgattttaagg

SEQ ID NO: 6993608 - DNA, 22 bp, Homo sapiens
agcccagctttgaaccatatca

SEQ ID NO: 6993609 - DNA, 22 bp, Homo sapiens
gtcctggaatcctagaacagtg

SEQ ID NO: 6993610 - DNA, 22 bp, Homo sapiens
atctatgtgcctttgtatagaa

SEQ ID NO: 6993611 - DNA, 22 bp, Homo sapiens
tttctgctcatcctagtggagc

SEQ ID NO: 6993612 - DNA, 22 bp, Homo sapiens
ttgtgggatctccctgttgctc

SEQ ID NO: 6993613 - DNA, 22 bp, Homo sapiens
ggccaaatgaaggcaatgggac

SEQ ID NO: 6993614 - DNA, 22 bp, Homo sapiens
ctgtgaacaatagcagcatctt

SEQ ID NO: 6993615 - DNA, 22 bp, Homo sapiens
ttcagcccaggcatagggcaaa

SEQ ID NO: 6993616 - DNA, 22 bp, Homo sapiens
aagctgtgcaggaactgcttgc

SEQ ID NO: 6993617 - DNA, 22 bp, Homo sapiens
acatgctttatcggattgacac

SEQ ID NO: 6993618 - DNA, 22 bp, Homo sapiens
agcagtggcatacattttgagt

SEQ ID NO: 6993619 - DNA, 20 bp, Homo sapiens
tggaccataaacaccaggta

SEQ ID NO: 6993620 - DNA, 22 bp, Homo sapiens
gagaatgtttctgtctgccctt

SEQ ID NO: 6993621 - DNA, 22 bp, Homo sapiens
aaagttacacatctagtaagtg

SEQ ID NO: 6993622 - DNA, 21 bp, Homo sapiens
agggagctggccacacagcct

SEQ ID NO: 6993623 - DNA, 22 bp, Homo sapiens
ctggccctggtaaggacaccca

SEQ ID NO: 6993624 - DNA, 22 bp, Homo sapiens
tccagtcttcttgcagctacat

SEQ ID NO: 6993625 - DNA, 23 bp, Homo sapiens
tccctacaaagtgcaggaatcag

SEQ ID NO: 6993626 - DNA, 20 bp, Homo sapiens
aacagggcagaagcggagac

SEQ ID NO: 6993627 - DNA, 22 bp, Homo sapiens
ttgttttcagggtgtcattcac

SEQ ID NO: 6993628 - DNA, 22 bp, Homo sapiens
agtctagggtggggtccacagg

SEQ ID NO: 6993629 - DNA, 22 bp, Homo sapiens
catctttgttctgtaaactttt

SEQ ID NO: 6993630 - DNA, 22 bp, Homo sapiens
tcagacagtttgcagtgtgcct

SEQ ID NO: 6993631 - DNA, 22 bp, Homo sapiens
atgttatgtccctcttactcag

SEQ ID NO: 6993632 - DNA, 22 bp, Homo sapiens
aaagtctgaaagataagagtga

SEQ ID NO: 6993633 - DNA, 22 bp, Homo sapiens
tgtgtccatctgacaggagagg

SEQ ID NO: 6993634 - DNA, 22 bp, Homo sapiens
aggccttgtgagaagcagagaa

SEQ ID NO: 6993635 - DNA, 23 bp, Homo sapiens
ctgcattgtctcctgggagcatg

SEQ ID NO: 6993636 - DNA, 22 bp, Homo sapiens
aatcagcctgagcacaaggcca

SEQ ID NO: 6993637 - DNA, 22 bp, Homo sapiens
agggcctggcttcactttctca

SEQ ID NO: 6993638 - DNA, 22 bp, Homo sapiens
gtctgtggtagacaggaaggca

SEQ ID NO: 6993639 - DNA, 22 bp, Homo sapiens
gtgcattctctgattttcacaa

SEQ ID NO: 6993640 - DNA, 22 bp, Homo sapiens
acacatgctgataagaatataa

SEQ ID NO: 6993641 - DNA, 22 bp, Homo sapiens
aggacttcatcacctgtataaa

SEQ ID NO: 6993642 - DNA, 22 bp, Homo sapiens
tggtctctctcctgcaacaact

SEQ ID NO: 6993643 - DNA, 22 bp, Homo sapiens
taaagtgtgcatggtcaaatat

SEQ ID NO: 6993644 - DNA, 22 bp, Homo sapiens
aaatatcatttataacttttaa

SEQ ID NO: 6993645 - DNA, 22 bp, Homo sapiens
agtgttatttattgtttcataa

SEQ ID NO: 6993646 - DNA, 23 bp, Homo sapiens
tctattacttattgtactctgga

SEQ ID NO: 6993647 - DNA, 22 bp, Homo sapiens
gacagatgagggagtattctca

SEQ ID NO: 6993648 - DNA, 23 bp, Homo sapiens
gacacaggagcacccagctgagc

SEQ ID NO: 6993649 - DNA, 22 bp, Homo sapiens
gcctgagtttgaactctagctc

SEQ ID NO: 6993650 - DNA, 22 bp, Homo sapiens
gctgtgcatcttcattctggac

SEQ ID NO: 6993651 - DNA, 22 bp, Homo sapiens
tcctgaggtctgaaaaaggagc

SEQ ID NO: 6993652 - DNA, 22 bp, Homo sapiens
agcagatatttgttgagcactt

SEQ ID NO: 6993653 - DNA, 22 bp, Homo sapiens
ttagtggtaaggatgaaatttc

SEQ ID NO: 6993654 - DNA, 22 bp, Homo sapiens
ggtttcagccctgctgttcctg

SEQ ID NO: 6993655 - DNA, 22 bp, Homo sapiens
aaagctagaaggaaattttatg

SEQ ID NO: 6993656 - DNA, 22 bp, Homo sapiens
ccagtgcaccaagaggcctaga

SEQ ID NO: 6993657 - DNA, 21 bp, Homo sapiens
tgtctagacctcatcctacag

SEQ ID NO: 6993658 - DNA, 22 bp, Homo sapiens
tggcttcacaatttcataacta

SEQ ID NO: 6993659 - DNA, 22 bp, Homo sapiens
gcctggactgttctaccatttt

SEQ ID NO: 6993660 - DNA, 22 bp, Homo sapiens
actgtgggtcccagctgtgtct

SEQ ID NO: 6993661 - DNA, 22 bp, Homo sapiens
cgtatgaaatttttgacatttg

SEQ ID NO: 6993662 - DNA, 22 bp, Homo sapiens
ggagatgccttgtttcaggaac

SEQ ID NO: 6993663 - DNA, 22 bp, Homo sapiens
ttgattctatgttgttgtctca

SEQ ID NO: 6993664 - DNA, 22 bp, Homo sapiens
gtgcctctcattggctgagccc

SEQ ID NO: 6993665 - DNA, 22 bp, Homo sapiens
catttcaaacagttacagctgc

SEQ ID NO: 6993666 - DNA, 22 bp, Homo sapiens
tgccaccctggcggcagcctgc

SEQ ID NO: 6993667 - DNA, 22 bp, Homo sapiens
tcacctgggagggctgtggtag

SEQ ID NO: 6993668 - DNA, 22 bp, Homo sapiens
gcatacatgaaaaggtactgac

SEQ ID NO: 6993669 - DNA, 22 bp, Homo sapiens
tgaggtgtgtccccagggaggt

SEQ ID NO: 6993670 - DNA, 22 bp, Homo sapiens
tggaaggctgtgattactgtgc

SEQ ID NO: 6993671 - DNA, 23 bp, Homo sapiens
gtggcctccccggaatgcctcgc

SEQ ID NO: 6993672 - DNA, 22 bp, Homo sapiens
aggaactggtgggaggtgattg

SEQ ID NO: 6993673 - DNA, 22 bp, Homo sapiens
tgtctcctcaactcatgctcga

SEQ ID NO: 6993674 - DNA, 22 bp, Homo sapiens
cttggtcagctcgagagtttgt

SEQ ID NO: 6993675 - DNA, 22 bp, Homo sapiens
ggctcactgcaagctccgcctc

SEQ ID NO: 6993676 - DNA, 22 bp, Homo sapiens
aatattgagaaccagcatgttt

SEQ ID NO: 6993677 - DNA, 22 bp, Homo sapiens
cagcagaacaggcagggaagct

SEQ ID NO: 6993678 - DNA, 22 bp, Homo sapiens
cattcctggacaaacatcaaaa

SEQ ID NO: 6993679 - DNA, 22 bp, Homo sapiens
gattctgatgccagttcaggac

SEQ ID NO: 6993680 - DNA, 22 bp, Homo sapiens
tgggccactgctccaagtagct

SEQ ID NO: 6993681 - DNA, 22 bp, Homo sapiens
tgcttctgacatgttcttggtt

SEQ ID NO: 6993682 - DNA, 22 bp, Homo sapiens
gtacagagaaggttacatatga

SEQ ID NO: 6993683 - DNA, 22 bp, Homo sapiens
gctgtttaattcaccattcaac

SEQ ID NO: 6993684 - DNA, 22 bp, Homo sapiens
gttggacagtttgggaagggag

SEQ ID NO: 6993685 - DNA, 19 bp, Homo sapiens
taaaaggatgtggaaggat

SEQ ID NO: 6993686 - DNA, 22 bp, Homo sapiens
cttgcacgcacatatttgtgca

SEQ ID NO: 6993687 - DNA, 20 bp, Homo sapiens
aaactgtctgtcagtatcta

SEQ ID NO: 6993688 - DNA, 22 bp, Homo sapiens
ccagggatgccaagctttacca

SEQ ID NO: 6993689 - DNA, 22 bp, Homo sapiens
ttaattgttggaaatagattat

SEQ ID NO: 6993690 - DNA, 19 bp, Homo sapiens
catgttatgctgtagtatc

SEQ ID NO: 6993691 - DNA, 20 bp, Homo sapiens
atcatctcaaagctgaggtt

SEQ ID NO: 6993692 - DNA, 22 bp, Homo sapiens
gaggctgagggttagagagtca

SEQ ID NO: 6993693 - DNA, 22 bp, Homo sapiens
tctgcatatttatcatgagtct

SEQ ID NO: 6993694 - DNA, 22 bp, Homo sapiens
tatttctgaggcccaggaagtg

SEQ ID NO: 6993695 - DNA, 22 bp, Homo sapiens
atttccatgccttagcttaagg

SEQ ID NO: 6993696 - DNA, 22 bp, Homo sapiens
tagctgatgaataattattctt

SEQ ID NO: 6993697 - DNA, 22 bp, Homo sapiens
ggccccagttcactcctggccg

SEQ ID NO: 6993698 - DNA, 22 bp, Homo sapiens
atttcctggagccagtttacct

SEQ ID NO: 6993699 - DNA, 22 bp, Homo sapiens
aaagatcaatagataaagctac

SEQ ID NO: 6993700 - DNA, 22 bp, Homo sapiens
ttctgagagctgaagaaatgtt

SEQ ID NO: 6993701 - DNA, 22 bp, Homo sapiens
gtgctgaacatttgggacttgt

SEQ ID NO: 6993702 - DNA, 22 bp, Homo sapiens
gaactggtcagtttagcccact

SEQ ID NO: 6993703 - DNA, 22 bp, Homo sapiens
tgatgaaagtgtttactcacct

SEQ ID NO: 6993704 - DNA, 22 bp, Homo sapiens
gtgtggccgtgtatccatggct

SEQ ID NO: 6993705 - DNA, 22 bp, Homo sapiens
ctggggcagagcctttagcaaa

SEQ ID NO: 6993706 - DNA, 17 bp, Homo sapiens
tattcagaggagtattt

SEQ ID NO: 6993707 - DNA, 22 bp, Homo sapiens
ttggctacatcgaggctccagc

SEQ ID NO: 6993708 - DNA, 22 bp, Homo sapiens
agggggagcttggctactcctg

SEQ ID NO: 6993709 - DNA, 22 bp, Homo sapiens
tggtcattgtttgctggctctt

SEQ ID NO: 6993710 - DNA, 22 bp, Homo sapiens
tgtctcaggtacatgcgtcctg

SEQ ID NO: 6993711 - DNA, 23 bp, Homo sapiens
ttgacagtaggtggttttcattg

SEQ ID NO: 6993712 - DNA, 22 bp, Homo sapiens
tgatcccttctccttcccttgg

SEQ ID NO: 6993713 - DNA, 22 bp, Homo sapiens
attgaaacaagttgctttctat

SEQ ID NO: 6993714 - DNA, 22 bp, Homo sapiens
tactcatcagactccagggtgg

SEQ ID NO: 6993715 - DNA, 22 bp, Homo sapiens
cagaacagaagtaaaatttacc

SEQ ID NO: 6993716 - DNA, 22 bp, Homo sapiens
tagaggcaccctggaggagact

SEQ ID NO: 6993717 - DNA, 22 bp, Homo sapiens
gactgcaagtctgggaaaggag

SEQ ID NO: 6993718 - DNA, 22 bp, Homo sapiens
ttctagaaactggagcaaacag

SEQ ID NO: 6993719 - DNA, 22 bp, Homo sapiens
ccttccagttcttggttgtaat

SEQ ID NO: 6993720 - DNA, 22 bp, Homo sapiens
agtcctgtgggtgggctggcca

SEQ ID NO: 6993721 - DNA, 18 bp, Homo sapiens
taaaccagatgacagttg

SEQ ID NO: 6993722 - DNA, 22 bp, Homo sapiens
agaattgttctgtagcttggct

SEQ ID NO: 6993723 - DNA, 22 bp, Homo sapiens
aaaagtctctctgagtaaaagt

SEQ ID NO: 6993724 - DNA, 22 bp, Homo sapiens
aagtcttttgctgtcataggtg

SEQ ID NO: 6993725 - DNA, 19 bp, Homo sapiens
aagctgagggctgtccacc

SEQ ID NO: 6993726 - DNA, 22 bp, Homo sapiens
cttgaccctaccccccagaagg

SEQ ID NO: 6993727 - DNA, 22 bp, Homo sapiens
ttcacaggttgaagcctaatcc

SEQ ID NO: 6993728 - DNA, 22 bp, Homo sapiens
aggccctggggtctgttaaatt

SEQ ID NO: 6993729 - DNA, 22 bp, Homo sapiens
agtaaacaggcatgatagtgtt

SEQ ID NO: 6993730 - DNA, 21 bp, Homo sapiens
gctcaggctcaggttcaggtt

SEQ ID NO: 6993731 - DNA, 20 bp, Homo sapiens
gggctggataattctttgct

SEQ ID NO: 6993732 - DNA, 22 bp, Homo sapiens
tgaggcaggagaatggcgggaa

SEQ ID NO: 6993733 - DNA, 22 bp, Homo sapiens
ggcttgaagactatgacatttc

SEQ ID NO: 6993734 - DNA, 22 bp, Homo sapiens
atgcagaacgtttgtgaaactt

SEQ ID NO: 6993735 - DNA, 22 bp, Homo sapiens
gagtctggtcattttctctccc

SEQ ID NO: 6993736 - DNA, 22 bp, Homo sapiens
tgtcatgtgcggggaggtgaag

SEQ ID NO: 6993737 - DNA, 22 bp, Homo sapiens
tgctgcctgctacgagggaaga

SEQ ID NO: 6993738 - DNA, 21 bp, Homo sapiens
ctgcaagacatgctgttcttg

SEQ ID NO: 6993739 - DNA, 19 bp, Homo sapiens
acctgcagtaataattcct

SEQ ID NO: 6993740 - DNA, 19 bp, Homo sapiens
tagctctgtcttattccaa

SEQ ID NO: 6993741 - DNA, 22 bp, Homo sapiens
tgtgacactgacatctgctccc

SEQ ID NO: 6993742 - DNA, 22 bp, Homo sapiens
catgtacactcatgtaactata

SEQ ID NO: 6993743 - DNA, 22 bp, Homo sapiens
atgcacagctgaacactctaaa

SEQ ID NO: 6993744 - DNA, 22 bp, Homo sapiens
ctccaggctcgtccaagatcga

SEQ ID NO: 6993745 - DNA, 22 bp, Homo sapiens
ttaggaggtctatggacatcct

SEQ ID NO: 6993746 - DNA, 22 bp, Homo sapiens
tttatagcagcatgatttatag

SEQ ID NO: 6993747 - DNA, 22 bp, Homo sapiens
aacagtgctgcattcattgagc

SEQ ID NO: 6993748 - DNA, 22 bp, Homo sapiens
gtccctggggaatcagctggag

SEQ ID NO: 6993749 - DNA, 18 bp, Homo sapiens
agatgaaagcaaatgaca

SEQ ID NO: 6993750 - DNA, 22 bp, Homo sapiens
tgaggaaacttacaaggcagaa

SEQ ID NO: 6993751 - DNA, 22 bp, Homo sapiens
tctttggtgaatggtcatccag

SEQ ID NO: 6993752 - DNA, 22 bp, Homo sapiens
agcagctcggccagtcaccagg

SEQ ID NO: 6993753 - DNA, 22 bp, Homo sapiens
ccagtgttattttagagtgtga

SEQ ID NO: 6993754 - DNA, 22 bp, Homo sapiens
agaattagccggattcttgttt

SEQ ID NO: 6993755 - DNA, 22 bp, Homo sapiens
gccatgagtaaactggaaagcc

SEQ ID NO: 6993756 - DNA, 23 bp, Homo sapiens
ggtgtttaattacagactgagag

SEQ ID NO: 6993757 - DNA, 20 bp, Homo sapiens
gggtgtggcctgggaatttg

SEQ ID NO: 6993758 - DNA, 22 bp, Homo sapiens
agtggctcttgggtcactgggc

SEQ ID NO: 6993759 - DNA, 22 bp, Homo sapiens
tgaccaggctggagtgcagtgg

SEQ ID NO: 6993760 - DNA, 22 bp, Homo sapiens
atccttgggtctctggaaattg

SEQ ID NO: 6993761 - DNA, 22 bp, Homo sapiens
ggctggataccaggagacaggg

SEQ ID NO: 6993762 - DNA, 22 bp, Homo sapiens
cccagctttccacttcctctgg

SEQ ID NO: 6993763 - DNA, 23 bp, Homo sapiens
gatgtatatatgagccgtcacat

SEQ ID NO: 6993764 - DNA, 22 bp, Homo sapiens
tgggaggccgaggcaggtggat

SEQ ID NO: 6993765 - DNA, 23 bp, Homo sapiens
tggatcaataagcctgactgtgt

SEQ ID NO: 6993766 - DNA, 22 bp, Homo sapiens
ggctgctgctgtgtaggcctgt

SEQ ID NO: 6993767 - DNA, 22 bp, Homo sapiens
cacacagctcaggggcactgcc

SEQ ID NO: 6993768 - DNA, 22 bp, Homo sapiens
tagcagtgcacagtaggacacc

SEQ ID NO: 6993769 - DNA, 22 bp, Homo sapiens
agataactaaagaaagggatta

SEQ ID NO: 6993770 - DNA, 22 bp, Homo sapiens
aagcaatttgacagtacatatc

SEQ ID NO: 6993771 - DNA, 22 bp, Homo sapiens
atgggctgaggtgggatagaag

SEQ ID NO: 6993772 - DNA, 22 bp, Homo sapiens
gaaatgcaggcttggattcagc

SEQ ID NO: 6993773 - DNA, 22 bp, Homo sapiens
tttgcttaaaagcggagcaaga

SEQ ID NO: 6993774 - DNA, 22 bp, Homo sapiens
agcagacaattgcctggatgga

SEQ ID NO: 6993775 - DNA, 22 bp, Homo sapiens
gacatgtgtctgcaagttgatc

SEQ ID NO: 6993776 - DNA, 22 bp, Homo sapiens
gctgtaggtcatttaatcacct

SEQ ID NO: 6993777 - DNA, 21 bp, Homo sapiens
acttggctttgttagaactag

SEQ ID NO: 6993778 - DNA, 22 bp, Homo sapiens
acaccatactcatgttggttcc

SEQ ID NO: 6993779 - DNA, 20 bp, Homo sapiens
attcccttctccctgtttga

SEQ ID NO: 6993780 - DNA, 22 bp, Homo sapiens
gtcatctttgccctgtgcagga

SEQ ID NO: 6993781 - DNA, 22 bp, Homo sapiens
ttgcatggtgtgctctgaatca

SEQ ID NO: 6993782 - DNA, 19 bp, Homo sapiens
ggcctgcccaatgtctgct

SEQ ID NO: 6993783 - DNA, 22 bp, Homo sapiens
gctctatgagtttctcagttta

SEQ ID NO: 6993784 - DNA, 19 bp, Homo sapiens
atctgcctgttatcacata

SEQ ID NO: 6993785 - DNA, 20 bp, Homo sapiens
tggctgcacaccaggacagg

SEQ ID NO: 6993786 - DNA, 22 bp, Homo sapiens
cttatagtatgatgttgagaat

SEQ ID NO: 6993787 - DNA, 22 bp, Homo sapiens
cccagtgggtcactgcatctca

SEQ ID NO: 6993788 - DNA, 22 bp, Homo sapiens
atggaaagctaagccatttacc

SEQ ID NO: 6993789 - DNA, 22 bp, Homo sapiens
ctttggcaatgtcattttcaat

SEQ ID NO: 6993790 - DNA, 22 bp, Homo sapiens
agagacagatctgagggacctc

SEQ ID NO: 6993791 - DNA, 22 bp, Homo sapiens
aataaagtagcgtttaaggtgc

SEQ ID NO: 6993792 - DNA, 20 bp, Homo sapiens
aattgttgactccccagaga

SEQ ID NO: 6993793 - DNA, 22 bp, Homo sapiens
tggggtcgagggttctctggca

SEQ ID NO: 6993794 - DNA, 22 bp, Homo sapiens
tttattctgtgctacatgaaga

SEQ ID NO: 6993795 - DNA, 22 bp, Homo sapiens
attttctgtgtgcagataaata

SEQ ID NO: 6993796 - DNA, 22 bp, Homo sapiens
cagaactgttataacagctgtt

SEQ ID NO: 6993797 - DNA, 22 bp, Homo sapiens
tttcatgtactgtcgaagttga

SEQ ID NO: 6993798 - DNA, 22 bp, Homo sapiens
ttctggaaatcagcagagggtg

SEQ ID NO: 6993799 - DNA, 21 bp, Homo sapiens
agtgctgaaaaagcatgtctc

SEQ ID NO: 6993800 - DNA, 22 bp, Homo sapiens
tcattaagaaatgaggagtccc

SEQ ID NO: 6993801 - DNA, 22 bp, Homo sapiens
acatgccagcccatttaaatgg

SEQ ID NO: 6993802 - DNA, 22 bp, Homo sapiens
gtaagcacatgtgtgtgcatgg

SEQ ID NO: 6993803 - DNA, 22 bp, Homo sapiens
aaaggcttaacagaagaccttt

SEQ ID NO: 6993804 - DNA, 22 bp, Homo sapiens
gtcttctgtctgtctggcatgt

SEQ ID NO: 6993805 - DNA, 21 bp, Homo sapiens
tgtcttcatatgagatggtgt

SEQ ID NO: 6993806 - DNA, 22 bp, Homo sapiens
tcttggtttttccagggctgat

SEQ ID NO: 6993807 - DNA, 22 bp, Homo sapiens
tatttggaatagcttgctaatg

SEQ ID NO: 6993808 - DNA, 18 bp, Homo sapiens
gcaaccacagattctttg

SEQ ID NO: 6993809 - DNA, 22 bp, Homo sapiens
tccacttgccctcttctgtgct

SEQ ID NO: 6993810 - DNA, 22 bp, Homo sapiens
tctaatgcagttctgggtattt

SEQ ID NO: 6993811 - DNA, 22 bp, Homo sapiens
ttactctgaatgtttctactga

SEQ ID NO: 6993812 - DNA, 22 bp, Homo sapiens
gtcactttggcctctacagcca

SEQ ID NO: 6993813 - DNA, 22 bp, Homo sapiens
cctggcctcagcctagggctga

SEQ ID NO: 6993814 - DNA, 22 bp, Homo sapiens
ctctcagtgcctgccctaggct

SEQ ID NO: 6993815 - DNA, 22 bp, Homo sapiens
ctgcagctgccagtgatttcag

SEQ ID NO: 6993816 - DNA, 22 bp, Homo sapiens
gtcattcttaacaactcagtag

SEQ ID NO: 6993817 - DNA, 22 bp, Homo sapiens
tagcttatggtctctagggaat

SEQ ID NO: 6993818 - DNA, 23 bp, Homo sapiens
tgaggacctctcaggggccaggc

SEQ ID NO: 6993819 - DNA, 22 bp, Homo sapiens
aactctttacatgtttgattca

SEQ ID NO: 6993820 - DNA, 19 bp, Homo sapiens
ggcaagcacaaaagctttg

SEQ ID NO: 6993821 - DNA, 22 bp, Homo sapiens
ccaggctctgccaggcccttga

SEQ ID NO: 6993822 - DNA, 22 bp, Homo sapiens
gcctttgctgtgacaatgctgg

SEQ ID NO: 6993823 - DNA, 22 bp, Homo sapiens
acacatgtatatgcttgtgtgt

SEQ ID NO: 6993824 - DNA, 22 bp, Homo sapiens
ggtatgctgtgcggacgcagac

SEQ ID NO: 6993825 - DNA, 22 bp, Homo sapiens
aagtgagtcacaagtttgcttt

SEQ ID NO: 6993826 - DNA, 22 bp, Homo sapiens
caaggcttgaattctgatgggt

SEQ ID NO: 6993827 - DNA, 22 bp, Homo sapiens
atgtgtctggcatggctctatt

SEQ ID NO: 6993828 - DNA, 22 bp, Homo sapiens
gcccagctggcttccagcacat

SEQ ID NO: 6993829 - DNA, 22 bp, Homo sapiens
tgactaaatcacagttgcctca

SEQ ID NO: 6993830 - DNA, 21 bp, Homo sapiens
tcccacagaaactgcgaaatt

SEQ ID NO: 6993831 - DNA, 22 bp, Homo sapiens
agtcacatgagcactaattagg

SEQ ID NO: 6993832 - DNA, 22 bp, Homo sapiens
aattccgtgcctgctgttatgt

SEQ ID NO: 6993833 - DNA, 22 bp, Homo sapiens
gacattaaatgtcttagttgcc

SEQ ID NO: 6993834 - DNA, 22 bp, Homo sapiens
cgtgcaattcgccagccaaaga

SEQ ID NO: 6993835 - DNA, 19 bp, Homo sapiens
agcatagacttctcaggaa

SEQ ID NO: 6993836 - DNA, 22 bp, Homo sapiens
caagttgctctgcctctgtagg

SEQ ID NO: 6993837 - DNA, 22 bp, Homo sapiens
tgataatgttcgagaatgaaga

SEQ ID NO: 6993838 - DNA, 22 bp, Homo sapiens
aggagaggtctcccttccccag

SEQ ID NO: 6993839 - DNA, 22 bp, Homo sapiens
agaaggggcccaaggatgtcag

SEQ ID NO: 6993840 - DNA, 22 bp, Homo sapiens
ttgatattagagtatttgtttg

SEQ ID NO: 6993841 - DNA, 22 bp, Homo sapiens
ctgtctgtatccctgttggtaa

SEQ ID NO: 6993842 - DNA, 22 bp, Homo sapiens
tctcaggggattcactggcacc

SEQ ID NO: 6993843 - DNA, 22 bp, Homo sapiens
cagcagttcaggctccttcccg

SEQ ID NO: 6993844 - DNA, 22 bp, Homo sapiens
ctgggctccactacttgctaac

SEQ ID NO: 6993845 - DNA, 22 bp, Homo sapiens
acagagatggcttttcagaggc

SEQ ID NO: 6993846 - DNA, 22 bp, Homo sapiens
tcttggccaggtgtggtgcctc

SEQ ID NO: 6993847 - DNA, 22 bp, Homo sapiens
tttattatgtacaggcactata

SEQ ID NO: 6993848 - DNA, 22 bp, Homo sapiens
aagacactgggggctgcagcca

SEQ ID NO: 6993849 - DNA, 22 bp, Homo sapiens
ttctgggagattcatatgaaaa

SEQ ID NO: 6993850 - DNA, 22 bp, Homo sapiens
caccgaggctggagtgcagtgg

SEQ ID NO: 6993851 - DNA, 22 bp, Homo sapiens
ctggggctctctggaatgcttg

SEQ ID NO: 6993852 - DNA, 22 bp, Homo sapiens
taaaggccatgatggaggatca

SEQ ID NO: 6993853 - DNA, 20 bp, Homo sapiens
taagcacatgaacagtcctc

SEQ ID NO: 6993854 - DNA, 22 bp, Homo sapiens
tcattgaatttcacagctttat

SEQ ID NO: 6993855 - DNA, 22 bp, Homo sapiens
tgagaacattcctcttcctggc

SEQ ID NO: 6993856 - DNA, 22 bp, Homo sapiens
aactgcatttaacaaatactct

SEQ ID NO: 6993857 - DNA, 22 bp, Homo sapiens
ggcaggctccagagccctctcc

SEQ ID NO: 6993858 - DNA, 22 bp, Homo sapiens
aaaaataggtcaaccgtgtatg

SEQ ID NO: 6993859 - DNA, 22 bp, Homo sapiens
ttctacagactataactgtgat

SEQ ID NO: 6993860 - DNA, 22 bp, Homo sapiens
tgctggccaagcagaggtcaat

SEQ ID NO: 6993861 - DNA, 22 bp, Homo sapiens
cctgtgggtacaacagggtcac

SEQ ID NO: 6993862 - DNA, 22 bp, Homo sapiens
ctttctggctgaagtgatgaat

SEQ ID NO: 6993863 - DNA, 22 bp, Homo sapiens
cgcatgcagtggggctgcagtt

SEQ ID NO: 6993864 - DNA, 22 bp, Homo sapiens
tctgttcatcatctggacacat

SEQ ID NO: 6993865 - DNA, 22 bp, Homo sapiens
atctaaacaggtgttctttaga

SEQ ID NO: 6993866 - DNA, 23 bp, Homo sapiens
ggttctttaccttgaatgttttc

SEQ ID NO: 6993867 - DNA, 22 bp, Homo sapiens
agggcttgacaagggctggagc

SEQ ID NO: 6993868 - DNA, 22 bp, Homo sapiens
tttggaatgttaggtgtctcat

SEQ ID NO: 6993869 - DNA, 22 bp, Homo sapiens
ttttctaacatctagtaatttg

SEQ ID NO: 6993870 - DNA, 22 bp, Homo sapiens
cttggctcgtacccggggcagg

SEQ ID NO: 6993871 - DNA, 22 bp, Homo sapiens
atgacaggaggcagctgggcag

SEQ ID NO: 6993872 - DNA, 22 bp, Homo sapiens
caggcagaggcttttcatggct

SEQ ID NO: 6993873 - DNA, 22 bp, Homo sapiens
tggccttgagatgcagcagcca

SEQ ID NO: 6993874 - DNA, 22 bp, Homo sapiens
tttatgtacatatccacaagga

SEQ ID NO: 6993875 - DNA, 22 bp, Homo sapiens
aggacaattagtctggcttggc

SEQ ID NO: 6993876 - DNA, 19 bp, Homo sapiens
gccgggcccgggttggccg

SEQ ID NO: 6993877 - DNA, 22 bp, Homo sapiens
gagatttaggggggaagatacg

SEQ ID NO: 6993878 - DNA, 22 bp, Homo sapiens
caacagtttatagtgttatctt

SEQ ID NO: 6993879 - DNA, 16 bp, Homo sapiens
agcaatcagaaatatc

SEQ ID NO: 6993880 - DNA, 20 bp, Homo sapiens
gtcaaactactggcagtgcc

SEQ ID NO: 6993881 - DNA, 22 bp, Homo sapiens
tgagtctgtatgtccagattta

SEQ ID NO: 6993882 - DNA, 22 bp, Homo sapiens
tggggaaagttcttgaaagtaa

SEQ ID NO: 6993883 - DNA, 22 bp, Homo sapiens
ctggagggtgagcctcatctct

SEQ ID NO: 6993884 - DNA, 22 bp, Homo sapiens
tcagctggagactgctcaatga

SEQ ID NO: 6993885 - DNA, 22 bp, Homo sapiens
atcaggaagaattggatgctac

SEQ ID NO: 6993886 - DNA, 20 bp, Homo sapiens
ttagtggacagtattacata

SEQ ID NO: 6993887 - DNA, 22 bp, Homo sapiens
tctgtgctcattcagtcattca

SEQ ID NO: 6993888 - DNA, 23 bp, Homo sapiens
gacatctgttttgtccctgtgct

SEQ ID NO: 6993889 - DNA, 14 bp, Homo sapiens
attgtgcatgccat

SEQ ID NO: 6993890 - DNA, 21 bp, Homo sapiens
agatccagtgccataaggccc

SEQ ID NO: 6993891 - DNA, 22 bp, Homo sapiens
tgcagctgtaacagaggcctca

SEQ ID NO: 6993892 - DNA, 22 bp, Homo sapiens
gtacacactatgtattgtacac

SEQ ID NO: 6993893 - DNA, 21 bp, Homo sapiens
atggagtcaggggaatgggcc

SEQ ID NO: 6993894 - DNA, 22 bp, Homo sapiens
tggttttaaaaacatgctgcat

SEQ ID NO: 6993895 - DNA, 22 bp, Homo sapiens
tggatttcagctccatacttac

SEQ ID NO: 6993896 - DNA, 22 bp, Homo sapiens
tctttcttcctggagcccaaca

SEQ ID NO: 6993897 - DNA, 22 bp, Homo sapiens
agaatttcaaatggaagtttta

SEQ ID NO: 6993898 - DNA, 22 bp, Homo sapiens
tattgacagagggtcagaagag

SEQ ID NO: 6993899 - DNA, 22 bp, Homo sapiens
ttgctaagttatagagtatctt

SEQ ID NO: 6993900 - DNA, 18 bp, Homo sapiens
ttccttggtaacatatgc

SEQ ID NO: 6993901 - DNA, 22 bp, Homo sapiens
ggctctggctactccaccctgt

SEQ ID NO: 6993902 - DNA, 21 bp, Homo sapiens
acactgagtgaattagcacat

SEQ ID NO: 6993903 - DNA, 22 bp, Homo sapiens
ctcagagggtctcctccagaat

SEQ ID NO: 6993904 - DNA, 22 bp, Homo sapiens
tttctcaaatactgttccagga

SEQ ID NO: 6993905 - DNA, 22 bp, Homo sapiens
gagtccaggctgttgctcatct

SEQ ID NO: 6993906 - DNA, 22 bp, Homo sapiens
tcattaatttgcttagacttat

SEQ ID NO: 6993907 - DNA, 22 bp, Homo sapiens
aggcctgcttacaatgttatcc

SEQ ID NO: 6993908 - DNA, 22 bp, Homo sapiens
tcagagtcaactgttgcctgtt

SEQ ID NO: 6993909 - DNA, 22 bp, Homo sapiens
tttgttaaaatgcagattctgt

SEQ ID NO: 6993910 - DNA, 22 bp, Homo sapiens
ggcttcgcagctcggcagccgc

SEQ ID NO: 6993911 - DNA, 22 bp, Homo sapiens
aaggagagagctttgctggaac

SEQ ID NO: 6993912 - DNA, 22 bp, Homo sapiens
tgaaggaagaataggcagtgtt

SEQ ID NO: 6993913 - DNA, 22 bp, Homo sapiens
tttaggtaagctgaatatgaag

SEQ ID NO: 6993914 - DNA, 22 bp, Homo sapiens
gtatatcaccccaagcagctga

SEQ ID NO: 6993915 - DNA, 22 bp, Homo sapiens
tctcttaattgtaatggttcct

SEQ ID NO: 6993916 - DNA, 22 bp, Homo sapiens
cgctgcagaagcgtgttcagga

SEQ ID NO: 6993917 - DNA, 22 bp, Homo sapiens
cacagtctctgttgctgggacc

SEQ ID NO: 6993918 - DNA, 22 bp, Homo sapiens
caggcacaatgagcgccatctt

SEQ ID NO: 6993919 - DNA, 22 bp, Homo sapiens
tagaaagcagaaaccatcagag

SEQ ID NO: 6993920 - DNA, 22 bp, Homo sapiens
tggagctgcctggcacctacag

SEQ ID NO: 6993921 - DNA, 22 bp, Homo sapiens
tagctctctttatctttctata

SEQ ID NO: 6993922 - DNA, 22 bp, Homo sapiens
tgagacctgcccaacgcagacc

SEQ ID NO: 6993923 - DNA, 19 bp, Homo sapiens
gcagtctgttgaagggcag

SEQ ID NO: 6993924 - DNA, 22 bp, Homo sapiens
cagacacagcaattctgtgttg

SEQ ID NO: 6993925 - DNA, 22 bp, Homo sapiens
aatgtcttccctggcaggccaa

SEQ ID NO: 6993926 - DNA, 22 bp, Homo sapiens
ctcctacacatagatgctttca

SEQ ID NO: 6993927 - DNA, 22 bp, Homo sapiens
aaggtgtcactgggacaggaaa

SEQ ID NO: 6993928 - DNA, 22 bp, Homo sapiens
tgtctggatagagcctaggccc

SEQ ID NO: 6993929 - DNA, 22 bp, Homo sapiens
tttgggaataattgcacagatt

SEQ ID NO: 6993930 - DNA, 22 bp, Homo sapiens
ctgtcacaggttcaaactcccc

SEQ ID NO: 6993931 - DNA, 22 bp, Homo sapiens
gcagtgttggtttgctctgcag

SEQ ID NO: 6993932 - DNA, 22 bp, Homo sapiens
cagcagcctcttgtgcctgtgg

SEQ ID NO: 6993933 - DNA, 22 bp, Homo sapiens
ctccacagagatgctgattgta

SEQ ID NO: 6993934 - DNA, 22 bp, Homo sapiens
ctaaatcaggccttacagcttc

SEQ ID NO: 6993935 - DNA, 22 bp, Homo sapiens
tttctaatctttagttacaaaa

SEQ ID NO: 6993936 - DNA, 22 bp, Homo sapiens
tggcactgggatgctactgtta

SEQ ID NO: 6993937 - DNA, 22 bp, Homo sapiens
ttacagatggcagtttcttgag

SEQ ID NO: 6993938 - DNA, 22 bp, Homo sapiens
agtcagtgacttttgctgagag

SEQ ID NO: 6993939 - DNA, 22 bp, Homo sapiens
aggctgctttcatggccgcccc

SEQ ID NO: 6993940 - DNA, 22 bp, Homo sapiens
agcatggcctcccgggcctggc

SEQ ID NO: 6993941 - DNA, 22 bp, Homo sapiens
aacactaatgggagaacaaccc

SEQ ID NO: 6993942 - DNA, 22 bp, Homo sapiens
gaaaggcttcttaagcttcact

SEQ ID NO: 6993943 - DNA, 22 bp, Homo sapiens
gtgtatgttctacttaatatta

SEQ ID NO: 6993944 - DNA, 22 bp, Homo sapiens
atatgacagaatgtgtgtgtat

SEQ ID NO: 6993945 - DNA, 22 bp, Homo sapiens
ctgtcctgaaagggagattggg

SEQ ID NO: 6993946 - DNA, 22 bp, Homo sapiens
gtcagaaaacttccctttgagt

SEQ ID NO: 6993947 - DNA, 22 bp, Homo sapiens
ctggattttaaattttctctgt

SEQ ID NO: 6993948 - DNA, 22 bp, Homo sapiens
ttttagttgctcaggtattctc

SEQ ID NO: 6993949 - DNA, 22 bp, Homo sapiens
atgggtaaagcaggaagagagt

SEQ ID NO: 6993950 - DNA, 22 bp, Homo sapiens
gtgtgtcccttggaacctcagc

SEQ ID NO: 6993951 - DNA, 18 bp, Homo sapiens
acttgggacttttgcatt

SEQ ID NO: 6993952 - DNA, 22 bp, Homo sapiens
caaggcaggaagcctgtcttat

SEQ ID NO: 6993953 - DNA, 19 bp, Homo sapiens
taaaggaagaggaagggaa

SEQ ID NO: 6993954 - DNA, 22 bp, Homo sapiens
aactggaaagatcagtaggaag

SEQ ID NO: 6993955 - DNA, 22 bp, Homo sapiens
ctcagtttttgctgtctggttc

SEQ ID NO: 6993956 - DNA, 22 bp, Homo sapiens
aatggtaccctggtgacttaga

SEQ ID NO: 6993957 - DNA, 22 bp, Homo sapiens
ttctgcatgtgtttcaaatact

SEQ ID NO: 6993958 - DNA, 22 bp, Homo sapiens
agggatgtgacattacagaagc

SEQ ID NO: 6993959 - DNA, 18 bp, Homo sapiens
agtttatgagccactgcc

SEQ ID NO: 6993960 - DNA, 22 bp, Homo sapiens
accctgagatgccacagcatga

SEQ ID NO: 6993961 - DNA, 22 bp, Homo sapiens
cagactgaaaatccctggtagt

SEQ ID NO: 6993962 - DNA, 22 bp, Homo sapiens
atacattgagttttgatgttct

SEQ ID NO: 6993963 - DNA, 22 bp, Homo sapiens
taaacatcaccttctgcagttg

SEQ ID NO: 6993964 - DNA, 22 bp, Homo sapiens
cagggcttgatctgcatcctgc

SEQ ID NO: 6993965 - DNA, 22 bp, Homo sapiens
atgcctttctttggtgcaggtt

SEQ ID NO: 6993966 - DNA, 22 bp, Homo sapiens
tttaaggcagtgaaactattct

SEQ ID NO: 6993967 - DNA, 22 bp, Homo sapiens
gaaattgccagatctagtagat

SEQ ID NO: 6993968 - DNA, 20 bp, Homo sapiens
tctgataaaaactactccat

SEQ ID NO: 6993969 - DNA, 22 bp, Homo sapiens
tttcaacaggatgataataggc

SEQ ID NO: 6993970 - DNA, 22 bp, Homo sapiens
attgcagggtccctgccatcgg

SEQ ID NO: 6993971 - DNA, 22 bp, Homo sapiens
ttggtcttcatccgtcacagca

SEQ ID NO: 6993972 - DNA, 22 bp, Homo sapiens
ccagggccagtaagattggcat

SEQ ID NO: 6993973 - DNA, 22 bp, Homo sapiens
agtgctgaagactggctaggga

SEQ ID NO: 6993974 - DNA, 22 bp, Homo sapiens
aggcacagcctcccttcacatg

SEQ ID NO: 6993975 - DNA, 22 bp, Homo sapiens
tgctgaatgtgctcccttttaa

SEQ ID NO: 6993976 - DNA, 22 bp, Homo sapiens
ttctgaattcatgagatttggg

SEQ ID NO: 6993977 - DNA, 22 bp, Homo sapiens
agacagcagaaactagagcact

SEQ ID NO: 6993978 - DNA, 22 bp, Homo sapiens
ttgtaattgaacccttaggctt

SEQ ID NO: 6993979 - DNA, 22 bp, Homo sapiens
ccccagtggaggtgagggtcct

SEQ ID NO: 6993980 - DNA, 23 bp, Homo sapiens
cacacccatcactaagagctcct

SEQ ID NO: 6993981 - DNA, 22 bp, Homo sapiens
acacatttctctttttgtaagt

SEQ ID NO: 6993982 - DNA, 17 bp, Homo sapiens
tccatacaattctctct

SEQ ID NO: 6993983 - DNA, 22 bp, Homo sapiens
tttctctgggctgttggcagcc

SEQ ID NO: 6993984 - DNA, 22 bp, Homo sapiens
tagttacaaaccaacaggcagc

SEQ ID NO: 6993985 - DNA, 22 bp, Homo sapiens
aatgttacgatcaacaacacat

SEQ ID NO: 6993986 - DNA, 22 bp, Homo sapiens
agggcctggtgacctgggtcct

SEQ ID NO: 6993987 - DNA, 22 bp, Homo sapiens
agagctctgtgtctctttgggt

SEQ ID NO: 6993988 - DNA, 22 bp, Homo sapiens
tgcacatctttcagcatcatac

SEQ ID NO: 6993989 - DNA, 18 bp, Homo sapiens
gggcagtaagtgtggggt

SEQ ID NO: 6993990 - DNA, 22 bp, Homo sapiens
aatgactaaatctgaagatagg

SEQ ID NO: 6993991 - DNA, 22 bp, Homo sapiens
taatgttagtatgtaatcttat

SEQ ID NO: 6993992 - DNA, 22 bp, Homo sapiens
catttagaaaatgataaccctt

SEQ ID NO: 6993993 - DNA, 22 bp, Homo sapiens
atctatgtgggaatcataatag

SEQ ID NO: 6993994 - DNA, 22 bp, Homo sapiens
ggtggagagctggatgagaggt

SEQ ID NO: 6993995 - DNA, 22 bp, Homo sapiens
cagtagcccactagtatgcagt

SEQ ID NO: 6993996 - DNA, 17 bp, Homo sapiens
tacaggagagcaggaac

SEQ ID NO: 6993997 - DNA, 22 bp, Homo sapiens
gtgagctgttttggacccatct

SEQ ID NO: 6993998 - DNA, 22 bp, Homo sapiens
atgccaataaatgttaatatct

SEQ ID NO: 6993999 - DNA, 22 bp, Homo sapiens
acacataagaaactacaaagag

SEQ ID NO: 6994000 - DNA, 22 bp, Homo sapiens
ttaattgtaaagtttgcctgtt

SEQ ID NO: 6994001 - DNA, 22 bp, Homo sapiens
gaagcacaaagtgtagttccga

SEQ ID NO: 6994002 - DNA, 21 bp, Homo sapiens
tttatgcatgcctctctgtca

SEQ ID NO: 6994003 - DNA, 22 bp, Homo sapiens
cagaaactgctcccctggtagg

SEQ ID NO: 6994004 - DNA, 22 bp, Homo sapiens
ccaagagttcaagagtgaacca

SEQ ID NO: 6994005 - DNA, 18 bp, Homo sapiens
tctgtgttctgtcattgc

SEQ ID NO: 6994006 - DNA, 22 bp, Homo sapiens
gtctccagaattcttgggaggg

SEQ ID NO: 6994007 - DNA, 18 bp, Homo sapiens
cagggccccagaattatc

SEQ ID NO: 6994008 - DNA, 22 bp, Homo sapiens
tgacccgggcctgctacgccgc

SEQ ID NO: 6994009 - DNA, 22 bp, Homo sapiens
aaacaatgaaattcattcttca

SEQ ID NO: 6994010 - DNA, 23 bp, Homo sapiens
agtctcagctggaaacatgtgtc

SEQ ID NO: 6994011 - DNA, 22 bp, Homo sapiens
cagggccaccgtgtttgctgct

SEQ ID NO: 6994012 - DNA, 22 bp, Homo sapiens
gacagcagacagcctggcccct

SEQ ID NO: 6994013 - DNA, 22 bp, Homo sapiens
cagggagctattagggttagtg

SEQ ID NO: 6994014 - DNA, 22 bp, Homo sapiens
ttggaaaggagtttttagctat

SEQ ID NO: 6994015 - DNA, 22 bp, Homo sapiens
aaggcagcagaggaaaggtgct

SEQ ID NO: 6994016 - DNA, 22 bp, Homo sapiens
gatgggcatcaaacatgacgtg

SEQ ID NO: 6994017 - DNA, 22 bp, Homo sapiens
ctgggcacaagtggccctggat

SEQ ID NO: 6994018 - DNA, 22 bp, Homo sapiens
agaaaccagggcttaccagtgc

SEQ ID NO: 6994019 - DNA, 22 bp, Homo sapiens
actttagtctgtttcattatct

SEQ ID NO: 6994020 - DNA, 22 bp, Homo sapiens
aatgaatgttttaaggcataaa

SEQ ID NO: 6994021 - DNA, 22 bp, Homo sapiens
ggagccaggggaccttcacaga

SEQ ID NO: 6994022 - DNA, 22 bp, Homo sapiens
agtcagtgaatctgaaggctaa

SEQ ID NO: 6994023 - DNA, 22 bp, Homo sapiens
ctcagccccaattctccccatt

SEQ ID NO: 6994024 - DNA, 22 bp, Homo sapiens
tccagctcagggttggctcaag

SEQ ID NO: 6994025 - DNA, 22 bp, Homo sapiens
ctggacagaaaaggccactgga

SEQ ID NO: 6994026 - DNA, 22 bp, Homo sapiens
acacatttattacatgcatgtg

SEQ ID NO: 6994027 - DNA, 22 bp, Homo sapiens
ggcttgtcatgttgatgttctt

SEQ ID NO: 6994028 - DNA, 22 bp, Homo sapiens
ctctggggaagcagccagctgg

SEQ ID NO: 6994029 - DNA, 22 bp, Homo sapiens
tttcatgtttatggaaaatgag

SEQ ID NO: 6994030 - DNA, 22 bp, Homo sapiens
agaaccttgatcttggacttct

SEQ ID NO: 6994031 - DNA, 22 bp, Homo sapiens
tgcagaaaggaggggtgggaat

SEQ ID NO: 6994032 - DNA, 22 bp, Homo sapiens
tctggcttgtgtccttccttgc

SEQ ID NO: 6994033 - DNA, 22 bp, Homo sapiens
cactcagaggtttgattgctca

SEQ ID NO: 6994034 - DNA, 22 bp, Homo sapiens
caggtgttatacatgaaattta

SEQ ID NO: 6994035 - DNA, 22 bp, Homo sapiens
gaagttccagtgatataaaact

SEQ ID NO: 6994036 - DNA, 22 bp, Homo sapiens
caggtctcgggttcagcagtga

SEQ ID NO: 6994037 - DNA, 22 bp, Homo sapiens
tctacattttcacaaggtctcc

SEQ ID NO: 6994038 - DNA, 22 bp, Homo sapiens
acccagagtaacagatggattc

SEQ ID NO: 6994039 - DNA, 22 bp, Homo sapiens
acttaacagacattatttacct

SEQ ID NO: 6994040 - DNA, 22 bp, Homo sapiens
tctgttcagttgatgtagtttt

SEQ ID NO: 6994041 - DNA, 22 bp, Homo sapiens
aggggaggcagcgataaacctg

SEQ ID NO: 6994042 - DNA, 22 bp, Homo sapiens
tgagaggcgctcactctcaggt

SEQ ID NO: 6994043 - DNA, 22 bp, Homo sapiens
aagtgattattgttttcaggtt

SEQ ID NO: 6994044 - DNA, 20 bp, Homo sapiens
tgcctggcctttctctgccc

SEQ ID NO: 6994045 - DNA, 21 bp, Homo sapiens
tgcaggctacttctgactcta

SEQ ID NO: 6994046 - DNA, 22 bp, Homo sapiens
ttttggtttggctccaaatagg

SEQ ID NO: 6994047 - DNA, 22 bp, Homo sapiens
gaggctgtgtgtccctctggac

SEQ ID NO: 6994048 - DNA, 22 bp, Homo sapiens
ctgtgggactctgaggaaaagc

SEQ ID NO: 6994049 - DNA, 22 bp, Homo sapiens
aagtgctgggattataggcatg

SEQ ID NO: 6994050 - DNA, 22 bp, Homo sapiens
ggtggcctggaatcttaacaag

SEQ ID NO: 6994051 - DNA, 22 bp, Homo sapiens
gatacaaaatataaatggagag

SEQ ID NO: 6994052 - DNA, 22 bp, Homo sapiens
aaagcaattgtggtttttgcca

SEQ ID NO: 6994053 - DNA, 22 bp, Homo sapiens
actgaatttattagtatagtct

SEQ ID NO: 6994054 - DNA, 22 bp, Homo sapiens
ggaagtttgtagatgtttctta

SEQ ID NO: 6994055 - DNA, 22 bp, Homo sapiens
tgggcatcatggacagcagagg

SEQ ID NO: 6994056 - DNA, 21 bp, Homo sapiens
tcactagtgccttctgtcatt

SEQ ID NO: 6994057 - DNA, 20 bp, Homo sapiens
ctctctctccattcccaggg

SEQ ID NO: 6994058 - DNA, 22 bp, Homo sapiens
ttgtaaagtacttagcacagca

SEQ ID NO: 6994059 - DNA, 17 bp, Homo sapiens
gctgtagtttgataaga

SEQ ID NO: 6994060 - DNA, 22 bp, Homo sapiens
ttgagagtttgggggcaatatg

SEQ ID NO: 6994061 - DNA, 22 bp, Homo sapiens
agctgggtacagcctgtgccta

SEQ ID NO: 6994062 - DNA, 22 bp, Homo sapiens
aagtggccccttgagaatacca

SEQ ID NO: 6994063 - DNA, 22 bp, Homo sapiens
attctggacaatgagaaactgg

SEQ ID NO: 6994064 - DNA, 22 bp, Homo sapiens
ctatacatcccaatttcagaga

SEQ ID NO: 6994065 - DNA, 22 bp, Homo sapiens
taggatgaaaagtgttctttga

SEQ ID NO: 6994066 - DNA, 16 bp, Homo sapiens
ctggtcttgctgccga

SEQ ID NO: 6994067 - DNA, 22 bp, Homo sapiens
tttgggaattgtagctgtcttg

SEQ ID NO: 6994068 - DNA, 22 bp, Homo sapiens
catgggaataggttgttcttgg

SEQ ID NO: 6994069 - DNA, 23 bp, Homo sapiens
tgccagcagggaatgggaaggac

SEQ ID NO: 6994070 - DNA, 22 bp, Homo sapiens
ggagttgacagtttagaagctt

SEQ ID NO: 6994071 - DNA, 22 bp, Homo sapiens
ttgtaattggacagccatcagg

SEQ ID NO: 6994072 - DNA, 22 bp, Homo sapiens
tcacacatttgaaggcctgtca

SEQ ID NO: 6994073 - DNA, 19 bp, Homo sapiens
aatgctgcttctttttgca

SEQ ID NO: 6994074 - DNA, 23 bp, Homo sapiens
ctgctgtgttggtctcgatggga

SEQ ID NO: 6994075 - DNA, 22 bp, Homo sapiens
actgaactccagcctgggtggc

SEQ ID NO: 6994076 - DNA, 22 bp, Homo sapiens
aggtggccccaggcctctgcca

SEQ ID NO: 6994077 - DNA, 21 bp, Homo sapiens
agtgacagaggaaggtgcata

SEQ ID NO: 6994078 - DNA, 22 bp, Homo sapiens
gacctggtgctagctggtgtgt

SEQ ID NO: 6994079 - DNA, 21 bp, Homo sapiens
tggccatttatccttatgaga

SEQ ID NO: 6994080 - DNA, 19 bp, Homo sapiens
agaagcccagatcccagcc

SEQ ID NO: 6994081 - DNA, 22 bp, Homo sapiens
ttgacgtcctcgatggggaact

SEQ ID NO: 6994082 - DNA, 22 bp, Homo sapiens
ttctggagtgtggaccgctgtt

SEQ ID NO: 6994083 - DNA, 22 bp, Homo sapiens
tccatttaggttccactagtta

SEQ ID NO: 6994084 - DNA, 22 bp, Homo sapiens
agctgagcacattcaaacaggt

SEQ ID NO: 6994085 - DNA, 22 bp, Homo sapiens
ggtggctctctgtcagtgacag

SEQ ID NO: 6994086 - DNA, 22 bp, Homo sapiens
tgccttaagtaagactgaacag

SEQ ID NO: 6994087 - DNA, 22 bp, Homo sapiens
tttgatagggaagtaagaatga

SEQ ID NO: 6994088 - DNA, 21 bp, Homo sapiens
gaaaagcaagggagtagaaca

SEQ ID NO: 6994089 - DNA, 22 bp, Homo sapiens
atggacagctcttatgtgggca

SEQ ID NO: 6994090 - DNA, 22 bp, Homo sapiens
cttctgtgaatgaagtgtggga

SEQ ID NO: 6994091 - DNA, 22 bp, Homo sapiens
aacagtacaactccacaagact

SEQ ID NO: 6994092 - DNA, 22 bp, Homo sapiens
agggcctggactaattggatcc

SEQ ID NO: 6994093 - DNA, 22 bp, Homo sapiens
tttcccacacagtccactgcag

SEQ ID NO: 6994094 - DNA, 17 bp, Homo sapiens
tgtgtacttgaacttga

SEQ ID NO: 6994095 - DNA, 22 bp, Homo sapiens
taggaaccttgatcttggattt

SEQ ID NO: 6994096 - DNA, 22 bp, Homo sapiens
agcagtgggggagtgttagttt

SEQ ID NO: 6994097 - DNA, 22 bp, Homo sapiens
tacatgtggccagaaatttgag

SEQ ID NO: 6994098 - DNA, 22 bp, Homo sapiens
tttggaatattgagaaagtgaa

SEQ ID NO: 6994099 - DNA, 20 bp, Homo sapiens
tggctcctgcggtggaacca

SEQ ID NO: 6994100 - DNA, 22 bp, Homo sapiens
tgtccacatatgttgtttctga

SEQ ID NO: 6994101 - DNA, 22 bp, Homo sapiens
ttaaggattagtcaaagagggc

SEQ ID NO: 6994102 - DNA, 22 bp, Homo sapiens
acccagctctttgatggtcttg

SEQ ID NO: 6994103 - DNA, 22 bp, Homo sapiens
ttaaggcacctgggggtgaact

SEQ ID NO: 6994104 - DNA, 22 bp, Homo sapiens
tgaggcaggacatggacaactg

SEQ ID NO: 6994105 - DNA, 22 bp, Homo sapiens
ggaaggctgtgcagtgtttgca

SEQ ID NO: 6994106 - DNA, 22 bp, Homo sapiens
attgggatgccggctgataaga

SEQ ID NO: 6994107 - DNA, 22 bp, Homo sapiens
ttctttcactcaagaaggatct

SEQ ID NO: 6994108 - DNA, 22 bp, Homo sapiens
tggtctctgctgcagcttctca

SEQ ID NO: 6994109 - DNA, 22 bp, Homo sapiens
gctgcagctgtaggacacaatt

SEQ ID NO: 6994110 - DNA, 22 bp, Homo sapiens
tgtccagtccttggggtgctgt

SEQ ID NO: 6994111 - DNA, 22 bp, Homo sapiens
tgagcagctactgtgttcaggg

SEQ ID NO: 6994112 - DNA, 22 bp, Homo sapiens
ggtctcagactggcaggcagtg

SEQ ID NO: 6994113 - DNA, 22 bp, Homo sapiens
ctcctgggagtcttcctggatg

SEQ ID NO: 6994114 - DNA, 22 bp, Homo sapiens
aaaggttttctgacccttagta

SEQ ID NO: 6994115 - DNA, 20 bp, Homo sapiens
tctcagggttcagcaaagta

SEQ ID NO: 6994116 - DNA, 22 bp, Homo sapiens
tctggctgtgtaatatgtgtag

SEQ ID NO: 6994117 - DNA, 22 bp, Homo sapiens
ccatttttcataaactatccaa

SEQ ID NO: 6994118 - DNA, 22 bp, Homo sapiens
aatgacaaccacaatggtgctg

SEQ ID NO: 6994119 - DNA, 22 bp, Homo sapiens
gcatccatgcatgcagggtgtg

SEQ ID NO: 6994120 - DNA, 22 bp, Homo sapiens
atttccaggctgttttgtgaat

SEQ ID NO: 6994121 - DNA, 22 bp, Homo sapiens
tcaggatggtcctttatgagaa

SEQ ID NO: 6994122 - DNA, 22 bp, Homo sapiens
cagctttctctggtttcaagat

SEQ ID NO: 6994123 - DNA, 22 bp, Homo sapiens
tgaagtcagggattccatgaag

SEQ ID NO: 6994124 - DNA, 22 bp, Homo sapiens
tcctctgagcctcagtttctca

SEQ ID NO: 6994125 - DNA, 22 bp, Homo sapiens
ctggatcatgcattgcttgtcc

SEQ ID NO: 6994126 - DNA, 22 bp, Homo sapiens
tggagtttccctgtgaaaatgc

SEQ ID NO: 6994127 - DNA, 22 bp, Homo sapiens
aagttaggttgcattggtcatc

SEQ ID NO: 6994128 - DNA, 22 bp, Homo sapiens
aggggaaagaacagtcttcagg

SEQ ID NO: 6994129 - DNA, 22 bp, Homo sapiens
tctaatgcttcctctcatccca

SEQ ID NO: 6994130 - DNA, 17 bp, Homo sapiens
agtgtgtgaaatggtgg

SEQ ID NO: 6994131 - DNA, 22 bp, Homo sapiens
cctggccaggctctcagcactg

SEQ ID NO: 6994132 - DNA, 22 bp, Homo sapiens
atgcattcagcggaatgcttag

SEQ ID NO: 6994133 - DNA, 22 bp, Homo sapiens
tgtgggaagagcagtggcagca

SEQ ID NO: 6994134 - DNA, 22 bp, Homo sapiens
tcagtgcagactgtaagttgga

SEQ ID NO: 6994135 - DNA, 22 bp, Homo sapiens
gaggctgctttgatgacaggag

SEQ ID NO: 6994136 - DNA, 22 bp, Homo sapiens
attttttatataccaaggtggg

SEQ ID NO: 6994137 - DNA, 22 bp, Homo sapiens
gtggctgagcagcagagagctg

SEQ ID NO: 6994138 - DNA, 22 bp, Homo sapiens
actggagtattgtttaatacca

SEQ ID NO: 6994139 - DNA, 20 bp, Homo sapiens
tttgcaggaaggaaataggt

SEQ ID NO: 6994140 - DNA, 21 bp, Homo sapiens
acacagctgccggagacggat

SEQ ID NO: 6994141 - DNA, 19 bp, Homo sapiens
gcctatgtcttcaaatcat

SEQ ID NO: 6994142 - DNA, 22 bp, Homo sapiens
gacacagacagttagaggtaat

SEQ ID NO: 6994143 - DNA, 22 bp, Homo sapiens
tgtaaacatgctgaggctggag

SEQ ID NO: 6994144 - DNA, 22 bp, Homo sapiens
tttctgcaaaatctaagttaga

SEQ ID NO: 6994145 - DNA, 22 bp, Homo sapiens
tagtttcatatgcaaaatagta

SEQ ID NO: 6994146 - DNA, 22 bp, Homo sapiens
aggcagtgagaaatagcaagat

SEQ ID NO: 6994147 - DNA, 22 bp, Homo sapiens
agcgtgaattagttggtacaca

SEQ ID NO: 6994148 - DNA, 22 bp, Homo sapiens
tggctgaggagggtcttctggt

SEQ ID NO: 6994149 - DNA, 22 bp, Homo sapiens
aggtattattagcatctctatt

SEQ ID NO: 6994150 - DNA, 22 bp, Homo sapiens
actgtactgaaaagtaagcaag

SEQ ID NO: 6994151 - DNA, 22 bp, Homo sapiens
aagtgttttgtaaacagaaaag

SEQ ID NO: 6994152 - DNA, 22 bp, Homo sapiens
accctcatgaagctggcctgga

SEQ ID NO: 6994153 - DNA, 22 bp, Homo sapiens
agcatgcagtaagtaccctgtg

SEQ ID NO: 6994154 - DNA, 22 bp, Homo sapiens
caggcttttgcatagcactggg

SEQ ID NO: 6994155 - DNA, 23 bp, Homo sapiens
aagtttggacgaagtcaaatgcc

SEQ ID NO: 6994156 - DNA, 22 bp, Homo sapiens
acagctctggtcctttagagag

SEQ ID NO: 6994157 - DNA, 23 bp, Homo sapiens
ctgtatgatgttaagtggaaagc

SEQ ID NO: 6994158 - DNA, 22 bp, Homo sapiens
aaatgcctctgggttattctag

SEQ ID NO: 6994159 - DNA, 23 bp, Homo sapiens
tgtagctttatacaagatctgtt

SEQ ID NO: 6994160 - DNA, 22 bp, Homo sapiens
tctcagggtttgtacaagtgta

SEQ ID NO: 6994161 - DNA, 16 bp, Homo sapiens
ttgaatactcatagca

SEQ ID NO: 6994162 - DNA, 22 bp, Homo sapiens
tcctgcgttcccctggcgccgg

SEQ ID NO: 6994163 - DNA, 22 bp, Homo sapiens
ctaggcagatggagaagtggct

SEQ ID NO: 6994164 - DNA, 22 bp, Homo sapiens
ctttggctctttagaattccct

SEQ ID NO: 6994165 - DNA, 22 bp, Homo sapiens
gctggagtgagtatgtgtagtc

SEQ ID NO: 6994166 - DNA, 22 bp, Homo sapiens
tttgcagcaattcgttatacag

SEQ ID NO: 6994167 - DNA, 22 bp, Homo sapiens
agtaccattatccagtaaagga

SEQ ID NO: 6994168 - DNA, 22 bp, Homo sapiens
tttggcacagcttcccagactt

SEQ ID NO: 6994169 - DNA, 22 bp, Homo sapiens
tttctgtaaagaccaagccagc

SEQ ID NO: 6994170 - DNA, 22 bp, Homo sapiens
cccaggcacactgaagtgacat

SEQ ID NO: 6994171 - DNA, 22 bp, Homo sapiens
gtttgcctgccgacgctctcat

SEQ ID NO: 6994172 - DNA, 22 bp, Homo sapiens
ctgcagcagcctccagccttgg

SEQ ID NO: 6994173 - DNA, 22 bp, Homo sapiens
cccaggagataacgttcccaag

SEQ ID NO: 6994174 - DNA, 22 bp, Homo sapiens
gagatggagtctttttctgtca

SEQ ID NO: 6994175 - DNA, 22 bp, Homo sapiens
ccaggctcagctattaagaaac

SEQ ID NO: 6994176 - DNA, 22 bp, Homo sapiens
tcagtaaatgcttgcaggccga

SEQ ID NO: 6994177 - DNA, 22 bp, Homo sapiens
tagatttgctccaatgagttaa

SEQ ID NO: 6994178 - DNA, 22 bp, Homo sapiens
agttctttaacctttctgggca

SEQ ID NO: 6994179 - DNA, 22 bp, Homo sapiens
ggccagctctgcacagcagctg

SEQ ID NO: 6994180 - DNA, 22 bp, Homo sapiens
agaacttttggagacttttagt

SEQ ID NO: 6994181 - DNA, 22 bp, Homo sapiens
tctgagtttataggttttccag

SEQ ID NO: 6994182 - DNA, 23 bp, Homo sapiens
ttcaaagcttaagctctttccac

SEQ ID NO: 6994183 - DNA, 22 bp, Homo sapiens
tctggagagtcacagtgccaga

SEQ ID NO: 6994184 - DNA, 22 bp, Homo sapiens
tctggctttctgactctacaac

SEQ ID NO: 6994185 - DNA, 22 bp, Homo sapiens
ttcatctgtagtttttccaagg

SEQ ID NO: 6994186 - DNA, 18 bp, Homo sapiens
tcctagtgaaatgcctgt

SEQ ID NO: 6994187 - DNA, 22 bp, Homo sapiens
agtttacccactgttgaaatta

SEQ ID NO: 6994188 - DNA, 22 bp, Homo sapiens
ctgggccagttatgtctcatct

SEQ ID NO: 6994189 - DNA, 22 bp, Homo sapiens
aacatttgcgagtgggtttggg

SEQ ID NO: 6994190 - DNA, 22 bp, Homo sapiens
tttgtcttgtaagttaaattca

SEQ ID NO: 6994191 - DNA, 22 bp, Homo sapiens
tcagttcctgttgcacagcatc

SEQ ID NO: 6994192 - DNA, 22 bp, Homo sapiens
agtgcatgtccagtagtttatg

SEQ ID NO: 6994193 - DNA, 22 bp, Homo sapiens
ggcttccatgtgaaattctttg

SEQ ID NO: 6994194 - DNA, 19 bp, Homo sapiens
tccaggctccattggcaga

SEQ ID NO: 6994195 - DNA, 22 bp, Homo sapiens
atctccagtatcctagtattgt

SEQ ID NO: 6994196 - DNA, 22 bp, Homo sapiens
agtttcacatagctcagtgctc

SEQ ID NO: 6994197 - DNA, 22 bp, Homo sapiens
ctgagcccattgggtgctgtta

SEQ ID NO: 6994198 - DNA, 22 bp, Homo sapiens
tacagaattagattattagaga

SEQ ID NO: 6994199 - DNA, 22 bp, Homo sapiens
tccatcactattatctacaaca

SEQ ID NO: 6994200 - DNA, 19 bp, Homo sapiens
tgagaggcttaaggcagct

SEQ ID NO: 6994201 - DNA, 22 bp, Homo sapiens
tttgacctctggaccctctgaa

SEQ ID NO: 6994202 - DNA, 22 bp, Homo sapiens
tagggctattctgagtaataat

SEQ ID NO: 6994203 - DNA, 22 bp, Homo sapiens
tgacagtattgatggcaggatt

SEQ ID NO: 6994204 - DNA, 22 bp, Homo sapiens
ctgtgcttacctgcccaggtga

SEQ ID NO: 6994205 - DNA, 22 bp, Homo sapiens
gtacctgggggatccacttctt

SEQ ID NO: 6994206 - DNA, 22 bp, Homo sapiens
taactttcacatcacactgact

SEQ ID NO: 6994207 - DNA, 22 bp, Homo sapiens
catagtaaataatgcagatgat

SEQ ID NO: 6994208 - DNA, 22 bp, Homo sapiens
caataaagaagatttttgcaat

SEQ ID NO: 6994209 - DNA, 22 bp, Homo sapiens
gcagctggagcatcttctcatc

SEQ ID NO: 6994210 - DNA, 22 bp, Homo sapiens
gatgcttaagatgttggtggca

SEQ ID NO: 6994211 - DNA, 22 bp, Homo sapiens
tagacatttatctccatgtgga

SEQ ID NO: 6994212 - DNA, 22 bp, Homo sapiens
tttgaaattaagatattgtcca

SEQ ID NO: 6994213 - DNA, 22 bp, Homo sapiens
tgctggctttctgtccctggca

SEQ ID NO: 6994214 - DNA, 22 bp, Homo sapiens
gattgaaaggtctttaaattgg

SEQ ID NO: 6994215 - DNA, 22 bp, Homo sapiens
cttgtgattgagaaagtctaaa

SEQ ID NO: 6994216 - DNA, 22 bp, Homo sapiens
acaatgtctcatattcgtgttc

SEQ ID NO: 6994217 - DNA, 22 bp, Homo sapiens
ctgagaaagtgagggttaaaca

SEQ ID NO: 6994218 - DNA, 21 bp, Homo sapiens
tgaggataagtaaagctgaag

SEQ ID NO: 6994219 - DNA, 22 bp, Homo sapiens
atataactctccattaagggcc

SEQ ID NO: 6994220 - DNA, 22 bp, Homo sapiens
cccctgcgaggacagtgggaca

SEQ ID NO: 6994221 - DNA, 22 bp, Homo sapiens
ggctagttctcaaattcctgaa

SEQ ID NO: 6994222 - DNA, 22 bp, Homo sapiens
aaagatgttgctgctccgccct

SEQ ID NO: 6994223 - DNA, 22 bp, Homo sapiens
ctctggagaacgctatggatct

SEQ ID NO: 6994224 - DNA, 22 bp, Homo sapiens
aaggaaatgaggttgatggatg

SEQ ID NO: 6994225 - DNA, 22 bp, Homo sapiens
tgctgctctggccaggaactgc

SEQ ID NO: 6994226 - DNA, 22 bp, Homo sapiens
ggaatagtttatgtagctgaat

SEQ ID NO: 6994227 - DNA, 22 bp, Homo sapiens
tagcaagtagatactcatttag

SEQ ID NO: 6994228 - DNA, 22 bp, Homo sapiens
tgcaggctcatctcaagagtag

SEQ ID NO: 6994229 - DNA, 22 bp, Homo sapiens
cctgttcctatggatatttgtt

SEQ ID NO: 6994230 - DNA, 22 bp, Homo sapiens
aacaatgagtcctctgaggtta

SEQ ID NO: 6994231 - DNA, 22 bp, Homo sapiens
gtctgagcgctggagcttgtgt

SEQ ID NO: 6994232 - DNA, 22 bp, Homo sapiens
aaagtgttgggaagaaagtgca

SEQ ID NO: 6994233 - DNA, 22 bp, Homo sapiens
tgagacaataaggctgagaagc

SEQ ID NO: 6994234 - DNA, 22 bp, Homo sapiens
gagcaggcttgcagagaagggg

SEQ ID NO: 6994235 - DNA, 22 bp, Homo sapiens
actgggaaggagcaggatctgt

SEQ ID NO: 6994236 - DNA, 21 bp, Homo sapiens
tatcagactcctagtaaccac

SEQ ID NO: 6994237 - DNA, 22 bp, Homo sapiens
gttacaaatgccaaagctgaga

SEQ ID NO: 6994238 - DNA, 22 bp, Homo sapiens
agagggtaacaagaggcctgga

SEQ ID NO: 6994239 - DNA, 22 bp, Homo sapiens
catagaaatcaggtgagaatct

SEQ ID NO: 6994240 - DNA, 22 bp, Homo sapiens
agtgctcctatggatcagttgt

SEQ ID NO: 6994241 - DNA, 22 bp, Homo sapiens
gttattgtccatttatttagca

SEQ ID NO: 6994242 - DNA, 22 bp, Homo sapiens
tgcatgatagagatggtattag

SEQ ID NO: 6994243 - DNA, 22 bp, Homo sapiens
cttcaggattaatttggggcct

SEQ ID NO: 6994244 - DNA, 22 bp, Homo sapiens
gtggcgtgatctcggctcactg

SEQ ID NO: 6994245 - DNA, 22 bp, Homo sapiens
acacttacggttccttcatcca

SEQ ID NO: 6994246 - DNA, 21 bp, Homo sapiens
gtacacagtggttctgaggga

SEQ ID NO: 6994247 - DNA, 22 bp, Homo sapiens
agagttctgaaattatctttac

SEQ ID NO: 6994248 - DNA, 22 bp, Homo sapiens
ttctgaggcatagaggatgaga

SEQ ID NO: 6994249 - DNA, 22 bp, Homo sapiens
taagtggaaggttatatgctaa

SEQ ID NO: 6994250 - DNA, 22 bp, Homo sapiens
ggtgattttcgagtttcatgtt

SEQ ID NO: 6994251 - DNA, 22 bp, Homo sapiens
gagtggagcaaaagaggtagat

SEQ ID NO: 6994252 - DNA, 22 bp, Homo sapiens
attcaccaagaatgatttcagt

SEQ ID NO: 6994253 - DNA, 22 bp, Homo sapiens
aatatgtttataagatatcttc

SEQ ID NO: 6994254 - DNA, 22 bp, Homo sapiens
gtggccagtgggaatgggctca

SEQ ID NO: 6994255 - DNA, 22 bp, Homo sapiens
taaggccaccgttatagaacca

SEQ ID NO: 6994256 - DNA, 21 bp, Homo sapiens
aggagctgtgtgcttcctttc

SEQ ID NO: 6994257 - DNA, 22 bp, Homo sapiens
acagaaatgatgtttggcaata

SEQ ID NO: 6994258 - DNA, 22 bp, Homo sapiens
actttcccacttaatgtattta

SEQ ID NO: 6994259 - DNA, 22 bp, Homo sapiens
gccactgttgctcctcaggaaa

SEQ ID NO: 6994260 - DNA, 22 bp, Homo sapiens
atgtaaaccgtgcactcccagg

SEQ ID NO: 6994261 - DNA, 22 bp, Homo sapiens
gagagtcactgtctgcatttcc

SEQ ID NO: 6994262 - DNA, 22 bp, Homo sapiens
gtaaggctttttagaagcacat

SEQ ID NO: 6994263 - DNA, 22 bp, Homo sapiens
atggagttctttaaattcacag

SEQ ID NO: 6994264 - DNA, 22 bp, Homo sapiens
tgcaggaaaaccaacacgcctt

SEQ ID NO: 6994265 - DNA, 22 bp, Homo sapiens
gtgcaaaagtaattgtggtttt

SEQ ID NO: 6994266 - DNA, 22 bp, Homo sapiens
ctggcagtggggcctcagtgtt

SEQ ID NO: 6994267 - DNA, 19 bp, Homo sapiens
aggcggctcgcgcgcctcc

SEQ ID NO: 6994268 - DNA, 22 bp, Homo sapiens
cacaatctcaactgccttttag

SEQ ID NO: 6994269 - DNA, 22 bp, Homo sapiens
ccatgcatggcactggactggg

SEQ ID NO: 6994270 - DNA, 22 bp, Homo sapiens
tcccaggaagatcccagggacc

SEQ ID NO: 6994271 - DNA, 22 bp, Homo sapiens
ttgaggtatctgtctttaattg

SEQ ID NO: 6994272 - DNA, 22 bp, Homo sapiens
cctagagtgattgagagcatca

SEQ ID NO: 6994273 - DNA, 22 bp, Homo sapiens
aaattggattttaaactgttgg

SEQ ID NO: 6994274 - DNA, 22 bp, Homo sapiens
tcccaggaatgtctgaaagtga

SEQ ID NO: 6994275 - DNA, 22 bp, Homo sapiens
caccactgtatccctagcactt

SEQ ID NO: 6994276 - DNA, 22 bp, Homo sapiens
gaaggaggctccccaaagtctg

SEQ ID NO: 6994277 - DNA, 22 bp, Homo sapiens
tttcttagcgatgcttgataaa

SEQ ID NO: 6994278 - DNA, 22 bp, Homo sapiens
tccagtcctagaaactggagag

SEQ ID NO: 6994279 - DNA, 22 bp, Homo sapiens
gggcaggttattggagtaggga

SEQ ID NO: 6994280 - DNA, 22 bp, Homo sapiens
tgtcagtggtcatagtagaaaa

SEQ ID NO: 6994281 - DNA, 22 bp, Homo sapiens
ggcagcttaaaccacagacatt

SEQ ID NO: 6994282 - DNA, 22 bp, Homo sapiens
aacagttacccttaagatcttt

SEQ ID NO: 6994283 - DNA, 22 bp, Homo sapiens
ttgtgaaatgtttcaaaatagt

SEQ ID NO: 6994284 - DNA, 22 bp, Homo sapiens
ggatgttctggggttctcttgt

SEQ ID NO: 6994285 - DNA, 21 bp, Homo sapiens
caatcagttggcatttgagca

SEQ ID NO: 6994286 - DNA, 22 bp, Homo sapiens
cgaggatgggatgtcttgacag

SEQ ID NO: 6994287 - DNA, 22 bp, Homo sapiens
tgccagtcagtggtttaaaagt

SEQ ID NO: 6994288 - DNA, 22 bp, Homo sapiens
cctggccagcagccccttcctc

SEQ ID NO: 6994289 - DNA, 22 bp, Homo sapiens
aagtcattctatttctctatgt

SEQ ID NO: 6994290 - DNA, 22 bp, Homo sapiens
tcctctgagacatcaggttgag

SEQ ID NO: 6994291 - DNA, 22 bp, Homo sapiens
gcctgctggctggaaattctcc

SEQ ID NO: 6994292 - DNA, 22 bp, Homo sapiens
acatgcaaatgtgcatgcatgt

SEQ ID NO: 6994293 - DNA, 22 bp, Homo sapiens
tctaggtattgtagttgctaat

SEQ ID NO: 6994294 - DNA, 22 bp, Homo sapiens
gtgggcttcccttaagccagag

SEQ ID NO: 6994295 - DNA, 22 bp, Homo sapiens
aaatgcatgtagaataatagag

SEQ ID NO: 6994296 - DNA, 22 bp, Homo sapiens
ttcaggtgtggccagaggagaa

SEQ ID NO: 6994297 - DNA, 22 bp, Homo sapiens
tgctttgcaggaaccctaagca

SEQ ID NO: 6994298 - DNA, 22 bp, Homo sapiens
taggtgtctaacaataagtgta

SEQ ID NO: 6994299 - DNA, 22 bp, Homo sapiens
gttggctgtcgctcacctccct

SEQ ID NO: 6994300 - DNA, 22 bp, Homo sapiens
atgggctgggatctgagtgtca

SEQ ID NO: 6994301 - DNA, 22 bp, Homo sapiens
ggagtgatggaaagtgcttggc

SEQ ID NO: 6994302 - DNA, 22 bp, Homo sapiens
gctggagaggggtcactctgag

SEQ ID NO: 6994303 - DNA, 22 bp, Homo sapiens
tgctcccaggctctgtggtctg

SEQ ID NO: 6994304 - DNA, 22 bp, Homo sapiens
gaagggtgcatggagggaagtc

SEQ ID NO: 6994305 - DNA, 22 bp, Homo sapiens
atcattataatggtatagttgt

SEQ ID NO: 6994306 - DNA, 22 bp, Homo sapiens
gtccttccacatggccaacttc

SEQ ID NO: 6994307 - DNA, 22 bp, Homo sapiens
gccttgccaaggggcagcagag

SEQ ID NO: 6994308 - DNA, 22 bp, Homo sapiens
tccctgtgagtcaactaaacaa

SEQ ID NO: 6994309 - DNA, 22 bp, Homo sapiens
tctgcttctcctacttcatggg

SEQ ID NO: 6994310 - DNA, 22 bp, Homo sapiens
cccagagttggtcaggggaccc

SEQ ID NO: 6994311 - DNA, 22 bp, Homo sapiens
tcggcttgaggcagtactggca

SEQ ID NO: 6994312 - DNA, 22 bp, Homo sapiens
tcataaagttacccaaatttta

SEQ ID NO: 6994313 - DNA, 22 bp, Homo sapiens
tgtggggactttcaaagccaat

SEQ ID NO: 6994314 - DNA, 22 bp, Homo sapiens
tgaatgtgggagagctggcaat

SEQ ID NO: 6994315 - DNA, 22 bp, Homo sapiens
gctctgctgtgtttgttcagca

SEQ ID NO: 6994316 - DNA, 19 bp, Homo sapiens
acagtgcatgggacctggt

SEQ ID NO: 6994317 - DNA, 21 bp, Homo sapiens
ctcacaggatgcagtgttact

SEQ ID NO: 6994318 - DNA, 22 bp, Homo sapiens
catggaaggcaaaagacacaga

SEQ ID NO: 6994319 - DNA, 22 bp, Homo sapiens
catggccaggcccagggcccag

SEQ ID NO: 6994320 - DNA, 22 bp, Homo sapiens
actatatacacattatcttgtt

SEQ ID NO: 6994321 - DNA, 23 bp, Homo sapiens
gagattctcctgttgtcaagtct

SEQ ID NO: 6994322 - DNA, 22 bp, Homo sapiens
cagcagccactagagggctcac

SEQ ID NO: 6994323 - DNA, 22 bp, Homo sapiens
tgaacacagttctgatgagctt

SEQ ID NO: 6994324 - DNA, 22 bp, Homo sapiens
tggctgagaaaaaagagctata

SEQ ID NO: 6994325 - DNA, 18 bp, Homo sapiens
gctctggctcacctccag

SEQ ID NO: 6994326 - DNA, 22 bp, Homo sapiens
tttatctgttgtacctgcattg

SEQ ID NO: 6994327 - DNA, 22 bp, Homo sapiens
tgtcatcttcactgggtcacaa

SEQ ID NO: 6994328 - DNA, 22 bp, Homo sapiens
aagacatgactgcacagccaaa

SEQ ID NO: 6994329 - DNA, 19 bp, Homo sapiens
ttacttggcaaagtcagtc

SEQ ID NO: 6994330 - DNA, 22 bp, Homo sapiens
ctggcatctagtgcgttgaggt

SEQ ID NO: 6994331 - DNA, 22 bp, Homo sapiens
caggccagtgtgcttcccaggc

SEQ ID NO: 6994332 - DNA, 22 bp, Homo sapiens
caggtcctggcagctgactcag

SEQ ID NO: 6994333 - DNA, 22 bp, Homo sapiens
tgctgagatgaatagggctgtc

SEQ ID NO: 6994334 - DNA, 20 bp, Homo sapiens
aggaggaaaaaatgacgagc

SEQ ID NO: 6994335 - DNA, 22 bp, Homo sapiens
tcctgcaggccagaggggtgag

SEQ ID NO: 6994336 - DNA, 22 bp, Homo sapiens
atgtccttcggacaaaattctt

SEQ ID NO: 6994337 - DNA, 22 bp, Homo sapiens
ggcttaaagaattaacagagat

SEQ ID NO: 6994338 - DNA, 22 bp, Homo sapiens
tgggggctccaggctccaggga

SEQ ID NO: 6994339 - DNA, 22 bp, Homo sapiens
tagaactaagagttatcattta

SEQ ID NO: 6994340 - DNA, 22 bp, Homo sapiens
ttgagaaactctgggttagaat

SEQ ID NO: 6994341 - DNA, 22 bp, Homo sapiens
gagtctatctcactcccccagg

SEQ ID NO: 6994342 - DNA, 22 bp, Homo sapiens
agtgtcccctacagaggcattc

SEQ ID NO: 6994343 - DNA, 22 bp, Homo sapiens
gaggccagtgtgctgtgttttc

SEQ ID NO: 6994344 - DNA, 22 bp, Homo sapiens
tgcatggtttgtgaattatacc

SEQ ID NO: 6994345 - DNA, 22 bp, Homo sapiens
aaagttgttcagtaagaaactc

SEQ ID NO: 6994346 - DNA, 22 bp, Homo sapiens
acacatggtggctggactatag

SEQ ID NO: 6994347 - DNA, 22 bp, Homo sapiens
agtgagcatcttcaggagccaa

SEQ ID NO: 6994348 - DNA, 22 bp, Homo sapiens
cagggaaactaggaaataagct

SEQ ID NO: 6994349 - DNA, 22 bp, Homo sapiens
gtcctcacctctagtgcagaca

SEQ ID NO: 6994350 - DNA, 22 bp, Homo sapiens
aggcctgaaggaagatgagctg

SEQ ID NO: 6994351 - DNA, 22 bp, Homo sapiens
gcctgcagacgtgttttcctca

SEQ ID NO: 6994352 - DNA, 22 bp, Homo sapiens
ctccctccctacgtgagctcac

SEQ ID NO: 6994353 - DNA, 22 bp, Homo sapiens
atttcagcccagtatgagcccc

SEQ ID NO: 6994354 - DNA, 22 bp, Homo sapiens
tttagaaattgcagagtgggtg

SEQ ID NO: 6994355 - DNA, 22 bp, Homo sapiens
gatcaacaacttttgaatagct

SEQ ID NO: 6994356 - DNA, 22 bp, Homo sapiens
tgagctgggagtggtgatgagg

SEQ ID NO: 6994357 - DNA, 22 bp, Homo sapiens
accagggcttacagcagtagct

SEQ ID NO: 6994358 - DNA, 22 bp, Homo sapiens
gctgccttgcttactccactgc

SEQ ID NO: 6994359 - DNA, 22 bp, Homo sapiens
acagaatgcagagatgcccaga

SEQ ID NO: 6994360 - DNA, 22 bp, Homo sapiens
ttcttggaaatacattcaataa

SEQ ID NO: 6994361 - DNA, 22 bp, Homo sapiens
ctagtgtttattaatcatgagg

SEQ ID NO: 6994362 - DNA, 22 bp, Homo sapiens
cctaggctaattcagtccagta

SEQ ID NO: 6994363 - DNA, 17 bp, Homo sapiens
gattagagaactaagga

SEQ ID NO: 6994364 - DNA, 22 bp, Homo sapiens
tgcacagttcgccttctccaag

SEQ ID NO: 6994365 - DNA, 22 bp, Homo sapiens
tttcactcagctctcattgtct

SEQ ID NO: 6994366 - DNA, 22 bp, Homo sapiens
tgagggagctgacctttctgtg

SEQ ID NO: 6994367 - DNA, 22 bp, Homo sapiens
caggcctgtgacaccgtgtctg

SEQ ID NO: 6994368 - DNA, 22 bp, Homo sapiens
atggaatggctccctgccccag

SEQ ID NO: 6994369 - DNA, 22 bp, Homo sapiens
tacagtgtccctttttcagaca

SEQ ID NO: 6994370 - DNA, 22 bp, Homo sapiens
cctcctgggccttgctctgtga

SEQ ID NO: 6994371 - DNA, 22 bp, Homo sapiens
ggctccagggtctctccttgtg

SEQ ID NO: 6994372 - DNA, 22 bp, Homo sapiens
gccagcttcccatctggcttcc

SEQ ID NO: 6994373 - DNA, 22 bp, Homo sapiens
gtccagcctgaagagtgggggc

SEQ ID NO: 6994374 - DNA, 23 bp, Homo sapiens
tggcaggaaatgagaatgttcct

SEQ ID NO: 6994375 - DNA, 22 bp, Homo sapiens
aaaatgctatttcatggaggag

SEQ ID NO: 6994376 - DNA, 22 bp, Homo sapiens
gaggcaactgcttttcctcctt

SEQ ID NO: 6994377 - DNA, 22 bp, Homo sapiens
ctttggcacagtctcatttgat

SEQ ID NO: 6994378 - DNA, 20 bp, Homo sapiens
tgtttgtgtggggccttggc

SEQ ID NO: 6994379 - DNA, 22 bp, Homo sapiens
agtgatttgggtgtcagaaagt

SEQ ID NO: 6994380 - DNA, 22 bp, Homo sapiens
ctcttgggatacactgccatag

SEQ ID NO: 6994381 - DNA, 22 bp, Homo sapiens
gcatggcagggattagtagtag

SEQ ID NO: 6994382 - DNA, 22 bp, Homo sapiens
ctgctaattttgtgcaagtctg

SEQ ID NO: 6994383 - DNA, 22 bp, Homo sapiens
ctgagactgtaccacttcctcc

SEQ ID NO: 6994384 - DNA, 22 bp, Homo sapiens
cagatggattttgtaggctgat

SEQ ID NO: 6994385 - DNA, 22 bp, Homo sapiens
attctaaatcagagagctctgt

SEQ ID NO: 6994386 - DNA, 22 bp, Homo sapiens
ttttccttctagagcagatttc

SEQ ID NO: 6994387 - DNA, 22 bp, Homo sapiens
ttagaacattccatcactgggt

SEQ ID NO: 6994388 - DNA, 22 bp, Homo sapiens
agagtgggttataggcagactt

SEQ ID NO: 6994389 - DNA, 22 bp, Homo sapiens
tggcattttgtagctgtgtatc

SEQ ID NO: 6994390 - DNA, 22 bp, Homo sapiens
gacccagctaaccaggtgggga

SEQ ID NO: 6994391 - DNA, 22 bp, Homo sapiens
gaatttaaaggccagacctgag

SEQ ID NO: 6994392 - DNA, 22 bp, Homo sapiens
tttcagtgtgagtgtcttattt

SEQ ID NO: 6994393 - DNA, 22 bp, Homo sapiens
cctgaccttagtttccttgtga

SEQ ID NO: 6994394 - DNA, 22 bp, Homo sapiens
agccaatctcctgttgatgcca

SEQ ID NO: 6994395 - DNA, 22 bp, Homo sapiens
ttaggaaattccacctgtattc

SEQ ID NO: 6994396 - DNA, 22 bp, Homo sapiens
aactgcaaaaatggtagtctta

SEQ ID NO: 6994397 - DNA, 22 bp, Homo sapiens
cactggtgtattagagctagaa

SEQ ID NO: 6994398 - DNA, 21 bp, Homo sapiens
acactggtgcctgatgtcagg

SEQ ID NO: 6994399 - DNA, 22 bp, Homo sapiens
caccctggcctcgctctctgca

SEQ ID NO: 6994400 - DNA, 22 bp, Homo sapiens
aaatagttagccctgcatatat

SEQ ID NO: 6994401 - DNA, 22 bp, Homo sapiens
aaacaggcttatattttgctct

SEQ ID NO: 6994402 - DNA, 22 bp, Homo sapiens
tctttgatttgacaatatcttg

SEQ ID NO: 6994403 - DNA, 22 bp, Homo sapiens
aacacagggcagctgctgggaa

SEQ ID NO: 6994404 - DNA, 22 bp, Homo sapiens
ccaatgcagataagacaaacac

SEQ ID NO: 6994405 - DNA, 22 bp, Homo sapiens
ttgccttatagtgctctgcatt

SEQ ID NO: 6994406 - DNA, 22 bp, Homo sapiens
cagaggcacagcttcttttaat

SEQ ID NO: 6994407 - DNA, 22 bp, Homo sapiens
ttgcatttcactttcagtaggc

SEQ ID NO: 6994408 - DNA, 20 bp, Homo sapiens
cagaagtttgcattggtata

SEQ ID NO: 6994409 - DNA, 22 bp, Homo sapiens
caggacccaacctccctgctct

SEQ ID NO: 6994410 - DNA, 20 bp, Homo sapiens
tgtccccaccaaaatttcat

SEQ ID NO: 6994411 - DNA, 22 bp, Homo sapiens
cagtcacacaagtggacttggg

SEQ ID NO: 6994412 - DNA, 21 bp, Homo sapiens
ttgaaagtaaattcagcagct

SEQ ID NO: 6994413 - DNA, 22 bp, Homo sapiens
aggtaacagcttcagcttcaga

SEQ ID NO: 6994414 - DNA, 22 bp, Homo sapiens
tatgagaacgggggcgtgtggg

SEQ ID NO: 6994415 - DNA, 22 bp, Homo sapiens
tggacagcgaaagtgcctggga

SEQ ID NO: 6994416 - DNA, 22 bp, Homo sapiens
atttctctgcagtgttcggaat

SEQ ID NO: 6994417 - DNA, 22 bp, Homo sapiens
agagcccaggcaggcatccagg

SEQ ID NO: 6994418 - DNA, 22 bp, Homo sapiens
ttagtcacttcttccttcatca

SEQ ID NO: 6994419 - DNA, 20 bp, Homo sapiens
tctccaccacagagagcaga

SEQ ID NO: 6994420 - DNA, 22 bp, Homo sapiens
acatcacggtccagcacggctg

SEQ ID NO: 6994421 - DNA, 22 bp, Homo sapiens
ggaacactgccttttattttcc

SEQ ID NO: 6994422 - DNA, 22 bp, Homo sapiens
caggctgtctgctgaggaaagg

SEQ ID NO: 6994423 - DNA, 21 bp, Homo sapiens
aggtggggctgcacctctgct

SEQ ID NO: 6994424 - DNA, 22 bp, Homo sapiens
ttccactgaaggatctagggaa

SEQ ID NO: 6994425 - DNA, 22 bp, Homo sapiens
actgaagacattactggtctaa

SEQ ID NO: 6994426 - DNA, 22 bp, Homo sapiens
tgtatatacacactcccatgtt

SEQ ID NO: 6994427 - DNA, 19 bp, Homo sapiens
agcacagagagtctatagc

SEQ ID NO: 6994428 - DNA, 22 bp, Homo sapiens
catcagtctgtgaagagggcta

SEQ ID NO: 6994429 - DNA, 22 bp, Homo sapiens
acatgagactgggtttgtaggg

SEQ ID NO: 6994430 - DNA, 22 bp, Homo sapiens
gcaggaagatgagctcaggtaa

SEQ ID NO: 6994431 - DNA, 22 bp, Homo sapiens
ggccttgcagccacagaacaca

SEQ ID NO: 6994432 - DNA, 22 bp, Homo sapiens
tcttgggaaataaacagattga

SEQ ID NO: 6994433 - DNA, 22 bp, Homo sapiens
ggtccctacccagctcgggggt

SEQ ID NO: 6994434 - DNA, 22 bp, Homo sapiens
ggtcagtggcagggggtacttc

SEQ ID NO: 6994435 - DNA, 22 bp, Homo sapiens
aggtacatgaggctaatagact

SEQ ID NO: 6994436 - DNA, 22 bp, Homo sapiens
ttagatgtttatatacagattt

SEQ ID NO: 6994437 - DNA, 22 bp, Homo sapiens
tcttggctagtaccttcctgcc

SEQ ID NO: 6994438 - DNA, 22 bp, Homo sapiens
gtaaatcatggtcagaataaat

SEQ ID NO: 6994439 - DNA, 22 bp, Homo sapiens
tgattctttggagagctatata

SEQ ID NO: 6994440 - DNA, 22 bp, Homo sapiens
aggaaacttcagagttttggtc

SEQ ID NO: 6994441 - DNA, 22 bp, Homo sapiens
agccctggtagcctgctgccat

SEQ ID NO: 6994442 - DNA, 22 bp, Homo sapiens
acccaggagccgtgagaggtta

SEQ ID NO: 6994443 - DNA, 22 bp, Homo sapiens
tgcacagaatcattttcagctg

SEQ ID NO: 6994444 - DNA, 22 bp, Homo sapiens
tttcaacagggcacaggtgcca

SEQ ID NO: 6994445 - DNA, 22 bp, Homo sapiens
gatgataagatggagttgaatt

SEQ ID NO: 6994446 - DNA, 22 bp, Homo sapiens
acagtgttctcttcctgtatag

SEQ ID NO: 6994447 - DNA, 22 bp, Homo sapiens
cagagctttgtgtcagggctgt

SEQ ID NO: 6994448 - DNA, 22 bp, Homo sapiens
tgatatcctttaacctggaccg

SEQ ID NO: 6994449 - DNA, 17 bp, Homo sapiens
gctgcagcggtaggcag

SEQ ID NO: 6994450 - DNA, 22 bp, Homo sapiens
tagaacctccacaggacctcca

SEQ ID NO: 6994451 - DNA, 22 bp, Homo sapiens
tgcaatttaatgtgtcccaatt

SEQ ID NO: 6994452 - DNA, 22 bp, Homo sapiens
atgagcagatgctcctgcctct

SEQ ID NO: 6994453 - DNA, 22 bp, Homo sapiens
aatacagtgaaagtgagcaagg

SEQ ID NO: 6994454 - DNA, 19 bp, Homo sapiens
ctgggcctgcatggttgtt

SEQ ID NO: 6994455 - DNA, 22 bp, Homo sapiens
cagaaggctgcaggtttgctgt

SEQ ID NO: 6994456 - DNA, 16 bp, Homo sapiens
cttcacagaggagagt

SEQ ID NO: 6994457 - DNA, 22 bp, Homo sapiens
aagagtttgtcagatctgcacg

SEQ ID NO: 6994458 - DNA, 22 bp, Homo sapiens
agtggctttgttccgtatggca

SEQ ID NO: 6994459 - DNA, 22 bp, Homo sapiens
tttgccctcaggtttttatgtg

SEQ ID NO: 6994460 - DNA, 22 bp, Homo sapiens
tctttcaaagtaacaaccacga

SEQ ID NO: 6994461 - DNA, 22 bp, Homo sapiens
atttctcagttcctactgttta

SEQ ID NO: 6994462 - DNA, 22 bp, Homo sapiens
caagtcattactgaaatgtcac

SEQ ID NO: 6994463 - DNA, 22 bp, Homo sapiens
accctgggtatttcccaaactt

SEQ ID NO: 6994464 - DNA, 22 bp, Homo sapiens
ttccagtaatgtgactttgagc

SEQ ID NO: 6994465 - DNA, 22 bp, Homo sapiens
ttagttgcatgccagacttggc

SEQ ID NO: 6994466 - DNA, 22 bp, Homo sapiens
aatacttgtgaattcaaagtct

SEQ ID NO: 6994467 - DNA, 18 bp, Homo sapiens
ggaagaaaaggaactcag

SEQ ID NO: 6994468 - DNA, 22 bp, Homo sapiens
tgtgccttctcagtcctgctca

SEQ ID NO: 6994469 - DNA, 19 bp, Homo sapiens
acatgcatatggacagttg

SEQ ID NO: 6994470 - DNA, 22 bp, Homo sapiens
gctagcctcccttttccatggt

SEQ ID NO: 6994471 - DNA, 22 bp, Homo sapiens
ggtgtctgtgatggcatataac

SEQ ID NO: 6994472 - DNA, 22 bp, Homo sapiens
tgacattctgttaagtctcata

SEQ ID NO: 6994473 - DNA, 22 bp, Homo sapiens
caacttggctctctggctatcc

SEQ ID NO: 6994474 - DNA, 22 bp, Homo sapiens
cctgtcagccccacttctgcct

SEQ ID NO: 6994475 - DNA, 22 bp, Homo sapiens
agagtctgaggaggaccaacag

SEQ ID NO: 6994476 - DNA, 19 bp, Homo sapiens
agctgggcttactcactcg

SEQ ID NO: 6994477 - DNA, 22 bp, Homo sapiens
agtaaacatatttgtggtggga

SEQ ID NO: 6994478 - DNA, 22 bp, Homo sapiens
tacattgaaatcaatggatgtg

SEQ ID NO: 6994479 - DNA, 22 bp, Homo sapiens
gtcagctaggcagctgcgatgg

SEQ ID NO: 6994480 - DNA, 18 bp, Homo sapiens
tccgaggcaccataaaaa

SEQ ID NO: 6994481 - DNA, 22 bp, Homo sapiens
aaatgcagtttcctgagaccca

SEQ ID NO: 6994482 - DNA, 22 bp, Homo sapiens
tggcaaaggcgctcacatgcct

SEQ ID NO: 6994483 - DNA, 22 bp, Homo sapiens
ctgtgttctccaggggcagctg

SEQ ID NO: 6994484 - DNA, 22 bp, Homo sapiens
caagagctgtgacctcattcac

SEQ ID NO: 6994485 - DNA, 22 bp, Homo sapiens
ctggcttgcagctcatcataaa

SEQ ID NO: 6994486 - DNA, 22 bp, Homo sapiens
cagccctgagttagcccacgga

SEQ ID NO: 6994487 - DNA, 22 bp, Homo sapiens
attcttcattgttgattcatgt

SEQ ID NO: 6994488 - DNA, 22 bp, Homo sapiens
aatgtggaaattcctttgagga

SEQ ID NO: 6994489 - DNA, 22 bp, Homo sapiens
tgatttttggatctgagctgca

SEQ ID NO: 6994490 - DNA, 22 bp, Homo sapiens
tggctttactgtcattcttatg

SEQ ID NO: 6994491 - DNA, 22 bp, Homo sapiens
catcctctccagcagtggagtg

SEQ ID NO: 6994492 - DNA, 22 bp, Homo sapiens
ctgggaagatggtgacagaatt

SEQ ID NO: 6994493 - DNA, 22 bp, Homo sapiens
ttctacatttgaggagagtcag

SEQ ID NO: 6994494 - DNA, 22 bp, Homo sapiens
tttgtttagagaattgaagcag

SEQ ID NO: 6994495 - DNA, 22 bp, Homo sapiens
ctcacagagctcatactgggag

SEQ ID NO: 6994496 - DNA, 22 bp, Homo sapiens
atctgggggagctgctcatgga

SEQ ID NO: 6994497 - DNA, 22 bp, Homo sapiens
tacaaagcaaatcatctaagag

SEQ ID NO: 6994498 - DNA, 22 bp, Homo sapiens
gagttacagagaggattatggt

SEQ ID NO: 6994499 - DNA, 22 bp, Homo sapiens
tgctggtgaggtccttgctgga

SEQ ID NO: 6994500 - DNA, 22 bp, Homo sapiens
tgtctcttggtgtccagaggag

SEQ ID NO: 6994501 - DNA, 22 bp, Homo sapiens
agtgggcagcccaggaggtctt

SEQ ID NO: 6994502 - DNA, 22 bp, Homo sapiens
atgaatccaaagtttactatta

SEQ ID NO: 6994503 - DNA, 18 bp, Homo sapiens
agcaacaggatcccaggg

SEQ ID NO: 6994504 - DNA, 22 bp, Homo sapiens
aggcagcatgggccccagctcc

SEQ ID NO: 6994505 - DNA, 22 bp, Homo sapiens
tcagtgttggcattcagaaatg

SEQ ID NO: 6994506 - DNA, 22 bp, Homo sapiens
attatatttgaaaggttggaag

SEQ ID NO: 6994507 - DNA, 22 bp, Homo sapiens
agcatgtctaactcttcagggt

SEQ ID NO: 6994508 - DNA, 22 bp, Homo sapiens
tcctccactttgtctagcaaca

SEQ ID NO: 6994509 - DNA, 22 bp, Homo sapiens
ttggctgctatttccatattta

SEQ ID NO: 6994510 - DNA, 22 bp, Homo sapiens
gcatccatcagcagattgactg

SEQ ID NO: 6994511 - DNA, 22 bp, Homo sapiens
atcactgtgtatgtatatgcag

SEQ ID NO: 6994512 - DNA, 19 bp, Homo sapiens
cagcctcaatccctcgggc

SEQ ID NO: 6994513 - DNA, 22 bp, Homo sapiens
ttacagatactttgtaggcaag

SEQ ID NO: 6994514 - DNA, 22 bp, Homo sapiens
tccggcagcagctctgaaggag

SEQ ID NO: 6994515 - DNA, 22 bp, Homo sapiens
acccaggcagcaggagctaaag

SEQ ID NO: 6994516 - DNA, 22 bp, Homo sapiens
tgtaccatgtgactggagtctt

SEQ ID NO: 6994517 - DNA, 22 bp, Homo sapiens
agcctccatcccatgcacaaag

SEQ ID NO: 6994518 - DNA, 22 bp, Homo sapiens
gttgggaagtgtagctccacct

SEQ ID NO: 6994519 - DNA, 22 bp, Homo sapiens
tcctgcagccttgggctggagc

SEQ ID NO: 6994520 - DNA, 22 bp, Homo sapiens
tagtataattgttctggaatca

SEQ ID NO: 6994521 - DNA, 22 bp, Homo sapiens
aaatccatcaaatcttctagaa

SEQ ID NO: 6994522 - DNA, 22 bp, Homo sapiens
gaacctggaatgtggcgcccaa

SEQ ID NO: 6994523 - DNA, 22 bp, Homo sapiens
cagacctcagtcctcagtagga

SEQ ID NO: 6994524 - DNA, 22 bp, Homo sapiens
cactccagtctgggaacaaagc

SEQ ID NO: 6994525 - DNA, 22 bp, Homo sapiens
gtgcagtggcagatcctagctc

SEQ ID NO: 6994526 - DNA, 22 bp, Homo sapiens
ttcaactttatgcatatgtatt

SEQ ID NO: 6994527 - DNA, 22 bp, Homo sapiens
caagatttgggggcacggaatc

SEQ ID NO: 6994528 - DNA, 22 bp, Homo sapiens
caggtgataccctttaacaggc

SEQ ID NO: 6994529 - DNA, 22 bp, Homo sapiens
caaatgcatagtttataagaag

SEQ ID NO: 6994530 - DNA, 22 bp, Homo sapiens
tgaaatgcacatattccataaa

SEQ ID NO: 6994531 - DNA, 22 bp, Homo sapiens
tcaagtatatctagtcattagg

SEQ ID NO: 6994532 - DNA, 22 bp, Homo sapiens
aggtcaaggccaaaagagtggt

SEQ ID NO: 6994533 - DNA, 22 bp, Homo sapiens
catccaggcaccacaaccagct

SEQ ID NO: 6994534 - DNA, 22 bp, Homo sapiens
ctgaggtcaccccactggctgt

SEQ ID NO: 6994535 - DNA, 22 bp, Homo sapiens
atgggcctgttcctatgctggt

SEQ ID NO: 6994536 - DNA, 18 bp, Homo sapiens
agcaagcagttttcatgt

SEQ ID NO: 6994537 - DNA, 22 bp, Homo sapiens
gtcactgtttcctattatattt

SEQ ID NO: 6994538 - DNA, 22 bp, Homo sapiens
agccactgtctgaacttctgtg

SEQ ID NO: 6994539 - DNA, 22 bp, Homo sapiens
cttccagcttgtggcgctttcc

SEQ ID NO: 6994540 - DNA, 22 bp, Homo sapiens
cagagccattatggagacttgc

SEQ ID NO: 6994541 - DNA, 22 bp, Homo sapiens
catctcccacttccttgggggt

SEQ ID NO: 6994542 - DNA, 22 bp, Homo sapiens
gtcagaggaatggatgagtgat

SEQ ID NO: 6994543 - DNA, 22 bp, Homo sapiens
tatagtgcattatttacagtaa

SEQ ID NO: 6994544 - DNA, 20 bp, Homo sapiens
tttgactcaggcctttagcc

SEQ ID NO: 6994545 - DNA, 19 bp, Homo sapiens
tggcagaggacaaggactt

SEQ ID NO: 6994546 - DNA, 22 bp, Homo sapiens
ttgcagagtggttgtgaggatt

SEQ ID NO: 6994547 - DNA, 22 bp, Homo sapiens
atcagagaccggtcaagtcatg

SEQ ID NO: 6994548 - DNA, 22 bp, Homo sapiens
caatccatcaattacacaggct

SEQ ID NO: 6994549 - DNA, 22 bp, Homo sapiens
aggtcctcgtcgtgctgggcca

SEQ ID NO: 6994550 - DNA, 22 bp, Homo sapiens
aaggaaagagtatgcaccttgt

SEQ ID NO: 6994551 - DNA, 22 bp, Homo sapiens
ttagtttccaccacacatgttc

SEQ ID NO: 6994552 - DNA, 22 bp, Homo sapiens
tccaggctggacatgaggcggg

SEQ ID NO: 6994553 - DNA, 22 bp, Homo sapiens
cctgaagagtgaatgtggcagt

SEQ ID NO: 6994554 - DNA, 22 bp, Homo sapiens
gctcagaggaggcctttaccta

SEQ ID NO: 6994555 - DNA, 22 bp, Homo sapiens
gagccaggaagaaggccttact

SEQ ID NO: 6994556 - DNA, 22 bp, Homo sapiens
tgaatgatacagaattatgtag

SEQ ID NO: 6994557 - DNA, 22 bp, Homo sapiens
gatgcctgcatttcaggagagt

SEQ ID NO: 6994558 - DNA, 22 bp, Homo sapiens
caccaggtgctggaggacatca

SEQ ID NO: 6994559 - DNA, 22 bp, Homo sapiens
atggctctcttgacctaggcac

SEQ ID NO: 6994560 - DNA, 22 bp, Homo sapiens
agaaatactgcctaagactgta

SEQ ID NO: 6994561 - DNA, 22 bp, Homo sapiens
atgatacatcttcatgtcagtg

SEQ ID NO: 6994562 - DNA, 22 bp, Homo sapiens
aagtgttttctccccaccaggc

SEQ ID NO: 6994563 - DNA, 22 bp, Homo sapiens
atttatgagctgaaccatgaaa

SEQ ID NO: 6994564 - DNA, 21 bp, Homo sapiens
ccaggcgagtttggactctcc

SEQ ID NO: 6994565 - DNA, 23 bp, Homo sapiens
atctgggcatctggagtggtcct

SEQ ID NO: 6994566 - DNA, 22 bp, Homo sapiens
cagacagggacctcgctccaga

SEQ ID NO: 6994567 - DNA, 22 bp, Homo sapiens
taagatgtttacagtatggaga

SEQ ID NO: 6994568 - DNA, 22 bp, Homo sapiens
cagagctgggcatggtgaaagg

SEQ ID NO: 6994569 - DNA, 22 bp, Homo sapiens
ttttttacagaatcattaatca

SEQ ID NO: 6994570 - DNA, 22 bp, Homo sapiens
agttttctgcctctggatgcgt

SEQ ID NO: 6994571 - DNA, 22 bp, Homo sapiens
atggcttcatcttttagtcctt

SEQ ID NO: 6994572 - DNA, 22 bp, Homo sapiens
aagggccatcccagaacagaaa

SEQ ID NO: 6994573 - DNA, 20 bp, Homo sapiens
ctctcctcacccgtgtcagg

SEQ ID NO: 6994574 - DNA, 22 bp, Homo sapiens
gctgggccagactttcaatgtc

SEQ ID NO: 6994575 - DNA, 22 bp, Homo sapiens
tacataataaggggcatggtgt

SEQ ID NO: 6994576 - DNA, 22 bp, Homo sapiens
gtttagctatgtacagaatgcc

SEQ ID NO: 6994577 - DNA, 22 bp, Homo sapiens
cctagaatgtgcagacttaggg

SEQ ID NO: 6994578 - DNA, 19 bp, Homo sapiens
agagtcggggggacatagg

SEQ ID NO: 6994579 - DNA, 22 bp, Homo sapiens
actgatgagagttagtgctagt

SEQ ID NO: 6994580 - DNA, 22 bp, Homo sapiens
catgaaatattagtaactgttt

SEQ ID NO: 6994581 - DNA, 22 bp, Homo sapiens
agaaagtttatttcttgatgga

SEQ ID NO: 6994582 - DNA, 22 bp, Homo sapiens
agtcttgaaagcacattagagt

SEQ ID NO: 6994583 - DNA, 22 bp, Homo sapiens
ctttctagactgtccagatgat

SEQ ID NO: 6994584 - DNA, 22 bp, Homo sapiens
tatgaagtctctgatgttgagt

SEQ ID NO: 6994585 - DNA, 22 bp, Homo sapiens
atcatctagtttaactttcttt

SEQ ID NO: 6994586 - DNA, 22 bp, Homo sapiens
ctaacttttacagtcatgttgc

SEQ ID NO: 6994587 - DNA, 22 bp, Homo sapiens
gctggctcggatttgaacagga

SEQ ID NO: 6994588 - DNA, 22 bp, Homo sapiens
aagaagcagctgccaggccagt

SEQ ID NO: 6994589 - DNA, 22 bp, Homo sapiens
ttgatggacagggaccactgtc

SEQ ID NO: 6994590 - DNA, 22 bp, Homo sapiens
accacaggggaggaatgatgcc

SEQ ID NO: 6994591 - DNA, 22 bp, Homo sapiens
tttgatactttgtgcaatttct

SEQ ID NO: 6994592 - DNA, 22 bp, Homo sapiens
tcttccagctcatattctatca

SEQ ID NO: 6994593 - DNA, 21 bp, Homo sapiens
agcaggaggcagtcacagctc

SEQ ID NO: 6994594 - DNA, 22 bp, Homo sapiens
actgggcctacccagattggca

SEQ ID NO: 6994595 - DNA, 22 bp, Homo sapiens
gtacatgtgcacaacatgcatg

SEQ ID NO: 6994596 - DNA, 22 bp, Homo sapiens
tagcaagatcgtgtctctaaaa

SEQ ID NO: 6994597 - DNA, 17 bp, Homo sapiens
tgcaaacaatcacatat

SEQ ID NO: 6994598 - DNA, 20 bp, Homo sapiens
gtctttatgttttatgacct

SEQ ID NO: 6994599 - DNA, 22 bp, Homo sapiens
ggggagctcatgatgtctttgt

SEQ ID NO: 6994600 - DNA, 22 bp, Homo sapiens
caggggccggctgtccgtgccc

SEQ ID NO: 6994601 - DNA, 22 bp, Homo sapiens
aatccgattcgtgtacattaat

SEQ ID NO: 6994602 - DNA, 22 bp, Homo sapiens
atgaggcatatcctcctatggt

SEQ ID NO: 6994603 - DNA, 22 bp, Homo sapiens
agtgatgtgaggtgtgagaggg

SEQ ID NO: 6994604 - DNA, 22 bp, Homo sapiens
tgagtctaggacaagttcagga

SEQ ID NO: 6994605 - DNA, 22 bp, Homo sapiens
tctaaattactttgggcagtat

SEQ ID NO: 6994606 - DNA, 22 bp, Homo sapiens
cccctcttgtactagacagttt

SEQ ID NO: 6994607 - DNA, 22 bp, Homo sapiens
agtgcaaaagtaattggagttt

SEQ ID NO: 6994608 - DNA, 22 bp, Homo sapiens
tatttctccaagggggccctct

SEQ ID NO: 6994609 - DNA, 22 bp, Homo sapiens
tccgctggcctgtgtcccaggc

SEQ ID NO: 6994610 - DNA, 22 bp, Homo sapiens
gtgtttatgagtgaccttgtct

SEQ ID NO: 6994611 - DNA, 22 bp, Homo sapiens
actctcagagggtggcagcaat

SEQ ID NO: 6994612 - DNA, 22 bp, Homo sapiens
catgtcaagaaagagatttgaa

SEQ ID NO: 6994613 - DNA, 22 bp, Homo sapiens
tatgatgtttgttcttgttcct

SEQ ID NO: 6994614 - DNA, 22 bp, Homo sapiens
caccattgttgttactgggaga

SEQ ID NO: 6994615 - DNA, 22 bp, Homo sapiens
ctggacagccctcactgtgtgc

SEQ ID NO: 6994616 - DNA, 22 bp, Homo sapiens
aacattgagttctacttccatt

SEQ ID NO: 6994617 - DNA, 22 bp, Homo sapiens
aggtggctcccagtgttgttgt

SEQ ID NO: 6994618 - DNA, 22 bp, Homo sapiens
ggcaggcctgagaggcagggct

SEQ ID NO: 6994619 - DNA, 22 bp, Homo sapiens
gccaatgccttctagaggagtc

SEQ ID NO: 6994620 - DNA, 22 bp, Homo sapiens
ctgttaaaatgtggtcttaaaa

SEQ ID NO: 6994621 - DNA, 20 bp, Homo sapiens
ttagtcagctccttgtgtga

SEQ ID NO: 6994622 - DNA, 22 bp, Homo sapiens
tttggcctgggccagcatatat

SEQ ID NO: 6994623 - DNA, 19 bp, Homo sapiens
ttacacttctgctttgtga

SEQ ID NO: 6994624 - DNA, 22 bp, Homo sapiens
ccagctgtgccgtgtggatagc

SEQ ID NO: 6994625 - DNA, 22 bp, Homo sapiens
caggagcttctgcccatggcca

SEQ ID NO: 6994626 - DNA, 22 bp, Homo sapiens
atggccaagaatatttctcaac

SEQ ID NO: 6994627 - DNA, 22 bp, Homo sapiens
gctcaggaaaacagtctagtaa

SEQ ID NO: 6994628 - DNA, 22 bp, Homo sapiens
cctggtcaggtaactgggctga

SEQ ID NO: 6994629 - DNA, 22 bp, Homo sapiens
gaggggagaaggcactaaccag

SEQ ID NO: 6994630 - DNA, 22 bp, Homo sapiens
gggcaagcacagcgagcgtgcg

SEQ ID NO: 6994631 - DNA, 22 bp, Homo sapiens
tattagaaagcttaatatcgtg

SEQ ID NO: 6994632 - DNA, 22 bp, Homo sapiens
aggcggcttctgaggaggctgc

SEQ ID NO: 6994633 - DNA, 22 bp, Homo sapiens
ctgtttatccctttggtcagca

SEQ ID NO: 6994634 - DNA, 22 bp, Homo sapiens
tcctgcaggcttgagtcctcag

SEQ ID NO: 6994635 - DNA, 22 bp, Homo sapiens
gcaccctagagttgcctgagga

SEQ ID NO: 6994636 - DNA, 22 bp, Homo sapiens
gcagccctcttggtcactaggc

SEQ ID NO: 6994637 - DNA, 21 bp, Homo sapiens
tctgaaggcattttccaaggt

SEQ ID NO: 6994638 - DNA, 22 bp, Homo sapiens
tacatacattacctcatttagt

SEQ ID NO: 6994639 - DNA, 22 bp, Homo sapiens
agcagcagggtgtaattgggca

SEQ ID NO: 6994640 - DNA, 22 bp, Homo sapiens
ctggctttgaaatgcatttcag

SEQ ID NO: 6994641 - DNA, 19 bp, Homo sapiens
gctactgaggcccaggacc

SEQ ID NO: 6994642 - DNA, 22 bp, Homo sapiens
gtaagtctagggcaaggcctga

SEQ ID NO: 6994643 - DNA, 22 bp, Homo sapiens
gatgacatgatggacactcagt

SEQ ID NO: 6994644 - DNA, 22 bp, Homo sapiens
atgttcaaagatcgtgctatcc

SEQ ID NO: 6994645 - DNA, 22 bp, Homo sapiens
gctttaaatggcttgcccaagt

SEQ ID NO: 6994646 - DNA, 22 bp, Homo sapiens
aaccagaagcaactggcggcct

SEQ ID NO: 6994647 - DNA, 22 bp, Homo sapiens
gtaaagctggagaggtctttta

SEQ ID NO: 6994648 - DNA, 22 bp, Homo sapiens
tctacacaagtgagtggcacaa

SEQ ID NO: 6994649 - DNA, 22 bp, Homo sapiens
aagcccttccgtgctgctggat

SEQ ID NO: 6994650 - DNA, 20 bp, Homo sapiens
acttggaactcatttttctt

SEQ ID NO: 6994651 - DNA, 22 bp, Homo sapiens
gtatatgagctctatgtaatgg

SEQ ID NO: 6994652 - DNA, 22 bp, Homo sapiens
ggaggccagggacccagtcagc

SEQ ID NO: 6994653 - DNA, 22 bp, Homo sapiens
gctgaataggcacagagggcat

SEQ ID NO: 6994654 - DNA, 22 bp, Homo sapiens
ctccctgtgctcagagccctgc

SEQ ID NO: 6994655 - DNA, 22 bp, Homo sapiens
tgaatcatgccactgagctccc

SEQ ID NO: 6994656 - DNA, 23 bp, Homo sapiens
tccaggctgggacttcaactggc

SEQ ID NO: 6994657 - DNA, 22 bp, Homo sapiens
atgtgagcagggagatgctgcc

SEQ ID NO: 6994658 - DNA, 22 bp, Homo sapiens
ggtaacttagctcatggctgtg

SEQ ID NO: 6994659 - DNA, 22 bp, Homo sapiens
ttgaggtcttcattcttgggca

SEQ ID NO: 6994660 - DNA, 22 bp, Homo sapiens
agtgttgtcaaacggctcagca

SEQ ID NO: 6994661 - DNA, 22 bp, Homo sapiens
acatgcagtgaggatcttagaa

SEQ ID NO: 6994662 - DNA, 22 bp, Homo sapiens
caaggcagttccccagagggct

SEQ ID NO: 6994663 - DNA, 22 bp, Homo sapiens
gccaccagcagaaaaggggcca

SEQ ID NO: 6994664 - DNA, 22 bp, Homo sapiens
gcccagcagatctcagtgtctc

SEQ ID NO: 6994665 - DNA, 19 bp, Homo sapiens
aagcaagctttgagtgggt

SEQ ID NO: 6994666 - DNA, 22 bp, Homo sapiens
ttgaagctgtgctttttgtagg

SEQ ID NO: 6994667 - DNA, 22 bp, Homo sapiens
tcttatacccctaaactgcagc

SEQ ID NO: 6994668 - DNA, 22 bp, Homo sapiens
ggtctgtctgcctcaggagatg

SEQ ID NO: 6994669 - DNA, 22 bp, Homo sapiens
cctggtgtcatggatgtcacat

SEQ ID NO: 6994670 - DNA, 22 bp, Homo sapiens
tgcagctgaacctagagtctgt

SEQ ID NO: 6994671 - DNA, 20 bp, Homo sapiens
ctctgggctgcaccctcgcc

SEQ ID NO: 6994672 - DNA, 22 bp, Homo sapiens
aagactagaccagtgaatagga

SEQ ID NO: 6994673 - DNA, 22 bp, Homo sapiens
taggacagagctggttacaatg

SEQ ID NO: 6994674 - DNA, 22 bp, Homo sapiens
ttgctctccagaggctcacagc

SEQ ID NO: 6994675 - DNA, 22 bp, Homo sapiens
acagagctaatgttgcataggc

SEQ ID NO: 6994676 - DNA, 22 bp, Homo sapiens
ggatgctgattccagtctccag

SEQ ID NO: 6994677 - DNA, 22 bp, Homo sapiens
ttgatcatctaagagtaatagt

SEQ ID NO: 6994678 - DNA, 22 bp, Homo sapiens
agctctgatgactttacaactt

SEQ ID NO: 6994679 - DNA, 22 bp, Homo sapiens
ggcactattaattttgagagaa

SEQ ID NO: 6994680 - DNA, 22 bp, Homo sapiens
tatgaagaagttctgtgaaatg

SEQ ID NO: 6994681 - DNA, 22 bp, Homo sapiens
atgtgtaaagcttttctttgtt

SEQ ID NO: 6994682 - DNA, 22 bp, Homo sapiens
tctcatttgcctcatctataaa

SEQ ID NO: 6994683 - DNA, 22 bp, Homo sapiens
tgacaaactctttgagaacaag

SEQ ID NO: 6994684 - DNA, 22 bp, Homo sapiens
ctgctgatcgaatcagtcaccc

SEQ ID NO: 6994685 - DNA, 22 bp, Homo sapiens
agtatatggggaattgcataat

SEQ ID NO: 6994686 - DNA, 22 bp, Homo sapiens
agttcatattgaaagcaggtga

SEQ ID NO: 6994687 - DNA, 22 bp, Homo sapiens
gggccctgcgactcgcggcgga

SEQ ID NO: 6994688 - DNA, 22 bp, Homo sapiens
tcagaggacaagctccctggtg

SEQ ID NO: 6994689 - DNA, 22 bp, Homo sapiens
tttcctagttctaagaaatgta

SEQ ID NO: 6994690 - DNA, 22 bp, Homo sapiens
tctgggaacattttgagggcaa

SEQ ID NO: 6994691 - DNA, 22 bp, Homo sapiens
tctcaaatcaaactttgagctt

SEQ ID NO: 6994692 - DNA, 20 bp, Homo sapiens
cttgcagtttcaccttcact

SEQ ID NO: 6994693 - DNA, 22 bp, Homo sapiens
ctagttatagtctcactcatgt

SEQ ID NO: 6994694 - DNA, 22 bp, Homo sapiens
taacttcagcgagttctcttaa

SEQ ID NO: 6994695 - DNA, 22 bp, Homo sapiens
tggcttcaggcagaatttagac

SEQ ID NO: 6994696 - DNA, 22 bp, Homo sapiens
cagctgcaatcagaagctaagg

SEQ ID NO: 6994697 - DNA, 22 bp, Homo sapiens
tagctggcatggccctgtggga

SEQ ID NO: 6994698 - DNA, 22 bp, Homo sapiens
aggaccaacatagcagcagtgg

SEQ ID NO: 6994699 - DNA, 22 bp, Homo sapiens
tggtcctatgttggtgaggtgc

SEQ ID NO: 6994700 - DNA, 22 bp, Homo sapiens
ttgaaagacttctcctgtgaaa

SEQ ID NO: 6994701 - DNA, 22 bp, Homo sapiens
cctctggcaacttcacagccca

SEQ ID NO: 6994702 - DNA, 22 bp, Homo sapiens
tgagaaacttgccaagcatctc

SEQ ID NO: 6994703 - DNA, 22 bp, Homo sapiens
tgctcctgagcggtttccatga

SEQ ID NO: 6994704 - DNA, 22 bp, Homo sapiens
agcagcccaaacagactaagac

SEQ ID NO: 6994705 - DNA, 22 bp, Homo sapiens
tatggctcatggggctagcaag

SEQ ID NO: 6994706 - DNA, 22 bp, Homo sapiens
tacagggtattcaagggtagtt

SEQ ID NO: 6994707 - DNA, 22 bp, Homo sapiens
agaggcatgatcttataattta

SEQ ID NO: 6994708 - DNA, 22 bp, Homo sapiens
tgtgaacagtatgtcatttcac

SEQ ID NO: 6994709 - DNA, 22 bp, Homo sapiens
tgtttataccttggtataacca

SEQ ID NO: 6994710 - DNA, 22 bp, Homo sapiens
gcatgtggccttcaggctggaa

SEQ ID NO: 6994711 - DNA, 22 bp, Homo sapiens
tgagacagtttttctatttcca

SEQ ID NO: 6994712 - DNA, 22 bp, Homo sapiens
tcaggtccttactgtgctccct

SEQ ID NO: 6994713 - DNA, 19 bp, Homo sapiens
gtccaggcattgggttggt

SEQ ID NO: 6994714 - DNA, 22 bp, Homo sapiens
tcagtcaccttgactatagctg

SEQ ID NO: 6994715 - DNA, 22 bp, Homo sapiens
ccaagagcttcccatagcttct

SEQ ID NO: 6994716 - DNA, 22 bp, Homo sapiens
ttgagagttctgaatgagtaac

SEQ ID NO: 6994717 - DNA, 22 bp, Homo sapiens
tctcctgggtaaaagggttgat

SEQ ID NO: 6994718 - DNA, 22 bp, Homo sapiens
aaaggctgacagggtcctaagt

SEQ ID NO: 6994719 - DNA, 22 bp, Homo sapiens
gttgctgaaattaatattggag

SEQ ID NO: 6994720 - DNA, 22 bp, Homo sapiens
gatgtactttaaaatacttcag

SEQ ID NO: 6994721 - DNA, 22 bp, Homo sapiens
cctgcacataggcttttcagaa

SEQ ID NO: 6994722 - DNA, 22 bp, Homo sapiens
tcacctgttggatgtatactgt

SEQ ID NO: 6994723 - DNA, 22 bp, Homo sapiens
tgtgtgcacgtacatactgtat

SEQ ID NO: 6994724 - DNA, 22 bp, Homo sapiens
cagctgttgactggtacatgaa

SEQ ID NO: 6994725 - DNA, 22 bp, Homo sapiens
ttgatatgttaggaagactgat

SEQ ID NO: 6994726 - DNA, 22 bp, Homo sapiens
gagtgggtctcatatatctggc

SEQ ID NO: 6994727 - DNA, 22 bp, Homo sapiens
atggaagaacgctcagggttac

SEQ ID NO: 6994728 - DNA, 22 bp, Homo sapiens
ggctgctggtaggggtaggaag

SEQ ID NO: 6994729 - DNA, 22 bp, Homo sapiens
ccagcagccagagaaggacctc

SEQ ID NO: 6994730 - DNA, 22 bp, Homo sapiens
gttcacaggttctctttctaag

SEQ ID NO: 6994731 - DNA, 22 bp, Homo sapiens
gctgtcctcttggactcagggc

SEQ ID NO: 6994732 - DNA, 22 bp, Homo sapiens
cagttttatacactgcagctcc

SEQ ID NO: 6994733 - DNA, 21 bp, Homo sapiens
ccatacctacctcacctggtt

SEQ ID NO: 6994734 - DNA, 22 bp, Homo sapiens
gccagttttctgaggattaagt

SEQ ID NO: 6994735 - DNA, 18 bp, Homo sapiens
atcaaggaggggaaggtc

SEQ ID NO: 6994736 - DNA, 22 bp, Homo sapiens
accagggccgcgggcgactagc

SEQ ID NO: 6994737 - DNA, 22 bp, Homo sapiens
tgtctccaccatcatcttacca

SEQ ID NO: 6994738 - DNA, 22 bp, Homo sapiens
gatgttaaatgtaaatagctgc

SEQ ID NO: 6994739 - DNA, 22 bp, Homo sapiens
tttgaacagtagcttaggtgtg

SEQ ID NO: 6994740 - DNA, 22 bp, Homo sapiens
agtctattttagctgcatatgt

SEQ ID NO: 6994741 - DNA, 22 bp, Homo sapiens
attgtacaagtttggttattta

SEQ ID NO: 6994742 - DNA, 22 bp, Homo sapiens
ggcggtattttttgaggataga

SEQ ID NO: 6994743 - DNA, 22 bp, Homo sapiens
tcagttttgtatgttgtaagtc

SEQ ID NO: 6994744 - DNA, 22 bp, Homo sapiens
gtcctgtgggagcattgctttg

SEQ ID NO: 6994745 - DNA, 22 bp, Homo sapiens
tgcccagcaataaaccagaaga

SEQ ID NO: 6994746 - DNA, 22 bp, Homo sapiens
tacatctcatctgtgctctccg

SEQ ID NO: 6994747 - DNA, 22 bp, Homo sapiens
ccagctgcatcctattcactgc

SEQ ID NO: 6994748 - DNA, 22 bp, Homo sapiens
ggctagaagtcagaggtcaaga

SEQ ID NO: 6994749 - DNA, 22 bp, Homo sapiens
gggtccagggacgtttctgcag

SEQ ID NO: 6994750 - DNA, 22 bp, Homo sapiens
tgaagctacagaccttcgcggt

SEQ ID NO: 6994751 - DNA, 22 bp, Homo sapiens
actgagcaagtgctgctcacgt

SEQ ID NO: 6994752 - DNA, 22 bp, Homo sapiens
tacatgctccactttctcctgt

SEQ ID NO: 6994753 - DNA, 22 bp, Homo sapiens
tgcatgtttgtgtctgagaact

SEQ ID NO: 6994754 - DNA, 22 bp, Homo sapiens
tttagcaataaagggatattaa

SEQ ID NO: 6994755 - DNA, 22 bp, Homo sapiens
ggtgacacagggaccagagtct

SEQ ID NO: 6994756 - DNA, 22 bp, Homo sapiens
ttgatcttcatttgttctgtat

SEQ ID NO: 6994757 - DNA, 23 bp, Homo sapiens
tggaccctgcacaccagctctac

SEQ ID NO: 6994758 - DNA, 22 bp, Homo sapiens
tagtccacagactctacagcat

SEQ ID NO: 6994759 - DNA, 22 bp, Homo sapiens
acatttagatggtgttatagta

SEQ ID NO: 6994760 - DNA, 22 bp, Homo sapiens
acagtgtatattgtttatctgg

SEQ ID NO: 6994761 - DNA, 22 bp, Homo sapiens
gcagggtcgctctaggagatca

SEQ ID NO: 6994762 - DNA, 22 bp, Homo sapiens
ctttggctgacaggtttctggt

SEQ ID NO: 6994763 - DNA, 22 bp, Homo sapiens
ggcacgtgcctaaggagcaggc

SEQ ID NO: 6994764 - DNA, 22 bp, Homo sapiens
tcaggctctacacttgacacac

SEQ ID NO: 6994765 - DNA, 22 bp, Homo sapiens
acagatttggaggcctcacccc

SEQ ID NO: 6994766 - DNA, 22 bp, Homo sapiens
agagccagcaactctagccctg

SEQ ID NO: 6994767 - DNA, 22 bp, Homo sapiens
atctggctcctacacttgaaga

SEQ ID NO: 6994768 - DNA, 22 bp, Homo sapiens
gaaattcaggacaaagactctt

SEQ ID NO: 6994769 - DNA, 17 bp, Homo sapiens
agcaacttctcccacag

SEQ ID NO: 6994770 - DNA, 22 bp, Homo sapiens
catactttgggataagagtgga

SEQ ID NO: 6994771 - DNA, 22 bp, Homo sapiens
tccacatggctgggaggcctca

SEQ ID NO: 6994772 - DNA, 22 bp, Homo sapiens
tgaggatgacgatggcaatggc

SEQ ID NO: 6994773 - DNA, 23 bp, Homo sapiens
ggtgggagattatccagaattat

SEQ ID NO: 6994774 - DNA, 22 bp, Homo sapiens
ttggaagggatattggcatatg

SEQ ID NO: 6994775 - DNA, 19 bp, Homo sapiens
tgtgagaggctagctgccc

SEQ ID NO: 6994776 - DNA, 15 bp, Homo sapiens
tgctgagtgcccatt

SEQ ID NO: 6994777 - DNA, 22 bp, Homo sapiens
gtgatatcttacaattctcttt

SEQ ID NO: 6994778 - DNA, 22 bp, Homo sapiens
tgggttagattccgcgaagcag

SEQ ID NO: 6994779 - DNA, 22 bp, Homo sapiens
ggtctccagctgggaccctgca

SEQ ID NO: 6994780 - DNA, 22 bp, Homo sapiens
tctttggctgcctgaagcccaa

SEQ ID NO: 6994781 - DNA, 22 bp, Homo sapiens
tttgacagcataatcctacacc

SEQ ID NO: 6994782 - DNA, 22 bp, Homo sapiens
atgcaagggtaaccccagacat

SEQ ID NO: 6994783 - DNA, 22 bp, Homo sapiens
cttaacaaacagtgtggatata

SEQ ID NO: 6994784 - DNA, 22 bp, Homo sapiens
aacaatgcactatcgtaagtgg

SEQ ID NO: 6994785 - DNA, 22 bp, Homo sapiens
gagaggagaagcctgcgcttca

SEQ ID NO: 6994786 - DNA, 19 bp, Homo sapiens
cataaatgtacaagataca

SEQ ID NO: 6994787 - DNA, 22 bp, Homo sapiens
gggtcccagaggcaaaggacta

SEQ ID NO: 6994788 - DNA, 22 bp, Homo sapiens
cttccaggtgctggcctggcct

SEQ ID NO: 6994789 - DNA, 18 bp, Homo sapiens
ctgaggcccagagagggc

SEQ ID NO: 6994790 - DNA, 22 bp, Homo sapiens
aacaaactcaaatggaagagtg

SEQ ID NO: 6994791 - DNA, 22 bp, Homo sapiens
cagaagtggatattagagtaat

SEQ ID NO: 6994792 - DNA, 23 bp, Homo sapiens
gccctgcccttagcacactcaca

SEQ ID NO: 6994793 - DNA, 22 bp, Homo sapiens
aaatgtcagaagctttacttct

SEQ ID NO: 6994794 - DNA, 22 bp, Homo sapiens
acctggtaactctccaggggag

SEQ ID NO: 6994795 - DNA, 22 bp, Homo sapiens
ttggaagaggaaaatgagccta

SEQ ID NO: 6994796 - DNA, 22 bp, Homo sapiens
tggctcagcaagacattgacct

SEQ ID NO: 6994797 - DNA, 22 bp, Homo sapiens
tagatgaaatttgtgtgtatgc

SEQ ID NO: 6994798 - DNA, 22 bp, Homo sapiens
agagggtgagcaggtacacatg

SEQ ID NO: 6994799 - DNA, 22 bp, Homo sapiens
tttggagttcatttaccacttt

SEQ ID NO: 6994800 - DNA, 22 bp, Homo sapiens
taacttggttggtgggcaggag

SEQ ID NO: 6994801 - DNA, 22 bp, Homo sapiens
gcaaagcaagattcagatgtag

SEQ ID NO: 6994802 - DNA, 18 bp, Homo sapiens
taggagataatagagggc

SEQ ID NO: 6994803 - DNA, 22 bp, Homo sapiens
atacatcaatttcttagttatc

SEQ ID NO: 6994804 - DNA, 22 bp, Homo sapiens
tatcattgtgtttgccagtcac

SEQ ID NO: 6994805 - DNA, 22 bp, Homo sapiens
actcaagtagatattaacaaaa

SEQ ID NO: 6994806 - DNA, 22 bp, Homo sapiens
cctgagcaaaggaaggatgact

SEQ ID NO: 6994807 - DNA, 22 bp, Homo sapiens
ccaggcaagtagaagctgtggt

SEQ ID NO: 6994808 - DNA, 22 bp, Homo sapiens
tctcagggttctgtgttataat

SEQ ID NO: 6994809 - DNA, 22 bp, Homo sapiens
aagcacatgaaaatgtgaagct

SEQ ID NO: 6994810 - DNA, 22 bp, Homo sapiens
tggaagcaaaatatcctttaat

SEQ ID NO: 6994811 - DNA, 22 bp, Homo sapiens
aaatggtggctcttttaaattg

SEQ ID NO: 6994812 - DNA, 22 bp, Homo sapiens
gcctctgtcatagctcatgtga

SEQ ID NO: 6994813 - DNA, 22 bp, Homo sapiens
tctgagaatagtgccactgtgg

SEQ ID NO: 6994814 - DNA, 22 bp, Homo sapiens
atgctcagacaccgggcggggg

SEQ ID NO: 6994815 - DNA, 19 bp, Homo sapiens
cctgcctgaccccggctac

SEQ ID NO: 6994816 - DNA, 22 bp, Homo sapiens
tcttccaggccctgccacagct

SEQ ID NO: 6994817 - DNA, 22 bp, Homo sapiens
agtttaactttggaaaactata

SEQ ID NO: 6994818 - DNA, 22 bp, Homo sapiens
agagattgctagctggctttaa

SEQ ID NO: 6994819 - DNA, 22 bp, Homo sapiens
tggtgctgcctcagatgcctta

SEQ ID NO: 6994820 - DNA, 22 bp, Homo sapiens
gaatgacgccctgtggtcactt

SEQ ID NO: 6994821 - DNA, 22 bp, Homo sapiens
tttctcctgtgtaagccgccca

SEQ ID NO: 6994822 - DNA, 22 bp, Homo sapiens
cacatacttgtgtgtacatatg

SEQ ID NO: 6994823 - DNA, 22 bp, Homo sapiens
atggcagtacgttgaaaatttt

SEQ ID NO: 6994824 - DNA, 22 bp, Homo sapiens
agagatgcagggtacatggaat

SEQ ID NO: 6994825 - DNA, 22 bp, Homo sapiens
ctgtggagtttgtggcgctgac

SEQ ID NO: 6994826 - DNA, 22 bp, Homo sapiens
ggtaccaccaattcagctgcca

SEQ ID NO: 6994827 - DNA, 22 bp, Homo sapiens
gcaggcctgtaatgaagggaca

SEQ ID NO: 6994828 - DNA, 22 bp, Homo sapiens
tgggcatcccgcgtctggctgc

SEQ ID NO: 6994829 - DNA, 22 bp, Homo sapiens
ctactgttgtgttttaaaggta

SEQ ID NO: 6994830 - DNA, 22 bp, Homo sapiens
tattgcatcagtaatttagtgt

SEQ ID NO: 6994831 - DNA, 22 bp, Homo sapiens
cagttaaattctccagttacca

SEQ ID NO: 6994832 - DNA, 22 bp, Homo sapiens
ctgcattacaattctgctctat

SEQ ID NO: 6994833 - DNA, 22 bp, Homo sapiens
cagctcgggcctccctctcccg

SEQ ID NO: 6994834 - DNA, 22 bp, Homo sapiens
tgtacacataccactgagtgaa

SEQ ID NO: 6994835 - DNA, 22 bp, Homo sapiens
tcagaggttacccatgggacag

SEQ ID NO: 6994836 - DNA, 17 bp, Homo sapiens
ctcacggaggatgaatc

SEQ ID NO: 6994837 - DNA, 22 bp, Homo sapiens
gcagcatcaatccatgcttctc

SEQ ID NO: 6994838 - DNA, 22 bp, Homo sapiens
ataatggcatgacagttatata

SEQ ID NO: 6994839 - DNA, 22 bp, Homo sapiens
caaggtgaacttgctgtacagc

SEQ ID NO: 6994840 - DNA, 22 bp, Homo sapiens
ttagaagtacatttagaacata

SEQ ID NO: 6994841 - DNA, 22 bp, Homo sapiens
ttatgggctgtcacgtgaatat

SEQ ID NO: 6994842 - DNA, 23 bp, Homo sapiens
cacatggattaaatgagaccaca

SEQ ID NO: 6994843 - DNA, 22 bp, Homo sapiens
acagtaacacctactctgtccc

SEQ ID NO: 6994844 - DNA, 22 bp, Homo sapiens
agagatgaaaagtggagactgg

SEQ ID NO: 6994845 - DNA, 22 bp, Homo sapiens
cactttatatgcattacctcat

SEQ ID NO: 6994846 - DNA, 22 bp, Homo sapiens
tcctcactttgtagccatcctt

SEQ ID NO: 6994847 - DNA, 22 bp, Homo sapiens
agtgtctgggctcccttggagc

SEQ ID NO: 6994848 - DNA, 22 bp, Homo sapiens
actgatggcccaccttggtctc

SEQ ID NO: 6994849 - DNA, 22 bp, Homo sapiens
ttgcttccccctgttctagttc

SEQ ID NO: 6994850 - DNA, 22 bp, Homo sapiens
ctgactctgacaggacttgtgg

SEQ ID NO: 6994851 - DNA, 22 bp, Homo sapiens
tctctgggagcaattgtttgct

SEQ ID NO: 6994852 - DNA, 21 bp, Homo sapiens
aggaggaacccgtggctgggc

SEQ ID NO: 6994853 - DNA, 22 bp, Homo sapiens
caagggcctccaccttgctcgt

SEQ ID NO: 6994854 - DNA, 22 bp, Homo sapiens
ctaatgtatcatggctctcagc

SEQ ID NO: 6994855 - DNA, 22 bp, Homo sapiens
atgtcactccagggacacaggt

SEQ ID NO: 6994856 - DNA, 22 bp, Homo sapiens
ctagttgaagaggctgtcatca

SEQ ID NO: 6994857 - DNA, 22 bp, Homo sapiens
cagtacttttcaaccagtatga

SEQ ID NO: 6994858 - DNA, 22 bp, Homo sapiens
caagggctcaaacggtggttgc

SEQ ID NO: 6994859 - DNA, 22 bp, Homo sapiens
gacttttgaataaggtaggata

SEQ ID NO: 6994860 - DNA, 22 bp, Homo sapiens
acaattagctgtgtgtctatct

SEQ ID NO: 6994861 - DNA, 22 bp, Homo sapiens
agctggaattacaggcacgcac

SEQ ID NO: 6994862 - DNA, 23 bp, Homo sapiens
tgtatctgtactattcctgcctc

SEQ ID NO: 6994863 - DNA, 22 bp, Homo sapiens
agccatcctccacagccttgat

SEQ ID NO: 6994864 - DNA, 22 bp, Homo sapiens
ccactctgattggtcacctctg

SEQ ID NO: 6994865 - DNA, 22 bp, Homo sapiens
gcaaatgttctatatttgctgt

SEQ ID NO: 6994866 - DNA, 22 bp, Homo sapiens
atgccaaagcccaagttcatca

SEQ ID NO: 6994867 - DNA, 17 bp, Homo sapiens
gagacagcaggagcccc

SEQ ID NO: 6994868 - DNA, 22 bp, Homo sapiens
caagaccaatttgaattaacca

SEQ ID NO: 6994869 - DNA, 22 bp, Homo sapiens
acactgtgtggtctctctcgga

SEQ ID NO: 6994870 - DNA, 22 bp, Homo sapiens
aatttgcatgatgagaacaata

SEQ ID NO: 6994871 - DNA, 22 bp, Homo sapiens
ggcctcagaggaggtgtgagtc

SEQ ID NO: 6994872 - DNA, 22 bp, Homo sapiens
ctgctgaggtggagattgcagt

SEQ ID NO: 6994873 - DNA, 16 bp, Homo sapiens
tcttggagttgttcct

SEQ ID NO: 6994874 - DNA, 22 bp, Homo sapiens
acagcagctaacccctgggcca

SEQ ID NO: 6994875 - DNA, 22 bp, Homo sapiens
agacacattttacattaactgt

SEQ ID NO: 6994876 - DNA, 22 bp, Homo sapiens
agccagtgacatacgattggga

SEQ ID NO: 6994877 - DNA, 19 bp, Homo sapiens
tcagggggctgataggagg

SEQ ID NO: 6994878 - DNA, 22 bp, Homo sapiens
atcaacttgtccttgatgttaa

SEQ ID NO: 6994879 - DNA, 22 bp, Homo sapiens
gttctgaatgtgcctgtactct

SEQ ID NO: 6994880 - DNA, 22 bp, Homo sapiens
attgagctgttttgtaggataa

SEQ ID NO: 6994881 - DNA, 22 bp, Homo sapiens
agtaaaattgtattggaaaaca

SEQ ID NO: 6994882 - DNA, 22 bp, Homo sapiens
tctggtcatcggaaagatcaaa

SEQ ID NO: 6994883 - DNA, 22 bp, Homo sapiens
cggggcctcgtcactctttgcg

SEQ ID NO: 6994884 - DNA, 22 bp, Homo sapiens
cacaatttttcttaggtcctgg

SEQ ID NO: 6994885 - DNA, 22 bp, Homo sapiens
atcagttttgggggacatactg

SEQ ID NO: 6994886 - DNA, 22 bp, Homo sapiens
ccacaggaccagaggagatcac

SEQ ID NO: 6994887 - DNA, 22 bp, Homo sapiens
tgcatgatggtttagatggggt

SEQ ID NO: 6994888 - DNA, 22 bp, Homo sapiens
acagcagccttgttggtttcga

SEQ ID NO: 6994889 - DNA, 22 bp, Homo sapiens
tctatactgatgggatactatt

SEQ ID NO: 6994890 - DNA, 22 bp, Homo sapiens
tcccactcccaggcaggcctct

SEQ ID NO: 6994891 - DNA, 22 bp, Homo sapiens
tccttgaaaatcttggtttaga

SEQ ID NO: 6994892 - DNA, 22 bp, Homo sapiens
tggctagtaggtgagtagtgct

SEQ ID NO: 6994893 - DNA, 22 bp, Homo sapiens
ggagggcccctccagtgggcag

SEQ ID NO: 6994894 - DNA, 22 bp, Homo sapiens
aggcgctgtgcttggggctgga

SEQ ID NO: 6994895 - DNA, 22 bp, Homo sapiens
tatgtgctaaacaccttccata

SEQ ID NO: 6994896 - DNA, 22 bp, Homo sapiens
tcactgcaacctccgcctcccg

SEQ ID NO: 6994897 - DNA, 16 bp, Homo sapiens
tcattgctcatgggtc

SEQ ID NO: 6994898 - DNA, 22 bp, Homo sapiens
ttatagcagcatgatttatagt

SEQ ID NO: 6994899 - DNA, 22 bp, Homo sapiens
agctgcaattaaagactgtgaa

SEQ ID NO: 6994900 - DNA, 22 bp, Homo sapiens
ccgctaggcctccggtcgcgca

SEQ ID NO: 6994901 - DNA, 22 bp, Homo sapiens
accagggcacattccggccaga

SEQ ID NO: 6994902 - DNA, 22 bp, Homo sapiens
ataaaatctttatgtgctctgc

SEQ ID NO: 6994903 - DNA, 21 bp, Homo sapiens
aggaagaaaggttggaggttg

SEQ ID NO: 6994904 - DNA, 19 bp, Homo sapiens
ttctagaactgttctctca

SEQ ID NO: 6994905 - DNA, 21 bp, Homo sapiens
gctcaagtttctctggcaaca

SEQ ID NO: 6994906 - DNA, 22 bp, Homo sapiens
atgctgggaagtcctaaccaca

SEQ ID NO: 6994907 - DNA, 22 bp, Homo sapiens
tggaggtacataatgagagggt

SEQ ID NO: 6994908 - DNA, 22 bp, Homo sapiens
attagggtaaggcttttcttag

SEQ ID NO: 6994909 - DNA, 20 bp, Homo sapiens
atatttcttaagaactttca

SEQ ID NO: 6994910 - DNA, 23 bp, Homo sapiens
ttaaacttcagtgcagaacactc

SEQ ID NO: 6994911 - DNA, 22 bp, Homo sapiens
tcatgcttttatgatatttact

SEQ ID NO: 6994912 - DNA, 22 bp, Homo sapiens
tcccagccattcctttaggtgt

SEQ ID NO: 6994913 - DNA, 23 bp, Homo sapiens
atggtcagaattttccagctgag

SEQ ID NO: 6994914 - DNA, 22 bp, Homo sapiens
tggtatttcctcattctgcttt

SEQ ID NO: 6994915 - DNA, 22 bp, Homo sapiens
acagtactgctgttcttgtcct

SEQ ID NO: 6994916 - DNA, 22 bp, Homo sapiens
tggcccgaagatccgagggtca

SEQ ID NO: 6994917 - DNA, 22 bp, Homo sapiens
ctaagggcacagccaatcatca

SEQ ID NO: 6994918 - DNA, 19 bp, Homo sapiens
tctgacacttacacacccc

SEQ ID NO: 6994919 - DNA, 22 bp, Homo sapiens
cttgaggtatgaaacctgcatt

SEQ ID NO: 6994920 - DNA, 22 bp, Homo sapiens
tccaagagttcaaggctacagt

SEQ ID NO: 6994921 - DNA, 22 bp, Homo sapiens
cctggccagaggcgtgcctgtg

SEQ ID NO: 6994922 - DNA, 20 bp, Homo sapiens
tgcacacaccctgtcctcca

SEQ ID NO: 6994923 - DNA, 22 bp, Homo sapiens
aagtgtgagccagccctttgca

SEQ ID NO: 6994924 - DNA, 22 bp, Homo sapiens
tggacccaggcaggtctgtcct

SEQ ID NO: 6994925 - DNA, 18 bp, Homo sapiens
tctctctgaagagttccc

SEQ ID NO: 6994926 - DNA, 22 bp, Homo sapiens
tcagggccgccggggatctcgc

SEQ ID NO: 6994927 - DNA, 23 bp, Homo sapiens
tggagctgggatttgatttgatt

SEQ ID NO: 6994928 - DNA, 22 bp, Homo sapiens
agtcctgatgctctggcaggag

SEQ ID NO: 6994929 - DNA, 22 bp, Homo sapiens
tgtcttttacctaatgagctgg

SEQ ID NO: 6994930 - DNA, 22 bp, Homo sapiens
ctgaatgaatggtttgtcttat

SEQ ID NO: 6994931 - DNA, 21 bp, Homo sapiens
cattgtcgacattttcccctc

SEQ ID NO: 6994932 - DNA, 22 bp, Homo sapiens
tcatgcataatggtgacaacct

SEQ ID NO: 6994933 - DNA, 22 bp, Homo sapiens
tttgtcctaacagtggtaaagg

SEQ ID NO: 6994934 - DNA, 22 bp, Homo sapiens
agccccagtccgctgcgggcgg

SEQ ID NO: 6994935 - DNA, 22 bp, Homo sapiens
actgtggggtgcgaggcagtga

SEQ ID NO: 6994936 - DNA, 22 bp, Homo sapiens
gggcagttgatggaggtctgga

SEQ ID NO: 6994937 - DNA, 22 bp, Homo sapiens
tggccacatctgaaatgagtgt

SEQ ID NO: 6994938 - DNA, 22 bp, Homo sapiens
ttgttgttataggtggtacaag

SEQ ID NO: 6994939 - DNA, 22 bp, Homo sapiens
tcctgagttgcatagtgaagat

SEQ ID NO: 6994940 - DNA, 22 bp, Homo sapiens
tgtttcaaaggttatacagtca

SEQ ID NO: 6994941 - DNA, 22 bp, Homo sapiens
gttcacatccttgtgaggattt

SEQ ID NO: 6994942 - DNA, 22 bp, Homo sapiens
tggagatgggttaatggagaga

SEQ ID NO: 6994943 - DNA, 22 bp, Homo sapiens
tagatatgtagtttttacagta

SEQ ID NO: 6994944 - DNA, 23 bp, Homo sapiens
agggtccagggatcaccaggtgt

SEQ ID NO: 6994945 - DNA, 22 bp, Homo sapiens
aaagcttaaggtaggtacagag

SEQ ID NO: 6994946 - DNA, 22 bp, Homo sapiens
actgtactccagctctgggtga

SEQ ID NO: 6994947 - DNA, 22 bp, Homo sapiens
tgtggttttggttcagaaacaa

SEQ ID NO: 6994948 - DNA, 22 bp, Homo sapiens
cttcatgagactccactgccat

SEQ ID NO: 6994949 - DNA, 22 bp, Homo sapiens
ccctgggattcaatttcactct

SEQ ID NO: 6994950 - DNA, 22 bp, Homo sapiens
gtgtccagatgaggagacgatg

SEQ ID NO: 6994951 - DNA, 22 bp, Homo sapiens
atcttacagcagcaaggaagta

SEQ ID NO: 6994952 - DNA, 22 bp, Homo sapiens
tagggatggaaactaggaatct

SEQ ID NO: 6994953 - DNA, 22 bp, Homo sapiens
agctatctcaggcactcacatt

SEQ ID NO: 6994954 - DNA, 22 bp, Homo sapiens
atgaggtccagggaagttaaat

SEQ ID NO: 6994955 - DNA, 22 bp, Homo sapiens
gggctaagtgaagattgctcca

SEQ ID NO: 6994956 - DNA, 23 bp, Homo sapiens
atactgaaactgttgtttatctg

SEQ ID NO: 6994957 - DNA, 22 bp, Homo sapiens
tgttcctctgaacttcttccaa

SEQ ID NO: 6994958 - DNA, 22 bp, Homo sapiens
ctctagctcccagggagcgtct

SEQ ID NO: 6994959 - DNA, 22 bp, Homo sapiens
agcagctgcagagggctccccc

SEQ ID NO: 6994960 - DNA, 22 bp, Homo sapiens
atctgacttcacgcccatgcca

SEQ ID NO: 6994961 - DNA, 22 bp, Homo sapiens
caacttattaagaatgggcctg

SEQ ID NO: 6994962 - DNA, 22 bp, Homo sapiens
tatggtaataatatgaaggtct

SEQ ID NO: 6994963 - DNA, 22 bp, Homo sapiens
tccatgtggccagacactggca

SEQ ID NO: 6994964 - DNA, 18 bp, Homo sapiens
gaggaaacaggctctgtg

SEQ ID NO: 6994965 - DNA, 19 bp, Homo sapiens
cagctcagtttgattctct

SEQ ID NO: 6994966 - DNA, 22 bp, Homo sapiens
agtaatgaagatttgttgcaca

SEQ ID NO: 6994967 - DNA, 22 bp, Homo sapiens
gaagtattatagcatattagcc

SEQ ID NO: 6994968 - DNA, 22 bp, Homo sapiens
gtccaagagtcaagaagggggc

SEQ ID NO: 6994969 - DNA, 22 bp, Homo sapiens
gaacctgcttccttttatatta

SEQ ID NO: 6994970 - DNA, 22 bp, Homo sapiens
acccagagatgtcaatggcttt

SEQ ID NO: 6994971 - DNA, 22 bp, Homo sapiens
tgtccccaggtcctctgccgtc

SEQ ID NO: 6994972 - DNA, 22 bp, Homo sapiens
ggtgtgacctcagtctgggtaa

SEQ ID NO: 6994973 - DNA, 22 bp, Homo sapiens
aaccagctgagaatgcttctgc

SEQ ID NO: 6994974 - DNA, 22 bp, Homo sapiens
agtttgtgcaatggtgtcacct

SEQ ID NO: 6994975 - DNA, 22 bp, Homo sapiens
cctggttcagtctttctatgct

SEQ ID NO: 6994976 - DNA, 22 bp, Homo sapiens
ttttataaagagagtcagttgg

SEQ ID NO: 6994977 - DNA, 22 bp, Homo sapiens
tccctgaggaaggggtgtggtg

SEQ ID NO: 6994978 - DNA, 22 bp, Homo sapiens
acagaagcagccgtcacagata

SEQ ID NO: 6994979 - DNA, 22 bp, Homo sapiens
ttaacacttgaactctacatgt

SEQ ID NO: 6994980 - DNA, 22 bp, Homo sapiens
ttcatggatgttggtagaaaac

SEQ ID NO: 6994981 - DNA, 22 bp, Homo sapiens
tgccatggagtgggtcaactat

SEQ ID NO: 6994982 - DNA, 21 bp, Homo sapiens
tataacacacttcagcttctc

SEQ ID NO: 6994983 - DNA, 22 bp, Homo sapiens
tcagttctggctgctgctgtca

SEQ ID NO: 6994984 - DNA, 22 bp, Homo sapiens
caggccttgggagagggtagat

SEQ ID NO: 6994985 - DNA, 22 bp, Homo sapiens
catcaattggccaaggagcagt

SEQ ID NO: 6994986 - DNA, 22 bp, Homo sapiens
atcagagcactgagcaggacac

SEQ ID NO: 6994987 - DNA, 22 bp, Homo sapiens
cttgtgcatcatagtttgccaa

SEQ ID NO: 6994988 - DNA, 22 bp, Homo sapiens
tttgtattccatatcatgccat

SEQ ID NO: 6994989 - DNA, 22 bp, Homo sapiens
ggccttggaaagatacccagct

SEQ ID NO: 6994990 - DNA, 22 bp, Homo sapiens
gcttttatttcttcacaaaagt

SEQ ID NO: 6994991 - DNA, 19 bp, Homo sapiens
cgcagagggcttctgagag

SEQ ID NO: 6994992 - DNA, 17 bp, Homo sapiens
gtcctggtgtgtgagga

SEQ ID NO: 6994993 - DNA, 22 bp, Homo sapiens
atttgacattgacacacctatg

SEQ ID NO: 6994994 - DNA, 22 bp, Homo sapiens
tctccttgtgctgggtccttcc

SEQ ID NO: 6994995 - DNA, 22 bp, Homo sapiens
tctttggattaaaatatttgta

SEQ ID NO: 6994996 - DNA, 22 bp, Homo sapiens
atctccaggttgtgcctgcgtc

SEQ ID NO: 6994997 - DNA, 22 bp, Homo sapiens
gctgggctgcccaacctctgac

SEQ ID NO: 6994998 - DNA, 19 bp, Homo sapiens
gcgctttattgattgcaag

SEQ ID NO: 6994999 - DNA, 22 bp, Homo sapiens
tctctgctctgtgcctcagttt

SEQ ID NO: 6995000 - DNA, 22 bp, Homo sapiens
gaagcagctagcccactagtca

SEQ ID NO: 6995001 - DNA, 22 bp, Homo sapiens
gtccacttctgacttgttcaga

SEQ ID NO: 6995002 - DNA, 22 bp, Homo sapiens
gtctgtgggccaaatacagccc

SEQ ID NO: 6995003 - DNA, 21 bp, Homo sapiens
tccaaaaaggagcgtccttct

SEQ ID NO: 6995004 - DNA, 22 bp, Homo sapiens
gtccctggagctgagcagtgct

SEQ ID NO: 6995005 - DNA, 22 bp, Homo sapiens
gaatctcaggggagttactgga

SEQ ID NO: 6995006 - DNA, 22 bp, Homo sapiens
ttcctaatgtctactttagttc

SEQ ID NO: 6995007 - DNA, 22 bp, Homo sapiens
agagtttgtagtggtgaatgta

SEQ ID NO: 6995008 - DNA, 22 bp, Homo sapiens
gttttctcaggatggtgtgtac

SEQ ID NO: 6995009 - DNA, 22 bp, Homo sapiens
tttattctataggcattaagca

SEQ ID NO: 6995010 - DNA, 22 bp, Homo sapiens
acctgctagaagcaaatgtctg

SEQ ID NO: 6995011 - DNA, 22 bp, Homo sapiens
ggctggcaggcacagtatgcaa

SEQ ID NO: 6995012 - DNA, 22 bp, Homo sapiens
agaaagaacgcacttgtgctgc

SEQ ID NO: 6995013 - DNA, 19 bp, Homo sapiens
gcacacgttgtgcttgagc

SEQ ID NO: 6995014 - DNA, 22 bp, Homo sapiens
agtgcagaggctgggaaatgct

SEQ ID NO: 6995015 - DNA, 22 bp, Homo sapiens
aactttagaaaggaaggaagtg

SEQ ID NO: 6995016 - DNA, 22 bp, Homo sapiens
acccaccacagtggctggcaca

SEQ ID NO: 6995017 - DNA, 21 bp, Homo sapiens
tgagataaatttccttactac

SEQ ID NO: 6995018 - DNA, 22 bp, Homo sapiens
tatgaaccgagaatgtcaggga

SEQ ID NO: 6995019 - DNA, 22 bp, Homo sapiens
gggcttctacttgcaaaggata

SEQ ID NO: 6995020 - DNA, 23 bp, Homo sapiens
ttctttgtggataatctccagtg

SEQ ID NO: 6995021 - DNA, 22 bp, Homo sapiens
ccaggcaaaacagatttgtatg

SEQ ID NO: 6995022 - DNA, 22 bp, Homo sapiens
cttctccctgggggctctttat

SEQ ID NO: 6995023 - DNA, 22 bp, Homo sapiens
acagaatagagactgcctgctc

SEQ ID NO: 6995024 - DNA, 22 bp, Homo sapiens
tacagccttcatctttgccttg

SEQ ID NO: 6995025 - DNA, 22 bp, Homo sapiens
ttcagaacaaccatggttagat

SEQ ID NO: 6995026 - DNA, 22 bp, Homo sapiens
gtctgggtctccacagtcagca

SEQ ID NO: 6995027 - DNA, 22 bp, Homo sapiens
cagatatatattcatcaggctg

SEQ ID NO: 6995028 - DNA, 22 bp, Homo sapiens
tgcctggaccccacctccggaa

SEQ ID NO: 6995029 - DNA, 22 bp, Homo sapiens
catgacccatttttcttgctgt

SEQ ID NO: 6995030 - DNA, 22 bp, Homo sapiens
tcacacagggttctggtctcat

SEQ ID NO: 6995031 - DNA, 22 bp, Homo sapiens
tgagaatgccataagagctatt

SEQ ID NO: 6995032 - DNA, 22 bp, Homo sapiens
ttcagagtcagggatctcagag

SEQ ID NO: 6995033 - DNA, 22 bp, Homo sapiens
acagtccttgtttcggtcagat

SEQ ID NO: 6995034 - DNA, 22 bp, Homo sapiens
cccaggaaatgggctcttgcct

SEQ ID NO: 6995035 - DNA, 22 bp, Homo sapiens
aaggctctgcaaaacctccaag

SEQ ID NO: 6995036 - DNA, 23 bp, Homo sapiens
tggtaaattgtttggcaagtctg

SEQ ID NO: 6995037 - DNA, 22 bp, Homo sapiens
ggagtgaagtggcgcgatctcg

SEQ ID NO: 6995038 - DNA, 22 bp, Homo sapiens
agtgtatggaattagctccctt

SEQ ID NO: 6995039 - DNA, 22 bp, Homo sapiens
tggcacagtatgggattaaaga

SEQ ID NO: 6995040 - DNA, 22 bp, Homo sapiens
gcggtatttgtgtgggtgtcga

SEQ ID NO: 6995041 - DNA, 22 bp, Homo sapiens
agagtctgaatgctcagagttg

SEQ ID NO: 6995042 - DNA, 22 bp, Homo sapiens
tggctcctggcaggtgtttcaa

SEQ ID NO: 6995043 - DNA, 22 bp, Homo sapiens
agcaattattgtataagaacaa

SEQ ID NO: 6995044 - DNA, 22 bp, Homo sapiens
ctctgggccaccgctggtgtat

SEQ ID NO: 6995045 - DNA, 22 bp, Homo sapiens
ttgtacaacacatattctacag

SEQ ID NO: 6995046 - DNA, 21 bp, Homo sapiens
aaatacagatgcaaatctgtt

SEQ ID NO: 6995047 - DNA, 22 bp, Homo sapiens
agaaggcactcacactggcacg

SEQ ID NO: 6995048 - DNA, 22 bp, Homo sapiens
ctgtacagcaagttcaccttgg

SEQ ID NO: 6995049 - DNA, 19 bp, Homo sapiens
tcataaggagagaggaaat

SEQ ID NO: 6995050 - DNA, 22 bp, Homo sapiens
tgaccttcgagctgcgggttgt

SEQ ID NO: 6995051 - DNA, 22 bp, Homo sapiens
tgtaatgggctactaggaagag

SEQ ID NO: 6995052 - DNA, 22 bp, Homo sapiens
aagaatcatcctgcaagagtct

SEQ ID NO: 6995053 - DNA, 21 bp, Homo sapiens
aggagccatgtggtctgatgg

SEQ ID NO: 6995054 - DNA, 22 bp, Homo sapiens
ggcgtggcagtcaggaaaaggt

SEQ ID NO: 6995055 - DNA, 22 bp, Homo sapiens
ggctatatcctcacaagatgga

SEQ ID NO: 6995056 - DNA, 22 bp, Homo sapiens
agtgtcctagcaagccggtcct

SEQ ID NO: 6995057 - DNA, 22 bp, Homo sapiens
ggctcagcacagggctggcatc

SEQ ID NO: 6995058 - DNA, 22 bp, Homo sapiens
tccttaaagttggggtgctgca

SEQ ID NO: 6995059 - DNA, 22 bp, Homo sapiens
gttcaaccatgattaggaactg

SEQ ID NO: 6995060 - DNA, 22 bp, Homo sapiens
ccctgccttgttggagcctatg

SEQ ID NO: 6995061 - DNA, 22 bp, Homo sapiens
ctgaagactgctgagaagttac

SEQ ID NO: 6995062 - DNA, 22 bp, Homo sapiens
acctacatagttaagtaacaaa

SEQ ID NO: 6995063 - DNA, 22 bp, Homo sapiens
cacagaggagtgcacactctct

SEQ ID NO: 6995064 - DNA, 22 bp, Homo sapiens
gcgtggggcagcccagggcttc

SEQ ID NO: 6995065 - DNA, 22 bp, Homo sapiens
actttatgtgcttgctctttcc

SEQ ID NO: 6995066 - DNA, 22 bp, Homo sapiens
agtgaagcccatttttagctgt

SEQ ID NO: 6995067 - DNA, 22 bp, Homo sapiens
gttattctcttggcctaattat

SEQ ID NO: 6995068 - DNA, 22 bp, Homo sapiens
gcctgtgcctcagcctgcagcc

SEQ ID NO: 6995069 - DNA, 22 bp, Homo sapiens
gcattgatgccaaccagattct

SEQ ID NO: 6995070 - DNA, 22 bp, Homo sapiens
aagtgctcccatatcctgccct

SEQ ID NO: 6995071 - DNA, 22 bp, Homo sapiens
cagatttacctaactccaagtt

SEQ ID NO: 6995072 - DNA, 22 bp, Homo sapiens
cctctgggtgacagactcttgg

SEQ ID NO: 6995073 - DNA, 22 bp, Homo sapiens
aagttccttgaatgaagctagg

SEQ ID NO: 6995074 - DNA, 22 bp, Homo sapiens
gcttggagtagaatgcattctt

SEQ ID NO: 6995075 - DNA, 22 bp, Homo sapiens
ttaagcacctatgttgtgccag

SEQ ID NO: 6995076 - DNA, 22 bp, Homo sapiens
ctctgacattctgtgactctga

SEQ ID NO: 6995077 - DNA, 22 bp, Homo sapiens
atcttcctttgccatgggatag

SEQ ID NO: 6995078 - DNA, 22 bp, Homo sapiens
tttctcaactgtattatgcaga

SEQ ID NO: 6995079 - DNA, 23 bp, Homo sapiens
aggaccaggttcccaaaagtcaa

SEQ ID NO: 6995080 - DNA, 22 bp, Homo sapiens
cctggatcagtcactgttgctg

SEQ ID NO: 6995081 - DNA, 18 bp, Homo sapiens
gctttctgtagaaaaggg

SEQ ID NO: 6995082 - DNA, 22 bp, Homo sapiens
tctcaggctcctgacatatatg

SEQ ID NO: 6995083 - DNA, 22 bp, Homo sapiens
ttgatgtaaaagccttggtggc

SEQ ID NO: 6995084 - DNA, 22 bp, Homo sapiens
gtgctctagaaatagtcagtgg

SEQ ID NO: 6995085 - DNA, 22 bp, Homo sapiens
tcactgtaccttccatttcatt

SEQ ID NO: 6995086 - DNA, 22 bp, Homo sapiens
cagagcagtagaaaacagcctt

SEQ ID NO: 6995087 - DNA, 20 bp, Homo sapiens
gctgtctgacagttcccaga

SEQ ID NO: 6995088 - DNA, 22 bp, Homo sapiens
ttccaggctatccggtgaaggg

SEQ ID NO: 6995089 - DNA, 22 bp, Homo sapiens
gtcatccaacaagaggctcttg

SEQ ID NO: 6995090 - DNA, 22 bp, Homo sapiens
ttgttaagggttatgcagcttt

SEQ ID NO: 6995091 - DNA, 22 bp, Homo sapiens
taaagccaatatacctagcata

SEQ ID NO: 6995092 - DNA, 23 bp, Homo sapiens
aaatggactattcggcatggaga

SEQ ID NO: 6995093 - DNA, 22 bp, Homo sapiens
acaacatttccatttccttggt

SEQ ID NO: 6995094 - DNA, 21 bp, Homo sapiens
gctgtgcaggattgaaagcag

SEQ ID NO: 6995095 - DNA, 20 bp, Homo sapiens
cagcttgctttgggacattt

SEQ ID NO: 6995096 - DNA, 22 bp, Homo sapiens
gcatggcaaatatcgagggcag

SEQ ID NO: 6995097 - DNA, 22 bp, Homo sapiens
gcattcatgcctgtgtgagctc

SEQ ID NO: 6995098 - DNA, 22 bp, Homo sapiens
gctttgcattcttgtgtgatca

SEQ ID NO: 6995099 - DNA, 22 bp, Homo sapiens
cctcatgagttcttctgcccat

SEQ ID NO: 6995100 - DNA, 22 bp, Homo sapiens
agtgacaaggtggtaatgaagc

SEQ ID NO: 6995101 - DNA, 22 bp, Homo sapiens
gttcttcaaagtgacaactaaa

SEQ ID NO: 6995102 - DNA, 22 bp, Homo sapiens
ctgacccttaatgagcaagtaa

SEQ ID NO: 6995103 - DNA, 22 bp, Homo sapiens
gaccacagaagccttgataggg

SEQ ID NO: 6995104 - DNA, 22 bp, Homo sapiens
cagaatcagcccttgctattaa

SEQ ID NO: 6995105 - DNA, 22 bp, Homo sapiens
cccagcaggtgccatcactctg

SEQ ID NO: 6995106 - DNA, 22 bp, Homo sapiens
aggctgcgttagcctcactccc

SEQ ID NO: 6995107 - DNA, 22 bp, Homo sapiens
aaggcatcatggctggctattt

SEQ ID NO: 6995108 - DNA, 22 bp, Homo sapiens
tgaagttagaactatgaggata

SEQ ID NO: 6995109 - DNA, 22 bp, Homo sapiens
aaggagattgttaaagctatat

SEQ ID NO: 6995110 - DNA, 18 bp, Homo sapiens
actgaagatgcaagacct

SEQ ID NO: 6995111 - DNA, 21 bp, Homo sapiens
tctgttggaggcctctcttcc

SEQ ID NO: 6995112 - DNA, 22 bp, Homo sapiens
ttggcagcaagaggctcttctg

SEQ ID NO: 6995113 - DNA, 22 bp, Homo sapiens
ctgcgtgagcgtgcccgtcttg

SEQ ID NO: 6995114 - DNA, 20 bp, Homo sapiens
cactttggacctgatgtatc

SEQ ID NO: 6995115 - DNA, 21 bp, Homo sapiens
agaatcatttttcccttctct

SEQ ID NO: 6995116 - DNA, 22 bp, Homo sapiens
gcatttcatgtaagtcagacca

SEQ ID NO: 6995117 - DNA, 22 bp, Homo sapiens
accaaaaagatatgttgaagcc

SEQ ID NO: 6995118 - DNA, 22 bp, Homo sapiens
cagagtatatatctcattttta

SEQ ID NO: 6995119 - DNA, 22 bp, Homo sapiens
ggagttgattttggatatatta

SEQ ID NO: 6995120 - DNA, 19 bp, Homo sapiens
actctgaggctgagacaag

SEQ ID NO: 6995121 - DNA, 22 bp, Homo sapiens
caggcagcctgcggtctgcaca

SEQ ID NO: 6995122 - DNA, 22 bp, Homo sapiens
gataacattataagttcactgt

SEQ ID NO: 6995123 - DNA, 22 bp, Homo sapiens
gatccttcagttcgatggggat

SEQ ID NO: 6995124 - DNA, 22 bp, Homo sapiens
cactggtagagagaagacaagg

SEQ ID NO: 6995125 - DNA, 22 bp, Homo sapiens
ggctggacgatctccccttcct

SEQ ID NO: 6995126 - DNA, 22 bp, Homo sapiens
tggtgggcacagtgcccaggct

SEQ ID NO: 6995127 - DNA, 22 bp, Homo sapiens
tctgggaaatgggcagcttcgc

SEQ ID NO: 6995128 - DNA, 22 bp, Homo sapiens
cagatgtacatgaagggcaatg

SEQ ID NO: 6995129 - DNA, 22 bp, Homo sapiens
ggcactgggtgagggtcactgg

SEQ ID NO: 6995130 - DNA, 22 bp, Homo sapiens
tctcttggaggttcttcctgtt

SEQ ID NO: 6995131 - DNA, 22 bp, Homo sapiens
tgactttgtgcaagtgaattat

SEQ ID NO: 6995132 - DNA, 22 bp, Homo sapiens
ggcagaaggcaattagagactg

SEQ ID NO: 6995133 - DNA, 22 bp, Homo sapiens
cagtctttgatgcatcctagcc

SEQ ID NO: 6995134 - DNA, 20 bp, Homo sapiens
tggaggcctgcaggtttggg

SEQ ID NO: 6995135 - DNA, 22 bp, Homo sapiens
ttttcattgttactatgagcta

SEQ ID NO: 6995136 - DNA, 22 bp, Homo sapiens
tgtgaaatgtggatgttaatag

SEQ ID NO: 6995137 - DNA, 22 bp, Homo sapiens
tgtggccaggaaaaggagatgg

SEQ ID NO: 6995138 - DNA, 22 bp, Homo sapiens
gaggctaagtaactgtccatgg

SEQ ID NO: 6995139 - DNA, 22 bp, Homo sapiens
tgctgaggtcatttccaagtga

SEQ ID NO: 6995140 - DNA, 18 bp, Homo sapiens
tgtccatgttgttcctga

SEQ ID NO: 6995141 - DNA, 22 bp, Homo sapiens
ttcttgaaaatagccatgtaca

SEQ ID NO: 6995142 - DNA, 22 bp, Homo sapiens
ttggggctcaggccgccgatgc

SEQ ID NO: 6995143 - DNA, 22 bp, Homo sapiens
aaaggccttttccccacttctt

SEQ ID NO: 6995144 - DNA, 22 bp, Homo sapiens
cttcccaccaaagcccttgttg

SEQ ID NO: 6995145 - DNA, 22 bp, Homo sapiens
aaagttttagctgtccagttcc

SEQ ID NO: 6995146 - DNA, 21 bp, Homo sapiens
agaggtcattgggctggttct

SEQ ID NO: 6995147 - DNA, 22 bp, Homo sapiens
aagttctaggtagtgctctttc

SEQ ID NO: 6995148 - DNA, 22 bp, Homo sapiens
tatgaaatgatggggaaaatag

SEQ ID NO: 6995149 - DNA, 22 bp, Homo sapiens
aaatgtaagtctttgtttctta

SEQ ID NO: 6995150 - DNA, 22 bp, Homo sapiens
gctgttctttcagcccagggct

SEQ ID NO: 6995151 - DNA, 22 bp, Homo sapiens
gcctttatccctgtacaaggtg

SEQ ID NO: 6995152 - DNA, 22 bp, Homo sapiens
ttgggacagagctggggctgga

SEQ ID NO: 6995153 - DNA, 22 bp, Homo sapiens
ttctgaaggctcctcaggaaag

SEQ ID NO: 6995154 - DNA, 22 bp, Homo sapiens
agtactttcttccgagagagaa

SEQ ID NO: 6995155 - DNA, 22 bp, Homo sapiens
acctagagtagtcaaattcata

SEQ ID NO: 6995156 - DNA, 22 bp, Homo sapiens
aatgtgaggccttggtagttat

SEQ ID NO: 6995157 - DNA, 22 bp, Homo sapiens
aaatgtctttgagtatttctgc

SEQ ID NO: 6995158 - DNA, 18 bp, Homo sapiens
tctgctattagaattgcc

SEQ ID NO: 6995159 - DNA, 22 bp, Homo sapiens
catgcactttgatggagagcgt

SEQ ID NO: 6995160 - DNA, 22 bp, Homo sapiens
tcatttttcacacagggtcacc

SEQ ID NO: 6995161 - DNA, 22 bp, Homo sapiens
aggtctacagcctgtgacactt

SEQ ID NO: 6995162 - DNA, 22 bp, Homo sapiens
ccctcatgtcagtccctgccca

SEQ ID NO: 6995163 - DNA, 22 bp, Homo sapiens
ggggacctgggcttcaagggtt

SEQ ID NO: 6995164 - DNA, 22 bp, Homo sapiens
ggtataaatgatcagatcgctg

SEQ ID NO: 6995165 - DNA, 22 bp, Homo sapiens
cctgtactagggtctcattgcc

SEQ ID NO: 6995166 - DNA, 22 bp, Homo sapiens
aactgtaagacaaatgacttct

SEQ ID NO: 6995167 - DNA, 22 bp, Homo sapiens
gtctggctgataaaatgctctt

SEQ ID NO: 6995168 - DNA, 22 bp, Homo sapiens
aaaatcctgctgactcgagatg

SEQ ID NO: 6995169 - DNA, 22 bp, Homo sapiens
atggtcaggcaaggagggctgg

SEQ ID NO: 6995170 - DNA, 22 bp, Homo sapiens
ggctcaggttaccagtccctcc

SEQ ID NO: 6995171 - DNA, 22 bp, Homo sapiens
tgctagccaagcccatcccttt

SEQ ID NO: 6995172 - DNA, 22 bp, Homo sapiens
acactagctattaacttcacat

SEQ ID NO: 6995173 - DNA, 22 bp, Homo sapiens
cagtgagggaagatctcagcac

SEQ ID NO: 6995174 - DNA, 22 bp, Homo sapiens
tcctgccttcatactgctgtat

SEQ ID NO: 6995175 - DNA, 22 bp, Homo sapiens
ggtgtcagaatttcctttttta

SEQ ID NO: 6995176 - DNA, 23 bp, Homo sapiens
atgtaaacttcagagtcattgcc

SEQ ID NO: 6995177 - DNA, 22 bp, Homo sapiens
agagggtcaaccaggagcgtca

SEQ ID NO: 6995178 - DNA, 22 bp, Homo sapiens
aactgtgtccttagctctcact

SEQ ID NO: 6995179 - DNA, 21 bp, Homo sapiens
ttcaacaaagggaataagttt

SEQ ID NO: 6995180 - DNA, 22 bp, Homo sapiens
caattagctggtactgacagga

SEQ ID NO: 6995181 - DNA, 22 bp, Homo sapiens
gacatgtattagtacatatggt

SEQ ID NO: 6995182 - DNA, 23 bp, Homo sapiens
ttcagctctgtgtatcctgcctc

SEQ ID NO: 6995183 - DNA, 20 bp, Homo sapiens
acctcctggcgggcatcctc

SEQ ID NO: 6995184 - DNA, 22 bp, Homo sapiens
gaattacaaagtgagacaagct

SEQ ID NO: 6995185 - DNA, 22 bp, Homo sapiens
cctcagagtaggtctcagctgt

SEQ ID NO: 6995186 - DNA, 20 bp, Homo sapiens
gcccaagcgccggccgcaga

SEQ ID NO: 6995187 - DNA, 22 bp, Homo sapiens
tgcaggtggacacgggagacgg

SEQ ID NO: 6995188 - DNA, 22 bp, Homo sapiens
aaggggcacaattgtacccaag

SEQ ID NO: 6995189 - DNA, 22 bp, Homo sapiens
atctgtaaataaaaagggaggt

SEQ ID NO: 6995190 - DNA, 22 bp, Homo sapiens
ctttggaactgtaaggagatgg

SEQ ID NO: 6995191 - DNA, 22 bp, Homo sapiens
gcttttgtgagctctcactttg

SEQ ID NO: 6995192 - DNA, 22 bp, Homo sapiens
cctggccaggctccaagtactg

SEQ ID NO: 6995193 - DNA, 22 bp, Homo sapiens
ggaccatgttccctctgaagct

SEQ ID NO: 6995194 - DNA, 22 bp, Homo sapiens
gagggtgggctttgttcctcca

SEQ ID NO: 6995195 - DNA, 22 bp, Homo sapiens
cttctcctctgagtcctgggag

SEQ ID NO: 6995196 - DNA, 22 bp, Homo sapiens
ttccaaagtcatgttgctgata

SEQ ID NO: 6995197 - DNA, 22 bp, Homo sapiens
gaaggctggggccttctcatct

SEQ ID NO: 6995198 - DNA, 22 bp, Homo sapiens
agggactggctctctgagcagg

SEQ ID NO: 6995199 - DNA, 22 bp, Homo sapiens
attggaaatacagtagaaaaat

SEQ ID NO: 6995200 - DNA, 19 bp, Homo sapiens
ctgaaacacagagagggct

SEQ ID NO: 6995201 - DNA, 22 bp, Homo sapiens
acaatgtctttgtctccttcag

SEQ ID NO: 6995202 - DNA, 22 bp, Homo sapiens
cagcacaggaatatggtggaca

SEQ ID NO: 6995203 - DNA, 22 bp, Homo sapiens
aacaatgatatagggattggca

SEQ ID NO: 6995204 - DNA, 22 bp, Homo sapiens
tgaggagcagggtggcttactc

SEQ ID NO: 6995205 - DNA, 22 bp, Homo sapiens
acattcctttcttgagcacagt

SEQ ID NO: 6995206 - DNA, 22 bp, Homo sapiens
ttgaatttagattgtatgttga

SEQ ID NO: 6995207 - DNA, 22 bp, Homo sapiens
tgtcagcaattctggcttactc

SEQ ID NO: 6995208 - DNA, 22 bp, Homo sapiens
cagctgcaggaacaaaaatgtg

SEQ ID NO: 6995209 - DNA, 22 bp, Homo sapiens
cccaggaggcctgcctggccgg

SEQ ID NO: 6995210 - DNA, 22 bp, Homo sapiens
atttcccagggccctcatagtt

SEQ ID NO: 6995211 - DNA, 22 bp, Homo sapiens
ggacagcacagctcttgacaac

SEQ ID NO: 6995212 - DNA, 22 bp, Homo sapiens
gagatggaatctgtgtggaggg

SEQ ID NO: 6995213 - DNA, 22 bp, Homo sapiens
acagggcagagtgaaatgctat

SEQ ID NO: 6995214 - DNA, 22 bp, Homo sapiens
tttagcttcatttggcgtgatt

SEQ ID NO: 6995215 - DNA, 22 bp, Homo sapiens
tgctggggcagaagagccaaga

SEQ ID NO: 6995216 - DNA, 22 bp, Homo sapiens
tgtttgtggaatattctttaag

SEQ ID NO: 6995217 - DNA, 22 bp, Homo sapiens
aacttgaactgatgagtgttag

SEQ ID NO: 6995218 - DNA, 22 bp, Homo sapiens
atggctctagaatacccctcag

SEQ ID NO: 6995219 - DNA, 22 bp, Homo sapiens
atgcccagaaccccctggatgg

SEQ ID NO: 6995220 - DNA, 19 bp, Homo sapiens
ggctctggcggctgtagcc

SEQ ID NO: 6995221 - DNA, 23 bp, Homo sapiens
aaagactctccagagggaagtag

SEQ ID NO: 6995222 - DNA, 22 bp, Homo sapiens
ctcacttagcaggttaatatca

SEQ ID NO: 6995223 - DNA, 22 bp, Homo sapiens
actctccagggatttaggatgg

SEQ ID NO: 6995224 - DNA, 21 bp, Homo sapiens
gtggagagtgattttgatgca

SEQ ID NO: 6995225 - DNA, 22 bp, Homo sapiens
ttaaggaaggtgaatttcttgg

SEQ ID NO: 6995226 - DNA, 22 bp, Homo sapiens
aatgtgtgcctgttaaggggca

SEQ ID NO: 6995227 - DNA, 22 bp, Homo sapiens
tcagcatgtacttctcctccat

SEQ ID NO: 6995228 - DNA, 22 bp, Homo sapiens
tcgtgatctgtccacctcggcc

SEQ ID NO: 6995229 - DNA, 22 bp, Homo sapiens
ctgaggcacccatcttctcctg

SEQ ID NO: 6995230 - DNA, 20 bp, Homo sapiens
attcctcagccccagcctca

SEQ ID NO: 6995231 - DNA, 22 bp, Homo sapiens
atagaatctttgtaaaacactt

SEQ ID NO: 6995232 - DNA, 19 bp, Homo sapiens
ctgggccagagctgtcctc

SEQ ID NO: 6995233 - DNA, 22 bp, Homo sapiens
ttagttaattgactatgttgca

SEQ ID NO: 6995234 - DNA, 22 bp, Homo sapiens
taggctatagcttccagttgtt

SEQ ID NO: 6995235 - DNA, 22 bp, Homo sapiens
gagccaaatgtgcagacattgt

SEQ ID NO: 6995236 - DNA, 22 bp, Homo sapiens
aaacacggagtgggaatccctg

SEQ ID NO: 6995237 - DNA, 22 bp, Homo sapiens
attctactgcttggaatatctt

SEQ ID NO: 6995238 - DNA, 22 bp, Homo sapiens
tcctgtgttaaagggggtgcta

SEQ ID NO: 6995239 - DNA, 17 bp, Homo sapiens
agactctgtcccatgta

SEQ ID NO: 6995240 - DNA, 22 bp, Homo sapiens
aattgcttcattaacatttagg

SEQ ID NO: 6995241 - DNA, 19 bp, Homo sapiens
gtctgtgtatttgttgctg

SEQ ID NO: 6995242 - DNA, 17 bp, Homo sapiens
acggaacagagggtgcc

SEQ ID NO: 6995243 - DNA, 20 bp, Homo sapiens
ttctctttgggtccagagaa

SEQ ID NO: 6995244 - DNA, 22 bp, Homo sapiens
tgcagcaccgtcccactggcta

SEQ ID NO: 6995245 - DNA, 22 bp, Homo sapiens
acttcttttcaaatcatgcaaa

SEQ ID NO: 6995246 - DNA, 22 bp, Homo sapiens
cagagtgaacagtgggatgtgc

SEQ ID NO: 6995247 - DNA, 22 bp, Homo sapiens
tgaatatgtatttcttatttac

SEQ ID NO: 6995248 - DNA, 19 bp, Homo sapiens
aggcacaattctgagaagc

SEQ ID NO: 6995249 - DNA, 22 bp, Homo sapiens
gaagttagtcattgaagcccca

SEQ ID NO: 6995250 - DNA, 22 bp, Homo sapiens
agagttgctgttggagcagtga

SEQ ID NO: 6995251 - DNA, 22 bp, Homo sapiens
gcacatatgtaaatagctgcct

SEQ ID NO: 6995252 - DNA, 22 bp, Homo sapiens
ttacacagtatccaaggttctt

SEQ ID NO: 6995253 - DNA, 22 bp, Homo sapiens
tcaggctgtaaatggtgtgggt

SEQ ID NO: 6995254 - DNA, 22 bp, Homo sapiens
tgggccacgtcatctcccacaa

SEQ ID NO: 6995255 - DNA, 22 bp, Homo sapiens
tggaaatgtatttgggcatgcc

SEQ ID NO: 6995256 - DNA, 22 bp, Homo sapiens
agagttggcccacgtgtaggcg

SEQ ID NO: 6995257 - DNA, 18 bp, Homo sapiens
ctcaggcctttccctgtg

SEQ ID NO: 6995258 - DNA, 22 bp, Homo sapiens
tagcagagtgattggccatgag

SEQ ID NO: 6995259 - DNA, 22 bp, Homo sapiens
aacacagacatagtgattacag

SEQ ID NO: 6995260 - DNA, 22 bp, Homo sapiens
taggatggtacaaggcaggggt

SEQ ID NO: 6995261 - DNA, 22 bp, Homo sapiens
tcctggctgttagagaggcaag

SEQ ID NO: 6995262 - DNA, 22 bp, Homo sapiens
tttaaagaaattcctcatcttt

SEQ ID NO: 6995263 - DNA, 22 bp, Homo sapiens
attggttaagacgcatcatgct

SEQ ID NO: 6995264 - DNA, 22 bp, Homo sapiens
gaatttaaatttaaatctacca

SEQ ID NO: 6995265 - DNA, 22 bp, Homo sapiens
aatgaagccagctgggatgcga

SEQ ID NO: 6995266 - DNA, 22 bp, Homo sapiens
aaatgctatttgggaacaacat

SEQ ID NO: 6995267 - DNA, 22 bp, Homo sapiens
aggggctcaaagtgtgcaggga

SEQ ID NO: 6995268 - DNA, 22 bp, Homo sapiens
tgttcacttatgttctcccatt

SEQ ID NO: 6995269 - DNA, 22 bp, Homo sapiens
aatgtctgctctactcaggagg

SEQ ID NO: 6995270 - DNA, 22 bp, Homo sapiens
acttcctagatacgagattgaa

SEQ ID NO: 6995271 - DNA, 22 bp, Homo sapiens
tattgatgaaagggattttgga

SEQ ID NO: 6995272 - DNA, 22 bp, Homo sapiens
accagagttttattagttctaa

SEQ ID NO: 6995273 - DNA, 22 bp, Homo sapiens
aagtctcttagtaatatccaac

SEQ ID NO: 6995274 - DNA, 22 bp, Homo sapiens
cgaggtgggcagatcacagagt

SEQ ID NO: 6995275 - DNA, 22 bp, Homo sapiens
tgtgtatgtgtatacactatat

SEQ ID NO: 6995276 - DNA, 22 bp, Homo sapiens
cattgtcctgtgggctccctgg

SEQ ID NO: 6995277 - DNA, 22 bp, Homo sapiens
agatgctgctccacaggccagg

SEQ ID NO: 6995278 - DNA, 22 bp, Homo sapiens
tccaggcaaagggactagcagg

SEQ ID NO: 6995279 - DNA, 22 bp, Homo sapiens
acagtttactggccttgccgtt

SEQ ID NO: 6995280 - DNA, 22 bp, Homo sapiens
gtgctttgtcttcaggatcata

SEQ ID NO: 6995281 - DNA, 22 bp, Homo sapiens
atgtccagaagggtcccctgtt

SEQ ID NO: 6995282 - DNA, 22 bp, Homo sapiens
atgcatataaggcacatgtatt

SEQ ID NO: 6995283 - DNA, 22 bp, Homo sapiens
tggcacaggagcactgccctgg

SEQ ID NO: 6995284 - DNA, 22 bp, Homo sapiens
ctgccctgagtcatgccagatg

SEQ ID NO: 6995285 - DNA, 22 bp, Homo sapiens
aagtttagtagggacagatgga

SEQ ID NO: 6995286 - DNA, 22 bp, Homo sapiens
gcctcaggccgccctgctgctc

SEQ ID NO: 6995287 - DNA, 22 bp, Homo sapiens
acagaggtcatggagagttctc

SEQ ID NO: 6995288 - DNA, 22 bp, Homo sapiens
tggatctgtttgttcaagggcc

SEQ ID NO: 6995289 - DNA, 20 bp, Homo sapiens
atgtaaaattataaggctga

SEQ ID NO: 6995290 - DNA, 22 bp, Homo sapiens
tgtgtgttagtctcaaagccgt

SEQ ID NO: 6995291 - DNA, 16 bp, Homo sapiens
aaatggcttaggctta

SEQ ID NO: 6995292 - DNA, 23 bp, Homo sapiens
taggtagaagttattttcttctc

SEQ ID NO: 6995293 - DNA, 22 bp, Homo sapiens
cctggaggggaccaggaccagg

SEQ ID NO: 6995294 - DNA, 22 bp, Homo sapiens
atgacaggtatgccttataatc

SEQ ID NO: 6995295 - DNA, 22 bp, Homo sapiens
gcggaggacaggaatgcgggcg

SEQ ID NO: 6995296 - DNA, 22 bp, Homo sapiens
atggcccaggccaggatccagc

SEQ ID NO: 6995297 - DNA, 22 bp, Homo sapiens
tttccacacaggctctactact

SEQ ID NO: 6995298 - DNA, 22 bp, Homo sapiens
cctggagggaccctggccctgt

SEQ ID NO: 6995299 - DNA, 20 bp, Homo sapiens
acagaaagagagaatgtcag

SEQ ID NO: 6995300 - DNA, 22 bp, Homo sapiens
atggatgaaggcgaggatgagg

SEQ ID NO: 6995301 - DNA, 22 bp, Homo sapiens
gcagagcagggattttgccata

SEQ ID NO: 6995302 - DNA, 19 bp, Homo sapiens
tgctgaggatgcaagatcc

SEQ ID NO: 6995303 - DNA, 22 bp, Homo sapiens
tcaggctgctgtactgtgaatg

SEQ ID NO: 6995304 - DNA, 22 bp, Homo sapiens
gaatcagaaccactggagggtt

SEQ ID NO: 6995305 - DNA, 22 bp, Homo sapiens
gatgatgagataaggataactt

SEQ ID NO: 6995306 - DNA, 22 bp, Homo sapiens
tggcagataaaataatagggaa

SEQ ID NO: 6995307 - DNA, 22 bp, Homo sapiens
tggtaccagctgtgtgttcact

SEQ ID NO: 6995308 - DNA, 22 bp, Homo sapiens
ttctgtctgatggtgccagaac

SEQ ID NO: 6995309 - DNA, 22 bp, Homo sapiens
ttgatattcccgatttaaggta

SEQ ID NO: 6995310 - DNA, 22 bp, Homo sapiens
atgaagctgtttattttagcag

SEQ ID NO: 6995311 - DNA, 22 bp, Homo sapiens
actgcacttacatagaggaggc

SEQ ID NO: 6995312 - DNA, 22 bp, Homo sapiens
tgtctcctaatgtctgtttcct

SEQ ID NO: 6995313 - DNA, 23 bp, Homo sapiens
ccagtgtggctctgtccgctctc

SEQ ID NO: 6995314 - DNA, 19 bp, Homo sapiens
aacagtgaggcccagcctg

SEQ ID NO: 6995315 - DNA, 22 bp, Homo sapiens
gtcccacaccttgaggggtctt

SEQ ID NO: 6995316 - DNA, 22 bp, Homo sapiens
ctggagagggagccctggcagt

SEQ ID NO: 6995317 - DNA, 22 bp, Homo sapiens
ctgggcctgtgggcacacggac

SEQ ID NO: 6995318 - DNA, 22 bp, Homo sapiens
gggctggaggtgagcaggacag

SEQ ID NO: 6995319 - DNA, 22 bp, Homo sapiens
ttccagtttgcagttgacacta

SEQ ID NO: 6995320 - DNA, 22 bp, Homo sapiens
tactgaaatactaagaagttaa

SEQ ID NO: 6995321 - DNA, 22 bp, Homo sapiens
tgttccagaggcagagatagga

SEQ ID NO: 6995322 - DNA, 22 bp, Homo sapiens
attagtgtgtaggctggaaaaa

SEQ ID NO: 6995323 - DNA, 22 bp, Homo sapiens
tgctgaataaataaagtctatt

SEQ ID NO: 6995324 - DNA, 22 bp, Homo sapiens
ccaggacaattcgtcactttct

SEQ ID NO: 6995325 - DNA, 20 bp, Homo sapiens
aagtatatgtccgtgtactt

SEQ ID NO: 6995326 - DNA, 22 bp, Homo sapiens
aatcataattttgtgaatgtag

SEQ ID NO: 6995327 - DNA, 22 bp, Homo sapiens
tggtccatgtcctccatctctc

SEQ ID NO: 6995328 - DNA, 22 bp, Homo sapiens
aggcccttggagtagaggctga

SEQ ID NO: 6995329 - DNA, 22 bp, Homo sapiens
tcagtgctgtgtaaatgtatta

SEQ ID NO: 6995330 - DNA, 21 bp, Homo sapiens
aggggcccttgccaggacgcc

SEQ ID NO: 6995331 - DNA, 22 bp, Homo sapiens
agctttggagactgactccatc

SEQ ID NO: 6995332 - DNA, 22 bp, Homo sapiens
tggctcagaggggaagtggttt

SEQ ID NO: 6995333 - DNA, 23 bp, Homo sapiens
gggagaatatgaggatgatggtg

SEQ ID NO: 6995334 - DNA, 22 bp, Homo sapiens
ttaatcttatattgttgggacc

SEQ ID NO: 6995335 - DNA, 22 bp, Homo sapiens
cccagggaagggctacctgagg

SEQ ID NO: 6995336 - DNA, 22 bp, Homo sapiens
ctgaggctgggctgagggtata

SEQ ID NO: 6995337 - DNA, 22 bp, Homo sapiens
gagcgggaggaacggctcgggc

SEQ ID NO: 6995338 - DNA, 22 bp, Homo sapiens
aacagagctggtgactccaggt

SEQ ID NO: 6995339 - DNA, 22 bp, Homo sapiens
tgaaatatgctcccattcactt

SEQ ID NO: 6995340 - DNA, 22 bp, Homo sapiens
gctgtgggacaggtccagccag

SEQ ID NO: 6995341 - DNA, 22 bp, Homo sapiens
gccccagcgtggctgtgttagg

SEQ ID NO: 6995342 - DNA, 16 bp, Homo sapiens
taatggccaagaattt

SEQ ID NO: 6995343 - DNA, 22 bp, Homo sapiens
agaaagggtcactgaaagagga

SEQ ID NO: 6995344 - DNA, 22 bp, Homo sapiens
gtgtcaatgaggtttatttttg

SEQ ID NO: 6995345 - DNA, 23 bp, Homo sapiens
tggaaagcggacctggggcagag

SEQ ID NO: 6995346 - DNA, 21 bp, Homo sapiens
ccctgcaggccagggctgagc

SEQ ID NO: 6995347 - DNA, 22 bp, Homo sapiens
aaagtcattggaatattaatga

SEQ ID NO: 6995348 - DNA, 22 bp, Homo sapiens
acggtgcagcctgtcccttctc

SEQ ID NO: 6995349 - DNA, 22 bp, Homo sapiens
gcttggtttggcaaaggaagga

SEQ ID NO: 6995350 - DNA, 22 bp, Homo sapiens
gagaagggatatgccactctcg

SEQ ID NO: 6995351 - DNA, 22 bp, Homo sapiens
tatttgtttctagtggcagcaa

SEQ ID NO: 6995352 - DNA, 22 bp, Homo sapiens
tcagttacctgacagtggttat

SEQ ID NO: 6995353 - DNA, 22 bp, Homo sapiens
tgggatgtctttaggggaagag

SEQ ID NO: 6995354 - DNA, 22 bp, Homo sapiens
tacttatgatattgtagacact

SEQ ID NO: 6995355 - DNA, 22 bp, Homo sapiens
cagaaatggaagttctggttta

SEQ ID NO: 6995356 - DNA, 22 bp, Homo sapiens
tctcagtctttttggttactca

SEQ ID NO: 6995357 - DNA, 22 bp, Homo sapiens
aggtagttttgacttcatggct

SEQ ID NO: 6995358 - DNA, 22 bp, Homo sapiens
ctgaccctttagggtatgttta

SEQ ID NO: 6995359 - DNA, 23 bp, Homo sapiens
ttgtctgtgcttttccagttgct

SEQ ID NO: 6995360 - DNA, 22 bp, Homo sapiens
aggcaagagtgactacgtgaaa

SEQ ID NO: 6995361 - DNA, 22 bp, Homo sapiens
caagcagagaggtcaactaata

SEQ ID NO: 6995362 - DNA, 22 bp, Homo sapiens
ttcctctctcttgccagaatgt

SEQ ID NO: 6995363 - DNA, 22 bp, Homo sapiens
ctggtgaatggataaactgttg

SEQ ID NO: 6995364 - DNA, 22 bp, Homo sapiens
agtgacaggaccaggtctggaa

SEQ ID NO: 6995365 - DNA, 22 bp, Homo sapiens
gagtggccagtggtggcatgtc

SEQ ID NO: 6995366 - DNA, 22 bp, Homo sapiens
attgatatcagtttgctgattg

SEQ ID NO: 6995367 - DNA, 22 bp, Homo sapiens
acctgcaggggtgctctctggg

SEQ ID NO: 6995368 - DNA, 22 bp, Homo sapiens
acagatggccatattactatat

SEQ ID NO: 6995369 - DNA, 22 bp, Homo sapiens
gaggaatgtcagcacaggcctc

SEQ ID NO: 6995370 - DNA, 22 bp, Homo sapiens
cagagtccccagcggcgcgggc

SEQ ID NO: 6995371 - DNA, 21 bp, Homo sapiens
aggatgccgcaggcggagaag

SEQ ID NO: 6995372 - DNA, 22 bp, Homo sapiens
gaggtggcattaagattctggt

SEQ ID NO: 6995373 - DNA, 22 bp, Homo sapiens
acagtgttcactaaggttagct

SEQ ID NO: 6995374 - DNA, 22 bp, Homo sapiens
tttctccccagtctaatctgga

SEQ ID NO: 6995375 - DNA, 22 bp, Homo sapiens
ctggagccagccagggccctct

SEQ ID NO: 6995376 - DNA, 22 bp, Homo sapiens
acaggccttggtcctgacctaa

SEQ ID NO: 6995377 - DNA, 22 bp, Homo sapiens
tcaaactgaattaaacacttgt

SEQ ID NO: 6995378 - DNA, 22 bp, Homo sapiens
cctccctgggtgctgggattgc

SEQ ID NO: 6995379 - DNA, 22 bp, Homo sapiens
agcacaaatataaaaatgtctg

SEQ ID NO: 6995380 - DNA, 22 bp, Homo sapiens
gcgtgggtccaagaatctgtga

SEQ ID NO: 6995381 - DNA, 22 bp, Homo sapiens
aatccacacatctggcatgtga

SEQ ID NO: 6995382 - DNA, 22 bp, Homo sapiens
acattgacttggatgggtagca

SEQ ID NO: 6995383 - DNA, 22 bp, Homo sapiens
ccctgaaagtacactgggacgg

SEQ ID NO: 6995384 - DNA, 22 bp, Homo sapiens
tgcacgtgggctctctgctctt

SEQ ID NO: 6995385 - DNA, 20 bp, Homo sapiens
tcagccttgaatgcttgaaa

SEQ ID NO: 6995386 - DNA, 17 bp, Homo sapiens
agagctcttcactgtga

SEQ ID NO: 6995387 - DNA, 22 bp, Homo sapiens
gataacatggttagtgttttta

SEQ ID NO: 6995388 - DNA, 22 bp, Homo sapiens
tatgacctctcctattgcctta

SEQ ID NO: 6995389 - DNA, 23 bp, Homo sapiens
tggccacagtccatgcatgccca

SEQ ID NO: 6995390 - DNA, 19 bp, Homo sapiens
tggggtcaagagaggcttc

SEQ ID NO: 6995391 - DNA, 22 bp, Homo sapiens
tgagcaggactcactgcagcct

SEQ ID NO: 6995392 - DNA, 22 bp, Homo sapiens
cccacagtgatcgcattcgtac

SEQ ID NO: 6995393 - DNA, 22 bp, Homo sapiens
tgtgacagaaagtggatgggac

SEQ ID NO: 6995394 - DNA, 22 bp, Homo sapiens
aggctatgatattattgagaca

SEQ ID NO: 6995395 - DNA, 22 bp, Homo sapiens
tgtgggaggtctggaaggctcc

SEQ ID NO: 6995396 - DNA, 22 bp, Homo sapiens
tggaaaattagtagtgaaaggc

SEQ ID NO: 6995397 - DNA, 19 bp, Homo sapiens
acccagcccaggagtggca

SEQ ID NO: 6995398 - DNA, 22 bp, Homo sapiens
tgctggaggggatgccttcact

SEQ ID NO: 6995399 - DNA, 22 bp, Homo sapiens
acatgcactctcactgtgctct

SEQ ID NO: 6995400 - DNA, 22 bp, Homo sapiens
aaagcacagagctcccacagga

SEQ ID NO: 6995401 - DNA, 22 bp, Homo sapiens
tggctttaagaagactgacagc

SEQ ID NO: 6995402 - DNA, 22 bp, Homo sapiens
tcacaaatgtctcctgtcctgt

SEQ ID NO: 6995403 - DNA, 22 bp, Homo sapiens
tccaccagttcaccttgtagca

SEQ ID NO: 6995404 - DNA, 22 bp, Homo sapiens
ccagggttgcagggagccagca

SEQ ID NO: 6995405 - DNA, 22 bp, Homo sapiens
tcctgcacagcctaagtagaaa

SEQ ID NO: 6995406 - DNA, 22 bp, Homo sapiens
tctcctctgtgccacagcttgg

SEQ ID NO: 6995407 - DNA, 22 bp, Homo sapiens
accttgaaggcagaggacacct

SEQ ID NO: 6995408 - DNA, 17 bp, Homo sapiens
ccagtcacaccaccctt

SEQ ID NO: 6995409 - DNA, 22 bp, Homo sapiens
aggcagcagactgttaatcaga

SEQ ID NO: 6995410 - DNA, 20 bp, Homo sapiens
aggctgagggtgattgtgtc

SEQ ID NO: 6995411 - DNA, 22 bp, Homo sapiens
acttggcaggtcaggggatatt

SEQ ID NO: 6995412 - DNA, 20 bp, Homo sapiens
tcctggcaagccgtacctcc

SEQ ID NO: 6995413 - DNA, 22 bp, Homo sapiens
tgggagaagagaaattactgcc

SEQ ID NO: 6995414 - DNA, 22 bp, Homo sapiens
agaaggacccggtgggagatga

SEQ ID NO: 6995415 - DNA, 22 bp, Homo sapiens
ttagcagctaagtcatgctgca

SEQ ID NO: 6995416 - DNA, 22 bp, Homo sapiens
agaggaggctgggtccagataa

SEQ ID NO: 6995417 - DNA, 20 bp, Homo sapiens
ctctttgttggcaaactctt

SEQ ID NO: 6995418 - DNA, 22 bp, Homo sapiens
tgacaagaaagcgtcttctttt

SEQ ID NO: 6995419 - DNA, 22 bp, Homo sapiens
gttattgctaaaggttttcatt

SEQ ID NO: 6995420 - DNA, 22 bp, Homo sapiens
tcagcatcttcagcatggggaa

SEQ ID NO: 6995421 - DNA, 22 bp, Homo sapiens
actgtaacacaatggtatctgt

SEQ ID NO: 6995422 - DNA, 22 bp, Homo sapiens
agtggcttgtccgtggtcacat

SEQ ID NO: 6995423 - DNA, 22 bp, Homo sapiens
aagttgattgcttcaaatttct

SEQ ID NO: 6995424 - DNA, 22 bp, Homo sapiens
gggaattatagctgtcacaggc

SEQ ID NO: 6995425 - DNA, 22 bp, Homo sapiens
tctgacagagaaggctcagcag

SEQ ID NO: 6995426 - DNA, 22 bp, Homo sapiens
gtgcagcttcctggtctcagcc

SEQ ID NO: 6995427 - DNA, 22 bp, Homo sapiens
tggctactgtacttgagctatt

SEQ ID NO: 6995428 - DNA, 22 bp, Homo sapiens
aaggcaactgtaaaacatgcac

SEQ ID NO: 6995429 - DNA, 22 bp, Homo sapiens
ggaggtaaagtaactcgcccag

SEQ ID NO: 6995430 - DNA, 22 bp, Homo sapiens
tgtaaagtgaggataagaacag

SEQ ID NO: 6995431 - DNA, 22 bp, Homo sapiens
ttttccttaacagagggagaaa

SEQ ID NO: 6995432 - DNA, 22 bp, Homo sapiens
gtgaactaaggattcaaacttc

SEQ ID NO: 6995433 - DNA, 22 bp, Homo sapiens
agtcccagatgacccagctact

SEQ ID NO: 6995434 - DNA, 22 bp, Homo sapiens
agtaacagtaacatcttcctag

SEQ ID NO: 6995435 - DNA, 18 bp, Homo sapiens
tagatggcagtctgcaga

SEQ ID NO: 6995436 - DNA, 22 bp, Homo sapiens
agggctcaagaaagtgtacctc

SEQ ID NO: 6995437 - DNA, 22 bp, Homo sapiens
agcagctgaaaggcaaacttct

SEQ ID NO: 6995438 - DNA, 22 bp, Homo sapiens
gtggtcctgtcctgacggcttc

SEQ ID NO: 6995439 - DNA, 22 bp, Homo sapiens
gaaatgcagattctgattctgt

SEQ ID NO: 6995440 - DNA, 22 bp, Homo sapiens
gcagggctgcagagggcactgt

SEQ ID NO: 6995441 - DNA, 22 bp, Homo sapiens
tatgtgatcaaaaaagtttgga

SEQ ID NO: 6995442 - DNA, 22 bp, Homo sapiens
agtctcttacccaagcagaatg

SEQ ID NO: 6995443 - DNA, 22 bp, Homo sapiens
tgtcagcatgaaccctgaatta

SEQ ID NO: 6995444 - DNA, 22 bp, Homo sapiens
ggcaaagccttactctaactga

SEQ ID NO: 6995445 - DNA, 22 bp, Homo sapiens
gctctggttaaaaagaattaaa

SEQ ID NO: 6995446 - DNA, 22 bp, Homo sapiens
tagccagtgaatgtttccagtg

SEQ ID NO: 6995447 - DNA, 22 bp, Homo sapiens
cagggttggggtagataagaaa

SEQ ID NO: 6995448 - DNA, 21 bp, Homo sapiens
tttgttcaggcaagttacagt

SEQ ID NO: 6995449 - DNA, 22 bp, Homo sapiens
gtctgtccatcagcaaaggctt

SEQ ID NO: 6995450 - DNA, 22 bp, Homo sapiens
cagcatggtggagctgctcttt

SEQ ID NO: 6995451 - DNA, 22 bp, Homo sapiens
tgcctgtgtgaccacgggcaag

SEQ ID NO: 6995452 - DNA, 22 bp, Homo sapiens
agcagcttctattttcttggtt

SEQ ID NO: 6995453 - DNA, 22 bp, Homo sapiens
cactttaactcacatttcagct

SEQ ID NO: 6995454 - DNA, 22 bp, Homo sapiens
atgtcataaatatactgttcct

SEQ ID NO: 6995455 - DNA, 22 bp, Homo sapiens
acactggtgtagttttctgcag

SEQ ID NO: 6995456 - DNA, 22 bp, Homo sapiens
ctccaggtgcagaaggactcag

SEQ ID NO: 6995457 - DNA, 22 bp, Homo sapiens
ttccgagggctcggcggccgcc

SEQ ID NO: 6995458 - DNA, 22 bp, Homo sapiens
cgggaacatgctttcatttcag

SEQ ID NO: 6995459 - DNA, 22 bp, Homo sapiens
ctagcatgtcaacttagagcta

SEQ ID NO: 6995460 - DNA, 22 bp, Homo sapiens
tactttattgtaaatgctgatg

SEQ ID NO: 6995461 - DNA, 22 bp, Homo sapiens
atgcagttttaaatcatttcag

SEQ ID NO: 6995462 - DNA, 22 bp, Homo sapiens
ctgagccactgcttgttcagtg

SEQ ID NO: 6995463 - DNA, 22 bp, Homo sapiens
acttgtttggtctcatgtttaa

SEQ ID NO: 6995464 - DNA, 21 bp, Homo sapiens
atacagaaggtggcaaagtac

SEQ ID NO: 6995465 - DNA, 22 bp, Homo sapiens
ctggctcatagagcagctccaa

SEQ ID NO: 6995466 - DNA, 22 bp, Homo sapiens
tgcagccttggcaaccagggac

SEQ ID NO: 6995467 - DNA, 22 bp, Homo sapiens
gaaggccattagagcctgtgcc

SEQ ID NO: 6995468 - DNA, 22 bp, Homo sapiens
tcttaatgaaagtgaaatatca

SEQ ID NO: 6995469 - DNA, 22 bp, Homo sapiens
acaaggcattccggaagtaacc

SEQ ID NO: 6995470 - DNA, 22 bp, Homo sapiens
gctgccagagattttagaacta

SEQ ID NO: 6995471 - DNA, 22 bp, Homo sapiens
agggcctgaggctgacggggag

SEQ ID NO: 6995472 - DNA, 22 bp, Homo sapiens
tcacatgtcagtcttaaacaga

SEQ ID NO: 6995473 - DNA, 22 bp, Homo sapiens
tgaaggtgtctttgtgaacatc

SEQ ID NO: 6995474 - DNA, 22 bp, Homo sapiens
ataatccattaattaatgacca

SEQ ID NO: 6995475 - DNA, 19 bp, Homo sapiens
tgctgctgtccttgcaggg

SEQ ID NO: 6995476 - DNA, 22 bp, Homo sapiens
gtgacccagaggctgactaaca

SEQ ID NO: 6995477 - DNA, 22 bp, Homo sapiens
cactgcttagatcttccttcaa

SEQ ID NO: 6995478 - DNA, 22 bp, Homo sapiens
aggtcattacaattatcatttt

SEQ ID NO: 6995479 - DNA, 22 bp, Homo sapiens
tctgagttcataccaggctacc

SEQ ID NO: 6995480 - DNA, 22 bp, Homo sapiens
ttcctgtgaagatctgggtgct

SEQ ID NO: 6995481 - DNA, 22 bp, Homo sapiens
ccctgacttgatctttgacttg

SEQ ID NO: 6995482 - DNA, 22 bp, Homo sapiens
ttttgcaatatgttcctgaata

SEQ ID NO: 6995483 - DNA, 22 bp, Homo sapiens
attgaaaccctggattgtccta

SEQ ID NO: 6995484 - DNA, 22 bp, Homo sapiens
gattaagtccttctcagccgcc

SEQ ID NO: 6995485 - DNA, 23 bp, Homo sapiens
tgtacaagtacgacctctccctc

SEQ ID NO: 6995486 - DNA, 22 bp, Homo sapiens
tcagtcaatgtgtcagctctcc

SEQ ID NO: 6995487 - DNA, 22 bp, Homo sapiens
taatgagtcattcctgaatgct

SEQ ID NO: 6995488 - DNA, 21 bp, Homo sapiens
caaatacttagaaacttaaga

SEQ ID NO: 6995489 - DNA, 22 bp, Homo sapiens
atcagcaagtcctgttaattct

SEQ ID NO: 6995490 - DNA, 22 bp, Homo sapiens
tacacatgtccaaggtgtcacc

SEQ ID NO: 6995491 - DNA, 22 bp, Homo sapiens
ctggctggagtgcaggtgagtg

SEQ ID NO: 6995492 - DNA, 22 bp, Homo sapiens
gaggcactgcagtacagtgact

SEQ ID NO: 6995493 - DNA, 22 bp, Homo sapiens
actcagagaatatctagaagga

SEQ ID NO: 6995494 - DNA, 22 bp, Homo sapiens
gatgctaaaataattattttga

SEQ ID NO: 6995495 - DNA, 22 bp, Homo sapiens
ctggccaccaagagcttgctca

SEQ ID NO: 6995496 - DNA, 22 bp, Homo sapiens
gggtggcatagggtgatggctt

SEQ ID NO: 6995497 - DNA, 22 bp, Homo sapiens
cacatgatggtggaagccatag

SEQ ID NO: 6995498 - DNA, 22 bp, Homo sapiens
ctcacaggtaccagcaccctcc

SEQ ID NO: 6995499 - DNA, 22 bp, Homo sapiens
ttgtagcattttaaatgagcat

SEQ ID NO: 6995500 - DNA, 22 bp, Homo sapiens
ggtaaggagctccggcttctgc

SEQ ID NO: 6995501 - DNA, 22 bp, Homo sapiens
tggactgatgctccctattgaa

SEQ ID NO: 6995502 - DNA, 15 bp, Homo sapiens
caggaaatgaatctg

SEQ ID NO: 6995503 - DNA, 22 bp, Homo sapiens
aagggctgttatgtttttatac

SEQ ID NO: 6995504 - DNA, 22 bp, Homo sapiens
atgattctaaacttaaggggga

SEQ ID NO: 6995505 - DNA, 22 bp, Homo sapiens
gtatggctgctgggatgacaac

SEQ ID NO: 6995506 - DNA, 22 bp, Homo sapiens
gtatccatgggggattggttcc

SEQ ID NO: 6995507 - DNA, 22 bp, Homo sapiens
agggctcagggtcaccatctgt

SEQ ID NO: 6995508 - DNA, 22 bp, Homo sapiens
tcctgtggtcattcttctgccc

SEQ ID NO: 6995509 - DNA, 22 bp, Homo sapiens
gtgaggtggtacaatattaact

SEQ ID NO: 6995510 - DNA, 22 bp, Homo sapiens
atcttacaattacaagacactc

SEQ ID NO: 6995511 - DNA, 22 bp, Homo sapiens
atggcacatgttgccttcgaat

SEQ ID NO: 6995512 - DNA, 22 bp, Homo sapiens
gacagtggaatgaccctttgag

SEQ ID NO: 6995513 - DNA, 22 bp, Homo sapiens
attatacattttgtgtagagat

SEQ ID NO: 6995514 - DNA, 22 bp, Homo sapiens
gtctgcctcagccgggggccgc

SEQ ID NO: 6995515 - DNA, 22 bp, Homo sapiens
ggcccagagacgtgcaatgtac

SEQ ID NO: 6995516 - DNA, 22 bp, Homo sapiens
tatactgatttgtctatactct

SEQ ID NO: 6995517 - DNA, 22 bp, Homo sapiens
tgaaggcagtgattttgtttgg

SEQ ID NO: 6995518 - DNA, 22 bp, Homo sapiens
acacaggtacacatatgtacct

SEQ ID NO: 6995519 - DNA, 22 bp, Homo sapiens
agaggaataaatttctgtagtg

SEQ ID NO: 6995520 - DNA, 22 bp, Homo sapiens
aggaaaatcgagtctggaggca

SEQ ID NO: 6995521 - DNA, 22 bp, Homo sapiens
atgtgagctggggcccggccag

SEQ ID NO: 6995522 - DNA, 22 bp, Homo sapiens
agccagatgtgagaaagaacac

SEQ ID NO: 6995523 - DNA, 22 bp, Homo sapiens
ttagattattgagcatccactg

SEQ ID NO: 6995524 - DNA, 22 bp, Homo sapiens
tagatgtgtgatattctcagat

SEQ ID NO: 6995525 - DNA, 22 bp, Homo sapiens
cagcagcagtggctgcagaaca

SEQ ID NO: 6995526 - DNA, 22 bp, Homo sapiens
actaaatgaactattaatactt

SEQ ID NO: 6995527 - DNA, 22 bp, Homo sapiens
atagaaacagggaagcaaagca

SEQ ID NO: 6995528 - DNA, 22 bp, Homo sapiens
ggtctggatgctgaggttccca

SEQ ID NO: 6995529 - DNA, 22 bp, Homo sapiens
gcctggctgaggcctctgctaa

SEQ ID NO: 6995530 - DNA, 22 bp, Homo sapiens
tttagaatgttagcgttaaagg

SEQ ID NO: 6995531 - DNA, 23 bp, Homo sapiens
tgatggaaatgatctgggtctgt

SEQ ID NO: 6995532 - DNA, 22 bp, Homo sapiens
acagtgctgatctagactgacc

SEQ ID NO: 6995533 - DNA, 22 bp, Homo sapiens
atctcctcccgcgccgagctcg

SEQ ID NO: 6995534 - DNA, 22 bp, Homo sapiens
cctgtacatctgctctcattgc

SEQ ID NO: 6995535 - DNA, 22 bp, Homo sapiens
tctcaccaaagccttgaccata

SEQ ID NO: 6995536 - DNA, 22 bp, Homo sapiens
ctgtgggaatactgcgagtgta

SEQ ID NO: 6995537 - DNA, 22 bp, Homo sapiens
tgctggagaggaaggtggggtc

SEQ ID NO: 6995538 - DNA, 22 bp, Homo sapiens
cttcatttccatccaactggga

SEQ ID NO: 6995539 - DNA, 22 bp, Homo sapiens
tcacttatgccagctctggaag

SEQ ID NO: 6995540 - DNA, 22 bp, Homo sapiens
tttggaaacatctcagaaaata

SEQ ID NO: 6995541 - DNA, 22 bp, Homo sapiens
ctgatgcttgcaacaaagaacc

SEQ ID NO: 6995542 - DNA, 22 bp, Homo sapiens
tgtggcctctcaggcttgatca

SEQ ID NO: 6995543 - DNA, 22 bp, Homo sapiens
agggagctgactggctgccatt

SEQ ID NO: 6995544 - DNA, 22 bp, Homo sapiens
acgtttgctttctttggcctgg

SEQ ID NO: 6995545 - DNA, 22 bp, Homo sapiens
agacgcttccttaacggcgcca

SEQ ID NO: 6995546 - DNA, 22 bp, Homo sapiens
aggctcagtttggtttccattg

SEQ ID NO: 6995547 - DNA, 22 bp, Homo sapiens
ccagagcttgacgtgcaacgga

SEQ ID NO: 6995548 - DNA, 22 bp, Homo sapiens
cacttattatgggctaggaact

SEQ ID NO: 6995549 - DNA, 22 bp, Homo sapiens
ctggctccctctccctgagtca

SEQ ID NO: 6995550 - DNA, 21 bp, Homo sapiens
gtgcccgtcccaggagccgac

SEQ ID NO: 6995551 - DNA, 21 bp, Homo sapiens
agaccctgcatatgttcagta

SEQ ID NO: 6995552 - DNA, 22 bp, Homo sapiens
taaattgttttctagaagttgt

SEQ ID NO: 6995553 - DNA, 22 bp, Homo sapiens
aggggtagagattgctggtgta

SEQ ID NO: 6995554 - DNA, 22 bp, Homo sapiens
tgagtcagtctgccctggcttc

SEQ ID NO: 6995555 - DNA, 22 bp, Homo sapiens
cagaatatgacaagattttcct

SEQ ID NO: 6995556 - DNA, 22 bp, Homo sapiens
gcacaggcacagagggccactg

SEQ ID NO: 6995557 - DNA, 22 bp, Homo sapiens
ctgaggcctgtgttggggcagt

SEQ ID NO: 6995558 - DNA, 22 bp, Homo sapiens
aaagaaggatgggagaaatcct

SEQ ID NO: 6995559 - DNA, 22 bp, Homo sapiens
gatatttttgcagacacctggg

SEQ ID NO: 6995560 - DNA, 22 bp, Homo sapiens
ctcctgtggctttctgatttca

SEQ ID NO: 6995561 - DNA, 21 bp, Homo sapiens
tgtaatctaaagaagctcttt

SEQ ID NO: 6995562 - DNA, 23 bp, Homo sapiens
taatctcttcaagagaaggggaa

SEQ ID NO: 6995563 - DNA, 22 bp, Homo sapiens
ttgaggtcccaaacccactgag

SEQ ID NO: 6995564 - DNA, 22 bp, Homo sapiens
cagcaggtgtctagcaagggtc

SEQ ID NO: 6995565 - DNA, 19 bp, Homo sapiens
acaaattgtcctcatcaag

SEQ ID NO: 6995566 - DNA, 22 bp, Homo sapiens
cagtccagccagtagggtgtgg

SEQ ID NO: 6995567 - DNA, 22 bp, Homo sapiens
gggcatgtagtgtgcatagaga

SEQ ID NO: 6995568 - DNA, 18 bp, Homo sapiens
ctgctgcaggcactcagg

SEQ ID NO: 6995569 - DNA, 22 bp, Homo sapiens
tttcacagctgtcttccgtctc

SEQ ID NO: 6995570 - DNA, 22 bp, Homo sapiens
ctgcaggaattcaaagtgagct

SEQ ID NO: 6995571 - DNA, 22 bp, Homo sapiens
agacatgtccacaaagcattca

SEQ ID NO: 6995572 - DNA, 20 bp, Homo sapiens
cactaactgctcatgactcc

SEQ ID NO: 6995573 - DNA, 22 bp, Homo sapiens
gttattttaacttctcagtaat

SEQ ID NO: 6995574 - DNA, 22 bp, Homo sapiens
ccttgaaagccaggcagaggaa

SEQ ID NO: 6995575 - DNA, 22 bp, Homo sapiens
agggcaatccagccagctgatc

SEQ ID NO: 6995576 - DNA, 22 bp, Homo sapiens
catagccagccattgctcccaa

SEQ ID NO: 6995577 - DNA, 22 bp, Homo sapiens
atctgggccaatcctagtacca

SEQ ID NO: 6995578 - DNA, 22 bp, Homo sapiens
gcagatttctaataagcaatgt

SEQ ID NO: 6995579 - DNA, 22 bp, Homo sapiens
tgagcctgagttcaaggctgca

SEQ ID NO: 6995580 - DNA, 22 bp, Homo sapiens
cctgtgagtttacattctggcc

SEQ ID NO: 6995581 - DNA, 22 bp, Homo sapiens
gcagcaatatccatgtcttcac

SEQ ID NO: 6995582 - DNA, 22 bp, Homo sapiens
taatcgtatgtgtatcaaatca

SEQ ID NO: 6995583 - DNA, 22 bp, Homo sapiens
catcagtgcggcatctgtcatc

SEQ ID NO: 6995584 - DNA, 22 bp, Homo sapiens
gcatttccttgatggctaatga

SEQ ID NO: 6995585 - DNA, 22 bp, Homo sapiens
tgtccaggctggagtgcagtgg

SEQ ID NO: 6995586 - DNA, 22 bp, Homo sapiens
agagcagtcaggaacatgctta

SEQ ID NO: 6995587 - DNA, 22 bp, Homo sapiens
caagatggagtccgggaatgtg

SEQ ID NO: 6995588 - DNA, 22 bp, Homo sapiens
ttcagaatatccgtttaagttt

SEQ ID NO: 6995589 - DNA, 22 bp, Homo sapiens
caacttttctgtgaatttaagt

SEQ ID NO: 6995590 - DNA, 19 bp, Homo sapiens
tgtcaggggtgtgctgtgc

SEQ ID NO: 6995591 - DNA, 22 bp, Homo sapiens
atgcaacatccaattccttttg

SEQ ID NO: 6995592 - DNA, 22 bp, Homo sapiens
agctgcagctacagtgttggtt

SEQ ID NO: 6995593 - DNA, 22 bp, Homo sapiens
agcctgcctgtgaggctttgag

SEQ ID NO: 6995594 - DNA, 22 bp, Homo sapiens
cagggccatgaggcacagggtc

SEQ ID NO: 6995595 - DNA, 19 bp, Homo sapiens
agctccaggcctggatgct

SEQ ID NO: 6995596 - DNA, 15 bp, Homo sapiens
tgcattatcaataga

SEQ ID NO: 6995597 - DNA, 22 bp, Homo sapiens
ctggaagaactccagttctgtg

SEQ ID NO: 6995598 - DNA, 22 bp, Homo sapiens
ccactgctaacttgctgcagct

SEQ ID NO: 6995599 - DNA, 22 bp, Homo sapiens
caggcaagattagagatgagca

SEQ ID NO: 6995600 - DNA, 22 bp, Homo sapiens
gggtggagtgtgaaatctggct

SEQ ID NO: 6995601 - DNA, 22 bp, Homo sapiens
aaggtaatatttttctctctaa

SEQ ID NO: 6995602 - DNA, 22 bp, Homo sapiens
gcagggcaaatgtggaaaggag

SEQ ID NO: 6995603 - DNA, 22 bp, Homo sapiens
ctaagataaatgctttgatgaa

SEQ ID NO: 6995604 - DNA, 22 bp, Homo sapiens
atcctgtggctccagggagccg

SEQ ID NO: 6995605 - DNA, 22 bp, Homo sapiens
atgagcccagggaattcctttc

SEQ ID NO: 6995606 - DNA, 22 bp, Homo sapiens
tcccaggcaggtgacaggggga

SEQ ID NO: 6995607 - DNA, 22 bp, Homo sapiens
attgtacagatgaggtaagtga

SEQ ID NO: 6995608 - DNA, 22 bp, Homo sapiens
atcagtttctgtgaagaacaca

SEQ ID NO: 6995609 - DNA, 23 bp, Homo sapiens
tcagctgcttcctcctgcctgcc

SEQ ID NO: 6995610 - DNA, 22 bp, Homo sapiens
ctagtttagagtatgcgtgtgt

SEQ ID NO: 6995611 - DNA, 22 bp, Homo sapiens
atgatattattctagcccagag

SEQ ID NO: 6995612 - DNA, 22 bp, Homo sapiens
agtgtgttctggtctaccttgg

SEQ ID NO: 6995613 - DNA, 22 bp, Homo sapiens
acaggactgtgatccagtaacc

SEQ ID NO: 6995614 - DNA, 22 bp, Homo sapiens
tattttccttggtggacccagt

SEQ ID NO: 6995615 - DNA, 22 bp, Homo sapiens
accactgtactatttgagtggc

SEQ ID NO: 6995616 - DNA, 22 bp, Homo sapiens
gtgaactcagtctctcttgcta

SEQ ID NO: 6995617 - DNA, 22 bp, Homo sapiens
agcttctcatcttccaaaattg

SEQ ID NO: 6995618 - DNA, 22 bp, Homo sapiens
ccagatattcacttttacatgc

SEQ ID NO: 6995619 - DNA, 22 bp, Homo sapiens
aggtccatagaggcactgatct

SEQ ID NO: 6995620 - DNA, 22 bp, Homo sapiens
acatttacagtgctagacaatc

SEQ ID NO: 6995621 - DNA, 22 bp, Homo sapiens
tccctttcactactgtgttggt

SEQ ID NO: 6995622 - DNA, 22 bp, Homo sapiens
tgtatgcaccattgtattacct

SEQ ID NO: 6995623 - DNA, 22 bp, Homo sapiens
cagggctcgctcgctcgctcgc

SEQ ID NO: 6995624 - DNA, 22 bp, Homo sapiens
ttagtcttggtgagtcttggtt

SEQ ID NO: 6995625 - DNA, 22 bp, Homo sapiens
tatgaatataccacaatttagg

SEQ ID NO: 6995626 - DNA, 22 bp, Homo sapiens
aattacaaatgtagactctcat

SEQ ID NO: 6995627 - DNA, 22 bp, Homo sapiens
gctcatctgccatgatgagttt

SEQ ID NO: 6995628 - DNA, 22 bp, Homo sapiens
cacagttttatcttatactgat

SEQ ID NO: 6995629 - DNA, 22 bp, Homo sapiens
ataaagtcaaggcattttatga

SEQ ID NO: 6995630 - DNA, 22 bp, Homo sapiens
ttgttactaagcctttaaatag

SEQ ID NO: 6995631 - DNA, 22 bp, Homo sapiens
caggttggtattcatctccaca

SEQ ID NO: 6995632 - DNA, 20 bp, Homo sapiens
ctgtcacaaaggatgtgtca

SEQ ID NO: 6995633 - DNA, 22 bp, Homo sapiens
actctgctctgtatttcactgt

SEQ ID NO: 6995634 - DNA, 22 bp, Homo sapiens
gtgaggatgtactgagataaat

SEQ ID NO: 6995635 - DNA, 22 bp, Homo sapiens
ctggagctgctgtccttgggtg

SEQ ID NO: 6995636 - DNA, 22 bp, Homo sapiens
tgaggatttaatgggactcatt

SEQ ID NO: 6995637 - DNA, 22 bp, Homo sapiens
ttgtccagcgaccaggctctgt

SEQ ID NO: 6995638 - DNA, 22 bp, Homo sapiens
tctgtgcaagaccaactttcaa

SEQ ID NO: 6995639 - DNA, 22 bp, Homo sapiens
tatctcttgcatgctttttaga

SEQ ID NO: 6995640 - DNA, 22 bp, Homo sapiens
aatgcatccctgccaatgcttt

SEQ ID NO: 6995641 - DNA, 22 bp, Homo sapiens
actgcacttcagcctgggtgac

SEQ ID NO: 6995642 - DNA, 22 bp, Homo sapiens
tcaaggttcaaggctggcttct

SEQ ID NO: 6995643 - DNA, 23 bp, Homo sapiens
gagctgggatacaggcttactgc

SEQ ID NO: 6995644 - DNA, 22 bp, Homo sapiens
tgtagcagtgtctaccacatta

SEQ ID NO: 6995645 - DNA, 22 bp, Homo sapiens
agtgtttaccccaatcagttta

SEQ ID NO: 6995646 - DNA, 22 bp, Homo sapiens
tctggattttcttcgtaaggat

SEQ ID NO: 6995647 - DNA, 22 bp, Homo sapiens
tttcctttgcccaatacatgtc

SEQ ID NO: 6995648 - DNA, 22 bp, Homo sapiens
gcagcagagtttgggagatggt

SEQ ID NO: 6995649 - DNA, 22 bp, Homo sapiens
aacccaggaggcagatgttgtg

SEQ ID NO: 6995650 - DNA, 22 bp, Homo sapiens
tgtgccttatgaattctttctg

SEQ ID NO: 6995651 - DNA, 22 bp, Homo sapiens
attgtgcagtaaagtccttttc

SEQ ID NO: 6995652 - DNA, 22 bp, Homo sapiens
ccaaagtgctgggattacaggc

SEQ ID NO: 6995653 - DNA, 22 bp, Homo sapiens
tccaggaaggactaatggtttg

SEQ ID NO: 6995654 - DNA, 22 bp, Homo sapiens
tgctgttatcacattttgtaaa

SEQ ID NO: 6995655 - DNA, 22 bp, Homo sapiens
acgtgctgaagttatccctgtt

SEQ ID NO: 6995656 - DNA, 22 bp, Homo sapiens
gtggccttaagaaacaaacaac

SEQ ID NO: 6995657 - DNA, 22 bp, Homo sapiens
tgggcctgatttatcatcttca

SEQ ID NO: 6995658 - DNA, 22 bp, Homo sapiens
agcatttaggagaatttgagaa

SEQ ID NO: 6995659 - DNA, 22 bp, Homo sapiens
gggtgcgaatactcataatgta

SEQ ID NO: 6995660 - DNA, 22 bp, Homo sapiens
caaccccactacacgttggaga

SEQ ID NO: 6995661 - DNA, 23 bp, Homo sapiens
cagtacaatgtggaaaaggagtg

SEQ ID NO: 6995662 - DNA, 22 bp, Homo sapiens
gccagctgctggaacagcgcga

SEQ ID NO: 6995663 - DNA, 22 bp, Homo sapiens
cctctgtggccttggaccagct

SEQ ID NO: 6995664 - DNA, 22 bp, Homo sapiens
tggcctgtggcatgacctctag

SEQ ID NO: 6995665 - DNA, 22 bp, Homo sapiens
agcagaacattttcagggctgt

SEQ ID NO: 6995666 - DNA, 22 bp, Homo sapiens
cagtctaagttaatttccacaa

SEQ ID NO: 6995667 - DNA, 22 bp, Homo sapiens
ctcacagcagctctgcgagata

SEQ ID NO: 6995668 - DNA, 22 bp, Homo sapiens
ttatgcagtcgacatctgatca

SEQ ID NO: 6995669 - DNA, 22 bp, Homo sapiens
tttcaggattagtttaagcagg

SEQ ID NO: 6995670 - DNA, 22 bp, Homo sapiens
gggcaagtgttttgtctgcctg

SEQ ID NO: 6995671 - DNA, 22 bp, Homo sapiens
tatgtgctatcaaatgctcatt

SEQ ID NO: 6995672 - DNA, 22 bp, Homo sapiens
tctgagctctatctgtgggaat

SEQ ID NO: 6995673 - DNA, 22 bp, Homo sapiens
tcagaatttttgttacccttga

SEQ ID NO: 6995674 - DNA, 22 bp, Homo sapiens
ggcgggtgataggatgagcagg

SEQ ID NO: 6995675 - DNA, 22 bp, Homo sapiens
atggaactgagcttgccaaact

SEQ ID NO: 6995676 - DNA, 22 bp, Homo sapiens
cccaggaggtggaggttgcagt

SEQ ID NO: 6995677 - DNA, 22 bp, Homo sapiens
atggcagcagtccattgcctca

SEQ ID NO: 6995678 - DNA, 22 bp, Homo sapiens
cagtttatagctctagcagctt

SEQ ID NO: 6995679 - DNA, 22 bp, Homo sapiens
tccaagctgtatgttcctagag

SEQ ID NO: 6995680 - DNA, 22 bp, Homo sapiens
tgcgggcgttcgttaccacttt

SEQ ID NO: 6995681 - DNA, 20 bp, Homo sapiens
tcctgtccgcgccttgcgtc

SEQ ID NO: 6995682 - DNA, 22 bp, Homo sapiens
tgcaggaggctttattcaggat

SEQ ID NO: 6995683 - DNA, 22 bp, Homo sapiens
ctccctggctttgtcctgaggc

SEQ ID NO: 6995684 - DNA, 22 bp, Homo sapiens
ttatgttcagcatctgctttat

SEQ ID NO: 6995685 - DNA, 22 bp, Homo sapiens
tcattagaaatgcagattctca

SEQ ID NO: 6995686 - DNA, 22 bp, Homo sapiens
cttcccttggtgaacagagcat

SEQ ID NO: 6995687 - DNA, 22 bp, Homo sapiens
tttctgttaggcatcattttaa

SEQ ID NO: 6995688 - DNA, 22 bp, Homo sapiens
atgtttgctattgttctagtgg

SEQ ID NO: 6995689 - DNA, 22 bp, Homo sapiens
aaagaagagcaaatttgttgta

SEQ ID NO: 6995690 - DNA, 22 bp, Homo sapiens
ggagggcaacttttcagtaggt

SEQ ID NO: 6995691 - DNA, 22 bp, Homo sapiens
gttcctaagcactgtgcattct

SEQ ID NO: 6995692 - DNA, 22 bp, Homo sapiens
tcacccagactgtctgactctt

SEQ ID NO: 6995693 - DNA, 21 bp, Homo sapiens
ttttggcaaggtgcatgtttc

SEQ ID NO: 6995694 - DNA, 22 bp, Homo sapiens
aatcgaaagctgagggagcatt

SEQ ID NO: 6995695 - DNA, 18 bp, Homo sapiens
ctccagggaactcagtca

SEQ ID NO: 6995696 - DNA, 22 bp, Homo sapiens
tgatcccatgggatggcatcag

SEQ ID NO: 6995697 - DNA, 22 bp, Homo sapiens
cctgcctgggttcaaatcccag

SEQ ID NO: 6995698 - DNA, 17 bp, Homo sapiens
atttcacttagcatgag

SEQ ID NO: 6995699 - DNA, 22 bp, Homo sapiens
agttaccatatatcaaacatgg

SEQ ID NO: 6995700 - DNA, 22 bp, Homo sapiens
attttgaaaccaagttatttcc

SEQ ID NO: 6995701 - DNA, 22 bp, Homo sapiens
gtatctgtagctagagggagag

SEQ ID NO: 6995702 - DNA, 22 bp, Homo sapiens
agtgggactgctatgacagaag

SEQ ID NO: 6995703 - DNA, 22 bp, Homo sapiens
tcagtgccaattctgccatggg

SEQ ID NO: 6995704 - DNA, 22 bp, Homo sapiens
agctgtctttcattacctcatt

SEQ ID NO: 6995705 - DNA, 22 bp, Homo sapiens
ttggttacttaagttggtgcga

SEQ ID NO: 6995706 - DNA, 22 bp, Homo sapiens
atggccagggccaaaagagatg

SEQ ID NO: 6995707 - DNA, 22 bp, Homo sapiens
agtgtatgtgaaactttccaaa

SEQ ID NO: 6995708 - DNA, 22 bp, Homo sapiens
attagcaaggttcatgagaaga

SEQ ID NO: 6995709 - DNA, 22 bp, Homo sapiens
ccaaggcaggggatcaaagttt

SEQ ID NO: 6995710 - DNA, 22 bp, Homo sapiens
tcattgcaccccagtcccagct

SEQ ID NO: 6995711 - DNA, 21 bp, Homo sapiens
tgagtatttgaatttctgtca

SEQ ID NO: 6995712 - DNA, 22 bp, Homo sapiens
agctcacaagactccctcccct

SEQ ID NO: 6995713 - DNA, 22 bp, Homo sapiens
gctgtgtggctgtgccgtcacg

SEQ ID NO: 6995714 - DNA, 22 bp, Homo sapiens
ttctctgcagcttaggcccagt

SEQ ID NO: 6995715 - DNA, 21 bp, Homo sapiens
tgtgtaaagttgaaatcctgt

SEQ ID NO: 6995716 - DNA, 17 bp, Homo sapiens
ggagatctggcagaggg

SEQ ID NO: 6995717 - DNA, 22 bp, Homo sapiens
ttctattgggcagcattgcttc

SEQ ID NO: 6995718 - DNA, 22 bp, Homo sapiens
cattacccttcattacttgagg

SEQ ID NO: 6995719 - DNA, 22 bp, Homo sapiens
acagaggtttccattgaggttt

SEQ ID NO: 6995720 - DNA, 20 bp, Homo sapiens
ggacagtgagacatatctca

SEQ ID NO: 6995721 - DNA, 22 bp, Homo sapiens
catctttaatttgtgacaacta

SEQ ID NO: 6995722 - DNA, 22 bp, Homo sapiens
gcactgcctatgcaaatgtact

SEQ ID NO: 6995723 - DNA, 17 bp, Homo sapiens
acagtctgcctgacagt

SEQ ID NO: 6995724 - DNA, 18 bp, Homo sapiens
aggcaggtgctaatattt

SEQ ID NO: 6995725 - DNA, 22 bp, Homo sapiens
agccctgctgcctgaattagct

SEQ ID NO: 6995726 - DNA, 22 bp, Homo sapiens
gcacagagcctggtaccgagaa

SEQ ID NO: 6995727 - DNA, 22 bp, Homo sapiens
gtcctagagctattaatgtgga

SEQ ID NO: 6995728 - DNA, 22 bp, Homo sapiens
tctttagttggagaacctctga

SEQ ID NO: 6995729 - DNA, 22 bp, Homo sapiens
ctccaggttacttagcctagct

SEQ ID NO: 6995730 - DNA, 22 bp, Homo sapiens
gtgaatttagtttgtaagaagg

SEQ ID NO: 6995731 - DNA, 22 bp, Homo sapiens
agggagttagaaatccaggata

SEQ ID NO: 6995732 - DNA, 22 bp, Homo sapiens
agagctgcaatttcatgtggtg

SEQ ID NO: 6995733 - DNA, 22 bp, Homo sapiens
tgtggaatatttctaaaggcct

SEQ ID NO: 6995734 - DNA, 22 bp, Homo sapiens
aacaggacactgggatggctac

SEQ ID NO: 6995735 - DNA, 22 bp, Homo sapiens
cagacctcaattatgtaagtaa

SEQ ID NO: 6995736 - DNA, 22 bp, Homo sapiens
tgggttccctgacagcgatgct

SEQ ID NO: 6995737 - DNA, 22 bp, Homo sapiens
tagcaggaagaaagctactcag

SEQ ID NO: 6995738 - DNA, 22 bp, Homo sapiens
gggagggagaggacagttctat

SEQ ID NO: 6995739 - DNA, 22 bp, Homo sapiens
gacattcaactttgatgattat

SEQ ID NO: 6995740 - DNA, 22 bp, Homo sapiens
tccaaggaagtttgcactattg

SEQ ID NO: 6995741 - DNA, 22 bp, Homo sapiens
gaacagggtttgagaggcttag

SEQ ID NO: 6995742 - DNA, 22 bp, Homo sapiens
gagggtgcatgtgagattccta

SEQ ID NO: 6995743 - DNA, 22 bp, Homo sapiens
acaaatgagaatgtagacagag

SEQ ID NO: 6995744 - DNA, 22 bp, Homo sapiens
gccatgttttggtaaataccat

SEQ ID NO: 6995745 - DNA, 22 bp, Homo sapiens
agaccactaaaactttctctat

SEQ ID NO: 6995746 - DNA, 21 bp, Homo sapiens
tgcagcctctgcccagcagtg

SEQ ID NO: 6995747 - DNA, 22 bp, Homo sapiens
caggcagcgctcgtggcctggc

SEQ ID NO: 6995748 - DNA, 22 bp, Homo sapiens
tcttagaaaaatggtatgtttt

SEQ ID NO: 6995749 - DNA, 22 bp, Homo sapiens
gagacagagaggtactcaacat

SEQ ID NO: 6995750 - DNA, 22 bp, Homo sapiens
caggcttccgccaggtttccag

SEQ ID NO: 6995751 - DNA, 22 bp, Homo sapiens
ggggacctttccatttctgaga

SEQ ID NO: 6995752 - DNA, 22 bp, Homo sapiens
gaggtgtgcacagcgtgctgac

SEQ ID NO: 6995753 - DNA, 22 bp, Homo sapiens
tttagcagagttatatggaagt

SEQ ID NO: 6995754 - DNA, 22 bp, Homo sapiens
atatagtttaagaaagtacagt

SEQ ID NO: 6995755 - DNA, 22 bp, Homo sapiens
ttgtgtgactcctagagtagag

SEQ ID NO: 6995756 - DNA, 22 bp, Homo sapiens
ctttaacagttccattcaattt

SEQ ID NO: 6995757 - DNA, 20 bp, Homo sapiens
caaagacatgctaggggtgg

SEQ ID NO: 6995758 - DNA, 22 bp, Homo sapiens
ttggtatttcctcaggcatgtc

SEQ ID NO: 6995759 - DNA, 22 bp, Homo sapiens
gtgtgctcagctcatttggata

SEQ ID NO: 6995760 - DNA, 22 bp, Homo sapiens
ttgggcccatggggctaagcta

SEQ ID NO: 6995761 - DNA, 22 bp, Homo sapiens
attggtctgtgagctgttgaca

SEQ ID NO: 6995762 - DNA, 22 bp, Homo sapiens
gaattacattgttagccttcct

SEQ ID NO: 6995763 - DNA, 22 bp, Homo sapiens
cagagcctgccacctttctccc

SEQ ID NO: 6995764 - DNA, 22 bp, Homo sapiens
tgcaggtgtggttcctcagcca

SEQ ID NO: 6995765 - DNA, 22 bp, Homo sapiens
gttcttcatcattaacactctg

SEQ ID NO: 6995766 - DNA, 22 bp, Homo sapiens
tgggccagctccctgcccctgg

SEQ ID NO: 6995767 - DNA, 22 bp, Homo sapiens
tatcaaaggctatgtgattttt

SEQ ID NO: 6995768 - DNA, 22 bp, Homo sapiens
tgtgccataggcagcgtggcca

SEQ ID NO: 6995769 - DNA, 22 bp, Homo sapiens
ctggctttctccagaaattttt

SEQ ID NO: 6995770 - DNA, 22 bp, Homo sapiens
gggaatgtagcaaatctgcaat

SEQ ID NO: 6995771 - DNA, 22 bp, Homo sapiens
ttctgtgactcctcagagattt

SEQ ID NO: 6995772 - DNA, 19 bp, Homo sapiens
ggtcacaaggagttgtgaa

SEQ ID NO: 6995773 - DNA, 22 bp, Homo sapiens
gtgagacaattcctcagtagac

SEQ ID NO: 6995774 - DNA, 22 bp, Homo sapiens
tacttttctgtgtggcagtcac

SEQ ID NO: 6995775 - DNA, 22 bp, Homo sapiens
taggtgagtttggggaagatag

SEQ ID NO: 6995776 - DNA, 22 bp, Homo sapiens
cacaggtgctcctcggggagct

SEQ ID NO: 6995777 - DNA, 23 bp, Homo sapiens
tccagctaagcaataatagaaga

SEQ ID NO: 6995778 - DNA, 22 bp, Homo sapiens
tctacaggtggggcctggcaat

SEQ ID NO: 6995779 - DNA, 22 bp, Homo sapiens
taaatacttagttttgtgtcta

SEQ ID NO: 6995780 - DNA, 22 bp, Homo sapiens
ctttcatttgataagaatgcca

SEQ ID NO: 6995781 - DNA, 22 bp, Homo sapiens
tcccaaaggtccgagcgggaat

SEQ ID NO: 6995782 - DNA, 22 bp, Homo sapiens
aggaagtgactaggtaacccaa

SEQ ID NO: 6995783 - DNA, 22 bp, Homo sapiens
agctttctggttacagtcttca

SEQ ID NO: 6995784 - DNA, 22 bp, Homo sapiens
gacctggattcaaattcagact

SEQ ID NO: 6995785 - DNA, 22 bp, Homo sapiens
taaagtgaaggtcataatgatt

SEQ ID NO: 6995786 - DNA, 22 bp, Homo sapiens
aagagttgattcataggtttta

SEQ ID NO: 6995787 - DNA, 22 bp, Homo sapiens
tttccagtgggccccttgaaat

SEQ ID NO: 6995788 - DNA, 22 bp, Homo sapiens
cactttctgtgttgtgcaaaaa

SEQ ID NO: 6995789 - DNA, 22 bp, Homo sapiens
ttcttctacagtgattaatagt

SEQ ID NO: 6995790 - DNA, 22 bp, Homo sapiens
aaggcttaaataataatttctg

SEQ ID NO: 6995791 - DNA, 22 bp, Homo sapiens
catgtgggttattgggttctag

SEQ ID NO: 6995792 - DNA, 22 bp, Homo sapiens
tccaggccctgggatgggagca

SEQ ID NO: 6995793 - DNA, 22 bp, Homo sapiens
aggcagatcacaggagggcctg

SEQ ID NO: 6995794 - DNA, 22 bp, Homo sapiens
gctttactgtctggaaagtttg

SEQ ID NO: 6995795 - DNA, 22 bp, Homo sapiens
ttgttgactgtggactgcagat

SEQ ID NO: 6995796 - DNA, 22 bp, Homo sapiens
ccctggcttaaaaacctcatat

SEQ ID NO: 6995797 - DNA, 22 bp, Homo sapiens
aagtgtgtatttttcttcagtg

SEQ ID NO: 6995798 - DNA, 22 bp, Homo sapiens
ttggcacttcacgagacagcta

SEQ ID NO: 6995799 - DNA, 22 bp, Homo sapiens
tatcagatagtagatatttagc

SEQ ID NO: 6995800 - DNA, 22 bp, Homo sapiens
gtggggctaaaaactgtgcagt

SEQ ID NO: 6995801 - DNA, 22 bp, Homo sapiens
aggctacactgttttgatgtct

SEQ ID NO: 6995802 - DNA, 22 bp, Homo sapiens
gaaggagagggtcaaggataat

SEQ ID NO: 6995803 - DNA, 18 bp, Homo sapiens
tgggagtgggagtggata

SEQ ID NO: 6995804 - DNA, 22 bp, Homo sapiens
cagtggagagacttttactctt

SEQ ID NO: 6995805 - DNA, 22 bp, Homo sapiens
gtgccctgttcatttctctccc

SEQ ID NO: 6995806 - DNA, 22 bp, Homo sapiens
tgttaaggttatttgttatgtc

SEQ ID NO: 6995807 - DNA, 20 bp, Homo sapiens
actgccagccttgtctactg

SEQ ID NO: 6995808 - DNA, 22 bp, Homo sapiens
ggctctgtaagtgttgcaggta

SEQ ID NO: 6995809 - DNA, 19 bp, Homo sapiens
ggccagcacagggctctgt

SEQ ID NO: 6995810 - DNA, 22 bp, Homo sapiens
gctggcaggagaccatacccta

SEQ ID NO: 6995811 - DNA, 21 bp, Homo sapiens
acagatatttcattgaacatt

SEQ ID NO: 6995812 - DNA, 22 bp, Homo sapiens
cccatcatattctattattggg

SEQ ID NO: 6995813 - DNA, 22 bp, Homo sapiens
ctgttggcctggtgatgaagct

SEQ ID NO: 6995814 - DNA, 22 bp, Homo sapiens
ggggcagagtctggactgttgt

SEQ ID NO: 6995815 - DNA, 19 bp, Homo sapiens
ttcagtgtgctggctcctg

SEQ ID NO: 6995816 - DNA, 22 bp, Homo sapiens
cctcacctcagtctgggcctca

SEQ ID NO: 6995817 - DNA, 22 bp, Homo sapiens
tagtaatgattgtatcttgtcc

SEQ ID NO: 6995818 - DNA, 22 bp, Homo sapiens
tggaatatgcaattgcatttca

SEQ ID NO: 6995819 - DNA, 22 bp, Homo sapiens
ccacattcaccagctgcacgac

SEQ ID NO: 6995820 - DNA, 22 bp, Homo sapiens
tatgtctttattctctgatgcg

SEQ ID NO: 6995821 - DNA, 22 bp, Homo sapiens
ggctttagggcaggcagtgtta

SEQ ID NO: 6995822 - DNA, 22 bp, Homo sapiens
acagtcctaagataattgtctc

SEQ ID NO: 6995823 - DNA, 22 bp, Homo sapiens
cttctcttcccagggacacagg

SEQ ID NO: 6995824 - DNA, 22 bp, Homo sapiens
aaggacaatgaagacagccaca

SEQ ID NO: 6995825 - DNA, 22 bp, Homo sapiens
tctagctctgcttatcatggct

SEQ ID NO: 6995826 - DNA, 22 bp, Homo sapiens
gagtcctggaaccctgaatgct

SEQ ID NO: 6995827 - DNA, 22 bp, Homo sapiens
tggccctctgcaagattctgga

SEQ ID NO: 6995828 - DNA, 22 bp, Homo sapiens
agctaaggaatcagaagaggtt

SEQ ID NO: 6995829 - DNA, 22 bp, Homo sapiens
tatttcaccaccgctgatgaag

SEQ ID NO: 6995830 - DNA, 22 bp, Homo sapiens
caggcatgtggcccaggggtga

SEQ ID NO: 6995831 - DNA, 20 bp, Homo sapiens
tggggtcctggaggggatcc

SEQ ID NO: 6995832 - DNA, 18 bp, Homo sapiens
gggtcctgtgggagacag

SEQ ID NO: 6995833 - DNA, 22 bp, Homo sapiens
ttcaagggaaaacacagtgaat

SEQ ID NO: 6995834 - DNA, 22 bp, Homo sapiens
catactgtaagtgcaaaagtgt

SEQ ID NO: 6995835 - DNA, 22 bp, Homo sapiens
gcactgtgacccagagcaggtg

SEQ ID NO: 6995836 - DNA, 22 bp, Homo sapiens
tacagtttctcattatgctctc

SEQ ID NO: 6995837 - DNA, 22 bp, Homo sapiens
agtcctcccttggggccacctt

SEQ ID NO: 6995838 - DNA, 22 bp, Homo sapiens
cctccttcctgggacagagctg

SEQ ID NO: 6995839 - DNA, 22 bp, Homo sapiens
aagttcctaaagtcaggggtca

SEQ ID NO: 6995840 - DNA, 22 bp, Homo sapiens
agatgctgcctctcctcacaag

SEQ ID NO: 6995841 - DNA, 22 bp, Homo sapiens
gcatttgtgttcttcctagagc

SEQ ID NO: 6995842 - DNA, 22 bp, Homo sapiens
ttcgggctcgcccagatcagtg

SEQ ID NO: 6995843 - DNA, 22 bp, Homo sapiens
agtttaatcctccagcccaact

SEQ ID NO: 6995844 - DNA, 22 bp, Homo sapiens
cagcccagcagactgttaccac

SEQ ID NO: 6995845 - DNA, 22 bp, Homo sapiens
atttggcagtgaagggatcaca

SEQ ID NO: 6995846 - DNA, 22 bp, Homo sapiens
agaaggctcactaagagtgact

SEQ ID NO: 6995847 - DNA, 22 bp, Homo sapiens
ccagtccaggccatggattttg

SEQ ID NO: 6995848 - DNA, 22 bp, Homo sapiens
agtctctgcacagtaagaagca

SEQ ID NO: 6995849 - DNA, 22 bp, Homo sapiens
gcagttacctattttgtagaaa

SEQ ID NO: 6995850 - DNA, 22 bp, Homo sapiens
tgggggctgagtaagatgagat

SEQ ID NO: 6995851 - DNA, 19 bp, Homo sapiens
cagaagctgcagtcggata

SEQ ID NO: 6995852 - DNA, 22 bp, Homo sapiens
caagtcccccaagaacagaacc

SEQ ID NO: 6995853 - DNA, 22 bp, Homo sapiens
caccatctatagaggtatttgg

SEQ ID NO: 6995854 - DNA, 22 bp, Homo sapiens
atagtcttagtctatagttttg

SEQ ID NO: 6995855 - DNA, 22 bp, Homo sapiens
tgtggcaggaagagcttctgag

SEQ ID NO: 6995856 - DNA, 22 bp, Homo sapiens
caaggacccaaatcttgttctt

SEQ ID NO: 6995857 - DNA, 22 bp, Homo sapiens
tagaatttcatgtatgttgggg

SEQ ID NO: 6995858 - DNA, 22 bp, Homo sapiens
ggagacagggttgaaccacgca

SEQ ID NO: 6995859 - DNA, 22 bp, Homo sapiens
cgccccctcggccacctgcggg

SEQ ID NO: 6995860 - DNA, 22 bp, Homo sapiens
tctgttttcatttgtcttgaga

SEQ ID NO: 6995861 - DNA, 22 bp, Homo sapiens
gaggccagtgaaatgttataaa

SEQ ID NO: 6995862 - DNA, 22 bp, Homo sapiens
tgaattgggcctggaaactggt

SEQ ID NO: 6995863 - DNA, 22 bp, Homo sapiens
gtcctggctggttctgtggggc

SEQ ID NO: 6995864 - DNA, 22 bp, Homo sapiens
gaggcactggaggaaaggagaa

SEQ ID NO: 6995865 - DNA, 23 bp, Homo sapiens
aagcttattgccaccttggggag

SEQ ID NO: 6995866 - DNA, 22 bp, Homo sapiens
tagcaagaagggagatggggtt

SEQ ID NO: 6995867 - DNA, 22 bp, Homo sapiens
tggaatctctggtatctgggga

SEQ ID NO: 6995868 - DNA, 22 bp, Homo sapiens
tgcgcctgcgcaaaggtttctg

SEQ ID NO: 6995869 - DNA, 20 bp, Homo sapiens
ctgggctgggctacagggtc

SEQ ID NO: 6995870 - DNA, 22 bp, Homo sapiens
gtaaacactacaaatcaaggct

SEQ ID NO: 6995871 - DNA, 22 bp, Homo sapiens
agggttcccatcacctccttcc

SEQ ID NO: 6995872 - DNA, 22 bp, Homo sapiens
atctctgccaacagttaatgtt

SEQ ID NO: 6995873 - DNA, 22 bp, Homo sapiens
atcatgttcatcgtatttaggc

SEQ ID NO: 6995874 - DNA, 22 bp, Homo sapiens
aattgtgctgctataggattaa

SEQ ID NO: 6995875 - DNA, 20 bp, Homo sapiens
caaatggcttttatttcctt

SEQ ID NO: 6995876 - DNA, 22 bp, Homo sapiens
ctgtgtccttttagttgctgtg

SEQ ID NO: 6995877 - DNA, 22 bp, Homo sapiens
gactgcatgatgttccagagga

SEQ ID NO: 6995878 - DNA, 22 bp, Homo sapiens
tgaggcttgatttgcccgagag

SEQ ID NO: 6995879 - DNA, 19 bp, Homo sapiens
tcctgcccaccagccaggg

SEQ ID NO: 6995880 - DNA, 22 bp, Homo sapiens
gcccatgtgatttcctgggagt

SEQ ID NO: 6995881 - DNA, 22 bp, Homo sapiens
tggtctgatttctttctggagt

SEQ ID NO: 6995882 - DNA, 22 bp, Homo sapiens
agaaaggagaccagctctgccc

SEQ ID NO: 6995883 - DNA, 22 bp, Homo sapiens
tcctggctctaagtcctgagtg

SEQ ID NO: 6995884 - DNA, 22 bp, Homo sapiens
aggagtcccactgtcaatgcta

SEQ ID NO: 6995885 - DNA, 18 bp, Homo sapiens
tgttgaaacttcaggtaa

SEQ ID NO: 6995886 - DNA, 22 bp, Homo sapiens
aggctgcagaacagtcaggtgc

SEQ ID NO: 6995887 - DNA, 22 bp, Homo sapiens
gcctcactgcagccccaggaag

SEQ ID NO: 6995888 - DNA, 22 bp, Homo sapiens
ttggaaagcagccgcagccaat

SEQ ID NO: 6995889 - DNA, 22 bp, Homo sapiens
tctagatttttgtgcacctttg

SEQ ID NO: 6995890 - DNA, 17 bp, Homo sapiens
ggcccggtgacgtcact

SEQ ID NO: 6995891 - DNA, 22 bp, Homo sapiens
attgtacaactgagggtggaat

SEQ ID NO: 6995892 - DNA, 22 bp, Homo sapiens
tgtcagggatttccaactcccc

SEQ ID NO: 6995893 - DNA, 22 bp, Homo sapiens
aggcagcaagattatttaatcc

SEQ ID NO: 6995894 - DNA, 22 bp, Homo sapiens
ccccagcactaccagaagccag

SEQ ID NO: 6995895 - DNA, 23 bp, Homo sapiens
ttgctgcctgagccttcctctgg

SEQ ID NO: 6995896 - DNA, 22 bp, Homo sapiens
tatgaagacaatgatagcatga

SEQ ID NO: 6995897 - DNA, 22 bp, Homo sapiens
aatagcatgcatcctgcataga

SEQ ID NO: 6995898 - DNA, 22 bp, Homo sapiens
gtccaggctgcccagggtcctg

SEQ ID NO: 6995899 - DNA, 22 bp, Homo sapiens
gtccttaacaaacggggaaaag

SEQ ID NO: 6995900 - DNA, 22 bp, Homo sapiens
ctgcagggtttcgccagttgtg

SEQ ID NO: 6995901 - DNA, 22 bp, Homo sapiens
ttgctggaggtgttccagatct

SEQ ID NO: 6995902 - DNA, 22 bp, Homo sapiens
aatccagggtgtggcctttcca

SEQ ID NO: 6995903 - DNA, 22 bp, Homo sapiens
tggaacacacttcaaggagaaa

SEQ ID NO: 6995904 - DNA, 22 bp, Homo sapiens
tgtggcaggctaggctttttgg

SEQ ID NO: 6995905 - DNA, 22 bp, Homo sapiens
ggaggcggaagttgcagtgagc

SEQ ID NO: 6995906 - DNA, 22 bp, Homo sapiens
aagaggcgccgggtacgtggcg

SEQ ID NO: 6995907 - DNA, 22 bp, Homo sapiens
tccaggctcagcacttgctact

SEQ ID NO: 6995908 - DNA, 21 bp, Homo sapiens
cagaggctgagagggcaatct

SEQ ID NO: 6995909 - DNA, 22 bp, Homo sapiens
aagacagatgcaacctgctagc

SEQ ID NO: 6995910 - DNA, 18 bp, Homo sapiens
gggagctgggaagctggt

SEQ ID NO: 6995911 - DNA, 22 bp, Homo sapiens
ctgaggtattgggaagtggact

SEQ ID NO: 6995912 - DNA, 22 bp, Homo sapiens
gctgtagtgaatggccgcgttc

SEQ ID NO: 6995913 - DNA, 22 bp, Homo sapiens
gtcctggcttagttcgctgtaa

SEQ ID NO: 6995914 - DNA, 19 bp, Homo sapiens
acagaaattagttattttc

SEQ ID NO: 6995915 - DNA, 22 bp, Homo sapiens
cattaattgtatttttcaaagt

SEQ ID NO: 6995916 - DNA, 22 bp, Homo sapiens
ctcaggcctgagtggcagtccc

SEQ ID NO: 6995917 - DNA, 22 bp, Homo sapiens
aagttaggatgaatgccttagc

SEQ ID NO: 6995918 - DNA, 22 bp, Homo sapiens
attgaaagagaatgtagctctt

SEQ ID NO: 6995919 - DNA, 22 bp, Homo sapiens
tttctgaagtcttctaacagat

SEQ ID NO: 6995920 - DNA, 22 bp, Homo sapiens
ttccttgtttcaagccatccac

SEQ ID NO: 6995921 - DNA, 22 bp, Homo sapiens
aaagacagtggattcaaaatcc

SEQ ID NO: 6995922 - DNA, 22 bp, Homo sapiens
agcaggcaagcgtgagttctct

SEQ ID NO: 6995923 - DNA, 22 bp, Homo sapiens
tctatattccagatacagatta

SEQ ID NO: 6995924 - DNA, 23 bp, Homo sapiens
attcttggggaaatagtatgagc

SEQ ID NO: 6995925 - DNA, 22 bp, Homo sapiens
ggttaaaatctaaaatgtgact

SEQ ID NO: 6995926 - DNA, 22 bp, Homo sapiens
attgtattataattaggccaaa

SEQ ID NO: 6995927 - DNA, 23 bp, Homo sapiens
tgaatttcattattgcagagatt

SEQ ID NO: 6995928 - DNA, 22 bp, Homo sapiens
acgaataaatctatttcacaca

SEQ ID NO: 6995929 - DNA, 22 bp, Homo sapiens
gccaggagactccattcatttg

SEQ ID NO: 6995930 - DNA, 20 bp, Homo sapiens
ttggcagttaagaatcttac

SEQ ID NO: 6995931 - DNA, 22 bp, Homo sapiens
ggattagaggtgatgattataa

SEQ ID NO: 6995932 - DNA, 22 bp, Homo sapiens
acattgatatttcaaatacagg

SEQ ID NO: 6995933 - DNA, 22 bp, Homo sapiens
ggaagatgcccaacccagcttt

SEQ ID NO: 6995934 - DNA, 22 bp, Homo sapiens
atgtgctaagcactacttgtca

SEQ ID NO: 6995935 - DNA, 22 bp, Homo sapiens
gtacacattatgcttctctaaa

SEQ ID NO: 6995936 - DNA, 22 bp, Homo sapiens
cagaggctgagcagtcagtttg

SEQ ID NO: 6995937 - DNA, 22 bp, Homo sapiens
tctcatcttcatatctgaaaga

SEQ ID NO: 6995938 - DNA, 22 bp, Homo sapiens
gaaggttttcaggagcctagtc

SEQ ID NO: 6995939 - DNA, 22 bp, Homo sapiens
cttcttgtgcactctctatgta

SEQ ID NO: 6995940 - DNA, 22 bp, Homo sapiens
cctggcctggcactccctctgc

SEQ ID NO: 6995941 - DNA, 22 bp, Homo sapiens
ccaggaaggatcgtttgggagt

SEQ ID NO: 6995942 - DNA, 20 bp, Homo sapiens
tcttgggcatggatgtctgg

SEQ ID NO: 6995943 - DNA, 22 bp, Homo sapiens
tcttttgtcggtgtatcatgga

SEQ ID NO: 6995944 - DNA, 22 bp, Homo sapiens
acagctgtgatttctatcatga

SEQ ID NO: 6995945 - DNA, 22 bp, Homo sapiens
agcttgtcacttaaggtctttg

SEQ ID NO: 6995946 - DNA, 22 bp, Homo sapiens
tagctttgtttatcaaggggca

SEQ ID NO: 6995947 - DNA, 22 bp, Homo sapiens
tctgttctttagcctgcttgag

SEQ ID NO: 6995948 - DNA, 22 bp, Homo sapiens
tacattgtacttacaaatagtg

SEQ ID NO: 6995949 - DNA, 19 bp, Homo sapiens
ttccacacagctctcgggc

SEQ ID NO: 6995950 - DNA, 22 bp, Homo sapiens
ctgaggcctctctccttggctt

SEQ ID NO: 6995951 - DNA, 22 bp, Homo sapiens
agtgattttatcaatttactca

SEQ ID NO: 6995952 - DNA, 22 bp, Homo sapiens
gtaggcagggctgtggggagaa

SEQ ID NO: 6995953 - DNA, 22 bp, Homo sapiens
tacaagggagattattcatatt

SEQ ID NO: 6995954 - DNA, 22 bp, Homo sapiens
gagggccaggtagatatcagga

SEQ ID NO: 6995955 - DNA, 23 bp, Homo sapiens
tttgtgcagaagacaaagtggcc

SEQ ID NO: 6995956 - DNA, 23 bp, Homo sapiens
gaatacagagataaatagaacac

SEQ ID NO: 6995957 - DNA, 22 bp, Homo sapiens
gagagaagaaagccatggtcct

SEQ ID NO: 6995958 - DNA, 21 bp, Homo sapiens
tttcccagctgaaaataaatg

SEQ ID NO: 6995959 - DNA, 22 bp, Homo sapiens
cagccctgcagccatggcctgt

SEQ ID NO: 6995960 - DNA, 22 bp, Homo sapiens
gtttagaccaatcataatttat

SEQ ID NO: 6995961 - DNA, 23 bp, Homo sapiens
tctgagttatgtccttacatttg

SEQ ID NO: 6995962 - DNA, 22 bp, Homo sapiens
gcctgcagggcctgggcctacc

SEQ ID NO: 6995963 - DNA, 22 bp, Homo sapiens
tattttgttaataatccagtcc

SEQ ID NO: 6995964 - DNA, 22 bp, Homo sapiens
tctttaagggatgttctgcttt

SEQ ID NO: 6995965 - DNA, 20 bp, Homo sapiens
catatggaaagatattgttc

SEQ ID NO: 6995966 - DNA, 22 bp, Homo sapiens
ctagctgacgggttgataggtg

SEQ ID NO: 6995967 - DNA, 23 bp, Homo sapiens
tgtgacccctaggagtggggacc

SEQ ID NO: 6995968 - DNA, 22 bp, Homo sapiens
tgggcacatagttttatggtca

SEQ ID NO: 6995969 - DNA, 22 bp, Homo sapiens
gaggtccaacacaatgggtgtt

SEQ ID NO: 6995970 - DNA, 22 bp, Homo sapiens
gaagcagcaaatctgcagtatc

SEQ ID NO: 6995971 - DNA, 22 bp, Homo sapiens
cccagctccttacagggccgaa

SEQ ID NO: 6995972 - DNA, 22 bp, Homo sapiens
gagcagtggttgaacagaggca

SEQ ID NO: 6995973 - DNA, 22 bp, Homo sapiens
atgagatgaggaatggccctcc

SEQ ID NO: 6995974 - DNA, 22 bp, Homo sapiens
agtatttctgaatattatcata

SEQ ID NO: 6995975 - DNA, 22 bp, Homo sapiens
ataaacagcctgcccaaattgg

SEQ ID NO: 6995976 - DNA, 22 bp, Homo sapiens
tctctgtgagtggaaggcaccc

SEQ ID NO: 6995977 - DNA, 23 bp, Homo sapiens
aagtgctcagtggacagcattgc

SEQ ID NO: 6995978 - DNA, 22 bp, Homo sapiens
gagacacaatctcatttacatt

SEQ ID NO: 6995979 - DNA, 22 bp, Homo sapiens
gacagtaagtcagagacttggt

SEQ ID NO: 6995980 - DNA, 18 bp, Homo sapiens
cccagaggaatgcctgga

SEQ ID NO: 6995981 - DNA, 22 bp, Homo sapiens
cttggtgcccagcaggtggctg

SEQ ID NO: 6995982 - DNA, 22 bp, Homo sapiens
tgtgcttcaggttgtcgccacg

SEQ ID NO: 6995983 - DNA, 22 bp, Homo sapiens
agccaggcgggtctttgctcct

SEQ ID NO: 6995984 - DNA, 22 bp, Homo sapiens
actccctggcaggtctttatct

SEQ ID NO: 6995985 - DNA, 22 bp, Homo sapiens
ctgcccctgctcatggctgtcc

SEQ ID NO: 6995986 - DNA, 20 bp, Homo sapiens
acaaagtattgaggacaagt

SEQ ID NO: 6995987 - DNA, 22 bp, Homo sapiens
gatccgttgcaaccaattagca

SEQ ID NO: 6995988 - DNA, 22 bp, Homo sapiens
atctcagaaagtttaatttttc

SEQ ID NO: 6995989 - DNA, 22 bp, Homo sapiens
cccttctttgtaataaagatta

SEQ ID NO: 6995990 - DNA, 22 bp, Homo sapiens
aggccgcctggggagaggccct

SEQ ID NO: 6995991 - DNA, 22 bp, Homo sapiens
tctgctttcttactaaaaatga

SEQ ID NO: 6995992 - DNA, 21 bp, Homo sapiens
cccttgcaaagtgctttccca

SEQ ID NO: 6995993 - DNA, 22 bp, Homo sapiens
tctacagtgtcaatgtgtcttg

SEQ ID NO: 6995994 - DNA, 22 bp, Homo sapiens
agttagaagtgtgtcatctgtg

SEQ ID NO: 6995995 - DNA, 22 bp, Homo sapiens
ccagaaacacctggattctgtt

SEQ ID NO: 6995996 - DNA, 22 bp, Homo sapiens
taagtcctaatggcagaagtct

SEQ ID NO: 6995997 - DNA, 22 bp, Homo sapiens
tccctgcacccttgctgggccc

SEQ ID NO: 6995998 - DNA, 22 bp, Homo sapiens
aacctgttccctggtccttgac

SEQ ID NO: 6995999 - DNA, 22 bp, Homo sapiens
tcattcactttgaaataaacga

SEQ ID NO: 6996000 - DNA, 22 bp, Homo sapiens
tgattaactgtctattaatcat

SEQ ID NO: 6996001 - DNA, 22 bp, Homo sapiens
attaataaaataccactttgtt

SEQ ID NO: 6996002 - DNA, 22 bp, Homo sapiens
tcatggaagaggtattttttgt

SEQ ID NO: 6996003 - DNA, 22 bp, Homo sapiens
tctgcgtccatctgcctgcttg

SEQ ID NO: 6996004 - DNA, 22 bp, Homo sapiens
gaattaattgtgtggtttgaat

SEQ ID NO: 6996005 - DNA, 22 bp, Homo sapiens
tgagtgtggggaatgtcatgag

SEQ ID NO: 6996006 - DNA, 22 bp, Homo sapiens
ctctctgagtggctgtactttc

SEQ ID NO: 6996007 - DNA, 22 bp, Homo sapiens
taccaggagttacaggcagcag

SEQ ID NO: 6996008 - DNA, 22 bp, Homo sapiens
tgaagaggccgtgtgcaggtga

SEQ ID NO: 6996009 - DNA, 22 bp, Homo sapiens
tataatttggggaaagtggtgt

SEQ ID NO: 6996010 - DNA, 22 bp, Homo sapiens
tttttgatactcaagaggggta

SEQ ID NO: 6996011 - DNA, 22 bp, Homo sapiens
agcaggaatctgttctgtataa

SEQ ID NO: 6996012 - DNA, 17 bp, Homo sapiens
agcagggagtcaaggga

SEQ ID NO: 6996013 - DNA, 21 bp, Homo sapiens
ccctgggatgggcttggactt

SEQ ID NO: 6996014 - DNA, 22 bp, Homo sapiens
aaaggttagacagctctgcata

SEQ ID NO: 6996015 - DNA, 22 bp, Homo sapiens
gctggtcctggggttgcagcat

SEQ ID NO: 6996016 - DNA, 22 bp, Homo sapiens
tcctccagtcttggtgaggttg

SEQ ID NO: 6996017 - DNA, 18 bp, Homo sapiens
gttcaaggtcaagagaga

SEQ ID NO: 6996018 - DNA, 22 bp, Homo sapiens
tgcctgggggactaaggccaaa

SEQ ID NO: 6996019 - DNA, 22 bp, Homo sapiens
ggacaaaacttcttgcatttct

SEQ ID NO: 6996020 - DNA, 22 bp, Homo sapiens
tgggtctgtagggctgtccaat

SEQ ID NO: 6996021 - DNA, 22 bp, Homo sapiens
aaagtggggtctagagggcctg

SEQ ID NO: 6996022 - DNA, 22 bp, Homo sapiens
ccaaagacagacttgactagag

SEQ ID NO: 6996023 - DNA, 22 bp, Homo sapiens
ggtagacaatggaatgtggcct

SEQ ID NO: 6996024 - DNA, 22 bp, Homo sapiens
tctctcatagagaaaaatatat

SEQ ID NO: 6996025 - DNA, 22 bp, Homo sapiens
aatttcacctgcactacatcgc

SEQ ID NO: 6996026 - DNA, 22 bp, Homo sapiens
aagttactaaaaggattttcag

SEQ ID NO: 6996027 - DNA, 22 bp, Homo sapiens
tgaaagctgaggacaggagggt

SEQ ID NO: 6996028 - DNA, 22 bp, Homo sapiens
caggctcggtccagtggcaccc

SEQ ID NO: 6996029 - DNA, 22 bp, Homo sapiens
cctcgacctccccaggctcagg

SEQ ID NO: 6996030 - DNA, 22 bp, Homo sapiens
caaggccagtttctcctagtca

SEQ ID NO: 6996031 - DNA, 22 bp, Homo sapiens
cagtgtctccagatgctccaat

SEQ ID NO: 6996032 - DNA, 22 bp, Homo sapiens
tgcctttaacaagatctccaga

SEQ ID NO: 6996033 - DNA, 22 bp, Homo sapiens
ctgctttactcatagggtttca

SEQ ID NO: 6996034 - DNA, 22 bp, Homo sapiens
tttcacaggaatacccggcttt

SEQ ID NO: 6996035 - DNA, 22 bp, Homo sapiens
ctagcttagggaaactgacaga

SEQ ID NO: 6996036 - DNA, 22 bp, Homo sapiens
tctgaggtcctgtgatttctct

SEQ ID NO: 6996037 - DNA, 19 bp, Homo sapiens
tctaacagctttcattcta

SEQ ID NO: 6996038 - DNA, 22 bp, Homo sapiens
aacttttcattccaaaggtgct

SEQ ID NO: 6996039 - DNA, 22 bp, Homo sapiens
ttattgcaaaggaagagcttga

SEQ ID NO: 6996040 - DNA, 22 bp, Homo sapiens
tctgttcaagactgaggtgaca

SEQ ID NO: 6996041 - DNA, 22 bp, Homo sapiens
gtctgtttggggacctgtggcc

SEQ ID NO: 6996042 - DNA, 22 bp, Homo sapiens
ggcctgaggcaatagtcagaca

SEQ ID NO: 6996043 - DNA, 22 bp, Homo sapiens
cttacagtacttctaatatgat

SEQ ID NO: 6996044 - DNA, 22 bp, Homo sapiens
aacagcaggtcctggcatgggt

SEQ ID NO: 6996045 - DNA, 22 bp, Homo sapiens
tggggaagggcaccctggagac

SEQ ID NO: 6996046 - DNA, 22 bp, Homo sapiens
tgtcccagcagctgggttctct

SEQ ID NO: 6996047 - DNA, 22 bp, Homo sapiens
gtctgtcctgtacccagcatct

SEQ ID NO: 6996048 - DNA, 21 bp, Homo sapiens
gtgactctggcttcttccagt

SEQ ID NO: 6996049 - DNA, 22 bp, Homo sapiens
gaaagcacagttcatgagacaa

SEQ ID NO: 6996050 - DNA, 22 bp, Homo sapiens
cttgctgttgtgggagactggg

SEQ ID NO: 6996051 - DNA, 22 bp, Homo sapiens
agtgattttcaagtggagcaca

SEQ ID NO: 6996052 - DNA, 22 bp, Homo sapiens
tcgttaccatagccttgtccct

SEQ ID NO: 6996053 - DNA, 22 bp, Homo sapiens
tcagtttacctcaccttaccta

SEQ ID NO: 6996054 - DNA, 22 bp, Homo sapiens
cttgaatgaaaccaactgatga

SEQ ID NO: 6996055 - DNA, 22 bp, Homo sapiens
tgtcaaattatgtaatgggaag

SEQ ID NO: 6996056 - DNA, 22 bp, Homo sapiens
acatttaaccctcaggtttctg

SEQ ID NO: 6996057 - DNA, 22 bp, Homo sapiens
taaggccaaggggccatagtct

SEQ ID NO: 6996058 - DNA, 22 bp, Homo sapiens
atggctttttagactttggtac

SEQ ID NO: 6996059 - DNA, 22 bp, Homo sapiens
tctggtaactcagaagaaagga

SEQ ID NO: 6996060 - DNA, 22 bp, Homo sapiens
tggagctctggaagttctaagc

SEQ ID NO: 6996061 - DNA, 22 bp, Homo sapiens
cttcagaattcctcagcctcag

SEQ ID NO: 6996062 - DNA, 22 bp, Homo sapiens
tattgagacttccagtatatga

SEQ ID NO: 6996063 - DNA, 22 bp, Homo sapiens
cctctcatagtctgtatccttt

SEQ ID NO: 6996064 - DNA, 22 bp, Homo sapiens
aagtcaggaagtgcaaaagttg

SEQ ID NO: 6996065 - DNA, 22 bp, Homo sapiens
caacagtgttgcaatctgaaaa

SEQ ID NO: 6996066 - DNA, 23 bp, Homo sapiens
cagccctggagatgtgggaggca

SEQ ID NO: 6996067 - DNA, 22 bp, Homo sapiens
tagcagcacatggtggttttat

SEQ ID NO: 6996068 - DNA, 22 bp, Homo sapiens
atccagagggtagcaggattag

SEQ ID NO: 6996069 - DNA, 22 bp, Homo sapiens
aactttggcaagtcagacttct

SEQ ID NO: 6996070 - DNA, 22 bp, Homo sapiens
aagctctgctcatgatgacgtt

SEQ ID NO: 6996071 - DNA, 22 bp, Homo sapiens
gtggcagggctttgctgttctt

SEQ ID NO: 6996072 - DNA, 22 bp, Homo sapiens
gggcatcttctgtagccatctc

SEQ ID NO: 6996073 - DNA, 22 bp, Homo sapiens
agaaattattagtgaatagtct

SEQ ID NO: 6996074 - DNA, 22 bp, Homo sapiens
agacatcttgcacacatatact

SEQ ID NO: 6996075 - DNA, 22 bp, Homo sapiens
aggctggcatacatttgttctt

SEQ ID NO: 6996076 - DNA, 22 bp, Homo sapiens
atttccagcagcatatttgtct

SEQ ID NO: 6996077 - DNA, 22 bp, Homo sapiens
atttcagggtgtcttccaactg

SEQ ID NO: 6996078 - DNA, 23 bp, Homo sapiens
ctccctggcccttgggagacctg

SEQ ID NO: 6996079 - DNA, 22 bp, Homo sapiens
aggcttctgtttcttaaaggtg

SEQ ID NO: 6996080 - DNA, 22 bp, Homo sapiens
ggctctgaagggtgacaggttt

SEQ ID NO: 6996081 - DNA, 22 bp, Homo sapiens
agagctgcccacacagcagatt

SEQ ID NO: 6996082 - DNA, 22 bp, Homo sapiens
acctttatagcaacctggtgaa

SEQ ID NO: 6996083 - DNA, 22 bp, Homo sapiens
tgaatgatctccgattagtcct

SEQ ID NO: 6996084 - DNA, 22 bp, Homo sapiens
ttgtatataaagcccccactgt

SEQ ID NO: 6996085 - DNA, 22 bp, Homo sapiens
agaagtttctctgaacgtgtag

SEQ ID NO: 6996086 - DNA, 22 bp, Homo sapiens
caggaatgtagcagcgatggaa

SEQ ID NO: 6996087 - DNA, 22 bp, Homo sapiens
gcaggctttgacttggggcagc

SEQ ID NO: 6996088 - DNA, 22 bp, Homo sapiens
acagctggccgaggctcaggga

SEQ ID NO: 6996089 - DNA, 22 bp, Homo sapiens
acttccaggttccacccaagac

SEQ ID NO: 6996090 - DNA, 22 bp, Homo sapiens
tgggctgcactccattttctgc

SEQ ID NO: 6996091 - DNA, 22 bp, Homo sapiens
taagtcctaacagactgggggc

SEQ ID NO: 6996092 - DNA, 22 bp, Homo sapiens
acttggcttttccatctctgca

SEQ ID NO: 6996093 - DNA, 22 bp, Homo sapiens
aggctttgaacatctacctgag

SEQ ID NO: 6996094 - DNA, 22 bp, Homo sapiens
aaccagtttcaaagaaaattgc

SEQ ID NO: 6996095 - DNA, 22 bp, Homo sapiens
cagaaggtattgtaattatgac

SEQ ID NO: 6996096 - DNA, 22 bp, Homo sapiens
actctgtgctggggacctcatc

SEQ ID NO: 6996097 - DNA, 22 bp, Homo sapiens
tggcagcatgtcccggcctcag

SEQ ID NO: 6996098 - DNA, 22 bp, Homo sapiens
aagtttctattattacattcgt

SEQ ID NO: 6996099 - DNA, 22 bp, Homo sapiens
gtgcattgtaggatgttatgca

SEQ ID NO: 6996100 - DNA, 22 bp, Homo sapiens
tgcagggaatccagtctagggt

SEQ ID NO: 6996101 - DNA, 22 bp, Homo sapiens
cagttctggaggatagaagtct

SEQ ID NO: 6996102 - DNA, 22 bp, Homo sapiens
ctttggaacacccagctctgtg

SEQ ID NO: 6996103 - DNA, 22 bp, Homo sapiens
actgttttctaaagaacagatg

SEQ ID NO: 6996104 - DNA, 20 bp, Homo sapiens
ttaaggaagccaccggtcag

SEQ ID NO: 6996105 - DNA, 22 bp, Homo sapiens
atgagtgtcatgtatgagatat

SEQ ID NO: 6996106 - DNA, 22 bp, Homo sapiens
tgagccagctccttgcctgtca

SEQ ID NO: 6996107 - DNA, 22 bp, Homo sapiens
aggccagggccagattagccac

SEQ ID NO: 6996108 - DNA, 22 bp, Homo sapiens
aatattagtttctcaagagaga

SEQ ID NO: 6996109 - DNA, 22 bp, Homo sapiens
tatttgctgtgcttattccatt

SEQ ID NO: 6996110 - DNA, 22 bp, Homo sapiens
caactgagaaatattgctgacg

SEQ ID NO: 6996111 - DNA, 22 bp, Homo sapiens
ggcaaatgtggtggcttttctg

SEQ ID NO: 6996112 - DNA, 22 bp, Homo sapiens
ggcatcaggagcttcttcaggt

SEQ ID NO: 6996113 - DNA, 22 bp, Homo sapiens
ggctctgctgcaagtcttcctc

SEQ ID NO: 6996114 - DNA, 22 bp, Homo sapiens
tgctggcaccagaatgactgca

SEQ ID NO: 6996115 - DNA, 19 bp, Homo sapiens
aaatacagcagctgtttcc

SEQ ID NO: 6996116 - DNA, 22 bp, Homo sapiens
tccaaagccccatgcactttct

SEQ ID NO: 6996117 - DNA, 22 bp, Homo sapiens
ctttgtgccacagcttgactac

SEQ ID NO: 6996118 - DNA, 22 bp, Homo sapiens
cgtttttcagtggtcttaggtc

SEQ ID NO: 6996119 - DNA, 22 bp, Homo sapiens
tcactgtccctgtcctcttatc

SEQ ID NO: 6996120 - DNA, 22 bp, Homo sapiens
tagtgcatacacagcttatttc

SEQ ID NO: 6996121 - DNA, 22 bp, Homo sapiens
atttagactctcacctccacct

SEQ ID NO: 6996122 - DNA, 22 bp, Homo sapiens
aggctgttctaggagagtggga

SEQ ID NO: 6996123 - DNA, 22 bp, Homo sapiens
atccacagtgcagcaagggccc

SEQ ID NO: 6996124 - DNA, 22 bp, Homo sapiens
tcagaattggaacgtgaagatt

SEQ ID NO: 6996125 - DNA, 22 bp, Homo sapiens
cctgttcaagggatgattgacc

SEQ ID NO: 6996126 - DNA, 22 bp, Homo sapiens
tctggagttttttctgtctgtg

SEQ ID NO: 6996127 - DNA, 22 bp, Homo sapiens
aggtgaggtttgggaggtgtca

SEQ ID NO: 6996128 - DNA, 22 bp, Homo sapiens
tagcaccacttcatgctttcag

SEQ ID NO: 6996129 - DNA, 22 bp, Homo sapiens
atttgaagtaagtaatgagtat

SEQ ID NO: 6996130 - DNA, 22 bp, Homo sapiens
actgggcatcccatggcagagc

SEQ ID NO: 6996131 - DNA, 22 bp, Homo sapiens
aagcatttttcacagcaacagc

SEQ ID NO: 6996132 - DNA, 22 bp, Homo sapiens
atttagtgatgcagtggattat

SEQ ID NO: 6996133 - DNA, 22 bp, Homo sapiens
atgcacagatccccaggaccct

SEQ ID NO: 6996134 - DNA, 22 bp, Homo sapiens
gtcccaggctccatggcagcca

SEQ ID NO: 6996135 - DNA, 22 bp, Homo sapiens
ctagaaatgtagattcttagtg

SEQ ID NO: 6996136 - DNA, 22 bp, Homo sapiens
tatttcacataccacagagtgt

SEQ ID NO: 6996137 - DNA, 22 bp, Homo sapiens
tagtcaggagtaggagttttgg

SEQ ID NO: 6996138 - DNA, 22 bp, Homo sapiens
tgagtgaggaagcggtggagga

SEQ ID NO: 6996139 - DNA, 22 bp, Homo sapiens
aaagcagtatattggtagttgt

SEQ ID NO: 6996140 - DNA, 22 bp, Homo sapiens
ctagtgtacaagtggtggagat

SEQ ID NO: 6996141 - DNA, 22 bp, Homo sapiens
tttcatgatccatttacaaaat

SEQ ID NO: 6996142 - DNA, 22 bp, Homo sapiens
ggccggcctttgcgagcattct

SEQ ID NO: 6996143 - DNA, 22 bp, Homo sapiens
tccagcaaagtgataggatttc

SEQ ID NO: 6996144 - DNA, 22 bp, Homo sapiens
gagatttccatattttgtaaca

SEQ ID NO: 6996145 - DNA, 22 bp, Homo sapiens
aagaaattaatgtgccattact

SEQ ID NO: 6996146 - DNA, 19 bp, Homo sapiens
tgcactagtcatttctgta

SEQ ID NO: 6996147 - DNA, 22 bp, Homo sapiens
tgcctaaacagtccccaaatta

SEQ ID NO: 6996148 - DNA, 22 bp, Homo sapiens
tgtctctctgcccccattgctc

SEQ ID NO: 6996149 - DNA, 22 bp, Homo sapiens
aatgacaaatatggaagcctga

SEQ ID NO: 6996150 - DNA, 22 bp, Homo sapiens
tgaagtctttctgatcatttac

SEQ ID NO: 6996151 - DNA, 22 bp, Homo sapiens
ttgcatggtaataaaatgtgac

SEQ ID NO: 6996152 - DNA, 22 bp, Homo sapiens
actcttattccctcagaaatat

SEQ ID NO: 6996153 - DNA, 22 bp, Homo sapiens
tgattctttgaccaaaaaattg

SEQ ID NO: 6996154 - DNA, 22 bp, Homo sapiens
ttcatggcatacatgtttccca

SEQ ID NO: 6996155 - DNA, 18 bp, Homo sapiens
tggccttgaatcatatca

SEQ ID NO: 6996156 - DNA, 22 bp, Homo sapiens
aactttgttttattcactgctg

SEQ ID NO: 6996157 - DNA, 22 bp, Homo sapiens
ctaggcagtcctgacggtacta

SEQ ID NO: 6996158 - DNA, 22 bp, Homo sapiens
gaatgatattatttcgtgctgg

SEQ ID NO: 6996159 - DNA, 22 bp, Homo sapiens
atacagtataactaataaaccc

SEQ ID NO: 6996160 - DNA, 22 bp, Homo sapiens
gggggctccaggcgagaatgtg

SEQ ID NO: 6996161 - DNA, 22 bp, Homo sapiens
gatttcaacctaacagtatgac

SEQ ID NO: 6996162 - DNA, 20 bp, Homo sapiens
ctttttctccagctctgagc

SEQ ID NO: 6996163 - DNA, 22 bp, Homo sapiens
acattgaatttcacttttgtac

SEQ ID NO: 6996164 - DNA, 22 bp, Homo sapiens
aaatgtcatatttaagtaggaa

SEQ ID NO: 6996165 - DNA, 22 bp, Homo sapiens
actgaaggcttaactctttcat

SEQ ID NO: 6996166 - DNA, 22 bp, Homo sapiens
tctgaaggtttgattggagcta

SEQ ID NO: 6996167 - DNA, 22 bp, Homo sapiens
atccatggaggacaagagcaat

SEQ ID NO: 6996168 - DNA, 22 bp, Homo sapiens
attcttttaaatggcagtagta

SEQ ID NO: 6996169 - DNA, 22 bp, Homo sapiens
tagcagcagtggtgtatttaga

SEQ ID NO: 6996170 - DNA, 19 bp, Homo sapiens
catctcccacagccacaca

SEQ ID NO: 6996171 - DNA, 22 bp, Homo sapiens
tgtcacaaaaatcagtaattgc

SEQ ID NO: 6996172 - DNA, 22 bp, Homo sapiens
tcattcatttgctcactccaca

SEQ ID NO: 6996173 - DNA, 22 bp, Homo sapiens
ctctgggtcaggacacaaaagt

SEQ ID NO: 6996174 - DNA, 22 bp, Homo sapiens
gtcactggaaatttcctttgtt

SEQ ID NO: 6996175 - DNA, 22 bp, Homo sapiens
agttacagctggcgtggggaaa

SEQ ID NO: 6996176 - DNA, 20 bp, Homo sapiens
aacagtaccatttatctcag

SEQ ID NO: 6996177 - DNA, 20 bp, Homo sapiens
tagacttttcatcaacctta

SEQ ID NO: 6996178 - DNA, 21 bp, Homo sapiens
gagagggcattataggaagtg

SEQ ID NO: 6996179 - DNA, 22 bp, Homo sapiens
atgtctgtcccctagccctgat

SEQ ID NO: 6996180 - DNA, 22 bp, Homo sapiens
gcttgttgaattgcattttcca

SEQ ID NO: 6996181 - DNA, 22 bp, Homo sapiens
acattcaaggccttctgacaca

SEQ ID NO: 6996182 - DNA, 22 bp, Homo sapiens
agcctggtttaagcattttata

SEQ ID NO: 6996183 - DNA, 22 bp, Homo sapiens
gccagcattccttggctcctgg

SEQ ID NO: 6996184 - DNA, 22 bp, Homo sapiens
ccactccccacgtgctgtcaga

SEQ ID NO: 6996185 - DNA, 22 bp, Homo sapiens
tgctcgaggtccccaccggctc

SEQ ID NO: 6996186 - DNA, 20 bp, Homo sapiens
cagattctccactaacatat

SEQ ID NO: 6996187 - DNA, 22 bp, Homo sapiens
acctagctgaggagtgtgagtg

SEQ ID NO: 6996188 - DNA, 17 bp, Homo sapiens
aggcagctcagaacatc

SEQ ID NO: 6996189 - DNA, 22 bp, Homo sapiens
gctgggctctgtcatgccttcc

SEQ ID NO: 6996190 - DNA, 22 bp, Homo sapiens
aattgtaagtgctgagttaagg

SEQ ID NO: 6996191 - DNA, 22 bp, Homo sapiens
tgactgaaggactagattgatt

SEQ ID NO: 6996192 - DNA, 22 bp, Homo sapiens
agcatacattggtatgtggttt

SEQ ID NO: 6996193 - DNA, 22 bp, Homo sapiens
actttgttttatagcacataag

SEQ ID NO: 6996194 - DNA, 22 bp, Homo sapiens
gtgttctttatttagtgatgct

SEQ ID NO: 6996195 - DNA, 22 bp, Homo sapiens
atgctgaggacaaagagatcaa

SEQ ID NO: 6996196 - DNA, 22 bp, Homo sapiens
ataaaagtttccaatcatgcct

SEQ ID NO: 6996197 - DNA, 22 bp, Homo sapiens
cctctggcagccagccagttgt

SEQ ID NO: 6996198 - DNA, 22 bp, Homo sapiens
tcttcagtgcacctgatgtctt

SEQ ID NO: 6996199 - DNA, 22 bp, Homo sapiens
agtgtttaatgccttttccagc

SEQ ID NO: 6996200 - DNA, 22 bp, Homo sapiens
atattaggcaaggagattattt

SEQ ID NO: 6996201 - DNA, 22 bp, Homo sapiens
tacctattagaatgctttcagc

SEQ ID NO: 6996202 - DNA, 22 bp, Homo sapiens
agtgctttagagaaatggtgct

SEQ ID NO: 6996203 - DNA, 22 bp, Homo sapiens
taggaaattagaacttggaaac

SEQ ID NO: 6996204 - DNA, 22 bp, Homo sapiens
ttagaatcttgtatcagaagtt

SEQ ID NO: 6996205 - DNA, 22 bp, Homo sapiens
tgcagttctatcacccaccccg

SEQ ID NO: 6996206 - DNA, 22 bp, Homo sapiens
tcccagaagtgaaatttctaga

SEQ ID NO: 6996207 - DNA, 22 bp, Homo sapiens
tgccagtgtgagtggagttctt

SEQ ID NO: 6996208 - DNA, 22 bp, Homo sapiens
ttgtcatggatggaagggatat

SEQ ID NO: 6996209 - DNA, 22 bp, Homo sapiens
ttggaaagaagggctgagcaag

SEQ ID NO: 6996210 - DNA, 22 bp, Homo sapiens
aaatcagttaagatgaggccat

SEQ ID NO: 6996211 - DNA, 21 bp, Homo sapiens
ccatctgtgctcatatttgct

SEQ ID NO: 6996212 - DNA, 19 bp, Homo sapiens
cagtttatgctttggggac

SEQ ID NO: 6996213 - DNA, 22 bp, Homo sapiens
aggggttggatttggcctagag

SEQ ID NO: 6996214 - DNA, 22 bp, Homo sapiens
taaagcacgtctatttaatgat

SEQ ID NO: 6996215 - DNA, 22 bp, Homo sapiens
cctctgggaagccagtcctgct

SEQ ID NO: 6996216 - DNA, 22 bp, Homo sapiens
atggagcagcagaaggggcttg

SEQ ID NO: 6996217 - DNA, 22 bp, Homo sapiens
cggggcagaaagttgtcttttg

SEQ ID NO: 6996218 - DNA, 22 bp, Homo sapiens
acaattttccccataggttatc

SEQ ID NO: 6996219 - DNA, 22 bp, Homo sapiens
tattgacagtgactattggtag

SEQ ID NO: 6996220 - DNA, 22 bp, Homo sapiens
ttgcaccatttcacttccatta

SEQ ID NO: 6996221 - DNA, 22 bp, Homo sapiens
gcttatactctggagaataaga

SEQ ID NO: 6996222 - DNA, 22 bp, Homo sapiens
ataacttagagtaggcaaaagt

SEQ ID NO: 6996223 - DNA, 22 bp, Homo sapiens
ggctctcggcggaccctgggaa

SEQ ID NO: 6996224 - DNA, 22 bp, Homo sapiens
aaggaaatgaagctgatgttgg

SEQ ID NO: 6996225 - DNA, 20 bp, Homo sapiens
tattatgacctgtgttctgg

SEQ ID NO: 6996226 - DNA, 22 bp, Homo sapiens
agcaaagatgtccggggcaagc

SEQ ID NO: 6996227 - DNA, 22 bp, Homo sapiens
aaatgtgtttagatggtttatt

SEQ ID NO: 6996228 - DNA, 22 bp, Homo sapiens
ttgtgtcctaacatctagttaa

SEQ ID NO: 6996229 - DNA, 22 bp, Homo sapiens
cctctgcatcccatataattct

SEQ ID NO: 6996230 - DNA, 22 bp, Homo sapiens
atgtcagattcctaaatatctt

SEQ ID NO: 6996231 - DNA, 21 bp, Homo sapiens
aggtcaaaggcatccatgagg

SEQ ID NO: 6996232 - DNA, 22 bp, Homo sapiens
ttacatttcccccttggaggct

SEQ ID NO: 6996233 - DNA, 22 bp, Homo sapiens
aataatttccagccaactggaa

SEQ ID NO: 6996234 - DNA, 22 bp, Homo sapiens
cataggccacggtcagcccaca

SEQ ID NO: 6996235 - DNA, 22 bp, Homo sapiens
atggagtggggactgcagtgga

SEQ ID NO: 6996236 - DNA, 22 bp, Homo sapiens
gtgcttaagcttctgctttatg

SEQ ID NO: 6996237 - DNA, 22 bp, Homo sapiens
tatcttagggaattaactaaaa

SEQ ID NO: 6996238 - DNA, 22 bp, Homo sapiens
tctccctactgactccaggacc

SEQ ID NO: 6996239 - DNA, 22 bp, Homo sapiens
ctatggtcatttcaatgatcaa

SEQ ID NO: 6996240 - DNA, 22 bp, Homo sapiens
aaatacagtgtgtgttctttga

SEQ ID NO: 6996241 - DNA, 22 bp, Homo sapiens
ttgagaatggaactttctgaca

SEQ ID NO: 6996242 - DNA, 22 bp, Homo sapiens
gtatttctttacatatgctcat

SEQ ID NO: 6996243 - DNA, 22 bp, Homo sapiens
cggggcctgtgccagcctgtgg

SEQ ID NO: 6996244 - DNA, 22 bp, Homo sapiens
taaggcagttttgcctgagata

SEQ ID NO: 6996245 - DNA, 22 bp, Homo sapiens
tttacatgtcaagactggcagt

SEQ ID NO: 6996246 - DNA, 22 bp, Homo sapiens
aaggattggtctggaagcatga

SEQ ID NO: 6996247 - DNA, 22 bp, Homo sapiens
gatgcctgtggtgagcacacat

SEQ ID NO: 6996248 - DNA, 22 bp, Homo sapiens
tgtcagatgcgataaactagtg

SEQ ID NO: 6996249 - DNA, 22 bp, Homo sapiens
tatatgacagtatcattttaaa

SEQ ID NO: 6996250 - DNA, 22 bp, Homo sapiens
aggtcctgtcttatctctgtaa

SEQ ID NO: 6996251 - DNA, 22 bp, Homo sapiens
ggaaatcagcagatgctggtga

SEQ ID NO: 6996252 - DNA, 22 bp, Homo sapiens
atggctttgctcaagtttagcc

SEQ ID NO: 6996253 - DNA, 22 bp, Homo sapiens
aattaattttgttcattcagtc

SEQ ID NO: 6996254 - DNA, 19 bp, Homo sapiens
ctctgcctctggctgtggc

SEQ ID NO: 6996255 - DNA, 21 bp, Homo sapiens
tagatgaaatcagagtatttc

SEQ ID NO: 6996256 - DNA, 22 bp, Homo sapiens
ttagggaagcatggaggagatg

SEQ ID NO: 6996257 - DNA, 22 bp, Homo sapiens
tgcagggccctcattcctgtcc

SEQ ID NO: 6996258 - DNA, 21 bp, Homo sapiens
ggccattttcactcattccat

SEQ ID NO: 6996259 - DNA, 20 bp, Homo sapiens
cttgttaaatatgcaggtag

SEQ ID NO: 6996260 - DNA, 22 bp, Homo sapiens
tgctgaatttacatttttgtag

SEQ ID NO: 6996261 - DNA, 22 bp, Homo sapiens
cagcacaggcaggggaactata

SEQ ID NO: 6996262 - DNA, 22 bp, Homo sapiens
tgctgaatcatatggtaattct

SEQ ID NO: 6996263 - DNA, 22 bp, Homo sapiens
tttcctgtgactaatctggaca

SEQ ID NO: 6996264 - DNA, 22 bp, Homo sapiens
tacctcattacatctgcaatga

SEQ ID NO: 6996265 - DNA, 22 bp, Homo sapiens
aagtcctgtgtgcttacacttg

SEQ ID NO: 6996266 - DNA, 22 bp, Homo sapiens
gatgtgtctccatacaccaccc

SEQ ID NO: 6996267 - DNA, 22 bp, Homo sapiens
actggctttggcttcagatgag

SEQ ID NO: 6996268 - DNA, 22 bp, Homo sapiens
aaaggtaacagttataaccagg

SEQ ID NO: 6996269 - DNA, 21 bp, Homo sapiens
ggagtctgaggaagaaaactg

SEQ ID NO: 6996270 - DNA, 22 bp, Homo sapiens
cctttacagtatggttgtatca

SEQ ID NO: 6996271 - DNA, 22 bp, Homo sapiens
atatggctaggttactaaactg

SEQ ID NO: 6996272 - DNA, 22 bp, Homo sapiens
tccatctcacctgcactctgcg

SEQ ID NO: 6996273 - DNA, 22 bp, Homo sapiens
gctttgcactccagctgtggcc

SEQ ID NO: 6996274 - DNA, 22 bp, Homo sapiens
gacagtaggacagttctgcctc

SEQ ID NO: 6996275 - DNA, 22 bp, Homo sapiens
attcacattgagcttcactgtg

SEQ ID NO: 6996276 - DNA, 22 bp, Homo sapiens
gccatcttgggccatgatgcca

SEQ ID NO: 6996277 - DNA, 22 bp, Homo sapiens
tgttaaacagctgtcttcttca

SEQ ID NO: 6996278 - DNA, 22 bp, Homo sapiens
tcagaattcagagggagtgggg

SEQ ID NO: 6996279 - DNA, 19 bp, Homo sapiens
tggagataagctgtcaata

SEQ ID NO: 6996280 - DNA, 22 bp, Homo sapiens
tgtgagagctccatcctcatga

SEQ ID NO: 6996281 - DNA, 22 bp, Homo sapiens
aagtacgtgcctccacttgtgt

SEQ ID NO: 6996282 - DNA, 22 bp, Homo sapiens
atatgtggcattatttctgagg

SEQ ID NO: 6996283 - DNA, 22 bp, Homo sapiens
tgacacagaaattaagctgtca

SEQ ID NO: 6996284 - DNA, 22 bp, Homo sapiens
ggtctctgaacttccactgcgc

SEQ ID NO: 6996285 - DNA, 22 bp, Homo sapiens
atgaccaatgggcagagctaga

SEQ ID NO: 6996286 - DNA, 22 bp, Homo sapiens
ctggagtggccggtgctgtggc

SEQ ID NO: 6996287 - DNA, 22 bp, Homo sapiens
accatcttagcagactgcagtg

SEQ ID NO: 6996288 - DNA, 22 bp, Homo sapiens
aggccacaggagtactgtcggt

SEQ ID NO: 6996289 - DNA, 22 bp, Homo sapiens
tgctggaaagagagtttcaatg

SEQ ID NO: 6996290 - DNA, 22 bp, Homo sapiens
ctggctcactagccctgccctg

SEQ ID NO: 6996291 - DNA, 22 bp, Homo sapiens
aacatctacagtgagatgttag

SEQ ID NO: 6996292 - DNA, 22 bp, Homo sapiens
aaccagtgaaacaccaggcaag

SEQ ID NO: 6996293 - DNA, 22 bp, Homo sapiens
tcaggctggggtgctaaggtgt

SEQ ID NO: 6996294 - DNA, 18 bp, Homo sapiens
gaggcacatagttggggc

SEQ ID NO: 6996295 - DNA, 22 bp, Homo sapiens
aggggtagtaggataacaaatt

SEQ ID NO: 6996296 - DNA, 22 bp, Homo sapiens
aaccagttgtatgtcctccagc

SEQ ID NO: 6996297 - DNA, 22 bp, Homo sapiens
gtcctgtgtgttgccggctgaa

SEQ ID NO: 6996298 - DNA, 22 bp, Homo sapiens
attccacgagtgtctgtcaagt

SEQ ID NO: 6996299 - DNA, 22 bp, Homo sapiens
agtaagcaatagagtgagaatt

SEQ ID NO: 6996300 - DNA, 22 bp, Homo sapiens
agtgagatgtgtaatcaggggt

SEQ ID NO: 6996301 - DNA, 22 bp, Homo sapiens
ctgtgtgtttatatcatttcct

SEQ ID NO: 6996302 - DNA, 22 bp, Homo sapiens
agcagctctggcactgtagcat

SEQ ID NO: 6996303 - DNA, 22 bp, Homo sapiens
ggccagcttctggacaaagtcc

SEQ ID NO: 6996304 - DNA, 22 bp, Homo sapiens
acaagcgggccacagtgctggt

SEQ ID NO: 6996305 - DNA, 22 bp, Homo sapiens
tgtgcacctcatccaccagacc

SEQ ID NO: 6996306 - DNA, 22 bp, Homo sapiens
tgcagaaatcacatttaaccct

SEQ ID NO: 6996307 - DNA, 22 bp, Homo sapiens
ctggagtttttggccataacgt

SEQ ID NO: 6996308 - DNA, 22 bp, Homo sapiens
tcctcagatgctcttggacgcc

SEQ ID NO: 6996309 - DNA, 22 bp, Homo sapiens
agaccttgtaactagaggccca

SEQ ID NO: 6996310 - DNA, 22 bp, Homo sapiens
aactgttggaggattattttgc

SEQ ID NO: 6996311 - DNA, 22 bp, Homo sapiens
agaggaggatttgtaaaggtct

SEQ ID NO: 6996312 - DNA, 22 bp, Homo sapiens
acaaggtttggtaccacatcca

SEQ ID NO: 6996313 - DNA, 22 bp, Homo sapiens
actctgctggctgcagggcagc

SEQ ID NO: 6996314 - DNA, 20 bp, Homo sapiens
taatttgatatctataagtt

SEQ ID NO: 6996315 - DNA, 22 bp, Homo sapiens
tcaaagtatgctttctttggga

SEQ ID NO: 6996316 - DNA, 22 bp, Homo sapiens
gacatcaattcagcattttaag

SEQ ID NO: 6996317 - DNA, 22 bp, Homo sapiens
cgaagtttggggagaggagtct

SEQ ID NO: 6996318 - DNA, 22 bp, Homo sapiens
agatcagacacggcttgtgacg

SEQ ID NO: 6996319 - DNA, 22 bp, Homo sapiens
agcaaagagtaattttgttttg

SEQ ID NO: 6996320 - DNA, 22 bp, Homo sapiens
ccagaagtggctttctcaggga

SEQ ID NO: 6996321 - DNA, 22 bp, Homo sapiens
ttcagaatctatgtgccagctc

SEQ ID NO: 6996322 - DNA, 21 bp, Homo sapiens
ctcagagcagttcagagggat

SEQ ID NO: 6996323 - DNA, 22 bp, Homo sapiens
agagtcaccaaagtaaaacagt

SEQ ID NO: 6996324 - DNA, 19 bp, Homo sapiens
tatatagatgtgtgtgtat

SEQ ID NO: 6996325 - DNA, 22 bp, Homo sapiens
acgtacagaccagaaacaggga

SEQ ID NO: 6996326 - DNA, 22 bp, Homo sapiens
agtggtagcattgggacttgca

SEQ ID NO: 6996327 - DNA, 22 bp, Homo sapiens
tggcaattttaggtggtttagt

SEQ ID NO: 6996328 - DNA, 22 bp, Homo sapiens
ggttatataattcagtgctttc

SEQ ID NO: 6996329 - DNA, 22 bp, Homo sapiens
tacagaccagtagttctcagcg

SEQ ID NO: 6996330 - DNA, 22 bp, Homo sapiens
ggacagagccctggtggcctaa

SEQ ID NO: 6996331 - DNA, 22 bp, Homo sapiens
ttgcttgccctgcagcatactt

SEQ ID NO: 6996332 - DNA, 22 bp, Homo sapiens
ggtgcccttcagacagtgggca

SEQ ID NO: 6996333 - DNA, 22 bp, Homo sapiens
atttgcatatctgatagactaa

SEQ ID NO: 6996334 - DNA, 22 bp, Homo sapiens
cagtctctaaatcaatctgaat

SEQ ID NO: 6996335 - DNA, 22 bp, Homo sapiens
ctgggcctggcgttccaggctg

SEQ ID NO: 6996336 - DNA, 22 bp, Homo sapiens
ttgaaatatttgggagtgtttg

SEQ ID NO: 6996337 - DNA, 22 bp, Homo sapiens
agtcacatgggattagaaccca

SEQ ID NO: 6996338 - DNA, 22 bp, Homo sapiens
agtcttgtcttgcaagggctga

SEQ ID NO: 6996339 - DNA, 22 bp, Homo sapiens
gagtagaactagaattcttcaa

SEQ ID NO: 6996340 - DNA, 22 bp, Homo sapiens
ggctgctgtgacctcaggtgat

SEQ ID NO: 6996341 - DNA, 22 bp, Homo sapiens
tttggcacagtactttttggct

SEQ ID NO: 6996342 - DNA, 22 bp, Homo sapiens
gggctctgcagtgacttgaggg

SEQ ID NO: 6996343 - DNA, 22 bp, Homo sapiens
tgcctgccttgctgctggacag

SEQ ID NO: 6996344 - DNA, 22 bp, Homo sapiens
tgggggcagaggattcaggaat

SEQ ID NO: 6996345 - DNA, 22 bp, Homo sapiens
tcaaggtctaggctcttctcca

SEQ ID NO: 6996346 - DNA, 22 bp, Homo sapiens
tgaaatcttatactttggtagt

SEQ ID NO: 6996347 - DNA, 22 bp, Homo sapiens
taacacaaaagaatatgtgtgt

SEQ ID NO: 6996348 - DNA, 22 bp, Homo sapiens
agggtctctggagagctgagga

SEQ ID NO: 6996349 - DNA, 22 bp, Homo sapiens
tcccactgtctgtcttgctgca

SEQ ID NO: 6996350 - DNA, 22 bp, Homo sapiens
tgggaaacagtgatgccaagaa

SEQ ID NO: 6996351 - DNA, 22 bp, Homo sapiens
caagtccatataagtctgtttc

SEQ ID NO: 6996352 - DNA, 15 bp, Homo sapiens
gggattaaagagccc

SEQ ID NO: 6996353 - DNA, 23 bp, Homo sapiens
acgccctcgcatcctgagagccc

SEQ ID NO: 6996354 - DNA, 19 bp, Homo sapiens
attaacatcagtgttggcc

SEQ ID NO: 6996355 - DNA, 19 bp, Homo sapiens
gacttctgatgtccagatg

SEQ ID NO: 6996356 - DNA, 22 bp, Homo sapiens
ctttatctagggtaagaaaacc

SEQ ID NO: 6996357 - DNA, 22 bp, Homo sapiens
acagtactgagtactgagttgg

SEQ ID NO: 6996358 - DNA, 20 bp, Homo sapiens
tcagcccagggtgagcatct

SEQ ID NO: 6996359 - DNA, 22 bp, Homo sapiens
gcaagctctctgcaggcagagc

SEQ ID NO: 6996360 - DNA, 22 bp, Homo sapiens
gctggagtctacattcaagaat

SEQ ID NO: 6996361 - DNA, 21 bp, Homo sapiens
tggagctccctgcatcccact

SEQ ID NO: 6996362 - DNA, 22 bp, Homo sapiens
ctagctgtaagagggatgtggc

SEQ ID NO: 6996363 - DNA, 22 bp, Homo sapiens
cagctatttgtaggaaaactgt

SEQ ID NO: 6996364 - DNA, 22 bp, Homo sapiens
atgtcacttttgagactaggtt

SEQ ID NO: 6996365 - DNA, 22 bp, Homo sapiens
agggacagtatccatctcacag

SEQ ID NO: 6996366 - DNA, 22 bp, Homo sapiens
tgcatgctaagaaatagcagct

SEQ ID NO: 6996367 - DNA, 22 bp, Homo sapiens
tgcatggactcatcagacaaga

SEQ ID NO: 6996368 - DNA, 22 bp, Homo sapiens
cttgtgcaattgacattgaatc

SEQ ID NO: 6996369 - DNA, 20 bp, Homo sapiens
agggcctgctctgtggtgtc

SEQ ID NO: 6996370 - DNA, 23 bp, Homo sapiens
cctgccggacctggtggggagac

SEQ ID NO: 6996371 - DNA, 22 bp, Homo sapiens
taacactggcttttgctgaggc

SEQ ID NO: 6996372 - DNA, 22 bp, Homo sapiens
tctctgagaagttcctttgtga

SEQ ID NO: 6996373 - DNA, 22 bp, Homo sapiens
tcaggctgtagggcccctggag

SEQ ID NO: 6996374 - DNA, 22 bp, Homo sapiens
gccagcagggcggagccatcta

SEQ ID NO: 6996375 - DNA, 22 bp, Homo sapiens
ctccccgagagaggttgtccgc

SEQ ID NO: 6996376 - DNA, 22 bp, Homo sapiens
gcgcaaagctatgtatttaaca

SEQ ID NO: 6996377 - DNA, 22 bp, Homo sapiens
acttagcaggtggtgactcgaa

SEQ ID NO: 6996378 - DNA, 22 bp, Homo sapiens
gaaatactgcacaccctgtaag

SEQ ID NO: 6996379 - DNA, 22 bp, Homo sapiens
agggcctgggatgtcctcctag

SEQ ID NO: 6996380 - DNA, 23 bp, Homo sapiens
agagagctcactatatagcattg

SEQ ID NO: 6996381 - DNA, 22 bp, Homo sapiens
gctctgtcaacagctagctgtg

SEQ ID NO: 6996382 - DNA, 22 bp, Homo sapiens
atagcacaatattacctttatg

SEQ ID NO: 6996383 - DNA, 22 bp, Homo sapiens
ttggcactcaaaattttatcgg

SEQ ID NO: 6996384 - DNA, 22 bp, Homo sapiens
gtgcatcaggatctgaccagat

SEQ ID NO: 6996385 - DNA, 20 bp, Homo sapiens
aatgagtcctgctggatcac

SEQ ID NO: 6996386 - DNA, 22 bp, Homo sapiens
ttctctaaggcttggcttccct

SEQ ID NO: 6996387 - DNA, 22 bp, Homo sapiens
gcagcagtgcgggcagctacag

SEQ ID NO: 6996388 - DNA, 22 bp, Homo sapiens
gagtccattatatagttcagaa

SEQ ID NO: 6996389 - DNA, 22 bp, Homo sapiens
acgtgtgtttaacaaacctgca

SEQ ID NO: 6996390 - DNA, 22 bp, Homo sapiens
tcagaggaagccttggtgggag

SEQ ID NO: 6996391 - DNA, 22 bp, Homo sapiens
tcaggctctgggtacacctgac

SEQ ID NO: 6996392 - DNA, 22 bp, Homo sapiens
ttcacttatttcttgagtagca

SEQ ID NO: 6996393 - DNA, 22 bp, Homo sapiens
catggaggaggaagggcgttgt

SEQ ID NO: 6996394 - DNA, 22 bp, Homo sapiens
caactgaactgatatcaactat

SEQ ID NO: 6996395 - DNA, 22 bp, Homo sapiens
taccataacgtaatgaacttga

SEQ ID NO: 6996396 - DNA, 22 bp, Homo sapiens
agctgtctttggagagggagag

SEQ ID NO: 6996397 - DNA, 22 bp, Homo sapiens
agtctcttaatgggcagaaagt

SEQ ID NO: 6996398 - DNA, 22 bp, Homo sapiens
aagggggcggcagccagtggaa

SEQ ID NO: 6996399 - DNA, 22 bp, Homo sapiens
agagtcttatcttttacaagta

SEQ ID NO: 6996400 - DNA, 22 bp, Homo sapiens
agtgtctgaagcctcagcccga

SEQ ID NO: 6996401 - DNA, 19 bp, Homo sapiens
tccaatttgtatgttttca

SEQ ID NO: 6996402 - DNA, 20 bp, Homo sapiens
aatgtttctgaacaggtagt

SEQ ID NO: 6996403 - DNA, 22 bp, Homo sapiens
tcctgggcgattttctgaatat

SEQ ID NO: 6996404 - DNA, 22 bp, Homo sapiens
aaatatagtaaatgcatagttc

SEQ ID NO: 6996405 - DNA, 22 bp, Homo sapiens
ttcaagatggctgcaaatactt

SEQ ID NO: 6996406 - DNA, 22 bp, Homo sapiens
gctgtgtgacctgggcaagtct

SEQ ID NO: 6996407 - DNA, 22 bp, Homo sapiens
tgtcattagtttcagccattct

SEQ ID NO: 6996408 - DNA, 22 bp, Homo sapiens
catgcaaaggtcaagatcagga

SEQ ID NO: 6996409 - DNA, 22 bp, Homo sapiens
ttatagtatgtgcatatgtgtg

SEQ ID NO: 6996410 - DNA, 22 bp, Homo sapiens
gtgaatgcaaactgtttctgat

SEQ ID NO: 6996411 - DNA, 22 bp, Homo sapiens
gcagtgtttttcaatgcttcca

SEQ ID NO: 6996412 - DNA, 22 bp, Homo sapiens
tcattctcagactcttggcctc

SEQ ID NO: 6996413 - DNA, 22 bp, Homo sapiens
gtgtgcagaacagggagtgggt

SEQ ID NO: 6996414 - DNA, 22 bp, Homo sapiens
gtcaggagagatcaggacagca

SEQ ID NO: 6996415 - DNA, 22 bp, Homo sapiens
agcacaggtgaaacagtcaggt

SEQ ID NO: 6996416 - DNA, 22 bp, Homo sapiens
gattactgtctacttgggatag

SEQ ID NO: 6996417 - DNA, 22 bp, Homo sapiens
gtattgcattttaatatgtgca

SEQ ID NO: 6996418 - DNA, 22 bp, Homo sapiens
caagtacaatagctctggaact

SEQ ID NO: 6996419 - DNA, 20 bp, Homo sapiens
tgaaataaggagttgtcctt

SEQ ID NO: 6996420 - DNA, 22 bp, Homo sapiens
tgtgtcagaaggcaatggggat

SEQ ID NO: 6996421 - DNA, 22 bp, Homo sapiens
cctgctggcgtggctggcgccc

SEQ ID NO: 6996422 - DNA, 22 bp, Homo sapiens
aggaatgaactcgagtgatctg

SEQ ID NO: 6996423 - DNA, 22 bp, Homo sapiens
aacacttctcatcactgcaagc

SEQ ID NO: 6996424 - DNA, 22 bp, Homo sapiens
gacagacacaattgatccatga

SEQ ID NO: 6996425 - DNA, 22 bp, Homo sapiens
tcagggactgttactgcctttg

SEQ ID NO: 6996426 - DNA, 22 bp, Homo sapiens
tgcaaataagctattatggaat

SEQ ID NO: 6996427 - DNA, 22 bp, Homo sapiens
acgtgaggacaaagggagaagg

SEQ ID NO: 6996428 - DNA, 22 bp, Homo sapiens
atgttgttttttcataaagtat

SEQ ID NO: 6996429 - DNA, 22 bp, Homo sapiens
ttttgacaatgctaatctcaat

SEQ ID NO: 6996430 - DNA, 20 bp, Homo sapiens
ttgtattccttgaatcaggt

SEQ ID NO: 6996431 - DNA, 22 bp, Homo sapiens
cagtctctggcagctgctggcc

SEQ ID NO: 6996432 - DNA, 22 bp, Homo sapiens
acagttaaatatttctactggg

SEQ ID NO: 6996433 - DNA, 22 bp, Homo sapiens
cttccaatagcaacaaagatta

SEQ ID NO: 6996434 - DNA, 22 bp, Homo sapiens
tgtacagtctgcagcttgctgt

SEQ ID NO: 6996435 - DNA, 22 bp, Homo sapiens
gcatccaaatgtttcatttctt

SEQ ID NO: 6996436 - DNA, 22 bp, Homo sapiens
ctgcagttggataaagatactt

SEQ ID NO: 6996437 - DNA, 22 bp, Homo sapiens
agaggctgcacttgctcatgat

SEQ ID NO: 6996438 - DNA, 22 bp, Homo sapiens
gctgagtgaggaaaaggttata

SEQ ID NO: 6996439 - DNA, 22 bp, Homo sapiens
acccagcctacaaagctcacct

SEQ ID NO: 6996440 - DNA, 20 bp, Homo sapiens
ctgacagaaaatatttcatc

SEQ ID NO: 6996441 - DNA, 22 bp, Homo sapiens
tcctcttctgcctatatctgcc

SEQ ID NO: 6996442 - DNA, 22 bp, Homo sapiens
gtacatatggcacatgctattt

SEQ ID NO: 6996443 - DNA, 22 bp, Homo sapiens
gtccttggggtcatccattatc

SEQ ID NO: 6996444 - DNA, 22 bp, Homo sapiens
tcgcctccaaagagttcctgag

SEQ ID NO: 6996445 - DNA, 22 bp, Homo sapiens
cttgctttccaaatgactcact

SEQ ID NO: 6996446 - DNA, 22 bp, Homo sapiens
agtgtcaaatgtgtgccaagct

SEQ ID NO: 6996447 - DNA, 20 bp, Homo sapiens
tactggaaatttctccacct

SEQ ID NO: 6996448 - DNA, 22 bp, Homo sapiens
agggagtggttaagaaggtgca

SEQ ID NO: 6996449 - DNA, 22 bp, Homo sapiens
aaagcttctattcacttacttg

SEQ ID NO: 6996450 - DNA, 22 bp, Homo sapiens
gaccttccaggctgaatggctg

SEQ ID NO: 6996451 - DNA, 22 bp, Homo sapiens
tttagttcataaaaccagggtg

SEQ ID NO: 6996452 - DNA, 22 bp, Homo sapiens
ttcagtccatcaggcgtggcat

SEQ ID NO: 6996453 - DNA, 22 bp, Homo sapiens
tagaaagccctgtgttcactgc

SEQ ID NO: 6996454 - DNA, 22 bp, Homo sapiens
ctgtcctcaccttggcaggggg

SEQ ID NO: 6996455 - DNA, 22 bp, Homo sapiens
acaggattagtggatttgtctt

SEQ ID NO: 6996456 - DNA, 22 bp, Homo sapiens
ggagccagtttagacctcagtt

SEQ ID NO: 6996457 - DNA, 22 bp, Homo sapiens
ctgtcctgagttcttggaggtc

SEQ ID NO: 6996458 - DNA, 23 bp, Homo sapiens
taattgcttgagttagtaataca

SEQ ID NO: 6996459 - DNA, 22 bp, Homo sapiens
gtgaataagacctaaggatgaa

SEQ ID NO: 6996460 - DNA, 22 bp, Homo sapiens
tctgaggccttggcagctaagg

SEQ ID NO: 6996461 - DNA, 22 bp, Homo sapiens
ccaggaggctctgactggaccc

SEQ ID NO: 6996462 - DNA, 22 bp, Homo sapiens
agtatttcctggcttatctgct

SEQ ID NO: 6996463 - DNA, 22 bp, Homo sapiens
acattcttcttgtgaatttact

SEQ ID NO: 6996464 - DNA, 22 bp, Homo sapiens
tcctttcttttctatgggccca

SEQ ID NO: 6996465 - DNA, 22 bp, Homo sapiens
tgtcttcatggcggaacaactt

SEQ ID NO: 6996466 - DNA, 23 bp, Homo sapiens
atgtatctcatccaaggaagctc

SEQ ID NO: 6996467 - DNA, 22 bp, Homo sapiens
actttctcccacccacccgtct

SEQ ID NO: 6996468 - DNA, 22 bp, Homo sapiens
tcccagaggtctctgctggttc

SEQ ID NO: 6996469 - DNA, 22 bp, Homo sapiens
aagcctgagccatgctttactg

SEQ ID NO: 6996470 - DNA, 19 bp, Homo sapiens
ccagtctccttgcagcatc

SEQ ID NO: 6996471 - DNA, 22 bp, Homo sapiens
ttcacacctcctagagttcaca

SEQ ID NO: 6996472 - DNA, 15 bp, Homo sapiens
tgggcagatcacttg

SEQ ID NO: 6996473 - DNA, 22 bp, Homo sapiens
tagatgaagagggtaggtagat

SEQ ID NO: 6996474 - DNA, 22 bp, Homo sapiens
taacctgggatctgacgggatg

SEQ ID NO: 6996475 - DNA, 22 bp, Homo sapiens
cacttaaatctgttgagaaaaa

SEQ ID NO: 6996476 - DNA, 22 bp, Homo sapiens
tatggcttttaaggagatctga

SEQ ID NO: 6996477 - DNA, 22 bp, Homo sapiens
ggtctctctgctttcccccaga

SEQ ID NO: 6996478 - DNA, 22 bp, Homo sapiens
tttaccatcctcttttagaatt

SEQ ID NO: 6996479 - DNA, 22 bp, Homo sapiens
agtctctagtcatttcacctct

SEQ ID NO: 6996480 - DNA, 22 bp, Homo sapiens
atcaaagtagtaggttttggac

SEQ ID NO: 6996481 - DNA, 22 bp, Homo sapiens
gtgccttatctgcaccctcccc

SEQ ID NO: 6996482 - DNA, 22 bp, Homo sapiens
gtcttgtttgggatgtggatgg

SEQ ID NO: 6996483 - DNA, 17 bp, Homo sapiens
caacttcacaaactgtc

SEQ ID NO: 6996484 - DNA, 22 bp, Homo sapiens
ctttagttagtagataatggca

SEQ ID NO: 6996485 - DNA, 22 bp, Homo sapiens
aacaaatgataccagttctcaa

SEQ ID NO: 6996486 - DNA, 22 bp, Homo sapiens
tctgattccagaaggggcatac

SEQ ID NO: 6996487 - DNA, 22 bp, Homo sapiens
gtctggcagatcgagcagccca

SEQ ID NO: 6996488 - DNA, 22 bp, Homo sapiens
ggatggtgacggcggcccgctt

SEQ ID NO: 6996489 - DNA, 22 bp, Homo sapiens
tagaaagcttggggtgtttaaa

SEQ ID NO: 6996490 - DNA, 22 bp, Homo sapiens
agagccaggctcccatggggca

SEQ ID NO: 6996491 - DNA, 22 bp, Homo sapiens
ttacaaagagaagttgtagaat

SEQ ID NO: 6996492 - DNA, 22 bp, Homo sapiens
aagagcattccgttctgattct

SEQ ID NO: 6996493 - DNA, 19 bp, Homo sapiens
ctgctccctccttctggca

SEQ ID NO: 6996494 - DNA, 22 bp, Homo sapiens
gaagttatgaaatttggacagc

SEQ ID NO: 6996495 - DNA, 22 bp, Homo sapiens
ccctgccccaggcggcttcact

SEQ ID NO: 6996496 - DNA, 22 bp, Homo sapiens
ggctggcttggtgagctgtcac

SEQ ID NO: 6996497 - DNA, 22 bp, Homo sapiens
ttcagaagtgctttcacactct

SEQ ID NO: 6996498 - DNA, 21 bp, Homo sapiens
tttgcattttacatgtgggga

SEQ ID NO: 6996499 - DNA, 22 bp, Homo sapiens
gctgtgggccatggccaagtga

SEQ ID NO: 6996500 - DNA, 22 bp, Homo sapiens
tccatacacatttatttggcct

SEQ ID NO: 6996501 - DNA, 22 bp, Homo sapiens
agatatgagaatatagaggccc

SEQ ID NO: 6996502 - DNA, 22 bp, Homo sapiens
ttggcagctgcacagactccat

SEQ ID NO: 6996503 - DNA, 22 bp, Homo sapiens
atcacgtgctgagagtgttatt

SEQ ID NO: 6996504 - DNA, 22 bp, Homo sapiens
tggcagctggatcccaaggcag

SEQ ID NO: 6996505 - DNA, 22 bp, Homo sapiens
aagagatgaaggtcctgactgt

SEQ ID NO: 6996506 - DNA, 22 bp, Homo sapiens
ggtgcaaaagtaatttggtttt

SEQ ID NO: 6996507 - DNA, 22 bp, Homo sapiens
ataccctttacaggaacagcaa

SEQ ID NO: 6996508 - DNA, 22 bp, Homo sapiens
gcagggctgggtgggagacaga

SEQ ID NO: 6996509 - DNA, 22 bp, Homo sapiens
tggctccactactgggtgtgtt

SEQ ID NO: 6996510 - DNA, 22 bp, Homo sapiens
tagacttttaagtccctcttta

SEQ ID NO: 6996511 - DNA, 22 bp, Homo sapiens
tcttcaaaaatacaggttttca

SEQ ID NO: 6996512 - DNA, 22 bp, Homo sapiens
tggtgaggtcatagagaactgt

SEQ ID NO: 6996513 - DNA, 22 bp, Homo sapiens
aattcatactctatattgcttt

SEQ ID NO: 6996514 - DNA, 22 bp, Homo sapiens
aaggcctttcctgctttgaatg

SEQ ID NO: 6996515 - DNA, 22 bp, Homo sapiens
cagagtccaattgctcagagcg

SEQ ID NO: 6996516 - DNA, 22 bp, Homo sapiens
attgaagattaaatgcttcctt

SEQ ID NO: 6996517 - DNA, 22 bp, Homo sapiens
agtgagcagtacttactcctgc

SEQ ID NO: 6996518 - DNA, 22 bp, Homo sapiens
tgaaagacaaggttttttcaga

SEQ ID NO: 6996519 - DNA, 22 bp, Homo sapiens
actcattgcagctccagcaaca

SEQ ID NO: 6996520 - DNA, 22 bp, Homo sapiens
ttcatgggtccagagccctggg

SEQ ID NO: 6996521 - DNA, 21 bp, Homo sapiens
tagatactgtattaaacctag

SEQ ID NO: 6996522 - DNA, 22 bp, Homo sapiens
tgaggtggcacacacttcctgc

SEQ ID NO: 6996523 - DNA, 22 bp, Homo sapiens
cagctcaagtttcccaggtcag

SEQ ID NO: 6996524 - DNA, 22 bp, Homo sapiens
ggctttatgtttttcatgtggt

SEQ ID NO: 6996525 - DNA, 22 bp, Homo sapiens
ggaggcctagaaaagtggttct

SEQ ID NO: 6996526 - DNA, 21 bp, Homo sapiens
ctgtccccagtgagcaccccc

SEQ ID NO: 6996527 - DNA, 22 bp, Homo sapiens
gcagtgtttcccagagatggaa

SEQ ID NO: 6996528 - DNA, 22 bp, Homo sapiens
tgccttcctaatggtggggttt

SEQ ID NO: 6996529 - DNA, 22 bp, Homo sapiens
actctcagggacagggtctggg

SEQ ID NO: 6996530 - DNA, 22 bp, Homo sapiens
aattagtaacctaattccatct

SEQ ID NO: 6996531 - DNA, 22 bp, Homo sapiens
ccatttgtattactgccccagg

SEQ ID NO: 6996532 - DNA, 22 bp, Homo sapiens
tcagggccatcttttgcctcaa

SEQ ID NO: 6996533 - DNA, 22 bp, Homo sapiens
aaagcagcaagtatttgttact

SEQ ID NO: 6996534 - DNA, 22 bp, Homo sapiens
agaggatgttctaggcactcat

SEQ ID NO: 6996535 - DNA, 22 bp, Homo sapiens
agctgtgtagggaatcagagaa

SEQ ID NO: 6996536 - DNA, 22 bp, Homo sapiens
cttagaataaaagggggctata

SEQ ID NO: 6996537 - DNA, 22 bp, Homo sapiens
tccttggagctctccaagggat

SEQ ID NO: 6996538 - DNA, 22 bp, Homo sapiens
gctggctttgatcttcccatct

SEQ ID NO: 6996539 - DNA, 22 bp, Homo sapiens
gtgcaagcagtacactcaaagc

SEQ ID NO: 6996540 - DNA, 22 bp, Homo sapiens
ttcctgagggacttttgagatt

SEQ ID NO: 6996541 - DNA, 22 bp, Homo sapiens
tgtgcagagtaaggcagctgtt

SEQ ID NO: 6996542 - DNA, 22 bp, Homo sapiens
atgcatgctggaaatacgttca

SEQ ID NO: 6996543 - DNA, 22 bp, Homo sapiens
ttttctcccgctggctgctctt

SEQ ID NO: 6996544 - DNA, 22 bp, Homo sapiens
cagtgggaagggcagaggcttt

SEQ ID NO: 6996545 - DNA, 18 bp, Homo sapiens
ggggaaaagccaggtgtc

SEQ ID NO: 6996546 - DNA, 22 bp, Homo sapiens
agaggctctggtgggagttggt

SEQ ID NO: 6996547 - DNA, 22 bp, Homo sapiens
tgggaggaatgtcactgagcca

SEQ ID NO: 6996548 - DNA, 20 bp, Homo sapiens
tccatgcagtttccatacag

SEQ ID NO: 6996549 - DNA, 22 bp, Homo sapiens
acacagatgggtagaaaacaga

SEQ ID NO: 6996550 - DNA, 22 bp, Homo sapiens
tctgtgcatccttaacgcctgc

SEQ ID NO: 6996551 - DNA, 22 bp, Homo sapiens
tagcaaatgggcttgttttcca

SEQ ID NO: 6996552 - DNA, 22 bp, Homo sapiens
aaagttttgttgattgtggaat

SEQ ID NO: 6996553 - DNA, 22 bp, Homo sapiens
cgctcctgaccagctgtgtccc

SEQ ID NO: 6996554 - DNA, 22 bp, Homo sapiens
taaattaaagattggagaagga

SEQ ID NO: 6996555 - DNA, 17 bp, Homo sapiens
ctggagctgtgtaacct

SEQ ID NO: 6996556 - DNA, 22 bp, Homo sapiens
tggcacagcccagagctcttga

SEQ ID NO: 6996557 - DNA, 22 bp, Homo sapiens
atgtacagtttctagactcaaa

SEQ ID NO: 6996558 - DNA, 23 bp, Homo sapiens
tgaacaaaggcaggagaaggcgg

SEQ ID NO: 6996559 - DNA, 22 bp, Homo sapiens
tggagcagaaatggcctcttgt

SEQ ID NO: 6996560 - DNA, 22 bp, Homo sapiens
agctagagctgagaagcacttg

SEQ ID NO: 6996561 - DNA, 22 bp, Homo sapiens
ggcctggagtcagggaaagcaa

SEQ ID NO: 6996562 - DNA, 22 bp, Homo sapiens
gagggcaggggtcttgcacggt

SEQ ID NO: 6996563 - DNA, 22 bp, Homo sapiens
ggcagttttctcagtggggtac

SEQ ID NO: 6996564 - DNA, 22 bp, Homo sapiens
gtgatgtggggaccgtcctggc

SEQ ID NO: 6996565 - DNA, 22 bp, Homo sapiens
atgaggcttaaactgctgcaac

SEQ ID NO: 6996566 - DNA, 22 bp, Homo sapiens
tttctgctttctatccttgtca

SEQ ID NO: 6996567 - DNA, 22 bp, Homo sapiens
ttggaattgaggatttacatag

SEQ ID NO: 6996568 - DNA, 22 bp, Homo sapiens
tcctgaagaggttgtctttata

SEQ ID NO: 6996569 - DNA, 22 bp, Homo sapiens
tggaaattttgaacagtttcta

SEQ ID NO: 6996570 - DNA, 22 bp, Homo sapiens
agatccagggttggatttgcat

SEQ ID NO: 6996571 - DNA, 22 bp, Homo sapiens
ttttccaaagtaccatgtccct

SEQ ID NO: 6996572 - DNA, 22 bp, Homo sapiens
ctttgaattgccgtttcatctg

SEQ ID NO: 6996573 - DNA, 23 bp, Homo sapiens
agaagttcaagaccagcctgccc

SEQ ID NO: 6996574 - DNA, 22 bp, Homo sapiens
tcatccatatagaaagatgatt

SEQ ID NO: 6996575 - DNA, 22 bp, Homo sapiens
ccagctgcctaagcaatccata

SEQ ID NO: 6996576 - DNA, 22 bp, Homo sapiens
gttgggctcattacagcctgct

SEQ ID NO: 6996577 - DNA, 22 bp, Homo sapiens
agctgccctttatgatgctgaa

SEQ ID NO: 6996578 - DNA, 22 bp, Homo sapiens
acagagtaggtgctgtcgactg

SEQ ID NO: 6996579 - DNA, 20 bp, Homo sapiens
ttctgggaattgggtagctg

SEQ ID NO: 6996580 - DNA, 23 bp, Homo sapiens
tggcctggagagaaaagatgagt

SEQ ID NO: 6996581 - DNA, 22 bp, Homo sapiens
aagtcatagtctaacccagcca

SEQ ID NO: 6996582 - DNA, 22 bp, Homo sapiens
ccctggaggtggaggttgcagg

SEQ ID NO: 6996583 - DNA, 21 bp, Homo sapiens
catgataatgaaggtgttatt

SEQ ID NO: 6996584 - DNA, 22 bp, Homo sapiens
tgcctggattcggttgttgtca

SEQ ID NO: 6996585 - DNA, 19 bp, Homo sapiens
agtgtttcatgtgctttta

SEQ ID NO: 6996586 - DNA, 22 bp, Homo sapiens
agtacagtagggtgctgttagt

SEQ ID NO: 6996587 - DNA, 22 bp, Homo sapiens
attattttatgtgcggcctgat

SEQ ID NO: 6996588 - DNA, 22 bp, Homo sapiens
accaataagacacattgagcta

SEQ ID NO: 6996589 - DNA, 22 bp, Homo sapiens
ttgtgatactgagcttggcatt

SEQ ID NO: 6996590 - DNA, 22 bp, Homo sapiens
gagaagcaggtttagcagacaa

SEQ ID NO: 6996591 - DNA, 22 bp, Homo sapiens
agtggccacccactgagacagg

SEQ ID NO: 6996592 - DNA, 22 bp, Homo sapiens
agtagaatgttctatgtcaatg

SEQ ID NO: 6996593 - DNA, 22 bp, Homo sapiens
atggattcattaatgacttctc

SEQ ID NO: 6996594 - DNA, 22 bp, Homo sapiens
tgcctgggagtgaccaagactc

SEQ ID NO: 6996595 - DNA, 22 bp, Homo sapiens
gccaccatgtattgacttggcc

SEQ ID NO: 6996596 - DNA, 22 bp, Homo sapiens
ggaaccttcatactgtttacca

SEQ ID NO: 6996597 - DNA, 22 bp, Homo sapiens
tgggcactgactgttagtgatg

SEQ ID NO: 6996598 - DNA, 22 bp, Homo sapiens
agagctggtgcatattcagaaa

SEQ ID NO: 6996599 - DNA, 22 bp, Homo sapiens
tggggacgtactgagaggtccg

SEQ ID NO: 6996600 - DNA, 22 bp, Homo sapiens
atgggctgtgaggtccggcagg

SEQ ID NO: 6996601 - DNA, 22 bp, Homo sapiens
ctctgggaagggctgagcactg

SEQ ID NO: 6996602 - DNA, 22 bp, Homo sapiens
tctcagagggaggattactgcc

SEQ ID NO: 6996603 - DNA, 22 bp, Homo sapiens
tggactctaagcagaggatcta

SEQ ID NO: 6996604 - DNA, 20 bp, Homo sapiens
agaactgaatcattttgggt

SEQ ID NO: 6996605 - DNA, 22 bp, Homo sapiens
aagctattgaatttatagcata

SEQ ID NO: 6996606 - DNA, 22 bp, Homo sapiens
cacaattagcagctctttattt

SEQ ID NO: 6996607 - DNA, 22 bp, Homo sapiens
ggcagcaagtggtgggagactt

SEQ ID NO: 6996608 - DNA, 22 bp, Homo sapiens
attggaactgattgatgataat

SEQ ID NO: 6996609 - DNA, 22 bp, Homo sapiens
aactgtgggatgcattaattca

SEQ ID NO: 6996610 - DNA, 22 bp, Homo sapiens
ttaggtcattccctgagcagat

SEQ ID NO: 6996611 - DNA, 18 bp, Homo sapiens
agcttgtttttgccttct

SEQ ID NO: 6996612 - DNA, 22 bp, Homo sapiens
tccagggcagccgcgggtgcgc

SEQ ID NO: 6996613 - DNA, 22 bp, Homo sapiens
aagagctggtcacaggtccatt

SEQ ID NO: 6996614 - DNA, 22 bp, Homo sapiens
tgggcagaggctctgaagtcca

SEQ ID NO: 6996615 - DNA, 22 bp, Homo sapiens
cctatgatatgtgttagataca

SEQ ID NO: 6996616 - DNA, 22 bp, Homo sapiens
cacttttaacaggagaattccc

SEQ ID NO: 6996617 - DNA, 22 bp, Homo sapiens
tacaggtatgcgccaccttgtc

SEQ ID NO: 6996618 - DNA, 22 bp, Homo sapiens
tttcagtggagtgacatgatct

SEQ ID NO: 6996619 - DNA, 22 bp, Homo sapiens
acccatgtttatttgtgtggtt

SEQ ID NO: 6996620 - DNA, 22 bp, Homo sapiens
catgcccagagctccgggcgcc

SEQ ID NO: 6996621 - DNA, 23 bp, Homo sapiens
aacaccaaggctcagagagataa

SEQ ID NO: 6996622 - DNA, 22 bp, Homo sapiens
gtggagagagataagcctggtc

SEQ ID NO: 6996623 - DNA, 22 bp, Homo sapiens
agattggttatttgataaggaa

SEQ ID NO: 6996624 - DNA, 19 bp, Homo sapiens
agtcatctcactgtgccca

SEQ ID NO: 6996625 - DNA, 22 bp, Homo sapiens
ggtgatttccttttgcaaagtc

SEQ ID NO: 6996626 - DNA, 22 bp, Homo sapiens
atatattttgaatagcctctgt

SEQ ID NO: 6996627 - DNA, 22 bp, Homo sapiens
cctgtgggagcccaggcagata

SEQ ID NO: 6996628 - DNA, 22 bp, Homo sapiens
tctcccaggtgggtgcctggag

SEQ ID NO: 6996629 - DNA, 22 bp, Homo sapiens
cctgctctccatacactttcta

SEQ ID NO: 6996630 - DNA, 21 bp, Homo sapiens
tggataaaggcacttttcatc

SEQ ID NO: 6996631 - DNA, 22 bp, Homo sapiens
gagagctccatgttcatgctgt

SEQ ID NO: 6996632 - DNA, 22 bp, Homo sapiens
tgttctggggttgagagacaat

SEQ ID NO: 6996633 - DNA, 22 bp, Homo sapiens
tttgtgttttcactagcagtgt

SEQ ID NO: 6996634 - DNA, 22 bp, Homo sapiens
gctgaggagcgagaactctgct

SEQ ID NO: 6996635 - DNA, 22 bp, Homo sapiens
tttaaaagttatcatctgtcca

SEQ ID NO: 6996636 - DNA, 22 bp, Homo sapiens
atggtttttcaagtattcagaa

SEQ ID NO: 6996637 - DNA, 22 bp, Homo sapiens
atatgctggagtacaggaaata

SEQ ID NO: 6996638 - DNA, 22 bp, Homo sapiens
ggaccctgcgtgtatccacact

SEQ ID NO: 6996639 - DNA, 21 bp, Homo sapiens
tggagtgcactcagagttggt

SEQ ID NO: 6996640 - DNA, 22 bp, Homo sapiens
aagtgattttcccaccatctac

SEQ ID NO: 6996641 - DNA, 22 bp, Homo sapiens
atagctgtattaattgttatga

SEQ ID NO: 6996642 - DNA, 22 bp, Homo sapiens
actctgctattgcagtgcaaaa

SEQ ID NO: 6996643 - DNA, 22 bp, Homo sapiens
tctggagtggaggtgccttggg

SEQ ID NO: 6996644 - DNA, 22 bp, Homo sapiens
ctggggactcattcagagcata

SEQ ID NO: 6996645 - DNA, 22 bp, Homo sapiens
aaaacacactggaccaatttaa

SEQ ID NO: 6996646 - DNA, 22 bp, Homo sapiens
ctgtcttctaccttcaacctcc

SEQ ID NO: 6996647 - DNA, 22 bp, Homo sapiens
ttggcttctgatgtattcctga

SEQ ID NO: 6996648 - DNA, 22 bp, Homo sapiens
agcaccctttgtgagcataagt

SEQ ID NO: 6996649 - DNA, 22 bp, Homo sapiens
aagcaggatggatctagtgttc

SEQ ID NO: 6996650 - DNA, 20 bp, Homo sapiens
tagaaatcttataaaagact

SEQ ID NO: 6996651 - DNA, 22 bp, Homo sapiens
attaagatgtgggaaaatttaa

SEQ ID NO: 6996652 - DNA, 22 bp, Homo sapiens
ttctgggcttgaaagtttaata

SEQ ID NO: 6996653 - DNA, 22 bp, Homo sapiens
tcacatcaggtgtctccccaag

SEQ ID NO: 6996654 - DNA, 22 bp, Homo sapiens
cttgattgcttctacgtgactg

SEQ ID NO: 6996655 - DNA, 22 bp, Homo sapiens
tatttgaagggagaaagtgcca

SEQ ID NO: 6996656 - DNA, 22 bp, Homo sapiens
aaactaggaagttcatcttatt

SEQ ID NO: 6996657 - DNA, 22 bp, Homo sapiens
tctagtcctaggagaggagtca

SEQ ID NO: 6996658 - DNA, 22 bp, Homo sapiens
actccaggcatctgcttctgct

SEQ ID NO: 6996659 - DNA, 22 bp, Homo sapiens
tggaggccgcgtagtctgagca

SEQ ID NO: 6996660 - DNA, 22 bp, Homo sapiens
agggccacagtggggcctgaga

SEQ ID NO: 6996661 - DNA, 22 bp, Homo sapiens
ctgctgttgccacctgcatgga

SEQ ID NO: 6996662 - DNA, 22 bp, Homo sapiens
ccttgtgtttacacctgtcttt

SEQ ID NO: 6996663 - DNA, 22 bp, Homo sapiens
tctaacacctgtcagatgtgat

SEQ ID NO: 6996664 - DNA, 22 bp, Homo sapiens
attcttcatacctactgaggtt

SEQ ID NO: 6996665 - DNA, 22 bp, Homo sapiens
catactttttagatctgccttc

SEQ ID NO: 6996666 - DNA, 20 bp, Homo sapiens
ggcagctctagtcgaggccc

SEQ ID NO: 6996667 - DNA, 22 bp, Homo sapiens
aaagcagggcgatgtcctcctc

SEQ ID NO: 6996668 - DNA, 22 bp, Homo sapiens
cttgctggtgtcgtgccttcac

SEQ ID NO: 6996669 - DNA, 22 bp, Homo sapiens
agactacatatgccacatgaag

SEQ ID NO: 6996670 - DNA, 22 bp, Homo sapiens
agtcaggagatattttgatatg

SEQ ID NO: 6996671 - DNA, 22 bp, Homo sapiens
aaccaaatggatggtaagaggg

SEQ ID NO: 6996672 - DNA, 22 bp, Homo sapiens
ctgttgtctatataagtttttc

SEQ ID NO: 6996673 - DNA, 21 bp, Homo sapiens
cttaagatggcatagtacgaa

SEQ ID NO: 6996674 - DNA, 22 bp, Homo sapiens
ttcattttctttcacgctgctg

SEQ ID NO: 6996675 - DNA, 23 bp, Homo sapiens
aaagtacttccacagctatgatc

SEQ ID NO: 6996676 - DNA, 22 bp, Homo sapiens
attcttttaagccccagggatt

SEQ ID NO: 6996677 - DNA, 18 bp, Homo sapiens
tctccacttctgtgagaa

SEQ ID NO: 6996678 - DNA, 22 bp, Homo sapiens
tttagcagatctatgtatgtga

SEQ ID NO: 6996679 - DNA, 21 bp, Homo sapiens
ttgtgtttccccagtcacttt

SEQ ID NO: 6996680 - DNA, 22 bp, Homo sapiens
ctggtccagaatttatgattct

SEQ ID NO: 6996681 - DNA, 22 bp, Homo sapiens
tctgggctctgtcagcacctct

SEQ ID NO: 6996682 - DNA, 22 bp, Homo sapiens
aacatcatcctttgagtattta

SEQ ID NO: 6996683 - DNA, 22 bp, Homo sapiens
tatagtacatggaatcttcata

SEQ ID NO: 6996684 - DNA, 22 bp, Homo sapiens
aacattgccatggttaatttta

SEQ ID NO: 6996685 - DNA, 22 bp, Homo sapiens
gactttattcgttaactgttaa

SEQ ID NO: 6996686 - DNA, 22 bp, Homo sapiens
tactgtatactactgctgttct

SEQ ID NO: 6996687 - DNA, 21 bp, Homo sapiens
ggtgcaggtaatgatgatata

SEQ ID NO: 6996688 - DNA, 22 bp, Homo sapiens
atcaacagagcaaagcctgaac

SEQ ID NO: 6996689 - DNA, 22 bp, Homo sapiens
attattggtacaccgtagtcat

SEQ ID NO: 6996690 - DNA, 22 bp, Homo sapiens
ttcattgatagttttatgtatg

SEQ ID NO: 6996691 - DNA, 22 bp, Homo sapiens
atggccaactgaaatgaaagat

SEQ ID NO: 6996692 - DNA, 18 bp, Homo sapiens
gatgggtaaaggcataaa

SEQ ID NO: 6996693 - DNA, 22 bp, Homo sapiens
gagtgacaggaatatttatctg

SEQ ID NO: 6996694 - DNA, 22 bp, Homo sapiens
gaaagttgcaatcatggctttt

SEQ ID NO: 6996695 - DNA, 22 bp, Homo sapiens
agctggaggataactcacttct

SEQ ID NO: 6996696 - DNA, 22 bp, Homo sapiens
tccttaaaggactagaagtcaa

SEQ ID NO: 6996697 - DNA, 22 bp, Homo sapiens
gcaggacaaaatttccagggtg

SEQ ID NO: 6996698 - DNA, 22 bp, Homo sapiens
gatgctttctcctttctccacc

SEQ ID NO: 6996699 - DNA, 22 bp, Homo sapiens
gaaattgaaagaccaactgcat

SEQ ID NO: 6996700 - DNA, 19 bp, Homo sapiens
cctgagtgtttcagagaca

SEQ ID NO: 6996701 - DNA, 22 bp, Homo sapiens
ggtgtgcatggcacagggcttg

SEQ ID NO: 6996702 - DNA, 22 bp, Homo sapiens
agagcaattagcttaggtaaaa

SEQ ID NO: 6996703 - DNA, 22 bp, Homo sapiens
aaggagaagtctgttgagattg

SEQ ID NO: 6996704 - DNA, 22 bp, Homo sapiens
tttatccacagtatccaaaatc

SEQ ID NO: 6996705 - DNA, 22 bp, Homo sapiens
catgataattgttaacaaagta

SEQ ID NO: 6996706 - DNA, 22 bp, Homo sapiens
tttaacagatgaggaggtgagg

SEQ ID NO: 6996707 - DNA, 22 bp, Homo sapiens
atacacttgtacattttttaat

SEQ ID NO: 6996708 - DNA, 22 bp, Homo sapiens
ctgtgacttgccaaaggtcatt

SEQ ID NO: 6996709 - DNA, 22 bp, Homo sapiens
gaagacattaagtctatgtcac

SEQ ID NO: 6996710 - DNA, 22 bp, Homo sapiens
tggagtaagagccaccagccaa

SEQ ID NO: 6996711 - DNA, 22 bp, Homo sapiens
cccacacacatttatgatagga

SEQ ID NO: 6996712 - DNA, 21 bp, Homo sapiens
atccatccatcttggcctaac

SEQ ID NO: 6996713 - DNA, 22 bp, Homo sapiens
gctgcaggcattttcctgggca

SEQ ID NO: 6996714 - DNA, 22 bp, Homo sapiens
atttgctttcccttccctgaca

SEQ ID NO: 6996715 - DNA, 22 bp, Homo sapiens
tctcgggctgtgcctctagcca

SEQ ID NO: 6996716 - DNA, 22 bp, Homo sapiens
gatgtcttggcttgctctctgt

SEQ ID NO: 6996717 - DNA, 22 bp, Homo sapiens
tgacatctggagtctgggctgt

SEQ ID NO: 6996718 - DNA, 22 bp, Homo sapiens
cagtatgcagttgaaaataagc

SEQ ID NO: 6996719 - DNA, 22 bp, Homo sapiens
tatctgattaatcagtgctttg

SEQ ID NO: 6996720 - DNA, 23 bp, Homo sapiens
aggcttcctatcttagagctggg

SEQ ID NO: 6996721 - DNA, 22 bp, Homo sapiens
ggctccctgttctattccctgg

SEQ ID NO: 6996722 - DNA, 22 bp, Homo sapiens
attcagaaatagaaaatttgat

SEQ ID NO: 6996723 - DNA, 22 bp, Homo sapiens
agtcagttcatggctctgtcct

SEQ ID NO: 6996724 - DNA, 22 bp, Homo sapiens
atgtggttgcctttctgtcctt

SEQ ID NO: 6996725 - DNA, 22 bp, Homo sapiens
taggccttgaattgagggatgt

SEQ ID NO: 6996726 - DNA, 21 bp, Homo sapiens
aggcctccctgttgacagggc

SEQ ID NO: 6996727 - DNA, 22 bp, Homo sapiens
tgacgtgaaggctgaagttcac

SEQ ID NO: 6996728 - DNA, 22 bp, Homo sapiens
taagttggctgttgctatagtt

SEQ ID NO: 6996729 - DNA, 22 bp, Homo sapiens
ttttgcctaagaatctctctga

SEQ ID NO: 6996730 - DNA, 22 bp, Homo sapiens
aggccagctgccacccggtccg

SEQ ID NO: 6996731 - DNA, 22 bp, Homo sapiens
tgggataaggtatgtgaagtac

SEQ ID NO: 6996732 - DNA, 22 bp, Homo sapiens
agacaggctgctgtctgctagg

SEQ ID NO: 6996733 - DNA, 19 bp, Homo sapiens
tgtgtcagatttgctcctt

SEQ ID NO: 6996734 - DNA, 22 bp, Homo sapiens
cagaggggataacaggtgtaga

SEQ ID NO: 6996735 - DNA, 22 bp, Homo sapiens
gtttcagctcttcctggaacca

SEQ ID NO: 6996736 - DNA, 22 bp, Homo sapiens
tgaaaaactttaatccataaag

SEQ ID NO: 6996737 - DNA, 22 bp, Homo sapiens
gagggccacttgaatgttttca

SEQ ID NO: 6996738 - DNA, 22 bp, Homo sapiens
ccttgccctgagcaggggtcag

SEQ ID NO: 6996739 - DNA, 22 bp, Homo sapiens
agttaccagccgtaagaagcat

SEQ ID NO: 6996740 - DNA, 22 bp, Homo sapiens
tggagcaggaaacatctagagg

SEQ ID NO: 6996741 - DNA, 20 bp, Homo sapiens
cattgcaggcagagtaagtg

SEQ ID NO: 6996742 - DNA, 22 bp, Homo sapiens
atgtgggtgagtgagagataga

SEQ ID NO: 6996743 - DNA, 22 bp, Homo sapiens
cggtgggattcccagcgacttc

SEQ ID NO: 6996744 - DNA, 22 bp, Homo sapiens
atgtttcatttagatatcaggc

SEQ ID NO: 6996745 - DNA, 22 bp, Homo sapiens
aatgtgcaggctcaaaccttgt

SEQ ID NO: 6996746 - DNA, 22 bp, Homo sapiens
taaattatgtcacatgactctg

SEQ ID NO: 6996747 - DNA, 20 bp, Homo sapiens
gggaatgtgccccttacccc

SEQ ID NO: 6996748 - DNA, 22 bp, Homo sapiens
gcactggagatggggttgtcgg

SEQ ID NO: 6996749 - DNA, 22 bp, Homo sapiens
tggctgccaatggcttggaaag

SEQ ID NO: 6996750 - DNA, 22 bp, Homo sapiens
tctggagtgtccagttctactc

SEQ ID NO: 6996751 - DNA, 22 bp, Homo sapiens
taattttgtattgccattgtag

SEQ ID NO: 6996752 - DNA, 22 bp, Homo sapiens
tgagatcatgtgtggaccccag

SEQ ID NO: 6996753 - DNA, 22 bp, Homo sapiens
ttagagaattccaaatgactac

SEQ ID NO: 6996754 - DNA, 22 bp, Homo sapiens
gcctgcctggagcttgaggtga

SEQ ID NO: 6996755 - DNA, 22 bp, Homo sapiens
cttgctggcagtcactgttgcg

SEQ ID NO: 6996756 - DNA, 22 bp, Homo sapiens
tttgcaatagtcctggcctgta

SEQ ID NO: 6996757 - DNA, 21 bp, Homo sapiens
atttccaagggtacctaagat

SEQ ID NO: 6996758 - DNA, 22 bp, Homo sapiens
tgcctggatggctctgagcagg

SEQ ID NO: 6996759 - DNA, 22 bp, Homo sapiens
gcaggaaccccgggaggctggc

SEQ ID NO: 6996760 - DNA, 22 bp, Homo sapiens
gggcccagcgtggttccatctg

SEQ ID NO: 6996761 - DNA, 22 bp, Homo sapiens
actgcactccagcctgggcgac

SEQ ID NO: 6996762 - DNA, 21 bp, Homo sapiens
gcattcttcatgtgattcaga

SEQ ID NO: 6996763 - DNA, 22 bp, Homo sapiens
aaggcagtcaaagcagacttct

SEQ ID NO: 6996764 - DNA, 16 bp, Homo sapiens
aggaccatatgtcatt

SEQ ID NO: 6996765 - DNA, 22 bp, Homo sapiens
ttcccacaatctgcgtgtgtat

SEQ ID NO: 6996766 - DNA, 22 bp, Homo sapiens
atgcaagacccagaaatcatta

SEQ ID NO: 6996767 - DNA, 22 bp, Homo sapiens
acaaattgcctagtctagcatc

SEQ ID NO: 6996768 - DNA, 22 bp, Homo sapiens
agtgcatggtcaagctaaacca

SEQ ID NO: 6996769 - DNA, 22 bp, Homo sapiens
gggacagaaggaagtgagcaca

SEQ ID NO: 6996770 - DNA, 22 bp, Homo sapiens
gcttctgtatttattgtccttt

SEQ ID NO: 6996771 - DNA, 22 bp, Homo sapiens
gaaccattgttgaaaagaatag

SEQ ID NO: 6996772 - DNA, 22 bp, Homo sapiens
cctgtggtttacatgacagtta

SEQ ID NO: 6996773 - DNA, 22 bp, Homo sapiens
ctgggtgcttactttgtgctag

SEQ ID NO: 6996774 - DNA, 22 bp, Homo sapiens
ttactcttaatggcaacaactg

SEQ ID NO: 6996775 - DNA, 22 bp, Homo sapiens
tactttaatatatgtgaagttc

SEQ ID NO: 6996776 - DNA, 22 bp, Homo sapiens
gtgattctgcctggaaggtcct

SEQ ID NO: 6996777 - DNA, 22 bp, Homo sapiens
tctgttggcttgagatttaatt

SEQ ID NO: 6996778 - DNA, 22 bp, Homo sapiens
ctcaagtctgagtactggctct

SEQ ID NO: 6996779 - DNA, 22 bp, Homo sapiens
tgtaaactccttggtgtgtgaa

SEQ ID NO: 6996780 - DNA, 22 bp, Homo sapiens
cagtgcctggccggcttccatt

SEQ ID NO: 6996781 - DNA, 22 bp, Homo sapiens
tgagtcagtgacatgaacttgt

SEQ ID NO: 6996782 - DNA, 22 bp, Homo sapiens
aaatggcatagaggtgaaggta

SEQ ID NO: 6996783 - DNA, 20 bp, Homo sapiens
gctgtgtagcagtgtgcagt

SEQ ID NO: 6996784 - DNA, 22 bp, Homo sapiens
aataatgtctgctattttaaaa

SEQ ID NO: 6996785 - DNA, 22 bp, Homo sapiens
gttccaaacaagtcataaagta

SEQ ID NO: 6996786 - DNA, 18 bp, Homo sapiens
tcagaggagatacctaaa

SEQ ID NO: 6996787 - DNA, 20 bp, Homo sapiens
tcccactcttgtgttttcag

SEQ ID NO: 6996788 - DNA, 22 bp, Homo sapiens
caggagctgggtctggaagcag

SEQ ID NO: 6996789 - DNA, 22 bp, Homo sapiens
gaggccaatgaagtgagtttaa

SEQ ID NO: 6996790 - DNA, 22 bp, Homo sapiens
agcagttttagggagacacatt

SEQ ID NO: 6996791 - DNA, 22 bp, Homo sapiens
actcctggttcccagttgagat

SEQ ID NO: 6996792 - DNA, 22 bp, Homo sapiens
ctgggtagggcaaggaactggc

SEQ ID NO: 6996793 - DNA, 22 bp, Homo sapiens
cagaaatatatatgggtcagag

SEQ ID NO: 6996794 - DNA, 22 bp, Homo sapiens
tatcagtttattctataaatag

SEQ ID NO: 6996795 - DNA, 22 bp, Homo sapiens
tatgagtttaaggctaaaatag

SEQ ID NO: 6996796 - DNA, 22 bp, Homo sapiens
ttcatacatttttactaacagc

SEQ ID NO: 6996797 - DNA, 22 bp, Homo sapiens
ggttcacatattgagagtattc

SEQ ID NO: 6996798 - DNA, 22 bp, Homo sapiens
aaactgagattgctgctgtctg

SEQ ID NO: 6996799 - DNA, 22 bp, Homo sapiens
gaaatctgcccagtgcactggt

SEQ ID NO: 6996800 - DNA, 22 bp, Homo sapiens
catctcatcagtgagagtcagc

SEQ ID NO: 6996801 - DNA, 22 bp, Homo sapiens
aagcagaatttaatagaaaggt

SEQ ID NO: 6996802 - DNA, 22 bp, Homo sapiens
tggctagccgaggggtgggccc

SEQ ID NO: 6996803 - DNA, 22 bp, Homo sapiens
taatgtacctcattctttctag

SEQ ID NO: 6996804 - DNA, 22 bp, Homo sapiens
ttgaaagtcacaatggcattaa

SEQ ID NO: 6996805 - DNA, 22 bp, Homo sapiens
catctgtcacctgtgaatgttg

SEQ ID NO: 6996806 - DNA, 22 bp, Homo sapiens
attctaattagttctacatgtt

SEQ ID NO: 6996807 - DNA, 22 bp, Homo sapiens
tcctccagaaactgaggcagaa

SEQ ID NO: 6996808 - DNA, 22 bp, Homo sapiens
aaacaaacaattagttgtgtgg

SEQ ID NO: 6996809 - DNA, 22 bp, Homo sapiens
tggctattcttgttgctgtgtg

SEQ ID NO: 6996810 - DNA, 22 bp, Homo sapiens
agggccagcagcttggccaacc

SEQ ID NO: 6996811 - DNA, 22 bp, Homo sapiens
ttatttgaatctggctagagaa

SEQ ID NO: 6996812 - DNA, 22 bp, Homo sapiens
tccctgggagatgatgatgagg

SEQ ID NO: 6996813 - DNA, 22 bp, Homo sapiens
tgagctgtactcctccccaggg

SEQ ID NO: 6996814 - DNA, 22 bp, Homo sapiens
tgggaaattgtatttctatttc

SEQ ID NO: 6996815 - DNA, 22 bp, Homo sapiens
gctgggagccgtacctgtcacg

SEQ ID NO: 6996816 - DNA, 22 bp, Homo sapiens
agggctgctgctccgggcccag

SEQ ID NO: 6996817 - DNA, 22 bp, Homo sapiens
taccaacccttcatgccgtacc

SEQ ID NO: 6996818 - DNA, 17 bp, Homo sapiens
tctgctctgccaatcca

SEQ ID NO: 6996819 - DNA, 22 bp, Homo sapiens
tatgaaattgccatttttatgg

SEQ ID NO: 6996820 - DNA, 22 bp, Homo sapiens
ctccttaaattacgaacccact

SEQ ID NO: 6996821 - DNA, 22 bp, Homo sapiens
gcacagctctccccaagacgaa

SEQ ID NO: 6996822 - DNA, 22 bp, Homo sapiens
gcatgcacacactttctcacta

SEQ ID NO: 6996823 - DNA, 22 bp, Homo sapiens
agtcccagttcggttcttcctc

SEQ ID NO: 6996824 - DNA, 20 bp, Homo sapiens
cattggacttggcttcatgg

SEQ ID NO: 6996825 - DNA, 22 bp, Homo sapiens
aggatacaaaacgtcttgcaga

SEQ ID NO: 6996826 - DNA, 22 bp, Homo sapiens
acagcacttattcagcacagtg

SEQ ID NO: 6996827 - DNA, 22 bp, Homo sapiens
taaggcttcagcattcaaaaca

SEQ ID NO: 6996828 - DNA, 22 bp, Homo sapiens
ataaagcatactttgtatgact

SEQ ID NO: 6996829 - DNA, 22 bp, Homo sapiens
aaatgtctgagacttctgaact

SEQ ID NO: 6996830 - DNA, 22 bp, Homo sapiens
agaaagttcactggtatatttt

SEQ ID NO: 6996831 - DNA, 22 bp, Homo sapiens
ctgtggaatcgggaaaagacag

SEQ ID NO: 6996832 - DNA, 22 bp, Homo sapiens
aatgcttttacgacatgtacct

SEQ ID NO: 6996833 - DNA, 22 bp, Homo sapiens
aagctatacaatgcacaaatga

SEQ ID NO: 6996834 - DNA, 21 bp, Homo sapiens
caaggatttgagccaggagag

SEQ ID NO: 6996835 - DNA, 22 bp, Homo sapiens
cacactttgttgaagttttcat

SEQ ID NO: 6996836 - DNA, 22 bp, Homo sapiens
aaaggaagatctatacacccca

SEQ ID NO: 6996837 - DNA, 23 bp, Homo sapiens
agacatatgttctttccagatat

SEQ ID NO: 6996838 - DNA, 22 bp, Homo sapiens
tggagcccctcacccacacctg

SEQ ID NO: 6996839 - DNA, 22 bp, Homo sapiens
ctttgaattaacgacacaagtg

SEQ ID NO: 6996840 - DNA, 19 bp, Homo sapiens
agtgaactccatatcaggt

SEQ ID NO: 6996841 - DNA, 22 bp, Homo sapiens
aagtctctaagactgtgccatc

SEQ ID NO: 6996842 - DNA, 22 bp, Homo sapiens
tcatccctctgccaggcccagg

SEQ ID NO: 6996843 - DNA, 22 bp, Homo sapiens
ttcagtgttcttttctgttagc

SEQ ID NO: 6996844 - DNA, 22 bp, Homo sapiens
actgctattttataacagaaga

SEQ ID NO: 6996845 - DNA, 22 bp, Homo sapiens
ccatagtgccaagtcttcagca

SEQ ID NO: 6996846 - DNA, 22 bp, Homo sapiens
agcttctcaagtgtttgcgggg

SEQ ID NO: 6996847 - DNA, 18 bp, Homo sapiens
aactaaagatctttaagc

SEQ ID NO: 6996848 - DNA, 22 bp, Homo sapiens
actgggaggcatctggagctga

SEQ ID NO: 6996849 - DNA, 22 bp, Homo sapiens
cagactggccacatctgcactg

SEQ ID NO: 6996850 - DNA, 22 bp, Homo sapiens
attggcatatccacgacaatgc

SEQ ID NO: 6996851 - DNA, 22 bp, Homo sapiens
gctggtccactccctggaggct

SEQ ID NO: 6996852 - DNA, 22 bp, Homo sapiens
gaatttgaaaagtgatgggaat

SEQ ID NO: 6996853 - DNA, 22 bp, Homo sapiens
gagcttccctctgcagtccctg

SEQ ID NO: 6996854 - DNA, 22 bp, Homo sapiens
tttgtgcaggtataggcggaga

SEQ ID NO: 6996855 - DNA, 20 bp, Homo sapiens
ccttcagaacttacatagta

SEQ ID NO: 6996856 - DNA, 22 bp, Homo sapiens
agtctaggcagccctgcagggt

SEQ ID NO: 6996857 - DNA, 22 bp, Homo sapiens
gctcaggctggattgcagtggc

SEQ ID NO: 6996858 - DNA, 19 bp, Homo sapiens
actttgcatgtgtgtctaa

SEQ ID NO: 6996859 - DNA, 22 bp, Homo sapiens
taatacactgctttttgtaact

SEQ ID NO: 6996860 - DNA, 22 bp, Homo sapiens
tgaattctcagaaggcaagggc

SEQ ID NO: 6996861 - DNA, 22 bp, Homo sapiens
ttgcatccgggctacttccaca

SEQ ID NO: 6996862 - DNA, 22 bp, Homo sapiens
atccttccttcatttgacaggt

SEQ ID NO: 6996863 - DNA, 22 bp, Homo sapiens
tagcacagggcatatgcggtgg

SEQ ID NO: 6996864 - DNA, 22 bp, Homo sapiens
acagtgtctgacacgtaggaag

SEQ ID NO: 6996865 - DNA, 22 bp, Homo sapiens
aggcaaagaagttggtcaggag

SEQ ID NO: 6996866 - DNA, 22 bp, Homo sapiens
acaggcagcaaaatcagcctca

SEQ ID NO: 6996867 - DNA, 22 bp, Homo sapiens
ccttgcatgtgctaacgacaag

SEQ ID NO: 6996868 - DNA, 22 bp, Homo sapiens
tcttagaaactgtatcgattag

SEQ ID NO: 6996869 - DNA, 22 bp, Homo sapiens
tgtactgtatcattgcaacttt

SEQ ID NO: 6996870 - DNA, 22 bp, Homo sapiens
aacagtgtgttttgttattaag

SEQ ID NO: 6996871 - DNA, 22 bp, Homo sapiens
aggcactgtgcagtcccaagca

SEQ ID NO: 6996872 - DNA, 22 bp, Homo sapiens
aacggctagcaggggtgtcatg

SEQ ID NO: 6996873 - DNA, 22 bp, Homo sapiens
gccttaggggtcagacagagct

SEQ ID NO: 6996874 - DNA, 22 bp, Homo sapiens
gggcaagctttgaacatcagca

SEQ ID NO: 6996875 - DNA, 20 bp, Homo sapiens
tatatgtgtacatacacaca

SEQ ID NO: 6996876 - DNA, 23 bp, Homo sapiens
actgttggtgcagaagtgccttg

SEQ ID NO: 6996877 - DNA, 19 bp, Homo sapiens
tccagggcaggaacatgta

SEQ ID NO: 6996878 - DNA, 22 bp, Homo sapiens
tattgcatcatcctgcaggggt

SEQ ID NO: 6996879 - DNA, 22 bp, Homo sapiens
tgcgtactgtttatacatgtgt

SEQ ID NO: 6996880 - DNA, 22 bp, Homo sapiens
actggcccgggagcagaggcct

SEQ ID NO: 6996881 - DNA, 18 bp, Homo sapiens
gagtgtggcactgggccc

SEQ ID NO: 6996882 - DNA, 22 bp, Homo sapiens
ctaattgtaagctccttgaggg

SEQ ID NO: 6996883 - DNA, 22 bp, Homo sapiens
taaacgtgcttcatatttttag

SEQ ID NO: 6996884 - DNA, 22 bp, Homo sapiens
catcagcaggcaacactcttgg

SEQ ID NO: 6996885 - DNA, 22 bp, Homo sapiens
agtgatgttaataaatgatgtt

SEQ ID NO: 6996886 - DNA, 22 bp, Homo sapiens
cccttagaacaacattagcata

SEQ ID NO: 6996887 - DNA, 22 bp, Homo sapiens
gaaaggtcttccggtcttccag

SEQ ID NO: 6996888 - DNA, 22 bp, Homo sapiens
cctgaatgctggttcctctcct

SEQ ID NO: 6996889 - DNA, 22 bp, Homo sapiens
atatttcacgtaggttgttttc

SEQ ID NO: 6996890 - DNA, 22 bp, Homo sapiens
tccctggggtaacattagaggg

SEQ ID NO: 6996891 - DNA, 22 bp, Homo sapiens
aagctgcctgggaggaagggct

SEQ ID NO: 6996892 - DNA, 22 bp, Homo sapiens
aagacctgcatgcggactaaca

SEQ ID NO: 6996893 - DNA, 22 bp, Homo sapiens
acaattcactccagtgacccca

SEQ ID NO: 6996894 - DNA, 22 bp, Homo sapiens
cctcttgccaatcagctacaga

SEQ ID NO: 6996895 - DNA, 22 bp, Homo sapiens
agggctctttaggccgaggcca

SEQ ID NO: 6996896 - DNA, 22 bp, Homo sapiens
ctggaagagtgactttgcattt

SEQ ID NO: 6996897 - DNA, 19 bp, Homo sapiens
cttcctggaggagagcctc

SEQ ID NO: 6996898 - DNA, 22 bp, Homo sapiens
caggaagctgagctgcactgca

SEQ ID NO: 6996899 - DNA, 22 bp, Homo sapiens
tcagtctttaaaagctcaggaa

SEQ ID NO: 6996900 - DNA, 22 bp, Homo sapiens
cacctagggtttcgcctttctt

SEQ ID NO: 6996901 - DNA, 22 bp, Homo sapiens
cctccctctttcagtcccacag

SEQ ID NO: 6996902 - DNA, 22 bp, Homo sapiens
agcccttcaacctgcctactcc

SEQ ID NO: 6996903 - DNA, 22 bp, Homo sapiens
ttcaaactcacactagggagac

SEQ ID NO: 6996904 - DNA, 22 bp, Homo sapiens
ttctcttgactaccagttagga

SEQ ID NO: 6996905 - DNA, 22 bp, Homo sapiens
aggggcctggcactgagctggc

SEQ ID NO: 6996906 - DNA, 22 bp, Homo sapiens
atccttaggtggtgcatcaggg

SEQ ID NO: 6996907 - DNA, 22 bp, Homo sapiens
gctgggctctttacccctgtac

SEQ ID NO: 6996908 - DNA, 22 bp, Homo sapiens
aattgcagcagcttcagcagtt

SEQ ID NO: 6996909 - DNA, 22 bp, Homo sapiens
tagattctcccatcatgagatg

SEQ ID NO: 6996910 - DNA, 22 bp, Homo sapiens
agagtgacagccactgcagtaa

SEQ ID NO: 6996911 - DNA, 22 bp, Homo sapiens
ggaggccaggaaggctcggaga

SEQ ID NO: 6996912 - DNA, 22 bp, Homo sapiens
tccaggaatagtcatgttttag

SEQ ID NO: 6996913 - DNA, 22 bp, Homo sapiens
gcttctgtgagtgcagatgctg

SEQ ID NO: 6996914 - DNA, 22 bp, Homo sapiens
ctctaggccatccagggccatt

SEQ ID NO: 6996915 - DNA, 19 bp, Homo sapiens
gcaggcagctggggtatcc

SEQ ID NO: 6996916 - DNA, 22 bp, Homo sapiens
ggcacctggaggtttactggat

SEQ ID NO: 6996917 - DNA, 17 bp, Homo sapiens
ggcagcctcaggcgttt

SEQ ID NO: 6996918 - DNA, 22 bp, Homo sapiens
ggcctgagcagacagcatgatg

SEQ ID NO: 6996919 - DNA, 22 bp, Homo sapiens
ctgtgtcttcacatttgtgtgc

SEQ ID NO: 6996920 - DNA, 22 bp, Homo sapiens
acatttaaatacctatgtttct

SEQ ID NO: 6996921 - DNA, 19 bp, Homo sapiens
atctagattattgagaagg

SEQ ID NO: 6996922 - DNA, 22 bp, Homo sapiens
tgctattacctgctggacagtc

SEQ ID NO: 6996923 - DNA, 22 bp, Homo sapiens
ccagctgcaggtgttccagatg

SEQ ID NO: 6996924 - DNA, 22 bp, Homo sapiens
gtgcatgaagcaggcagctcct

SEQ ID NO: 6996925 - DNA, 21 bp, Homo sapiens
tgggcctgattcccagggtca

SEQ ID NO: 6996926 - DNA, 22 bp, Homo sapiens
taaactgtgaaaggcttaacat

SEQ ID NO: 6996927 - DNA, 22 bp, Homo sapiens
ccactgtgagcatgaacaggac

SEQ ID NO: 6996928 - DNA, 22 bp, Homo sapiens
caggttcagcaggaggcatccc

SEQ ID NO: 6996929 - DNA, 22 bp, Homo sapiens
aggctgccgcagccaatggttg

SEQ ID NO: 6996930 - DNA, 22 bp, Homo sapiens
gtcagcatagttcacacacagt

SEQ ID NO: 6996931 - DNA, 22 bp, Homo sapiens
agcagcagcattgagcgcttgt

SEQ ID NO: 6996932 - DNA, 22 bp, Homo sapiens
ctgcaagccagggagagatgcc

SEQ ID NO: 6996933 - DNA, 22 bp, Homo sapiens
tggccttgaaccaggtctccac

SEQ ID NO: 6996934 - DNA, 22 bp, Homo sapiens
ccacagtcctggcttctgtctg

SEQ ID NO: 6996935 - DNA, 22 bp, Homo sapiens
tcggagcgtcactggctggagg

SEQ ID NO: 6996936 - DNA, 22 bp, Homo sapiens
tggattgataagagacaagtga

SEQ ID NO: 6996937 - DNA, 22 bp, Homo sapiens
attccacataggccttcatgac

SEQ ID NO: 6996938 - DNA, 22 bp, Homo sapiens
tgaactgcaggaatctcagtgg

SEQ ID NO: 6996939 - DNA, 22 bp, Homo sapiens
cagaacagaatcgtgtggtgag

SEQ ID NO: 6996940 - DNA, 22 bp, Homo sapiens
tcagatttctgaaagccctctc

SEQ ID NO: 6996941 - DNA, 22 bp, Homo sapiens
aacttgaaccacagaagctgcc

SEQ ID NO: 6996942 - DNA, 22 bp, Homo sapiens
tacttacagttgatcgatgtat

SEQ ID NO: 6996943 - DNA, 22 bp, Homo sapiens
tgtgaaggtaaggtttgcttga

SEQ ID NO: 6996944 - DNA, 22 bp, Homo sapiens
tgaattcaggttgacgttgcca

SEQ ID NO: 6996945 - DNA, 22 bp, Homo sapiens
accctagttggttgtagaagga

SEQ ID NO: 6996946 - DNA, 22 bp, Homo sapiens
ttctgtcctgttggatgaatca

SEQ ID NO: 6996947 - DNA, 22 bp, Homo sapiens
acctcctatgcctggggccagt

SEQ ID NO: 6996948 - DNA, 22 bp, Homo sapiens
aggtcacaggctttgaaatcaa

SEQ ID NO: 6996949 - DNA, 22 bp, Homo sapiens
cagtcctgtgtcccttggtggg

SEQ ID NO: 6996950 - DNA, 22 bp, Homo sapiens
caatctgagttgggaatgtatt

SEQ ID NO: 6996951 - DNA, 22 bp, Homo sapiens
ctctggaggcctaaggaagtgg

SEQ ID NO: 6996952 - DNA, 22 bp, Homo sapiens
gcctctggtccctcatgctgtg

SEQ ID NO: 6996953 - DNA, 22 bp, Homo sapiens
acctgttttagtctttaatcat

SEQ ID NO: 6996954 - DNA, 22 bp, Homo sapiens
aacatctttacaacagacctag

SEQ ID NO: 6996955 - DNA, 22 bp, Homo sapiens
atagtatgagctcatacacttg

SEQ ID NO: 6996956 - DNA, 22 bp, Homo sapiens
atacatcacctatatattcaca

SEQ ID NO: 6996957 - DNA, 23 bp, Homo sapiens
tttaccactatgtttcacaagtt

SEQ ID NO: 6996958 - DNA, 22 bp, Homo sapiens
gcaaagtctgcatctggatcag

SEQ ID NO: 6996959 - DNA, 22 bp, Homo sapiens
gggacctcgcatgcacgaagcc

SEQ ID NO: 6996960 - DNA, 22 bp, Homo sapiens
tgctgccatgcagagcaacaga

SEQ ID NO: 6996961 - DNA, 22 bp, Homo sapiens
ttggccaaagctcaccagtgct

SEQ ID NO: 6996962 - DNA, 22 bp, Homo sapiens
ctgaatgagtggatttttcatt

SEQ ID NO: 6996963 - DNA, 22 bp, Homo sapiens
gcctgcctagaattgcagcttt

SEQ ID NO: 6996964 - DNA, 22 bp, Homo sapiens
ctgacagctgctgccgccgcat

SEQ ID NO: 6996965 - DNA, 22 bp, Homo sapiens
atggctgagatgggctccaggc

SEQ ID NO: 6996966 - DNA, 22 bp, Homo sapiens
gctgctttacaggtgggggagc

SEQ ID NO: 6996967 - DNA, 22 bp, Homo sapiens
atacagtcagactttagccatt

SEQ ID NO: 6996968 - DNA, 22 bp, Homo sapiens
ttacatgatgatttcataaaca

SEQ ID NO: 6996969 - DNA, 19 bp, Homo sapiens
ccaggagtggtggggtgag

SEQ ID NO: 6996970 - DNA, 19 bp, Homo sapiens
tgcagaagacacagtggtg

SEQ ID NO: 6996971 - DNA, 22 bp, Homo sapiens
aataggcagcttagcaggggct

SEQ ID NO: 6996972 - DNA, 22 bp, Homo sapiens
tggctcaggataattttcccaa

SEQ ID NO: 6996973 - DNA, 22 bp, Homo sapiens
gtttgtaaccagaacagagagt

SEQ ID NO: 6996974 - DNA, 22 bp, Homo sapiens
atttgccatgaagagtgtttga

SEQ ID NO: 6996975 - DNA, 22 bp, Homo sapiens
tccccaggggcatctctctgct

SEQ ID NO: 6996976 - DNA, 22 bp, Homo sapiens
ttttctaaaagaagtcactgat

SEQ ID NO: 6996977 - DNA, 23 bp, Homo sapiens
agaaatcatctccaccccatgtc

SEQ ID NO: 6996978 - DNA, 22 bp, Homo sapiens
cgagcagaatggagggtgccga

SEQ ID NO: 6996979 - DNA, 20 bp, Homo sapiens
tcacacatggtaagctatga

SEQ ID NO: 6996980 - DNA, 22 bp, Homo sapiens
ggcaggcaagtctgctctgtga

SEQ ID NO: 6996981 - DNA, 22 bp, Homo sapiens
tagactcagacagaaaatgtgt

SEQ ID NO: 6996982 - DNA, 22 bp, Homo sapiens
cagtccagctcatcagtggcac

SEQ ID NO: 6996983 - DNA, 22 bp, Homo sapiens
tagggctcagctctagctcctg

SEQ ID NO: 6996984 - DNA, 22 bp, Homo sapiens
ccagagcagaaccggaacacca

SEQ ID NO: 6996985 - DNA, 17 bp, Homo sapiens
gccagttgtcttggcat

SEQ ID NO: 6996986 - DNA, 22 bp, Homo sapiens
tctggagagcagatgcctctgg

SEQ ID NO: 6996987 - DNA, 22 bp, Homo sapiens
aagtcttgatgatctcctcctt

SEQ ID NO: 6996988 - DNA, 22 bp, Homo sapiens
tccttcagaggataaggaagaa

SEQ ID NO: 6996989 - DNA, 22 bp, Homo sapiens
attctgaggacagagtctagca

SEQ ID NO: 6996990 - DNA, 20 bp, Homo sapiens
ttctagggggagccacaaag

SEQ ID NO: 6996991 - DNA, 22 bp, Homo sapiens
tgctctatttcttcacctacaa

SEQ ID NO: 6996992 - DNA, 22 bp, Homo sapiens
ctttccaccaactcacttccct

SEQ ID NO: 6996993 - DNA, 22 bp, Homo sapiens
cactacttgaaagaattacaga

SEQ ID NO: 6996994 - DNA, 22 bp, Homo sapiens
cttgggcaggggaaacagctgc

SEQ ID NO: 6996995 - DNA, 22 bp, Homo sapiens
tggaggtgtggagtcaaaggga

SEQ ID NO: 6996996 - DNA, 22 bp, Homo sapiens
aactctggtccaggctagtgcc

SEQ ID NO: 6996997 - DNA, 22 bp, Homo sapiens
cccagaataggtaagcccaggg

SEQ ID NO: 6996998 - DNA, 22 bp, Homo sapiens
ccaggcagagggaatagcaagt

SEQ ID NO: 6996999 - DNA, 22 bp, Homo sapiens
aaagctgcccagctgcctgttt

SEQ ID NO: 6997000 - DNA, 22 bp, Homo sapiens
tactgcttggtgttgttgtatc

SEQ ID NO: 6997001 - DNA, 22 bp, Homo sapiens
agttaagggctggtgtagactc

SEQ ID NO: 6997002 - DNA, 21 bp, Homo sapiens
caggcttgaggaatgtgcctg

SEQ ID NO: 6997003 - DNA, 22 bp, Homo sapiens
ttcagtcccttgcttaaattta

SEQ ID NO: 6997004 - DNA, 22 bp, Homo sapiens
cagcattgccctttttctcaga

SEQ ID NO: 6997005 - DNA, 22 bp, Homo sapiens
tggcccaggtctctctgagccc

SEQ ID NO: 6997006 - DNA, 23 bp, Homo sapiens
cctggcagcaaacgaggaggtta

SEQ ID NO: 6997007 - DNA, 20 bp, Homo sapiens
ttgcaaagtgaatagcaatt

SEQ ID NO: 6997008 - DNA, 22 bp, Homo sapiens
accaggagttgggggtgggacc

SEQ ID NO: 6997009 - DNA, 22 bp, Homo sapiens
ctagaggtagaggcagtgggaa

SEQ ID NO: 6997010 - DNA, 22 bp, Homo sapiens
cctgacaaggctaacaaaaggc

SEQ ID NO: 6997011 - DNA, 22 bp, Homo sapiens
ttcaaagattttcccaaagctc

SEQ ID NO: 6997012 - DNA, 22 bp, Homo sapiens
tggcctgagttgtctgcaggcc

SEQ ID NO: 6997013 - DNA, 22 bp, Homo sapiens
ggagacacccacattgctgggt

SEQ ID NO: 6997014 - DNA, 22 bp, Homo sapiens
acttgcaaggttgcagttagaa

SEQ ID NO: 6997015 - DNA, 22 bp, Homo sapiens
gcagccctcgctagctctcccc

SEQ ID NO: 6997016 - DNA, 22 bp, Homo sapiens
atatgggtcatgtgatgttcaa

SEQ ID NO: 6997017 - DNA, 22 bp, Homo sapiens
cttgctgcccaggaatacagtc

SEQ ID NO: 6997018 - DNA, 22 bp, Homo sapiens
caggcttcgctctgtgggcagg

SEQ ID NO: 6997019 - DNA, 22 bp, Homo sapiens
tgaacagtgtatctagatcatg

SEQ ID NO: 6997020 - DNA, 22 bp, Homo sapiens
atggaagacagataaggcagaa

SEQ ID NO: 6997021 - DNA, 19 bp, Homo sapiens
atatccttgagaaagggaa

SEQ ID NO: 6997022 - DNA, 22 bp, Homo sapiens
ggatggccgagaagacagcgta

SEQ ID NO: 6997023 - DNA, 22 bp, Homo sapiens
gcacccttgctgccaagtggat

SEQ ID NO: 6997024 - DNA, 22 bp, Homo sapiens
ccatatgtctactgctttctgt

SEQ ID NO: 6997025 - DNA, 22 bp, Homo sapiens
ttctttcaatagctggcatatg

SEQ ID NO: 6997026 - DNA, 22 bp, Homo sapiens
cctgggctcaagcgatcttgtc

SEQ ID NO: 6997027 - DNA, 22 bp, Homo sapiens
ccaggagcaccaggcctgtgcc

SEQ ID NO: 6997028 - DNA, 22 bp, Homo sapiens
gatggcctcatggctgcaggcc

SEQ ID NO: 6997029 - DNA, 22 bp, Homo sapiens
aagggatcataattgggttcaa

SEQ ID NO: 6997030 - DNA, 22 bp, Homo sapiens
ggggctgctcccacccctgagg

SEQ ID NO: 6997031 - DNA, 22 bp, Homo sapiens
ctctctggtttcagcgaagggg

SEQ ID NO: 6997032 - DNA, 22 bp, Homo sapiens
tagtttaccaaattgatcttcc

SEQ ID NO: 6997033 - DNA, 22 bp, Homo sapiens
tgtcttcatgcctgaaagaaga

SEQ ID NO: 6997034 - DNA, 22 bp, Homo sapiens
tggttctgctcaagccagactg

SEQ ID NO: 6997035 - DNA, 22 bp, Homo sapiens
gagtcctcaacggggagaggcg

SEQ ID NO: 6997036 - DNA, 19 bp, Homo sapiens
tgggttggaagggaatgaa

SEQ ID NO: 6997037 - DNA, 22 bp, Homo sapiens
aagtcctgccacctataagcct

SEQ ID NO: 6997038 - DNA, 22 bp, Homo sapiens
tactcatttcaaacagcacaaa

SEQ ID NO: 6997039 - DNA, 22 bp, Homo sapiens
cttttccaaagtccatctggtc

SEQ ID NO: 6997040 - DNA, 22 bp, Homo sapiens
aggtgccaggagggaatttagg

SEQ ID NO: 6997041 - DNA, 22 bp, Homo sapiens
tcaggagatgtaaccttagctg

SEQ ID NO: 6997042 - DNA, 22 bp, Homo sapiens
agaaggctgaagaagatccgtt

SEQ ID NO: 6997043 - DNA, 22 bp, Homo sapiens
taggaatgcagtgagacacaga

SEQ ID NO: 6997044 - DNA, 22 bp, Homo sapiens
tgatataagaagtagtatggat

SEQ ID NO: 6997045 - DNA, 18 bp, Homo sapiens
ctggaagttagtctttgg

SEQ ID NO: 6997046 - DNA, 22 bp, Homo sapiens
cagtatttatggcttgagtatt

SEQ ID NO: 6997047 - DNA, 22 bp, Homo sapiens
tttgctgaataaatgtgtgact

SEQ ID NO: 6997048 - DNA, 22 bp, Homo sapiens
tttggtcatagattgcgaacat

SEQ ID NO: 6997049 - DNA, 22 bp, Homo sapiens
aaagacttgggtgaagtaattt

SEQ ID NO: 6997050 - DNA, 19 bp, Homo sapiens
cacagggcaggtctcatgt

SEQ ID NO: 6997051 - DNA, 21 bp, Homo sapiens
agaggccttacaggatagacc

SEQ ID NO: 6997052 - DNA, 22 bp, Homo sapiens
gagtccagagattaagcacctc

SEQ ID NO: 6997053 - DNA, 22 bp, Homo sapiens
gctgggagaggcagctttcgga

SEQ ID NO: 6997054 - DNA, 22 bp, Homo sapiens
gtgaattaaatatagccaggtc

SEQ ID NO: 6997055 - DNA, 22 bp, Homo sapiens
ctgcttaagcaagaaagcagca

SEQ ID NO: 6997056 - DNA, 22 bp, Homo sapiens
agtctgggaactgggaacgttt

SEQ ID NO: 6997057 - DNA, 22 bp, Homo sapiens
attctgcacatccaagaacagg

SEQ ID NO: 6997058 - DNA, 23 bp, Homo sapiens
tgcatgtgaattcatacttgttt

SEQ ID NO: 6997059 - DNA, 22 bp, Homo sapiens
atgaaacacacacgcgcatact

SEQ ID NO: 6997060 - DNA, 22 bp, Homo sapiens
ttcccacaacagatctgtatta

SEQ ID NO: 6997061 - DNA, 22 bp, Homo sapiens
ccagggagcctggtgtgtcagc

SEQ ID NO: 6997062 - DNA, 22 bp, Homo sapiens
ccactgaggggtcatggtggga

SEQ ID NO: 6997063 - DNA, 22 bp, Homo sapiens
tcagcagacagttagctatatt

SEQ ID NO: 6997064 - DNA, 22 bp, Homo sapiens
gaggtactttctggttcaggtg

SEQ ID NO: 6997065 - DNA, 22 bp, Homo sapiens
ctctctatggatgcagtttttc

SEQ ID NO: 6997066 - DNA, 23 bp, Homo sapiens
agacggactccagggtgttgtat

SEQ ID NO: 6997067 - DNA, 22 bp, Homo sapiens
tgcagctgagtcacccagccat

SEQ ID NO: 6997068 - DNA, 22 bp, Homo sapiens
gtcccaggtgcccagtgggcag

SEQ ID NO: 6997069 - DNA, 22 bp, Homo sapiens
gagtgcagatgccagccccagt

SEQ ID NO: 6997070 - DNA, 22 bp, Homo sapiens
gtccctggcgctttcgagcctt

SEQ ID NO: 6997071 - DNA, 22 bp, Homo sapiens
aaggcaaggcttccagctcccc

SEQ ID NO: 6997072 - DNA, 22 bp, Homo sapiens
caggaagctcttagcagtcacc

SEQ ID NO: 6997073 - DNA, 18 bp, Homo sapiens
attgtgactctcagttca

SEQ ID NO: 6997074 - DNA, 22 bp, Homo sapiens
agtgcattatatgtttcaatgg

SEQ ID NO: 6997075 - DNA, 23 bp, Homo sapiens
tattgcagacatgaagggaatgc

SEQ ID NO: 6997076 - DNA, 22 bp, Homo sapiens
gcctttagactttgggacttat

SEQ ID NO: 6997077 - DNA, 22 bp, Homo sapiens
tattggtataggcattgaaact

SEQ ID NO: 6997078 - DNA, 22 bp, Homo sapiens
ggctagaaagctactacaggag

SEQ ID NO: 6997079 - DNA, 22 bp, Homo sapiens
gtgcggatgaggaggttgaacc

SEQ ID NO: 6997080 - DNA, 22 bp, Homo sapiens
tcctccagtggtactggccaat

SEQ ID NO: 6997081 - DNA, 22 bp, Homo sapiens
caccaggagtgagaatgaaggg

SEQ ID NO: 6997082 - DNA, 22 bp, Homo sapiens
tacattgaggcagtagctggag

SEQ ID NO: 6997083 - DNA, 22 bp, Homo sapiens
aagaaagtgctttgtaaattat

SEQ ID NO: 6997084 - DNA, 22 bp, Homo sapiens
agcgctgtgggcgtgcgaggag

SEQ ID NO: 6997085 - DNA, 22 bp, Homo sapiens
ccttgcatttaaaggcgtaggg

SEQ ID NO: 6997086 - DNA, 22 bp, Homo sapiens
atggagtttggggtcaaatact

SEQ ID NO: 6997087 - DNA, 20 bp, Homo sapiens
ggcagtcttcctcatttctt

SEQ ID NO: 6997088 - DNA, 22 bp, Homo sapiens
aagcagctgaaggattcagggt

SEQ ID NO: 6997089 - DNA, 22 bp, Homo sapiens
tgtgttggcttgcctgttaggc

SEQ ID NO: 6997090 - DNA, 22 bp, Homo sapiens
ctacccagatccaggatggcta

SEQ ID NO: 6997091 - DNA, 22 bp, Homo sapiens
cctggtccttacgtcattgctt

SEQ ID NO: 6997092 - DNA, 22 bp, Homo sapiens
agattacaacatgggacgcata

SEQ ID NO: 6997093 - DNA, 23 bp, Homo sapiens
tcaagtaatactcccatcttggc

SEQ ID NO: 6997094 - DNA, 22 bp, Homo sapiens
atgtaaagttacttgagttttg

SEQ ID NO: 6997095 - DNA, 22 bp, Homo sapiens
tctttcttgcaaggatgcagga

SEQ ID NO: 6997096 - DNA, 22 bp, Homo sapiens
acatttctgtcttagggactgt

SEQ ID NO: 6997097 - DNA, 22 bp, Homo sapiens
tctgacctgaatgaaacagatg

SEQ ID NO: 6997098 - DNA, 22 bp, Homo sapiens
ccatccttggctcgctctctgt

SEQ ID NO: 6997099 - DNA, 19 bp, Homo sapiens
tgtgaccccagacaagctg

SEQ ID NO: 6997100 - DNA, 22 bp, Homo sapiens
ttccacattccttacattcata

SEQ ID NO: 6997101 - DNA, 22 bp, Homo sapiens
gctgcaggttgggcaacagagt

SEQ ID NO: 6997102 - DNA, 22 bp, Homo sapiens
tacattgctcattatattgctt

SEQ ID NO: 6997103 - DNA, 22 bp, Homo sapiens
tgcaaaggcctttaggttgaaa

SEQ ID NO: 6997104 - DNA, 22 bp, Homo sapiens
ctttatatattcccaggctgcc

SEQ ID NO: 6997105 - DNA, 22 bp, Homo sapiens
aggacttccaaacctcccaaat

SEQ ID NO: 6997106 - DNA, 22 bp, Homo sapiens
ttgctaacgctcaccctttgcc

SEQ ID NO: 6997107 - DNA, 22 bp, Homo sapiens
cagtggttttgagattcagggt

SEQ ID NO: 6997108 - DNA, 22 bp, Homo sapiens
cacacatcttatcccagttatt

SEQ ID NO: 6997109 - DNA, 22 bp, Homo sapiens
gttgctgattaacactttgagt

SEQ ID NO: 6997110 - DNA, 22 bp, Homo sapiens
tgcagcttcactcaggaagcca

SEQ ID NO: 6997111 - DNA, 22 bp, Homo sapiens
gccacctctctcttgactcgag

SEQ ID NO: 6997112 - DNA, 22 bp, Homo sapiens
caagatgaagtgaagattagaa

SEQ ID NO: 6997113 - DNA, 22 bp, Homo sapiens
tgctggagcatctgagagcatc

SEQ ID NO: 6997114 - DNA, 22 bp, Homo sapiens
aaggactagatattcatacatg

SEQ ID NO: 6997115 - DNA, 22 bp, Homo sapiens
gcaggcttgagagatcagatgg

SEQ ID NO: 6997116 - DNA, 22 bp, Homo sapiens
aggctgccaaagcttctgtctc

SEQ ID NO: 6997117 - DNA, 22 bp, Homo sapiens
atgcatattggattagcagcca

SEQ ID NO: 6997118 - DNA, 22 bp, Homo sapiens
attgcttactaatcatcttcag

SEQ ID NO: 6997119 - DNA, 22 bp, Homo sapiens
tatgcctacctccaaaatatat

SEQ ID NO: 6997120 - DNA, 18 bp, Homo sapiens
ggctttgctggggtttct

SEQ ID NO: 6997121 - DNA, 22 bp, Homo sapiens
tgagtatagaaagtcacccttt

SEQ ID NO: 6997122 - DNA, 15 bp, Homo sapiens
catatcactgggaat

SEQ ID NO: 6997123 - DNA, 22 bp, Homo sapiens
ggaagtgaggaaatattttgtt

SEQ ID NO: 6997124 - DNA, 22 bp, Homo sapiens
agtcttggtgtcagtggtctga

SEQ ID NO: 6997125 - DNA, 18 bp, Homo sapiens
ttctttaattcagtttga

SEQ ID NO: 6997126 - DNA, 22 bp, Homo sapiens
cagctctgttcatagatggtgc

SEQ ID NO: 6997127 - DNA, 23 bp, Homo sapiens
gcagcgtccgcaccccggccggg

SEQ ID NO: 6997128 - DNA, 22 bp, Homo sapiens
gaggctggttcccttgatcttt

SEQ ID NO: 6997129 - DNA, 22 bp, Homo sapiens
ttgccaccgtcatggccattat

SEQ ID NO: 6997130 - DNA, 22 bp, Homo sapiens
aattaggaaatgagagtatttg

SEQ ID NO: 6997131 - DNA, 22 bp, Homo sapiens
atggaatgccaagttcactgct

SEQ ID NO: 6997132 - DNA, 22 bp, Homo sapiens
aatcagaaattgagggtctggt

SEQ ID NO: 6997133 - DNA, 22 bp, Homo sapiens
ttattaagtgcctacaataaag

SEQ ID NO: 6997134 - DNA, 18 bp, Homo sapiens
gcccagagccctcttatt

SEQ ID NO: 6997135 - DNA, 18 bp, Homo sapiens
cctggcagccatgcgcgc

SEQ ID NO: 6997136 - DNA, 22 bp, Homo sapiens
cagctgtgctgtattaagctct

SEQ ID NO: 6997137 - DNA, 22 bp, Homo sapiens
ttgtagagtacacaacacttgg

SEQ ID NO: 6997138 - DNA, 22 bp, Homo sapiens
aggatcttatgtaataattatg

SEQ ID NO: 6997139 - DNA, 22 bp, Homo sapiens
atgctacaggagccccacttag

SEQ ID NO: 6997140 - DNA, 21 bp, Homo sapiens
ctacagaatcgagcattctgg

SEQ ID NO: 6997141 - DNA, 22 bp, Homo sapiens
tggggtgacagtgcagtggtca

SEQ ID NO: 6997142 - DNA, 22 bp, Homo sapiens
tttgactccagagcccattttt

SEQ ID NO: 6997143 - DNA, 22 bp, Homo sapiens
ctgtgccactgggggccggcaa

SEQ ID NO: 6997144 - DNA, 22 bp, Homo sapiens
acctaagaaatccagagatttc

SEQ ID NO: 6997145 - DNA, 22 bp, Homo sapiens
ttgtggaactcatctgcctggt

SEQ ID NO: 6997146 - DNA, 22 bp, Homo sapiens
cttccagtttccccttccagtc

SEQ ID NO: 6997147 - DNA, 22 bp, Homo sapiens
tgagttctccaagagaaggtaa

SEQ ID NO: 6997148 - DNA, 22 bp, Homo sapiens
gtggagcaatcagagggtcagt

SEQ ID NO: 6997149 - DNA, 22 bp, Homo sapiens
agcagttatcgaagaatcaggt

SEQ ID NO: 6997150 - DNA, 22 bp, Homo sapiens
aagttatgaaatttggacagct

SEQ ID NO: 6997151 - DNA, 19 bp, Homo sapiens
ggctcagggcgctgccgcc

SEQ ID NO: 6997152 - DNA, 22 bp, Homo sapiens
agtttccaggcaggagctaatt

SEQ ID NO: 6997153 - DNA, 22 bp, Homo sapiens
agaattagaggccatgtacttg

SEQ ID NO: 6997154 - DNA, 22 bp, Homo sapiens
ttggcactcatcctggttgttt

SEQ ID NO: 6997155 - DNA, 22 bp, Homo sapiens
ttctagttaaagtatgtattag

SEQ ID NO: 6997156 - DNA, 22 bp, Homo sapiens
caggctcccttctcggaattct

SEQ ID NO: 6997157 - DNA, 22 bp, Homo sapiens
tccagccaactgcctagggagc

SEQ ID NO: 6997158 - DNA, 22 bp, Homo sapiens
tgctggagtgcagtggcttaac

SEQ ID NO: 6997159 - DNA, 22 bp, Homo sapiens
gcaggacattcagtgaatgggc

SEQ ID NO: 6997160 - DNA, 22 bp, Homo sapiens
tcctcagtaaggatcgtcagct

SEQ ID NO: 6997161 - DNA, 22 bp, Homo sapiens
aacagtgctgattattttacct

SEQ ID NO: 6997162 - DNA, 22 bp, Homo sapiens
agaatcctggagaagctgtacc

SEQ ID NO: 6997163 - DNA, 22 bp, Homo sapiens
tggagcaggtcggcaccatttg

SEQ ID NO: 6997164 - DNA, 22 bp, Homo sapiens
ggctttctccttgccttagtct

SEQ ID NO: 6997165 - DNA, 22 bp, Homo sapiens
ttctttctgtccataatgagac

SEQ ID NO: 6997166 - DNA, 20 bp, Homo sapiens
ccagtccctgagcaccaggg

SEQ ID NO: 6997167 - DNA, 21 bp, Homo sapiens
ttactttagaaattgcctttt

SEQ ID NO: 6997168 - DNA, 22 bp, Homo sapiens
cggcttgtttagacttttcaaa

SEQ ID NO: 6997169 - DNA, 22 bp, Homo sapiens
aagccagattccttaagcacag

SEQ ID NO: 6997170 - DNA, 22 bp, Homo sapiens
tttctaattctaactggcagag

SEQ ID NO: 6997171 - DNA, 22 bp, Homo sapiens
aagaaaacaatgacttgccagc

SEQ ID NO: 6997172 - DNA, 22 bp, Homo sapiens
aagagcatttggtgagatttga

SEQ ID NO: 6997173 - DNA, 22 bp, Homo sapiens
acaatgattttttagagtagtt

SEQ ID NO: 6997174 - DNA, 21 bp, Homo sapiens
tacagatgaggagaccaaggc

SEQ ID NO: 6997175 - DNA, 22 bp, Homo sapiens
cagctctccaccctcctggttc

SEQ ID NO: 6997176 - DNA, 22 bp, Homo sapiens
ccatggctttctttcattgtaa

SEQ ID NO: 6997177 - DNA, 22 bp, Homo sapiens
ttcgcagccagtgagcagagga

SEQ ID NO: 6997178 - DNA, 22 bp, Homo sapiens
ctgctgtgacagctgccgtgtt

SEQ ID NO: 6997179 - DNA, 22 bp, Homo sapiens
tcaagcggactgagatactctg

SEQ ID NO: 6997180 - DNA, 22 bp, Homo sapiens
cagcatcccagagcccagagct

SEQ ID NO: 6997181 - DNA, 22 bp, Homo sapiens
atgcatgcttcttatagtactt

SEQ ID NO: 6997182 - DNA, 22 bp, Homo sapiens
ccttttgagacttccactgtgt

SEQ ID NO: 6997183 - DNA, 20 bp, Homo sapiens
ttctaaactgttaggcttgc

SEQ ID NO: 6997184 - DNA, 22 bp, Homo sapiens
gctctggcttggggcactcgtc

SEQ ID NO: 6997185 - DNA, 22 bp, Homo sapiens
ctctggactttttgtggattct

SEQ ID NO: 6997186 - DNA, 22 bp, Homo sapiens
atggtactggggtcccggagtt

SEQ ID NO: 6997187 - DNA, 22 bp, Homo sapiens
tgtggcacagaagaaagagagg

SEQ ID NO: 6997188 - DNA, 19 bp, Homo sapiens
tgaaggacagtgcacatca

SEQ ID NO: 6997189 - DNA, 22 bp, Homo sapiens
tgcatgaacggagggtaagctg

SEQ ID NO: 6997190 - DNA, 22 bp, Homo sapiens
gagaaggctggtcttaagtcga

SEQ ID NO: 6997191 - DNA, 22 bp, Homo sapiens
ctctgggaccatggcaagtgcg

SEQ ID NO: 6997192 - DNA, 22 bp, Homo sapiens
gccatctggcattgcagcacct

SEQ ID NO: 6997193 - DNA, 22 bp, Homo sapiens
ttgtcaggcctatgagagatct

SEQ ID NO: 6997194 - DNA, 22 bp, Homo sapiens
gccctttgagagtggccttgtt

SEQ ID NO: 6997195 - DNA, 20 bp, Homo sapiens
tttcagatttacagaaatgt

SEQ ID NO: 6997196 - DNA, 22 bp, Homo sapiens
ccactgccatgggctaggcatg

SEQ ID NO: 6997197 - DNA, 22 bp, Homo sapiens
atccttctacctaggactattt

SEQ ID NO: 6997198 - DNA, 22 bp, Homo sapiens
agtaaaaatatgcttgtggcta

SEQ ID NO: 6997199 - DNA, 22 bp, Homo sapiens
acctccctcgccgtccactctg

SEQ ID NO: 6997200 - DNA, 22 bp, Homo sapiens
tctgctcacatggctccatgca

SEQ ID NO: 6997201 - DNA, 22 bp, Homo sapiens
agggacagatgaatgactgagt

SEQ ID NO: 6997202 - DNA, 21 bp, Homo sapiens
agagcggcggggcgcgtctgc

SEQ ID NO: 6997203 - DNA, 19 bp, Homo sapiens
ttgtgactggctctgcata

SEQ ID NO: 6997204 - DNA, 21 bp, Homo sapiens
aaggacgaggttttgattaca

SEQ ID NO: 6997205 - DNA, 22 bp, Homo sapiens
tgcaggggcttgtctgggcctg

SEQ ID NO: 6997206 - DNA, 22 bp, Homo sapiens
tttatttatccttctggattgc

SEQ ID NO: 6997207 - DNA, 22 bp, Homo sapiens
attattgctgacatggtgttga

SEQ ID NO: 6997208 - DNA, 22 bp, Homo sapiens
ttttcctggagatggagttgtt

SEQ ID NO: 6997209 - DNA, 22 bp, Homo sapiens
acagaaatattcgtggtgcttg

SEQ ID NO: 6997210 - DNA, 22 bp, Homo sapiens
ctgcagggcagaagggcataga

SEQ ID NO: 6997211 - DNA, 22 bp, Homo sapiens
gagtccagttgttcacagaggc

SEQ ID NO: 6997212 - DNA, 22 bp, Homo sapiens
cacaggcttttctgacataggc

SEQ ID NO: 6997213 - DNA, 22 bp, Homo sapiens
aaagtcacttacagctcttttg

SEQ ID NO: 6997214 - DNA, 20 bp, Homo sapiens
attctccctatactcacttt

SEQ ID NO: 6997215 - DNA, 22 bp, Homo sapiens
cccatgccttctgactcacagg

SEQ ID NO: 6997216 - DNA, 22 bp, Homo sapiens
tgcttctgggcaaatgtgtgtg

SEQ ID NO: 6997217 - DNA, 18 bp, Homo sapiens
aagttgagtgcctgtcat

SEQ ID NO: 6997218 - DNA, 22 bp, Homo sapiens
acatgagtacagatggatgtaa

SEQ ID NO: 6997219 - DNA, 22 bp, Homo sapiens
tacagggctgagtgagacatgg

SEQ ID NO: 6997220 - DNA, 22 bp, Homo sapiens
caaaggcctgagaactgagggg

SEQ ID NO: 6997221 - DNA, 22 bp, Homo sapiens
atcatccactggagccggcagg

SEQ ID NO: 6997222 - DNA, 22 bp, Homo sapiens
gccagcctgtgcttggccaggc

SEQ ID NO: 6997223 - DNA, 22 bp, Homo sapiens
ggcaaaggaaaacgtctcagct

SEQ ID NO: 6997224 - DNA, 22 bp, Homo sapiens
ctccttccaacaagagaaagag

SEQ ID NO: 6997225 - DNA, 22 bp, Homo sapiens
ccctttcttcttgactgaaaac

SEQ ID NO: 6997226 - DNA, 19 bp, Homo sapiens
tctggcaggtaattaggga

SEQ ID NO: 6997227 - DNA, 22 bp, Homo sapiens
gccaaagctggaggtggaggtg

SEQ ID NO: 6997228 - DNA, 22 bp, Homo sapiens
tcaatcaaagcactgggctttg

SEQ ID NO: 6997229 - DNA, 22 bp, Homo sapiens
tgctccagtgagctggccatcc

SEQ ID NO: 6997230 - DNA, 22 bp, Homo sapiens
gcagtcagtctcttgccttgag

SEQ ID NO: 6997231 - DNA, 18 bp, Homo sapiens
agctgttgttgactctgt

SEQ ID NO: 6997232 - DNA, 22 bp, Homo sapiens
gtggtgcatccttgagtaagct

SEQ ID NO: 6997233 - DNA, 20 bp, Homo sapiens
aagagctgactcacagtggt

SEQ ID NO: 6997234 - DNA, 22 bp, Homo sapiens
actttgtttccatatttgtagc

SEQ ID NO: 6997235 - DNA, 22 bp, Homo sapiens
tactgaagcaccattaaagaca

SEQ ID NO: 6997236 - DNA, 22 bp, Homo sapiens
acagtagaccctggataaacat

SEQ ID NO: 6997237 - DNA, 22 bp, Homo sapiens
catttgaattgttctgtgggaa

SEQ ID NO: 6997238 - DNA, 22 bp, Homo sapiens
ccctctctgctgcatagaggaa

SEQ ID NO: 6997239 - DNA, 22 bp, Homo sapiens
tttggcagctaaggcagctcgc

SEQ ID NO: 6997240 - DNA, 22 bp, Homo sapiens
agcaggcaggaggctactaagg

SEQ ID NO: 6997241 - DNA, 17 bp, Homo sapiens
tgatttagtaagctgcc

SEQ ID NO: 6997242 - DNA, 22 bp, Homo sapiens
aatgtcttacatttactgagca

SEQ ID NO: 6997243 - DNA, 22 bp, Homo sapiens
ctggctccaaggaagaggtttt

SEQ ID NO: 6997244 - DNA, 22 bp, Homo sapiens
tgttttgtgcatttacaacatg

SEQ ID NO: 6997245 - DNA, 22 bp, Homo sapiens
ggctttactatatggtacattt

SEQ ID NO: 6997246 - DNA, 22 bp, Homo sapiens
tccagtgtgtgtccagctgctg

SEQ ID NO: 6997247 - DNA, 22 bp, Homo sapiens
agctgtggttagatagagtcct

SEQ ID NO: 6997248 - DNA, 22 bp, Homo sapiens
ctccaaggctaggagcatgttc

SEQ ID NO: 6997249 - DNA, 22 bp, Homo sapiens
gtagcggttatgtctgcaggga

SEQ ID NO: 6997250 - DNA, 22 bp, Homo sapiens
aggtgtcagaagtgacagttgg

SEQ ID NO: 6997251 - DNA, 22 bp, Homo sapiens
aggctagggccatggctggtga

SEQ ID NO: 6997252 - DNA, 21 bp, Homo sapiens
gtctttttaattgcgatttcc

SEQ ID NO: 6997253 - DNA, 22 bp, Homo sapiens
agagcctgggaatttgcatgtt

SEQ ID NO: 6997254 - DNA, 22 bp, Homo sapiens
agtgccagagacgtgcacttta

SEQ ID NO: 6997255 - DNA, 20 bp, Homo sapiens
ttctctagccttcccctggg

SEQ ID NO: 6997256 - DNA, 22 bp, Homo sapiens
accctggggtcacccttctctg

SEQ ID NO: 6997257 - DNA, 22 bp, Homo sapiens
cagcatcaccgccatttctgat

SEQ ID NO: 6997258 - DNA, 22 bp, Homo sapiens
cagtcaacagagagcccgtcag

SEQ ID NO: 6997259 - DNA, 22 bp, Homo sapiens
gaagaactgtgacagaagcagt

SEQ ID NO: 6997260 - DNA, 22 bp, Homo sapiens
tgctaaacaatgtacagtgtat

SEQ ID NO: 6997261 - DNA, 19 bp, Homo sapiens
aaagttctgactgtagagc

SEQ ID NO: 6997262 - DNA, 22 bp, Homo sapiens
tcagagtgtggtgagatgtgca

SEQ ID NO: 6997263 - DNA, 22 bp, Homo sapiens
attaggacagagatgtcaagag

SEQ ID NO: 6997264 - DNA, 22 bp, Homo sapiens
aaatctagaagtttaaaaggat

SEQ ID NO: 6997265 - DNA, 22 bp, Homo sapiens
taactgtattttaggtctcatt

SEQ ID NO: 6997266 - DNA, 22 bp, Homo sapiens
aagtcctgggcatttgaacagg

SEQ ID NO: 6997267 - DNA, 22 bp, Homo sapiens
gctgtgcttgggaagaatctct

SEQ ID NO: 6997268 - DNA, 22 bp, Homo sapiens
catcagaaccagtggggacatt

SEQ ID NO: 6997269 - DNA, 22 bp, Homo sapiens
gcaacaagtgtaaacatgcatt

SEQ ID NO: 6997270 - DNA, 22 bp, Homo sapiens
tcagtttctaaatcttaccaat

SEQ ID NO: 6997271 - DNA, 23 bp, Homo sapiens
gtgctgtgagccccttggcctcc

SEQ ID NO: 6997272 - DNA, 23 bp, Homo sapiens
gggggctggttgactctctgcag

SEQ ID NO: 6997273 - DNA, 22 bp, Homo sapiens
accatgtcatttattggccaaa

SEQ ID NO: 6997274 - DNA, 22 bp, Homo sapiens
ccagggcacttaggcccagccc

SEQ ID NO: 6997275 - DNA, 22 bp, Homo sapiens
attaaggattatactctccttt

SEQ ID NO: 6997276 - DNA, 22 bp, Homo sapiens
gaggtagctcttactctctccg

SEQ ID NO: 6997277 - DNA, 22 bp, Homo sapiens
atgctgtccctgcccttcaccc

SEQ ID NO: 6997278 - DNA, 22 bp, Homo sapiens
tcacagagctcacagtttagca

SEQ ID NO: 6997279 - DNA, 22 bp, Homo sapiens
cttttcttgtattggatgcccc

SEQ ID NO: 6997280 - DNA, 22 bp, Homo sapiens
ctcagtgctacggttaccatat

SEQ ID NO: 6997281 - DNA, 22 bp, Homo sapiens
tggaagcttcctgttcttgagg

SEQ ID NO: 6997282 - DNA, 22 bp, Homo sapiens
tggtatcagagccatctgtatt

SEQ ID NO: 6997283 - DNA, 22 bp, Homo sapiens
ggtgcagcctccccagtgacag

SEQ ID NO: 6997284 - DNA, 22 bp, Homo sapiens
atatcaaaataaacagcatgca

SEQ ID NO: 6997285 - DNA, 22 bp, Homo sapiens
ccacagagacagggtccttgct

SEQ ID NO: 6997286 - DNA, 22 bp, Homo sapiens
ggtcaagtaacaaatcaggagc

SEQ ID NO: 6997287 - DNA, 22 bp, Homo sapiens
ttggccagagaccagagcaggg

SEQ ID NO: 6997288 - DNA, 22 bp, Homo sapiens
gacagcttctagaaatggtcac

SEQ ID NO: 6997289 - DNA, 22 bp, Homo sapiens
atggaagggacagaagggcaag

SEQ ID NO: 6997290 - DNA, 22 bp, Homo sapiens
tctagaatttgcgtaggttaga

SEQ ID NO: 6997291 - DNA, 22 bp, Homo sapiens
gcatacatgggtgcagggacat

SEQ ID NO: 6997292 - DNA, 22 bp, Homo sapiens
atttcctatagatatggtgagt

SEQ ID NO: 6997293 - DNA, 22 bp, Homo sapiens
aggagcagcccactcctgtcct

SEQ ID NO: 6997294 - DNA, 22 bp, Homo sapiens
acctttgagtgtattgtctttc

SEQ ID NO: 6997295 - DNA, 22 bp, Homo sapiens
ctgcagggaggttccttgttct

SEQ ID NO: 6997296 - DNA, 22 bp, Homo sapiens
ctgttaagtgtagataatgtgg

SEQ ID NO: 6997297 - DNA, 22 bp, Homo sapiens
cagagcattaaaaccagctctg

SEQ ID NO: 6997298 - DNA, 22 bp, Homo sapiens
tggcctcatttggaaatagggc

SEQ ID NO: 6997299 - DNA, 22 bp, Homo sapiens
tctgttatctcaagtcacaaga

SEQ ID NO: 6997300 - DNA, 22 bp, Homo sapiens
tctgacaattagcctagtcctg

SEQ ID NO: 6997301 - DNA, 22 bp, Homo sapiens
agggccctaaggaaggcacaca

SEQ ID NO: 6997302 - DNA, 22 bp, Homo sapiens
gctgcagggctctcacaggggg

SEQ ID NO: 6997303 - DNA, 22 bp, Homo sapiens
gaagaatctgaggacagtcatt

SEQ ID NO: 6997304 - DNA, 22 bp, Homo sapiens
tgggaacattttgagctgagag

SEQ ID NO: 6997305 - DNA, 22 bp, Homo sapiens
atgtgcatgtgcacacatgcgt

SEQ ID NO: 6997306 - DNA, 22 bp, Homo sapiens
agttagttatggtccaacctcc

SEQ ID NO: 6997307 - DNA, 22 bp, Homo sapiens
aggatcagtgaatactcagggt

SEQ ID NO: 6997308 - DNA, 22 bp, Homo sapiens
tgattgtttcctatgtacacct

SEQ ID NO: 6997309 - DNA, 22 bp, Homo sapiens
ttgaatgccaatatctccttct

SEQ ID NO: 6997310 - DNA, 22 bp, Homo sapiens
cacagtctcctctcttagcctg

SEQ ID NO: 6997311 - DNA, 16 bp, Homo sapiens
ttttggtgaccctgga

SEQ ID NO: 6997312 - DNA, 22 bp, Homo sapiens
aagtacatgttgctcaacagcc

SEQ ID NO: 6997313 - DNA, 22 bp, Homo sapiens
cctggctgcagtttttgcagaa

SEQ ID NO: 6997314 - DNA, 22 bp, Homo sapiens
agggtcagagtcaggtgcagta

SEQ ID NO: 6997315 - DNA, 22 bp, Homo sapiens
gctgacctgctctcagcagaga

SEQ ID NO: 6997316 - DNA, 22 bp, Homo sapiens
ggcaccaggggatgtaatgtcc

SEQ ID NO: 6997317 - DNA, 22 bp, Homo sapiens
gtttctcttaacacataaagta

SEQ ID NO: 6997318 - DNA, 22 bp, Homo sapiens
acctgggaggcggaggttgcag

SEQ ID NO: 6997319 - DNA, 22 bp, Homo sapiens
agattggatcaagcagcagttg

SEQ ID NO: 6997320 - DNA, 22 bp, Homo sapiens
agcaggaactgacaccaagcca

SEQ ID NO: 6997321 - DNA, 22 bp, Homo sapiens
attctgggagtgtaggatggtt

SEQ ID NO: 6997322 - DNA, 22 bp, Homo sapiens
ctcaagataatgacaaaaagag

SEQ ID NO: 6997323 - DNA, 22 bp, Homo sapiens
cactgggagcagctccaacatt

SEQ ID NO: 6997324 - DNA, 22 bp, Homo sapiens
ccagtagttccaggaacctcct

SEQ ID NO: 6997325 - DNA, 22 bp, Homo sapiens
tattccaggacaggtgtgctgt

SEQ ID NO: 6997326 - DNA, 22 bp, Homo sapiens
tcagaagtcatgctcagtctgt

SEQ ID NO: 6997327 - DNA, 22 bp, Homo sapiens
gtggggagggagatgctgaagt

SEQ ID NO: 6997328 - DNA, 22 bp, Homo sapiens
cagatttaagagataaacagtg

SEQ ID NO: 6997329 - DNA, 20 bp, Homo sapiens
tagatacccaatgctcatca

SEQ ID NO: 6997330 - DNA, 22 bp, Homo sapiens
tcccaggaattgaagccagtgt

SEQ ID NO: 6997331 - DNA, 22 bp, Homo sapiens
actgttattgtgaacgggcaat

SEQ ID NO: 6997332 - DNA, 22 bp, Homo sapiens
tcagtaaatgaatgaatatatg

SEQ ID NO: 6997333 - DNA, 22 bp, Homo sapiens
agggcctgtgcttcctgagata

SEQ ID NO: 6997334 - DNA, 22 bp, Homo sapiens
tgttccttctggcttttacatc

SEQ ID NO: 6997335 - DNA, 22 bp, Homo sapiens
acaggtagatacatacttctaa

SEQ ID NO: 6997336 - DNA, 22 bp, Homo sapiens
gtgtatcaaagcacagacttca

SEQ ID NO: 6997337 - DNA, 22 bp, Homo sapiens
cagtgtggagggagagagcctg

SEQ ID NO: 6997338 - DNA, 22 bp, Homo sapiens
ctgtgataggtcatactgtctc

SEQ ID NO: 6997339 - DNA, 22 bp, Homo sapiens
gctgagttgaaagcagaggata

SEQ ID NO: 6997340 - DNA, 22 bp, Homo sapiens
actggattctcttacacagatg

SEQ ID NO: 6997341 - DNA, 22 bp, Homo sapiens
ggatgtggaccttgcctggtga

SEQ ID NO: 6997342 - DNA, 22 bp, Homo sapiens
taagagcagaggttgaataaat

SEQ ID NO: 6997343 - DNA, 22 bp, Homo sapiens
atgctacagagataggttgggt

SEQ ID NO: 6997344 - DNA, 22 bp, Homo sapiens
agtgagggatgaagaactgcgg

SEQ ID NO: 6997345 - DNA, 22 bp, Homo sapiens
gtcttaagaatgaatgctgaga

SEQ ID NO: 6997346 - DNA, 22 bp, Homo sapiens
atggtatagagccacatgtatt

SEQ ID NO: 6997347 - DNA, 22 bp, Homo sapiens
gaacactgtttcttcgtgaaca

SEQ ID NO: 6997348 - DNA, 21 bp, Homo sapiens
cagcagaagcatctatggaag

SEQ ID NO: 6997349 - DNA, 22 bp, Homo sapiens
gcctttcatctcagctggccgg

SEQ ID NO: 6997350 - DNA, 22 bp, Homo sapiens
ttgaagcattgtggcttgtatt

SEQ ID NO: 6997351 - DNA, 22 bp, Homo sapiens
acagtgtagtgtgatgtcaaaa

SEQ ID NO: 6997352 - DNA, 22 bp, Homo sapiens
tgggctagcagggaagagagac

SEQ ID NO: 6997353 - DNA, 22 bp, Homo sapiens
attactagattgtcaagattta

SEQ ID NO: 6997354 - DNA, 22 bp, Homo sapiens
agagttaaatgaaatggtatgt

SEQ ID NO: 6997355 - DNA, 22 bp, Homo sapiens
ccttctctgcaggtagttggct

SEQ ID NO: 6997356 - DNA, 22 bp, Homo sapiens
agagtcaagggtgcagaggaag

SEQ ID NO: 6997357 - DNA, 22 bp, Homo sapiens
ttgggcagaggccaggaggatg

SEQ ID NO: 6997358 - DNA, 17 bp, Homo sapiens
ctgaagagtcctggcta

SEQ ID NO: 6997359 - DNA, 22 bp, Homo sapiens
tcagccctacattaggtaagcc

SEQ ID NO: 6997360 - DNA, 18 bp, Homo sapiens
cagtctagtgagaaatgt

SEQ ID NO: 6997361 - DNA, 22 bp, Homo sapiens
atctggctcccttggaatccgt

SEQ ID NO: 6997362 - DNA, 22 bp, Homo sapiens
attcagagcactgggtagaatt

SEQ ID NO: 6997363 - DNA, 22 bp, Homo sapiens
atgcatatcagtgattgtttgc

SEQ ID NO: 6997364 - DNA, 22 bp, Homo sapiens
ggcagacacctttatgtctaat

SEQ ID NO: 6997365 - DNA, 22 bp, Homo sapiens
gcctgggaaagagtagggaaat

SEQ ID NO: 6997366 - DNA, 22 bp, Homo sapiens
gaggccatgcctcctgatcagt

SEQ ID NO: 6997367 - DNA, 22 bp, Homo sapiens
ttccaagagcctttcttctaga

SEQ ID NO: 6997368 - DNA, 22 bp, Homo sapiens
aggtatgtgctattgttatatt

SEQ ID NO: 6997369 - DNA, 22 bp, Homo sapiens
gaatgctacttgactcagctca

SEQ ID NO: 6997370 - DNA, 22 bp, Homo sapiens
tctagggagctctagcagtggt

SEQ ID NO: 6997371 - DNA, 22 bp, Homo sapiens
cagattcttcattgccccattc

SEQ ID NO: 6997372 - DNA, 22 bp, Homo sapiens
tctgccaggcattgtgctgctc

SEQ ID NO: 6997373 - DNA, 22 bp, Homo sapiens
ctagggcagggagtgtttgcgc

SEQ ID NO: 6997374 - DNA, 22 bp, Homo sapiens
acagttacatgattcttgtgag

SEQ ID NO: 6997375 - DNA, 22 bp, Homo sapiens
ccccatcctattcatgtttctg

SEQ ID NO: 6997376 - DNA, 22 bp, Homo sapiens
tgtgagagcagaagacacatag

SEQ ID NO: 6997377 - DNA, 23 bp, Homo sapiens
atctagaaacctgatgactctgt

SEQ ID NO: 6997378 - DNA, 21 bp, Homo sapiens
gggcagaggggcctcctgggt

SEQ ID NO: 6997379 - DNA, 22 bp, Homo sapiens
taggatttaataaaagaataga

SEQ ID NO: 6997380 - DNA, 22 bp, Homo sapiens
taggccaacgtggaagggtcca

SEQ ID NO: 6997381 - DNA, 22 bp, Homo sapiens
ctggtggagagtgggctctgga

SEQ ID NO: 6997382 - DNA, 22 bp, Homo sapiens
aatgatgtattagtacaacaca

SEQ ID NO: 6997383 - DNA, 22 bp, Homo sapiens
acatctatttttttctgtccat

SEQ ID NO: 6997384 - DNA, 22 bp, Homo sapiens
aaggcctcatgtaatcaggccc

SEQ ID NO: 6997385 - DNA, 22 bp, Homo sapiens
atgttatcatgtttgttatacg

SEQ ID NO: 6997386 - DNA, 22 bp, Homo sapiens
tccatcacgtaggcatgattga

SEQ ID NO: 6997387 - DNA, 22 bp, Homo sapiens
agagatatgctgcctaaattta

SEQ ID NO: 6997388 - DNA, 22 bp, Homo sapiens
ggagccctgctgacatgggtgt

SEQ ID NO: 6997389 - DNA, 22 bp, Homo sapiens
acaggaagtgggaagaaacagg

SEQ ID NO: 6997390 - DNA, 22 bp, Homo sapiens
aatgagatggaattcccgccta

SEQ ID NO: 6997391 - DNA, 22 bp, Homo sapiens
gaggctggtggttagttccatt

SEQ ID NO: 6997392 - DNA, 22 bp, Homo sapiens
tccctaggaccccaccttccgc

SEQ ID NO: 6997393 - DNA, 22 bp, Homo sapiens
acctctgcaaccctggaatggg

SEQ ID NO: 6997394 - DNA, 22 bp, Homo sapiens
agctacaacttttccatgagca

SEQ ID NO: 6997395 - DNA, 19 bp, Homo sapiens
tcatgcaatcagtgaactg

SEQ ID NO: 6997396 - DNA, 22 bp, Homo sapiens
atgtagttttggatggttgctg

SEQ ID NO: 6997397 - DNA, 21 bp, Homo sapiens
ggtagggaaggttcgctggtg

SEQ ID NO: 6997398 - DNA, 22 bp, Homo sapiens
ttctctttgacattattcaggt

SEQ ID NO: 6997399 - DNA, 22 bp, Homo sapiens
gttagcaatgcccaggaatgca

SEQ ID NO: 6997400 - DNA, 22 bp, Homo sapiens
gtgcagttgagacaataggctg

SEQ ID NO: 6997401 - DNA, 22 bp, Homo sapiens
attgggagtgtcctgatatccc

SEQ ID NO: 6997402 - DNA, 22 bp, Homo sapiens
aggagcactgagccagcatggg

SEQ ID NO: 6997403 - DNA, 22 bp, Homo sapiens
ccctgggaggcttccaggcaga

SEQ ID NO: 6997404 - DNA, 22 bp, Homo sapiens
tacatacagtggatgctttagg

SEQ ID NO: 6997405 - DNA, 21 bp, Homo sapiens
gagtgcaggtctgatgccatc

SEQ ID NO: 6997406 - DNA, 22 bp, Homo sapiens
ccatgggaattgggaggtccca

SEQ ID NO: 6997407 - DNA, 19 bp, Homo sapiens
aacagtctgggaagcacag

SEQ ID NO: 6997408 - DNA, 22 bp, Homo sapiens
actcagaggggactggtgtggt

SEQ ID NO: 6997409 - DNA, 22 bp, Homo sapiens
cagagagagtcaaatctttgct

SEQ ID NO: 6997410 - DNA, 22 bp, Homo sapiens
attctgagtacaacaagatgtt

SEQ ID NO: 6997411 - DNA, 22 bp, Homo sapiens
aaagtgctgtgggctgtaagtg

SEQ ID NO: 6997412 - DNA, 22 bp, Homo sapiens
gagcttcaaatggacgaccttt

SEQ ID NO: 6997413 - DNA, 22 bp, Homo sapiens
tgtcccaggtcctagatgacca

SEQ ID NO: 6997414 - DNA, 22 bp, Homo sapiens
ttccaggaagattcaacaaaag

SEQ ID NO: 6997415 - DNA, 22 bp, Homo sapiens
gaggggattggaaggaacaccc

SEQ ID NO: 6997416 - DNA, 22 bp, Homo sapiens
tcagtacttcccattctgagct

SEQ ID NO: 6997417 - DNA, 22 bp, Homo sapiens
ctcagtggtcggcacagtttgt

SEQ ID NO: 6997418 - DNA, 22 bp, Homo sapiens
attcttcactgtttcagaatga

SEQ ID NO: 6997419 - DNA, 23 bp, Homo sapiens
gcaatacaagactggtcatgagc

SEQ ID NO: 6997420 - DNA, 22 bp, Homo sapiens
cttggtcaaatgcaggcttccc

SEQ ID NO: 6997421 - DNA, 22 bp, Homo sapiens
acagcatccttctaaagtagct

SEQ ID NO: 6997422 - DNA, 20 bp, Homo sapiens
tgaggcccagcagagtcggg

SEQ ID NO: 6997423 - DNA, 22 bp, Homo sapiens
tgggaaatattggttattggat

SEQ ID NO: 6997424 - DNA, 22 bp, Homo sapiens
aaagtactcgaggaggaggagc

SEQ ID NO: 6997425 - DNA, 22 bp, Homo sapiens
aacatgtctgggtattcacaag

SEQ ID NO: 6997426 - DNA, 22 bp, Homo sapiens
atgatcatacagagccctggta

SEQ ID NO: 6997427 - DNA, 22 bp, Homo sapiens
accattacatgatccttaccca

SEQ ID NO: 6997428 - DNA, 22 bp, Homo sapiens
gtgcacacaagcaatgcactta

SEQ ID NO: 6997429 - DNA, 22 bp, Homo sapiens
cccagctccgagctccgagccg

SEQ ID NO: 6997430 - DNA, 22 bp, Homo sapiens
ctgtgtgtgctacaggcttcca

SEQ ID NO: 6997431 - DNA, 22 bp, Homo sapiens
gttgtcctccacatggcctctc

SEQ ID NO: 6997432 - DNA, 22 bp, Homo sapiens
caaggttttgcttgtaagggaa

SEQ ID NO: 6997433 - DNA, 22 bp, Homo sapiens
gagaaaggcatccttggcttca

SEQ ID NO: 6997434 - DNA, 22 bp, Homo sapiens
tacagctgttggtgtttcctct

SEQ ID NO: 6997435 - DNA, 22 bp, Homo sapiens
accctggcccattgctgtgcct

SEQ ID NO: 6997436 - DNA, 19 bp, Homo sapiens
tttgtgtatgtgcgtacca

SEQ ID NO: 6997437 - DNA, 22 bp, Homo sapiens
gggctggaggaccggcctcgga

SEQ ID NO: 6997438 - DNA, 22 bp, Homo sapiens
gttctgtactccaagctcttcc

SEQ ID NO: 6997439 - DNA, 22 bp, Homo sapiens
ccttacctgattgctggcatcc

SEQ ID NO: 6997440 - DNA, 22 bp, Homo sapiens
gctgctctggctctgcagtgtc

SEQ ID NO: 6997441 - DNA, 22 bp, Homo sapiens
aaacttgcgtcatgtcatgaaa

SEQ ID NO: 6997442 - DNA, 22 bp, Homo sapiens
catatacacttccacctctgtg

SEQ ID NO: 6997443 - DNA, 22 bp, Homo sapiens
acagtcaatgagtgagtgaatg

SEQ ID NO: 6997444 - DNA, 22 bp, Homo sapiens
tgctgcaggtgtgttcagtgag

SEQ ID NO: 6997445 - DNA, 22 bp, Homo sapiens
actgtattctagtcatgtttgt

SEQ ID NO: 6997446 - DNA, 23 bp, Homo sapiens
ctctccccctttgatgttagctc

SEQ ID NO: 6997447 - DNA, 22 bp, Homo sapiens
caggcagagcaactggtccaga

SEQ ID NO: 6997448 - DNA, 22 bp, Homo sapiens
actctgcctggaggtaacagga

SEQ ID NO: 6997449 - DNA, 22 bp, Homo sapiens
taaagtgctcataaaaatggat

SEQ ID NO: 6997450 - DNA, 22 bp, Homo sapiens
aagtgcccagtgaagcagtggt

SEQ ID NO: 6997451 - DNA, 22 bp, Homo sapiens
ggctggaaccagagtgaggcag

SEQ ID NO: 6997452 - DNA, 22 bp, Homo sapiens
gacaaggagccaccagtcacgt

SEQ ID NO: 6997453 - DNA, 22 bp, Homo sapiens
tttggcatttttcagatgactg

SEQ ID NO: 6997454 - DNA, 22 bp, Homo sapiens
ttccacaagatgtttcttagaa

SEQ ID NO: 6997455 - DNA, 22 bp, Homo sapiens
tttgcaaagttatttagactca

SEQ ID NO: 6997456 - DNA, 22 bp, Homo sapiens
ttgttgtagacgcgaagtgact

SEQ ID NO: 6997457 - DNA, 22 bp, Homo sapiens
gcctccacttttgctggcttct

SEQ ID NO: 6997458 - DNA, 22 bp, Homo sapiens
cactgaaccgtaaatgatttag

SEQ ID NO: 6997459 - DNA, 22 bp, Homo sapiens
agacatgagaaacccaccagag

SEQ ID NO: 6997460 - DNA, 20 bp, Homo sapiens
agcattttatggtaggaaac

SEQ ID NO: 6997461 - DNA, 22 bp, Homo sapiens
tctttagtgctgcttttggatt

SEQ ID NO: 6997462 - DNA, 22 bp, Homo sapiens
tgaaggccagctctttatcagc

SEQ ID NO: 6997463 - DNA, 22 bp, Homo sapiens
aggcttggaggttctgtagcca

SEQ ID NO: 6997464 - DNA, 22 bp, Homo sapiens
gaggtagccacagatagagact

SEQ ID NO: 6997465 - DNA, 22 bp, Homo sapiens
gtaaagctgtttctccaccgtc

SEQ ID NO: 6997466 - DNA, 22 bp, Homo sapiens
cccccggagctggggctcagct

SEQ ID NO: 6997467 - DNA, 21 bp, Homo sapiens
ccccatggagtacagttgggc

SEQ ID NO: 6997468 - DNA, 18 bp, Homo sapiens
ctcagggcatcagtctgg

SEQ ID NO: 6997469 - DNA, 22 bp, Homo sapiens
tctcccgacccatgtgccaggg

SEQ ID NO: 6997470 - DNA, 22 bp, Homo sapiens
gtgcaaatacatatgctgtgga

SEQ ID NO: 6997471 - DNA, 22 bp, Homo sapiens
ctgggcagaattttaggatggc

SEQ ID NO: 6997472 - DNA, 22 bp, Homo sapiens
caggccaatttcttgtcattta

SEQ ID NO: 6997473 - DNA, 22 bp, Homo sapiens
tcaaagtctatctgtaattact

SEQ ID NO: 6997474 - DNA, 22 bp, Homo sapiens
agtaaaactcacaaaaggatgg

SEQ ID NO: 6997475 - DNA, 22 bp, Homo sapiens
aaaagtactattttaacaaagt

SEQ ID NO: 6997476 - DNA, 22 bp, Homo sapiens
aggcactctgggtttaaattct

SEQ ID NO: 6997477 - DNA, 22 bp, Homo sapiens
gtttccaggcactttttctgct

SEQ ID NO: 6997478 - DNA, 22 bp, Homo sapiens
gaaatgtctctggatttgcttt

SEQ ID NO: 6997479 - DNA, 22 bp, Homo sapiens
aatgcaggttcttgggccacat

SEQ ID NO: 6997480 - DNA, 22 bp, Homo sapiens
cttgtatagggaaagataaatc

SEQ ID NO: 6997481 - DNA, 22 bp, Homo sapiens
aagttacagtcagaggttaaca

SEQ ID NO: 6997482 - DNA, 22 bp, Homo sapiens
ttgctttccgtcatgtgctaat

SEQ ID NO: 6997483 - DNA, 22 bp, Homo sapiens
cagactgactttctgtggctat

SEQ ID NO: 6997484 - DNA, 22 bp, Homo sapiens
aggcttgtggattggagcgagt

SEQ ID NO: 6997485 - DNA, 22 bp, Homo sapiens
atttggaaacaattatattctt

SEQ ID NO: 6997486 - DNA, 22 bp, Homo sapiens
agctctttatgtggaagaggca

SEQ ID NO: 6997487 - DNA, 22 bp, Homo sapiens
caacttatctaatgttgggata

SEQ ID NO: 6997488 - DNA, 22 bp, Homo sapiens
caggaaaatctgcccacacaag

SEQ ID NO: 6997489 - DNA, 22 bp, Homo sapiens
aggaagaacagataatggacgc

SEQ ID NO: 6997490 - DNA, 18 bp, Homo sapiens
acagggagggcgctgggg

SEQ ID NO: 6997491 - DNA, 22 bp, Homo sapiens
aggcaactgtttgataatgttg

SEQ ID NO: 6997492 - DNA, 22 bp, Homo sapiens
aaagagccagggcattaggtga

SEQ ID NO: 6997493 - DNA, 22 bp, Homo sapiens
aaactgaggctcccgagggtgt

SEQ ID NO: 6997494 - DNA, 22 bp, Homo sapiens
tgagacctgtaatgagaaattg

SEQ ID NO: 6997495 - DNA, 20 bp, Homo sapiens
ggcagatgcagagctatgca

SEQ ID NO: 6997496 - DNA, 22 bp, Homo sapiens
actgtttaaatatttgggctgg

SEQ ID NO: 6997497 - DNA, 22 bp, Homo sapiens
tgctggctatttaaagaagaaa

SEQ ID NO: 6997498 - DNA, 22 bp, Homo sapiens
taactttgagaactttctggtg

SEQ ID NO: 6997499 - DNA, 22 bp, Homo sapiens
cggggtggcactctaaatagaa

SEQ ID NO: 6997500 - DNA, 22 bp, Homo sapiens
gagagcaatggggacgggcagg

SEQ ID NO: 6997501 - DNA, 22 bp, Homo sapiens
gaactaaatttgacagacaaca

SEQ ID NO: 6997502 - DNA, 22 bp, Homo sapiens
cagccctggtgaggttggctat

SEQ ID NO: 6997503 - DNA, 19 bp, Homo sapiens
tttacaagttctttgtatg

SEQ ID NO: 6997504 - DNA, 22 bp, Homo sapiens
cttgttttaaactgttgtggct

SEQ ID NO: 6997505 - DNA, 22 bp, Homo sapiens
agtacaaaatgcagcatcatca

SEQ ID NO: 6997506 - DNA, 23 bp, Homo sapiens
tatgagtcatctgctacaaccca

SEQ ID NO: 6997507 - DNA, 22 bp, Homo sapiens
agccttgtagaccattttaagg

SEQ ID NO: 6997508 - DNA, 22 bp, Homo sapiens
gctggaggtagggaggtcctgt

SEQ ID NO: 6997509 - DNA, 20 bp, Homo sapiens
agtaagcaggacttctcctc

SEQ ID NO: 6997510 - DNA, 20 bp, Homo sapiens
cctgttcactgcgcagtttc

SEQ ID NO: 6997511 - DNA, 19 bp, Homo sapiens
ctgctcaggtcagtctgtc

SEQ ID NO: 6997512 - DNA, 22 bp, Homo sapiens
ctttcaggtcacataacgccaa

SEQ ID NO: 6997513 - DNA, 22 bp, Homo sapiens
gtaggcagataggagtgcagcc

SEQ ID NO: 6997514 - DNA, 22 bp, Homo sapiens
atcttccaggtgccgggggtca

SEQ ID NO: 6997515 - DNA, 22 bp, Homo sapiens
tcatgcatatggggtcagccca

SEQ ID NO: 6997516 - DNA, 22 bp, Homo sapiens
tgtcctagattggcctggagtt

SEQ ID NO: 6997517 - DNA, 22 bp, Homo sapiens
agctgagacacttgagagacta

SEQ ID NO: 6997518 - DNA, 19 bp, Homo sapiens
tgaggtctacatgggcatc

SEQ ID NO: 6997519 - DNA, 22 bp, Homo sapiens
aggtgccaagatgtcacagaca

SEQ ID NO: 6997520 - DNA, 19 bp, Homo sapiens
ctgcctgttatggagagaa

SEQ ID NO: 6997521 - DNA, 22 bp, Homo sapiens
ttctttggcatttcctgtatgt

SEQ ID NO: 6997522 - DNA, 22 bp, Homo sapiens
atcacgtcatggtttgatctgg

SEQ ID NO: 6997523 - DNA, 22 bp, Homo sapiens
aaagtgcatagagtagtgccta

SEQ ID NO: 6997524 - DNA, 22 bp, Homo sapiens
ctgtcctggccgcccttgtgag

SEQ ID NO: 6997525 - DNA, 22 bp, Homo sapiens
catgacatctgcttagtatgaa

SEQ ID NO: 6997526 - DNA, 22 bp, Homo sapiens
ctgccaggcactgggctctgca

SEQ ID NO: 6997527 - DNA, 21 bp, Homo sapiens
tccacaatagggaaattcacc

SEQ ID NO: 6997528 - DNA, 19 bp, Homo sapiens
tattatttgtagcaaggcc

SEQ ID NO: 6997529 - DNA, 22 bp, Homo sapiens
acttgggagggtgtgggcagct

SEQ ID NO: 6997530 - DNA, 22 bp, Homo sapiens
tgcaaatttgagcagactgttc

SEQ ID NO: 6997531 - DNA, 22 bp, Homo sapiens
tggctcagtgcattcacagtaa

SEQ ID NO: 6997532 - DNA, 19 bp, Homo sapiens
gtggttttctgaggagtct

SEQ ID NO: 6997533 - DNA, 22 bp, Homo sapiens
gaggtgtctgagtggggacctg

SEQ ID NO: 6997534 - DNA, 22 bp, Homo sapiens
ggaaatcaggggtgttgctttc

SEQ ID NO: 6997535 - DNA, 22 bp, Homo sapiens
tctggcaccctgacttagtgtt

SEQ ID NO: 6997536 - DNA, 22 bp, Homo sapiens
tgcccacattcaaaaggtgatg

SEQ ID NO: 6997537 - DNA, 22 bp, Homo sapiens
atgacagaggagtgcaggtgat

SEQ ID NO: 6997538 - DNA, 19 bp, Homo sapiens
tgtcctgctcgtgaaattc

SEQ ID NO: 6997539 - DNA, 22 bp, Homo sapiens
cctcctggagcattggtgagga

SEQ ID NO: 6997540 - DNA, 22 bp, Homo sapiens
ttcaagttacctttaaacagct

SEQ ID NO: 6997541 - DNA, 22 bp, Homo sapiens
ccactttgcaagatattcagag

SEQ ID NO: 6997542 - DNA, 22 bp, Homo sapiens
cggccgctgacaaatagttccc

SEQ ID NO: 6997543 - DNA, 22 bp, Homo sapiens
cacatggaagagatacagtgag

SEQ ID NO: 6997544 - DNA, 22 bp, Homo sapiens
tgtctggaagggctatgtgacc

SEQ ID NO: 6997545 - DNA, 22 bp, Homo sapiens
tggaatccaggaggagaggctc

SEQ ID NO: 6997546 - DNA, 22 bp, Homo sapiens
tgtctggctcattttctgcagt

SEQ ID NO: 6997547 - DNA, 22 bp, Homo sapiens
aaatgtctgtatgagaaagaga

SEQ ID NO: 6997548 - DNA, 17 bp, Homo sapiens
ccctctggggagggagg

SEQ ID NO: 6997549 - DNA, 22 bp, Homo sapiens
ccctccccacaaagcttcacac

SEQ ID NO: 6997550 - DNA, 22 bp, Homo sapiens
cacatttcttatggatgttggc

SEQ ID NO: 6997551 - DNA, 20 bp, Homo sapiens
ccactcagctgtattctcag

SEQ ID NO: 6997552 - DNA, 22 bp, Homo sapiens
ttatacacaattcttttactac

SEQ ID NO: 6997553 - DNA, 22 bp, Homo sapiens
aaaccacatgccttcaaatgct

SEQ ID NO: 6997554 - DNA, 22 bp, Homo sapiens
tgcctgctctgtgccacagttg

SEQ ID NO: 6997555 - DNA, 22 bp, Homo sapiens
aggccccaaagcagtgcaagta

SEQ ID NO: 6997556 - DNA, 22 bp, Homo sapiens
tcagcagagtttcatcttggga

SEQ ID NO: 6997557 - DNA, 22 bp, Homo sapiens
aaagccagcaaggtgagtttca

SEQ ID NO: 6997558 - DNA, 22 bp, Homo sapiens
ggaacacagaagggctgaaaaa

SEQ ID NO: 6997559 - DNA, 22 bp, Homo sapiens
tttgcacacacaataacaaatg

SEQ ID NO: 6997560 - DNA, 22 bp, Homo sapiens
cagcaggaggcatggcttccct

SEQ ID NO: 6997561 - DNA, 22 bp, Homo sapiens
cctgtggttacgcctgtttcca

SEQ ID NO: 6997562 - DNA, 22 bp, Homo sapiens
atctcaggaggttcctctgtcc

SEQ ID NO: 6997563 - DNA, 22 bp, Homo sapiens
tcctggccgctggcccctgaga

SEQ ID NO: 6997564 - DNA, 22 bp, Homo sapiens
cacaggtagatgccatgcagca

SEQ ID NO: 6997565 - DNA, 22 bp, Homo sapiens
cattgttgtgagatcaagcagt

SEQ ID NO: 6997566 - DNA, 22 bp, Homo sapiens
atgctttagttcaaaggactta

SEQ ID NO: 6997567 - DNA, 22 bp, Homo sapiens
tatgtacacacacatgcatgta

SEQ ID NO: 6997568 - DNA, 22 bp, Homo sapiens
taagtgagaaagacattaactg

SEQ ID NO: 6997569 - DNA, 22 bp, Homo sapiens
attttgctttatgtaaatatgt

SEQ ID NO: 6997570 - DNA, 22 bp, Homo sapiens
aggccacaaccaccctgtgccc

SEQ ID NO: 6997571 - DNA, 22 bp, Homo sapiens
taaagcatgtgttagaagtgca

SEQ ID NO: 6997572 - DNA, 22 bp, Homo sapiens
aaggccctcatgcgtcagagcc

SEQ ID NO: 6997573 - DNA, 20 bp, Homo sapiens
agcaaggctaaatcatgatt

SEQ ID NO: 6997574 - DNA, 22 bp, Homo sapiens
caatttttaaactatgaagttg

SEQ ID NO: 6997575 - DNA, 22 bp, Homo sapiens
gctgaagatgcatcccttctct

SEQ ID NO: 6997576 - DNA, 22 bp, Homo sapiens
tataggaatgacgtcatttcct

SEQ ID NO: 6997577 - DNA, 22 bp, Homo sapiens
gtgcagtatctctgggagtggg

SEQ ID NO: 6997578 - DNA, 22 bp, Homo sapiens
tgtgtacttttgtttctaagcc

SEQ ID NO: 6997579 - DNA, 22 bp, Homo sapiens
gaacgtaaatgttcatgtttga

SEQ ID NO: 6997580 - DNA, 22 bp, Homo sapiens
tatgcacattatctaatccatt

SEQ ID NO: 6997581 - DNA, 22 bp, Homo sapiens
gtgaaggactagcatggagggc

SEQ ID NO: 6997582 - DNA, 22 bp, Homo sapiens
ttcttagctccagcttcatgtt

SEQ ID NO: 6997583 - DNA, 22 bp, Homo sapiens
ttggataaaaatgtttaagtgt

SEQ ID NO: 6997584 - DNA, 20 bp, Homo sapiens
caatgcacacagctgcttct

SEQ ID NO: 6997585 - DNA, 22 bp, Homo sapiens
tgggcaaggctggagcctgcag

SEQ ID NO: 6997586 - DNA, 22 bp, Homo sapiens
aaatgcacaaagtaagtgtaat

SEQ ID NO: 6997587 - DNA, 22 bp, Homo sapiens
cctgtaatcccaactacttggg

SEQ ID NO: 6997588 - DNA, 22 bp, Homo sapiens
ctgatacactccctaaaatata

SEQ ID NO: 6997589 - DNA, 22 bp, Homo sapiens
aagtctgagagaaactctctca

SEQ ID NO: 6997590 - DNA, 22 bp, Homo sapiens
gggggtaggcagacaaggacat

SEQ ID NO: 6997591 - DNA, 22 bp, Homo sapiens
taggttccatgagggaggcaaa

SEQ ID NO: 6997592 - DNA, 22 bp, Homo sapiens
attgttgctaggattcaatgag

SEQ ID NO: 6997593 - DNA, 22 bp, Homo sapiens
gcctggcaggaatctcagtgct

SEQ ID NO: 6997594 - DNA, 21 bp, Homo sapiens
ttggccgtgcagatgaacagc

SEQ ID NO: 6997595 - DNA, 22 bp, Homo sapiens
aagtgaattcattgtgttatat

SEQ ID NO: 6997596 - DNA, 22 bp, Homo sapiens
tagtctggacttcttagtgtca

SEQ ID NO: 6997597 - DNA, 22 bp, Homo sapiens
cacagcgtgtccctgcggatgc

SEQ ID NO: 6997598 - DNA, 22 bp, Homo sapiens
tatgacaggcatgagatcctaa

SEQ ID NO: 6997599 - DNA, 22 bp, Homo sapiens
tatacagaactgcacgtgcacg

SEQ ID NO: 6997600 - DNA, 22 bp, Homo sapiens
aatatagaatcactttccttca

SEQ ID NO: 6997601 - DNA, 22 bp, Homo sapiens
ttgtaattaatggcagcaatta

SEQ ID NO: 6997602 - DNA, 22 bp, Homo sapiens
aagttcccgaggaccacagttg

SEQ ID NO: 6997603 - DNA, 22 bp, Homo sapiens
ctccaggcttcaagggccggcc

SEQ ID NO: 6997604 - DNA, 22 bp, Homo sapiens
gcccacagttaatgggggctct

SEQ ID NO: 6997605 - DNA, 22 bp, Homo sapiens
gagaaggtggatttcgtatccc

SEQ ID NO: 6997606 - DNA, 21 bp, Homo sapiens
tccaacatgcctgatggtgcc

SEQ ID NO: 6997607 - DNA, 19 bp, Homo sapiens
gggcagtggcactagggag

SEQ ID NO: 6997608 - DNA, 22 bp, Homo sapiens
ggcagaatgggctattataatg

SEQ ID NO: 6997609 - DNA, 16 bp, Homo sapiens
tgcctgctctgatctc

SEQ ID NO: 6997610 - DNA, 22 bp, Homo sapiens
agaatgattttggacaatatgg

SEQ ID NO: 6997611 - DNA, 22 bp, Homo sapiens
gcacccatgctcttgtctcagg

SEQ ID NO: 6997612 - DNA, 22 bp, Homo sapiens
tccctgaggatgaggctgatca

SEQ ID NO: 6997613 - DNA, 19 bp, Homo sapiens
tggcatctgtaaaatggtg

SEQ ID NO: 6997614 - DNA, 22 bp, Homo sapiens
tggcaggaagacgtggggcacc

SEQ ID NO: 6997615 - DNA, 22 bp, Homo sapiens
gagctgcacatctgaggctaat

SEQ ID NO: 6997616 - DNA, 21 bp, Homo sapiens
tttgttcaggggcaaagttaa

SEQ ID NO: 6997617 - DNA, 22 bp, Homo sapiens
tgggcgaggcccagggctgcgt

SEQ ID NO: 6997618 - DNA, 22 bp, Homo sapiens
aggaaaggggtaggtgtggacg

SEQ ID NO: 6997619 - DNA, 22 bp, Homo sapiens
tgtgctgtggaagtttagagaa

SEQ ID NO: 6997620 - DNA, 22 bp, Homo sapiens
tctcccacagtctcccatggct

SEQ ID NO: 6997621 - DNA, 22 bp, Homo sapiens
caggcttgtgctccactttcag

SEQ ID NO: 6997622 - DNA, 22 bp, Homo sapiens
ccccaaagcctcagcctgcctg

SEQ ID NO: 6997623 - DNA, 22 bp, Homo sapiens
ctctgaaagagtttagtattat

SEQ ID NO: 6997624 - DNA, 20 bp, Homo sapiens
atacacatattcttgcaact

SEQ ID NO: 6997625 - DNA, 22 bp, Homo sapiens
caagcatttattataattatca

SEQ ID NO: 6997626 - DNA, 22 bp, Homo sapiens
cctctgctgctgttgagcaccg

SEQ ID NO: 6997627 - DNA, 22 bp, Homo sapiens
caggctgatagggtccaaagtt

SEQ ID NO: 6997628 - DNA, 22 bp, Homo sapiens
actgccttgtctcttgcctgtt

SEQ ID NO: 6997629 - DNA, 22 bp, Homo sapiens
actgtctgtgccagatgctggg

SEQ ID NO: 6997630 - DNA, 22 bp, Homo sapiens
tgctgccacctgtggtagtctg

SEQ ID NO: 6997631 - DNA, 22 bp, Homo sapiens
tgtgtactcaattgagccattt

SEQ ID NO: 6997632 - DNA, 22 bp, Homo sapiens
caagtatatttgaacatgtaaa

SEQ ID NO: 6997633 - DNA, 22 bp, Homo sapiens
gtttggtgtgagttcataccac

SEQ ID NO: 6997634 - DNA, 22 bp, Homo sapiens
tccttcagctctctatttagat

SEQ ID NO: 6997635 - DNA, 22 bp, Homo sapiens
tcccactgtgcctgttgtaatc

SEQ ID NO: 6997636 - DNA, 22 bp, Homo sapiens
agcatagggtcctagtacacag

SEQ ID NO: 6997637 - DNA, 22 bp, Homo sapiens
actggtggccctcagtgttctc

SEQ ID NO: 6997638 - DNA, 22 bp, Homo sapiens
ctggttctgattttgctgcatt

SEQ ID NO: 6997639 - DNA, 22 bp, Homo sapiens
aacaatgtgttcagcactgtgg

SEQ ID NO: 6997640 - DNA, 22 bp, Homo sapiens
gggccctgccccgtggctctga

SEQ ID NO: 6997641 - DNA, 22 bp, Homo sapiens
acacagatattgtacttgatcc

SEQ ID NO: 6997642 - DNA, 22 bp, Homo sapiens
tgggctttatcatgggtctggt

SEQ ID NO: 6997643 - DNA, 22 bp, Homo sapiens
tgaagagtttccagcctgcttg

SEQ ID NO: 6997644 - DNA, 22 bp, Homo sapiens
ccacagctgaccgcaggtgagc

SEQ ID NO: 6997645 - DNA, 22 bp, Homo sapiens
tcacttttgggtttccagtaga

SEQ ID NO: 6997646 - DNA, 22 bp, Homo sapiens
atgtgactttgtgtcttccatc

SEQ ID NO: 6997647 - DNA, 22 bp, Homo sapiens
agatgctgggatgcttggatgg

SEQ ID NO: 6997648 - DNA, 23 bp, Homo sapiens
actttgcatacccaaattgtttt

SEQ ID NO: 6997649 - DNA, 22 bp, Homo sapiens
ttgctgtttctctgtgtctggt

SEQ ID NO: 6997650 - DNA, 23 bp, Homo sapiens
tgcccattgcatcttggtactgg

SEQ ID NO: 6997651 - DNA, 22 bp, Homo sapiens
aaatggtaccctaatggccaga

SEQ ID NO: 6997652 - DNA, 22 bp, Homo sapiens
caaatctgagtctacaatttta

SEQ ID NO: 6997653 - DNA, 22 bp, Homo sapiens
tgatgcccccaaatctggctca

SEQ ID NO: 6997654 - DNA, 22 bp, Homo sapiens
ggggacgcagaaagagtggcag

SEQ ID NO: 6997655 - DNA, 22 bp, Homo sapiens
agccaggggattcatcagggac

SEQ ID NO: 6997656 - DNA, 23 bp, Homo sapiens
ctatggaataccaatgattctca

SEQ ID NO: 6997657 - DNA, 22 bp, Homo sapiens
aacaagaagggaaggcatgatt

SEQ ID NO: 6997658 - DNA, 22 bp, Homo sapiens
ttctgggacattgcaggtattc

SEQ ID NO: 6997659 - DNA, 22 bp, Homo sapiens
gccagctggagtgagagtgggc

SEQ ID NO: 6997660 - DNA, 22 bp, Homo sapiens
tagcaggaaggttcagggccct

SEQ ID NO: 6997661 - DNA, 23 bp, Homo sapiens
gtgtgttcccggagtagctcccg

SEQ ID NO: 6997662 - DNA, 22 bp, Homo sapiens
tttgggctgagatgtgggccga

SEQ ID NO: 6997663 - DNA, 22 bp, Homo sapiens
tctagacatcttggctgcaatt

SEQ ID NO: 6997664 - DNA, 23 bp, Homo sapiens
ttgggctcagtggcaggaagagt

SEQ ID NO: 6997665 - DNA, 22 bp, Homo sapiens
acacagagtccttactgaggta

SEQ ID NO: 6997666 - DNA, 22 bp, Homo sapiens
ctgaaggctgaggctgtgttgt

SEQ ID NO: 6997667 - DNA, 22 bp, Homo sapiens
tgagttactgcctagtaacttg

SEQ ID NO: 6997668 - DNA, 22 bp, Homo sapiens
ggacctgaaggaaagccactta

SEQ ID NO: 6997669 - DNA, 22 bp, Homo sapiens
ttatagaaggagcattcactta

SEQ ID NO: 6997670 - DNA, 18 bp, Homo sapiens
agcagctttgacaggaaa

SEQ ID NO: 6997671 - DNA, 20 bp, Homo sapiens
ggtccttgtcacaaggagag

SEQ ID NO: 6997672 - DNA, 22 bp, Homo sapiens
cattaatttaatattcaaagaa

SEQ ID NO: 6997673 - DNA, 22 bp, Homo sapiens
gtggcatcgtctgaggtggggt

SEQ ID NO: 6997674 - DNA, 22 bp, Homo sapiens
cttcttaatgacagattaaaat

SEQ ID NO: 6997675 - DNA, 22 bp, Homo sapiens
tttggccacagatccttggggg

SEQ ID NO: 6997676 - DNA, 18 bp, Homo sapiens
taaaggaagtgggagagg

SEQ ID NO: 6997677 - DNA, 22 bp, Homo sapiens
ttcttctgtgaggtgtgtgcct

SEQ ID NO: 6997678 - DNA, 21 bp, Homo sapiens
taagggcaggaattgggcttt

SEQ ID NO: 6997679 - DNA, 22 bp, Homo sapiens
ggctctgtttactttcagaggc

SEQ ID NO: 6997680 - DNA, 22 bp, Homo sapiens
tgctggcagcttctttaaatgt

SEQ ID NO: 6997681 - DNA, 22 bp, Homo sapiens
ccatggcaaaggagatgttttc

SEQ ID NO: 6997682 - DNA, 22 bp, Homo sapiens
gaaggtgtcagcaagtcaaagc

SEQ ID NO: 6997683 - DNA, 22 bp, Homo sapiens
acagctgtggccacttgcatcc

SEQ ID NO: 6997684 - DNA, 22 bp, Homo sapiens
tgtggccatatactttgttgtg

SEQ ID NO: 6997685 - DNA, 22 bp, Homo sapiens
cagatgaactctatcctgtggc

SEQ ID NO: 6997686 - DNA, 19 bp, Homo sapiens
agttgaattaacttgtcac

SEQ ID NO: 6997687 - DNA, 21 bp, Homo sapiens
atattggtatctttttaaatc

SEQ ID NO: 6997688 - DNA, 22 bp, Homo sapiens
tatgcatatgaccccaagcttg

SEQ ID NO: 6997689 - DNA, 22 bp, Homo sapiens
taaggcttatgatcagaaggtt

SEQ ID NO: 6997690 - DNA, 22 bp, Homo sapiens
aagttcaaggaagcctccagtt

SEQ ID NO: 6997691 - DNA, 22 bp, Homo sapiens
acaatgatgcagatgagtaaga

SEQ ID NO: 6997692 - DNA, 22 bp, Homo sapiens
tctcagttttttcaaccataat

SEQ ID NO: 6997693 - DNA, 22 bp, Homo sapiens
gagtaggaatgttctgccatct

SEQ ID NO: 6997694 - DNA, 22 bp, Homo sapiens
gttagtttgaacttgtctatgt

SEQ ID NO: 6997695 - DNA, 22 bp, Homo sapiens
agacggattacctgaggtcagg

SEQ ID NO: 6997696 - DNA, 22 bp, Homo sapiens
gtgcgatgcctgcttcttaggg

SEQ ID NO: 6997697 - DNA, 22 bp, Homo sapiens
tggtagtgactcccccagggct

SEQ ID NO: 6997698 - DNA, 22 bp, Homo sapiens
gagagaagaatgttccgaggcc

SEQ ID NO: 6997699 - DNA, 22 bp, Homo sapiens
ggcccaggtccagcgagtacct

SEQ ID NO: 6997700 - DNA, 22 bp, Homo sapiens
ggtaagattcttcaaacaagag

SEQ ID NO: 6997701 - DNA, 22 bp, Homo sapiens
aatggcttttaaaaatagcatt

SEQ ID NO: 6997702 - DNA, 22 bp, Homo sapiens
tcatggagactttgagcctgtt

SEQ ID NO: 6997703 - DNA, 22 bp, Homo sapiens
tttgatatcttggtatacagat

SEQ ID NO: 6997704 - DNA, 22 bp, Homo sapiens
ggaggtggtttgatttctatat

SEQ ID NO: 6997705 - DNA, 22 bp, Homo sapiens
gatgacataaacttaacagtat

SEQ ID NO: 6997706 - DNA, 22 bp, Homo sapiens
ccatgtggctgtgtggtttatt

SEQ ID NO: 6997707 - DNA, 22 bp, Homo sapiens
tcaggaggtaggacatactggt

SEQ ID NO: 6997708 - DNA, 22 bp, Homo sapiens
cgtattcactcaggacacatag

SEQ ID NO: 6997709 - DNA, 22 bp, Homo sapiens
ccagcatcagcattgtcttagg

SEQ ID NO: 6997710 - DNA, 22 bp, Homo sapiens
taatgaacacagaatttcactt

SEQ ID NO: 6997711 - DNA, 22 bp, Homo sapiens
tagaagcacagcctgatggaca

SEQ ID NO: 6997712 - DNA, 22 bp, Homo sapiens
tcttgttttgaactcatcagga

SEQ ID NO: 6997713 - DNA, 20 bp, Homo sapiens
cccagaagtcacctccactc

SEQ ID NO: 6997714 - DNA, 19 bp, Homo sapiens
tccacctttcttcatttgg

SEQ ID NO: 6997715 - DNA, 22 bp, Homo sapiens
gcctcctggattttagtgccat

SEQ ID NO: 6997716 - DNA, 22 bp, Homo sapiens
ggccctgagctgaagtactgtg

SEQ ID NO: 6997717 - DNA, 22 bp, Homo sapiens
gtagtcacaaaccattcatatg

SEQ ID NO: 6997718 - DNA, 22 bp, Homo sapiens
cgcgcggctctcgcgagatgtg

SEQ ID NO: 6997719 - DNA, 22 bp, Homo sapiens
ctgaggagaaagatggtccaag

SEQ ID NO: 6997720 - DNA, 21 bp, Homo sapiens
tctgggctgctgctgcccatc

SEQ ID NO: 6997721 - DNA, 22 bp, Homo sapiens
ttggcagactgggtcctgggga

SEQ ID NO: 6997722 - DNA, 18 bp, Homo sapiens
ttctgtgcatctttctat

SEQ ID NO: 6997723 - DNA, 19 bp, Homo sapiens
agagaaagaattgagtcta

SEQ ID NO: 6997724 - DNA, 22 bp, Homo sapiens
ttggcagtaaaagaaaatgctt

SEQ ID NO: 6997725 - DNA, 22 bp, Homo sapiens
tctagaatctaaactatagttt

SEQ ID NO: 6997726 - DNA, 22 bp, Homo sapiens
gtgtttcccaagcctgggaagg

SEQ ID NO: 6997727 - DNA, 22 bp, Homo sapiens
gctgctgctggtctggggccac

SEQ ID NO: 6997728 - DNA, 22 bp, Homo sapiens
agcttaatggaacttgctcaaa

SEQ ID NO: 6997729 - DNA, 20 bp, Homo sapiens
ataggttacaggtctttcaa

SEQ ID NO: 6997730 - DNA, 22 bp, Homo sapiens
acctgctgtcttgggggaatgc

SEQ ID NO: 6997731 - DNA, 22 bp, Homo sapiens
aaatcagagtggttggtcatcc

SEQ ID NO: 6997732 - DNA, 22 bp, Homo sapiens
gcctggagctcggctgagggcg

SEQ ID NO: 6997733 - DNA, 22 bp, Homo sapiens
gtttctctgtctgttacattgg

SEQ ID NO: 6997734 - DNA, 22 bp, Homo sapiens
cagctgtctgaagcaggagtcc

SEQ ID NO: 6997735 - DNA, 22 bp, Homo sapiens
gtgccaaggtgctaagggcatg

SEQ ID NO: 6997736 - DNA, 19 bp, Homo sapiens
aggctgtgagggaggactc

SEQ ID NO: 6997737 - DNA, 22 bp, Homo sapiens
agctgaagtcctcgcggtgcta

SEQ ID NO: 6997738 - DNA, 22 bp, Homo sapiens
ctaagaaatgttgtgaatgcca

SEQ ID NO: 6997739 - DNA, 22 bp, Homo sapiens
tactgaaaatcctgcctgtcct

SEQ ID NO: 6997740 - DNA, 22 bp, Homo sapiens
agacagcaatatgggagacgga

SEQ ID NO: 6997741 - DNA, 22 bp, Homo sapiens
ttggaagcattctgaatgtcca

SEQ ID NO: 6997742 - DNA, 22 bp, Homo sapiens
ctgggcctttgggagttcggtg

SEQ ID NO: 6997743 - DNA, 22 bp, Homo sapiens
aaaaggtagttgccaaataagg

SEQ ID NO: 6997744 - DNA, 22 bp, Homo sapiens
aggatttgaacctaggcaatca

SEQ ID NO: 6997745 - DNA, 22 bp, Homo sapiens
attaacatgagttggagatagg

SEQ ID NO: 6997746 - DNA, 22 bp, Homo sapiens
ctctctggtacatagagtttgg

SEQ ID NO: 6997747 - DNA, 22 bp, Homo sapiens
ttgcaaataaacaagtatacat

SEQ ID NO: 6997748 - DNA, 22 bp, Homo sapiens
aggcttcagacaaatgttatgg

SEQ ID NO: 6997749 - DNA, 22 bp, Homo sapiens
cttcatttcaggctgaagaata

SEQ ID NO: 6997750 - DNA, 22 bp, Homo sapiens
tttagcttcatcttcaagctgg

SEQ ID NO: 6997751 - DNA, 22 bp, Homo sapiens
ctgggagtactgggggatgtca

SEQ ID NO: 6997752 - DNA, 22 bp, Homo sapiens
agtaaactgggaaggtgcaggg

SEQ ID NO: 6997753 - DNA, 22 bp, Homo sapiens
gaggcaacacatttggaaagca

SEQ ID NO: 6997754 - DNA, 22 bp, Homo sapiens
gaccctttctgagtgagcagtt

SEQ ID NO: 6997755 - DNA, 22 bp, Homo sapiens
aaagttacacgactatttatgt

SEQ ID NO: 6997756 - DNA, 22 bp, Homo sapiens
aagaggaagtctccatggagag

SEQ ID NO: 6997757 - DNA, 22 bp, Homo sapiens
aatagtctctcccacaccatcc

SEQ ID NO: 6997758 - DNA, 18 bp, Homo sapiens
cctcggagcctccgtgtc

SEQ ID NO: 6997759 - DNA, 22 bp, Homo sapiens
gaaagcatccgcctggaggtgg

SEQ ID NO: 6997760 - DNA, 22 bp, Homo sapiens
acaattgcattgtcacaaataa

SEQ ID NO: 6997761 - DNA, 22 bp, Homo sapiens
ccaggctccccaggaggccctt

SEQ ID NO: 6997762 - DNA, 22 bp, Homo sapiens
tgcttgctgggccaatggcaat

SEQ ID NO: 6997763 - DNA, 22 bp, Homo sapiens
ccaataattcttcaagtgtttt

SEQ ID NO: 6997764 - DNA, 22 bp, Homo sapiens
agctgctgccggtggccaccct

SEQ ID NO: 6997765 - DNA, 17 bp, Homo sapiens
ccctcactcctgccggg

SEQ ID NO: 6997766 - DNA, 22 bp, Homo sapiens
gaagaaggtgctacacagggca

SEQ ID NO: 6997767 - DNA, 22 bp, Homo sapiens
tcattgtcttgatatgattgtc

SEQ ID NO: 6997768 - DNA, 22 bp, Homo sapiens
tgaatcctaattctatcactta

SEQ ID NO: 6997769 - DNA, 22 bp, Homo sapiens
tcagaggcctgaaagaatttgg

SEQ ID NO: 6997770 - DNA, 22 bp, Homo sapiens
acattgtttggaggagtgagag

SEQ ID NO: 6997771 - DNA, 22 bp, Homo sapiens
taggtactggacataatataag

SEQ ID NO: 6997772 - DNA, 22 bp, Homo sapiens
tgagtcactatcactttctctg

SEQ ID NO: 6997773 - DNA, 22 bp, Homo sapiens
ctgagggagctgctggccttgg

SEQ ID NO: 6997774 - DNA, 19 bp, Homo sapiens
atcattgatcttcacccct

SEQ ID NO: 6997775 - DNA, 22 bp, Homo sapiens
agtgccttgggtattttgagta

SEQ ID NO: 6997776 - DNA, 22 bp, Homo sapiens
ttgtggaaatacagactccaag

SEQ ID NO: 6997777 - DNA, 22 bp, Homo sapiens
cctaacttcacttcattgaagt

SEQ ID NO: 6997778 - DNA, 22 bp, Homo sapiens
agagactgtaatgagaggtaca

SEQ ID NO: 6997779 - DNA, 22 bp, Homo sapiens
tgtcagtgccaactttgctggt

SEQ ID NO: 6997780 - DNA, 22 bp, Homo sapiens
atgatccaaagccacaggggca

SEQ ID NO: 6997781 - DNA, 22 bp, Homo sapiens
agcaaagcttccataaagcagc

SEQ ID NO: 6997782 - DNA, 22 bp, Homo sapiens
ccaggtgtccccgtcactgcag

SEQ ID NO: 6997783 - DNA, 22 bp, Homo sapiens
agatgtgatgttaggcccttgg

SEQ ID NO: 6997784 - DNA, 22 bp, Homo sapiens
gagcaaggtagctctctggggc

SEQ ID NO: 6997785 - DNA, 17 bp, Homo sapiens
cagctttatgctactgt

SEQ ID NO: 6997786 - DNA, 22 bp, Homo sapiens
gttgcctaggctggagtgcagt

SEQ ID NO: 6997787 - DNA, 22 bp, Homo sapiens
tcatctaattttggaacagaga

SEQ ID NO: 6997788 - DNA, 22 bp, Homo sapiens
cgcggtctcagccgctcgcagc

SEQ ID NO: 6997789 - DNA, 19 bp, Homo sapiens
ctctctccagtggctggct

SEQ ID NO: 6997790 - DNA, 22 bp, Homo sapiens
tttcatgattaacttagtgaat

SEQ ID NO: 6997791 - DNA, 22 bp, Homo sapiens
aaacattcacatttgctagtaa

SEQ ID NO: 6997792 - DNA, 22 bp, Homo sapiens
ttacaataccacatcacctcat

SEQ ID NO: 6997793 - DNA, 22 bp, Homo sapiens
aggaagagctggaccagaggac

SEQ ID NO: 6997794 - DNA, 22 bp, Homo sapiens
ggtgcgattggcttcacactgt

SEQ ID NO: 6997795 - DNA, 20 bp, Homo sapiens
caagttcaccttctcctctc

SEQ ID NO: 6997796 - DNA, 22 bp, Homo sapiens
caggtcctcacgcctcaccctt

SEQ ID NO: 6997797 - DNA, 22 bp, Homo sapiens
atgagagtctcagagtctcttc

SEQ ID NO: 6997798 - DNA, 22 bp, Homo sapiens
gtgcacagattcagaggttttg

SEQ ID NO: 6997799 - DNA, 22 bp, Homo sapiens
cagctccaaagccccactgtcc

SEQ ID NO: 6997800 - DNA, 23 bp, Homo sapiens
ggctgagactacaggcgcttgcc

SEQ ID NO: 6997801 - DNA, 22 bp, Homo sapiens
tctggcttttctcttggatggt

SEQ ID NO: 6997802 - DNA, 22 bp, Homo sapiens
atgatggttgtcctaggtgcat

SEQ ID NO: 6997803 - DNA, 22 bp, Homo sapiens
ccaggtgtgagcattctgtctt

SEQ ID NO: 6997804 - DNA, 22 bp, Homo sapiens
agatttcagatgctcggcagtt

SEQ ID NO: 6997805 - DNA, 22 bp, Homo sapiens
catggctgaaattcttcgcttg

SEQ ID NO: 6997806 - DNA, 22 bp, Homo sapiens
tggcttgtgttttatctcgcat

SEQ ID NO: 6997807 - DNA, 22 bp, Homo sapiens
gactttatcctgcctgaccacg

SEQ ID NO: 6997808 - DNA, 22 bp, Homo sapiens
tttggaaactgatggtacattc

SEQ ID NO: 6997809 - DNA, 22 bp, Homo sapiens
cattcccacgtgttctttgctt

SEQ ID NO: 6997810 - DNA, 22 bp, Homo sapiens
tcactttacagatgggaaaact

SEQ ID NO: 6997811 - DNA, 22 bp, Homo sapiens
ttcttaggggcagtcgggtcag

SEQ ID NO: 6997812 - DNA, 22 bp, Homo sapiens
ctcctgccaccgcggtgtcctg

SEQ ID NO: 6997813 - DNA, 18 bp, Homo sapiens
acaggctgtgggaatggt

SEQ ID NO: 6997814 - DNA, 22 bp, Homo sapiens
caaacctgactggggatgggcg

SEQ ID NO: 6997815 - DNA, 22 bp, Homo sapiens
ttcacaggatatatgtgcaggg

SEQ ID NO: 6997816 - DNA, 22 bp, Homo sapiens
tcactgcttaactcaagatctc

SEQ ID NO: 6997817 - DNA, 22 bp, Homo sapiens
caagcccagatcctgcgtgtct

SEQ ID NO: 6997818 - DNA, 21 bp, Homo sapiens
tgtgtgtatgcacacacatgc

SEQ ID NO: 6997819 - DNA, 22 bp, Homo sapiens
agtcatatttatataatttccc

SEQ ID NO: 6997820 - DNA, 22 bp, Homo sapiens
tcctcagctttggtttactcat

SEQ ID NO: 6997821 - DNA, 22 bp, Homo sapiens
ctgggctacgtgttgacagcat

SEQ ID NO: 6997822 - DNA, 22 bp, Homo sapiens
ttggccctggcacacccccacg

SEQ ID NO: 6997823 - DNA, 22 bp, Homo sapiens
cagtgagaaaactaagacatta

SEQ ID NO: 6997824 - DNA, 17 bp, Homo sapiens
ttcctcctcaccatgtt

SEQ ID NO: 6997825 - DNA, 22 bp, Homo sapiens
tttgtgttgttttaagccacta

SEQ ID NO: 6997826 - DNA, 22 bp, Homo sapiens
ctctgtgtctgagttatggtct

SEQ ID NO: 6997827 - DNA, 22 bp, Homo sapiens
ggtcccatgactgacacagcag

SEQ ID NO: 6997828 - DNA, 22 bp, Homo sapiens
acctctgagccatggaaggtga

SEQ ID NO: 6997829 - DNA, 22 bp, Homo sapiens
atgaaaagttcgatctagaagg

SEQ ID NO: 6997830 - DNA, 22 bp, Homo sapiens
ttcctgagtcccgggtaaagat

SEQ ID NO: 6997831 - DNA, 22 bp, Homo sapiens
caccgcggagtgatggagaaac

SEQ ID NO: 6997832 - DNA, 21 bp, Homo sapiens
atagtgctagaatcagaggct

SEQ ID NO: 6997833 - DNA, 19 bp, Homo sapiens
caagttaaaatgaggtcat

SEQ ID NO: 6997834 - DNA, 19 bp, Homo sapiens
ggaaacagcacacttttga

SEQ ID NO: 6997835 - DNA, 22 bp, Homo sapiens
aggtcaggaggttaagagtctt

SEQ ID NO: 6997836 - DNA, 22 bp, Homo sapiens
tggcaggaaaaacattggagat

SEQ ID NO: 6997837 - DNA, 22 bp, Homo sapiens
tcacagacacagggagaagcat

SEQ ID NO: 6997838 - DNA, 22 bp, Homo sapiens
ggaaggaggatgctctggcctt

SEQ ID NO: 6997839 - DNA, 22 bp, Homo sapiens
cagctcagtgatgccttcacag

SEQ ID NO: 6997840 - DNA, 22 bp, Homo sapiens
cataatttctaccagggccata

SEQ ID NO: 6997841 - DNA, 20 bp, Homo sapiens
gggagaagggctgatgagag

SEQ ID NO: 6997842 - DNA, 22 bp, Homo sapiens
agcatccaacaggagggaaggg

SEQ ID NO: 6997843 - DNA, 22 bp, Homo sapiens
cgtcactggcgtgaagtgagga

SEQ ID NO: 6997844 - DNA, 22 bp, Homo sapiens
tcattaagattcctatggcatt

SEQ ID NO: 6997845 - DNA, 22 bp, Homo sapiens
agatggtgagggcagaagtaac

SEQ ID NO: 6997846 - DNA, 22 bp, Homo sapiens
cagaatctgagtcgtgattgta

SEQ ID NO: 6997847 - DNA, 22 bp, Homo sapiens
catgagttttttagttcatgca

SEQ ID NO: 6997848 - DNA, 22 bp, Homo sapiens
gggtgcagagcttaactgtagg

SEQ ID NO: 6997849 - DNA, 22 bp, Homo sapiens
ttcagaaacagagtgagtgagt

SEQ ID NO: 6997850 - DNA, 22 bp, Homo sapiens
gtgcagagaaatgagaagtcga

SEQ ID NO: 6997851 - DNA, 19 bp, Homo sapiens
taccctcagggcctcattt

SEQ ID NO: 6997852 - DNA, 22 bp, Homo sapiens
tactcacattctgtttcttgct

SEQ ID NO: 6997853 - DNA, 22 bp, Homo sapiens
agctttggttgccatgatctga

SEQ ID NO: 6997854 - DNA, 22 bp, Homo sapiens
ccagcccttgaggtctgtccat

SEQ ID NO: 6997855 - DNA, 19 bp, Homo sapiens
tttaagcaatagtatcttg

SEQ ID NO: 6997856 - DNA, 22 bp, Homo sapiens
gagaaggagctcaaatatggct

SEQ ID NO: 6997857 - DNA, 22 bp, Homo sapiens
gtaacatagtttgtgcttcatc

SEQ ID NO: 6997858 - DNA, 22 bp, Homo sapiens
aaactctcattttagtgcactg

SEQ ID NO: 6997859 - DNA, 22 bp, Homo sapiens
tagaaacctcagggaaatcttt

SEQ ID NO: 6997860 - DNA, 22 bp, Homo sapiens
tgggtgtgccatattccatttc

SEQ ID NO: 6997861 - DNA, 22 bp, Homo sapiens
ggggcagaaagcccacagagtg

SEQ ID NO: 6997862 - DNA, 22 bp, Homo sapiens
gggcttgaggtgaaggtaggga

SEQ ID NO: 6997863 - DNA, 22 bp, Homo sapiens
gtctttgtggtagtcctcagcc

SEQ ID NO: 6997864 - DNA, 23 bp, Homo sapiens
tgcaatggcatgatttcagctca

SEQ ID NO: 6997865 - DNA, 22 bp, Homo sapiens
ttgaattatatgtatgtccttt

SEQ ID NO: 6997866 - DNA, 22 bp, Homo sapiens
attgggctggccttctggagag

SEQ ID NO: 6997867 - DNA, 22 bp, Homo sapiens
gtctgagggagaaggatctggg

SEQ ID NO: 6997868 - DNA, 22 bp, Homo sapiens
tgccacctagtggtctttagtc

SEQ ID NO: 6997869 - DNA, 19 bp, Homo sapiens
tgcccagagtgtatgcgca

SEQ ID NO: 6997870 - DNA, 22 bp, Homo sapiens
atttacagaccctcccactaag

SEQ ID NO: 6997871 - DNA, 22 bp, Homo sapiens
catccatagcttgatctgttcc

SEQ ID NO: 6997872 - DNA, 22 bp, Homo sapiens
aaaaactggtaactattcccca

SEQ ID NO: 6997873 - DNA, 22 bp, Homo sapiens
ctctccagaatatgccgccgtg

SEQ ID NO: 6997874 - DNA, 22 bp, Homo sapiens
tgcctggattcaaagctcatgt

SEQ ID NO: 6997875 - DNA, 21 bp, Homo sapiens
ctcaaatgccagttttattta

SEQ ID NO: 6997876 - DNA, 22 bp, Homo sapiens
gagtaaacagatattgactttc

SEQ ID NO: 6997877 - DNA, 22 bp, Homo sapiens
tgcatctttctgcatatgtaaa

SEQ ID NO: 6997878 - DNA, 22 bp, Homo sapiens
tagacatattgtatttacttaa

SEQ ID NO: 6997879 - DNA, 22 bp, Homo sapiens
tccaggacagcggcaggcagat

SEQ ID NO: 6997880 - DNA, 22 bp, Homo sapiens
tgtgtgcactgccttttgtgga

SEQ ID NO: 6997881 - DNA, 22 bp, Homo sapiens
tttgcttgacccttgtgctgaa

SEQ ID NO: 6997882 - DNA, 22 bp, Homo sapiens
tgggctttgagctcggtcacct

SEQ ID NO: 6997883 - DNA, 22 bp, Homo sapiens
gccaggctcttccatttgggtc

SEQ ID NO: 6997884 - DNA, 22 bp, Homo sapiens
gctcagactgcacaccctggtc

SEQ ID NO: 6997885 - DNA, 22 bp, Homo sapiens
tgatttacacacctatgattta

SEQ ID NO: 6997886 - DNA, 22 bp, Homo sapiens
actgagcatttgctggtggacc

SEQ ID NO: 6997887 - DNA, 22 bp, Homo sapiens
cctgaaggaaactggaaataca

SEQ ID NO: 6997888 - DNA, 22 bp, Homo sapiens
agctttgaaattatgtttcaga

SEQ ID NO: 6997889 - DNA, 22 bp, Homo sapiens
atgccagcctctaagcacttta

SEQ ID NO: 6997890 - DNA, 22 bp, Homo sapiens
atataactcttgttcttatagt

SEQ ID NO: 6997891 - DNA, 22 bp, Homo sapiens
ctctggacctcagctacagact

SEQ ID NO: 6997892 - DNA, 20 bp, Homo sapiens
ttttccagaaagtatcattg

SEQ ID NO: 6997893 - DNA, 22 bp, Homo sapiens
gaaactctcgcatcctgggaac

SEQ ID NO: 6997894 - DNA, 22 bp, Homo sapiens
tcagaatttgattcctgggata

SEQ ID NO: 6997895 - DNA, 22 bp, Homo sapiens
caatcactctgcaacattcctg

SEQ ID NO: 6997896 - DNA, 22 bp, Homo sapiens
ggtgtcctactgcttggttgct

SEQ ID NO: 6997897 - DNA, 22 bp, Homo sapiens
aaaggaagtgccactcttcttc

SEQ ID NO: 6997898 - DNA, 23 bp, Homo sapiens
ggctctgtgctaattgctgaaaa

SEQ ID NO: 6997899 - DNA, 22 bp, Homo sapiens
tcagaggtaagggctgagagga

SEQ ID NO: 6997900 - DNA, 22 bp, Homo sapiens
ctctcaaatgtaatttgaggtt

SEQ ID NO: 6997901 - DNA, 22 bp, Homo sapiens
tgtctgggtcacccctcctggc

SEQ ID NO: 6997902 - DNA, 22 bp, Homo sapiens
atgtcagaagaacaatgagata

SEQ ID NO: 6997903 - DNA, 22 bp, Homo sapiens
tgttctgcaatgctgcctcctt

SEQ ID NO: 6997904 - DNA, 22 bp, Homo sapiens
ccagggcaaatgagatcatagc

SEQ ID NO: 6997905 - DNA, 22 bp, Homo sapiens
tactgcttcacccttgagtctt

SEQ ID NO: 6997906 - DNA, 22 bp, Homo sapiens
gagtctagctgcagaggaccct

SEQ ID NO: 6997907 - DNA, 22 bp, Homo sapiens
ccaaaatgtttgaatgcatgtg

SEQ ID NO: 6997908 - DNA, 22 bp, Homo sapiens
agtggggacttatgccagcatt

SEQ ID NO: 6997909 - DNA, 22 bp, Homo sapiens
agtcactgagatggtgaggcta

SEQ ID NO: 6997910 - DNA, 22 bp, Homo sapiens
accacagtttagtccaatgaca

SEQ ID NO: 6997911 - DNA, 22 bp, Homo sapiens
acagtgtcatcagtttctcaac

SEQ ID NO: 6997912 - DNA, 22 bp, Homo sapiens
agaagtcagccacagtgggaga

SEQ ID NO: 6997913 - DNA, 22 bp, Homo sapiens
aggcttcattacagtggttcaa

SEQ ID NO: 6997914 - DNA, 18 bp, Homo sapiens
ctagggtggagtaccttt

SEQ ID NO: 6997915 - DNA, 22 bp, Homo sapiens
gtaagtttttccctagatgtag

SEQ ID NO: 6997916 - DNA, 22 bp, Homo sapiens
ctggccttcagactcggactga

SEQ ID NO: 6997917 - DNA, 22 bp, Homo sapiens
tgaacattgtcacattcctagc

SEQ ID NO: 6997918 - DNA, 22 bp, Homo sapiens
tgaggagcttctggaaagtgca

SEQ ID NO: 6997919 - DNA, 19 bp, Homo sapiens
agctgcctgtgcgcgcccg

SEQ ID NO: 6997920 - DNA, 22 bp, Homo sapiens
ggagaggggcaagtttatctag

SEQ ID NO: 6997921 - DNA, 22 bp, Homo sapiens
agaatataaagataattctgtt

SEQ ID NO: 6997922 - DNA, 22 bp, Homo sapiens
aggctgctcacctccctgtctg

SEQ ID NO: 6997923 - DNA, 20 bp, Homo sapiens
cagtgcattgcttctgattt

SEQ ID NO: 6997924 - DNA, 22 bp, Homo sapiens
aagcatcaacctgtatgctgca

SEQ ID NO: 6997925 - DNA, 22 bp, Homo sapiens
tattgggctggaattgcttcag

SEQ ID NO: 6997926 - DNA, 22 bp, Homo sapiens
agcagtggcctggggctctgtg

SEQ ID NO: 6997927 - DNA, 22 bp, Homo sapiens
tgtaaattgaaggaaatttgtg

SEQ ID NO: 6997928 - DNA, 22 bp, Homo sapiens
ttggaagcagtgtacactgtac

SEQ ID NO: 6997929 - DNA, 21 bp, Homo sapiens
agccagtctcagtactgtact

SEQ ID NO: 6997930 - DNA, 22 bp, Homo sapiens
atcagtgctgggagatgtcaga

SEQ ID NO: 6997931 - DNA, 22 bp, Homo sapiens
gcagaggtcctagccaggagtc

SEQ ID NO: 6997932 - DNA, 18 bp, Homo sapiens
agctgaggggactgaaga

SEQ ID NO: 6997933 - DNA, 22 bp, Homo sapiens
gtggaagggactgcctagagga

SEQ ID NO: 6997934 - DNA, 22 bp, Homo sapiens
ttcactgcaacctccgcctccc

SEQ ID NO: 6997935 - DNA, 22 bp, Homo sapiens
ctcactgcaacctccgtctccc

SEQ ID NO: 6997936 - DNA, 22 bp, Homo sapiens
tcccattgcccaggtagtgtac

SEQ ID NO: 6997937 - DNA, 22 bp, Homo sapiens
gaaatagacactttctatgaat

SEQ ID NO: 6997938 - DNA, 22 bp, Homo sapiens
ttaaattgtcatttgagcaatg

SEQ ID NO: 6997939 - DNA, 22 bp, Homo sapiens
taagtgtgtaataggtccttct

SEQ ID NO: 6997940 - DNA, 22 bp, Homo sapiens
acatacttatgctaaaaatata

SEQ ID NO: 6997941 - DNA, 15 bp, Homo sapiens
ctccatgattttgca

SEQ ID NO: 6997942 - DNA, 22 bp, Homo sapiens
gactggctcactccactcctat

SEQ ID NO: 6997943 - DNA, 22 bp, Homo sapiens
ctgcactgacttccccggctgc

SEQ ID NO: 6997944 - DNA, 22 bp, Homo sapiens
ctgaagtttttcaatttatgtt

SEQ ID NO: 6997945 - DNA, 22 bp, Homo sapiens
ggagtccaccaagtatttcagg

SEQ ID NO: 6997946 - DNA, 22 bp, Homo sapiens
gtctgcatattagatttgtttt

SEQ ID NO: 6997947 - DNA, 22 bp, Homo sapiens
gtacaaggcatttatctgttca

SEQ ID NO: 6997948 - DNA, 17 bp, Homo sapiens
tcctccccgcagttgca

SEQ ID NO: 6997949 - DNA, 22 bp, Homo sapiens
gagagatccagactgtgggtga

SEQ ID NO: 6997950 - DNA, 19 bp, Homo sapiens
caggattgtttaaagcttt

SEQ ID NO: 6997951 - DNA, 22 bp, Homo sapiens
ccctctgacctcctgccacagt

SEQ ID NO: 6997952 - DNA, 22 bp, Homo sapiens
gctgccacttggtcatgtcatg

SEQ ID NO: 6997953 - DNA, 22 bp, Homo sapiens
ctcagggctggaaagccaggaa

SEQ ID NO: 6997954 - DNA, 22 bp, Homo sapiens
acgattgtggacctgggacagt

SEQ ID NO: 6997955 - DNA, 22 bp, Homo sapiens
cctgagttagttgctgtgtctc

SEQ ID NO: 6997956 - DNA, 22 bp, Homo sapiens
ctgtgcaaataaagagcaacat

SEQ ID NO: 6997957 - DNA, 22 bp, Homo sapiens
tacatatagacagttactctag

SEQ ID NO: 6997958 - DNA, 22 bp, Homo sapiens
acagtgcaggtctcaacaatta

SEQ ID NO: 6997959 - DNA, 22 bp, Homo sapiens
aaacttgagtcacttctcttcc

SEQ ID NO: 6997960 - DNA, 22 bp, Homo sapiens
taacagcactggcaggcactgt

SEQ ID NO: 6997961 - DNA, 23 bp, Homo sapiens
ctgaggcctgctgcgttcaggtt

SEQ ID NO: 6997962 - DNA, 20 bp, Homo sapiens
taacggaagctgtaaaatct

SEQ ID NO: 6997963 - DNA, 22 bp, Homo sapiens
tgaggatggcagtgtgctcagc

SEQ ID NO: 6997964 - DNA, 22 bp, Homo sapiens
tcctgaggtggattgagcagag

SEQ ID NO: 6997965 - DNA, 22 bp, Homo sapiens
tttgcaaataccatgaaacttg

SEQ ID NO: 6997966 - DNA, 21 bp, Homo sapiens
aggcaccacatctccctcccc

SEQ ID NO: 6997967 - DNA, 21 bp, Homo sapiens
ccttccaccttctgccatgtg

SEQ ID NO: 6997968 - DNA, 22 bp, Homo sapiens
cagtcttctgagaaggcaaggg

SEQ ID NO: 6997969 - DNA, 22 bp, Homo sapiens
ggacaggcccggggagcctgga

SEQ ID NO: 6997970 - DNA, 22 bp, Homo sapiens
atcccacacccctacaacatat

SEQ ID NO: 6997971 - DNA, 22 bp, Homo sapiens
tatgtgtcaaaccattcatctg

SEQ ID NO: 6997972 - DNA, 22 bp, Homo sapiens
tgctactacttgtcaacggtca

SEQ ID NO: 6997973 - DNA, 22 bp, Homo sapiens
cctagagtctctctgcaggagt

SEQ ID NO: 6997974 - DNA, 22 bp, Homo sapiens
acctatcagccctgtggtttag

SEQ ID NO: 6997975 - DNA, 19 bp, Homo sapiens
tctaaactctatactggta

SEQ ID NO: 6997976 - DNA, 22 bp, Homo sapiens
ctgggactgccattcacagcca

SEQ ID NO: 6997977 - DNA, 22 bp, Homo sapiens
atatggaactattctgtgtaga

SEQ ID NO: 6997978 - DNA, 22 bp, Homo sapiens
gggccccactggggctgcctgc

SEQ ID NO: 6997979 - DNA, 22 bp, Homo sapiens
atacagcagtttgtgatcctag

SEQ ID NO: 6997980 - DNA, 22 bp, Homo sapiens
cagctgcaggagaaacagaggc

SEQ ID NO: 6997981 - DNA, 22 bp, Homo sapiens
agttcacatatctgttttattt

SEQ ID NO: 6997982 - DNA, 22 bp, Homo sapiens
gaaatctacgattagtgaaaat

SEQ ID NO: 6997983 - DNA, 22 bp, Homo sapiens
ccagcaagtgcagatggccaag

SEQ ID NO: 6997984 - DNA, 22 bp, Homo sapiens
gaggttcgatacagcgtattta

SEQ ID NO: 6997985 - DNA, 22 bp, Homo sapiens
ctccaccacacatctgtccacc

SEQ ID NO: 6997986 - DNA, 22 bp, Homo sapiens
cctggtttctccatgtctcatt

SEQ ID NO: 6997987 - DNA, 21 bp, Homo sapiens
agcacacttacctgttctaag

SEQ ID NO: 6997988 - DNA, 18 bp, Homo sapiens
gtggatgcattgggaggg

SEQ ID NO: 6997989 - DNA, 22 bp, Homo sapiens
cattcaaacattaatttattca

SEQ ID NO: 6997990 - DNA, 22 bp, Homo sapiens
aagctacttttatatgcagtag

SEQ ID NO: 6997991 - DNA, 22 bp, Homo sapiens
aagaaagtgggtaatatgattt

SEQ ID NO: 6997992 - DNA, 22 bp, Homo sapiens
ccctccaggcactgccctcttc

SEQ ID NO: 6997993 - DNA, 22 bp, Homo sapiens
tgcatacataaagtgctatcat

SEQ ID NO: 6997994 - DNA, 20 bp, Homo sapiens
cagaggcaaggagacttgga

SEQ ID NO: 6997995 - DNA, 22 bp, Homo sapiens
tagccaccagaaaggttttcag

SEQ ID NO: 6997996 - DNA, 22 bp, Homo sapiens
atgaaggccaggcttcagtgtg

SEQ ID NO: 6997997 - DNA, 22 bp, Homo sapiens
atttctcacagtggaatctctg

SEQ ID NO: 6997998 - DNA, 22 bp, Homo sapiens
ggaggggctgagcaactttcag

SEQ ID NO: 6997999 - DNA, 22 bp, Homo sapiens
gataatgtggatttattgtgat

SEQ ID NO: 6998000 - DNA, 22 bp, Homo sapiens
agccagctccctcccctgcagg

SEQ ID NO: 6998001 - DNA, 22 bp, Homo sapiens
acagaagctcaagagagcagtg

SEQ ID NO: 6998002 - DNA, 22 bp, Homo sapiens
actttgccttcttactgtgttg

SEQ ID NO: 6998003 - DNA, 22 bp, Homo sapiens
ttctgtccactgctggggcctc

SEQ ID NO: 6998004 - DNA, 22 bp, Homo sapiens
tgtttaagcctgtggtgtcatc

SEQ ID NO: 6998005 - DNA, 22 bp, Homo sapiens
tgccatcgctttgaacatcact

SEQ ID NO: 6998006 - DNA, 22 bp, Homo sapiens
agggcagagattaattaagaca

SEQ ID NO: 6998007 - DNA, 22 bp, Homo sapiens
cagtgtggtgagattccaggtg

SEQ ID NO: 6998008 - DNA, 23 bp, Homo sapiens
acatgggaaatgcaaagagaagt

SEQ ID NO: 6998009 - DNA, 22 bp, Homo sapiens
atttagtgtatcaatgtgatat

SEQ ID NO: 6998010 - DNA, 22 bp, Homo sapiens
cttcattggcttccatagatgc

SEQ ID NO: 6998011 - DNA, 22 bp, Homo sapiens
catgaggtcagggggagccggt

SEQ ID NO: 6998012 - DNA, 22 bp, Homo sapiens
actttctattcccacagagata

SEQ ID NO: 6998013 - DNA, 21 bp, Homo sapiens
tagggcatattcagtggtctg

SEQ ID NO: 6998014 - DNA, 22 bp, Homo sapiens
tgaccttcctaagaggctggca

SEQ ID NO: 6998015 - DNA, 22 bp, Homo sapiens
ctggggtggatgggtccaagtt

SEQ ID NO: 6998016 - DNA, 22 bp, Homo sapiens
cccctcctgcagcacctttctt

SEQ ID NO: 6998017 - DNA, 20 bp, Homo sapiens
ctgtaaaccaggcttcttgg

SEQ ID NO: 6998018 - DNA, 22 bp, Homo sapiens
ctggttcacatctgtttatctg

SEQ ID NO: 6998019 - DNA, 22 bp, Homo sapiens
aactcttgaattcccttgaaga

SEQ ID NO: 6998020 - DNA, 22 bp, Homo sapiens
agtgtattgtctcacagttctt

SEQ ID NO: 6998021 - DNA, 22 bp, Homo sapiens
cctttggttgagtgaaagtaag

SEQ ID NO: 6998022 - DNA, 22 bp, Homo sapiens
tgagtgagctggggagccggtg

SEQ ID NO: 6998023 - DNA, 22 bp, Homo sapiens
ctcaccatatgactttactaac

SEQ ID NO: 6998024 - DNA, 22 bp, Homo sapiens
tagcaacaccatctggtgagaa

SEQ ID NO: 6998025 - DNA, 22 bp, Homo sapiens
tcttcccagaccttacatgtga

SEQ ID NO: 6998026 - DNA, 22 bp, Homo sapiens
agacacctgccacccagagctc

SEQ ID NO: 6998027 - DNA, 22 bp, Homo sapiens
tgtcagtgaactggaaggcctg

SEQ ID NO: 6998028 - DNA, 22 bp, Homo sapiens
tggtttatatcttgattctagt

SEQ ID NO: 6998029 - DNA, 21 bp, Homo sapiens
agtccaggcctgcccacttcc

SEQ ID NO: 6998030 - DNA, 22 bp, Homo sapiens
gcagagatgagctatcaggaca

SEQ ID NO: 6998031 - DNA, 22 bp, Homo sapiens
acagccttcgaagtttcttcct

SEQ ID NO: 6998032 - DNA, 22 bp, Homo sapiens
tggtttgcccactcgagtgatt

SEQ ID NO: 6998033 - DNA, 22 bp, Homo sapiens
gacagcagccacagggagaggg

SEQ ID NO: 6998034 - DNA, 19 bp, Homo sapiens
aaccaggacaaggggctgg

SEQ ID NO: 6998035 - DNA, 22 bp, Homo sapiens
gaaccacaatgtgaagaaggag

SEQ ID NO: 6998036 - DNA, 20 bp, Homo sapiens
aactatgaatagaagagatt

SEQ ID NO: 6998037 - DNA, 22 bp, Homo sapiens
tccaagggttcatgtgcattca

SEQ ID NO: 6998038 - DNA, 22 bp, Homo sapiens
tagctttgtattatcagcattg

SEQ ID NO: 6998039 - DNA, 22 bp, Homo sapiens
tgagtgggatgagttagaggtg

SEQ ID NO: 6998040 - DNA, 22 bp, Homo sapiens
agagtatgctacaaagccagcc

SEQ ID NO: 6998041 - DNA, 22 bp, Homo sapiens
tggcttgtaggcccaatccggg

SEQ ID NO: 6998042 - DNA, 22 bp, Homo sapiens
gctgcaagtcacagaaacagtg

SEQ ID NO: 6998043 - DNA, 20 bp, Homo sapiens
attggctggggttctgatgc

SEQ ID NO: 6998044 - DNA, 22 bp, Homo sapiens
atggcagaaagaatagaggcta

SEQ ID NO: 6998045 - DNA, 22 bp, Homo sapiens
agaacactgatagctgagggga

SEQ ID NO: 6998046 - DNA, 22 bp, Homo sapiens
taagatttttaaaatgtcctca

SEQ ID NO: 6998047 - DNA, 22 bp, Homo sapiens
accaacttgcagccaaatttga

SEQ ID NO: 6998048 - DNA, 22 bp, Homo sapiens
tctgcagatttatcagcagctg

SEQ ID NO: 6998049 - DNA, 22 bp, Homo sapiens
tagactcttggggaaatctgca

SEQ ID NO: 6998050 - DNA, 20 bp, Homo sapiens
gtggcccttaaagagggaag

SEQ ID NO: 6998051 - DNA, 22 bp, Homo sapiens
gtgtgagaagggaatgtaaagc

SEQ ID NO: 6998052 - DNA, 22 bp, Homo sapiens
aatcttggaagtgtccactggt

SEQ ID NO: 6998053 - DNA, 22 bp, Homo sapiens
tctgtgctcatgcatgtgaatt

SEQ ID NO: 6998054 - DNA, 22 bp, Homo sapiens
acaaagtctctaataatcttct

SEQ ID NO: 6998055 - DNA, 22 bp, Homo sapiens
ggcctggctggttcagtaccct

SEQ ID NO: 6998056 - DNA, 22 bp, Homo sapiens
ctgagaggaacatcttatgctt

SEQ ID NO: 6998057 - DNA, 20 bp, Homo sapiens
aggctggcactcctggccag

SEQ ID NO: 6998058 - DNA, 22 bp, Homo sapiens
gaactcttggtggtcattagat

SEQ ID NO: 6998059 - DNA, 22 bp, Homo sapiens
tttggctagccaagaaacaaaa

SEQ ID NO: 6998060 - DNA, 22 bp, Homo sapiens
gctgtggatgctatggatcatc

SEQ ID NO: 6998061 - DNA, 22 bp, Homo sapiens
tgcaggcagggccagcgtgagg

SEQ ID NO: 6998062 - DNA, 22 bp, Homo sapiens
aatgtgtctatgtggttcacag

SEQ ID NO: 6998063 - DNA, 22 bp, Homo sapiens
gggtaacgttggaatttttgtg

SEQ ID NO: 6998064 - DNA, 22 bp, Homo sapiens
ctgaaagcattaactccacttc

SEQ ID NO: 6998065 - DNA, 22 bp, Homo sapiens
ggcccttcctcttgtgctggca

SEQ ID NO: 6998066 - DNA, 22 bp, Homo sapiens
atctccagaacatttataaacg

SEQ ID NO: 6998067 - DNA, 22 bp, Homo sapiens
attatgtagctaaaaattgtgt

SEQ ID NO: 6998068 - DNA, 22 bp, Homo sapiens
tttgttcactatatccctcagt

SEQ ID NO: 6998069 - DNA, 20 bp, Homo sapiens
attgtcagccttcagaggag

SEQ ID NO: 6998070 - DNA, 22 bp, Homo sapiens
agctggcaccaaatatagtaaa

SEQ ID NO: 6998071 - DNA, 22 bp, Homo sapiens
acccagtgcatggatagatagc

SEQ ID NO: 6998072 - DNA, 22 bp, Homo sapiens
acacagtttatggtattctgtt

SEQ ID NO: 6998073 - DNA, 22 bp, Homo sapiens
aaacactgaaaattttggtcat

SEQ ID NO: 6998074 - DNA, 22 bp, Homo sapiens
aacctggctgccagcaatgtgt

SEQ ID NO: 6998075 - DNA, 22 bp, Homo sapiens
gtagccattggcaatgaagcct

SEQ ID NO: 6998076 - DNA, 22 bp, Homo sapiens
ctgcaaaagtcattgtggtttt

SEQ ID NO: 6998077 - DNA, 22 bp, Homo sapiens
ctgaggttggagatattgcaga

SEQ ID NO: 6998078 - DNA, 23 bp, Homo sapiens
tttaaccttggtcaagaatttcc

SEQ ID NO: 6998079 - DNA, 18 bp, Homo sapiens
gacatagctcagagctca

SEQ ID NO: 6998080 - DNA, 22 bp, Homo sapiens
tcctgagagccttggcttcaga

SEQ ID NO: 6998081 - DNA, 22 bp, Homo sapiens
aacctaagtgctgttgaacgtt

SEQ ID NO: 6998082 - DNA, 22 bp, Homo sapiens
gagggagccgccacagactggg

SEQ ID NO: 6998083 - DNA, 22 bp, Homo sapiens
taggaccagatcaagactcttg

SEQ ID NO: 6998084 - DNA, 22 bp, Homo sapiens
tcacttccctcttcagctccca

SEQ ID NO: 6998085 - DNA, 22 bp, Homo sapiens
gtctgtgagggcttgatggggt

SEQ ID NO: 6998086 - DNA, 22 bp, Homo sapiens
tccaaagcatttggctcccacc

SEQ ID NO: 6998087 - DNA, 22 bp, Homo sapiens
ctgtccccgcgagtccagagct

SEQ ID NO: 6998088 - DNA, 22 bp, Homo sapiens
tcctctttctcaacattagtta

SEQ ID NO: 6998089 - DNA, 22 bp, Homo sapiens
ttaccatagtactatcagttta

SEQ ID NO: 6998090 - DNA, 22 bp, Homo sapiens
ttccctggtctatcctggttca

SEQ ID NO: 6998091 - DNA, 22 bp, Homo sapiens
tggactcagtgctgccattccc

SEQ ID NO: 6998092 - DNA, 22 bp, Homo sapiens
taatgccaggagggagttttta

SEQ ID NO: 6998093 - DNA, 22 bp, Homo sapiens
ggtattagttgtatggctctgc

SEQ ID NO: 6998094 - DNA, 22 bp, Homo sapiens
gaaatgtaggcataattatttt

SEQ ID NO: 6998095 - DNA, 22 bp, Homo sapiens
tctgctttgctgcctcctgatc

SEQ ID NO: 6998096 - DNA, 22 bp, Homo sapiens
tcatgttatcagacacagagta

SEQ ID NO: 6998097 - DNA, 22 bp, Homo sapiens
ccaggagactgtactgatattt

SEQ ID NO: 6998098 - DNA, 22 bp, Homo sapiens
aaacatctatcagcatttttta

SEQ ID NO: 6998099 - DNA, 23 bp, Homo sapiens
gcgtccggcctctctcgctcccg

SEQ ID NO: 6998100 - DNA, 22 bp, Homo sapiens
aagcagcataattgctatttta

SEQ ID NO: 6998101 - DNA, 20 bp, Homo sapiens
agccaaaggagaacagtgct

SEQ ID NO: 6998102 - DNA, 22 bp, Homo sapiens
gttctggaaagcaagaaagagt

SEQ ID NO: 6998103 - DNA, 22 bp, Homo sapiens
tttctcaacagagtatgccctt

SEQ ID NO: 6998104 - DNA, 22 bp, Homo sapiens
aagtgatacctaggaaatcaag

SEQ ID NO: 6998105 - DNA, 22 bp, Homo sapiens
tgtacacatgcccacttgaagc

SEQ ID NO: 6998106 - DNA, 20 bp, Homo sapiens
tggccttttggcttggagct

SEQ ID NO: 6998107 - DNA, 22 bp, Homo sapiens
ttcagggctgacaagcctattg

SEQ ID NO: 6998108 - DNA, 22 bp, Homo sapiens
tgggttttcagcatgagtttat

SEQ ID NO: 6998109 - DNA, 22 bp, Homo sapiens
agtgccagctccacacagcagc

SEQ ID NO: 6998110 - DNA, 22 bp, Homo sapiens
tttcacaaactgaggagacaat

SEQ ID NO: 6998111 - DNA, 22 bp, Homo sapiens
ggcaggagaaaggtctcttctt

SEQ ID NO: 6998112 - DNA, 22 bp, Homo sapiens
aggctctggcaacagctggtgt

SEQ ID NO: 6998113 - DNA, 22 bp, Homo sapiens
cacagggcagtgctgcccactc

SEQ ID NO: 6998114 - DNA, 22 bp, Homo sapiens
actgctgattatgaaagtgaca

SEQ ID NO: 6998115 - DNA, 23 bp, Homo sapiens
agggaaagtagtaatggcctttg

SEQ ID NO: 6998116 - DNA, 22 bp, Homo sapiens
ctggccagatgttacgtccaat

SEQ ID NO: 6998117 - DNA, 22 bp, Homo sapiens
aaacagtttataacatgatact

SEQ ID NO: 6998118 - DNA, 22 bp, Homo sapiens
ggcctgtctcacccccgggtgc

SEQ ID NO: 6998119 - DNA, 22 bp, Homo sapiens
gagtcaccacacggtgctgact

SEQ ID NO: 6998120 - DNA, 22 bp, Homo sapiens
tggctcaagtgatcctcctgcc

SEQ ID NO: 6998121 - DNA, 22 bp, Homo sapiens
gcagctagtccagttatgtggc

SEQ ID NO: 6998122 - DNA, 22 bp, Homo sapiens
gccttggctgccaagctgctga

SEQ ID NO: 6998123 - DNA, 22 bp, Homo sapiens
gaataacattggaaccctgaag

SEQ ID NO: 6998124 - DNA, 22 bp, Homo sapiens
cacatttaagcagatgtggacc

SEQ ID NO: 6998125 - DNA, 22 bp, Homo sapiens
atgccagaagagtctgcaggga

SEQ ID NO: 6998126 - DNA, 22 bp, Homo sapiens
gaattgactgcgtttgcttcct

SEQ ID NO: 6998127 - DNA, 22 bp, Homo sapiens
tgcccaggctcctcgcagcctt

SEQ ID NO: 6998128 - DNA, 19 bp, Homo sapiens
gctctgtgatgctgagggg

SEQ ID NO: 6998129 - DNA, 22 bp, Homo sapiens
cagagtcctggacacagagaca

SEQ ID NO: 6998130 - DNA, 22 bp, Homo sapiens
caccagctactccagggccgtg

SEQ ID NO: 6998131 - DNA, 22 bp, Homo sapiens
atggtacaatgatggatagtgg

SEQ ID NO: 6998132 - DNA, 22 bp, Homo sapiens
tgctgtagccctgcacagtgca

SEQ ID NO: 6998133 - DNA, 18 bp, Homo sapiens
aggtataagtgatctgct

SEQ ID NO: 6998134 - DNA, 19 bp, Homo sapiens
ctggaaggagggactgttc

SEQ ID NO: 6998135 - DNA, 22 bp, Homo sapiens
agctcaggtcattccagggatg

SEQ ID NO: 6998136 - DNA, 21 bp, Homo sapiens
gtcttttaagtgaagagaggc

SEQ ID NO: 6998137 - DNA, 22 bp, Homo sapiens
aatgagctgctgctgttccacc

SEQ ID NO: 6998138 - DNA, 22 bp, Homo sapiens
caggctccctgccagggccggc

SEQ ID NO: 6998139 - DNA, 22 bp, Homo sapiens
ttgtgcattacatggcttttgt

SEQ ID NO: 6998140 - DNA, 17 bp, Homo sapiens
taaagccagtcaagtca

SEQ ID NO: 6998141 - DNA, 22 bp, Homo sapiens
aacatttcttctgaaactgagt

SEQ ID NO: 6998142 - DNA, 22 bp, Homo sapiens
ggccaggaggcaggggctcaat

SEQ ID NO: 6998143 - DNA, 22 bp, Homo sapiens
ctggtggaggtgccaggatttg

SEQ ID NO: 6998144 - DNA, 21 bp, Homo sapiens
ccataattttgtttcagaagt

SEQ ID NO: 6998145 - DNA, 22 bp, Homo sapiens
tctcttaatccggtgctttctg

SEQ ID NO: 6998146 - DNA, 17 bp, Homo sapiens
ctggagtctaacccctt

SEQ ID NO: 6998147 - DNA, 22 bp, Homo sapiens
acctgaccaggtggcttcccaa

SEQ ID NO: 6998148 - DNA, 22 bp, Homo sapiens
acctgaggactggatggtagaa

SEQ ID NO: 6998149 - DNA, 22 bp, Homo sapiens
acaggtgtgggctgggctctga

SEQ ID NO: 6998150 - DNA, 22 bp, Homo sapiens
cccttagaattttgtagttatt

SEQ ID NO: 6998151 - DNA, 22 bp, Homo sapiens
gcattcctacaggctgctatga

SEQ ID NO: 6998152 - DNA, 22 bp, Homo sapiens
tgagaatactgcattgttagga

SEQ ID NO: 6998153 - DNA, 22 bp, Homo sapiens
agcagcaggtgacctcgatgcc

SEQ ID NO: 6998154 - DNA, 22 bp, Homo sapiens
attcacaacaaaaggatatgag

SEQ ID NO: 6998155 - DNA, 22 bp, Homo sapiens
aagtccaagaggaaaggtttcc

SEQ ID NO: 6998156 - DNA, 22 bp, Homo sapiens
aagcacagctggaacagcagga

SEQ ID NO: 6998157 - DNA, 22 bp, Homo sapiens
ctcagacttgctttttatggaa

SEQ ID NO: 6998158 - DNA, 22 bp, Homo sapiens
agaccctatgcaacatttcacc

SEQ ID NO: 6998159 - DNA, 22 bp, Homo sapiens
ggatgttgattgaatggccatt

SEQ ID NO: 6998160 - DNA, 22 bp, Homo sapiens
catcagaacaaatcggttaaga

SEQ ID NO: 6998161 - DNA, 22 bp, Homo sapiens
atattgtactagggttacatgt

SEQ ID NO: 6998162 - DNA, 22 bp, Homo sapiens
caaagttatcaactgcaacatt

SEQ ID NO: 6998163 - DNA, 22 bp, Homo sapiens
agcctggccaggcctgcccagg

SEQ ID NO: 6998164 - DNA, 22 bp, Homo sapiens
ttgtgtgtagactcagccattg

SEQ ID NO: 6998165 - DNA, 22 bp, Homo sapiens
agtgactgggcagggcagggcc

SEQ ID NO: 6998166 - DNA, 22 bp, Homo sapiens
agtgtgtcttatcctgggagaa

SEQ ID NO: 6998167 - DNA, 22 bp, Homo sapiens
gcagggccaggtacaagaagca

SEQ ID NO: 6998168 - DNA, 22 bp, Homo sapiens
tgcctggggttggcaaactgct

SEQ ID NO: 6998169 - DNA, 22 bp, Homo sapiens
aaagtgctgggattacaggctt

SEQ ID NO: 6998170 - DNA, 22 bp, Homo sapiens
tgtgagagctgcttcagccagg

SEQ ID NO: 6998171 - DNA, 22 bp, Homo sapiens
ctcagcccagctcaggtctttc

SEQ ID NO: 6998172 - DNA, 22 bp, Homo sapiens
tcagtgtagcagacttgtagcc

SEQ ID NO: 6998173 - DNA, 21 bp, Homo sapiens
aaagagacaaatggcatatac

SEQ ID NO: 6998174 - DNA, 18 bp, Homo sapiens
aatgcacacatttactcc

SEQ ID NO: 6998175 - DNA, 22 bp, Homo sapiens
tttcaacagatctgtcttcagg

SEQ ID NO: 6998176 - DNA, 22 bp, Homo sapiens
tgtccagatcaatgcccacatg

SEQ ID NO: 6998177 - DNA, 22 bp, Homo sapiens
caggacaggtgttctagatcag

SEQ ID NO: 6998178 - DNA, 22 bp, Homo sapiens
tattgtccaataggatgttcct

SEQ ID NO: 6998179 - DNA, 22 bp, Homo sapiens
tgagtctcccaagtagttggaa

SEQ ID NO: 6998180 - DNA, 22 bp, Homo sapiens
tattaggcaaagctaagtgtgt

SEQ ID NO: 6998181 - DNA, 22 bp, Homo sapiens
tgtacttccccaatgacagcac

SEQ ID NO: 6998182 - DNA, 21 bp, Homo sapiens
tggagtgcaacactaggtata

SEQ ID NO: 6998183 - DNA, 22 bp, Homo sapiens
ggagaggtgagaggtacaagtt

SEQ ID NO: 6998184 - DNA, 22 bp, Homo sapiens
caagggtggaaatatttttaag

SEQ ID NO: 6998185 - DNA, 22 bp, Homo sapiens
aaggccctggagtttctggaca

SEQ ID NO: 6998186 - DNA, 22 bp, Homo sapiens
acattgaacagtacaaatgatc

SEQ ID NO: 6998187 - DNA, 22 bp, Homo sapiens
atgcctttaagagatactgagg

SEQ ID NO: 6998188 - DNA, 23 bp, Homo sapiens
ccaggaagaggccatccacagtc

SEQ ID NO: 6998189 - DNA, 22 bp, Homo sapiens
ggtcaagtattttggccccagc

SEQ ID NO: 6998190 - DNA, 22 bp, Homo sapiens
atcttcaacaacaaattgcctc

SEQ ID NO: 6998191 - DNA, 22 bp, Homo sapiens
acataataggtgcctgaatatt

SEQ ID NO: 6998192 - DNA, 20 bp, Homo sapiens
tgccaggcacggagtgcatg

SEQ ID NO: 6998193 - DNA, 22 bp, Homo sapiens
tgttattgaggttacttataag

SEQ ID NO: 6998194 - DNA, 22 bp, Homo sapiens
taggcaatgttctaaggaatga

SEQ ID NO: 6998195 - DNA, 22 bp, Homo sapiens
taaggcaagagcagggtctttg

SEQ ID NO: 6998196 - DNA, 21 bp, Homo sapiens
aagcaggctgtaatcatgtgg

SEQ ID NO: 6998197 - DNA, 22 bp, Homo sapiens
acatttgagtcatatttgctta

SEQ ID NO: 6998198 - DNA, 18 bp, Homo sapiens
tccagtcttattaccatt

SEQ ID NO: 6998199 - DNA, 22 bp, Homo sapiens
tgggtaggaatcgagtgtatgg

SEQ ID NO: 6998200 - DNA, 22 bp, Homo sapiens
taagatgtacttttgtcctcac

SEQ ID NO: 6998201 - DNA, 22 bp, Homo sapiens
gggcttcagggtacttcctcct

SEQ ID NO: 6998202 - DNA, 22 bp, Homo sapiens
agcaagctcttggaaatgagct

SEQ ID NO: 6998203 - DNA, 23 bp, Homo sapiens
tgcaaataacaaggagtttaagg

SEQ ID NO: 6998204 - DNA, 22 bp, Homo sapiens
attatgtaactgtggttcagca

SEQ ID NO: 6998205 - DNA, 22 bp, Homo sapiens
agaagtatgtgagaaattatcc

SEQ ID NO: 6998206 - DNA, 22 bp, Homo sapiens
tctaagggaaggtgatatgtta

SEQ ID NO: 6998207 - DNA, 22 bp, Homo sapiens
tatttatcgagtgtctactatg

SEQ ID NO: 6998208 - DNA, 22 bp, Homo sapiens
aaacttgacagtgagacagttt

SEQ ID NO: 6998209 - DNA, 22 bp, Homo sapiens
ttagcagatttcatgtacattt

SEQ ID NO: 6998210 - DNA, 22 bp, Homo sapiens
atgtttacaattcagtattaca

SEQ ID NO: 6998211 - DNA, 18 bp, Homo sapiens
gtacacaaagtcaaagta

SEQ ID NO: 6998212 - DNA, 22 bp, Homo sapiens
caggctcagaagccagtggagc

SEQ ID NO: 6998213 - DNA, 22 bp, Homo sapiens
ccagaggtggaagattgttttg

SEQ ID NO: 6998214 - DNA, 22 bp, Homo sapiens
tcagtgcttcctggaggaagcc

SEQ ID NO: 6998215 - DNA, 22 bp, Homo sapiens
gtagccagatctgctgtgtctg

SEQ ID NO: 6998216 - DNA, 22 bp, Homo sapiens
ctgcaggagtgaaagcaggcct

SEQ ID NO: 6998217 - DNA, 22 bp, Homo sapiens
acaaagtgtgcggagcccaggg

SEQ ID NO: 6998218 - DNA, 22 bp, Homo sapiens
tgaggcctgcattgaactagaa

SEQ ID NO: 6998219 - DNA, 20 bp, Homo sapiens
caggtgtacagtgagctgag

SEQ ID NO: 6998220 - DNA, 23 bp, Homo sapiens
aacgacagctacaggcatcccac

SEQ ID NO: 6998221 - DNA, 22 bp, Homo sapiens
gctgcctggaataacggctggc

SEQ ID NO: 6998222 - DNA, 18 bp, Homo sapiens
gtgtgggctcctccgagt

SEQ ID NO: 6998223 - DNA, 22 bp, Homo sapiens
tctgcctttcccaggctactgt

SEQ ID NO: 6998224 - DNA, 22 bp, Homo sapiens
tgagtagacctcacgtgtcaga

SEQ ID NO: 6998225 - DNA, 22 bp, Homo sapiens
tggcactcactctcagagtctg

SEQ ID NO: 6998226 - DNA, 22 bp, Homo sapiens
ttgagaagaggctttgtaggaa

SEQ ID NO: 6998227 - DNA, 22 bp, Homo sapiens
ctgagctaggagttaggaagct

SEQ ID NO: 6998228 - DNA, 22 bp, Homo sapiens
tctgtccaacaagccccttctc

SEQ ID NO: 6998229 - DNA, 22 bp, Homo sapiens
tatctttaacttgcagtattta

SEQ ID NO: 6998230 - DNA, 22 bp, Homo sapiens
aatctattccctttctgtaaaa

SEQ ID NO: 6998231 - DNA, 20 bp, Homo sapiens
tgtattacttggtcttacaa

SEQ ID NO: 6998232 - DNA, 22 bp, Homo sapiens
cccaggccctggcagagcttgt

SEQ ID NO: 6998233 - DNA, 19 bp, Homo sapiens
ggctgcctggagcgagggc

SEQ ID NO: 6998234 - DNA, 22 bp, Homo sapiens
attcagcataatcagtagcttg

SEQ ID NO: 6998235 - DNA, 22 bp, Homo sapiens
ctggactaataacttcagtggg

SEQ ID NO: 6998236 - DNA, 22 bp, Homo sapiens
ccagactgtcagcaacttcaag

SEQ ID NO: 6998237 - DNA, 22 bp, Homo sapiens
acctagaatccatctgcttatt

SEQ ID NO: 6998238 - DNA, 22 bp, Homo sapiens
ccctgcttagcacccttgcacc

SEQ ID NO: 6998239 - DNA, 22 bp, Homo sapiens
atgagtgcctaactgtcagatt

SEQ ID NO: 6998240 - DNA, 22 bp, Homo sapiens
cagctttgtgacttcggacaag

SEQ ID NO: 6998241 - DNA, 22 bp, Homo sapiens
cctcagtcttgaattagccaga

SEQ ID NO: 6998242 - DNA, 22 bp, Homo sapiens
tctgattgatgcagaccatatt

SEQ ID NO: 6998243 - DNA, 22 bp, Homo sapiens
ttcttcttcatttctgacgatg

SEQ ID NO: 6998244 - DNA, 22 bp, Homo sapiens
aggaggctgaactagggtctgg

SEQ ID NO: 6998245 - DNA, 22 bp, Homo sapiens
ccacgctcatcctctctgagag

SEQ ID NO: 6998246 - DNA, 23 bp, Homo sapiens
ttccaagtgctttacttaatcct

SEQ ID NO: 6998247 - DNA, 22 bp, Homo sapiens
catggctatgcatgaggaaggt

SEQ ID NO: 6998248 - DNA, 22 bp, Homo sapiens
agcccctctgtagctaatagta

SEQ ID NO: 6998249 - DNA, 22 bp, Homo sapiens
cccagtaatcggagagtactta

SEQ ID NO: 6998250 - DNA, 22 bp, Homo sapiens
ataaagctattcctctcttttt

SEQ ID NO: 6998251 - DNA, 22 bp, Homo sapiens
agcagggcctggcactcctggg

SEQ ID NO: 6998252 - DNA, 22 bp, Homo sapiens
tggctctgttgctcgcagtttt

SEQ ID NO: 6998253 - DNA, 22 bp, Homo sapiens
acacagatgcattacacatcta

SEQ ID NO: 6998254 - DNA, 22 bp, Homo sapiens
tttcaaggctaatccacagtat

SEQ ID NO: 6998255 - DNA, 22 bp, Homo sapiens
agcactcctgtctttccccttt

SEQ ID NO: 6998256 - DNA, 22 bp, Homo sapiens
aggcctcagtttgtcatctgta

SEQ ID NO: 6998257 - DNA, 22 bp, Homo sapiens
tgaggtagtaaaggtgttagtt

SEQ ID NO: 6998258 - DNA, 22 bp, Homo sapiens
ctttggtcaattgctgcgggga

SEQ ID NO: 6998259 - DNA, 23 bp, Homo sapiens
aggaagttatgaagggagaatag

SEQ ID NO: 6998260 - DNA, 22 bp, Homo sapiens
aggacacactgcaagagcctgg

SEQ ID NO: 6998261 - DNA, 22 bp, Homo sapiens
agaaggctcatccctcacccca

SEQ ID NO: 6998262 - DNA, 22 bp, Homo sapiens
aagtacctagaaatatttttga

SEQ ID NO: 6998263 - DNA, 22 bp, Homo sapiens
tcccagcagggccgaccagcct

SEQ ID NO: 6998264 - DNA, 22 bp, Homo sapiens
tgttttctgggtggaaggtact

SEQ ID NO: 6998265 - DNA, 19 bp, Homo sapiens
tgactctgtggaacagaag

SEQ ID NO: 6998266 - DNA, 22 bp, Homo sapiens
actctattgctgcttgatgtga

SEQ ID NO: 6998267 - DNA, 19 bp, Homo sapiens
acaaagtgcgtgctctttt

SEQ ID NO: 6998268 - DNA, 22 bp, Homo sapiens
agctgtgtgccaggggagatgt

SEQ ID NO: 6998269 - DNA, 22 bp, Homo sapiens
gtgacaaaggtcaagcttttga

SEQ ID NO: 6998270 - DNA, 22 bp, Homo sapiens
tgaggcagtgtgagataataaa

SEQ ID NO: 6998271 - DNA, 22 bp, Homo sapiens
attcagaattgtgggcagtaca

SEQ ID NO: 6998272 - DNA, 22 bp, Homo sapiens
ctacagagtgaatgcagaaaat

SEQ ID NO: 6998273 - DNA, 22 bp, Homo sapiens
aaggctcagggtttaagtttct

SEQ ID NO: 6998274 - DNA, 22 bp, Homo sapiens
tggctgtgggtggaaggaaacc

SEQ ID NO: 6998275 - DNA, 22 bp, Homo sapiens
cctatattcagggaactgaccc

SEQ ID NO: 6998276 - DNA, 22 bp, Homo sapiens
cttgatggggtgatccagcacc

SEQ ID NO: 6998277 - DNA, 22 bp, Homo sapiens
gggcaagcagtggctaccagta

SEQ ID NO: 6998278 - DNA, 22 bp, Homo sapiens
ttcagatatcattaatttagta

SEQ ID NO: 6998279 - DNA, 22 bp, Homo sapiens
tgaaacttatatatcccaggtt

SEQ ID NO: 6998280 - DNA, 22 bp, Homo sapiens
taggccaccagggttccattta

SEQ ID NO: 6998281 - DNA, 22 bp, Homo sapiens
ggctctggcggctctttcaata

SEQ ID NO: 6998282 - DNA, 22 bp, Homo sapiens
gactggttatccccagcacaca

SEQ ID NO: 6998283 - DNA, 22 bp, Homo sapiens
aactgtttggaactcttccaca

SEQ ID NO: 6998284 - DNA, 22 bp, Homo sapiens
caggcttgctagaggagccaaa

SEQ ID NO: 6998285 - DNA, 22 bp, Homo sapiens
cattagcactctaaggaagaga

SEQ ID NO: 6998286 - DNA, 22 bp, Homo sapiens
tgccctctgcctcctctgcaga

SEQ ID NO: 6998287 - DNA, 22 bp, Homo sapiens
actcctgtgtggctgggaggtt

SEQ ID NO: 6998288 - DNA, 22 bp, Homo sapiens
acatggagctcaaacatgagtg

SEQ ID NO: 6998289 - DNA, 22 bp, Homo sapiens
cacgggagacgtgatcttggac

SEQ ID NO: 6998290 - DNA, 22 bp, Homo sapiens
aaggaggaattctgagttcatg

SEQ ID NO: 6998291 - DNA, 22 bp, Homo sapiens
gaaacaatcatcatgtgatttg

SEQ ID NO: 6998292 - DNA, 22 bp, Homo sapiens
tttgacaggaattctctctagg

SEQ ID NO: 6998293 - DNA, 22 bp, Homo sapiens
aggtgtctgtgatgggagcgat

SEQ ID NO: 6998294 - DNA, 22 bp, Homo sapiens
agaagcttcctacattgttctt

SEQ ID NO: 6998295 - DNA, 22 bp, Homo sapiens
aattagagaagagtgaccagtc

SEQ ID NO: 6998296 - DNA, 22 bp, Homo sapiens
caacagaaatcaattttcccat

SEQ ID NO: 6998297 - DNA, 22 bp, Homo sapiens
taggtagatcttagtaatgaaa

SEQ ID NO: 6998298 - DNA, 22 bp, Homo sapiens
gtctgtagtcacacaggtgaca

SEQ ID NO: 6998299 - DNA, 22 bp, Homo sapiens
catcatcaactggcaggtaagt

SEQ ID NO: 6998300 - DNA, 21 bp, Homo sapiens
gtttggaacagaccctgggga

SEQ ID NO: 6998301 - DNA, 22 bp, Homo sapiens
ggcgcctaggcaaggaacccct

SEQ ID NO: 6998302 - DNA, 22 bp, Homo sapiens
tatatgtaagctatgtaagagt

SEQ ID NO: 6998303 - DNA, 22 bp, Homo sapiens
cagcaggtggacacactcacct

SEQ ID NO: 6998304 - DNA, 22 bp, Homo sapiens
tcagaactacatggacatgtta

SEQ ID NO: 6998305 - DNA, 22 bp, Homo sapiens
tgtccaggctcccttggtgctg

SEQ ID NO: 6998306 - DNA, 22 bp, Homo sapiens
tccaggcccactcggtggggct

SEQ ID NO: 6998307 - DNA, 22 bp, Homo sapiens
atcagtgtgtcaaaagcacaaa

SEQ ID NO: 6998308 - DNA, 19 bp, Homo sapiens
gctggatggatcctggagt

SEQ ID NO: 6998309 - DNA, 22 bp, Homo sapiens
ccatttggcaagaaagagtcat

SEQ ID NO: 6998310 - DNA, 22 bp, Homo sapiens
acaataatgtattgccaaaagt

SEQ ID NO: 6998311 - DNA, 22 bp, Homo sapiens
tgtaagcttcaaatatctgtga

SEQ ID NO: 6998312 - DNA, 19 bp, Homo sapiens
gggagctgtctgcccgtgg

SEQ ID NO: 6998313 - DNA, 19 bp, Homo sapiens
cttggttatggtatgatgc

SEQ ID NO: 6998314 - DNA, 19 bp, Homo sapiens
tgtaatctttgctgttgct

SEQ ID NO: 6998315 - DNA, 22 bp, Homo sapiens
gagagaaccctaaatgagatat

SEQ ID NO: 6998316 - DNA, 22 bp, Homo sapiens
gccctggtgtgcccagcatggg

SEQ ID NO: 6998317 - DNA, 22 bp, Homo sapiens
tgctgaatgaatggatggttgc

SEQ ID NO: 6998318 - DNA, 22 bp, Homo sapiens
aagcactgagcacagtggctga

SEQ ID NO: 6998319 - DNA, 22 bp, Homo sapiens
ctggagctctccagagccccgt

SEQ ID NO: 6998320 - DNA, 22 bp, Homo sapiens
caggacctgaagacaggcaggt

SEQ ID NO: 6998321 - DNA, 22 bp, Homo sapiens
taagagctgagcctcgtattca

SEQ ID NO: 6998322 - DNA, 22 bp, Homo sapiens
cttacacagtctggcacttctt

SEQ ID NO: 6998323 - DNA, 18 bp, Homo sapiens
ccaaggcccctgctgggg

SEQ ID NO: 6998324 - DNA, 22 bp, Homo sapiens
aatatccaggtagatgtcttct

SEQ ID NO: 6998325 - DNA, 22 bp, Homo sapiens
tgcactgttgctttatatgatt

SEQ ID NO: 6998326 - DNA, 22 bp, Homo sapiens
tgagcttacgtgggaacagact

SEQ ID NO: 6998327 - DNA, 22 bp, Homo sapiens
ttaagatttgtagagaaaaagc

SEQ ID NO: 6998328 - DNA, 22 bp, Homo sapiens
gggtggtggcggaggctccagg

SEQ ID NO: 6998329 - DNA, 22 bp, Homo sapiens
cctgtggggccatctcagtcac

SEQ ID NO: 6998330 - DNA, 22 bp, Homo sapiens
gtgagaaattgaatggctccca

SEQ ID NO: 6998331 - DNA, 22 bp, Homo sapiens
ggtctggaagcgcagtaggctg

SEQ ID NO: 6998332 - DNA, 22 bp, Homo sapiens
ctgctgtcctatctctttgttc

SEQ ID NO: 6998333 - DNA, 22 bp, Homo sapiens
aggctagtcaagtcaagcagtg

SEQ ID NO: 6998334 - DNA, 22 bp, Homo sapiens
aggactggcagtgtgaggggtc

SEQ ID NO: 6998335 - DNA, 22 bp, Homo sapiens
tagcaaagaagatattattgca

SEQ ID NO: 6998336 - DNA, 22 bp, Homo sapiens
gacagcagtttttctctagggt

SEQ ID NO: 6998337 - DNA, 22 bp, Homo sapiens
ctaaggttggcagtggaattgg

SEQ ID NO: 6998338 - DNA, 22 bp, Homo sapiens
aacagaattgctgctgccaatg

SEQ ID NO: 6998339 - DNA, 22 bp, Homo sapiens
cattccgctccccttccttgcg

SEQ ID NO: 6998340 - DNA, 22 bp, Homo sapiens
gttgatttgaagagcagaaagt

SEQ ID NO: 6998341 - DNA, 22 bp, Homo sapiens
caggagctggataggaccacaa

SEQ ID NO: 6998342 - DNA, 23 bp, Homo sapiens
agtgttgagcagatgcaaaggtt

SEQ ID NO: 6998343 - DNA, 22 bp, Homo sapiens
cagcctttatggaaaggcctgg

SEQ ID NO: 6998344 - DNA, 22 bp, Homo sapiens
tacaatgttggtaaagtatcat

SEQ ID NO: 6998345 - DNA, 22 bp, Homo sapiens
gagaggcaggcgctgcaatggt

SEQ ID NO: 6998346 - DNA, 22 bp, Homo sapiens
ctgttgtccctgggagctcagc

SEQ ID NO: 6998347 - DNA, 20 bp, Homo sapiens
gttactgtgataacctttgt

SEQ ID NO: 6998348 - DNA, 22 bp, Homo sapiens
ttcctggcaccctggacccggc

SEQ ID NO: 6998349 - DNA, 22 bp, Homo sapiens
aagtccaaggctgggtgcagtg

SEQ ID NO: 6998350 - DNA, 22 bp, Homo sapiens
cttcctggcatgggtctcatga

SEQ ID NO: 6998351 - DNA, 22 bp, Homo sapiens
cattagcaagtcactattttat

SEQ ID NO: 6998352 - DNA, 22 bp, Homo sapiens
tggtggccacgtgggcgcgagc

SEQ ID NO: 6998353 - DNA, 22 bp, Homo sapiens
taggtctgtaaatgagagagac

SEQ ID NO: 6998354 - DNA, 22 bp, Homo sapiens
gagctaagagtctagaaaggct

SEQ ID NO: 6998355 - DNA, 17 bp, Homo sapiens
ttccacaatagtttgtc

SEQ ID NO: 6998356 - DNA, 22 bp, Homo sapiens
ttgaaaagcaaatgatgggtag

SEQ ID NO: 6998357 - DNA, 22 bp, Homo sapiens
tccatttgaaatgaaagtgata

SEQ ID NO: 6998358 - DNA, 22 bp, Homo sapiens
tttttatatgaaggatagtgcg

SEQ ID NO: 6998359 - DNA, 21 bp, Homo sapiens
aggcaataaagttttgtctac

SEQ ID NO: 6998360 - DNA, 22 bp, Homo sapiens
gctcagctatcagtgttcctga

SEQ ID NO: 6998361 - DNA, 22 bp, Homo sapiens
agggcagagctgtctaaatggc

SEQ ID NO: 6998362 - DNA, 22 bp, Homo sapiens
ggcgcacaatgtgcaggtttgt

SEQ ID NO: 6998363 - DNA, 22 bp, Homo sapiens
tgtccaggtggcctctgctgct

SEQ ID NO: 6998364 - DNA, 18 bp, Homo sapiens
tgggaatgctcaaggccc

SEQ ID NO: 6998365 - DNA, 22 bp, Homo sapiens
tatattaacacccacttgcctc

SEQ ID NO: 6998366 - DNA, 22 bp, Homo sapiens
gtctgctgtgccttggggaaaa

SEQ ID NO: 6998367 - DNA, 22 bp, Homo sapiens
tctgtccagtggctctcaggga

SEQ ID NO: 6998368 - DNA, 22 bp, Homo sapiens
tgggccagaggcatggagctat

SEQ ID NO: 6998369 - DNA, 22 bp, Homo sapiens
agccactggtaaactggtagga

SEQ ID NO: 6998370 - DNA, 22 bp, Homo sapiens
ttgaccattatacactggcttg

SEQ ID NO: 6998371 - DNA, 15 bp, Homo sapiens
tgtcaggtgaatggt

SEQ ID NO: 6998372 - DNA, 19 bp, Homo sapiens
agtctgtggatttgtgggt

SEQ ID NO: 6998373 - DNA, 22 bp, Homo sapiens
caagatgaaactacagggagga

SEQ ID NO: 6998374 - DNA, 22 bp, Homo sapiens
aaagagtcgtgttccaggtttg

SEQ ID NO: 6998375 - DNA, 22 bp, Homo sapiens
tgccagctgttcccacccaaaa

SEQ ID NO: 6998376 - DNA, 22 bp, Homo sapiens
tgtcctgggtccctgctagaag

SEQ ID NO: 6998377 - DNA, 22 bp, Homo sapiens
ctgcactgtgtattccttggct

SEQ ID NO: 6998378 - DNA, 22 bp, Homo sapiens
tcttcccagaggaggtgccagc

SEQ ID NO: 6998379 - DNA, 22 bp, Homo sapiens
gccagcaggttgtcaaggagct

SEQ ID NO: 6998380 - DNA, 22 bp, Homo sapiens
tgttatagtagaatcattacaa

SEQ ID NO: 6998381 - DNA, 22 bp, Homo sapiens
gccagtggagactgaaacccat

SEQ ID NO: 6998382 - DNA, 22 bp, Homo sapiens
acattgttgagcctcttgttca

SEQ ID NO: 6998383 - DNA, 22 bp, Homo sapiens
gcatatggtattagtggtgcta

SEQ ID NO: 6998384 - DNA, 22 bp, Homo sapiens
acaggcttttttagaatgacat

SEQ ID NO: 6998385 - DNA, 22 bp, Homo sapiens
ctaaagctcaacaggcactatt

SEQ ID NO: 6998386 - DNA, 21 bp, Homo sapiens
tgaagcctgaggcatagcccc

SEQ ID NO: 6998387 - DNA, 22 bp, Homo sapiens
agggaggcaggaaagttgtctg

SEQ ID NO: 6998388 - DNA, 22 bp, Homo sapiens
tgcaggctgtgtcatttagtga

SEQ ID NO: 6998389 - DNA, 18 bp, Homo sapiens
atccaactatcgctcatt

SEQ ID NO: 6998390 - DNA, 22 bp, Homo sapiens
atccagtccatgacattctgtt

SEQ ID NO: 6998391 - DNA, 22 bp, Homo sapiens
acttggctgcagagaacgtgtg

SEQ ID NO: 6998392 - DNA, 22 bp, Homo sapiens
agggtgctgccggacaggtggg

SEQ ID NO: 6998393 - DNA, 22 bp, Homo sapiens
actcagagcagagcagcctgag

SEQ ID NO: 6998394 - DNA, 22 bp, Homo sapiens
gaaacgttgtggaaaatcctct

SEQ ID NO: 6998395 - DNA, 23 bp, Homo sapiens
agactctgagagtgtgctttgca

SEQ ID NO: 6998396 - DNA, 22 bp, Homo sapiens
ttacactctggttgtgggcctt

SEQ ID NO: 6998397 - DNA, 22 bp, Homo sapiens
agcataggtggagattagtgtt

SEQ ID NO: 6998398 - DNA, 18 bp, Homo sapiens
agcttagcatacttttcc

SEQ ID NO: 6998399 - DNA, 20 bp, Homo sapiens
caggtgagcagatctgggtg

SEQ ID NO: 6998400 - DNA, 22 bp, Homo sapiens
cactgagagatgtgtcacagca

SEQ ID NO: 6998401 - DNA, 22 bp, Homo sapiens
ctgggcaatatgctgggcctgg

SEQ ID NO: 6998402 - DNA, 19 bp, Homo sapiens
tttgaaagagttttattgg

SEQ ID NO: 6998403 - DNA, 22 bp, Homo sapiens
gaagtattactctgaatgtatt

SEQ ID NO: 6998404 - DNA, 22 bp, Homo sapiens
ttgaatgaattctacttccaga

SEQ ID NO: 6998405 - DNA, 22 bp, Homo sapiens
gatgtggcataagagtgaacac

SEQ ID NO: 6998406 - DNA, 17 bp, Homo sapiens
aggctcctcctaaggtc

SEQ ID NO: 6998407 - DNA, 22 bp, Homo sapiens
tcagaagcagatatttcaaaat

SEQ ID NO: 6998408 - DNA, 22 bp, Homo sapiens
tccagaaaattcagaaattgtt

SEQ ID NO: 6998409 - DNA, 22 bp, Homo sapiens
gcctgtggccactgcgtctgca

SEQ ID NO: 6998410 - DNA, 22 bp, Homo sapiens
tatgaaatttaaacacagatca

SEQ ID NO: 6998411 - DNA, 22 bp, Homo sapiens
ggatgggaacttggtagggcat

SEQ ID NO: 6998412 - DNA, 22 bp, Homo sapiens
tgatttccctgtagcctctgaa

SEQ ID NO: 6998413 - DNA, 22 bp, Homo sapiens
attgcattgtattgtaaatgtt

SEQ ID NO: 6998414 - DNA, 22 bp, Homo sapiens
agtcattttgccagtcttcagg

SEQ ID NO: 6998415 - DNA, 22 bp, Homo sapiens
tgttaaagtggataagctgaat

SEQ ID NO: 6998416 - DNA, 22 bp, Homo sapiens
tggagcccaggagaggataaac

SEQ ID NO: 6998417 - DNA, 22 bp, Homo sapiens
gagggtgggctcctatctgggt

SEQ ID NO: 6998418 - DNA, 22 bp, Homo sapiens
tgctttataggggattgcaggc

SEQ ID NO: 6998419 - DNA, 22 bp, Homo sapiens
acagttagttgaggagtgtttg

SEQ ID NO: 6998420 - DNA, 22 bp, Homo sapiens
gaagtacaaaggacatggaaac

SEQ ID NO: 6998421 - DNA, 22 bp, Homo sapiens
ttaattgtctgtgagtacctga

SEQ ID NO: 6998422 - DNA, 22 bp, Homo sapiens
atttagtcatcactcatgtgtt

SEQ ID NO: 6998423 - DNA, 22 bp, Homo sapiens
tttcagactgctgtgtgaaact

SEQ ID NO: 6998424 - DNA, 22 bp, Homo sapiens
tcagaggcttccttcctcggag

SEQ ID NO: 6998425 - DNA, 22 bp, Homo sapiens
tatgattaatattcttaaaatt

SEQ ID NO: 6998426 - DNA, 22 bp, Homo sapiens
tgctcctgtttcatcagctata

SEQ ID NO: 6998427 - DNA, 22 bp, Homo sapiens
cagggctctgccttgagggatg

SEQ ID NO: 6998428 - DNA, 21 bp, Homo sapiens
aggggaagtagagttttgatt

SEQ ID NO: 6998429 - DNA, 22 bp, Homo sapiens
gtgcagaccttagttcaagcca

SEQ ID NO: 6998430 - DNA, 22 bp, Homo sapiens
cattttatcctctgggaagcta

SEQ ID NO: 6998431 - DNA, 22 bp, Homo sapiens
ttctctagcagatcataatgaa

SEQ ID NO: 6998432 - DNA, 20 bp, Homo sapiens
aggatgtccccgagggcctg

SEQ ID NO: 6998433 - DNA, 22 bp, Homo sapiens
ttcctcagggcggatgggcagg

SEQ ID NO: 6998434 - DNA, 22 bp, Homo sapiens
ctgaatgaggaaaagagtgagg

SEQ ID NO: 6998435 - DNA, 22 bp, Homo sapiens
ggaaggctttctgttctgtgac

SEQ ID NO: 6998436 - DNA, 22 bp, Homo sapiens
agggctcactacaaccctggga

SEQ ID NO: 6998437 - DNA, 22 bp, Homo sapiens
acgcccagactcccatactttg

SEQ ID NO: 6998438 - DNA, 22 bp, Homo sapiens
aagtacatgttgttcaaaagcc

SEQ ID NO: 6998439 - DNA, 22 bp, Homo sapiens
tggacacagtaggagctgcgca

SEQ ID NO: 6998440 - DNA, 22 bp, Homo sapiens
cggcagcatcgaaactacattc

SEQ ID NO: 6998441 - DNA, 22 bp, Homo sapiens
tcaccggtgaccctcggctcgc

SEQ ID NO: 6998442 - DNA, 22 bp, Homo sapiens
ttcactgttgagttcctgatat

SEQ ID NO: 6998443 - DNA, 19 bp, Homo sapiens
gccaggagggctctggctg

SEQ ID NO: 6998444 - DNA, 22 bp, Homo sapiens
agcacgagatcgatgtgccttt

SEQ ID NO: 6998445 - DNA, 20 bp, Homo sapiens
ttgtttaaaggtgaagaggc

SEQ ID NO: 6998446 - DNA, 22 bp, Homo sapiens
aagggtgaagggtggtggccta

SEQ ID NO: 6998447 - DNA, 22 bp, Homo sapiens
tacaggtagaaatgaagccaga

SEQ ID NO: 6998448 - DNA, 22 bp, Homo sapiens
ttgagacacaaggcacagtaag

SEQ ID NO: 6998449 - DNA, 21 bp, Homo sapiens
gtgattctctgagttttgggg

SEQ ID NO: 6998450 - DNA, 22 bp, Homo sapiens
aggtggcaaggggcgcctctct

SEQ ID NO: 6998451 - DNA, 22 bp, Homo sapiens
ttgacacagatcaatattcaac

SEQ ID NO: 6998452 - DNA, 22 bp, Homo sapiens
aactctcagaacttttggtggg

SEQ ID NO: 6998453 - DNA, 22 bp, Homo sapiens
tgactacaacctccacctcccg

SEQ ID NO: 6998454 - DNA, 19 bp, Homo sapiens
ttacatctgcaacactggt

SEQ ID NO: 6998455 - DNA, 22 bp, Homo sapiens
tttccaattcaagcttttacgt

SEQ ID NO: 6998456 - DNA, 22 bp, Homo sapiens
cagcaagtcagtgagtagaaga

SEQ ID NO: 6998457 - DNA, 22 bp, Homo sapiens
ctgtatgatatccaaattgata

SEQ ID NO: 6998458 - DNA, 22 bp, Homo sapiens
tatgtgtctgtcgtgcataaat

SEQ ID NO: 6998459 - DNA, 22 bp, Homo sapiens
tgctttattttaaatatgccat

SEQ ID NO: 6998460 - DNA, 22 bp, Homo sapiens
aagctctttgacctgggcctgg

SEQ ID NO: 6998461 - DNA, 20 bp, Homo sapiens
acagaaagctgccttgtccc

SEQ ID NO: 6998462 - DNA, 22 bp, Homo sapiens
agaagcattatttaattttact

SEQ ID NO: 6998463 - DNA, 22 bp, Homo sapiens
cccaggggttcaaggctgcagt

SEQ ID NO: 6998464 - DNA, 22 bp, Homo sapiens
ttggctctcattttccccatta

SEQ ID NO: 6998465 - DNA, 22 bp, Homo sapiens
cactgctatgatgatgatattt

SEQ ID NO: 6998466 - DNA, 23 bp, Homo sapiens
gttaccttacttctgtgatcttc

SEQ ID NO: 6998467 - DNA, 22 bp, Homo sapiens
agcactgtggtggaagcatcaa

SEQ ID NO: 6998468 - DNA, 20 bp, Homo sapiens
tctctgacttctccccgcct

SEQ ID NO: 6998469 - DNA, 21 bp, Homo sapiens
caaaacttaggtgacttagga

SEQ ID NO: 6998470 - DNA, 22 bp, Homo sapiens
taacaagttctgacagcattgt

SEQ ID NO: 6998471 - DNA, 22 bp, Homo sapiens
agccctggggctggtcttggaa

SEQ ID NO: 6998472 - DNA, 22 bp, Homo sapiens
actgtacttacgcatatacagg

SEQ ID NO: 6998473 - DNA, 20 bp, Homo sapiens
tggggcctgtttctgtggtt

SEQ ID NO: 6998474 - DNA, 21 bp, Homo sapiens
ttcataaaccattctcatgca

SEQ ID NO: 6998475 - DNA, 22 bp, Homo sapiens
tacattcacagttgttcatctc

SEQ ID NO: 6998476 - DNA, 22 bp, Homo sapiens
gtgtcctggagcccccagttca

SEQ ID NO: 6998477 - DNA, 21 bp, Homo sapiens
gcaaggctcattcttgttgta

SEQ ID NO: 6998478 - DNA, 22 bp, Homo sapiens
aggtctggctcttctccacaga

SEQ ID NO: 6998479 - DNA, 22 bp, Homo sapiens
gcgagtcgccgctgcagcccta

SEQ ID NO: 6998480 - DNA, 22 bp, Homo sapiens
ggcatggtctttgcttgcagga

SEQ ID NO: 6998481 - DNA, 18 bp, Homo sapiens
tgggtggctagggagttt

SEQ ID NO: 6998482 - DNA, 22 bp, Homo sapiens
ggctccttatctctcctatgcc

SEQ ID NO: 6998483 - DNA, 22 bp, Homo sapiens
agaagccagcttcagctgcccg

SEQ ID NO: 6998484 - DNA, 22 bp, Homo sapiens
aaacagataagggacaatttca

SEQ ID NO: 6998485 - DNA, 22 bp, Homo sapiens
catgtgtagtgaaataagcagt

SEQ ID NO: 6998486 - DNA, 23 bp, Homo sapiens
tgccatttggaagttgggggtct

SEQ ID NO: 6998487 - DNA, 22 bp, Homo sapiens
gtttcttatttcaactggaaca

SEQ ID NO: 6998488 - DNA, 22 bp, Homo sapiens
taaagtgttagagtctagcttc

SEQ ID NO: 6998489 - DNA, 22 bp, Homo sapiens
ggaggggaggtccagctgatct

SEQ ID NO: 6998490 - DNA, 22 bp, Homo sapiens
gttccatatcacagcagacgaa

SEQ ID NO: 6998491 - DNA, 22 bp, Homo sapiens
atggcagaatccatagtaggtg

SEQ ID NO: 6998492 - DNA, 22 bp, Homo sapiens
ttgtttaaaatgtagcaagaaa

SEQ ID NO: 6998493 - DNA, 22 bp, Homo sapiens
ctggaagctaacatccttttcc

SEQ ID NO: 6998494 - DNA, 22 bp, Homo sapiens
tagcagctcacagcctcccatt

SEQ ID NO: 6998495 - DNA, 21 bp, Homo sapiens
gcacttctgcagggctgctgg

SEQ ID NO: 6998496 - DNA, 21 bp, Homo sapiens
tctcttcctccgcgccgccgc

SEQ ID NO: 6998497 - DNA, 18 bp, Homo sapiens
gagtccaggctcttcacc

SEQ ID NO: 6998498 - DNA, 22 bp, Homo sapiens
ggaaaactgaggctctcagcag

SEQ ID NO: 6998499 - DNA, 20 bp, Homo sapiens
gcaaatggacactcagggaa

SEQ ID NO: 6998500 - DNA, 22 bp, Homo sapiens
accctctggctcatttcctagt

SEQ ID NO: 6998501 - DNA, 22 bp, Homo sapiens
tttggaaatgagaagccacctt

SEQ ID NO: 6998502 - DNA, 22 bp, Homo sapiens
ctcagagagtgaattcctgcct

SEQ ID NO: 6998503 - DNA, 20 bp, Homo sapiens
ggattctgactgtgaagagg

SEQ ID NO: 6998504 - DNA, 22 bp, Homo sapiens
ggtgctgctgctgaacccagct

SEQ ID NO: 6998505 - DNA, 22 bp, Homo sapiens
ttaagcatggaagtgaaataat

SEQ ID NO: 6998506 - DNA, 22 bp, Homo sapiens
agtcacaataccgtgtgtcagt

SEQ ID NO: 6998507 - DNA, 22 bp, Homo sapiens
attccttctattctctgtgggt

SEQ ID NO: 6998508 - DNA, 22 bp, Homo sapiens
tgagatgagatttcactgtcct

SEQ ID NO: 6998509 - DNA, 22 bp, Homo sapiens
cacagtcctgccagagggcctt

SEQ ID NO: 6998510 - DNA, 22 bp, Homo sapiens
ccccaaaacttagtgacttaaa

SEQ ID NO: 6998511 - DNA, 22 bp, Homo sapiens
atcgcctgttcacacctgtcca

SEQ ID NO: 6998512 - DNA, 22 bp, Homo sapiens
gtaaatcccatcctttctctgg

SEQ ID NO: 6998513 - DNA, 22 bp, Homo sapiens
gctggaacagtctttaagcagg

SEQ ID NO: 6998514 - DNA, 22 bp, Homo sapiens
tatgaagaaatctttgaaaatc

SEQ ID NO: 6998515 - DNA, 22 bp, Homo sapiens
agtccagggagcccaggctttg

SEQ ID NO: 6998516 - DNA, 22 bp, Homo sapiens
ccgaggctggcctcagggctgt

SEQ ID NO: 6998517 - DNA, 22 bp, Homo sapiens
catccctggttcctgtgtttaa

SEQ ID NO: 6998518 - DNA, 22 bp, Homo sapiens
agtgtggacttttcctaggagg

SEQ ID NO: 6998519 - DNA, 20 bp, Homo sapiens
tacagaatgcaataaaatgg

SEQ ID NO: 6998520 - DNA, 22 bp, Homo sapiens
tcagaactggtatttatcaagg

SEQ ID NO: 6998521 - DNA, 22 bp, Homo sapiens
gaagtcttggctgaaaaccctc

SEQ ID NO: 6998522 - DNA, 22 bp, Homo sapiens
ggccttgcctcaatagctccac

SEQ ID NO: 6998523 - DNA, 22 bp, Homo sapiens
tagtttagccccacgtgtgctt

SEQ ID NO: 6998524 - DNA, 22 bp, Homo sapiens
tcttattgtgatgatgaagaac

SEQ ID NO: 6998525 - DNA, 22 bp, Homo sapiens
cagggagcactgcgagcggcag

SEQ ID NO: 6998526 - DNA, 22 bp, Homo sapiens
cagccactgtggtctagctgca

SEQ ID NO: 6998527 - DNA, 22 bp, Homo sapiens
ctgaggcctctctcctgggctt

SEQ ID NO: 6998528 - DNA, 22 bp, Homo sapiens
gtgttagtttgctaaggataat

SEQ ID NO: 6998529 - DNA, 22 bp, Homo sapiens
catcttataggcagagttcagt

SEQ ID NO: 6998530 - DNA, 22 bp, Homo sapiens
tggatctgtcccaaggctaggc

SEQ ID NO: 6998531 - DNA, 22 bp, Homo sapiens
cctagagtcagcgccgggtcag

SEQ ID NO: 6998532 - DNA, 22 bp, Homo sapiens
tttggctaattaggtgctgatt

SEQ ID NO: 6998533 - DNA, 22 bp, Homo sapiens
tgtgttaagtatttgatacact

SEQ ID NO: 6998534 - DNA, 22 bp, Homo sapiens
tttcacagatgttttggagtct

SEQ ID NO: 6998535 - DNA, 22 bp, Homo sapiens
actttttgctggtctcttccat

SEQ ID NO: 6998536 - DNA, 23 bp, Homo sapiens
accaggagttgtctcaggaaaca

SEQ ID NO: 6998537 - DNA, 22 bp, Homo sapiens
ggcctgacaagtgggaagaggc

SEQ ID NO: 6998538 - DNA, 22 bp, Homo sapiens
tgatggctgtagggtccggggc

SEQ ID NO: 6998539 - DNA, 22 bp, Homo sapiens
tgtttacttctttccatggctt

SEQ ID NO: 6998540 - DNA, 21 bp, Homo sapiens
actttgggcactttcctgccc

SEQ ID NO: 6998541 - DNA, 22 bp, Homo sapiens
tagctgcctttgggctcctgct

SEQ ID NO: 6998542 - DNA, 22 bp, Homo sapiens
tggcattatgtagcagggagca

SEQ ID NO: 6998543 - DNA, 22 bp, Homo sapiens
agatacaactgtttaaacatta

SEQ ID NO: 6998544 - DNA, 22 bp, Homo sapiens
gggctgtgtgcccacttcccat

SEQ ID NO: 6998545 - DNA, 23 bp, Homo sapiens
agtcagtgtaagtttggaatgca

SEQ ID NO: 6998546 - DNA, 22 bp, Homo sapiens
ttggttaccttcagaaatgagt

SEQ ID NO: 6998547 - DNA, 22 bp, Homo sapiens
tggaggagaccattccactcag

SEQ ID NO: 6998548 - DNA, 22 bp, Homo sapiens
tttcagttgattgcttgggtta

SEQ ID NO: 6998549 - DNA, 21 bp, Homo sapiens
gatctctggaatgactctggc

SEQ ID NO: 6998550 - DNA, 22 bp, Homo sapiens
gagtggctccaatttggtccta

SEQ ID NO: 6998551 - DNA, 22 bp, Homo sapiens
gaagccagatttggggcatatc

SEQ ID NO: 6998552 - DNA, 22 bp, Homo sapiens
gtttccagtcaacttgtgtgtg

SEQ ID NO: 6998553 - DNA, 22 bp, Homo sapiens
ctggctggctgtgcccctgccg

SEQ ID NO: 6998554 - DNA, 22 bp, Homo sapiens
ggctttgggggtgtccaagaaa

SEQ ID NO: 6998555 - DNA, 22 bp, Homo sapiens
atggcattgcagcctctcccat

SEQ ID NO: 6998556 - DNA, 22 bp, Homo sapiens
tggaggtggggctcaggaatct

SEQ ID NO: 6998557 - DNA, 22 bp, Homo sapiens
tcccggagcctgcactcctaac

SEQ ID NO: 6998558 - DNA, 22 bp, Homo sapiens
ctgaggccagagtgggcctctt

SEQ ID NO: 6998559 - DNA, 22 bp, Homo sapiens
gccacttactaacctcctatcc

SEQ ID NO: 6998560 - DNA, 22 bp, Homo sapiens
taagtgaatattttcttctgta

SEQ ID NO: 6998561 - DNA, 22 bp, Homo sapiens
tcaccctgtgattgcaaagaaa

SEQ ID NO: 6998562 - DNA, 21 bp, Homo sapiens
tcagtccctgggtgtgtccca

SEQ ID NO: 6998563 - DNA, 22 bp, Homo sapiens
aagctttcagagcagaatgtga

SEQ ID NO: 6998564 - DNA, 22 bp, Homo sapiens
cccgtgtggatgcgctggtgct

SEQ ID NO: 6998565 - DNA, 22 bp, Homo sapiens
ctgggtggctgtccagccagcc

SEQ ID NO: 6998566 - DNA, 20 bp, Homo sapiens
aggctcagatacccagggaa

SEQ ID NO: 6998567 - DNA, 16 bp, Homo sapiens
ctggaaaggctagctc

SEQ ID NO: 6998568 - DNA, 22 bp, Homo sapiens
tctgaaatactgcaggttctct

SEQ ID NO: 6998569 - DNA, 21 bp, Homo sapiens
tagaagcacataggttcaaag

SEQ ID NO: 6998570 - DNA, 20 bp, Homo sapiens
acatatgtgtgcatatcttt

SEQ ID NO: 6998571 - DNA, 22 bp, Homo sapiens
aactgtcttgcctactcagcat

SEQ ID NO: 6998572 - DNA, 22 bp, Homo sapiens
caggagcatgctgatgccagaa

SEQ ID NO: 6998573 - DNA, 22 bp, Homo sapiens
ggtgggggagacttggtcaaga

SEQ ID NO: 6998574 - DNA, 22 bp, Homo sapiens
tcactgcacttcaggctttctc

SEQ ID NO: 6998575 - DNA, 22 bp, Homo sapiens
tggcagtgtttctaaggggctc

SEQ ID NO: 6998576 - DNA, 22 bp, Homo sapiens
tcacatcttggattacaatttt

SEQ ID NO: 6998577 - DNA, 22 bp, Homo sapiens
tcctggccagaggacaaagctg

SEQ ID NO: 6998578 - DNA, 22 bp, Homo sapiens
agggagcttgtgtttcttttag

SEQ ID NO: 6998579 - DNA, 22 bp, Homo sapiens
agcactttaagcaacagatcaa

SEQ ID NO: 6998580 - DNA, 22 bp, Homo sapiens
aagatggagcacgagcagaagc

SEQ ID NO: 6998581 - DNA, 22 bp, Homo sapiens
taaccatgcatgtctctagttt

SEQ ID NO: 6998582 - DNA, 22 bp, Homo sapiens
tgcaagaatgacccatctaccc

SEQ ID NO: 6998583 - DNA, 22 bp, Homo sapiens
tgctggctttttgtgtcaaaga

SEQ ID NO: 6998584 - DNA, 22 bp, Homo sapiens
atgaatgagaaagctgaaatct

SEQ ID NO: 6998585 - DNA, 22 bp, Homo sapiens
tgaagccacactagcttgtcct

SEQ ID NO: 6998586 - DNA, 22 bp, Homo sapiens
gtggggtctctctgtacctccc

SEQ ID NO: 6998587 - DNA, 22 bp, Homo sapiens
gctgtcccttgtcccaccttgc

SEQ ID NO: 6998588 - DNA, 22 bp, Homo sapiens
cacagtgcaatcggccacaaat

SEQ ID NO: 6998589 - DNA, 22 bp, Homo sapiens
agccagagactttacctgtgca

SEQ ID NO: 6998590 - DNA, 22 bp, Homo sapiens
tatgaagtgatgttgaattttg

SEQ ID NO: 6998591 - DNA, 22 bp, Homo sapiens
gctgagggtaacacttcgggat

SEQ ID NO: 6998592 - DNA, 22 bp, Homo sapiens
aacatcacaatttcatttatgc

SEQ ID NO: 6998593 - DNA, 19 bp, Homo sapiens
actgggcttgtcctcgtgg

SEQ ID NO: 6998594 - DNA, 22 bp, Homo sapiens
cgagcaccacttcactcttcct

SEQ ID NO: 6998595 - DNA, 22 bp, Homo sapiens
tgggagctctgagcctgctatg

SEQ ID NO: 6998596 - DNA, 22 bp, Homo sapiens
ttgaaatgaaatatttaagctc

SEQ ID NO: 6998597 - DNA, 22 bp, Homo sapiens
tctgaactccagccctgctctc

SEQ ID NO: 6998598 - DNA, 22 bp, Homo sapiens
tatctgtcgcatacatacttgg

SEQ ID NO: 6998599 - DNA, 23 bp, Homo sapiens
ctggatttggaagcttaaataac

SEQ ID NO: 6998600 - DNA, 22 bp, Homo sapiens
tgcagctgaaaggactgaatga

SEQ ID NO: 6998601 - DNA, 22 bp, Homo sapiens
gcaggccactgtctcctctggg

SEQ ID NO: 6998602 - DNA, 22 bp, Homo sapiens
ctgtagccagaagcagaaggcc

SEQ ID NO: 6998603 - DNA, 22 bp, Homo sapiens
aggcggaagatggccccataga

SEQ ID NO: 6998604 - DNA, 16 bp, Homo sapiens
tggcttcccagagata

SEQ ID NO: 6998605 - DNA, 22 bp, Homo sapiens
tgaatgaggatccttgacctta

SEQ ID NO: 6998606 - DNA, 22 bp, Homo sapiens
acaggcaggtcctgtcccagct

SEQ ID NO: 6998607 - DNA, 22 bp, Homo sapiens
gctgagaatgttcctactggta

SEQ ID NO: 6998608 - DNA, 22 bp, Homo sapiens
tctctgagacagtagcctctgc

SEQ ID NO: 6998609 - DNA, 22 bp, Homo sapiens
accacccattcagaaacactga

SEQ ID NO: 6998610 - DNA, 22 bp, Homo sapiens
acataacatgtcaatcacccga

SEQ ID NO: 6998611 - DNA, 22 bp, Homo sapiens
ggctctgccgtgtgctcacatg

SEQ ID NO: 6998612 - DNA, 22 bp, Homo sapiens
cctaggccctaggcttccatca

SEQ ID NO: 6998613 - DNA, 22 bp, Homo sapiens
cttacattaagtaagagattga

SEQ ID NO: 6998614 - DNA, 22 bp, Homo sapiens
ctgtgctgattcagcacaggcc

SEQ ID NO: 6998615 - DNA, 22 bp, Homo sapiens
atccatatctggactctacccc

SEQ ID NO: 6998616 - DNA, 22 bp, Homo sapiens
ttccttggatacaagtaacttt

SEQ ID NO: 6998617 - DNA, 22 bp, Homo sapiens
tgggcctgggctggacagcctg

SEQ ID NO: 6998618 - DNA, 22 bp, Homo sapiens
gtcaggatgacaagtgctttca

SEQ ID NO: 6998619 - DNA, 17 bp, Homo sapiens
atttcccagcagtgcta

SEQ ID NO: 6998620 - DNA, 22 bp, Homo sapiens
cattagcattacttcaaagagt

SEQ ID NO: 6998621 - DNA, 22 bp, Homo sapiens
cccagtccagaccatgacctca

SEQ ID NO: 6998622 - DNA, 22 bp, Homo sapiens
tgcttcccaaggtttcatgtgc

SEQ ID NO: 6998623 - DNA, 22 bp, Homo sapiens
aagggctccctgcctgaggtgg

SEQ ID NO: 6998624 - DNA, 22 bp, Homo sapiens
aatgtacaataagacaaagagg

SEQ ID NO: 6998625 - DNA, 22 bp, Homo sapiens
ctgccatgccactgtgactgca

SEQ ID NO: 6998626 - DNA, 22 bp, Homo sapiens
gtttccagagatcatttacata

SEQ ID NO: 6998627 - DNA, 22 bp, Homo sapiens
aggttcagtctttggacccctc

SEQ ID NO: 6998628 - DNA, 22 bp, Homo sapiens
tcaccagctctgcctcgccagt

SEQ ID NO: 6998629 - DNA, 22 bp, Homo sapiens
attaagcacttggggaaaggat

SEQ ID NO: 6998630 - DNA, 22 bp, Homo sapiens
tctttgcaactcccatttccat

SEQ ID NO: 6998631 - DNA, 19 bp, Homo sapiens
ttggggtgaatgccagaca

SEQ ID NO: 6998632 - DNA, 21 bp, Homo sapiens
ctctctagatggcttccagcc

SEQ ID NO: 6998633 - DNA, 22 bp, Homo sapiens
gagactggtgtttgctgggctg

SEQ ID NO: 6998634 - DNA, 22 bp, Homo sapiens
ataatgaggatttgcatattag

SEQ ID NO: 6998635 - DNA, 22 bp, Homo sapiens
tccaaggactcttgtcagctgt

SEQ ID NO: 6998636 - DNA, 22 bp, Homo sapiens
gtatttctagtttcttccacag

SEQ ID NO: 6998637 - DNA, 22 bp, Homo sapiens
gtatttcttggaaatcctttta

SEQ ID NO: 6998638 - DNA, 22 bp, Homo sapiens
atattttgtaacttggaatagg

SEQ ID NO: 6998639 - DNA, 22 bp, Homo sapiens
gatgtagacacttggaggctta

SEQ ID NO: 6998640 - DNA, 22 bp, Homo sapiens
agtttggaaaatgagacaagga

SEQ ID NO: 6998641 - DNA, 22 bp, Homo sapiens
tatgtgtatgtacatacataca

SEQ ID NO: 6998642 - DNA, 22 bp, Homo sapiens
tcagaggaccttactgagaacc

SEQ ID NO: 6998643 - DNA, 22 bp, Homo sapiens
atgaagtaggactgaacttggg

SEQ ID NO: 6998644 - DNA, 22 bp, Homo sapiens
atttgtaacacgtgacaggttg

SEQ ID NO: 6998645 - DNA, 22 bp, Homo sapiens
aagggaggaggatttattgtac

SEQ ID NO: 6998646 - DNA, 22 bp, Homo sapiens
gtccttcatttcctgatctcta

SEQ ID NO: 6998647 - DNA, 22 bp, Homo sapiens
tggacaactggtttttgacaaa

SEQ ID NO: 6998648 - DNA, 22 bp, Homo sapiens
gctggcagactgggggcagaac

SEQ ID NO: 6998649 - DNA, 22 bp, Homo sapiens
ggaaccacagcccccagcaggc

SEQ ID NO: 6998650 - DNA, 23 bp, Homo sapiens
agagggagatgtttttctcaaga

SEQ ID NO: 6998651 - DNA, 22 bp, Homo sapiens
agaggctaggaccatgtatcat

SEQ ID NO: 6998652 - DNA, 22 bp, Homo sapiens
catggttttgagcctattatgc

SEQ ID NO: 6998653 - DNA, 22 bp, Homo sapiens
gacagactaaatggctgtagga

SEQ ID NO: 6998654 - DNA, 22 bp, Homo sapiens
cggccagtgccgctctcgcctc

SEQ ID NO: 6998655 - DNA, 22 bp, Homo sapiens
cctcagctgctgcacagctttt

SEQ ID NO: 6998656 - DNA, 23 bp, Homo sapiens
tctgagggagtgggcagtggcac

SEQ ID NO: 6998657 - DNA, 22 bp, Homo sapiens
ccctgctgaagaacgttcatac

SEQ ID NO: 6998658 - DNA, 22 bp, Homo sapiens
ggtgagcactgccctgggtctc

SEQ ID NO: 6998659 - DNA, 22 bp, Homo sapiens
cagcagtgcttcagtgtgagat

SEQ ID NO: 6998660 - DNA, 22 bp, Homo sapiens
ggcaaacacacctcggtgagaa

SEQ ID NO: 6998661 - DNA, 22 bp, Homo sapiens
gacaggtactatgtgcagacac

SEQ ID NO: 6998662 - DNA, 22 bp, Homo sapiens
aaatgacattaggatcctgcat

SEQ ID NO: 6998663 - DNA, 22 bp, Homo sapiens
tggctattgagtgatctctaga

SEQ ID NO: 6998664 - DNA, 22 bp, Homo sapiens
ccttctgagcttcaatttcagt

SEQ ID NO: 6998665 - DNA, 22 bp, Homo sapiens
actgtcttcaaatgaatatatt

SEQ ID NO: 6998666 - DNA, 22 bp, Homo sapiens
cccagccaaaagcaagtttacc

SEQ ID NO: 6998667 - DNA, 22 bp, Homo sapiens
ccagtgtttccccagaagagag

SEQ ID NO: 6998668 - DNA, 22 bp, Homo sapiens
acctaaatctacctcatgtttt

SEQ ID NO: 6998669 - DNA, 22 bp, Homo sapiens
caagatgaggtcatactggaat

SEQ ID NO: 6998670 - DNA, 22 bp, Homo sapiens
ctgaacaacttgtcattccaag

SEQ ID NO: 6998671 - DNA, 22 bp, Homo sapiens
tgaaatgcttaggaccagaagg

SEQ ID NO: 6998672 - DNA, 22 bp, Homo sapiens
ggcagtttcatcaggagaaaag

SEQ ID NO: 6998673 - DNA, 22 bp, Homo sapiens
tgactttggcttaagcagcagt

SEQ ID NO: 6998674 - DNA, 22 bp, Homo sapiens
atcctaaactattgagaaagct

SEQ ID NO: 6998675 - DNA, 22 bp, Homo sapiens
ctcatttagggggcatggtaca

SEQ ID NO: 6998676 - DNA, 22 bp, Homo sapiens
cactgagcatgagtgggctgtg

SEQ ID NO: 6998677 - DNA, 22 bp, Homo sapiens
tttttgtatatgcttcgaggat

SEQ ID NO: 6998678 - DNA, 22 bp, Homo sapiens
taagatgtctaagaggagatgc

SEQ ID NO: 6998679 - DNA, 22 bp, Homo sapiens
atatgtcctcggcacataatgt

SEQ ID NO: 6998680 - DNA, 22 bp, Homo sapiens
aaagcaagatgcatccgtcaag

SEQ ID NO: 6998681 - DNA, 22 bp, Homo sapiens
atgacagatagtcttcatttgc

SEQ ID NO: 6998682 - DNA, 22 bp, Homo sapiens
tttggctaactgcaaaaagtac

SEQ ID NO: 6998683 - DNA, 22 bp, Homo sapiens
ccttctggatgtgctaaggaag

SEQ ID NO: 6998684 - DNA, 22 bp, Homo sapiens
ctggtgtcattttagcctcagg

SEQ ID NO: 6998685 - DNA, 19 bp, Homo sapiens
ccattcctctagaatttgg

SEQ ID NO: 6998686 - DNA, 22 bp, Homo sapiens
agcccactgttttcatttctct

SEQ ID NO: 6998687 - DNA, 22 bp, Homo sapiens
agattggtgttgcagaaccatg

SEQ ID NO: 6998688 - DNA, 22 bp, Homo sapiens
tccttatagttgtctttgaacc

SEQ ID NO: 6998689 - DNA, 22 bp, Homo sapiens
tgctctattaattttaacgatg

SEQ ID NO: 6998690 - DNA, 22 bp, Homo sapiens
atgtttgcttaattggagaaat

SEQ ID NO: 6998691 - DNA, 22 bp, Homo sapiens
tcaactaaggcacaatctctaa

SEQ ID NO: 6998692 - DNA, 22 bp, Homo sapiens
gatcaaagcctagttccaagat

SEQ ID NO: 6998693 - DNA, 22 bp, Homo sapiens
gtgttcttttgcttcacagaaa

SEQ ID NO: 6998694 - DNA, 22 bp, Homo sapiens
ggcagttctggatgcattgtca

SEQ ID NO: 6998695 - DNA, 22 bp, Homo sapiens
atgtcacatggtcacctctagc

SEQ ID NO: 6998696 - DNA, 22 bp, Homo sapiens
caggcacagctgggcaattgcg

SEQ ID NO: 6998697 - DNA, 22 bp, Homo sapiens
ggccttgatctctctaactgct

SEQ ID NO: 6998698 - DNA, 22 bp, Homo sapiens
gctttcttgctgcatggtggct

SEQ ID NO: 6998699 - DNA, 22 bp, Homo sapiens
ttatccatttaaaccagttata

SEQ ID NO: 6998700 - DNA, 22 bp, Homo sapiens
ggacagtccacctcagtgaaga

SEQ ID NO: 6998701 - DNA, 22 bp, Homo sapiens
ccggcgggcgcggtgacgtcag

SEQ ID NO: 6998702 - DNA, 21 bp, Homo sapiens
aaggtctgtaaagtgacagga

SEQ ID NO: 6998703 - DNA, 22 bp, Homo sapiens
ggacagcagcctcttacatgaa

SEQ ID NO: 6998704 - DNA, 22 bp, Homo sapiens
gccaggctaagaaaggtgtgat

SEQ ID NO: 6998705 - DNA, 22 bp, Homo sapiens
aattccatccatttgtttcaac

SEQ ID NO: 6998706 - DNA, 22 bp, Homo sapiens
agaattcataggaagtttccta

SEQ ID NO: 6998707 - DNA, 22 bp, Homo sapiens
ggtccctggaaggcactagtga

SEQ ID NO: 6998708 - DNA, 22 bp, Homo sapiens
gagattatggagaggacattct

SEQ ID NO: 6998709 - DNA, 22 bp, Homo sapiens
tcaaagcatcagtcaatttagg

SEQ ID NO: 6998710 - DNA, 22 bp, Homo sapiens
tttcttctcgacaccttatccc

SEQ ID NO: 6998711 - DNA, 22 bp, Homo sapiens
ctctccagggaagcagtgtact

SEQ ID NO: 6998712 - DNA, 22 bp, Homo sapiens
gctggtcctcaagggcacagcc

SEQ ID NO: 6998713 - DNA, 22 bp, Homo sapiens
ctccagaggaaagcacatagtg

SEQ ID NO: 6998714 - DNA, 22 bp, Homo sapiens
aggcttttagaatcttatttct

SEQ ID NO: 6998715 - DNA, 22 bp, Homo sapiens
ttcaaatacattctttgccact

SEQ ID NO: 6998716 - DNA, 22 bp, Homo sapiens
ctgggggtgagcagcagcgacg

SEQ ID NO: 6998717 - DNA, 22 bp, Homo sapiens
tgggagcagccaacatggcctt

SEQ ID NO: 6998718 - DNA, 22 bp, Homo sapiens
aaactgtaaagcaggtgagtag

SEQ ID NO: 6998719 - DNA, 22 bp, Homo sapiens
tttcttggggctcctgcgccat

SEQ ID NO: 6998720 - DNA, 22 bp, Homo sapiens
cagccaggactcccatttagga

SEQ ID NO: 6998721 - DNA, 22 bp, Homo sapiens
ttcctgcccctgagagctccca

SEQ ID NO: 6998722 - DNA, 22 bp, Homo sapiens
atgttttgattggttaggtctg

SEQ ID NO: 6998723 - DNA, 16 bp, Homo sapiens
cttaagtgctgaaagg

SEQ ID NO: 6998724 - DNA, 21 bp, Homo sapiens
cactggttcctgaatgccttc

SEQ ID NO: 6998725 - DNA, 22 bp, Homo sapiens
acaacatttaaggaggcactga

SEQ ID NO: 6998726 - DNA, 22 bp, Homo sapiens
tagacacaagagaagggtataa

SEQ ID NO: 6998727 - DNA, 18 bp, Homo sapiens
ttcagtttctagttcctt

SEQ ID NO: 6998728 - DNA, 22 bp, Homo sapiens
tttcaattgactttggaagaaa

SEQ ID NO: 6998729 - DNA, 22 bp, Homo sapiens
cctcacccagtcacctaggtgg

SEQ ID NO: 6998730 - DNA, 22 bp, Homo sapiens
tggagcccacggatgtcgcttt

SEQ ID NO: 6998731 - DNA, 22 bp, Homo sapiens
ctggtgttgtccgggtgagagt

SEQ ID NO: 6998732 - DNA, 22 bp, Homo sapiens
agcacaaaaacattcccagagt

SEQ ID NO: 6998733 - DNA, 22 bp, Homo sapiens
ctctgggtcaccatcggggatt

SEQ ID NO: 6998734 - DNA, 22 bp, Homo sapiens
gtctcattggttctgccagagt

SEQ ID NO: 6998735 - DNA, 22 bp, Homo sapiens
gtcctgcacatggagggcaatg

SEQ ID NO: 6998736 - DNA, 22 bp, Homo sapiens
gccctgagaggcaatgactctt

SEQ ID NO: 6998737 - DNA, 22 bp, Homo sapiens
atcaacttttagcatggtacct

SEQ ID NO: 6998738 - DNA, 22 bp, Homo sapiens
tacagccacaggtgactctcat

SEQ ID NO: 6998739 - DNA, 22 bp, Homo sapiens
agacaaatttcctgcaatgaag

SEQ ID NO: 6998740 - DNA, 22 bp, Homo sapiens
agagaaggtcactaaggaccca

SEQ ID NO: 6998741 - DNA, 22 bp, Homo sapiens
aaatgtgagttatagcaataga

SEQ ID NO: 6998742 - DNA, 22 bp, Homo sapiens
ggcacctgctcatctggactca

SEQ ID NO: 6998743 - DNA, 22 bp, Homo sapiens
actgcccattaaaggtgctttg

SEQ ID NO: 6998744 - DNA, 22 bp, Homo sapiens
aatgtcacagaagaactcccca

SEQ ID NO: 6998745 - DNA, 22 bp, Homo sapiens
tgcctgtgtatgtgcatgcaca

SEQ ID NO: 6998746 - DNA, 22 bp, Homo sapiens
agctttggaaatcaatgtaaaa

SEQ ID NO: 6998747 - DNA, 22 bp, Homo sapiens
tggcagcaagttcttgggaggt

SEQ ID NO: 6998748 - DNA, 22 bp, Homo sapiens
tctggtcaaggagcagtgactg

SEQ ID NO: 6998749 - DNA, 22 bp, Homo sapiens
ccactggagaacgtctgatgaa

SEQ ID NO: 6998750 - DNA, 22 bp, Homo sapiens
gtccatacaggcagtggctctg

SEQ ID NO: 6998751 - DNA, 22 bp, Homo sapiens
gtcagtttgactcagtgttata

SEQ ID NO: 6998752 - DNA, 22 bp, Homo sapiens
gcaggaggccaggtatgcttta

SEQ ID NO: 6998753 - DNA, 22 bp, Homo sapiens
acattccaggttggtgcagggt

SEQ ID NO: 6998754 - DNA, 22 bp, Homo sapiens
tgcttctggaaacagtggctgt

SEQ ID NO: 6998755 - DNA, 22 bp, Homo sapiens
gttacaagtgttcgagagtgac

SEQ ID NO: 6998756 - DNA, 22 bp, Homo sapiens
tcaacagattgtattaaggtta

SEQ ID NO: 6998757 - DNA, 22 bp, Homo sapiens
ctattttgcctgcctagaaatc

SEQ ID NO: 6998758 - DNA, 22 bp, Homo sapiens
atgtccagggcacacagcagtg

SEQ ID NO: 6998759 - DNA, 22 bp, Homo sapiens
attgcctgccactctgtgagga

SEQ ID NO: 6998760 - DNA, 22 bp, Homo sapiens
tcacttcacacccactatcatg

SEQ ID NO: 6998761 - DNA, 22 bp, Homo sapiens
aaaagtatggtggtccttttta

SEQ ID NO: 6998762 - DNA, 22 bp, Homo sapiens
actgaggtaattgtgaggatta

SEQ ID NO: 6998763 - DNA, 22 bp, Homo sapiens
agctttggtgctgtcacacaaa

SEQ ID NO: 6998764 - DNA, 22 bp, Homo sapiens
gtccatctttgatgaaaactta

SEQ ID NO: 6998765 - DNA, 23 bp, Homo sapiens
tagatcctatggctgtgtgcaga

SEQ ID NO: 6998766 - DNA, 22 bp, Homo sapiens
tcctgaaaaattacatgttcag

SEQ ID NO: 6998767 - DNA, 22 bp, Homo sapiens
tctctgtgacatttctgagcct

SEQ ID NO: 6998768 - DNA, 20 bp, Homo sapiens
cctagttttctgagcgtgac

SEQ ID NO: 6998769 - DNA, 22 bp, Homo sapiens
ttttcagtggtatctttgtaaa

SEQ ID NO: 6998770 - DNA, 22 bp, Homo sapiens
ttcatctgtagcatcttccaat

SEQ ID NO: 6998771 - DNA, 22 bp, Homo sapiens
gttcacagttttatacctgaga

SEQ ID NO: 6998772 - DNA, 22 bp, Homo sapiens
gtaattgagttacctggaccag

SEQ ID NO: 6998773 - DNA, 21 bp, Homo sapiens
ttttttcttgcgtgaggcctg

SEQ ID NO: 6998774 - DNA, 22 bp, Homo sapiens
gaggtccattttcacatatgat

SEQ ID NO: 6998775 - DNA, 22 bp, Homo sapiens
ttgattaaacaggcatattcaa

SEQ ID NO: 6998776 - DNA, 19 bp, Homo sapiens
aaagtgaatgctgttttct

SEQ ID NO: 6998777 - DNA, 22 bp, Homo sapiens
tcacttatatttcaggagatat

SEQ ID NO: 6998778 - DNA, 22 bp, Homo sapiens
gagttattagtcaaatagggaa

SEQ ID NO: 6998779 - DNA, 22 bp, Homo sapiens
ctgacagctgttgcagtgaatg

SEQ ID NO: 6998780 - DNA, 22 bp, Homo sapiens
ctggagccccaggctgtgcaga

SEQ ID NO: 6998781 - DNA, 22 bp, Homo sapiens
cagagtggtgcaagggcagtgt

SEQ ID NO: 6998782 - DNA, 22 bp, Homo sapiens
gaataacattttttcctttaca

SEQ ID NO: 6998783 - DNA, 22 bp, Homo sapiens
atttcttgattccaccagtgaa

SEQ ID NO: 6998784 - DNA, 22 bp, Homo sapiens
aaggacctgattttgagcatct

SEQ ID NO: 6998785 - DNA, 22 bp, Homo sapiens
gcgagtgccgagagggcagggc

SEQ ID NO: 6998786 - DNA, 22 bp, Homo sapiens
ggatgaggaagattactgagaa

SEQ ID NO: 6998787 - DNA, 22 bp, Homo sapiens
ccagctccaagtttgggcatca

SEQ ID NO: 6998788 - DNA, 22 bp, Homo sapiens
tctctggaattttgagagtgac

SEQ ID NO: 6998789 - DNA, 22 bp, Homo sapiens
attctttaattcaattgaagga

SEQ ID NO: 6998790 - DNA, 22 bp, Homo sapiens
cctttgttcattgccttcagtc

SEQ ID NO: 6998791 - DNA, 22 bp, Homo sapiens
ctgccagcagaggccagcgctg

SEQ ID NO: 6998792 - DNA, 22 bp, Homo sapiens
aagagtcagcttctgtatgggt

SEQ ID NO: 6998793 - DNA, 22 bp, Homo sapiens
agctgatttttaggagacagga

SEQ ID NO: 6998794 - DNA, 19 bp, Homo sapiens
tgcctggcaccagctccac

SEQ ID NO: 6998795 - DNA, 22 bp, Homo sapiens
tttatatgaaagtgaccagtgg

SEQ ID NO: 6998796 - DNA, 22 bp, Homo sapiens
gggcaatttgttttaatgaggg

SEQ ID NO: 6998797 - DNA, 22 bp, Homo sapiens
ccagagaggtagcttaccctct

SEQ ID NO: 6998798 - DNA, 22 bp, Homo sapiens
tggcgctatgagatgaaagagg

SEQ ID NO: 6998799 - DNA, 22 bp, Homo sapiens
agcactagcctgttttgctgtg

SEQ ID NO: 6998800 - DNA, 20 bp, Homo sapiens
tacatctctcagatgtctaa

SEQ ID NO: 6998801 - DNA, 18 bp, Homo sapiens
ttttactcatagcaggcc

SEQ ID NO: 6998802 - DNA, 22 bp, Homo sapiens
acacaggaactcaagctcgctt

SEQ ID NO: 6998803 - DNA, 22 bp, Homo sapiens
atggtgtacagccagatgtaga

SEQ ID NO: 6998804 - DNA, 22 bp, Homo sapiens
gtggaattggatgtggggtttt

SEQ ID NO: 6998805 - DNA, 22 bp, Homo sapiens
ttcttgaatagggattgataaa

SEQ ID NO: 6998806 - DNA, 22 bp, Homo sapiens
ccccagggactggtttcatgga

SEQ ID NO: 6998807 - DNA, 22 bp, Homo sapiens
agcagaaatagaagtcaatgat

SEQ ID NO: 6998808 - DNA, 22 bp, Homo sapiens
aatgtgactggagtctcttggc

SEQ ID NO: 6998809 - DNA, 22 bp, Homo sapiens
tgcttgatggctcttctttcta

SEQ ID NO: 6998810 - DNA, 22 bp, Homo sapiens
tggagcttgggactcttggtag

SEQ ID NO: 6998811 - DNA, 22 bp, Homo sapiens
catgaatttatattattagtga

SEQ ID NO: 6998812 - DNA, 22 bp, Homo sapiens
atcactgattcattgtggtgat

SEQ ID NO: 6998813 - DNA, 22 bp, Homo sapiens
taatttctggagggagaaagag

SEQ ID NO: 6998814 - DNA, 22 bp, Homo sapiens
tgacatgtatgtatttgtttat

SEQ ID NO: 6998815 - DNA, 22 bp, Homo sapiens
ctctttggcccccgatgattca

SEQ ID NO: 6998816 - DNA, 22 bp, Homo sapiens
ctgaggtgctatggaggatacg

SEQ ID NO: 6998817 - DNA, 22 bp, Homo sapiens
gtttccagggctctcttcatga

SEQ ID NO: 6998818 - DNA, 22 bp, Homo sapiens
acatttgtgggggaacaggata

SEQ ID NO: 6998819 - DNA, 22 bp, Homo sapiens
ttccatcattaacaccacaagg

SEQ ID NO: 6998820 - DNA, 22 bp, Homo sapiens
attctacaacccaataataatt

SEQ ID NO: 6998821 - DNA, 22 bp, Homo sapiens
attaaagacagcagatggatgg

SEQ ID NO: 6998822 - DNA, 22 bp, Homo sapiens
aagttgagagaaagcccgtgtt

SEQ ID NO: 6998823 - DNA, 22 bp, Homo sapiens
aaggctgaattcaagggtaggc

SEQ ID NO: 6998824 - DNA, 22 bp, Homo sapiens
ggtcagaagtgcaaaatcagtt

SEQ ID NO: 6998825 - DNA, 22 bp, Homo sapiens
cccagcagcttgcacagtgctg

SEQ ID NO: 6998826 - DNA, 22 bp, Homo sapiens
actgtcactactatgtgtttgt

SEQ ID NO: 6998827 - DNA, 22 bp, Homo sapiens
gtggccagaagttaagtggtta

SEQ ID NO: 6998828 - DNA, 23 bp, Homo sapiens
gttttacaggtgagaaaatggag

SEQ ID NO: 6998829 - DNA, 22 bp, Homo sapiens
cagtagctaaattattttcatg

SEQ ID NO: 6998830 - DNA, 22 bp, Homo sapiens
ttgcttatgcctcttgacaaag

SEQ ID NO: 6998831 - DNA, 22 bp, Homo sapiens
atttacaggtagaattttaagt

SEQ ID NO: 6998832 - DNA, 22 bp, Homo sapiens
ctcgtatgtgacttaatttagt

SEQ ID NO: 6998833 - DNA, 22 bp, Homo sapiens
tcagtagttcagcaaatatttt

SEQ ID NO: 6998834 - DNA, 22 bp, Homo sapiens
ggccacttggcagatggcagct

SEQ ID NO: 6998835 - DNA, 22 bp, Homo sapiens
aagttacatattcttgggctat

SEQ ID NO: 6998836 - DNA, 20 bp, Homo sapiens
agcaattgtgaacttattca

SEQ ID NO: 6998837 - DNA, 22 bp, Homo sapiens
aagcccagatgagatccctgga

SEQ ID NO: 6998838 - DNA, 22 bp, Homo sapiens
caggctggagtgcagtggcgct

SEQ ID NO: 6998839 - DNA, 22 bp, Homo sapiens
agggagctttaccccagatcac

SEQ ID NO: 6998840 - DNA, 19 bp, Homo sapiens
tgagctggctgagcctctc

SEQ ID NO: 6998841 - DNA, 21 bp, Homo sapiens
cagagagctagaacttcatga

SEQ ID NO: 6998842 - DNA, 22 bp, Homo sapiens
acatgaatatatgaagttcaac

SEQ ID NO: 6998843 - DNA, 22 bp, Homo sapiens
actcctggaaaagaacgcaggg

SEQ ID NO: 6998844 - DNA, 22 bp, Homo sapiens
ccttggggaatatccattcttc

SEQ ID NO: 6998845 - DNA, 22 bp, Homo sapiens
cctgtgttctaatccatctcag

SEQ ID NO: 6998846 - DNA, 22 bp, Homo sapiens
caggagctttcttcccaaactt

SEQ ID NO: 6998847 - DNA, 22 bp, Homo sapiens
tttttataccacctctcactta

SEQ ID NO: 6998848 - DNA, 22 bp, Homo sapiens
atctacaagaggttctcctctc

SEQ ID NO: 6998849 - DNA, 22 bp, Homo sapiens
attaagcattcagggctagaga

SEQ ID NO: 6998850 - DNA, 22 bp, Homo sapiens
ctggagggactttctcacggat

SEQ ID NO: 6998851 - DNA, 22 bp, Homo sapiens
ctcctcagtcaggtctagggtc

SEQ ID NO: 6998852 - DNA, 22 bp, Homo sapiens
agggtccacttggacattgatc

SEQ ID NO: 6998853 - DNA, 22 bp, Homo sapiens
ttgctagctggtgtatgcattg

SEQ ID NO: 6998854 - DNA, 22 bp, Homo sapiens
acagaattaaagtgtttgtgga

SEQ ID NO: 6998855 - DNA, 22 bp, Homo sapiens
ccctccatgacgtcttcagccg

SEQ ID NO: 6998856 - DNA, 22 bp, Homo sapiens
taaattgtggccatttgtgttt

SEQ ID NO: 6998857 - DNA, 22 bp, Homo sapiens
tctaaatgtggtagtcataaga

SEQ ID NO: 6998858 - DNA, 22 bp, Homo sapiens
gctgcagcccggcgcgcctgag

SEQ ID NO: 6998859 - DNA, 22 bp, Homo sapiens
ttcattagagattataaaatga

SEQ ID NO: 6998860 - DNA, 22 bp, Homo sapiens
ttcacttaacatttaccaagga

SEQ ID NO: 6998861 - DNA, 22 bp, Homo sapiens
tcttgcagaagaagctgccaag

SEQ ID NO: 6998862 - DNA, 22 bp, Homo sapiens
caggaggaaactggattcactt

SEQ ID NO: 6998863 - DNA, 22 bp, Homo sapiens
ctgcagttcttctcctcaaggc

SEQ ID NO: 6998864 - DNA, 22 bp, Homo sapiens
cagttgcctgtttccttgtgtg

SEQ ID NO: 6998865 - DNA, 22 bp, Homo sapiens
tggcagtggcactgcccccata

SEQ ID NO: 6998866 - DNA, 22 bp, Homo sapiens
ggccagctcttgtccacggagg

SEQ ID NO: 6998867 - DNA, 22 bp, Homo sapiens
aggctcatctgagcagaaacct

SEQ ID NO: 6998868 - DNA, 22 bp, Homo sapiens
agctttgggggtaggtatagag

SEQ ID NO: 6998869 - DNA, 22 bp, Homo sapiens
gaagcacatggctgtgagcaac

SEQ ID NO: 6998870 - DNA, 22 bp, Homo sapiens
tcagtgtcttgggcttgaatgc

SEQ ID NO: 6998871 - DNA, 22 bp, Homo sapiens
gctgaggtcaggagctgtgggg

SEQ ID NO: 6998872 - DNA, 21 bp, Homo sapiens
caagctgcctgagggtggttg

SEQ ID NO: 6998873 - DNA, 22 bp, Homo sapiens
agtcctggcatggaattgtccc

SEQ ID NO: 6998874 - DNA, 22 bp, Homo sapiens
acgctcctaataaatgtggttt

SEQ ID NO: 6998875 - DNA, 22 bp, Homo sapiens
tgcagagatcctggactgagcg

SEQ ID NO: 6998876 - DNA, 22 bp, Homo sapiens
agggtctgtgcaagaacacgcc

SEQ ID NO: 6998877 - DNA, 22 bp, Homo sapiens
cgtagtatgatttctgagctcc

SEQ ID NO: 6998878 - DNA, 22 bp, Homo sapiens
aggtcttggtaggccagagtct

SEQ ID NO: 6998879 - DNA, 22 bp, Homo sapiens
atgtatcaactgcaggcaagtt

SEQ ID NO: 6998880 - DNA, 22 bp, Homo sapiens
ttacttaaacagaaatgcagaa

SEQ ID NO: 6998881 - DNA, 22 bp, Homo sapiens
atggctgttgtgaggatcaaat

SEQ ID NO: 6998882 - DNA, 22 bp, Homo sapiens
ccctagtccacaggttcctgga

SEQ ID NO: 6998883 - DNA, 23 bp, Homo sapiens
aagtgctaagtactgtaatcatc

SEQ ID NO: 6998884 - DNA, 22 bp, Homo sapiens
cctctgagttggcctgtcttgt

SEQ ID NO: 6998885 - DNA, 22 bp, Homo sapiens
aagctgcaaaaaatttctgtct

SEQ ID NO: 6998886 - DNA, 22 bp, Homo sapiens
taacctgaggagaacagtgctt

SEQ ID NO: 6998887 - DNA, 22 bp, Homo sapiens
agctcctcctgtgccaggccag

SEQ ID NO: 6998888 - DNA, 22 bp, Homo sapiens
actggctctctacatttgccag

SEQ ID NO: 6998889 - DNA, 22 bp, Homo sapiens
tttcaaatagaatctttccaaa

SEQ ID NO: 6998890 - DNA, 21 bp, Homo sapiens
agtgtagttctagtttttaac

SEQ ID NO: 6998891 - DNA, 22 bp, Homo sapiens
tggcatttagaaaacaacatgt

SEQ ID NO: 6998892 - DNA, 22 bp, Homo sapiens
aaggggtcaagcggcagctaca

SEQ ID NO: 6998893 - DNA, 22 bp, Homo sapiens
agaacagcagttatggttcatt

SEQ ID NO: 6998894 - DNA, 22 bp, Homo sapiens
aactttcagcaagtaattctgg

SEQ ID NO: 6998895 - DNA, 22 bp, Homo sapiens
tagagaaaaccactggtgagct

SEQ ID NO: 6998896 - DNA, 22 bp, Homo sapiens
aacctggctcatgcagaaccct

SEQ ID NO: 6998897 - DNA, 22 bp, Homo sapiens
gaactctgggcaagccaagggc

SEQ ID NO: 6998898 - DNA, 22 bp, Homo sapiens
gctcaggatcccaggggtgtgc

SEQ ID NO: 6998899 - DNA, 22 bp, Homo sapiens
tatctagatttctttctctgtg

SEQ ID NO: 6998900 - DNA, 22 bp, Homo sapiens
gctgcaggcggccgtggtggcg

SEQ ID NO: 6998901 - DNA, 22 bp, Homo sapiens
aaacattctcagccctgcttgc

SEQ ID NO: 6998902 - DNA, 22 bp, Homo sapiens
tagatgaattagcaattatctt

SEQ ID NO: 6998903 - DNA, 22 bp, Homo sapiens
aattagagtagagcctaagaat

SEQ ID NO: 6998904 - DNA, 22 bp, Homo sapiens
tacacccacattgagcatggga

SEQ ID NO: 6998905 - DNA, 22 bp, Homo sapiens
gcttatgttttgccattgaaga

SEQ ID NO: 6998906 - DNA, 22 bp, Homo sapiens
tcagagggcttatgatatattg

SEQ ID NO: 6998907 - DNA, 22 bp, Homo sapiens
agggtcctaagcctcagataag

SEQ ID NO: 6998908 - DNA, 22 bp, Homo sapiens
aagataatgttctagctgtcag

SEQ ID NO: 6998909 - DNA, 21 bp, Homo sapiens
gcagccaggactttgggctgg

SEQ ID NO: 6998910 - DNA, 22 bp, Homo sapiens
aaaatgaataagttaacccagg

SEQ ID NO: 6998911 - DNA, 22 bp, Homo sapiens
tcatggctaaccaaggcctgat

SEQ ID NO: 6998912 - DNA, 22 bp, Homo sapiens
tttaaggattgtccatagtgtt

SEQ ID NO: 6998913 - DNA, 22 bp, Homo sapiens
actcttatgggaacaaggatta

SEQ ID NO: 6998914 - DNA, 22 bp, Homo sapiens
tgtatggcttggaaatagttta

SEQ ID NO: 6998915 - DNA, 22 bp, Homo sapiens
tagcagggagggccagtgtcaa

SEQ ID NO: 6998916 - DNA, 22 bp, Homo sapiens
atcatctgggttaatgtgctca

SEQ ID NO: 6998917 - DNA, 22 bp, Homo sapiens
ctgtgcttagccatcacattca

SEQ ID NO: 6998918 - DNA, 22 bp, Homo sapiens
acatggataaattttactttcc

SEQ ID NO: 6998919 - DNA, 22 bp, Homo sapiens
gactacaggtgtgtgccaccat

SEQ ID NO: 6998920 - DNA, 21 bp, Homo sapiens
tcttcctgacatatgcaaggc

SEQ ID NO: 6998921 - DNA, 22 bp, Homo sapiens
acatgattggactccttcccct

SEQ ID NO: 6998922 - DNA, 22 bp, Homo sapiens
gccaccccaacctccctaagtt

SEQ ID NO: 6998923 - DNA, 22 bp, Homo sapiens
tgcacagtgaccactgagcaag

SEQ ID NO: 6998924 - DNA, 23 bp, Homo sapiens
tttgtacagaattttgccttcag

SEQ ID NO: 6998925 - DNA, 22 bp, Homo sapiens
tatgtgagtctaattgtgtagt

SEQ ID NO: 6998926 - DNA, 22 bp, Homo sapiens
agctgcagattctatctagaag

SEQ ID NO: 6998927 - DNA, 22 bp, Homo sapiens
aaagggccaatggagagtgtgg

SEQ ID NO: 6998928 - DNA, 22 bp, Homo sapiens
catggtgtgaatgagcggataa

SEQ ID NO: 6998929 - DNA, 22 bp, Homo sapiens
tgacaggaggcttgaggccagg

SEQ ID NO: 6998930 - DNA, 22 bp, Homo sapiens
caggagcccagagtcctcagct

SEQ ID NO: 6998931 - DNA, 20 bp, Homo sapiens
gcatggaaacaaaggttgca

SEQ ID NO: 6998932 - DNA, 22 bp, Homo sapiens
catggctgaggcagaggactga

SEQ ID NO: 6998933 - DNA, 22 bp, Homo sapiens
gtctagaaatgccatacgtgcc

SEQ ID NO: 6998934 - DNA, 22 bp, Homo sapiens
ttctccagtcactgacttcgag

SEQ ID NO: 6998935 - DNA, 22 bp, Homo sapiens
gaagacacctactgtcatttct

SEQ ID NO: 6998936 - DNA, 22 bp, Homo sapiens
agactgtgagggagatacaggg

SEQ ID NO: 6998937 - DNA, 22 bp, Homo sapiens
cagcagatgccaagttgtagtc

SEQ ID NO: 6998938 - DNA, 23 bp, Homo sapiens
gcaggaactcagggtaggcagca

SEQ ID NO: 6998939 - DNA, 19 bp, Homo sapiens
aggctgcctcaccctccct

SEQ ID NO: 6998940 - DNA, 22 bp, Homo sapiens
cagtatttaggattaggagaga

SEQ ID NO: 6998941 - DNA, 22 bp, Homo sapiens
aggtcctgtttcttccctgggg

SEQ ID NO: 6998942 - DNA, 22 bp, Homo sapiens
attgtacagctctgagaggggg

SEQ ID NO: 6998943 - DNA, 18 bp, Homo sapiens
cctcacagacttccatgt

SEQ ID NO: 6998944 - DNA, 22 bp, Homo sapiens
aggaatgtaatagtgtggctca

SEQ ID NO: 6998945 - DNA, 22 bp, Homo sapiens
gaggcagctgggtccggtcggg

SEQ ID NO: 6998946 - DNA, 22 bp, Homo sapiens
gatgaagctatttggttggcac

SEQ ID NO: 6998947 - DNA, 22 bp, Homo sapiens
tgactgcccccaccgcacaggc

SEQ ID NO: 6998948 - DNA, 23 bp, Homo sapiens
tctcctggctgcactgtggccac

SEQ ID NO: 6998949 - DNA, 22 bp, Homo sapiens
gtctgggcttagggacatggca

SEQ ID NO: 6998950 - DNA, 22 bp, Homo sapiens
ctgctactcgttgcattccggt

SEQ ID NO: 6998951 - DNA, 22 bp, Homo sapiens
taacaagatgtcactcctgtcc

SEQ ID NO: 6998952 - DNA, 22 bp, Homo sapiens
tggtctgaactaagacagtagt

SEQ ID NO: 6998953 - DNA, 22 bp, Homo sapiens
tcacagaaggagggaagctagt

SEQ ID NO: 6998954 - DNA, 22 bp, Homo sapiens
agaagtataactatttgctttc

SEQ ID NO: 6998955 - DNA, 22 bp, Homo sapiens
gaagtgttgtatctttttaata

SEQ ID NO: 6998956 - DNA, 22 bp, Homo sapiens
attacccagtctgtggtattct

SEQ ID NO: 6998957 - DNA, 22 bp, Homo sapiens
cagccagcttcagatccaagcc

SEQ ID NO: 6998958 - DNA, 22 bp, Homo sapiens
agacatttattcacacatttat

SEQ ID NO: 6998959 - DNA, 22 bp, Homo sapiens
attctgcaactgttgttggtgg

SEQ ID NO: 6998960 - DNA, 22 bp, Homo sapiens
tagggctataagagaataagac

SEQ ID NO: 6998961 - DNA, 22 bp, Homo sapiens
gacaccagagactgatgaggcc

SEQ ID NO: 6998962 - DNA, 22 bp, Homo sapiens
agggatcagcagagggtgtggt

SEQ ID NO: 6998963 - DNA, 22 bp, Homo sapiens
aaatagcattgtatttagctga

SEQ ID NO: 6998964 - DNA, 22 bp, Homo sapiens
aggaatgtgaaacaggtggctg

SEQ ID NO: 6998965 - DNA, 22 bp, Homo sapiens
aaaacagttataaacagagtca

SEQ ID NO: 6998966 - DNA, 22 bp, Homo sapiens
atggcatttatgttgacaatgg

SEQ ID NO: 6998967 - DNA, 22 bp, Homo sapiens
aaagcagtgctgtgagaacact

SEQ ID NO: 6998968 - DNA, 23 bp, Homo sapiens
cagtggagactcatgcttcctta

SEQ ID NO: 6998969 - DNA, 20 bp, Homo sapiens
ggatttacaggggaaaagtg

SEQ ID NO: 6998970 - DNA, 22 bp, Homo sapiens
ttctgccttcagtcctctgact

SEQ ID NO: 6998971 - DNA, 22 bp, Homo sapiens
catgtgtcctagctattctcct

SEQ ID NO: 6998972 - DNA, 22 bp, Homo sapiens
actgggcaccatcatgagatag

SEQ ID NO: 6998973 - DNA, 21 bp, Homo sapiens
tacagcaacggaggttttcta

SEQ ID NO: 6998974 - DNA, 22 bp, Homo sapiens
agagggcagtctcagattggga

SEQ ID NO: 6998975 - DNA, 22 bp, Homo sapiens
ttggatcagatgatatctttgt

SEQ ID NO: 6998976 - DNA, 22 bp, Homo sapiens
cacagaatggaccagttttaga

SEQ ID NO: 6998977 - DNA, 20 bp, Homo sapiens
ccagaagagatgatcatcca

SEQ ID NO: 6998978 - DNA, 22 bp, Homo sapiens
tgttgtaatcattttatgaaaa

SEQ ID NO: 6998979 - DNA, 22 bp, Homo sapiens
tgggccttctcaatgcactgga

SEQ ID NO: 6998980 - DNA, 22 bp, Homo sapiens
gtgaccagagcgggagattggg

SEQ ID NO: 6998981 - DNA, 22 bp, Homo sapiens
atccaaacctggacatgagtgg

SEQ ID NO: 6998982 - DNA, 22 bp, Homo sapiens
ggcagagcattcgatggacctg

SEQ ID NO: 6998983 - DNA, 22 bp, Homo sapiens
atttagtgtgtattgctattat

SEQ ID NO: 6998984 - DNA, 22 bp, Homo sapiens
tcaggagtaagttataagtatt

SEQ ID NO: 6998985 - DNA, 22 bp, Homo sapiens
cagtgtcaccaggcgagtctcc

SEQ ID NO: 6998986 - DNA, 22 bp, Homo sapiens
actgtcatgatcgaagatgtca

SEQ ID NO: 6998987 - DNA, 22 bp, Homo sapiens
gcaggtgaatgatggactagga

SEQ ID NO: 6998988 - DNA, 22 bp, Homo sapiens
aagggctctgtgcttgtcccat

SEQ ID NO: 6998989 - DNA, 22 bp, Homo sapiens
tactgtctttaggggtagaaat

SEQ ID NO: 6998990 - DNA, 22 bp, Homo sapiens
tcctgggcccaggctgccaggg

SEQ ID NO: 6998991 - DNA, 22 bp, Homo sapiens
tgaaggtgggaattcaccaggt

SEQ ID NO: 6998992 - DNA, 22 bp, Homo sapiens
gagctctttcagttgactccta

SEQ ID NO: 6998993 - DNA, 22 bp, Homo sapiens
gagaagctctagaggtgttttt

SEQ ID NO: 6998994 - DNA, 22 bp, Homo sapiens
cttgcagcatccggtcctctct

SEQ ID NO: 6998995 - DNA, 22 bp, Homo sapiens
gactgtggcagaaatgttgttg

SEQ ID NO: 6998996 - DNA, 22 bp, Homo sapiens
tctgcccacagcctcctgtcca

SEQ ID NO: 6998997 - DNA, 22 bp, Homo sapiens
ttcgtgtggagatgtttctgca

SEQ ID NO: 6998998 - DNA, 22 bp, Homo sapiens
taacttgagctctcagtgctat

SEQ ID NO: 6998999 - DNA, 22 bp, Homo sapiens
gtgaacttccagatgataaaca

SEQ ID NO: 6999000 - DNA, 22 bp, Homo sapiens
cactaaaactacattggaaaca

SEQ ID NO: 6999001 - DNA, 22 bp, Homo sapiens
tacacagatttaaaagcaggga

SEQ ID NO: 6999002 - DNA, 22 bp, Homo sapiens
gcagctgctggaagttcctgcc

SEQ ID NO: 6999003 - DNA, 22 bp, Homo sapiens
atttctggattttggatgctgc

SEQ ID NO: 6999004 - DNA, 22 bp, Homo sapiens
agactcttggagaagagctata

SEQ ID NO: 6999005 - DNA, 22 bp, Homo sapiens
ccagaccctttcttggcatgtg

SEQ ID NO: 6999006 - DNA, 22 bp, Homo sapiens
gcgaccagggaagcttcttcat

SEQ ID NO: 6999007 - DNA, 22 bp, Homo sapiens
gcttagtggtgtgcaaaggggt

SEQ ID NO: 6999008 - DNA, 22 bp, Homo sapiens
agaggattttaacttatgcaac

SEQ ID NO: 6999009 - DNA, 23 bp, Homo sapiens
acaaccagcactggagggcacca

SEQ ID NO: 6999010 - DNA, 23 bp, Homo sapiens
tacctgaagtaagcattcatcca

SEQ ID NO: 6999011 - DNA, 22 bp, Homo sapiens
agaggtgggagcctggtcacat

SEQ ID NO: 6999012 - DNA, 22 bp, Homo sapiens
acccagggagtgctcctgttct

SEQ ID NO: 6999013 - DNA, 22 bp, Homo sapiens
tgttgatttgtgggctgcaaaa

SEQ ID NO: 6999014 - DNA, 22 bp, Homo sapiens
ttctgcttttattgccagagtt

SEQ ID NO: 6999015 - DNA, 22 bp, Homo sapiens
gctggattggagcaatagagtc

SEQ ID NO: 6999016 - DNA, 22 bp, Homo sapiens
acccgtcagaatggctgttatt

SEQ ID NO: 6999017 - DNA, 22 bp, Homo sapiens
ctgcagttctcaatttctattg

SEQ ID NO: 6999018 - DNA, 22 bp, Homo sapiens
gaaggcatttaggaactgcaat

SEQ ID NO: 6999019 - DNA, 20 bp, Homo sapiens
cactggacctctctgagcct

SEQ ID NO: 6999020 - DNA, 22 bp, Homo sapiens
ttggacacactgattggccagg

SEQ ID NO: 6999021 - DNA, 22 bp, Homo sapiens
agtccaaaacactgattttcta

SEQ ID NO: 6999022 - DNA, 22 bp, Homo sapiens
cttgaaagtcacatgcagccct

SEQ ID NO: 6999023 - DNA, 22 bp, Homo sapiens
gatgacttatgtttacaaatgt

SEQ ID NO: 6999024 - DNA, 22 bp, Homo sapiens
actgtaaagaagtaagtatggg

SEQ ID NO: 6999025 - DNA, 22 bp, Homo sapiens
gctgaatacagcatgccttatg

SEQ ID NO: 6999026 - DNA, 22 bp, Homo sapiens
acctcctccaaggagccatagg

SEQ ID NO: 6999027 - DNA, 22 bp, Homo sapiens
tttgattctcaattgccctctg

SEQ ID NO: 6999028 - DNA, 22 bp, Homo sapiens
atgaaatgtatgagtctgggtt

SEQ ID NO: 6999029 - DNA, 22 bp, Homo sapiens
tgcatctgcctggagtagcgcc

SEQ ID NO: 6999030 - DNA, 22 bp, Homo sapiens
gtccagcaggatgcaagtgcca

SEQ ID NO: 6999031 - DNA, 22 bp, Homo sapiens
catcagttttagaggggtgaaa

SEQ ID NO: 6999032 - DNA, 22 bp, Homo sapiens
atcagagaaatggagggcgctt

SEQ ID NO: 6999033 - DNA, 22 bp, Homo sapiens
aacatatttggctgatattccc

SEQ ID NO: 6999034 - DNA, 22 bp, Homo sapiens
gtcccctcattttagagaaaga

SEQ ID NO: 6999035 - DNA, 22 bp, Homo sapiens
tgaggcaggatgcttgcacagg

SEQ ID NO: 6999036 - DNA, 22 bp, Homo sapiens
tattgacagatgcattatgttg

SEQ ID NO: 6999037 - DNA, 22 bp, Homo sapiens
cttgttttcttctgcagtctat

SEQ ID NO: 6999038 - DNA, 22 bp, Homo sapiens
tcatttcagttcagaggccttt

SEQ ID NO: 6999039 - DNA, 23 bp, Homo sapiens
tgtctttgttaggactgtgttta

SEQ ID NO: 6999040 - DNA, 22 bp, Homo sapiens
accttttcatctgaaactttta

SEQ ID NO: 6999041 - DNA, 22 bp, Homo sapiens
ttgctaatgccctagaagtatt

SEQ ID NO: 6999042 - DNA, 22 bp, Homo sapiens
aggcatccatggtggtcgctga

SEQ ID NO: 6999043 - DNA, 21 bp, Homo sapiens
atgtgcagcaagcagcatgct

SEQ ID NO: 6999044 - DNA, 22 bp, Homo sapiens
agctggcagtcatcctagtgag

SEQ ID NO: 6999045 - DNA, 22 bp, Homo sapiens
atatacgtatattccaaagggt

SEQ ID NO: 6999046 - DNA, 22 bp, Homo sapiens
agcttcctgatgcaagagggct

SEQ ID NO: 6999047 - DNA, 21 bp, Homo sapiens
cttaacattttaaatgaaagg

SEQ ID NO: 6999048 - DNA, 22 bp, Homo sapiens
ctgtcactctggcaacccagta

SEQ ID NO: 6999049 - DNA, 22 bp, Homo sapiens
tagcatttattccagatttgga

SEQ ID NO: 6999050 - DNA, 22 bp, Homo sapiens
gttcttcagttcaggctgttca

SEQ ID NO: 6999051 - DNA, 22 bp, Homo sapiens
ccctggcagtgctcctttagac

SEQ ID NO: 6999052 - DNA, 22 bp, Homo sapiens
acagctgatcattttgaagaat

SEQ ID NO: 6999053 - DNA, 22 bp, Homo sapiens
ggcatttactagagccacattt

SEQ ID NO: 6999054 - DNA, 16 bp, Homo sapiens
cccactgtctggtctt

SEQ ID NO: 6999055 - DNA, 22 bp, Homo sapiens
gaaagttacagaaaccattagt

SEQ ID NO: 6999056 - DNA, 22 bp, Homo sapiens
gcgagaaactaagtgccctttg

SEQ ID NO: 6999057 - DNA, 22 bp, Homo sapiens
gacactctttcctcttctggaa

SEQ ID NO: 6999058 - DNA, 22 bp, Homo sapiens
ccaaggcagaagatggctcttg

SEQ ID NO: 6999059 - DNA, 22 bp, Homo sapiens
atcattaaatataagcttcaca

SEQ ID NO: 6999060 - DNA, 22 bp, Homo sapiens
aagctgccaatggtaagctgct

SEQ ID NO: 6999061 - DNA, 22 bp, Homo sapiens
ctccgcagcgggccaatccgga

SEQ ID NO: 6999062 - DNA, 22 bp, Homo sapiens
tggcaatgtggcatcaacgaag

SEQ ID NO: 6999063 - DNA, 22 bp, Homo sapiens
gacaactgatgtgcttgtggga

SEQ ID NO: 6999064 - DNA, 23 bp, Homo sapiens
tgtgccaagcttagaaagaacct

SEQ ID NO: 6999065 - DNA, 22 bp, Homo sapiens
cttatacagatcaagggaaaag

SEQ ID NO: 6999066 - DNA, 22 bp, Homo sapiens
catcactgtccaaagttcagtt

SEQ ID NO: 6999067 - DNA, 22 bp, Homo sapiens
gtcataaagcttgttgcattta

SEQ ID NO: 6999068 - DNA, 22 bp, Homo sapiens
tccatagaatgcagtgtaaatt

SEQ ID NO: 6999069 - DNA, 21 bp, Homo sapiens
atgtctgttctgattggtgcg

SEQ ID NO: 6999070 - DNA, 22 bp, Homo sapiens
tcctggtttatagactgatggc

SEQ ID NO: 6999071 - DNA, 22 bp, Homo sapiens
agataatggagggatttgcatt

SEQ ID NO: 6999072 - DNA, 22 bp, Homo sapiens
ggctctgcttcctggaattgtg

SEQ ID NO: 6999073 - DNA, 22 bp, Homo sapiens
cctgcctggatcagccatcctg

SEQ ID NO: 6999074 - DNA, 22 bp, Homo sapiens
ctcagaaacggagctgccattt

SEQ ID NO: 6999075 - DNA, 22 bp, Homo sapiens
atggccctatcacctttgcttc

SEQ ID NO: 6999076 - DNA, 20 bp, Homo sapiens
ggtgtgttggttcagcatgg

SEQ ID NO: 6999077 - DNA, 22 bp, Homo sapiens
catgacaaataaacctttgcca

SEQ ID NO: 6999078 - DNA, 22 bp, Homo sapiens
gcctttggctctgtctgacctg

SEQ ID NO: 6999079 - DNA, 22 bp, Homo sapiens
tacaggaactgggcaggacatt

SEQ ID NO: 6999080 - DNA, 22 bp, Homo sapiens
ttgattcagaaaaagatggaga

SEQ ID NO: 6999081 - DNA, 22 bp, Homo sapiens
gcctgcagctgcttccacacac

SEQ ID NO: 6999082 - DNA, 22 bp, Homo sapiens
tctctggcagacacctccctga

SEQ ID NO: 6999083 - DNA, 22 bp, Homo sapiens
tatgagttgtggcttagtcaca

SEQ ID NO: 6999084 - DNA, 22 bp, Homo sapiens
gccacagcccgagcaccatgag

SEQ ID NO: 6999085 - DNA, 21 bp, Homo sapiens
agcagcttgagtctggagctc

SEQ ID NO: 6999086 - DNA, 22 bp, Homo sapiens
ttagcaaaaatatctcatatta

SEQ ID NO: 6999087 - DNA, 19 bp, Homo sapiens
gggaaattcacttgcttcc

SEQ ID NO: 6999088 - DNA, 22 bp, Homo sapiens
gtgtcattaaccaccatgcaaa

SEQ ID NO: 6999089 - DNA, 22 bp, Homo sapiens
tgttcctgtactgctgtggctt

SEQ ID NO: 6999090 - DNA, 20 bp, Homo sapiens
cagggcctaagagctgaaaa

SEQ ID NO: 6999091 - DNA, 22 bp, Homo sapiens
cactgagccttgccagcttggt

SEQ ID NO: 6999092 - DNA, 22 bp, Homo sapiens
ctgtatgaggatcagactggac

SEQ ID NO: 6999093 - DNA, 21 bp, Homo sapiens
tccaccctctctgctcccagt

SEQ ID NO: 6999094 - DNA, 22 bp, Homo sapiens
gacagtcctgcaggttgaactc

SEQ ID NO: 6999095 - DNA, 22 bp, Homo sapiens
agtgtctttgtcaaattacagg

SEQ ID NO: 6999096 - DNA, 20 bp, Homo sapiens
tcacaggagggaaggcaggt

SEQ ID NO: 6999097 - DNA, 22 bp, Homo sapiens
agtggccctggagtgactcgta

SEQ ID NO: 6999098 - DNA, 22 bp, Homo sapiens
tggagctggaatttgagctgga

SEQ ID NO: 6999099 - DNA, 22 bp, Homo sapiens
acagcgagaatgtaaggagccc

SEQ ID NO: 6999100 - DNA, 22 bp, Homo sapiens
atgtaacttctgtgaatctgac

SEQ ID NO: 6999101 - DNA, 22 bp, Homo sapiens
cttgggtcaatcttgggtgtag

SEQ ID NO: 6999102 - DNA, 22 bp, Homo sapiens
acccaggacatgggcacccgtg

SEQ ID NO: 6999103 - DNA, 22 bp, Homo sapiens
cgctgggcgcgctccgaacccg

SEQ ID NO: 6999104 - DNA, 22 bp, Homo sapiens
gagctgagaagcagcgcttgat

SEQ ID NO: 6999105 - DNA, 22 bp, Homo sapiens
catgcaggcgcaacttctacaa

SEQ ID NO: 6999106 - DNA, 22 bp, Homo sapiens
caagctggaggttggagctact

SEQ ID NO: 6999107 - DNA, 22 bp, Homo sapiens
tgccaggcaactgcccagccat

SEQ ID NO: 6999108 - DNA, 22 bp, Homo sapiens
gggcagctctcacagcagccaa

SEQ ID NO: 6999109 - DNA, 22 bp, Homo sapiens
gtatgcaattcttaacatacac

SEQ ID NO: 6999110 - DNA, 22 bp, Homo sapiens
tagccaatctccagcataaatc

SEQ ID NO: 6999111 - DNA, 22 bp, Homo sapiens
tgccctttatttctggggcaga

SEQ ID NO: 6999112 - DNA, 22 bp, Homo sapiens
tgttcattactgctgtttgcca

SEQ ID NO: 6999113 - DNA, 22 bp, Homo sapiens
tggcatgtttaatgtactgtat

SEQ ID NO: 6999114 - DNA, 22 bp, Homo sapiens
ttcccaggactctgggtgtctt

SEQ ID NO: 6999115 - DNA, 22 bp, Homo sapiens
cagggcctgagggctgctctgc

SEQ ID NO: 6999116 - DNA, 22 bp, Homo sapiens
tcctctgacaccttgtgcagtg

SEQ ID NO: 6999117 - DNA, 22 bp, Homo sapiens
aggggctttggtgctggtcctg

SEQ ID NO: 6999118 - DNA, 22 bp, Homo sapiens
actaaatagcctctggtagttg

SEQ ID NO: 6999119 - DNA, 22 bp, Homo sapiens
aagtcaattagtaaacttggaa

SEQ ID NO: 6999120 - DNA, 22 bp, Homo sapiens
gtctacttttgtcatcattgca

SEQ ID NO: 6999121 - DNA, 22 bp, Homo sapiens
taaggcagtgagaagaaacagg

SEQ ID NO: 6999122 - DNA, 22 bp, Homo sapiens
gaagtctctctgggctcagttc

SEQ ID NO: 6999123 - DNA, 22 bp, Homo sapiens
gcacaggctctcttggggacac

SEQ ID NO: 6999124 - DNA, 22 bp, Homo sapiens
tcggggatggtgtctgagggag

SEQ ID NO: 6999125 - DNA, 22 bp, Homo sapiens
tgggtggaataaatcagttctg

SEQ ID NO: 6999126 - DNA, 22 bp, Homo sapiens
tgattcctgtgcttattccagt

SEQ ID NO: 6999127 - DNA, 22 bp, Homo sapiens
ctggagtcttaggttatggtga

SEQ ID NO: 6999128 - DNA, 22 bp, Homo sapiens
tggtggaaggcagagctacacc

SEQ ID NO: 6999129 - DNA, 19 bp, Homo sapiens
tcacaggcatctccccaga

SEQ ID NO: 6999130 - DNA, 22 bp, Homo sapiens
gatacaaattcatgtctgaatt

SEQ ID NO: 6999131 - DNA, 22 bp, Homo sapiens
cattcaaaggcatgtcctattt

SEQ ID NO: 6999132 - DNA, 22 bp, Homo sapiens
cagctaaggctccttctaggta

SEQ ID NO: 6999133 - DNA, 22 bp, Homo sapiens
caccttactccctctggatgcc

SEQ ID NO: 6999134 - DNA, 22 bp, Homo sapiens
taccacaggccaaatttgaggt

SEQ ID NO: 6999135 - DNA, 22 bp, Homo sapiens
tctgggaatgaggcccagcgat

SEQ ID NO: 6999136 - DNA, 22 bp, Homo sapiens
aggtatttgtctcagattgggt

SEQ ID NO: 6999137 - DNA, 22 bp, Homo sapiens
cctgccagtcactatgtcacct

SEQ ID NO: 6999138 - DNA, 22 bp, Homo sapiens
taatgcagtaggtattaaagaa

SEQ ID NO: 6999139 - DNA, 22 bp, Homo sapiens
atactgttggctttggtgatgg

SEQ ID NO: 6999140 - DNA, 22 bp, Homo sapiens
aagttccttagccttagggctt

SEQ ID NO: 6999141 - DNA, 22 bp, Homo sapiens
ttgttacagcagcaatagaaaa

SEQ ID NO: 6999142 - DNA, 22 bp, Homo sapiens
ctactagtggtctctttctgtg

SEQ ID NO: 6999143 - DNA, 22 bp, Homo sapiens
attatggctttcatgggcaata

SEQ ID NO: 6999144 - DNA, 23 bp, Homo sapiens
atccatgtgagaatagactagca

SEQ ID NO: 6999145 - DNA, 22 bp, Homo sapiens
agtgccctttacaacttcttga

SEQ ID NO: 6999146 - DNA, 19 bp, Homo sapiens
ggtcaggaatttgacaata

SEQ ID NO: 6999147 - DNA, 22 bp, Homo sapiens
tattgacatttttatagcttga

SEQ ID NO: 6999148 - DNA, 22 bp, Homo sapiens
gaatgtgtcaccctgtcccatg

SEQ ID NO: 6999149 - DNA, 22 bp, Homo sapiens
ctcaacatgcctactcagtctg

SEQ ID NO: 6999150 - DNA, 22 bp, Homo sapiens
ctgccgggccctggatttggca

SEQ ID NO: 6999151 - DNA, 17 bp, Homo sapiens
aagacagaagccatgag

SEQ ID NO: 6999152 - DNA, 22 bp, Homo sapiens
cacaggagattgatctattggt

SEQ ID NO: 6999153 - DNA, 18 bp, Homo sapiens
ctgccccttctctgagat

SEQ ID NO: 6999154 - DNA, 22 bp, Homo sapiens
tctgagtgggaactctcatgac

SEQ ID NO: 6999155 - DNA, 22 bp, Homo sapiens
gcaagaacaggtgcttggcaag

SEQ ID NO: 6999156 - DNA, 22 bp, Homo sapiens
gacaagactggtttatttaagg

SEQ ID NO: 6999157 - DNA, 22 bp, Homo sapiens
atagtacatgggtgtcctcaca

SEQ ID NO: 6999158 - DNA, 22 bp, Homo sapiens
ttccaatgacatttgttttaaa

SEQ ID NO: 6999159 - DNA, 22 bp, Homo sapiens
tctactctactgtctgtgccta

SEQ ID NO: 6999160 - DNA, 22 bp, Homo sapiens
aggctctgcagtgctggaggac

SEQ ID NO: 6999161 - DNA, 22 bp, Homo sapiens
ggaaaaggccacagggacacat

SEQ ID NO: 6999162 - DNA, 22 bp, Homo sapiens
agagcccatcagtggcagtgga

SEQ ID NO: 6999163 - DNA, 17 bp, Homo sapiens
gctctgccccagcctct

SEQ ID NO: 6999164 - DNA, 23 bp, Homo sapiens
tgaatgatggtgctcctcatctt

SEQ ID NO: 6999165 - DNA, 22 bp, Homo sapiens
tattgtgagtataactgcattt

SEQ ID NO: 6999166 - DNA, 22 bp, Homo sapiens
aatggcactttataaatgttaa

SEQ ID NO: 6999167 - DNA, 22 bp, Homo sapiens
ctgggaggcagaggttgcagtg

SEQ ID NO: 6999168 - DNA, 18 bp, Homo sapiens
ttcagcagcagacacact

SEQ ID NO: 6999169 - DNA, 22 bp, Homo sapiens
taggcagtagcttgagatataa

SEQ ID NO: 6999170 - DNA, 22 bp, Homo sapiens
atggagacattacactaagtga

SEQ ID NO: 6999171 - DNA, 17 bp, Homo sapiens
cctgtgtttgctccttc

SEQ ID NO: 6999172 - DNA, 22 bp, Homo sapiens
gcagctccttcaatctcaccat

SEQ ID NO: 6999173 - DNA, 22 bp, Homo sapiens
atgtctttggctttgacatggc

SEQ ID NO: 6999174 - DNA, 22 bp, Homo sapiens
gcagaggagcaagctggacacc

SEQ ID NO: 6999175 - DNA, 18 bp, Homo sapiens
cctctgcctttgtagagc

SEQ ID NO: 6999176 - DNA, 22 bp, Homo sapiens
ttgtacaagtattatgtgaaca

SEQ ID NO: 6999177 - DNA, 22 bp, Homo sapiens
tctgcacccttctgggttggaa

SEQ ID NO: 6999178 - DNA, 22 bp, Homo sapiens
ctgcagggcttaccttgctctg

SEQ ID NO: 6999179 - DNA, 20 bp, Homo sapiens
ttatgcaagcatcaatattg

SEQ ID NO: 6999180 - DNA, 22 bp, Homo sapiens
aatcacaaacgaattgatggaa

SEQ ID NO: 6999181 - DNA, 22 bp, Homo sapiens
tttcattgcagagtctgtgtgc

SEQ ID NO: 6999182 - DNA, 22 bp, Homo sapiens
aaggtgtcggcagagccgcttc

SEQ ID NO: 6999183 - DNA, 22 bp, Homo sapiens
cagatcctttatagcagtgtcc

SEQ ID NO: 6999184 - DNA, 22 bp, Homo sapiens
gctgcctccaatctgtgccccg

SEQ ID NO: 6999185 - DNA, 22 bp, Homo sapiens
atgcaaaagactatttgttgct

SEQ ID NO: 6999186 - DNA, 22 bp, Homo sapiens
atggtacaaaatgtataaagtc

SEQ ID NO: 6999187 - DNA, 22 bp, Homo sapiens
gcagtggctaggagtctggcgt

SEQ ID NO: 6999188 - DNA, 22 bp, Homo sapiens
aagatcagaactttatacagga

SEQ ID NO: 6999189 - DNA, 22 bp, Homo sapiens
gctcctgtcagtcatcaggtgc

SEQ ID NO: 6999190 - DNA, 22 bp, Homo sapiens
tagtgcttaacacaaagtgatt

SEQ ID NO: 6999191 - DNA, 22 bp, Homo sapiens
gggtggaaagtatttggggacc

SEQ ID NO: 6999192 - DNA, 22 bp, Homo sapiens
tggcatgataggaggtgcagaa

SEQ ID NO: 6999193 - DNA, 22 bp, Homo sapiens
tgacatttttataagagtcaaa

SEQ ID NO: 6999194 - DNA, 22 bp, Homo sapiens
tccctcctggccgtcaccgctg

SEQ ID NO: 6999195 - DNA, 22 bp, Homo sapiens
ttgcaacattgtaagtttatat

SEQ ID NO: 6999196 - DNA, 22 bp, Homo sapiens
tgctgcatttgcagtcctttaa

SEQ ID NO: 6999197 - DNA, 22 bp, Homo sapiens
aaagcaatgggtctaaggtaaa

SEQ ID NO: 6999198 - DNA, 22 bp, Homo sapiens
tattcctggtccctaccacaga

SEQ ID NO: 6999199 - DNA, 22 bp, Homo sapiens
tggggacacagaggttcgttgg

SEQ ID NO: 6999200 - DNA, 22 bp, Homo sapiens
gcagggctgagtcatgtgtgcc

SEQ ID NO: 6999201 - DNA, 22 bp, Homo sapiens
caggttctggagatgcagagat

SEQ ID NO: 6999202 - DNA, 22 bp, Homo sapiens
tgaagagtcatttcattcccag

SEQ ID NO: 6999203 - DNA, 17 bp, Homo sapiens
ctgaggggagtgctgtg

SEQ ID NO: 6999204 - DNA, 22 bp, Homo sapiens
cactgtaagatgagctttttta

SEQ ID NO: 6999205 - DNA, 22 bp, Homo sapiens
tagacacatcttcatccacaat

SEQ ID NO: 6999206 - DNA, 22 bp, Homo sapiens
actccagggctgaacgaggccc

SEQ ID NO: 6999207 - DNA, 22 bp, Homo sapiens
tgcagtttcctttctagtcttt

SEQ ID NO: 6999208 - DNA, 22 bp, Homo sapiens
cagtgcacacaatcctctgccg

SEQ ID NO: 6999209 - DNA, 22 bp, Homo sapiens
gtctgtctccctgtgactgaga

SEQ ID NO: 6999210 - DNA, 22 bp, Homo sapiens
atttgcacatagtattatcttt

SEQ ID NO: 6999211 - DNA, 22 bp, Homo sapiens
cctctcccctcccaaggcggga

SEQ ID NO: 6999212 - DNA, 22 bp, Homo sapiens
tgtttagaggaacaacagactt

SEQ ID NO: 6999213 - DNA, 22 bp, Homo sapiens
gaggcactgaccattttcatat

SEQ ID NO: 6999214 - DNA, 22 bp, Homo sapiens
cccaggaggcagagcttgcagt

SEQ ID NO: 6999215 - DNA, 22 bp, Homo sapiens
tgagcacagctcgcaccagctt

SEQ ID NO: 6999216 - DNA, 22 bp, Homo sapiens
gcacttgtcaaatattatagta

SEQ ID NO: 6999217 - DNA, 19 bp, Homo sapiens
gaagaagttggaggatctc

SEQ ID NO: 6999218 - DNA, 23 bp, Homo sapiens
tgacaaagtcatctctccttctt

SEQ ID NO: 6999219 - DNA, 22 bp, Homo sapiens
acatgcaggaaaatgcacagat

SEQ ID NO: 6999220 - DNA, 22 bp, Homo sapiens
gattagctaaactctcaggttc

SEQ ID NO: 6999221 - DNA, 22 bp, Homo sapiens
tctgtgtttgccatccttgctc

SEQ ID NO: 6999222 - DNA, 22 bp, Homo sapiens
aagaccagggtgggtacgttcc

SEQ ID NO: 6999223 - DNA, 22 bp, Homo sapiens
aaggcccaggggctctagggca

SEQ ID NO: 6999224 - DNA, 22 bp, Homo sapiens
tgtttcatgtggacatagttgt

SEQ ID NO: 6999225 - DNA, 22 bp, Homo sapiens
gatagagaaacacagataaatg

SEQ ID NO: 6999226 - DNA, 22 bp, Homo sapiens
gctgagacttccactgccatct

SEQ ID NO: 6999227 - DNA, 22 bp, Homo sapiens
tgacagaaagagtattaaagat

SEQ ID NO: 6999228 - DNA, 22 bp, Homo sapiens
ctctgagagagctggtgagcac

SEQ ID NO: 6999229 - DNA, 22 bp, Homo sapiens
cagcccagtaccaagcagttgg

SEQ ID NO: 6999230 - DNA, 22 bp, Homo sapiens
tgtggagatgtgagcaagggga

SEQ ID NO: 6999231 - DNA, 22 bp, Homo sapiens
agctgtggcagcagccgtggca

SEQ ID NO: 6999232 - DNA, 22 bp, Homo sapiens
cactggaagagcatctgagcca

SEQ ID NO: 6999233 - DNA, 22 bp, Homo sapiens
agctcaatttaaggcttggctt

SEQ ID NO: 6999234 - DNA, 22 bp, Homo sapiens
ccattctgagtcttatgtcttt

SEQ ID NO: 6999235 - DNA, 22 bp, Homo sapiens
tcaggatggcacccaagctctt

SEQ ID NO: 6999236 - DNA, 20 bp, Homo sapiens
tcctccttgcagagcccaga

SEQ ID NO: 6999237 - DNA, 22 bp, Homo sapiens
aacttccaccaaatagtatata

SEQ ID NO: 6999238 - DNA, 22 bp, Homo sapiens
tcacatgccctgtatttaccag

SEQ ID NO: 6999239 - DNA, 22 bp, Homo sapiens
tggccctgacacgtggtactgg

SEQ ID NO: 6999240 - DNA, 22 bp, Homo sapiens
tttctagaagatggctaataag

SEQ ID NO: 6999241 - DNA, 22 bp, Homo sapiens
atacccagccccagctgcagga

SEQ ID NO: 6999242 - DNA, 22 bp, Homo sapiens
gtggaacatgtccatatacatt

SEQ ID NO: 6999243 - DNA, 22 bp, Homo sapiens
ttcgttttctaggaccaacaga

SEQ ID NO: 6999244 - DNA, 22 bp, Homo sapiens
atggtttgtaacccaatactcc

SEQ ID NO: 6999245 - DNA, 22 bp, Homo sapiens
taatgcacagaattgacatggg

SEQ ID NO: 6999246 - DNA, 22 bp, Homo sapiens
gaatccagggttgtttgagcta

SEQ ID NO: 6999247 - DNA, 22 bp, Homo sapiens
caggatgcagtgggacccaggg

SEQ ID NO: 6999248 - DNA, 22 bp, Homo sapiens
acttttgtggagtctgcggagc

SEQ ID NO: 6999249 - DNA, 22 bp, Homo sapiens
ttgtgcatctcatggtgggcca

SEQ ID NO: 6999250 - DNA, 22 bp, Homo sapiens
cctgcgtccacggctgggagac

SEQ ID NO: 6999251 - DNA, 22 bp, Homo sapiens
ggcagctcgatgacttctgcat

SEQ ID NO: 6999252 - DNA, 22 bp, Homo sapiens
tgagctccggcatatggaatta

SEQ ID NO: 6999253 - DNA, 22 bp, Homo sapiens
tcattgcagaaataaaggtgaa

SEQ ID NO: 6999254 - DNA, 22 bp, Homo sapiens
aagctcttttcaccattaaagt

SEQ ID NO: 6999255 - DNA, 22 bp, Homo sapiens
atgtccctcactcctcattcag

SEQ ID NO: 6999256 - DNA, 22 bp, Homo sapiens
tagtttcatctccaccctgccc

SEQ ID NO: 6999257 - DNA, 22 bp, Homo sapiens
ttgcagcatattgatctcctgt

SEQ ID NO: 6999258 - DNA, 22 bp, Homo sapiens
atgtttcccataagattttctg

SEQ ID NO: 6999259 - DNA, 22 bp, Homo sapiens
tatgtcatgtcttagagaatga

SEQ ID NO: 6999260 - DNA, 22 bp, Homo sapiens
ttcaacagcttccaaagtgtgt

SEQ ID NO: 6999261 - DNA, 22 bp, Homo sapiens
cagcagtcttcccttccttttt

SEQ ID NO: 6999262 - DNA, 22 bp, Homo sapiens
tttctgttgttggtgtctggct

SEQ ID NO: 6999263 - DNA, 22 bp, Homo sapiens
ttcacatttctctgctgtttga

SEQ ID NO: 6999264 - DNA, 22 bp, Homo sapiens
gcagctttctgggacagaaagg

SEQ ID NO: 6999265 - DNA, 22 bp, Homo sapiens
ttctctagtgcaaattgtttga

SEQ ID NO: 6999266 - DNA, 22 bp, Homo sapiens
ctattattatcctaatttctgt

SEQ ID NO: 6999267 - DNA, 22 bp, Homo sapiens
aggctctggtgcagctgtaact

SEQ ID NO: 6999268 - DNA, 22 bp, Homo sapiens
aggaattaataaccagtaagcc

SEQ ID NO: 6999269 - DNA, 22 bp, Homo sapiens
tcagctttctatgttgctaaac

SEQ ID NO: 6999270 - DNA, 23 bp, Homo sapiens
agcccttgataataaagcaccag

SEQ ID NO: 6999271 - DNA, 22 bp, Homo sapiens
aaggtcaacactgattttagtc

SEQ ID NO: 6999272 - DNA, 22 bp, Homo sapiens
ggctgagcaattttgatgacat

SEQ ID NO: 6999273 - DNA, 22 bp, Homo sapiens
catgtcttaattggagcccaga

SEQ ID NO: 6999274 - DNA, 22 bp, Homo sapiens
cctggagttttttggttgactc

SEQ ID NO: 6999275 - DNA, 22 bp, Homo sapiens
ttcaccagaggttagaatattt

SEQ ID NO: 6999276 - DNA, 22 bp, Homo sapiens
tcaggcttgtctctagagcaat

SEQ ID NO: 6999277 - DNA, 20 bp, Homo sapiens
tgtaacaatctggatgttgc

SEQ ID NO: 6999278 - DNA, 20 bp, Homo sapiens
aatgaggcaatggagggcat

SEQ ID NO: 6999279 - DNA, 22 bp, Homo sapiens
aaagccatgggtctttggcata

SEQ ID NO: 6999280 - DNA, 22 bp, Homo sapiens
tgtgtcttggccaccttgggaa

SEQ ID NO: 6999281 - DNA, 22 bp, Homo sapiens
ccccaccagcaccctctctatc

SEQ ID NO: 6999282 - DNA, 22 bp, Homo sapiens
gattttcattatagctagtttc

SEQ ID NO: 6999283 - DNA, 22 bp, Homo sapiens
agggatggaagctcgtctgcaa

SEQ ID NO: 6999284 - DNA, 22 bp, Homo sapiens
tctctgtctgcacccaatcaat

SEQ ID NO: 6999285 - DNA, 22 bp, Homo sapiens
gtatgagaatcagacacatatt

SEQ ID NO: 6999286 - DNA, 22 bp, Homo sapiens
acaatgagtttgatgtagtttg

SEQ ID NO: 6999287 - DNA, 22 bp, Homo sapiens
gatatatttggaccagagcatt

SEQ ID NO: 6999288 - DNA, 22 bp, Homo sapiens
gcacaatttgactctattcata

SEQ ID NO: 6999289 - DNA, 22 bp, Homo sapiens
tgatgctgtcaaggaggtgaac

SEQ ID NO: 6999290 - DNA, 22 bp, Homo sapiens
tgcagaaacaagccatcattca

SEQ ID NO: 6999291 - DNA, 21 bp, Homo sapiens
agtgccagtaggtatggagga

SEQ ID NO: 6999292 - DNA, 22 bp, Homo sapiens
aagtgtttaaattatttgcagg

SEQ ID NO: 6999293 - DNA, 22 bp, Homo sapiens
gtgtacatattgagtctgctga

SEQ ID NO: 6999294 - DNA, 22 bp, Homo sapiens
ttcatcaggcatcatgctcaag

SEQ ID NO: 6999295 - DNA, 22 bp, Homo sapiens
tctgttttggtcacctttatat

SEQ ID NO: 6999296 - DNA, 22 bp, Homo sapiens
cagtgagggcattcagtgctgg

SEQ ID NO: 6999297 - DNA, 20 bp, Homo sapiens
tacagcctattcaccacata

SEQ ID NO: 6999298 - DNA, 22 bp, Homo sapiens
tgccaccctgagctaaatgacc

SEQ ID NO: 6999299 - DNA, 22 bp, Homo sapiens
ggcattatctgagcacgtaata

SEQ ID NO: 6999300 - DNA, 22 bp, Homo sapiens
atgaacatctctgatccaagca

SEQ ID NO: 6999301 - DNA, 22 bp, Homo sapiens
tgtcacacttggtggttttggt

SEQ ID NO: 6999302 - DNA, 22 bp, Homo sapiens
gcacggctaatttttgtatttt

SEQ ID NO: 6999303 - DNA, 22 bp, Homo sapiens
agtgtttatttacagatggttt

SEQ ID NO: 6999304 - DNA, 22 bp, Homo sapiens
agagaattaacattccatggct

SEQ ID NO: 6999305 - DNA, 22 bp, Homo sapiens
ttacactttggcaagctattaa

SEQ ID NO: 6999306 - DNA, 22 bp, Homo sapiens
tctcgggtcatgatttccatca

SEQ ID NO: 6999307 - DNA, 18 bp, Homo sapiens
gagcagcaggatcaagaa

SEQ ID NO: 6999308 - DNA, 22 bp, Homo sapiens
cggtcagctgcgcccggcctga

SEQ ID NO: 6999309 - DNA, 22 bp, Homo sapiens
taggaaatttatagaggtgttt

SEQ ID NO: 6999310 - DNA, 22 bp, Homo sapiens
aacttgtgggctcaagcaattt

SEQ ID NO: 6999311 - DNA, 22 bp, Homo sapiens
cagcccatctagctttagagat

SEQ ID NO: 6999312 - DNA, 23 bp, Homo sapiens
tcattgtacatgttccagtggat

SEQ ID NO: 6999313 - DNA, 22 bp, Homo sapiens
ctggctgattttctcacttctc

SEQ ID NO: 6999314 - DNA, 22 bp, Homo sapiens
tcatgggaacaccagtattctc

SEQ ID NO: 6999315 - DNA, 22 bp, Homo sapiens
ggctgccctagagctggcaagg

SEQ ID NO: 6999316 - DNA, 22 bp, Homo sapiens
tcagccctgggacccagggatg

SEQ ID NO: 6999317 - DNA, 22 bp, Homo sapiens
acagtgaaaagaatattagaat

SEQ ID NO: 6999318 - DNA, 22 bp, Homo sapiens
ttccaactttgaaaatgttatg

SEQ ID NO: 6999319 - DNA, 22 bp, Homo sapiens
atggcaaaaactgcagttacct

SEQ ID NO: 6999320 - DNA, 22 bp, Homo sapiens
cttttctgtatcaaaaggatta

SEQ ID NO: 6999321 - DNA, 22 bp, Homo sapiens
cctgagttcttatttccagtca

SEQ ID NO: 6999322 - DNA, 22 bp, Homo sapiens
gcccagctgagaagcgcggggc

SEQ ID NO: 6999323 - DNA, 22 bp, Homo sapiens
tggtgagatgtatggagggttg

SEQ ID NO: 6999324 - DNA, 22 bp, Homo sapiens
cctgtgtccttggcagatatcc

SEQ ID NO: 6999325 - DNA, 22 bp, Homo sapiens
atacacttccaaatattgatta

SEQ ID NO: 6999326 - DNA, 21 bp, Homo sapiens
ggacttacataggtaaggggt

SEQ ID NO: 6999327 - DNA, 22 bp, Homo sapiens
ggtgagtgcctggcctggccac

SEQ ID NO: 6999328 - DNA, 22 bp, Homo sapiens
acatttaatgatcctactgtga

SEQ ID NO: 6999329 - DNA, 23 bp, Homo sapiens
tgattacaggaagttcaagtgtt

SEQ ID NO: 6999330 - DNA, 20 bp, Homo sapiens
gtgcaatggctcagtctcag

SEQ ID NO: 6999331 - DNA, 22 bp, Homo sapiens
gctgcccagttctgctgctgcc

SEQ ID NO: 6999332 - DNA, 22 bp, Homo sapiens
tctgggagtaaggcctaggcat

SEQ ID NO: 6999333 - DNA, 22 bp, Homo sapiens
gaggctgtaacttgggcactgg

SEQ ID NO: 6999334 - DNA, 22 bp, Homo sapiens
tgtgtacattgccttttaaagg

SEQ ID NO: 6999335 - DNA, 22 bp, Homo sapiens
tgatgctgttccagttatattg

SEQ ID NO: 6999336 - DNA, 22 bp, Homo sapiens
cctttatgtttctgcagccccc

SEQ ID NO: 6999337 - DNA, 22 bp, Homo sapiens
tgcagcacctatggacacttgt

SEQ ID NO: 6999338 - DNA, 22 bp, Homo sapiens
gctgtggctgtacagagaccat

SEQ ID NO: 6999339 - DNA, 22 bp, Homo sapiens
caggcagagaggagcatttaat

SEQ ID NO: 6999340 - DNA, 20 bp, Homo sapiens
gctgttgccagtacagatgg

SEQ ID NO: 6999341 - DNA, 22 bp, Homo sapiens
ttctgagaaatgggttcacata

SEQ ID NO: 6999342 - DNA, 22 bp, Homo sapiens
gtgtgggcagggccgtgctccc

SEQ ID NO: 6999343 - DNA, 22 bp, Homo sapiens
cttagcttttccagcttctaga

SEQ ID NO: 6999344 - DNA, 22 bp, Homo sapiens
tatctacagttaatatgtcatc

SEQ ID NO: 6999345 - DNA, 20 bp, Homo sapiens
tcacaactccatcatttccc

SEQ ID NO: 6999346 - DNA, 22 bp, Homo sapiens
tataggattggttcccatttta

SEQ ID NO: 6999347 - DNA, 22 bp, Homo sapiens
cttgggtgttttaaaactagat

SEQ ID NO: 6999348 - DNA, 22 bp, Homo sapiens
aacccttaagcaaactcattta

SEQ ID NO: 6999349 - DNA, 22 bp, Homo sapiens
catgtctgtgtacacatgcaca

SEQ ID NO: 6999350 - DNA, 22 bp, Homo sapiens
gaggtggctgtcagcttcactt

SEQ ID NO: 6999351 - DNA, 22 bp, Homo sapiens
tatcactacacctggctaatta

SEQ ID NO: 6999352 - DNA, 22 bp, Homo sapiens
cccagagaggtaaaacagcctt

SEQ ID NO: 6999353 - DNA, 19 bp, Homo sapiens
gcaggataggctgagacta

SEQ ID NO: 6999354 - DNA, 22 bp, Homo sapiens
tcccaagagctctgggataagg

SEQ ID NO: 6999355 - DNA, 22 bp, Homo sapiens
gcaatgattgcattagaagatg

SEQ ID NO: 6999356 - DNA, 21 bp, Homo sapiens
cattacatggttttagtgaac

SEQ ID NO: 6999357 - DNA, 22 bp, Homo sapiens
tattgtatcttctgtttagaag

SEQ ID NO: 6999358 - DNA, 19 bp, Homo sapiens
tgagtgggcccctgcagac

SEQ ID NO: 6999359 - DNA, 22 bp, Homo sapiens
tgcactagccacatttcaaatg

SEQ ID NO: 6999360 - DNA, 22 bp, Homo sapiens
cctgccaggacattgcttgaag

SEQ ID NO: 6999361 - DNA, 22 bp, Homo sapiens
ttattgctttggaaaacactca

SEQ ID NO: 6999362 - DNA, 22 bp, Homo sapiens
tgctggaggcctgactgtgttt

SEQ ID NO: 6999363 - DNA, 22 bp, Homo sapiens
cagaagcagattctaaagcaag

SEQ ID NO: 6999364 - DNA, 22 bp, Homo sapiens
gctcccagcattgctgctgaat

SEQ ID NO: 6999365 - DNA, 20 bp, Homo sapiens
ttacagtgggaccttcctga

SEQ ID NO: 6999366 - DNA, 22 bp, Homo sapiens
tgcatttgcaatgggtacacaa

SEQ ID NO: 6999367 - DNA, 22 bp, Homo sapiens
aagtccaccagtcagactagga

SEQ ID NO: 6999368 - DNA, 22 bp, Homo sapiens
tgcctcagctgaggccgctcca

SEQ ID NO: 6999369 - DNA, 22 bp, Homo sapiens
ctccctggtgactcccaaagct

SEQ ID NO: 6999370 - DNA, 20 bp, Homo sapiens
tgcagtgtggaagactgaga

SEQ ID NO: 6999371 - DNA, 22 bp, Homo sapiens
atcatccagtttttcagcctct

SEQ ID NO: 6999372 - DNA, 22 bp, Homo sapiens
cacaggaaagtcagccagaaga

SEQ ID NO: 6999373 - DNA, 22 bp, Homo sapiens
tatacagctatggcaagacaaa

SEQ ID NO: 6999374 - DNA, 22 bp, Homo sapiens
ttgcgagcacagagcaggaccg

SEQ ID NO: 6999375 - DNA, 15 bp, Homo sapiens
ctgaactctaaacca

SEQ ID NO: 6999376 - DNA, 22 bp, Homo sapiens
gcagttaaaaataaaccttcat

SEQ ID NO: 6999377 - DNA, 22 bp, Homo sapiens
ggcctctgtttggagccaggat

SEQ ID NO: 6999378 - DNA, 22 bp, Homo sapiens
tgaagaagccaattggtaggct

SEQ ID NO: 6999379 - DNA, 22 bp, Homo sapiens
taatgcacgttaacatttgaga

SEQ ID NO: 6999380 - DNA, 22 bp, Homo sapiens
cttacaggaaagaagaaagcat

SEQ ID NO: 6999381 - DNA, 22 bp, Homo sapiens
tggaggccaaggcaggcggatc

SEQ ID NO: 6999382 - DNA, 22 bp, Homo sapiens
aagtcaagataaaggtgctggc

SEQ ID NO: 6999383 - DNA, 22 bp, Homo sapiens
aggctcagacaggaaaagtaac

SEQ ID NO: 6999384 - DNA, 21 bp, Homo sapiens
cattgcagttttctctaagtt

SEQ ID NO: 6999385 - DNA, 22 bp, Homo sapiens
catgctctgcagcagacctgtg

SEQ ID NO: 6999386 - DNA, 22 bp, Homo sapiens
tttcatgtacttttttgataga

SEQ ID NO: 6999387 - DNA, 22 bp, Homo sapiens
gttggggaaggtgggagaatgt

SEQ ID NO: 6999388 - DNA, 22 bp, Homo sapiens
atgctgatgtcagccccatctc

SEQ ID NO: 6999389 - DNA, 22 bp, Homo sapiens
tgaacattcctgaatgaagcat

SEQ ID NO: 6999390 - DNA, 22 bp, Homo sapiens
ctggaaggctctgctgcctgtc

SEQ ID NO: 6999391 - DNA, 22 bp, Homo sapiens
aggatgggtcagctagagtcca

SEQ ID NO: 6999392 - DNA, 22 bp, Homo sapiens
tcaagcttgtcataaacagctc

SEQ ID NO: 6999393 - DNA, 22 bp, Homo sapiens
acaatgtagaggctgaaagcaa

SEQ ID NO: 6999394 - DNA, 22 bp, Homo sapiens
gacattaatttctttggtaatt

SEQ ID NO: 6999395 - DNA, 22 bp, Homo sapiens
tgagtctcaactgggaattgat

SEQ ID NO: 6999396 - DNA, 22 bp, Homo sapiens
ctgacagatctggatctgaact

SEQ ID NO: 6999397 - DNA, 19 bp, Homo sapiens
ctatacagcctctgaggaa

SEQ ID NO: 6999398 - DNA, 22 bp, Homo sapiens
ggctggactctgggcctctcca

SEQ ID NO: 6999399 - DNA, 22 bp, Homo sapiens
tacttctagcctgccccttgtg

SEQ ID NO: 6999400 - DNA, 22 bp, Homo sapiens
ggcagctagagctctttaaagt

SEQ ID NO: 6999401 - DNA, 22 bp, Homo sapiens
tagcccttttctgagcccacat

SEQ ID NO: 6999402 - DNA, 22 bp, Homo sapiens
tccatgtgacggtggcagtttt

SEQ ID NO: 6999403 - DNA, 22 bp, Homo sapiens
agcatagcttagctgtggaggc

SEQ ID NO: 6999404 - DNA, 22 bp, Homo sapiens
agggctcctgaggcccttctgg

SEQ ID NO: 6999405 - DNA, 22 bp, Homo sapiens
tctgtgtcagcagcactcagcc

SEQ ID NO: 6999406 - DNA, 22 bp, Homo sapiens
tttagcaaaaaagctctgcgta

SEQ ID NO: 6999407 - DNA, 22 bp, Homo sapiens
caggtctcttttgtcacaccac

SEQ ID NO: 6999408 - DNA, 22 bp, Homo sapiens
ctggccttggaagggagcccgt

SEQ ID NO: 6999409 - DNA, 22 bp, Homo sapiens
tctattagaatgttctttttca

SEQ ID NO: 6999410 - DNA, 22 bp, Homo sapiens
ctgagagtgcttgaaaggccag

SEQ ID NO: 6999411 - DNA, 22 bp, Homo sapiens
gcccagaaagactgcctaacag

SEQ ID NO: 6999412 - DNA, 22 bp, Homo sapiens
aactctcattttaggtgtaagg

SEQ ID NO: 6999413 - DNA, 22 bp, Homo sapiens
gccctgagaagaagtcggaggg

SEQ ID NO: 6999414 - DNA, 22 bp, Homo sapiens
tctgtggaccagggtataagga

SEQ ID NO: 6999415 - DNA, 21 bp, Homo sapiens
agcttttctgttttatatcta

SEQ ID NO: 6999416 - DNA, 22 bp, Homo sapiens
ttgagatattcagttccattga

SEQ ID NO: 6999417 - DNA, 22 bp, Homo sapiens
ttatgcaaaggggcctcttcct

SEQ ID NO: 6999418 - DNA, 18 bp, Homo sapiens
gtcaggcatgaatctggg

SEQ ID NO: 6999419 - DNA, 22 bp, Homo sapiens
tagctacatacttggccattct

SEQ ID NO: 6999420 - DNA, 22 bp, Homo sapiens
ggcaaagcggccctgtggccag

SEQ ID NO: 6999421 - DNA, 22 bp, Homo sapiens
tagctgtcagcaatcaagtggt

SEQ ID NO: 6999422 - DNA, 22 bp, Homo sapiens
ttggccttgtacatcatattaa

SEQ ID NO: 6999423 - DNA, 22 bp, Homo sapiens
gagctgagatcgtgccattgca

SEQ ID NO: 6999424 - DNA, 22 bp, Homo sapiens
ataacttaatgggtcatgctct

SEQ ID NO: 6999425 - DNA, 22 bp, Homo sapiens
aaaagtgttcaggaagaataat

SEQ ID NO: 6999426 - DNA, 22 bp, Homo sapiens
tactaacaatgagaacaagcca

SEQ ID NO: 6999427 - DNA, 22 bp, Homo sapiens
taatctactgtttatatgaaat

SEQ ID NO: 6999428 - DNA, 22 bp, Homo sapiens
agtcatctcaacagcttgccca

SEQ ID NO: 6999429 - DNA, 22 bp, Homo sapiens
tgaagtttttccagacaagtcc

SEQ ID NO: 6999430 - DNA, 22 bp, Homo sapiens
tgcaggctgctcaagacttagt

SEQ ID NO: 6999431 - DNA, 22 bp, Homo sapiens
gctgacaatgagaaagagcaaa

SEQ ID NO: 6999432 - DNA, 22 bp, Homo sapiens
gaactttgcaaatgtcagaagc

SEQ ID NO: 6999433 - DNA, 22 bp, Homo sapiens
taccttcaggctgccctttgat

SEQ ID NO: 6999434 - DNA, 22 bp, Homo sapiens
aagcttgggaaccacggtaatc

SEQ ID NO: 6999435 - DNA, 22 bp, Homo sapiens
aactttgtcttttatgcttaca

SEQ ID NO: 6999436 - DNA, 21 bp, Homo sapiens
aatgctgcccagtaagatggc

SEQ ID NO: 6999437 - DNA, 22 bp, Homo sapiens
ctgtttataaatagaggggagt

SEQ ID NO: 6999438 - DNA, 22 bp, Homo sapiens
ggctggagatatgtctggaaca

SEQ ID NO: 6999439 - DNA, 22 bp, Homo sapiens
tggggcatggatgataagctgg

SEQ ID NO: 6999440 - DNA, 22 bp, Homo sapiens
gcagtgatggggatctcactgg

SEQ ID NO: 6999441 - DNA, 22 bp, Homo sapiens
agactgtaattgacatgtcagc

SEQ ID NO: 6999442 - DNA, 22 bp, Homo sapiens
ggcccagctttcattccttgct

SEQ ID NO: 6999443 - DNA, 22 bp, Homo sapiens
ttcttgatgtaccaacttggga

SEQ ID NO: 6999444 - DNA, 22 bp, Homo sapiens
tatccgttgttaccagataaga

SEQ ID NO: 6999445 - DNA, 20 bp, Homo sapiens
tatgaagatatgtgaacagc

SEQ ID NO: 6999446 - DNA, 22 bp, Homo sapiens
cagaaggctttgtggagtagac

SEQ ID NO: 6999447 - DNA, 22 bp, Homo sapiens
gtgataaagacgtgtcataatt

SEQ ID NO: 6999448 - DNA, 22 bp, Homo sapiens
taaggcattatagagacagcct

SEQ ID NO: 6999449 - DNA, 22 bp, Homo sapiens
gagtttctaggatggaggtgag

SEQ ID NO: 6999450 - DNA, 22 bp, Homo sapiens
aatccaggtggcggaggttgtg

SEQ ID NO: 6999451 - DNA, 22 bp, Homo sapiens
atgaggcagctgacagctgttc

SEQ ID NO: 6999452 - DNA, 23 bp, Homo sapiens
acagcacccatgtcatctggctc

SEQ ID NO: 6999453 - DNA, 22 bp, Homo sapiens
tggaatgaaaagtacttcagaa

SEQ ID NO: 6999454 - DNA, 22 bp, Homo sapiens
gggatgatggaaaagtctgtta

SEQ ID NO: 6999455 - DNA, 22 bp, Homo sapiens
tgaggggtctaggctgcgcacc

SEQ ID NO: 6999456 - DNA, 22 bp, Homo sapiens
tacagggattcctgccgctcgc

SEQ ID NO: 6999457 - DNA, 22 bp, Homo sapiens
attcagcatgcaattaggtaat

SEQ ID NO: 6999458 - DNA, 22 bp, Homo sapiens
cagggacatgactggtctctgt

SEQ ID NO: 6999459 - DNA, 19 bp, Homo sapiens
agctttgccaaaaacttag

SEQ ID NO: 6999460 - DNA, 22 bp, Homo sapiens
aattatggtggatcccagtggg

SEQ ID NO: 6999461 - DNA, 22 bp, Homo sapiens
tcctggggaggtcgaggctgag

SEQ ID NO: 6999462 - DNA, 22 bp, Homo sapiens
accagggaccgccacactgcaa

SEQ ID NO: 6999463 - DNA, 21 bp, Homo sapiens
tcaggctaattccaaggtagg

SEQ ID NO: 6999464 - DNA, 22 bp, Homo sapiens
tatttgttccagagataaaaat

SEQ ID NO: 6999465 - DNA, 22 bp, Homo sapiens
tgtcatggactggatttctgct

SEQ ID NO: 6999466 - DNA, 22 bp, Homo sapiens
gaagcagccacggggagacaga

SEQ ID NO: 6999467 - DNA, 22 bp, Homo sapiens
taaattcccaactctgctcttc

SEQ ID NO: 6999468 - DNA, 22 bp, Homo sapiens
cctgcatttttcccactctgtc

SEQ ID NO: 6999469 - DNA, 22 bp, Homo sapiens
tttaaaatcagatgggagttgg

SEQ ID NO: 6999470 - DNA, 18 bp, Homo sapiens
tgggtggtttttctctcc

SEQ ID NO: 6999471 - DNA, 22 bp, Homo sapiens
cagccctgggtccctgccctgg

SEQ ID NO: 6999472 - DNA, 22 bp, Homo sapiens
tggaggacaggactggacagcc

SEQ ID NO: 6999473 - DNA, 22 bp, Homo sapiens
aggagccagaatccagactcgg

SEQ ID NO: 6999474 - DNA, 22 bp, Homo sapiens
ttggcagcattccagccaagca

SEQ ID NO: 6999475 - DNA, 22 bp, Homo sapiens
cagcctttagcattaattccaa

SEQ ID NO: 6999476 - DNA, 22 bp, Homo sapiens
ctgttgatctcagttagctaga

SEQ ID NO: 6999477 - DNA, 22 bp, Homo sapiens
agagtccatatattgatttgtt

SEQ ID NO: 6999478 - DNA, 22 bp, Homo sapiens
cctcatctgtcatcctagggaa

SEQ ID NO: 6999479 - DNA, 22 bp, Homo sapiens
aatctgttttctgcctctatga

SEQ ID NO: 6999480 - DNA, 22 bp, Homo sapiens
aggtcagaaaaggagagcattg

SEQ ID NO: 6999481 - DNA, 22 bp, Homo sapiens
acttagaattaaatatttttgg

SEQ ID NO: 6999482 - DNA, 22 bp, Homo sapiens
tctgcctgtggatacatgctct

SEQ ID NO: 6999483 - DNA, 22 bp, Homo sapiens
cccagggaagccatttctgact

SEQ ID NO: 6999484 - DNA, 22 bp, Homo sapiens
actgcaattatttgttcaccaa

SEQ ID NO: 6999485 - DNA, 22 bp, Homo sapiens
tttctaaggctaggtcttaagg

SEQ ID NO: 6999486 - DNA, 22 bp, Homo sapiens
cacagggccttgtgtgactgca

SEQ ID NO: 6999487 - DNA, 21 bp, Homo sapiens
ttcttagtaactatcttccac

SEQ ID NO: 6999488 - DNA, 22 bp, Homo sapiens
tcccttggtaattctgttcctt

SEQ ID NO: 6999489 - DNA, 21 bp, Homo sapiens
tggcatacagtggttttcccc

SEQ ID NO: 6999490 - DNA, 22 bp, Homo sapiens
tcgtggatcaccgcgtctgtgt

SEQ ID NO: 6999491 - DNA, 22 bp, Homo sapiens
gggaagtcctgaggtcaaataa

SEQ ID NO: 6999492 - DNA, 20 bp, Homo sapiens
atatttcaggtagtgtgccc

SEQ ID NO: 6999493 - DNA, 22 bp, Homo sapiens
cgctcagtagcttcctccacct

SEQ ID NO: 6999494 - DNA, 22 bp, Homo sapiens
attcttcatcactaccttgtga

SEQ ID NO: 6999495 - DNA, 22 bp, Homo sapiens
gggaacagagtgccagactgac

SEQ ID NO: 6999496 - DNA, 22 bp, Homo sapiens
taatttcaagtttagggctcta

SEQ ID NO: 6999497 - DNA, 22 bp, Homo sapiens
agtacagtgctcagtaatctaa

SEQ ID NO: 6999498 - DNA, 22 bp, Homo sapiens
tcaaacataggcacacattcag

SEQ ID NO: 6999499 - DNA, 22 bp, Homo sapiens
acagtctcttgcttgaatacta

SEQ ID NO: 6999500 - DNA, 22 bp, Homo sapiens
tctatttcgcatataagttttg

SEQ ID NO: 6999501 - DNA, 22 bp, Homo sapiens
attgtatttccagcttgaatgt

SEQ ID NO: 6999502 - DNA, 22 bp, Homo sapiens
actgtgcaggtagatgcctggg

SEQ ID NO: 6999503 - DNA, 22 bp, Homo sapiens
gattatgagaataagggggtat

SEQ ID NO: 6999504 - DNA, 22 bp, Homo sapiens
aaagccttgggatttgtgatca

SEQ ID NO: 6999505 - DNA, 22 bp, Homo sapiens
tgcttgctggaggcagacagaa

SEQ ID NO: 6999506 - DNA, 22 bp, Homo sapiens
tatagcaaagtactaccaactc

SEQ ID NO: 6999507 - DNA, 22 bp, Homo sapiens
aacatctttgccaaattgctat

SEQ ID NO: 6999508 - DNA, 22 bp, Homo sapiens
atccagagtggccttctttcca

SEQ ID NO: 6999509 - DNA, 22 bp, Homo sapiens
gtggccaataggagcagctatc

SEQ ID NO: 6999510 - DNA, 22 bp, Homo sapiens
tagttctcaggacgtcaaggtt

SEQ ID NO: 6999511 - DNA, 22 bp, Homo sapiens
aaccaggaaaagttatgaatag

SEQ ID NO: 6999512 - DNA, 22 bp, Homo sapiens
attgttgacttgattactcaac

SEQ ID NO: 6999513 - DNA, 22 bp, Homo sapiens
accttaagatcaaacattcttt

SEQ ID NO: 6999514 - DNA, 22 bp, Homo sapiens
ttaacagctttgggtctgatat

SEQ ID NO: 6999515 - DNA, 22 bp, Homo sapiens
aacataatgtggccaaagtcac

SEQ ID NO: 6999516 - DNA, 22 bp, Homo sapiens
aatgctcaaaatgtttcatcta

SEQ ID NO: 6999517 - DNA, 22 bp, Homo sapiens
agccaggtaataaaggtcaaca

SEQ ID NO: 6999518 - DNA, 22 bp, Homo sapiens
tgaaagaagtgtcacattgcca

SEQ ID NO: 6999519 - DNA, 22 bp, Homo sapiens
gggagaaggagctagttcttga

SEQ ID NO: 6999520 - DNA, 22 bp, Homo sapiens
cattatgttcagaggtccataa

SEQ ID NO: 6999521 - DNA, 22 bp, Homo sapiens
agtttgaagattatgccagagt

SEQ ID NO: 6999522 - DNA, 22 bp, Homo sapiens
catccattaactcatttgtttc

SEQ ID NO: 6999523 - DNA, 22 bp, Homo sapiens
cctggccggtatcccacctcct

SEQ ID NO: 6999524 - DNA, 22 bp, Homo sapiens
acacttaacttctgagaataaa

SEQ ID NO: 6999525 - DNA, 22 bp, Homo sapiens
tgttctagcaacacagttttgg

SEQ ID NO: 6999526 - DNA, 22 bp, Homo sapiens
tgttttcctcctggtttctgcc

SEQ ID NO: 6999527 - DNA, 23 bp, Homo sapiens
cttttaactagagtatcagctgc

SEQ ID NO: 6999528 - DNA, 22 bp, Homo sapiens
tgttgggatcgaatggtggaac

SEQ ID NO: 6999529 - DNA, 22 bp, Homo sapiens
cttcttctggacaggcagctcc

SEQ ID NO: 6999530 - DNA, 18 bp, Homo sapiens
tggtggtgacagggtcat

SEQ ID NO: 6999531 - DNA, 22 bp, Homo sapiens
atttgtctgcttgctgccttcc

SEQ ID NO: 6999532 - DNA, 22 bp, Homo sapiens
atgtatgtctgcatacacatac

SEQ ID NO: 6999533 - DNA, 22 bp, Homo sapiens
tttcagacctggatgtgggggc

SEQ ID NO: 6999534 - DNA, 20 bp, Homo sapiens
ctgcaagcaggttattccag

SEQ ID NO: 6999535 - DNA, 22 bp, Homo sapiens
ctaaatcatcatttatgtttgt

SEQ ID NO: 6999536 - DNA, 17 bp, Homo sapiens
gctggtccttggtaact

SEQ ID NO: 6999537 - DNA, 22 bp, Homo sapiens
ttagaaccacctggagagcttt

SEQ ID NO: 6999538 - DNA, 22 bp, Homo sapiens
atctcagatctacagatctaca

SEQ ID NO: 6999539 - DNA, 22 bp, Homo sapiens
tcctgcacattagtatttttta

SEQ ID NO: 6999540 - DNA, 22 bp, Homo sapiens
gcatgggtaccccttctgtgca

SEQ ID NO: 6999541 - DNA, 19 bp, Homo sapiens
taagacagattcctagagt

SEQ ID NO: 6999542 - DNA, 22 bp, Homo sapiens
gtcagcaagatgaatcagcagg

SEQ ID NO: 6999543 - DNA, 20 bp, Homo sapiens
tgaaggccatttgttccaga

SEQ ID NO: 6999544 - DNA, 22 bp, Homo sapiens
agggaaataatctattctgagg

SEQ ID NO: 6999545 - DNA, 22 bp, Homo sapiens
ggaagtagaggtcattctgaat

SEQ ID NO: 6999546 - DNA, 22 bp, Homo sapiens
atgtgacagtgtttgacagatg

SEQ ID NO: 6999547 - DNA, 22 bp, Homo sapiens
attcactggcagacagaactca

SEQ ID NO: 6999548 - DNA, 22 bp, Homo sapiens
ctttgagtaataattctgcctt

SEQ ID NO: 6999549 - DNA, 22 bp, Homo sapiens
tgctggcctgtccacgggctgt

SEQ ID NO: 6999550 - DNA, 22 bp, Homo sapiens
gtatacatagatgatgaacaag

SEQ ID NO: 6999551 - DNA, 21 bp, Homo sapiens
ttccagttttaattaaattgt

SEQ ID NO: 6999552 - DNA, 22 bp, Homo sapiens
ctttgtgcaaaccctagaatca

SEQ ID NO: 6999553 - DNA, 20 bp, Homo sapiens
tttcagttatcttgaccttc

SEQ ID NO: 6999554 - DNA, 18 bp, Homo sapiens
cactggtttctgatgttt

SEQ ID NO: 6999555 - DNA, 22 bp, Homo sapiens
tggctgaattcatcaagaaaat

SEQ ID NO: 6999556 - DNA, 17 bp, Homo sapiens
tcctggctctgccactg

SEQ ID NO: 6999557 - DNA, 22 bp, Homo sapiens
tgcagttgaccatgctttatat

SEQ ID NO: 6999558 - DNA, 22 bp, Homo sapiens
acttctctcattcagacatagc

SEQ ID NO: 6999559 - DNA, 22 bp, Homo sapiens
ctacaagtcattccaggtactt

SEQ ID NO: 6999560 - DNA, 20 bp, Homo sapiens
tattgtgataggtgttaatc

SEQ ID NO: 6999561 - DNA, 22 bp, Homo sapiens
tcttataaaaggactcccattt

SEQ ID NO: 6999562 - DNA, 22 bp, Homo sapiens
agagctgtgaaaatgaggtttg

SEQ ID NO: 6999563 - DNA, 22 bp, Homo sapiens
aactagagcttccagcttcttg

SEQ ID NO: 6999564 - DNA, 22 bp, Homo sapiens
cattaatattgttcttctttag

SEQ ID NO: 6999565 - DNA, 22 bp, Homo sapiens
cctagggatgtgttagccagat

SEQ ID NO: 6999566 - DNA, 22 bp, Homo sapiens
gagtacccagatatctctgctc

SEQ ID NO: 6999567 - DNA, 22 bp, Homo sapiens
ttggaggaggcattggaggatt

SEQ ID NO: 6999568 - DNA, 22 bp, Homo sapiens
gctggcctctggagaagggctt

SEQ ID NO: 6999569 - DNA, 22 bp, Homo sapiens
cctctggcttactgttgggttt

SEQ ID NO: 6999570 - DNA, 22 bp, Homo sapiens
tccagccactcagcagggattg

SEQ ID NO: 6999571 - DNA, 22 bp, Homo sapiens
gagtccagctctgcctcttact

SEQ ID NO: 6999572 - DNA, 22 bp, Homo sapiens
cagttgcagctgtgacattgcg

SEQ ID NO: 6999573 - DNA, 22 bp, Homo sapiens
ctctgcctgtctcatcctgcaa

SEQ ID NO: 6999574 - DNA, 22 bp, Homo sapiens
aaggagtgcatgactcagagta

SEQ ID NO: 6999575 - DNA, 22 bp, Homo sapiens
atggaactgatcaggagtgcca

SEQ ID NO: 6999576 - DNA, 22 bp, Homo sapiens
ttccagttctggctttgccact

SEQ ID NO: 6999577 - DNA, 22 bp, Homo sapiens
tgagtactccctaggtgctgta

SEQ ID NO: 6999578 - DNA, 22 bp, Homo sapiens
cagctgtctcagggaggtgatc

SEQ ID NO: 6999579 - DNA, 22 bp, Homo sapiens
cagaggtcaggacttcattata

SEQ ID NO: 6999580 - DNA, 22 bp, Homo sapiens
gatggtgtcccaggctcaggct

SEQ ID NO: 6999581 - DNA, 22 bp, Homo sapiens
tgaacatattcacctctaaata

SEQ ID NO: 6999582 - DNA, 22 bp, Homo sapiens
accttttacggtgtgactagca

SEQ ID NO: 6999583 - DNA, 22 bp, Homo sapiens
aactgctaactggtttgatact

SEQ ID NO: 6999584 - DNA, 22 bp, Homo sapiens
ctcagtcagggagccttgaggg

SEQ ID NO: 6999585 - DNA, 18 bp, Homo sapiens
atgtatgtacatatttat

SEQ ID NO: 6999586 - DNA, 22 bp, Homo sapiens
gtcaccatggataagaatcact

SEQ ID NO: 6999587 - DNA, 22 bp, Homo sapiens
tgtgtataaacaagagtctgtg

SEQ ID NO: 6999588 - DNA, 22 bp, Homo sapiens
gccatgaggaactgtaagacaa

SEQ ID NO: 6999589 - DNA, 22 bp, Homo sapiens
tgcctcagtctaaagtctctca

SEQ ID NO: 6999590 - DNA, 22 bp, Homo sapiens
gttgtacaaaatatcagtgagg

SEQ ID NO: 6999591 - DNA, 22 bp, Homo sapiens
ggaggctctcctggccttgtct

SEQ ID NO: 6999592 - DNA, 22 bp, Homo sapiens
ctcggaggtttgttaagtggct

SEQ ID NO: 6999593 - DNA, 22 bp, Homo sapiens
tgaagacagttttactcatgag

SEQ ID NO: 6999594 - DNA, 22 bp, Homo sapiens
tgaaaatatagttttccagact

SEQ ID NO: 6999595 - DNA, 22 bp, Homo sapiens
atattatgtgactcttcaccag

SEQ ID NO: 6999596 - DNA, 22 bp, Homo sapiens
gaccttcaagcaccatatttat

SEQ ID NO: 6999597 - DNA, 22 bp, Homo sapiens
cgtagctcacgccccctctccc

SEQ ID NO: 6999598 - DNA, 22 bp, Homo sapiens
ttcacctgtgttttgtggctga

SEQ ID NO: 6999599 - DNA, 23 bp, Homo sapiens
tctgccctctgcctgtttttgta

SEQ ID NO: 6999600 - DNA, 21 bp, Homo sapiens
atgttggaatccaaaaacatt

SEQ ID NO: 6999601 - DNA, 22 bp, Homo sapiens
ttagcaaacccttgctggtgag

SEQ ID NO: 6999602 - DNA, 22 bp, Homo sapiens
gcaggcagatcacctgtcagga

SEQ ID NO: 6999603 - DNA, 22 bp, Homo sapiens
tgtgacttagggcaggtgagat

SEQ ID NO: 6999604 - DNA, 22 bp, Homo sapiens
gtggccgtgtaacttgagtaca

SEQ ID NO: 6999605 - DNA, 22 bp, Homo sapiens
tgatccttccccttgaggatgg

SEQ ID NO: 6999606 - DNA, 22 bp, Homo sapiens
tattatgattcggacgtggcag

SEQ ID NO: 6999607 - DNA, 21 bp, Homo sapiens
aggttattacaatttttctac

SEQ ID NO: 6999608 - DNA, 22 bp, Homo sapiens
gggtagccagacaaggggatgc

SEQ ID NO: 6999609 - DNA, 22 bp, Homo sapiens
gaaggtttgaaataggtataga

SEQ ID NO: 6999610 - DNA, 22 bp, Homo sapiens
tgccaggccaatgaaggcaggg

SEQ ID NO: 6999611 - DNA, 22 bp, Homo sapiens
cactgtaatagcattataagtg

SEQ ID NO: 6999612 - DNA, 22 bp, Homo sapiens
tgtcatgcttatgttacatact

SEQ ID NO: 6999613 - DNA, 22 bp, Homo sapiens
atctttaggaacctaacctatt

SEQ ID NO: 6999614 - DNA, 18 bp, Homo sapiens
gagctgggagaaggaagg

SEQ ID NO: 6999615 - DNA, 20 bp, Homo sapiens
agttacgctattactctcct

SEQ ID NO: 6999616 - DNA, 22 bp, Homo sapiens
acccttcatagaggagaagctg

SEQ ID NO: 6999617 - DNA, 23 bp, Homo sapiens
acagaataccattgactaggtgt

SEQ ID NO: 6999618 - DNA, 22 bp, Homo sapiens
aaaagcagagactctggagcta

SEQ ID NO: 6999619 - DNA, 22 bp, Homo sapiens
ttgtgctttggaacagaatcct

SEQ ID NO: 6999620 - DNA, 22 bp, Homo sapiens
agtcgtctgaactgtctgcttt

SEQ ID NO: 6999621 - DNA, 22 bp, Homo sapiens
tacacacttactggagatgaag

SEQ ID NO: 6999622 - DNA, 20 bp, Homo sapiens
tggctcctggctcctccctc

SEQ ID NO: 6999623 - DNA, 21 bp, Homo sapiens
ggccagcagcgtccactgtgg

SEQ ID NO: 6999624 - DNA, 22 bp, Homo sapiens
acaggcagatgttttagttgta

SEQ ID NO: 6999625 - DNA, 22 bp, Homo sapiens
tccaggggctgtcttggaatct

SEQ ID NO: 6999626 - DNA, 22 bp, Homo sapiens
agggcattggcacagatctgct

SEQ ID NO: 6999627 - DNA, 22 bp, Homo sapiens
cttctgtgtagaaaggtagccc

SEQ ID NO: 6999628 - DNA, 22 bp, Homo sapiens
aaaagagagctgaggagctcca

SEQ ID NO: 6999629 - DNA, 19 bp, Homo sapiens
ccctaggggctcctgaggg

SEQ ID NO: 6999630 - DNA, 22 bp, Homo sapiens
tagtgttctgggctgagagggg

SEQ ID NO: 6999631 - DNA, 22 bp, Homo sapiens
ctgaacaaagaaatagtcatgg

SEQ ID NO: 6999632 - DNA, 22 bp, Homo sapiens
ggcttcccagtccctgctctca

SEQ ID NO: 6999633 - DNA, 22 bp, Homo sapiens
tcagtcctcacttggttctaag

SEQ ID NO: 6999634 - DNA, 22 bp, Homo sapiens
ggagtgcagtggcgtgatctcg

SEQ ID NO: 6999635 - DNA, 22 bp, Homo sapiens
ggccagagctgacctatcaatg

SEQ ID NO: 6999636 - DNA, 22 bp, Homo sapiens
aagtcccatctgcctccatgta

SEQ ID NO: 6999637 - DNA, 22 bp, Homo sapiens
tctgccctgccattcactggaa

SEQ ID NO: 6999638 - DNA, 22 bp, Homo sapiens
ctggctcttcagtgcttggttc

SEQ ID NO: 6999639 - DNA, 22 bp, Homo sapiens
aaacaatgtacacatgaatgtt

SEQ ID NO: 6999640 - DNA, 22 bp, Homo sapiens
ttggggccgggataaggttgtt

SEQ ID NO: 6999641 - DNA, 22 bp, Homo sapiens
attttccttctaagaggaaggt

SEQ ID NO: 6999642 - DNA, 22 bp, Homo sapiens
ttattatgtgctagagaatgta

SEQ ID NO: 6999643 - DNA, 21 bp, Homo sapiens
tgtgacagaggcggtgcctac

SEQ ID NO: 6999644 - DNA, 22 bp, Homo sapiens
gtccccctgaaagcagccgcag

SEQ ID NO: 6999645 - DNA, 22 bp, Homo sapiens
atggtattaagaacaattccaa

SEQ ID NO: 6999646 - DNA, 22 bp, Homo sapiens
gcccaggaaagatagggcctca

SEQ ID NO: 6999647 - DNA, 22 bp, Homo sapiens
tggcagggaatacagatgttta

SEQ ID NO: 6999648 - DNA, 22 bp, Homo sapiens
gccccagccctgtggaccatgg

SEQ ID NO: 6999649 - DNA, 22 bp, Homo sapiens
aattctctactgtttggtgctc

SEQ ID NO: 6999650 - DNA, 22 bp, Homo sapiens
ttctggattctcaggatagaga

SEQ ID NO: 6999651 - DNA, 22 bp, Homo sapiens
aacttgtaggactgcactgtag

SEQ ID NO: 6999652 - DNA, 22 bp, Homo sapiens
acagttatttactgcataaact

SEQ ID NO: 6999653 - DNA, 22 bp, Homo sapiens
ctgtggagtcctggggaatgga

SEQ ID NO: 6999654 - DNA, 22 bp, Homo sapiens
tatatcaccaaaaacagttctg

SEQ ID NO: 6999655 - DNA, 22 bp, Homo sapiens
ctgggacacgttgtgctttaac

SEQ ID NO: 6999656 - DNA, 22 bp, Homo sapiens
ggctgcctcaattaatcttaca

SEQ ID NO: 6999657 - DNA, 22 bp, Homo sapiens
tggtccctagaagttctgaatc

SEQ ID NO: 6999658 - DNA, 22 bp, Homo sapiens
aggttctcacacgtctacaccc

SEQ ID NO: 6999659 - DNA, 22 bp, Homo sapiens
acaaggatttgttcctaatgtt

SEQ ID NO: 6999660 - DNA, 22 bp, Homo sapiens
caagatttgacttcgtggtttg

SEQ ID NO: 6999661 - DNA, 22 bp, Homo sapiens
ctcagggaattatttctgtcct

SEQ ID NO: 6999662 - DNA, 22 bp, Homo sapiens
gtgctgtcgtggaactgggctg

SEQ ID NO: 6999663 - DNA, 22 bp, Homo sapiens
cagtgaggtggatggatggcct

SEQ ID NO: 6999664 - DNA, 22 bp, Homo sapiens
tagatgatggtaaaaagaagtt

SEQ ID NO: 6999665 - DNA, 22 bp, Homo sapiens
atttctaggttcacatgtgttt

SEQ ID NO: 6999666 - DNA, 22 bp, Homo sapiens
agtgccttaaacagcatcggag

SEQ ID NO: 6999667 - DNA, 22 bp, Homo sapiens
tccattcaccattcagggaaca

SEQ ID NO: 6999668 - DNA, 22 bp, Homo sapiens
taacagtatccccatttgcaag

SEQ ID NO: 6999669 - DNA, 22 bp, Homo sapiens
cacagagatcggaacagaagta

SEQ ID NO: 6999670 - DNA, 22 bp, Homo sapiens
atttcctgcagagcccctccga

SEQ ID NO: 6999671 - DNA, 22 bp, Homo sapiens
tgtggctgcaggcgatggagga

SEQ ID NO: 6999672 - DNA, 22 bp, Homo sapiens
aacttctgacctcaagaactgt

SEQ ID NO: 6999673 - DNA, 22 bp, Homo sapiens
ctgaagctaggtcaaaaaaggg

SEQ ID NO: 6999674 - DNA, 22 bp, Homo sapiens
gaatagataagtgactatttgg

SEQ ID NO: 6999675 - DNA, 22 bp, Homo sapiens
gagaagctgttggagaattttt

SEQ ID NO: 6999676 - DNA, 18 bp, Homo sapiens
acaaggacgcgctgtgtg

SEQ ID NO: 6999677 - DNA, 22 bp, Homo sapiens
ctacattgttatctgtaagtgt

SEQ ID NO: 6999678 - DNA, 22 bp, Homo sapiens
gaatgtttaaggaaggcgtggc

SEQ ID NO: 6999679 - DNA, 22 bp, Homo sapiens
tggtccctagtgtgggagcttg

SEQ ID NO: 6999680 - DNA, 22 bp, Homo sapiens
tgtctctggctgcagcctgttc

SEQ ID NO: 6999681 - DNA, 22 bp, Homo sapiens
gataactacacttaagacaacc

SEQ ID NO: 6999682 - DNA, 22 bp, Homo sapiens
cagaagagtagctgaacaagtt

SEQ ID NO: 6999683 - DNA, 22 bp, Homo sapiens
tctgtgcggtctgtgttatgaa

SEQ ID NO: 6999684 - DNA, 22 bp, Homo sapiens
catacagaaaatatattttgat

SEQ ID NO: 6999685 - DNA, 22 bp, Homo sapiens
catttctagagtcccaagaggt

SEQ ID NO: 6999686 - DNA, 22 bp, Homo sapiens
ttctcatatgcactctatttga

SEQ ID NO: 6999687 - DNA, 22 bp, Homo sapiens
tgggctctcctggaggacaaca

SEQ ID NO: 6999688 - DNA, 22 bp, Homo sapiens
gtccaggcctgcctctgaggag

SEQ ID NO: 6999689 - DNA, 22 bp, Homo sapiens
atttccttgcaacttaggcatg

SEQ ID NO: 6999690 - DNA, 22 bp, Homo sapiens
gagaggctggcagtgccaggtt

SEQ ID NO: 6999691 - DNA, 22 bp, Homo sapiens
cctggggattctgacacggagt

SEQ ID NO: 6999692 - DNA, 22 bp, Homo sapiens
tagcactatttttcactatcct

SEQ ID NO: 6999693 - DNA, 22 bp, Homo sapiens
ttattttgccacaggtgacctt

SEQ ID NO: 6999694 - DNA, 22 bp, Homo sapiens
tctctcagaggccagggtcctg

SEQ ID NO: 6999695 - DNA, 22 bp, Homo sapiens
ctttttgtgtatgctacagttg

SEQ ID NO: 6999696 - DNA, 22 bp, Homo sapiens
agaagtcaatgatgagagtgct

SEQ ID NO: 6999697 - DNA, 22 bp, Homo sapiens
agtgtctttagcaagtttagtc

SEQ ID NO: 6999698 - DNA, 22 bp, Homo sapiens
ggtagtcggccttgccctgggc

SEQ ID NO: 6999699 - DNA, 22 bp, Homo sapiens
acatttgttgccattcatggag

SEQ ID NO: 6999700 - DNA, 19 bp, Homo sapiens
tgtcagtgatacatgcttt

SEQ ID NO: 6999701 - DNA, 22 bp, Homo sapiens
tggagcccatgagccataccag

SEQ ID NO: 6999702 - DNA, 22 bp, Homo sapiens
taacagaatagcagaaacagaa

SEQ ID NO: 6999703 - DNA, 22 bp, Homo sapiens
ataatgtgttcatcttacaatt

SEQ ID NO: 6999704 - DNA, 22 bp, Homo sapiens
tatactattattgtcagtttat

SEQ ID NO: 6999705 - DNA, 22 bp, Homo sapiens
aaacctctgggttccgtggttt

SEQ ID NO: 6999706 - DNA, 22 bp, Homo sapiens
ttacctgaaaggttaatttcca

SEQ ID NO: 6999707 - DNA, 22 bp, Homo sapiens
tggagagtaatttctgaagacc

SEQ ID NO: 6999708 - DNA, 22 bp, Homo sapiens
tcagaatctgcatttaacaaaa

SEQ ID NO: 6999709 - DNA, 22 bp, Homo sapiens
tgagcagtggctcctgctggac

SEQ ID NO: 6999710 - DNA, 22 bp, Homo sapiens
gccaggggtgcccacccaagga

SEQ ID NO: 6999711 - DNA, 22 bp, Homo sapiens
ttaacacatatttatcaattgc

SEQ ID NO: 6999712 - DNA, 22 bp, Homo sapiens
gagtggggcgaagtcggcgagt

SEQ ID NO: 6999713 - DNA, 22 bp, Homo sapiens
gaggctgtttgtggcagtgatg

SEQ ID NO: 6999714 - DNA, 22 bp, Homo sapiens
aatgtcatgagcctgctcttgt

SEQ ID NO: 6999715 - DNA, 22 bp, Homo sapiens
aggccctgatccgaatccagat

SEQ ID NO: 6999716 - DNA, 19 bp, Homo sapiens
aaagttgagaaacaatgga

SEQ ID NO: 6999717 - DNA, 22 bp, Homo sapiens
ttcaattatccctgcaactgag

SEQ ID NO: 6999718 - DNA, 22 bp, Homo sapiens
aaagcatgactcaagaattact

SEQ ID NO: 6999719 - DNA, 22 bp, Homo sapiens
gagagtcatacagaccaatata

SEQ ID NO: 6999720 - DNA, 22 bp, Homo sapiens
agcatagatacattgagccaca

SEQ ID NO: 6999721 - DNA, 22 bp, Homo sapiens
taattattatgacaacaattgc

SEQ ID NO: 6999722 - DNA, 22 bp, Homo sapiens
ttcatacagtggctgcactcca

SEQ ID NO: 6999723 - DNA, 22 bp, Homo sapiens
gccgaagacgctgggcgtgggc

SEQ ID NO: 6999724 - DNA, 22 bp, Homo sapiens
atagaattctttgaaatttatg

SEQ ID NO: 6999725 - DNA, 22 bp, Homo sapiens
ctgggaagtagaatcagatgag

SEQ ID NO: 6999726 - DNA, 22 bp, Homo sapiens
tccggtgccagagtgggatcag

SEQ ID NO: 6999727 - DNA, 22 bp, Homo sapiens
gaaggccacggaatggagctgg

SEQ ID NO: 6999728 - DNA, 23 bp, Homo sapiens
tgaggaagtaattgtaaaggtct

SEQ ID NO: 6999729 - DNA, 22 bp, Homo sapiens
caggaggctttgggatccaagt

SEQ ID NO: 6999730 - DNA, 22 bp, Homo sapiens
caaagtcctagaacagtgcttg

SEQ ID NO: 6999731 - DNA, 22 bp, Homo sapiens
tgaagagtattaggttatttga

SEQ ID NO: 6999732 - DNA, 22 bp, Homo sapiens
gctcttgaaataatggctaatg

SEQ ID NO: 6999733 - DNA, 22 bp, Homo sapiens
agccattggctgcctggtgcgt

SEQ ID NO: 6999734 - DNA, 22 bp, Homo sapiens
tgaaatgttaatcacacaaagg

SEQ ID NO: 6999735 - DNA, 22 bp, Homo sapiens
ctagcagcatcacaggaagact

SEQ ID NO: 6999736 - DNA, 22 bp, Homo sapiens
ttccccttataagtctggcttc

SEQ ID NO: 6999737 - DNA, 22 bp, Homo sapiens
cctcttgagtgtctgttttcca

SEQ ID NO: 6999738 - DNA, 22 bp, Homo sapiens
aagaatatagattttttgaagt

SEQ ID NO: 6999739 - DNA, 22 bp, Homo sapiens
ctggcagcgtgagcagcatcca

SEQ ID NO: 6999740 - DNA, 22 bp, Homo sapiens
gagtgtgtcggtcagcgtggcg

SEQ ID NO: 6999741 - DNA, 22 bp, Homo sapiens
acattacagcaagtttacgtta

SEQ ID NO: 6999742 - DNA, 22 bp, Homo sapiens
agcaggtgacccaagcaggctg

SEQ ID NO: 6999743 - DNA, 22 bp, Homo sapiens
acccagaggtgtctagcaagct

SEQ ID NO: 6999744 - DNA, 22 bp, Homo sapiens
gtctggtacataagaggtgctc

SEQ ID NO: 6999745 - DNA, 22 bp, Homo sapiens
gctgtgtaaacttgtacagtgc

SEQ ID NO: 6999746 - DNA, 20 bp, Homo sapiens
tacccaagtgtggccatgtg

SEQ ID NO: 6999747 - DNA, 20 bp, Homo sapiens
tgatgctggtctgaattgca

SEQ ID NO: 6999748 - DNA, 22 bp, Homo sapiens
tgcagctggtttagaactagat

SEQ ID NO: 6999749 - DNA, 22 bp, Homo sapiens
tttggtcatgtgcccacccctg

SEQ ID NO: 6999750 - DNA, 22 bp, Homo sapiens
tctagcatgggaaaatcacagc

SEQ ID NO: 6999751 - DNA, 22 bp, Homo sapiens
atgcaggaggactaaagggatg

SEQ ID NO: 6999752 - DNA, 22 bp, Homo sapiens
tcacagagaactataatccatc

SEQ ID NO: 6999753 - DNA, 21 bp, Homo sapiens
tgggatgggtctgggaccagc

SEQ ID NO: 6999754 - DNA, 22 bp, Homo sapiens
atcataactgtaattcatctac

SEQ ID NO: 6999755 - DNA, 22 bp, Homo sapiens
agctgctgcctcactggtctgt

SEQ ID NO: 6999756 - DNA, 20 bp, Homo sapiens
aggccctgccagggacggag

SEQ ID NO: 6999757 - DNA, 22 bp, Homo sapiens
gaagtacagaaaggggcccctt

SEQ ID NO: 6999758 - DNA, 22 bp, Homo sapiens
tcacaatactcactcaatggct

SEQ ID NO: 6999759 - DNA, 22 bp, Homo sapiens
aagctatattatatttgtgttt

SEQ ID NO: 6999760 - DNA, 22 bp, Homo sapiens
catttccactctgggagtcaga

SEQ ID NO: 6999761 - DNA, 22 bp, Homo sapiens
ctcagcagagaccagggaggaa

SEQ ID NO: 6999762 - DNA, 19 bp, Homo sapiens
cacttcacatggtgaaagc

SEQ ID NO: 6999763 - DNA, 22 bp, Homo sapiens
tgccaggcagtgtcagattgag

SEQ ID NO: 6999764 - DNA, 22 bp, Homo sapiens
cctgtgcttcagctggaggagg

SEQ ID NO: 6999765 - DNA, 22 bp, Homo sapiens
gaggcagctgggatacaaggga

SEQ ID NO: 6999766 - DNA, 22 bp, Homo sapiens
tgggggtgactatctcgggaat

SEQ ID NO: 6999767 - DNA, 22 bp, Homo sapiens
gataaggactttggggtctaca

SEQ ID NO: 6999768 - DNA, 22 bp, Homo sapiens
tagattgttcttaactttataa

SEQ ID NO: 6999769 - DNA, 22 bp, Homo sapiens
tattaggttggtgcaaaagtaa

SEQ ID NO: 6999770 - DNA, 22 bp, Homo sapiens
gcatgcttttatatctgtttaa

SEQ ID NO: 6999771 - DNA, 22 bp, Homo sapiens
cagcctaacccatctgatgcag

SEQ ID NO: 6999772 - DNA, 22 bp, Homo sapiens
ttttctcctaagacccttcacc

SEQ ID NO: 6999773 - DNA, 22 bp, Homo sapiens
catggggcccatgtgctccaag

SEQ ID NO: 6999774 - DNA, 22 bp, Homo sapiens
atattgcattggctggtcttga

SEQ ID NO: 6999775 - DNA, 22 bp, Homo sapiens
atacagaaaatgatgcagagtt

SEQ ID NO: 6999776 - DNA, 22 bp, Homo sapiens
gcagagccccattgctggcggg

SEQ ID NO: 6999777 - DNA, 21 bp, Homo sapiens
tgctcagtaaatgctgagtga

SEQ ID NO: 6999778 - DNA, 22 bp, Homo sapiens
aactattcaccaccttgtggta

SEQ ID NO: 6999779 - DNA, 22 bp, Homo sapiens
cagctgacccgtgggaggcggg

SEQ ID NO: 6999780 - DNA, 22 bp, Homo sapiens
ttcagaggttagagcagtggga

SEQ ID NO: 6999781 - DNA, 22 bp, Homo sapiens
cagagcaggtatctttggtgaa

SEQ ID NO: 6999782 - DNA, 22 bp, Homo sapiens
cagggaaagttcttgtccactc

SEQ ID NO: 6999783 - DNA, 20 bp, Homo sapiens
tccagggccctggctcctct

SEQ ID NO: 6999784 - DNA, 22 bp, Homo sapiens
atgtaaactttaccagctctga

SEQ ID NO: 6999785 - DNA, 22 bp, Homo sapiens
atgcattgcttgagggtaggaa

SEQ ID NO: 6999786 - DNA, 22 bp, Homo sapiens
taatttatttcaactgccaagg

SEQ ID NO: 6999787 - DNA, 22 bp, Homo sapiens
agagtgctttattagatgtagc

SEQ ID NO: 6999788 - DNA, 23 bp, Homo sapiens
tctgagtgattagcctctggggt

SEQ ID NO: 6999789 - DNA, 22 bp, Homo sapiens
gccagcttggccagtggccagt

SEQ ID NO: 6999790 - DNA, 22 bp, Homo sapiens
tggagtcatgatggctgctgat

SEQ ID NO: 6999791 - DNA, 22 bp, Homo sapiens
aaattagaccagttcaggtcca

SEQ ID NO: 6999792 - DNA, 22 bp, Homo sapiens
ctgggggccttacggaactcca

SEQ ID NO: 6999793 - DNA, 18 bp, Homo sapiens
acgtgctgtgccttttgc

SEQ ID NO: 6999794 - DNA, 19 bp, Homo sapiens
tgtgtcagcagggggcttc

SEQ ID NO: 6999795 - DNA, 22 bp, Homo sapiens
tttgttgtactgggattagact

SEQ ID NO: 6999796 - DNA, 22 bp, Homo sapiens
atgcatgtgacatgatcctgga

SEQ ID NO: 6999797 - DNA, 19 bp, Homo sapiens
ggctgctggttacagaggc

SEQ ID NO: 6999798 - DNA, 22 bp, Homo sapiens
ggtggctgggattagtagccca

SEQ ID NO: 6999799 - DNA, 22 bp, Homo sapiens
aagccgtatgtggagtattagc

SEQ ID NO: 6999800 - DNA, 22 bp, Homo sapiens
ttagcgcacatcacagggggaa

SEQ ID NO: 6999801 - DNA, 22 bp, Homo sapiens
ttggtcaagtcttaaagaaaaa

SEQ ID NO: 6999802 - DNA, 22 bp, Homo sapiens
ccttagtgtgcctgaggcagat

SEQ ID NO: 6999803 - DNA, 22 bp, Homo sapiens
agaacagccaataaaagagggg

SEQ ID NO: 6999804 - DNA, 22 bp, Homo sapiens
tgtggactttattttagggagg

SEQ ID NO: 6999805 - DNA, 22 bp, Homo sapiens
tgctagaatacctacctggagg

SEQ ID NO: 6999806 - DNA, 22 bp, Homo sapiens
gagtataagctttttcacttca

SEQ ID NO: 6999807 - DNA, 22 bp, Homo sapiens
atatcactagagaagttgttaa

SEQ ID NO: 6999808 - DNA, 22 bp, Homo sapiens
gcagtttactgtcaataactct

SEQ ID NO: 6999809 - DNA, 22 bp, Homo sapiens
actcagagatatggtggttgat

SEQ ID NO: 6999810 - DNA, 22 bp, Homo sapiens
gaacactgctgttgggttctga

SEQ ID NO: 6999811 - DNA, 22 bp, Homo sapiens
tggtcctaggctggggaaggct

SEQ ID NO: 6999812 - DNA, 18 bp, Homo sapiens
caatttcaatggtctgaa

SEQ ID NO: 6999813 - DNA, 22 bp, Homo sapiens
ttggctgctttactctgacggg

SEQ ID NO: 6999814 - DNA, 22 bp, Homo sapiens
tctcagggagttgaggctgcct

SEQ ID NO: 6999815 - DNA, 22 bp, Homo sapiens
gggtgggccactgagcagcgtg

SEQ ID NO: 6999816 - DNA, 22 bp, Homo sapiens
tctacattttaacaagatgccc

SEQ ID NO: 6999817 - DNA, 22 bp, Homo sapiens
ctagaattgcattctatgaata

SEQ ID NO: 6999818 - DNA, 22 bp, Homo sapiens
aagctgctctcacaacactgtt

SEQ ID NO: 6999819 - DNA, 18 bp, Homo sapiens
ttcacagatccacaggaa

SEQ ID NO: 6999820 - DNA, 22 bp, Homo sapiens
tagcaggcatggagatgactgt

SEQ ID NO: 6999821 - DNA, 22 bp, Homo sapiens
ggagaacaggcaagcatctggc

SEQ ID NO: 6999822 - DNA, 22 bp, Homo sapiens
agttaagggggttcatctgtaa

SEQ ID NO: 6999823 - DNA, 22 bp, Homo sapiens
agccccagcccctctctcacaa

SEQ ID NO: 6999824 - DNA, 20 bp, Homo sapiens
tcagacttgattctatgcta

SEQ ID NO: 6999825 - DNA, 22 bp, Homo sapiens
gtggcacaaggcttacacagca

SEQ ID NO: 6999826 - DNA, 22 bp, Homo sapiens
tgtaacagctctccatgtgggg

SEQ ID NO: 6999827 - DNA, 22 bp, Homo sapiens
agcctgactaataggagttgag

SEQ ID NO: 6999828 - DNA, 17 bp, Homo sapiens
acaggcctgcttgcact

SEQ ID NO: 6999829 - DNA, 22 bp, Homo sapiens
acacatttgggctcctacataa

SEQ ID NO: 6999830 - DNA, 22 bp, Homo sapiens
ttgtctctggaaggaaaaagca

SEQ ID NO: 6999831 - DNA, 22 bp, Homo sapiens
agatgttttggagacactaacc

SEQ ID NO: 6999832 - DNA, 22 bp, Homo sapiens
gcaggatgggagcttcactttg

SEQ ID NO: 6999833 - DNA, 22 bp, Homo sapiens
ttctcctctgcaatgactggca

SEQ ID NO: 6999834 - DNA, 22 bp, Homo sapiens
aacttagtttagggtattgatt

SEQ ID NO: 6999835 - DNA, 22 bp, Homo sapiens
gcagctctgagactctacagaa

SEQ ID NO: 6999836 - DNA, 22 bp, Homo sapiens
catgggccagagctcctctggg

SEQ ID NO: 6999837 - DNA, 22 bp, Homo sapiens
ctgtctttagtacaaaaaatgt

SEQ ID NO: 6999838 - DNA, 22 bp, Homo sapiens
aagaatgtcaagcagaaggtct

SEQ ID NO: 6999839 - DNA, 22 bp, Homo sapiens
gttcacagcttcttaggtcata

SEQ ID NO: 6999840 - DNA, 20 bp, Homo sapiens
cctgtctgcaatggaggtca

SEQ ID NO: 6999841 - DNA, 22 bp, Homo sapiens
tgggagtgatacagtatggaat

SEQ ID NO: 6999842 - DNA, 22 bp, Homo sapiens
taaggtgagctgtataacaggg

SEQ ID NO: 6999843 - DNA, 22 bp, Homo sapiens
actcacagaataggcatgatgg

SEQ ID NO: 6999844 - DNA, 22 bp, Homo sapiens
tctgagtgatcagatgcattgc

SEQ ID NO: 6999845 - DNA, 22 bp, Homo sapiens
ctgtggctcaaaatcccatgat

SEQ ID NO: 6999846 - DNA, 22 bp, Homo sapiens
ttccactactcgaatggtaaca

SEQ ID NO: 6999847 - DNA, 22 bp, Homo sapiens
cagagacattctccccattgga

SEQ ID NO: 6999848 - DNA, 17 bp, Homo sapiens
aaggaatgtcagaagtt

SEQ ID NO: 6999849 - DNA, 22 bp, Homo sapiens
aaatatagtgacacttatagtc

SEQ ID NO: 6999850 - DNA, 22 bp, Homo sapiens
ccagaatccaaaacgttttgag

SEQ ID NO: 6999851 - DNA, 22 bp, Homo sapiens
tcagagacagttctggggcagg

SEQ ID NO: 6999852 - DNA, 22 bp, Homo sapiens
ctccaggcgccgcttttgcagt

SEQ ID NO: 6999853 - DNA, 22 bp, Homo sapiens
aatctctttggctcaaggatcc

SEQ ID NO: 6999854 - DNA, 22 bp, Homo sapiens
cctgggaggtggaggttgcagc

SEQ ID NO: 6999855 - DNA, 22 bp, Homo sapiens
tggggcacagtctgaatgtttc

SEQ ID NO: 6999856 - DNA, 22 bp, Homo sapiens
cagctcttcagtgcctgagata

SEQ ID NO: 6999857 - DNA, 22 bp, Homo sapiens
aggcctgtttcttgtccagctc

SEQ ID NO: 6999858 - DNA, 22 bp, Homo sapiens
tcaacaagtatttttcaaggct

SEQ ID NO: 6999859 - DNA, 22 bp, Homo sapiens
ccaccagagggcagactgtgat

SEQ ID NO: 6999860 - DNA, 22 bp, Homo sapiens
tgaggaactgccagactgtttt

SEQ ID NO: 6999861 - DNA, 22 bp, Homo sapiens
actcttgaaaatagatccacat

SEQ ID NO: 6999862 - DNA, 22 bp, Homo sapiens
gagggtgtctcacgtgaaagta

SEQ ID NO: 6999863 - DNA, 22 bp, Homo sapiens
ccagtgtctactgtggcatatc

SEQ ID NO: 6999864 - DNA, 22 bp, Homo sapiens
actgtcttgttccaagactaaa

SEQ ID NO: 6999865 - DNA, 22 bp, Homo sapiens
atccagacagtctggtgccaga

SEQ ID NO: 6999866 - DNA, 22 bp, Homo sapiens
ggctgagcgtggctgccgtggg

SEQ ID NO: 6999867 - DNA, 22 bp, Homo sapiens
agcattgctaaagctaattttt

SEQ ID NO: 6999868 - DNA, 22 bp, Homo sapiens
aagcatagagacacaaatttgg

SEQ ID NO: 6999869 - DNA, 18 bp, Homo sapiens
tcctggcagtcagagagg

SEQ ID NO: 6999870 - DNA, 22 bp, Homo sapiens
gcaaggaagcagagttgctatc

SEQ ID NO: 6999871 - DNA, 22 bp, Homo sapiens
ctgccaggcagggagatggctg

SEQ ID NO: 6999872 - DNA, 22 bp, Homo sapiens
tctctgggatcgttttgggctc

SEQ ID NO: 6999873 - DNA, 22 bp, Homo sapiens
tttgcattatctcacttatata

SEQ ID NO: 6999874 - DNA, 19 bp, Homo sapiens
tgctatttgaagaagtgta

SEQ ID NO: 6999875 - DNA, 22 bp, Homo sapiens
gcccaagagagcgaaggttggc

SEQ ID NO: 6999876 - DNA, 17 bp, Homo sapiens
catgccccaggcttagc

SEQ ID NO: 6999877 - DNA, 21 bp, Homo sapiens
actgggagaacgagcctttcc

SEQ ID NO: 6999878 - DNA, 22 bp, Homo sapiens
ttaacactcctaactacagtct

SEQ ID NO: 6999879 - DNA, 22 bp, Homo sapiens
tgccctggatgctgcaggtgtg

SEQ ID NO: 6999880 - DNA, 22 bp, Homo sapiens
agtagcagtttggctgaattta

SEQ ID NO: 6999881 - DNA, 22 bp, Homo sapiens
aaggagtgtgaccttccagctc

SEQ ID NO: 6999882 - DNA, 22 bp, Homo sapiens
tctcaggcccctgagtttctct

SEQ ID NO: 6999883 - DNA, 20 bp, Homo sapiens
ctcctgggactgctggttat

SEQ ID NO: 6999884 - DNA, 22 bp, Homo sapiens
acatgtgtctaagaatgaaaga

SEQ ID NO: 6999885 - DNA, 22 bp, Homo sapiens
aggctggctggggatgcgtctt

SEQ ID NO: 6999886 - DNA, 22 bp, Homo sapiens
tgcacagcgcttgtcgggtgtg

SEQ ID NO: 6999887 - DNA, 22 bp, Homo sapiens
tacagacaaagtgctatagggt

SEQ ID NO: 6999888 - DNA, 22 bp, Homo sapiens
tggcttcatcactcgggctgcc

SEQ ID NO: 6999889 - DNA, 22 bp, Homo sapiens
tgccatggtgactgcaggaggt

SEQ ID NO: 6999890 - DNA, 22 bp, Homo sapiens
cccaggcagggacgtgctctgg

SEQ ID NO: 6999891 - DNA, 22 bp, Homo sapiens
cactccagccatttgtccccag

SEQ ID NO: 6999892 - DNA, 22 bp, Homo sapiens
gggatcgctcagtgtgtgaaga

SEQ ID NO: 6999893 - DNA, 22 bp, Homo sapiens
gaggaagagcatggccagtttc

SEQ ID NO: 6999894 - DNA, 22 bp, Homo sapiens
cagggtggaatggaatgctggc

SEQ ID NO: 6999895 - DNA, 22 bp, Homo sapiens
tggctggtcacatggtaggtct

SEQ ID NO: 6999896 - DNA, 22 bp, Homo sapiens
gaagggaactgggtctccttgt

SEQ ID NO: 6999897 - DNA, 22 bp, Homo sapiens
acatgtctcttctgaaagacaa

SEQ ID NO: 6999898 - DNA, 22 bp, Homo sapiens
tgtgagcttaggacagggctat

SEQ ID NO: 6999899 - DNA, 22 bp, Homo sapiens
cacctggctggaagtgctccgg

SEQ ID NO: 6999900 - DNA, 22 bp, Homo sapiens
catggccttgagtgactgcact

SEQ ID NO: 6999901 - DNA, 22 bp, Homo sapiens
tggtgccacttcttaggctggt

SEQ ID NO: 6999902 - DNA, 22 bp, Homo sapiens
tataatccattcattgatttct

SEQ ID NO: 6999903 - DNA, 18 bp, Homo sapiens
agcattaggaggttatca

SEQ ID NO: 6999904 - DNA, 22 bp, Homo sapiens
cttcactttaagccaatcatga

SEQ ID NO: 6999905 - DNA, 18 bp, Homo sapiens
tgaggctgagggtagagg

SEQ ID NO: 6999906 - DNA, 22 bp, Homo sapiens
cagtgcaacgttgtgcattcaa

SEQ ID NO: 6999907 - DNA, 22 bp, Homo sapiens
agaggcctctgttgttcagacg

SEQ ID NO: 6999908 - DNA, 22 bp, Homo sapiens
aatttcaaactcttgccctcag

SEQ ID NO: 6999909 - DNA, 22 bp, Homo sapiens
gggataggaaacttaggtacac

SEQ ID NO: 6999910 - DNA, 22 bp, Homo sapiens
ttcagctctgctagctctgtgc

SEQ ID NO: 6999911 - DNA, 18 bp, Homo sapiens
agccaggtggaatggaac

SEQ ID NO: 6999912 - DNA, 23 bp, Homo sapiens
agcccctcatggtgtctagacag

SEQ ID NO: 6999913 - DNA, 22 bp, Homo sapiens
gtaggtcagacataagaggaca

SEQ ID NO: 6999914 - DNA, 23 bp, Homo sapiens
ctcctggagggtccggccctgcc

SEQ ID NO: 6999915 - DNA, 22 bp, Homo sapiens
tgtgtatctgtatacaagtttg

SEQ ID NO: 6999916 - DNA, 22 bp, Homo sapiens
accttcaggtgagcacacagat

SEQ ID NO: 6999917 - DNA, 22 bp, Homo sapiens
gagtcccaggatatgtgctgtt

SEQ ID NO: 6999918 - DNA, 22 bp, Homo sapiens
acgtaatactattcttagtgat

SEQ ID NO: 6999919 - DNA, 22 bp, Homo sapiens
gcattcatcttcatgaaagcac

SEQ ID NO: 6999920 - DNA, 22 bp, Homo sapiens
actgtatagatggagttgattt

SEQ ID NO: 6999921 - DNA, 19 bp, Homo sapiens
ctcagtctggctctgcctg

SEQ ID NO: 6999922 - DNA, 22 bp, Homo sapiens
gacagagctgctctagattctg

SEQ ID NO: 6999923 - DNA, 22 bp, Homo sapiens
aagggcctttcaaaggtgatta

SEQ ID NO: 6999924 - DNA, 22 bp, Homo sapiens
ccctgcagcattctctaactgg

SEQ ID NO: 6999925 - DNA, 22 bp, Homo sapiens
ctctgggcggcccaggccaacc

SEQ ID NO: 6999926 - DNA, 22 bp, Homo sapiens
ttccaggctcccttggaggtgt

SEQ ID NO: 6999927 - DNA, 22 bp, Homo sapiens
ggcttaccgcaagctccgcctc

SEQ ID NO: 6999928 - DNA, 19 bp, Homo sapiens
gcaggtcattaggctaggt

SEQ ID NO: 6999929 - DNA, 17 bp, Homo sapiens
gggctcctcccctgggg

SEQ ID NO: 6999930 - DNA, 22 bp, Homo sapiens
gtgtgggacgggtgagtggcca

SEQ ID NO: 6999931 - DNA, 22 bp, Homo sapiens
tcaggagctgcattatcctgtg

SEQ ID NO: 6999932 - DNA, 22 bp, Homo sapiens
tttattgtctatgaactgcttg

SEQ ID NO: 6999933 - DNA, 22 bp, Homo sapiens
cagtgctgcaggcgcctgcggt

SEQ ID NO: 6999934 - DNA, 22 bp, Homo sapiens
gagccctggcagtctgggatgg

SEQ ID NO: 6999935 - DNA, 22 bp, Homo sapiens
taaaacactcagcacctagcaa

SEQ ID NO: 6999936 - DNA, 22 bp, Homo sapiens
ttcttggggttccacaatggga

SEQ ID NO: 6999937 - DNA, 22 bp, Homo sapiens
aatgcaaactccactggagcag

SEQ ID NO: 6999938 - DNA, 22 bp, Homo sapiens
tcaatgatagtacaatcagcct

SEQ ID NO: 6999939 - DNA, 22 bp, Homo sapiens
tatacacaggaatctgtgaaaa

SEQ ID NO: 6999940 - DNA, 22 bp, Homo sapiens
gctgccctacccgaggcactct

SEQ ID NO: 6999941 - DNA, 22 bp, Homo sapiens
cagctgttgtgatttccaggag

SEQ ID NO: 6999942 - DNA, 22 bp, Homo sapiens
ttggtgtgactaaggcagtgtg

SEQ ID NO: 6999943 - DNA, 22 bp, Homo sapiens
acttcacacagcaaatttatct

SEQ ID NO: 6999944 - DNA, 22 bp, Homo sapiens
ctgattctcctcaagactttcg

SEQ ID NO: 6999945 - DNA, 22 bp, Homo sapiens
taagtcatatgtgtcccaagtc

SEQ ID NO: 6999946 - DNA, 22 bp, Homo sapiens
caagggctgaacacaggtttca

SEQ ID NO: 6999947 - DNA, 22 bp, Homo sapiens
acaggtagtctgaacactgggt

SEQ ID NO: 6999948 - DNA, 17 bp, Homo sapiens
agctagggcctagaatc

SEQ ID NO: 6999949 - DNA, 22 bp, Homo sapiens
aaagctatttgtgagttataga

SEQ ID NO: 6999950 - DNA, 22 bp, Homo sapiens
gaggtatggatatctggagagg

SEQ ID NO: 6999951 - DNA, 22 bp, Homo sapiens
aggctggcttcccaagcgtcct

SEQ ID NO: 6999952 - DNA, 22 bp, Homo sapiens
gctggctggagtaaggagggag

SEQ ID NO: 6999953 - DNA, 22 bp, Homo sapiens
taaatgcagattcctgagccta

SEQ ID NO: 6999954 - DNA, 22 bp, Homo sapiens
ttggatgaggttgagaatcatt

SEQ ID NO: 6999955 - DNA, 22 bp, Homo sapiens
tctgttaacaggagagaatgat

SEQ ID NO: 6999956 - DNA, 22 bp, Homo sapiens
cctctgagtagactggacatga

SEQ ID NO: 6999957 - DNA, 22 bp, Homo sapiens
agctgccatcagcctttggatg

SEQ ID NO: 6999958 - DNA, 20 bp, Homo sapiens
tgaggctcagagaggttgag

SEQ ID NO: 6999959 - DNA, 22 bp, Homo sapiens
acaaacatcttgacctcagatt

SEQ ID NO: 6999960 - DNA, 22 bp, Homo sapiens
gcaagcagcccagaacagctct

SEQ ID NO: 6999961 - DNA, 22 bp, Homo sapiens
cccagcctctggattctgccct

SEQ ID NO: 6999962 - DNA, 19 bp, Homo sapiens
aaaaggaatattctttggg

SEQ ID NO: 6999963 - DNA, 22 bp, Homo sapiens
agctgcatgtcttattgagctg

SEQ ID NO: 6999964 - DNA, 22 bp, Homo sapiens
ggcaggaggtgagtggcgggtg

SEQ ID NO: 6999965 - DNA, 22 bp, Homo sapiens
aagccagtgtccagaatgggca

SEQ ID NO: 6999966 - DNA, 22 bp, Homo sapiens
actgaaatgaaatctatcatct

SEQ ID NO: 6999967 - DNA, 22 bp, Homo sapiens
tagctacaaatctgataagtgg

SEQ ID NO: 6999968 - DNA, 22 bp, Homo sapiens
gctgagggatagctgctcactg

SEQ ID NO: 6999969 - DNA, 22 bp, Homo sapiens
atataatttttggttagctcaa

SEQ ID NO: 6999970 - DNA, 22 bp, Homo sapiens
aatgaggttcgcagttgtttta

SEQ ID NO: 6999971 - DNA, 22 bp, Homo sapiens
tctccaggcccactgatttata

SEQ ID NO: 6999972 - DNA, 22 bp, Homo sapiens
ccctggcaagtgctgtgtagct

SEQ ID NO: 6999973 - DNA, 22 bp, Homo sapiens
taacactgtaaacctagatgtt

SEQ ID NO: 6999974 - DNA, 22 bp, Homo sapiens
ctggttgggaggttggctttca

SEQ ID NO: 6999975 - DNA, 22 bp, Homo sapiens
ctagcactgagaatagtgcata

SEQ ID NO: 6999976 - DNA, 22 bp, Homo sapiens
gctttacacagctggttcttgt

SEQ ID NO: 6999977 - DNA, 22 bp, Homo sapiens
gtgtgtccaggcgggagtcaag

SEQ ID NO: 6999978 - DNA, 22 bp, Homo sapiens
atagggctgccatcacagaaga

SEQ ID NO: 6999979 - DNA, 22 bp, Homo sapiens
gcccagaagtgactcagcactg

SEQ ID NO: 6999980 - DNA, 22 bp, Homo sapiens
cacatgacactattttgttcta

SEQ ID NO: 6999981 - DNA, 22 bp, Homo sapiens
gcagtggtccagttcacaccca

SEQ ID NO: 6999982 - DNA, 22 bp, Homo sapiens
ttggtgaattgagaccatttgt

SEQ ID NO: 6999983 - DNA, 22 bp, Homo sapiens
ttagctttcatgaacctggtcg

SEQ ID NO: 6999984 - DNA, 22 bp, Homo sapiens
gctcaggagctcttggtggcgc

SEQ ID NO: 6999985 - DNA, 21 bp, Homo sapiens
ggaaaattccatacacccacg

SEQ ID NO: 6999986 - DNA, 22 bp, Homo sapiens
aagagttaaatgaatgagtggg

SEQ ID NO: 6999987 - DNA, 22 bp, Homo sapiens
tgatgtctctctatactctaac

SEQ ID NO: 6999988 - DNA, 22 bp, Homo sapiens
atttgccttactgaagaaggag

SEQ ID NO: 6999989 - DNA, 19 bp, Homo sapiens
aggaaaggatcaaaatagc

SEQ ID NO: 6999990 - DNA, 22 bp, Homo sapiens
aagaggccacagctgacagcac

SEQ ID NO: 6999991 - DNA, 22 bp, Homo sapiens
agcttccatactaagacaaaag

SEQ ID NO: 6999992 - DNA, 22 bp, Homo sapiens
atgtagaaataatttcagttcc

SEQ ID NO: 6999993 - DNA, 20 bp, Homo sapiens
tgtgcaggagagtgaggctg

SEQ ID NO: 6999994 - DNA, 21 bp, Homo sapiens
ggaatagcttaaagtgagggg

SEQ ID NO: 6999995 - DNA, 22 bp, Homo sapiens
caggctgctgtccacaaagcat

SEQ ID NO: 6999996 - DNA, 22 bp, Homo sapiens
gaacagggttgggtgagagagg

SEQ ID NO: 6999997 - DNA, 22 bp, Homo sapiens
tggcctctgggaaagcagattc

SEQ ID NO: 6999998 - DNA, 22 bp, Homo sapiens
gaggtggctggctcagagccag

SEQ ID NO: 6999999 - DNA, 19 bp, Homo sapiens
tgtgtgtatttcagttctt

SEQ ID NO: 7000000 - DNA, 20 bp, Homo sapiens
ccacagaggacagggctgtg

SEQ ID NO: 7000001 - DNA, 22 bp, Homo sapiens
gttctcactagtgctttgagag

SEQ ID NO: 7000002 - DNA, 22 bp, Homo sapiens
cctccagcgcgatccactccgg

SEQ ID NO: 7000003 - DNA, 22 bp, Homo sapiens
tctgcaccccgcagggtcaggt

SEQ ID NO: 7000004 - DNA, 22 bp, Homo sapiens
tccctgtggctaagacatgaca

SEQ ID NO: 7000005 - DNA, 18 bp, Homo sapiens
acactagggatgtgagaa

SEQ ID NO: 7000006 - DNA, 22 bp, Homo sapiens
tgaggatttaatactcataagc

SEQ ID NO: 7000007 - DNA, 22 bp, Homo sapiens
tttctgtaggggatatctttga

SEQ ID NO: 7000008 - DNA, 22 bp, Homo sapiens
ccctggtggggccagacttgct

SEQ ID NO: 7000009 - DNA, 21 bp, Homo sapiens
cgacaggagaggcagccagcc

SEQ ID NO: 7000010 - DNA, 22 bp, Homo sapiens
atctggagagatcttcacaaaa

SEQ ID NO: 7000011 - DNA, 22 bp, Homo sapiens
cccaggtgggttggcctctgtc

SEQ ID NO: 7000012 - DNA, 22 bp, Homo sapiens
tttggcaagaaaatgtgattga

SEQ ID NO: 7000013 - DNA, 22 bp, Homo sapiens
taggatggtcacagagatggac

SEQ ID NO: 7000014 - DNA, 22 bp, Homo sapiens
aatgtcatttaggattatgttt

SEQ ID NO: 7000015 - DNA, 22 bp, Homo sapiens
ggggctctggagaaaggccagt

SEQ ID NO: 7000016 - DNA, 21 bp, Homo sapiens
agcgtcaatatcgtcaacagg

SEQ ID NO: 7000017 - DNA, 22 bp, Homo sapiens
ttcaaagtttcaatctgtatca

SEQ ID NO: 7000018 - DNA, 22 bp, Homo sapiens
ttgagcatctgaggattttcct

SEQ ID NO: 7000019 - DNA, 22 bp, Homo sapiens
ctccaactgatctcacagcaga

SEQ ID NO: 7000020 - DNA, 21 bp, Homo sapiens
tgtctgcctgcttcttcactc

SEQ ID NO: 7000021 - DNA, 22 bp, Homo sapiens
ctggctggggccttagataaga

SEQ ID NO: 7000022 - DNA, 22 bp, Homo sapiens
gtacttccagccaagtgagaca

SEQ ID NO: 7000023 - DNA, 22 bp, Homo sapiens
acagtagtgccatgacctacag

SEQ ID NO: 7000024 - DNA, 22 bp, Homo sapiens
gacttctgttaacttgtaagag

SEQ ID NO: 7000025 - DNA, 22 bp, Homo sapiens
tacacataggagggtaataaaa

SEQ ID NO: 7000026 - DNA, 23 bp, Homo sapiens
tctgtctgaataatttactcttt

SEQ ID NO: 7000027 - DNA, 21 bp, Homo sapiens
gccagctgggtcttgcaggag

SEQ ID NO: 7000028 - DNA, 22 bp, Homo sapiens
gacatgctaattactggttcaa

SEQ ID NO: 7000029 - DNA, 19 bp, Homo sapiens
tgtgtaaagtctgtggtca

SEQ ID NO: 7000030 - DNA, 22 bp, Homo sapiens
gacaggcttcctaagtgccaga

SEQ ID NO: 7000031 - DNA, 22 bp, Homo sapiens
ctgtttgcattaaagtatatga

SEQ ID NO: 7000032 - DNA, 22 bp, Homo sapiens
gtctctgagctctgagctggct

SEQ ID NO: 7000033 - DNA, 22 bp, Homo sapiens
agggctctgagctggaccacct

SEQ ID NO: 7000034 - DNA, 22 bp, Homo sapiens
taagctgtgggagattggcata

SEQ ID NO: 7000035 - DNA, 21 bp, Homo sapiens
tgcccaccaagctccacactg

SEQ ID NO: 7000036 - DNA, 22 bp, Homo sapiens
ttcagggcatgagggacacatc

SEQ ID NO: 7000037 - DNA, 22 bp, Homo sapiens
aaaactgaaatacgatccaatg

SEQ ID NO: 7000038 - DNA, 22 bp, Homo sapiens
tggaaagacattcagccgctgg

SEQ ID NO: 7000039 - DNA, 22 bp, Homo sapiens
cagtgtacttggaatgtaacag

SEQ ID NO: 7000040 - DNA, 17 bp, Homo sapiens
atacattgttaaagtat

SEQ ID NO: 7000041 - DNA, 22 bp, Homo sapiens
tttgagaactttggtattttcc

SEQ ID NO: 7000042 - DNA, 22 bp, Homo sapiens
ctcagtgttaaagactttccag

SEQ ID NO: 7000043 - DNA, 22 bp, Homo sapiens
gatgtacaaagagaggatttca

SEQ ID NO: 7000044 - DNA, 19 bp, Homo sapiens
tgtgttaacaggaattggt

SEQ ID NO: 7000045 - DNA, 22 bp, Homo sapiens
gggaaagagaggtggacgcagg

SEQ ID NO: 7000046 - DNA, 22 bp, Homo sapiens
gtgtgcatgtggaagcatgtat

SEQ ID NO: 7000047 - DNA, 22 bp, Homo sapiens
aaagaagggacagactgcctct

SEQ ID NO: 7000048 - DNA, 22 bp, Homo sapiens
tgccatttacgagcagtatgac

SEQ ID NO: 7000049 - DNA, 22 bp, Homo sapiens
agaggtattgcacgtgctctct

SEQ ID NO: 7000050 - DNA, 22 bp, Homo sapiens
tctcagggaccatgatgatgac

SEQ ID NO: 7000051 - DNA, 22 bp, Homo sapiens
agtcagcatatatggagtaagg

SEQ ID NO: 7000052 - DNA, 22 bp, Homo sapiens
aatctgttgatgcaaacctccc

SEQ ID NO: 7000053 - DNA, 22 bp, Homo sapiens
tgttccataagtggtgctttgt

SEQ ID NO: 7000054 - DNA, 22 bp, Homo sapiens
tatctgtcttgacatgttggtt

SEQ ID NO: 7000055 - DNA, 22 bp, Homo sapiens
cctgaatgcctgacatttcact

SEQ ID NO: 7000056 - DNA, 21 bp, Homo sapiens
ggggatgcgaccacaggctcc

SEQ ID NO: 7000057 - DNA, 22 bp, Homo sapiens
tgcatacttttaatgactgttt

SEQ ID NO: 7000058 - DNA, 22 bp, Homo sapiens
ctggccagaagcacctttggcg

SEQ ID NO: 7000059 - DNA, 22 bp, Homo sapiens
caacatctgtatcattagtaca

SEQ ID NO: 7000060 - DNA, 22 bp, Homo sapiens
aggctcagattcacatttggtt

SEQ ID NO: 7000061 - DNA, 22 bp, Homo sapiens
aagctccccgaaacccacctct

SEQ ID NO: 7000062 - DNA, 22 bp, Homo sapiens
acagttaagcagtatgatcaca

SEQ ID NO: 7000063 - DNA, 22 bp, Homo sapiens
aattaaaggtcatgttaaaggg

SEQ ID NO: 7000064 - DNA, 21 bp, Homo sapiens
tctggcagcagtttgttgagt

SEQ ID NO: 7000065 - DNA, 22 bp, Homo sapiens
tccttggcaagctgcaatggga

SEQ ID NO: 7000066 - DNA, 21 bp, Homo sapiens
ggcagctgaccgcgcggtgca

SEQ ID NO: 7000067 - DNA, 22 bp, Homo sapiens
aggagctgtcatttgattcaca

SEQ ID NO: 7000068 - DNA, 22 bp, Homo sapiens
ggtggcctggctctcaccttgg

SEQ ID NO: 7000069 - DNA, 22 bp, Homo sapiens
atgattgtctataaaggaaggg

SEQ ID NO: 7000070 - DNA, 22 bp, Homo sapiens
catgaacattcagaaatacagc

SEQ ID NO: 7000071 - DNA, 23 bp, Homo sapiens
ttatttggattttagtggaaaga

SEQ ID NO: 7000072 - DNA, 22 bp, Homo sapiens
ctgaatggaatcatccctgctt

SEQ ID NO: 7000073 - DNA, 22 bp, Homo sapiens
agctgggcctgatttgcagggg

SEQ ID NO: 7000074 - DNA, 17 bp, Homo sapiens
acttgtattgtgcttta

SEQ ID NO: 7000075 - DNA, 22 bp, Homo sapiens
acaggcagagaactcagccaga

SEQ ID NO: 7000076 - DNA, 22 bp, Homo sapiens
ctcaagaaggatgagctattgc

SEQ ID NO: 7000077 - DNA, 22 bp, Homo sapiens
acagatgttagcaatgatgatg

SEQ ID NO: 7000078 - DNA, 22 bp, Homo sapiens
acataatggacaataatgcatc

SEQ ID NO: 7000079 - DNA, 22 bp, Homo sapiens
tcaagccactggcagaagatta

SEQ ID NO: 7000080 - DNA, 22 bp, Homo sapiens
acccgccctcagccttaccgtg

SEQ ID NO: 7000081 - DNA, 19 bp, Homo sapiens
cacatacagaaaagagtaa

SEQ ID NO: 7000082 - DNA, 22 bp, Homo sapiens
ccaatacactttatagaagaaa

SEQ ID NO: 7000083 - DNA, 20 bp, Homo sapiens
agtctaggattttggcagct

SEQ ID NO: 7000084 - DNA, 22 bp, Homo sapiens
acaagtttatttgattagaaca

SEQ ID NO: 7000085 - DNA, 22 bp, Homo sapiens
taattgtcatcgtagtaaacat

SEQ ID NO: 7000086 - DNA, 22 bp, Homo sapiens
atctcctggtccacccgggcgg

SEQ ID NO: 7000087 - DNA, 22 bp, Homo sapiens
caggtccagtcactggtctgca

SEQ ID NO: 7000088 - DNA, 22 bp, Homo sapiens
caggcaacgtccttagagatgc

SEQ ID NO: 7000089 - DNA, 22 bp, Homo sapiens
agattgctaatgaagttcttga

SEQ ID NO: 7000090 - DNA, 22 bp, Homo sapiens
acaccaccgtcccagcctcctg

SEQ ID NO: 7000091 - DNA, 22 bp, Homo sapiens
ctgatttctcagttctaggaag

SEQ ID NO: 7000092 - DNA, 22 bp, Homo sapiens
aaccttcacttgcttcatttga

SEQ ID NO: 7000093 - DNA, 22 bp, Homo sapiens
agcaagagcatgtcggcctggt

SEQ ID NO: 7000094 - DNA, 22 bp, Homo sapiens
tggagagatgtctgttcaaggt

SEQ ID NO: 7000095 - DNA, 20 bp, Homo sapiens
cctcagagcgcaggccccct

SEQ ID NO: 7000096 - DNA, 22 bp, Homo sapiens
cttcctggcaaagcaatcagag

SEQ ID NO: 7000097 - DNA, 22 bp, Homo sapiens
cctcagtgtgtggatgttagag

SEQ ID NO: 7000098 - DNA, 21 bp, Homo sapiens
aggacaggaactggctgaata

SEQ ID NO: 7000099 - DNA, 22 bp, Homo sapiens
ttccaggaggcattcttagttt

SEQ ID NO: 7000100 - DNA, 22 bp, Homo sapiens
tgtttgtggttataataagtat

SEQ ID NO: 7000101 - DNA, 22 bp, Homo sapiens
ttacatcatggagggtattgaa

SEQ ID NO: 7000102 - DNA, 18 bp, Homo sapiens
tcactgtgtgtcttgggt

SEQ ID NO: 7000103 - DNA, 22 bp, Homo sapiens
ttaaggtagtcagcctctgtgt

SEQ ID NO: 7000104 - DNA, 22 bp, Homo sapiens
ggaccaggccagcctccctgcg

SEQ ID NO: 7000105 - DNA, 22 bp, Homo sapiens
tgctggagaaagtttttctgaa

SEQ ID NO: 7000106 - DNA, 22 bp, Homo sapiens
ggcctgtaatcccagctactca

SEQ ID NO: 7000107 - DNA, 22 bp, Homo sapiens
agggccagtcgtgtattactgt

SEQ ID NO: 7000108 - DNA, 22 bp, Homo sapiens
attccaaacttaccccagagga

SEQ ID NO: 7000109 - DNA, 22 bp, Homo sapiens
cctcacccactacactcaaggg

SEQ ID NO: 7000110 - DNA, 22 bp, Homo sapiens
acccttggttttgcagagctgt

SEQ ID NO: 7000111 - DNA, 19 bp, Homo sapiens
tatctttatgcagtggtgg

SEQ ID NO: 7000112 - DNA, 22 bp, Homo sapiens
tttggcaaagatggctagctgt

SEQ ID NO: 7000113 - DNA, 22 bp, Homo sapiens
aaagtttaggctttgaaaccag

SEQ ID NO: 7000114 - DNA, 21 bp, Homo sapiens
ggtgtcctgagggataggtag

SEQ ID NO: 7000115 - DNA, 22 bp, Homo sapiens
tccgagaagcataaagcaggaa

SEQ ID NO: 7000116 - DNA, 22 bp, Homo sapiens
gggatctgggacaacaggtggt

SEQ ID NO: 7000117 - DNA, 22 bp, Homo sapiens
tctggcactgggctgtgtgagc

SEQ ID NO: 7000118 - DNA, 22 bp, Homo sapiens
agaagccacaggcctcgtctgg

SEQ ID NO: 7000119 - DNA, 19 bp, Homo sapiens
ccacccctttgctgggccc

SEQ ID NO: 7000120 - DNA, 22 bp, Homo sapiens
tgggcactgaagctttgagcag

SEQ ID NO: 7000121 - DNA, 19 bp, Homo sapiens
acactgatcagatcagcag

SEQ ID NO: 7000122 - DNA, 22 bp, Homo sapiens
tcacaggaagggtaaatattta

SEQ ID NO: 7000123 - DNA, 22 bp, Homo sapiens
ttgggccaaagatgtccttgtt

SEQ ID NO: 7000124 - DNA, 22 bp, Homo sapiens
gtcactacctaagtgttgttgg

SEQ ID NO: 7000125 - DNA, 22 bp, Homo sapiens
tagcaccactggtgggaaaaac

SEQ ID NO: 7000126 - DNA, 22 bp, Homo sapiens
ttagccatgccctagaagagga

SEQ ID NO: 7000127 - DNA, 22 bp, Homo sapiens
catacagatggccaggcctcac

SEQ ID NO: 7000128 - DNA, 22 bp, Homo sapiens
gctgtcacaagcatctggggca

SEQ ID NO: 7000129 - DNA, 22 bp, Homo sapiens
atgctaaatgttaatgttacct

SEQ ID NO: 7000130 - DNA, 22 bp, Homo sapiens
tgtagaaagaatatgtttcata

SEQ ID NO: 7000131 - DNA, 22 bp, Homo sapiens
tttgcagtagacatcttatttt

SEQ ID NO: 7000132 - DNA, 22 bp, Homo sapiens
cagcagcaaggtgagggtggag

SEQ ID NO: 7000133 - DNA, 22 bp, Homo sapiens
atctggattctagatctagatc

SEQ ID NO: 7000134 - DNA, 17 bp, Homo sapiens
cataaaacagttctatt

SEQ ID NO: 7000135 - DNA, 22 bp, Homo sapiens
atgaagcagaatttcccactct

SEQ ID NO: 7000136 - DNA, 22 bp, Homo sapiens
ataggagccataaataaaatct

SEQ ID NO: 7000137 - DNA, 22 bp, Homo sapiens
accttgttaaaatgaggattct

SEQ ID NO: 7000138 - DNA, 22 bp, Homo sapiens
ctgggactgggtcctcaggaca

SEQ ID NO: 7000139 - DNA, 22 bp, Homo sapiens
tttgtcatgctttccttatgga

SEQ ID NO: 7000140 - DNA, 22 bp, Homo sapiens
gcactgaactttaatcatttct

SEQ ID NO: 7000141 - DNA, 21 bp, Homo sapiens
actgtgataatgctttttctg

SEQ ID NO: 7000142 - DNA, 22 bp, Homo sapiens
ctgcctctcagcctgaccgcca

SEQ ID NO: 7000143 - DNA, 22 bp, Homo sapiens
gacctgaccgcgtccctgccga

SEQ ID NO: 7000144 - DNA, 22 bp, Homo sapiens
acagcagtgggttgccagtggg

SEQ ID NO: 7000145 - DNA, 22 bp, Homo sapiens
tcccacaggaaagtagacattg

SEQ ID NO: 7000146 - DNA, 19 bp, Homo sapiens
gccagcacccagctgtgtc

SEQ ID NO: 7000147 - DNA, 22 bp, Homo sapiens
ctgggccagatccagcctcaca

SEQ ID NO: 7000148 - DNA, 22 bp, Homo sapiens
taacaattctcaaaagagggga

SEQ ID NO: 7000149 - DNA, 22 bp, Homo sapiens
tgcatgtgtttcccagcaagct

SEQ ID NO: 7000150 - DNA, 22 bp, Homo sapiens
gaaaggaacttgtgagtgggag

SEQ ID NO: 7000151 - DNA, 22 bp, Homo sapiens
tgtgactctcaactgattgtat

SEQ ID NO: 7000152 - DNA, 22 bp, Homo sapiens
cagcaggtcctgggcgtggcct

SEQ ID NO: 7000153 - DNA, 22 bp, Homo sapiens
ggaggtggaggttgcaatgagc

SEQ ID NO: 7000154 - DNA, 22 bp, Homo sapiens
aagccagtcctctactgggcac

SEQ ID NO: 7000155 - DNA, 21 bp, Homo sapiens
tgcagagatttttacttgtct

SEQ ID NO: 7000156 - DNA, 22 bp, Homo sapiens
cagagggaccagaacatactgt

SEQ ID NO: 7000157 - DNA, 22 bp, Homo sapiens
ggggcaggagcccttcttcagc

SEQ ID NO: 7000158 - DNA, 22 bp, Homo sapiens
aatgcattagctacatatgtct

SEQ ID NO: 7000159 - DNA, 22 bp, Homo sapiens
acatttcagaatcacacagctt

SEQ ID NO: 7000160 - DNA, 22 bp, Homo sapiens
acagactcctttccatccgtgg

SEQ ID NO: 7000161 - DNA, 22 bp, Homo sapiens
gctttggctatcatagcatttg

SEQ ID NO: 7000162 - DNA, 22 bp, Homo sapiens
gcagccttcctgacctctaccc

SEQ ID NO: 7000163 - DNA, 22 bp, Homo sapiens
atctcctcgcaggccagaacac

SEQ ID NO: 7000164 - DNA, 22 bp, Homo sapiens
tgaattcacctgaaagtctgga

SEQ ID NO: 7000165 - DNA, 18 bp, Homo sapiens
tattcctgattcatcttt

SEQ ID NO: 7000166 - DNA, 22 bp, Homo sapiens
cagataaatagacttggtcaga

SEQ ID NO: 7000167 - DNA, 22 bp, Homo sapiens
gagctttgcctaaaactagaat

SEQ ID NO: 7000168 - DNA, 23 bp, Homo sapiens
ttaatcctagtagtttggaggca

SEQ ID NO: 7000169 - DNA, 22 bp, Homo sapiens
tgacagggctgttctgttttag

SEQ ID NO: 7000170 - DNA, 22 bp, Homo sapiens
cagtctggaggtcagctggctt

SEQ ID NO: 7000171 - DNA, 22 bp, Homo sapiens
actttggacgccatgctgtttg

SEQ ID NO: 7000172 - DNA, 22 bp, Homo sapiens
tttatggttgcagaggttggag

SEQ ID NO: 7000173 - DNA, 22 bp, Homo sapiens
acttcatttcatttgcacagtg

SEQ ID NO: 7000174 - DNA, 22 bp, Homo sapiens
cctcaggcttaacttgtcttga

SEQ ID NO: 7000175 - DNA, 22 bp, Homo sapiens
ttgagactcctggtgtagaata

SEQ ID NO: 7000176 - DNA, 22 bp, Homo sapiens
cccagagagcatttggacaaag

SEQ ID NO: 7000177 - DNA, 22 bp, Homo sapiens
gggtcagtccagggcgctggga

SEQ ID NO: 7000178 - DNA, 22 bp, Homo sapiens
ggacagagggcaggagcccaga

SEQ ID NO: 7000179 - DNA, 22 bp, Homo sapiens
cagtcacatttcgacataacta

SEQ ID NO: 7000180 - DNA, 22 bp, Homo sapiens
acatacatatgacaactttcct

SEQ ID NO: 7000181 - DNA, 22 bp, Homo sapiens
gagtgatgcttctatggaacca

SEQ ID NO: 7000182 - DNA, 22 bp, Homo sapiens
accagagctcttcagcacagga

SEQ ID NO: 7000183 - DNA, 22 bp, Homo sapiens
gtggcccagccctacagaggac

SEQ ID NO: 7000184 - DNA, 22 bp, Homo sapiens
ctggcacaaatggaaaccaagc

SEQ ID NO: 7000185 - DNA, 22 bp, Homo sapiens
ctgtggtgagcaactgactgaa

SEQ ID NO: 7000186 - DNA, 22 bp, Homo sapiens
tgggagtcagacagcctgagat

SEQ ID NO: 7000187 - DNA, 22 bp, Homo sapiens
acatttttatcctgagtgccag

SEQ ID NO: 7000188 - DNA, 22 bp, Homo sapiens
gtccaaggtctttggagataga

SEQ ID NO: 7000189 - DNA, 22 bp, Homo sapiens
accagagagcctaggctgggca

SEQ ID NO: 7000190 - DNA, 21 bp, Homo sapiens
tgcagggatctttctgcctga

SEQ ID NO: 7000191 - DNA, 18 bp, Homo sapiens
gtagatccttgagctacc

SEQ ID NO: 7000192 - DNA, 22 bp, Homo sapiens
aagtcattatctcttctaatct

SEQ ID NO: 7000193 - DNA, 20 bp, Homo sapiens
tccagaggccacatccagtg

SEQ ID NO: 7000194 - DNA, 20 bp, Homo sapiens
cttagcttctaaggttctgg

SEQ ID NO: 7000195 - DNA, 22 bp, Homo sapiens
agtagacagccttgctcctgag

SEQ ID NO: 7000196 - DNA, 22 bp, Homo sapiens
agctccactccctgcctgtttc

SEQ ID NO: 7000197 - DNA, 22 bp, Homo sapiens
tctatgtaggagagagcttgac

SEQ ID NO: 7000198 - DNA, 22 bp, Homo sapiens
aattatggaatttttagagaag

SEQ ID NO: 7000199 - DNA, 22 bp, Homo sapiens
cagccactggtgccaggctgtt

SEQ ID NO: 7000200 - DNA, 22 bp, Homo sapiens
tagttttatgaattggtataat

SEQ ID NO: 7000201 - DNA, 22 bp, Homo sapiens
tggtaaggttccagatctagaa

SEQ ID NO: 7000202 - DNA, 22 bp, Homo sapiens
tttaatatctcacacttccatg

SEQ ID NO: 7000203 - DNA, 22 bp, Homo sapiens
gtcctgagtcaagtgtgggcag

SEQ ID NO: 7000204 - DNA, 22 bp, Homo sapiens
tcaaaggaatttgattttgatg

SEQ ID NO: 7000205 - DNA, 22 bp, Homo sapiens
ttctccagctcatcagggaggg

SEQ ID NO: 7000206 - DNA, 22 bp, Homo sapiens
gcaccaggcagctgagcaggcc

SEQ ID NO: 7000207 - DNA, 22 bp, Homo sapiens
tgatgatttgaaaccagtttct

SEQ ID NO: 7000208 - DNA, 22 bp, Homo sapiens
tactaattgttcacacttgttt

SEQ ID NO: 7000209 - DNA, 22 bp, Homo sapiens
ttgtatacaggtcttgtccatt

SEQ ID NO: 7000210 - DNA, 22 bp, Homo sapiens
gaggtgtctagatctaccagta

SEQ ID NO: 7000211 - DNA, 22 bp, Homo sapiens
tgtctgaattcaagaaattcaa

SEQ ID NO: 7000212 - DNA, 22 bp, Homo sapiens
aagcatcttaaaaagtatcaga

SEQ ID NO: 7000213 - DNA, 22 bp, Homo sapiens
agccctcctcacatcagcgtcc

SEQ ID NO: 7000214 - DNA, 22 bp, Homo sapiens
agaggggttatgcttgacattt

SEQ ID NO: 7000215 - DNA, 22 bp, Homo sapiens
tctcacagcagagaagggacat

SEQ ID NO: 7000216 - DNA, 21 bp, Homo sapiens
aagaggtcaaattataaatgg

SEQ ID NO: 7000217 - DNA, 22 bp, Homo sapiens
actttggtgcgaagtcacttta

SEQ ID NO: 7000218 - DNA, 22 bp, Homo sapiens
atcctgagttcctgcctctaaa

SEQ ID NO: 7000219 - DNA, 22 bp, Homo sapiens
cagctaccatggtttgttccag

SEQ ID NO: 7000220 - DNA, 21 bp, Homo sapiens
tactatgtagtgattgcagga

SEQ ID NO: 7000221 - DNA, 22 bp, Homo sapiens
gaccttggttgagcttcctaat

SEQ ID NO: 7000222 - DNA, 18 bp, Homo sapiens
gtcacagcagagaactgc

SEQ ID NO: 7000223 - DNA, 22 bp, Homo sapiens
tggcctggaaaaatgcagatgg

SEQ ID NO: 7000224 - DNA, 22 bp, Homo sapiens
acctgccagaatccaagccaca

SEQ ID NO: 7000225 - DNA, 22 bp, Homo sapiens
acttctgagaaatttaaggaca

SEQ ID NO: 7000226 - DNA, 19 bp, Homo sapiens
agctttggacttgcatttc

SEQ ID NO: 7000227 - DNA, 22 bp, Homo sapiens
tgcactatttcgccatggttgt

SEQ ID NO: 7000228 - DNA, 22 bp, Homo sapiens
tctgggagaagctgatgtgaag

SEQ ID NO: 7000229 - DNA, 22 bp, Homo sapiens
ttagctgctgattaaatatgtt

SEQ ID NO: 7000230 - DNA, 22 bp, Homo sapiens
gccttggaacaattattgctgc

SEQ ID NO: 7000231 - DNA, 18 bp, Homo sapiens
tgggaagaaattcttctc

SEQ ID NO: 7000232 - DNA, 22 bp, Homo sapiens
gctgctgatgggcagggagtcg

SEQ ID NO: 7000233 - DNA, 22 bp, Homo sapiens
atctctccttcagctgaggccc

SEQ ID NO: 7000234 - DNA, 22 bp, Homo sapiens
tttcctcctagcctccagccgc

SEQ ID NO: 7000235 - DNA, 22 bp, Homo sapiens
tcagggagtgttggcaggatca

SEQ ID NO: 7000236 - DNA, 21 bp, Homo sapiens
taggtatttctatcatgtctc

SEQ ID NO: 7000237 - DNA, 22 bp, Homo sapiens
ttgtgcatatagagttagatgg

SEQ ID NO: 7000238 - DNA, 22 bp, Homo sapiens
gctgtgagccgctgctgagcat

SEQ ID NO: 7000239 - DNA, 22 bp, Homo sapiens
aactggttctcttttgcttgtg

SEQ ID NO: 7000240 - DNA, 22 bp, Homo sapiens
gcctgagtcaagatgtggcacc

SEQ ID NO: 7000241 - DNA, 22 bp, Homo sapiens
ttagcttttcacttgcattatc

SEQ ID NO: 7000242 - DNA, 22 bp, Homo sapiens
gtgaaccaagaagtcaaagcga

SEQ ID NO: 7000243 - DNA, 22 bp, Homo sapiens
tttagcaatatcataaggaaga

SEQ ID NO: 7000244 - DNA, 22 bp, Homo sapiens
gcgtgaggcccacattctttag

SEQ ID NO: 7000245 - DNA, 22 bp, Homo sapiens
acttcacaactgtacatggcag

SEQ ID NO: 7000246 - DNA, 22 bp, Homo sapiens
tgagcacactcctggtgagcga

SEQ ID NO: 7000247 - DNA, 22 bp, Homo sapiens
aaggcatagtctttaagttctg

SEQ ID NO: 7000248 - DNA, 22 bp, Homo sapiens
agtgtcttacatgaattgattt

SEQ ID NO: 7000249 - DNA, 22 bp, Homo sapiens
tctgcaagatggtcttagaggt

SEQ ID NO: 7000250 - DNA, 22 bp, Homo sapiens
tcagggagagcctgtctgacgt

SEQ ID NO: 7000251 - DNA, 22 bp, Homo sapiens
tgaatatggcaactcttgtaac

SEQ ID NO: 7000252 - DNA, 22 bp, Homo sapiens
cagaattatagttgctttttaa

SEQ ID NO: 7000253 - DNA, 22 bp, Homo sapiens
tggcagttcaggctgcaatcat

SEQ ID NO: 7000254 - DNA, 22 bp, Homo sapiens
cagagaacttagctagttttcc

SEQ ID NO: 7000255 - DNA, 22 bp, Homo sapiens
ttgcaaattatataagggatgc

SEQ ID NO: 7000256 - DNA, 22 bp, Homo sapiens
gtatatcaggcagaatgttctc

SEQ ID NO: 7000257 - DNA, 22 bp, Homo sapiens
tagccatgtgtggaacacagcc

SEQ ID NO: 7000258 - DNA, 22 bp, Homo sapiens
aggctctgggaacagacgggtg

SEQ ID NO: 7000259 - DNA, 22 bp, Homo sapiens
atttgtaatttcttatctgtgt

SEQ ID NO: 7000260 - DNA, 22 bp, Homo sapiens
ctcctgcttcacgggcaccgcc

SEQ ID NO: 7000261 - DNA, 22 bp, Homo sapiens
gggctggaccgcgacccctgag

SEQ ID NO: 7000262 - DNA, 22 bp, Homo sapiens
tgacttctgattgcttctattt

SEQ ID NO: 7000263 - DNA, 22 bp, Homo sapiens
tcctgttggtctgtttctctcg

SEQ ID NO: 7000264 - DNA, 22 bp, Homo sapiens
tctctcaagcactatccaccca

SEQ ID NO: 7000265 - DNA, 22 bp, Homo sapiens
aatcaggactgtgccaaaccta

SEQ ID NO: 7000266 - DNA, 22 bp, Homo sapiens
agagtggggaaggtgttgagaa

SEQ ID NO: 7000267 - DNA, 22 bp, Homo sapiens
gggactggcacagggctgggag

SEQ ID NO: 7000268 - DNA, 22 bp, Homo sapiens
gcaaacatgctgagaaataaga

SEQ ID NO: 7000269 - DNA, 23 bp, Homo sapiens
atagtcatgtaaaatatttgaag

SEQ ID NO: 7000270 - DNA, 23 bp, Homo sapiens
tcttcagtgagaccagcaaggcc

SEQ ID NO: 7000271 - DNA, 22 bp, Homo sapiens
actcagaggctggaaatcaaag

SEQ ID NO: 7000272 - DNA, 22 bp, Homo sapiens
ggctggactgcctcccagagtc

SEQ ID NO: 7000273 - DNA, 15 bp, Homo sapiens
tacattcatttccac

SEQ ID NO: 7000274 - DNA, 22 bp, Homo sapiens
cagaggaagctgggtgtggagt

SEQ ID NO: 7000275 - DNA, 20 bp, Homo sapiens
ctcctgtgcctctctgggcc

SEQ ID NO: 7000276 - DNA, 22 bp, Homo sapiens
tctctgatgtatatcagagaac

SEQ ID NO: 7000277 - DNA, 20 bp, Homo sapiens
ggctccttctttcatggccc

SEQ ID NO: 7000278 - DNA, 22 bp, Homo sapiens
agctggcaatctttctaaatac

SEQ ID NO: 7000279 - DNA, 22 bp, Homo sapiens
gtgctactagtttcatttttca

SEQ ID NO: 7000280 - DNA, 22 bp, Homo sapiens
tccagactctgtcacttcctag

SEQ ID NO: 7000281 - DNA, 22 bp, Homo sapiens
cagttgatgtttagactctgca

SEQ ID NO: 7000282 - DNA, 22 bp, Homo sapiens
taaatctctgctcctcttgggt

SEQ ID NO: 7000283 - DNA, 22 bp, Homo sapiens
aatcacttaatagctacactgg

SEQ ID NO: 7000284 - DNA, 22 bp, Homo sapiens
gcaggatgccagggcagcagcg

SEQ ID NO: 7000285 - DNA, 19 bp, Homo sapiens
gactatctctggagaccat

SEQ ID NO: 7000286 - DNA, 20 bp, Homo sapiens
tctggcacactgagaagctc

SEQ ID NO: 7000287 - DNA, 22 bp, Homo sapiens
atttctcagtaatctcagcaat

SEQ ID NO: 7000288 - DNA, 22 bp, Homo sapiens
catgttaatatgcattgagtac

SEQ ID NO: 7000289 - DNA, 22 bp, Homo sapiens
tagttctataagcagatagagt

SEQ ID NO: 7000290 - DNA, 22 bp, Homo sapiens
tggccttggtcctctttgcaat

SEQ ID NO: 7000291 - DNA, 22 bp, Homo sapiens
agttactcaaggctgatataag

SEQ ID NO: 7000292 - DNA, 22 bp, Homo sapiens
caggatctgttaagttgttcca

SEQ ID NO: 7000293 - DNA, 22 bp, Homo sapiens
aagttaagggaagattccaaac

SEQ ID NO: 7000294 - DNA, 22 bp, Homo sapiens
aaatggagatgataagagggtt

SEQ ID NO: 7000295 - DNA, 22 bp, Homo sapiens
ccagccctgtcaccaactggag

SEQ ID NO: 7000296 - DNA, 22 bp, Homo sapiens
ttatggcttttatcctctcttg

SEQ ID NO: 7000297 - DNA, 22 bp, Homo sapiens
ggatctggttacgtaagagtct

SEQ ID NO: 7000298 - DNA, 22 bp, Homo sapiens
ctgggaggcaccgcgtcgtgct

SEQ ID NO: 7000299 - DNA, 22 bp, Homo sapiens
tccaggcctggctccattcagt

SEQ ID NO: 7000300 - DNA, 22 bp, Homo sapiens
agcacaagtttctggcagacag

SEQ ID NO: 7000301 - DNA, 22 bp, Homo sapiens
atgatacatttacctatggtct

SEQ ID NO: 7000302 - DNA, 22 bp, Homo sapiens
aagggtgcgacctaggagtgag

SEQ ID NO: 7000303 - DNA, 20 bp, Homo sapiens
tctgagacctttccacaccc

SEQ ID NO: 7000304 - DNA, 22 bp, Homo sapiens
ttgctggaaggtggctggaatc

SEQ ID NO: 7000305 - DNA, 22 bp, Homo sapiens
tgagctgtttctctggtggctt

SEQ ID NO: 7000306 - DNA, 22 bp, Homo sapiens
aatgtcatgggaatttattcat

SEQ ID NO: 7000307 - DNA, 20 bp, Homo sapiens
tgctggcatgcaagagggaa

SEQ ID NO: 7000308 - DNA, 22 bp, Homo sapiens
agtaactatgcttgagaatcag

SEQ ID NO: 7000309 - DNA, 21 bp, Homo sapiens
ctctgcagccctgcttccagg

SEQ ID NO: 7000310 - DNA, 22 bp, Homo sapiens
ggagggcgacagggcgaccgcg

SEQ ID NO: 7000311 - DNA, 22 bp, Homo sapiens
tccgtatttgactattgcaccg

SEQ ID NO: 7000312 - DNA, 22 bp, Homo sapiens
ctggctgtgctgactgagaggg

SEQ ID NO: 7000313 - DNA, 22 bp, Homo sapiens
caggccaccagatacatgcccc

SEQ ID NO: 7000314 - DNA, 22 bp, Homo sapiens
gttttttgggtgtatatcttct

SEQ ID NO: 7000315 - DNA, 22 bp, Homo sapiens
ggagactctcattgtcaagctt

SEQ ID NO: 7000316 - DNA, 22 bp, Homo sapiens
atatcaaacgaagttattttaa

SEQ ID NO: 7000317 - DNA, 22 bp, Homo sapiens
aaactagccacacagaatacac

SEQ ID NO: 7000318 - DNA, 22 bp, Homo sapiens
tacagacattcaattttgaccc

SEQ ID NO: 7000319 - DNA, 22 bp, Homo sapiens
tttcatcaccccaaatctatgg

SEQ ID NO: 7000320 - DNA, 22 bp, Homo sapiens
atttctgccaaagtggggacct

SEQ ID NO: 7000321 - DNA, 22 bp, Homo sapiens
agccatcatttctgtcactggc

SEQ ID NO: 7000322 - DNA, 22 bp, Homo sapiens
gatagggcttcactaggcggag

SEQ ID NO: 7000323 - DNA, 22 bp, Homo sapiens
tcagagaactccacaccttagg

SEQ ID NO: 7000324 - DNA, 22 bp, Homo sapiens
atggcaattgtaaatggaaaga

SEQ ID NO: 7000325 - DNA, 17 bp, Homo sapiens
gagaagttttgctaccg

SEQ ID NO: 7000326 - DNA, 22 bp, Homo sapiens
caaaagtaattgtggttttcac

SEQ ID NO: 7000327 - DNA, 21 bp, Homo sapiens
agcaatttcatttggtttaac

SEQ ID NO: 7000328 - DNA, 22 bp, Homo sapiens
gtaaagcaggtagttgggacac

SEQ ID NO: 7000329 - DNA, 22 bp, Homo sapiens
tagtgcaatctcttcctcagca

SEQ ID NO: 7000330 - DNA, 22 bp, Homo sapiens
ctgggccatgggccagcgaggc

SEQ ID NO: 7000331 - DNA, 22 bp, Homo sapiens
gtccttaaagagagcatcattc

SEQ ID NO: 7000332 - DNA, 19 bp, Homo sapiens
tgtcttaattaactcagag

SEQ ID NO: 7000333 - DNA, 19 bp, Homo sapiens
tcctgctgtgtgaagggga

SEQ ID NO: 7000334 - DNA, 22 bp, Homo sapiens
ttcagtcagtgactaagcagtt

SEQ ID NO: 7000335 - DNA, 22 bp, Homo sapiens
gatgttgagtatcaatgcttta

SEQ ID NO: 7000336 - DNA, 22 bp, Homo sapiens
aagtgttagggtaaagttggta

SEQ ID NO: 7000337 - DNA, 21 bp, Homo sapiens
atttagaaggaaattttgcaa

SEQ ID NO: 7000338 - DNA, 22 bp, Homo sapiens
tgcaaagaactaagcagcctta

SEQ ID NO: 7000339 - DNA, 23 bp, Homo sapiens
gtcagggcagctcccagcccaac

SEQ ID NO: 7000340 - DNA, 22 bp, Homo sapiens
atcatcttatctgactcatttt

SEQ ID NO: 7000341 - DNA, 22 bp, Homo sapiens
acttcacagatatttatttggt

SEQ ID NO: 7000342 - DNA, 22 bp, Homo sapiens
ttccaggaattcagctctcagt

SEQ ID NO: 7000343 - DNA, 19 bp, Homo sapiens
tgctccattgaggtgtctc

SEQ ID NO: 7000344 - DNA, 22 bp, Homo sapiens
gtggcagctgtgggacactggt

SEQ ID NO: 7000345 - DNA, 22 bp, Homo sapiens
gccacagggcgagcggaggcca

SEQ ID NO: 7000346 - DNA, 22 bp, Homo sapiens
tgcccagggtggagtgcagtgg

SEQ ID NO: 7000347 - DNA, 22 bp, Homo sapiens
tataccatgtgtgcacactccc

SEQ ID NO: 7000348 - DNA, 22 bp, Homo sapiens
tcaaggtgatggtcttgttttc

SEQ ID NO: 7000349 - DNA, 22 bp, Homo sapiens
tttgtacttcattggttctact

SEQ ID NO: 7000350 - DNA, 22 bp, Homo sapiens
gcaggaaaggttgagactttgc

SEQ ID NO: 7000351 - DNA, 22 bp, Homo sapiens
tatgtgtgcatgtatacattaa

SEQ ID NO: 7000352 - DNA, 20 bp, Homo sapiens
cagtatctcgctctcccaat

SEQ ID NO: 7000353 - DNA, 22 bp, Homo sapiens
ggctttattaagcagggtaagt

SEQ ID NO: 7000354 - DNA, 22 bp, Homo sapiens
tagcttaaggcaggcccttgtc

SEQ ID NO: 7000355 - DNA, 22 bp, Homo sapiens
ctgtatgttccgttttgtcact

SEQ ID NO: 7000356 - DNA, 22 bp, Homo sapiens
gacaggaagtctgaaggaggga

SEQ ID NO: 7000357 - DNA, 22 bp, Homo sapiens
tggcaggaaccttaaccacaaa

SEQ ID NO: 7000358 - DNA, 22 bp, Homo sapiens
agagataaggattgtttttctc

SEQ ID NO: 7000359 - DNA, 22 bp, Homo sapiens
agctgccctgtggggagggttg

SEQ ID NO: 7000360 - DNA, 23 bp, Homo sapiens
gtgagcagcaccatgaggctaga

SEQ ID NO: 7000361 - DNA, 22 bp, Homo sapiens
gggatctgtgttgcgatggatt

SEQ ID NO: 7000362 - DNA, 22 bp, Homo sapiens
aaagtacaaggaaaggatctga

SEQ ID NO: 7000363 - DNA, 22 bp, Homo sapiens
tttaagatttcttctcctgaga

SEQ ID NO: 7000364 - DNA, 22 bp, Homo sapiens
ttgctgttgatgatgtgataca

SEQ ID NO: 7000365 - DNA, 22 bp, Homo sapiens
tccatacagtccacacggtgca

SEQ ID NO: 7000366 - DNA, 22 bp, Homo sapiens
aaagcaatgtctctgcctggtt

SEQ ID NO: 7000367 - DNA, 20 bp, Homo sapiens
ttcagtctcctgcttccttc

SEQ ID NO: 7000368 - DNA, 22 bp, Homo sapiens
acatgcatctccaggctcattt

SEQ ID NO: 7000369 - DNA, 22 bp, Homo sapiens
taggggcagaagcggcggtcca

SEQ ID NO: 7000370 - DNA, 22 bp, Homo sapiens
ctgctgagagccccagctgaga

SEQ ID NO: 7000371 - DNA, 22 bp, Homo sapiens
gtgagcaaaggttaaacattta

SEQ ID NO: 7000372 - DNA, 22 bp, Homo sapiens
gatatgtattgaatgatcattt

SEQ ID NO: 7000373 - DNA, 22 bp, Homo sapiens
ctaggcaagagtttattatggt

SEQ ID NO: 7000374 - DNA, 22 bp, Homo sapiens
gcaaattgaatccagtaataaa

SEQ ID NO: 7000375 - DNA, 18 bp, Homo sapiens
tgctcacactgacctctg

SEQ ID NO: 7000376 - DNA, 22 bp, Homo sapiens
cagcatcgtgtggaaagtggta

SEQ ID NO: 7000377 - DNA, 22 bp, Homo sapiens
cagaatgtagatcatcatcaag

SEQ ID NO: 7000378 - DNA, 21 bp, Homo sapiens
cagtataacgttgggctcttc

SEQ ID NO: 7000379 - DNA, 22 bp, Homo sapiens
ttcatataaatggaatcagaat

SEQ ID NO: 7000380 - DNA, 22 bp, Homo sapiens
ctagggtctgttttccaggtgt

SEQ ID NO: 7000381 - DNA, 22 bp, Homo sapiens
gagctgaattacggtgagtcat

SEQ ID NO: 7000382 - DNA, 22 bp, Homo sapiens
aatgcttcaacctcccacatgt

SEQ ID NO: 7000383 - DNA, 22 bp, Homo sapiens
gggtggtgagatgtagctgatg

SEQ ID NO: 7000384 - DNA, 22 bp, Homo sapiens
cggggcctaccgctgcgtggcc

SEQ ID NO: 7000385 - DNA, 22 bp, Homo sapiens
actctaaattgtgccaatatgc

SEQ ID NO: 7000386 - DNA, 22 bp, Homo sapiens
agctgtggaagactgtcagggt

SEQ ID NO: 7000387 - DNA, 22 bp, Homo sapiens
ctaattgttaggtgtctgatgt

SEQ ID NO: 7000388 - DNA, 19 bp, Homo sapiens
atggcagcagcagctctcc

SEQ ID NO: 7000389 - DNA, 22 bp, Homo sapiens
gggtctctcctccccagctgtg

SEQ ID NO: 7000390 - DNA, 22 bp, Homo sapiens
tgtcacaagtaactggcaatgc

SEQ ID NO: 7000391 - DNA, 22 bp, Homo sapiens
cactaattaatgaaattccagg

SEQ ID NO: 7000392 - DNA, 22 bp, Homo sapiens
taggaaatggctcagttactgc

SEQ ID NO: 7000393 - DNA, 22 bp, Homo sapiens
catcactgcttctaaaatggtg

SEQ ID NO: 7000394 - DNA, 22 bp, Homo sapiens
atggaagaaagagacaatttga

SEQ ID NO: 7000395 - DNA, 22 bp, Homo sapiens
agctggcttctctgcagacatt

SEQ ID NO: 7000396 - DNA, 22 bp, Homo sapiens
acatctgagcaacagaacacta

SEQ ID NO: 7000397 - DNA, 22 bp, Homo sapiens
taggccaggagtcagacagatt

SEQ ID NO: 7000398 - DNA, 22 bp, Homo sapiens
gggctgagcacatactgacagc

SEQ ID NO: 7000399 - DNA, 22 bp, Homo sapiens
ggagctggagagtacagagttt

SEQ ID NO: 7000400 - DNA, 22 bp, Homo sapiens
ttagtgcttgttttaaaaatat

SEQ ID NO: 7000401 - DNA, 22 bp, Homo sapiens
taaatgcagcagtttctgttct

SEQ ID NO: 7000402 - DNA, 22 bp, Homo sapiens
cagatgtgattcttccctcagc

SEQ ID NO: 7000403 - DNA, 22 bp, Homo sapiens
gggcaggtaggtgaaataatga

SEQ ID NO: 7000404 - DNA, 21 bp, Homo sapiens
tacatgagtgtatgagcatat

SEQ ID NO: 7000405 - DNA, 20 bp, Homo sapiens
cttagaaatttttaccctgg

SEQ ID NO: 7000406 - DNA, 22 bp, Homo sapiens
gggtggcaccacgtgtcttcaa

SEQ ID NO: 7000407 - DNA, 22 bp, Homo sapiens
ctctcagggtccctgcggagga

SEQ ID NO: 7000408 - DNA, 22 bp, Homo sapiens
tttcaggcaggtggaatgagta

SEQ ID NO: 7000409 - DNA, 22 bp, Homo sapiens
aatgtgattttcccagtagaat

SEQ ID NO: 7000410 - DNA, 20 bp, Homo sapiens
ggtagcagctgctgtcatcc

SEQ ID NO: 7000411 - DNA, 22 bp, Homo sapiens
atgctctagagctcttttcact

SEQ ID NO: 7000412 - DNA, 22 bp, Homo sapiens
agaagtgagactcagttgatga

SEQ ID NO: 7000413 - DNA, 22 bp, Homo sapiens
ggtatggatcagatgggctcaa

SEQ ID NO: 7000414 - DNA, 22 bp, Homo sapiens
tagtaaattaaaatattgactt

SEQ ID NO: 7000415 - DNA, 22 bp, Homo sapiens
gagactttttaatcactaggaa

SEQ ID NO: 7000416 - DNA, 23 bp, Homo sapiens
ccacaattgagagattctgcaat

SEQ ID NO: 7000417 - DNA, 22 bp, Homo sapiens
tttctcatagtcatgcctctta

SEQ ID NO: 7000418 - DNA, 17 bp, Homo sapiens
ttggggattgattactt

SEQ ID NO: 7000419 - DNA, 22 bp, Homo sapiens
cctgtgacgtgtctcctggcac

SEQ ID NO: 7000420 - DNA, 22 bp, Homo sapiens
tcaacgtagatcttctgtgtat

SEQ ID NO: 7000421 - DNA, 22 bp, Homo sapiens
caacaagtgggtactttacagg

SEQ ID NO: 7000422 - DNA, 22 bp, Homo sapiens
aggctgctctgcgaagtcagct

SEQ ID NO: 7000423 - DNA, 22 bp, Homo sapiens
gtcctggtagctggcttggtca

SEQ ID NO: 7000424 - DNA, 19 bp, Homo sapiens
acagtcttacaaatgtcca

SEQ ID NO: 7000425 - DNA, 22 bp, Homo sapiens
atgtatgatgctaggctctcag

SEQ ID NO: 7000426 - DNA, 22 bp, Homo sapiens
ccaaacaaatccccattcttag

SEQ ID NO: 7000427 - DNA, 22 bp, Homo sapiens
tgttcattaaactactgtgtgg

SEQ ID NO: 7000428 - DNA, 22 bp, Homo sapiens
tgtatgaatatgtattttcata

SEQ ID NO: 7000429 - DNA, 22 bp, Homo sapiens
agccaccaccactgaaaggtta

SEQ ID NO: 7000430 - DNA, 22 bp, Homo sapiens
tagctcttgccagatcctcgat

SEQ ID NO: 7000431 - DNA, 22 bp, Homo sapiens
ttggctgaactgagctccatcg

SEQ ID NO: 7000432 - DNA, 22 bp, Homo sapiens
tgtttgaaaagtggagatttat

SEQ ID NO: 7000433 - DNA, 22 bp, Homo sapiens
gaacacagtacttttcctgatg

SEQ ID NO: 7000434 - DNA, 22 bp, Homo sapiens
cttcctcccggcccatgctctg

SEQ ID NO: 7000435 - DNA, 22 bp, Homo sapiens
tacaaagaggcagctccatttt

SEQ ID NO: 7000436 - DNA, 22 bp, Homo sapiens
gctgcagcagctgcagggttgt

SEQ ID NO: 7000437 - DNA, 19 bp, Homo sapiens
atcccaaggagctgggact

SEQ ID NO: 7000438 - DNA, 18 bp, Homo sapiens
cccaccctggctcttagt

SEQ ID NO: 7000439 - DNA, 22 bp, Homo sapiens
gacatcatatcaggaggcatgt

SEQ ID NO: 7000440 - DNA, 22 bp, Homo sapiens
gagcagctctgggtgacccagt

SEQ ID NO: 7000441 - DNA, 22 bp, Homo sapiens
tctttgaatttctgactgtctt

SEQ ID NO: 7000442 - DNA, 20 bp, Homo sapiens
tcaaagacaagctctcatcc

SEQ ID NO: 7000443 - DNA, 22 bp, Homo sapiens
attctggggctggttattttga

SEQ ID NO: 7000444 - DNA, 19 bp, Homo sapiens
agtgtcatcagctactcag

SEQ ID NO: 7000445 - DNA, 22 bp, Homo sapiens
ctgcatgtcactctgctgtccc

SEQ ID NO: 7000446 - DNA, 22 bp, Homo sapiens
tcacaggcaaagaagattggtg

SEQ ID NO: 7000447 - DNA, 22 bp, Homo sapiens
ttaacagctgttgcttctcttc

SEQ ID NO: 7000448 - DNA, 23 bp, Homo sapiens
tttctcaaagagtggcagcttca

SEQ ID NO: 7000449 - DNA, 22 bp, Homo sapiens
tgtttcaaaacagtgataattt

SEQ ID NO: 7000450 - DNA, 22 bp, Homo sapiens
tggcaagcctgagatccgggag

SEQ ID NO: 7000451 - DNA, 22 bp, Homo sapiens
aggtgggcatagctagaatatt

SEQ ID NO: 7000452 - DNA, 22 bp, Homo sapiens
tgaaaaactgaatagttgagta

SEQ ID NO: 7000453 - DNA, 22 bp, Homo sapiens
tgcagagtcccaggacccagag

SEQ ID NO: 7000454 - DNA, 18 bp, Homo sapiens
tgtggacatggctcttca

SEQ ID NO: 7000455 - DNA, 22 bp, Homo sapiens
agagactgatggagctcactct

SEQ ID NO: 7000456 - DNA, 22 bp, Homo sapiens
atcattccacatgtaccactag

SEQ ID NO: 7000457 - DNA, 22 bp, Homo sapiens
tgcaattttttagcacaaggag

SEQ ID NO: 7000458 - DNA, 22 bp, Homo sapiens
gtgcaaaagcagttgtggtttt

SEQ ID NO: 7000459 - DNA, 22 bp, Homo sapiens
gtgattcatcctggcattcatt

SEQ ID NO: 7000460 - DNA, 17 bp, Homo sapiens
ggttggcttatcccagg

SEQ ID NO: 7000461 - DNA, 22 bp, Homo sapiens
tcatttgttacagccacatacc

SEQ ID NO: 7000462 - DNA, 22 bp, Homo sapiens
tgtctgtgcccaaggctcccgg

SEQ ID NO: 7000463 - DNA, 22 bp, Homo sapiens
atgtttaagaaagtcttccata

SEQ ID NO: 7000464 - DNA, 22 bp, Homo sapiens
taacaagaaatacattggttct

SEQ ID NO: 7000465 - DNA, 22 bp, Homo sapiens
cccaggaagtggaggttgcagt

SEQ ID NO: 7000466 - DNA, 22 bp, Homo sapiens
agaggactgttggtcttagaaa

SEQ ID NO: 7000467 - DNA, 22 bp, Homo sapiens
tttctacatttgtaaccagatt

SEQ ID NO: 7000468 - DNA, 22 bp, Homo sapiens
gggctgcactagggcaaggtga

SEQ ID NO: 7000469 - DNA, 20 bp, Homo sapiens
attcacaaagccagtgttgc

SEQ ID NO: 7000470 - DNA, 22 bp, Homo sapiens
gtggatggattgaggcagtggg

SEQ ID NO: 7000471 - DNA, 22 bp, Homo sapiens
ggctgaaggatgaaagctgcag

SEQ ID NO: 7000472 - DNA, 22 bp, Homo sapiens
ggttgttgtgaaggtgaagaga

SEQ ID NO: 7000473 - DNA, 22 bp, Homo sapiens
ttgctgatgagtcattggttta

SEQ ID NO: 7000474 - DNA, 22 bp, Homo sapiens
tgtcagcaagacatcagagtga

SEQ ID NO: 7000475 - DNA, 22 bp, Homo sapiens
gaggccacgtgcttatgtttct

SEQ ID NO: 7000476 - DNA, 19 bp, Homo sapiens
taaaaactgaaggaagcag

SEQ ID NO: 7000477 - DNA, 22 bp, Homo sapiens
ttggctgagccatgtgaaacca

SEQ ID NO: 7000478 - DNA, 22 bp, Homo sapiens
ttattactgtattaatccagag

SEQ ID NO: 7000479 - DNA, 21 bp, Homo sapiens
cagaatgcattctttgaagga

SEQ ID NO: 7000480 - DNA, 22 bp, Homo sapiens
ccgggggactactgggaaactg

SEQ ID NO: 7000481 - DNA, 22 bp, Homo sapiens
acttgggaggctgaaggacatt

SEQ ID NO: 7000482 - DNA, 22 bp, Homo sapiens
cctcttcaggcactcgaaggcc

SEQ ID NO: 7000483 - DNA, 22 bp, Homo sapiens
tgcatatctggggatagggatg

SEQ ID NO: 7000484 - DNA, 22 bp, Homo sapiens
tgagctgtctatggtcctgtct

SEQ ID NO: 7000485 - DNA, 22 bp, Homo sapiens
cacaagtctgtggtctccaaca

SEQ ID NO: 7000486 - DNA, 22 bp, Homo sapiens
tggctggagagggtcccatgag

SEQ ID NO: 7000487 - DNA, 22 bp, Homo sapiens
tccttgaaaagaatgtctccat

SEQ ID NO: 7000488 - DNA, 22 bp, Homo sapiens
atgtttctaaaacttgcatggc

SEQ ID NO: 7000489 - DNA, 22 bp, Homo sapiens
cctgctgtccctctgggctcca

SEQ ID NO: 7000490 - DNA, 22 bp, Homo sapiens
tgaggcaaagacaaagcagcat

SEQ ID NO: 7000491 - DNA, 22 bp, Homo sapiens
acatgtttgataaatatttggg

SEQ ID NO: 7000492 - DNA, 22 bp, Homo sapiens
gcccaggagttgaagggctgac

SEQ ID NO: 7000493 - DNA, 22 bp, Homo sapiens
cttgaaagatttggcctctgtg

SEQ ID NO: 7000494 - DNA, 22 bp, Homo sapiens
gatacataaaaatgtgctctat

SEQ ID NO: 7000495 - DNA, 22 bp, Homo sapiens
aaaatgagccatgaaccaacca

SEQ ID NO: 7000496 - DNA, 22 bp, Homo sapiens
ataaaggctggctgctgtgagc

SEQ ID NO: 7000497 - DNA, 22 bp, Homo sapiens
atggcagggcccttggctccca

SEQ ID NO: 7000498 - DNA, 23 bp, Homo sapiens
aaaggcacagcattgtctagcag

SEQ ID NO: 7000499 - DNA, 18 bp, Homo sapiens
attgagcacttaccatgt

SEQ ID NO: 7000500 - DNA, 21 bp, Homo sapiens
aagatccaagcaggcacttgt

SEQ ID NO: 7000501 - DNA, 22 bp, Homo sapiens
ctgagccctgcctcttgtcact

SEQ ID NO: 7000502 - DNA, 22 bp, Homo sapiens
ctgggtgccagcatggctgagt

SEQ ID NO: 7000503 - DNA, 22 bp, Homo sapiens
ctccttcccctactcagcatcc

SEQ ID NO: 7000504 - DNA, 22 bp, Homo sapiens
tcatagctaagctccagagtgc

SEQ ID NO: 7000505 - DNA, 22 bp, Homo sapiens
attagaggttgttttgtaaaga

SEQ ID NO: 7000506 - DNA, 22 bp, Homo sapiens
tctgctgtcttttctgggtgag

SEQ ID NO: 7000507 - DNA, 22 bp, Homo sapiens
gcaattatttttgcaccaatgt

SEQ ID NO: 7000508 - DNA, 22 bp, Homo sapiens
tgctgctagctgtattgcaaga

SEQ ID NO: 7000509 - DNA, 22 bp, Homo sapiens
ggtgggagggctgcgttcctct

SEQ ID NO: 7000510 - DNA, 22 bp, Homo sapiens
ggacatttagtttcattgggca

SEQ ID NO: 7000511 - DNA, 22 bp, Homo sapiens
ctttcataaaggaaatgatgag

SEQ ID NO: 7000512 - DNA, 23 bp, Homo sapiens
gggggagctggactcctagatcc

SEQ ID NO: 7000513 - DNA, 22 bp, Homo sapiens
gccaagcctgggaagagcccat

SEQ ID NO: 7000514 - DNA, 22 bp, Homo sapiens
gggaaggaaatcttgcttgtga

SEQ ID NO: 7000515 - DNA, 22 bp, Homo sapiens
actcagagaactggattagagg

SEQ ID NO: 7000516 - DNA, 22 bp, Homo sapiens
agggaaggcttttgacatttcc

SEQ ID NO: 7000517 - DNA, 22 bp, Homo sapiens
agctttgcttctgggagccaag

SEQ ID NO: 7000518 - DNA, 22 bp, Homo sapiens
ttagggaaataaaattatcagt

SEQ ID NO: 7000519 - DNA, 22 bp, Homo sapiens
gtgcctgggacacagcagatac

SEQ ID NO: 7000520 - DNA, 22 bp, Homo sapiens
ctcgcaggacagtgctaggact

SEQ ID NO: 7000521 - DNA, 22 bp, Homo sapiens
gggtggccttaggcaagtcact

SEQ ID NO: 7000522 - DNA, 22 bp, Homo sapiens
taatactgtaacttggtgggtc

SEQ ID NO: 7000523 - DNA, 22 bp, Homo sapiens
ttcacagtttgctgggacagga

SEQ ID NO: 7000524 - DNA, 22 bp, Homo sapiens
taattgctttatcctgttagaa

SEQ ID NO: 7000525 - DNA, 22 bp, Homo sapiens
tgtgtatacatacatacacacg

SEQ ID NO: 7000526 - DNA, 18 bp, Homo sapiens
ccagctgcgctgaaccga

SEQ ID NO: 7000527 - DNA, 22 bp, Homo sapiens
aaagcaatttaatggaccatga

SEQ ID NO: 7000528 - DNA, 22 bp, Homo sapiens
ttcttacaagtatgacgtagca

SEQ ID NO: 7000529 - DNA, 22 bp, Homo sapiens
ttctccttgttcccttcaattg

SEQ ID NO: 7000530 - DNA, 22 bp, Homo sapiens
aaatctctggtcacagaactta

SEQ ID NO: 7000531 - DNA, 22 bp, Homo sapiens
gtgcagttgtggacatgacaac

SEQ ID NO: 7000532 - DNA, 22 bp, Homo sapiens
tacgacacatctgatctcaaaa

SEQ ID NO: 7000533 - DNA, 21 bp, Homo sapiens
tgtgttttaatgatattctgt

SEQ ID NO: 7000534 - DNA, 22 bp, Homo sapiens
atacatgtgctatgttggtgta

SEQ ID NO: 7000535 - DNA, 22 bp, Homo sapiens
tcaatgttcaagtatgacaatg

SEQ ID NO: 7000536 - DNA, 22 bp, Homo sapiens
tgctccagcaacaggcttagct

SEQ ID NO: 7000537 - DNA, 22 bp, Homo sapiens
gaccctggggaccatctagccc

SEQ ID NO: 7000538 - DNA, 22 bp, Homo sapiens
cctgtcattttctcctgtcagc

SEQ ID NO: 7000539 - DNA, 22 bp, Homo sapiens
cctggctccctgcacagggctc

SEQ ID NO: 7000540 - DNA, 22 bp, Homo sapiens
ctgtatgtttctatgaatgtga

SEQ ID NO: 7000541 - DNA, 22 bp, Homo sapiens
agtttgaagaaggatctatgaa

SEQ ID NO: 7000542 - DNA, 22 bp, Homo sapiens
tggggctctccacagtgtctca

SEQ ID NO: 7000543 - DNA, 22 bp, Homo sapiens
ggccaagaatgataggctcagt

SEQ ID NO: 7000544 - DNA, 22 bp, Homo sapiens
tgcggcaggagaaggtgttatg

SEQ ID NO: 7000545 - DNA, 20 bp, Homo sapiens
cttcaagttatggttggcaa

SEQ ID NO: 7000546 - DNA, 22 bp, Homo sapiens
agtgtatgaacttaagagagag

SEQ ID NO: 7000547 - DNA, 22 bp, Homo sapiens
tgggccaacaggaggtctagga

SEQ ID NO: 7000548 - DNA, 22 bp, Homo sapiens
tcctcagacaccctgctggctt

SEQ ID NO: 7000549 - DNA, 22 bp, Homo sapiens
agataagatagtccagcacaat

SEQ ID NO: 7000550 - DNA, 22 bp, Homo sapiens
ggctgcctgaactttggggaaa

SEQ ID NO: 7000551 - DNA, 22 bp, Homo sapiens
tgcccagctgtcaaagtagata

SEQ ID NO: 7000552 - DNA, 20 bp, Homo sapiens
tcaggagcctaggacatgat

SEQ ID NO: 7000553 - DNA, 22 bp, Homo sapiens
cttgctcattaagtagctcaca

SEQ ID NO: 7000554 - DNA, 23 bp, Homo sapiens
agcatgttgtgatgttaccactg

SEQ ID NO: 7000555 - DNA, 22 bp, Homo sapiens
gttggcagaaagctttcgatcg

SEQ ID NO: 7000556 - DNA, 22 bp, Homo sapiens
ttatataaagataacttttctt

SEQ ID NO: 7000557 - DNA, 22 bp, Homo sapiens
gagtgtctatgtttagtctttc

SEQ ID NO: 7000558 - DNA, 22 bp, Homo sapiens
tcctgcctcttgccttcttcac

SEQ ID NO: 7000559 - DNA, 22 bp, Homo sapiens
cagctggtgaactagtttttca

SEQ ID NO: 7000560 - DNA, 22 bp, Homo sapiens
taacaactggacaatgttgctc

SEQ ID NO: 7000561 - DNA, 19 bp, Homo sapiens
tttaagcatagaggccaga

SEQ ID NO: 7000562 - DNA, 22 bp, Homo sapiens
tttggaattctgcagctcatgt

SEQ ID NO: 7000563 - DNA, 19 bp, Homo sapiens
atctggacatgtgccaggt

SEQ ID NO: 7000564 - DNA, 22 bp, Homo sapiens
ttatgctaagtggaataagcca

SEQ ID NO: 7000565 - DNA, 22 bp, Homo sapiens
aagtgattctgatgtgtttctt

SEQ ID NO: 7000566 - DNA, 22 bp, Homo sapiens
ccctgctgaatcccatggagtc

SEQ ID NO: 7000567 - DNA, 22 bp, Homo sapiens
tcttctcccatcggccgcaggg

SEQ ID NO: 7000568 - DNA, 22 bp, Homo sapiens
gtatgtcatgagccttgtgcgt

SEQ ID NO: 7000569 - DNA, 22 bp, Homo sapiens
caacctatgggggaaggacttt

SEQ ID NO: 7000570 - DNA, 22 bp, Homo sapiens
atagtatttccagaaatagtct

SEQ ID NO: 7000571 - DNA, 22 bp, Homo sapiens
atccagtttatgtcatattctt

SEQ ID NO: 7000572 - DNA, 22 bp, Homo sapiens
tcaagtctcaatgtattatggt

SEQ ID NO: 7000573 - DNA, 22 bp, Homo sapiens
ctactctcccatgattctctgt

SEQ ID NO: 7000574 - DNA, 22 bp, Homo sapiens
ctgtagcagctgacctggctaa

SEQ ID NO: 7000575 - DNA, 22 bp, Homo sapiens
acaggtacaagggattaggatg

SEQ ID NO: 7000576 - DNA, 22 bp, Homo sapiens
tcagatttcagctaaagggatg

SEQ ID NO: 7000577 - DNA, 22 bp, Homo sapiens
gaggatggtgagcaggacccag

SEQ ID NO: 7000578 - DNA, 22 bp, Homo sapiens
taagaaactattgtctctgaac

SEQ ID NO: 7000579 - DNA, 22 bp, Homo sapiens
tcagctatgttttggaacaggg

SEQ ID NO: 7000580 - DNA, 18 bp, Homo sapiens
gtcactagttcaaacttc

SEQ ID NO: 7000581 - DNA, 21 bp, Homo sapiens
tctgatgtgtttaatggtggg

SEQ ID NO: 7000582 - DNA, 22 bp, Homo sapiens
ttcaattctgctctgatcttag

SEQ ID NO: 7000583 - DNA, 15 bp, Homo sapiens
tgctgagttctgctg

SEQ ID NO: 7000584 - DNA, 22 bp, Homo sapiens
aaggtatcagtaaagctctgcc

SEQ ID NO: 7000585 - DNA, 22 bp, Homo sapiens
atgtccagagtgtcctggaaag

SEQ ID NO: 7000586 - DNA, 19 bp, Homo sapiens
ggccacctctcttcccagg

SEQ ID NO: 7000587 - DNA, 22 bp, Homo sapiens
agcctgtgtgctttggacaggg

SEQ ID NO: 7000588 - DNA, 22 bp, Homo sapiens
agggctgctaccttaatcagtt

SEQ ID NO: 7000589 - DNA, 22 bp, Homo sapiens
attgacagtgttaaagttgcct

SEQ ID NO: 7000590 - DNA, 23 bp, Homo sapiens
cctcaggggacctgtgagcctga

SEQ ID NO: 7000591 - DNA, 22 bp, Homo sapiens
aggctggcaaggcagatgtgtg

SEQ ID NO: 7000592 - DNA, 22 bp, Homo sapiens
actctctgagctaccaggtgag

SEQ ID NO: 7000593 - DNA, 22 bp, Homo sapiens
cctccaggataagtcagggcct

SEQ ID NO: 7000594 - DNA, 22 bp, Homo sapiens
tctcattgaaatgtgactgagt

SEQ ID NO: 7000595 - DNA, 22 bp, Homo sapiens
ttcacttatagggatgttattg

SEQ ID NO: 7000596 - DNA, 22 bp, Homo sapiens
tggcattggttgccaggctgtg

SEQ ID NO: 7000597 - DNA, 22 bp, Homo sapiens
gctctggttccagttccgcacc

SEQ ID NO: 7000598 - DNA, 22 bp, Homo sapiens
tgtggctctgcctggcagtatt

SEQ ID NO: 7000599 - DNA, 22 bp, Homo sapiens
gggacagacccatgggccaggt

SEQ ID NO: 7000600 - DNA, 22 bp, Homo sapiens
ctgaaccactaatattttgatt

SEQ ID NO: 7000601 - DNA, 22 bp, Homo sapiens
atttctggactgaaaaggaagt

SEQ ID NO: 7000602 - DNA, 22 bp, Homo sapiens
cacattggcaaacggggttgca

SEQ ID NO: 7000603 - DNA, 22 bp, Homo sapiens
gacagggaggaaagagactgct

SEQ ID NO: 7000604 - DNA, 22 bp, Homo sapiens
agatgtcagctcacatgccacc

SEQ ID NO: 7000605 - DNA, 22 bp, Homo sapiens
ccagtcgtgacaaccaaaaata

SEQ ID NO: 7000606 - DNA, 20 bp, Homo sapiens
agctgcatatttatgtgtac

SEQ ID NO: 7000607 - DNA, 20 bp, Homo sapiens
tgaggatgtctacgttttaa

SEQ ID NO: 7000608 - DNA, 22 bp, Homo sapiens
agctggctttgagctgggaggt

SEQ ID NO: 7000609 - DNA, 22 bp, Homo sapiens
tgtgaaatcaattagctgcaga

SEQ ID NO: 7000610 - DNA, 22 bp, Homo sapiens
tgggctgctgagaatgagagag

SEQ ID NO: 7000611 - DNA, 22 bp, Homo sapiens
tggcacttaaaaattattcttc

SEQ ID NO: 7000612 - DNA, 22 bp, Homo sapiens
cacaaggacctcagatggatga

SEQ ID NO: 7000613 - DNA, 22 bp, Homo sapiens
tggcaccaggcggggtggctgt

SEQ ID NO: 7000614 - DNA, 22 bp, Homo sapiens
gccacctcggctttctctgctc

SEQ ID NO: 7000615 - DNA, 18 bp, Homo sapiens
tcctgtggcccagagttt

SEQ ID NO: 7000616 - DNA, 22 bp, Homo sapiens
ctgtgaattgcaacaattgcaa

SEQ ID NO: 7000617 - DNA, 22 bp, Homo sapiens
tttgacaaaggaaaaatgcaca

SEQ ID NO: 7000618 - DNA, 22 bp, Homo sapiens
cctgggtgatgtgctgccctcg

SEQ ID NO: 7000619 - DNA, 22 bp, Homo sapiens
atccccaggggcattcaagctt

SEQ ID NO: 7000620 - DNA, 22 bp, Homo sapiens
agacataaacttactgaaatac

SEQ ID NO: 7000621 - DNA, 22 bp, Homo sapiens
cgtctggcttctccacggtaaa

SEQ ID NO: 7000622 - DNA, 22 bp, Homo sapiens
gtcctgtgtactcctgatactt

SEQ ID NO: 7000623 - DNA, 22 bp, Homo sapiens
cctgttcaatattcttccttgt

SEQ ID NO: 7000624 - DNA, 22 bp, Homo sapiens
acagaacttcctgctggagtgg

SEQ ID NO: 7000625 - DNA, 23 bp, Homo sapiens
ggtcacatgtgagattaaacttg

SEQ ID NO: 7000626 - DNA, 22 bp, Homo sapiens
ggcgcggcctctgggtcggttt

SEQ ID NO: 7000627 - DNA, 22 bp, Homo sapiens
gactgtggctgcgtgtaaggaa

SEQ ID NO: 7000628 - DNA, 22 bp, Homo sapiens
gtctgtgcttattcagcagggg

SEQ ID NO: 7000629 - DNA, 22 bp, Homo sapiens
cacaccttaggcctgagcgctt

SEQ ID NO: 7000630 - DNA, 20 bp, Homo sapiens
accaggccccgggccctgca

SEQ ID NO: 7000631 - DNA, 19 bp, Homo sapiens
tcaaccctctttgcctagc

SEQ ID NO: 7000632 - DNA, 22 bp, Homo sapiens
agtttcttattcttagttatgt

SEQ ID NO: 7000633 - DNA, 22 bp, Homo sapiens
aggaattgcctggggcctggga

SEQ ID NO: 7000634 - DNA, 22 bp, Homo sapiens
gacaatacagaaagggacatgc

SEQ ID NO: 7000635 - DNA, 22 bp, Homo sapiens
aattcatatggatatgctagta

SEQ ID NO: 7000636 - DNA, 22 bp, Homo sapiens
gccaggagggaaaggacaattt

SEQ ID NO: 7000637 - DNA, 21 bp, Homo sapiens
gggaagtcataaaattagggc

SEQ ID NO: 7000638 - DNA, 22 bp, Homo sapiens
ctgattctgtaatttttcctaa

SEQ ID NO: 7000639 - DNA, 22 bp, Homo sapiens
cctttggagagtttgttagggg

SEQ ID NO: 7000640 - DNA, 22 bp, Homo sapiens
ggcaggtgagagctctttgaaa

SEQ ID NO: 7000641 - DNA, 22 bp, Homo sapiens
tctggacaatcctgagacagac

SEQ ID NO: 7000642 - DNA, 22 bp, Homo sapiens
tttggctcgatggactttgaat

SEQ ID NO: 7000643 - DNA, 22 bp, Homo sapiens
agtgtctttgacacattcaaag

SEQ ID NO: 7000644 - DNA, 22 bp, Homo sapiens
tttggtcaaatattatcctgag

SEQ ID NO: 7000645 - DNA, 22 bp, Homo sapiens
caaggcaggccagtttcaaggc

SEQ ID NO: 7000646 - DNA, 22 bp, Homo sapiens
tccttataacaacaggagtgga

SEQ ID NO: 7000647 - DNA, 22 bp, Homo sapiens
atttcaacgttagatgtaatag

SEQ ID NO: 7000648 - DNA, 22 bp, Homo sapiens
aatgaggccagtagaaggaagt

SEQ ID NO: 7000649 - DNA, 22 bp, Homo sapiens
atatactgatagctgcacttct

SEQ ID NO: 7000650 - DNA, 22 bp, Homo sapiens
taccgtacacattaactacagt

SEQ ID NO: 7000651 - DNA, 21 bp, Homo sapiens
tgctgcctgtgggtgtttacc

SEQ ID NO: 7000652 - DNA, 16 bp, Homo sapiens
cagcctgcagtggtca

SEQ ID NO: 7000653 - DNA, 17 bp, Homo sapiens
ttgccctgatttttaac

SEQ ID NO: 7000654 - DNA, 22 bp, Homo sapiens
tctggattcttttggtagttct

SEQ ID NO: 7000655 - DNA, 22 bp, Homo sapiens
agtaccattactcacttatttt

SEQ ID NO: 7000656 - DNA, 22 bp, Homo sapiens
ttcagctaaaggaaactcagat

SEQ ID NO: 7000657 - DNA, 17 bp, Homo sapiens
tgtatgcataaaattta

SEQ ID NO: 7000658 - DNA, 22 bp, Homo sapiens
gtccacagggatggccacacat

SEQ ID NO: 7000659 - DNA, 22 bp, Homo sapiens
tagctcttaagtctgtgataga

SEQ ID NO: 7000660 - DNA, 22 bp, Homo sapiens
aaaggcagtgtgatactgtggt

SEQ ID NO: 7000661 - DNA, 22 bp, Homo sapiens
ctgtgactagacctgcaggaga

SEQ ID NO: 7000662 - DNA, 22 bp, Homo sapiens
gtgagagtgtttggaaatagaa

SEQ ID NO: 7000663 - DNA, 22 bp, Homo sapiens
cctgccagctgtgggccagcct

SEQ ID NO: 7000664 - DNA, 22 bp, Homo sapiens
gactggtcttttgtgatggatg

SEQ ID NO: 7000665 - DNA, 22 bp, Homo sapiens
aataacagtgccatgaaattga

SEQ ID NO: 7000666 - DNA, 22 bp, Homo sapiens
ttctgaaagccaattcattgaa

SEQ ID NO: 7000667 - DNA, 22 bp, Homo sapiens
agagtttggagagggtgaggca

SEQ ID NO: 7000668 - DNA, 21 bp, Homo sapiens
ggctaggatgctggggtttcc

SEQ ID NO: 7000669 - DNA, 22 bp, Homo sapiens
tctggggttaagcccaggaatg

SEQ ID NO: 7000670 - DNA, 22 bp, Homo sapiens
tccctgatgccttgatccgtgg

SEQ ID NO: 7000671 - DNA, 22 bp, Homo sapiens
ctctggctgtcccgatgagcag

SEQ ID NO: 7000672 - DNA, 22 bp, Homo sapiens
tctacagtgtttggtttgagga

SEQ ID NO: 7000673 - DNA, 21 bp, Homo sapiens
agcaccttacagctataatgg

SEQ ID NO: 7000674 - DNA, 22 bp, Homo sapiens
ggctcagcgcgctgggagggag

SEQ ID NO: 7000675 - DNA, 19 bp, Homo sapiens
tctaacctccccttcagtt

SEQ ID NO: 7000676 - DNA, 22 bp, Homo sapiens
caggacaaagccctttgagaaa

SEQ ID NO: 7000677 - DNA, 22 bp, Homo sapiens
cagctttgaaacatggctctag

SEQ ID NO: 7000678 - DNA, 22 bp, Homo sapiens
atgtaagccttgtctcaggggg

SEQ ID NO: 7000679 - DNA, 22 bp, Homo sapiens
agtcagcagtgaaagcacagcc

SEQ ID NO: 7000680 - DNA, 22 bp, Homo sapiens
ttaaggaacttgtctttctctt

SEQ ID NO: 7000681 - DNA, 22 bp, Homo sapiens
aactgaactgataacatacacg

SEQ ID NO: 7000682 - DNA, 22 bp, Homo sapiens
tgattctgatcatcatcatggt

SEQ ID NO: 7000683 - DNA, 20 bp, Homo sapiens
gctgtggccgtgccagactc

SEQ ID NO: 7000684 - DNA, 23 bp, Homo sapiens
tgggcgaggcaggagtggagcac

SEQ ID NO: 7000685 - DNA, 22 bp, Homo sapiens
cttcatagaacagaaatttaat

SEQ ID NO: 7000686 - DNA, 22 bp, Homo sapiens
tgtctaaatgcaatggatttcc

SEQ ID NO: 7000687 - DNA, 22 bp, Homo sapiens
taagaacaagctgggggttcca

SEQ ID NO: 7000688 - DNA, 22 bp, Homo sapiens
ttggcagggcatcagacacgtg

SEQ ID NO: 7000689 - DNA, 22 bp, Homo sapiens
ctctgccctcgcacatctgcca

SEQ ID NO: 7000690 - DNA, 21 bp, Homo sapiens
tggcagacaggaggagctcac

SEQ ID NO: 7000691 - DNA, 22 bp, Homo sapiens
agctggttagcaatctaagtga

SEQ ID NO: 7000692 - DNA, 22 bp, Homo sapiens
ctgagtccagggacagaggcgt

SEQ ID NO: 7000693 - DNA, 22 bp, Homo sapiens
gaggctccagcgacacctaggc

SEQ ID NO: 7000694 - DNA, 21 bp, Homo sapiens
ctgtttgcaagcctatgtgtc

SEQ ID NO: 7000695 - DNA, 22 bp, Homo sapiens
ggagctgttatggcataagcat

SEQ ID NO: 7000696 - DNA, 22 bp, Homo sapiens
actgagctccaagcctggaatc

SEQ ID NO: 7000697 - DNA, 22 bp, Homo sapiens
agctgcctgggcttgtacacct

SEQ ID NO: 7000698 - DNA, 22 bp, Homo sapiens
accagagaatttagccaagaaa

SEQ ID NO: 7000699 - DNA, 22 bp, Homo sapiens
tctggcagggtcagggcccagg

SEQ ID NO: 7000700 - DNA, 22 bp, Homo sapiens
ctggagtttgtggcttgctcaa

SEQ ID NO: 7000701 - DNA, 22 bp, Homo sapiens
gagagtgcgattcattcattta

SEQ ID NO: 7000702 - DNA, 22 bp, Homo sapiens
tgcacagctggctctccttttc

SEQ ID NO: 7000703 - DNA, 18 bp, Homo sapiens
ctacattcataggaaagg

SEQ ID NO: 7000704 - DNA, 22 bp, Homo sapiens
tgggccttctaatctggtccct

SEQ ID NO: 7000705 - DNA, 22 bp, Homo sapiens
ctgtttattctcatctaaaatg

SEQ ID NO: 7000706 - DNA, 22 bp, Homo sapiens
aaagcagcagcacctgcatttc

SEQ ID NO: 7000707 - DNA, 22 bp, Homo sapiens
acactgcatttcaacaaggccc

SEQ ID NO: 7000708 - DNA, 18 bp, Homo sapiens
tatagacacatatgccag

SEQ ID NO: 7000709 - DNA, 22 bp, Homo sapiens
catttacaatgtacaggttgtg

SEQ ID NO: 7000710 - DNA, 22 bp, Homo sapiens
tggcttcagggttgtcttcagc

SEQ ID NO: 7000711 - DNA, 22 bp, Homo sapiens
gccctaggcctgtttgtccata

SEQ ID NO: 7000712 - DNA, 22 bp, Homo sapiens
catgaaaataacattgttgtga

SEQ ID NO: 7000713 - DNA, 22 bp, Homo sapiens
tggcgtctctcataagtatgtg

SEQ ID NO: 7000714 - DNA, 22 bp, Homo sapiens
tactgtccatggtgctggacgg

SEQ ID NO: 7000715 - DNA, 22 bp, Homo sapiens
gtctcccactttctggcctctt

SEQ ID NO: 7000716 - DNA, 22 bp, Homo sapiens
ttaatagatttgattttaaagg

SEQ ID NO: 7000717 - DNA, 22 bp, Homo sapiens
tagtttactgttcactttgccc

SEQ ID NO: 7000718 - DNA, 22 bp, Homo sapiens
tcaggtgtattgatgtctgtga

SEQ ID NO: 7000719 - DNA, 22 bp, Homo sapiens
agcctgggccctgcctcttctc

SEQ ID NO: 7000720 - DNA, 22 bp, Homo sapiens
ctggagccctgaatgggcagga

SEQ ID NO: 7000721 - DNA, 22 bp, Homo sapiens
agcaggttgttttgtggccagg

SEQ ID NO: 7000722 - DNA, 22 bp, Homo sapiens
tctgcgcgctgctggtaccgaa

SEQ ID NO: 7000723 - DNA, 22 bp, Homo sapiens
attgtggacccactcccaaata

SEQ ID NO: 7000724 - DNA, 17 bp, Homo sapiens
tgctgctaattaaaata

SEQ ID NO: 7000725 - DNA, 22 bp, Homo sapiens
tcactgtgaatgttatcatctt

SEQ ID NO: 7000726 - DNA, 22 bp, Homo sapiens
acagagagaggcccgaggctgc

SEQ ID NO: 7000727 - DNA, 23 bp, Homo sapiens
atgggccaagcaagacccatgac

SEQ ID NO: 7000728 - DNA, 22 bp, Homo sapiens
ctgccaggctgtcccaggtccg

SEQ ID NO: 7000729 - DNA, 22 bp, Homo sapiens
cctggggctcaagatggcgccg

SEQ ID NO: 7000730 - DNA, 22 bp, Homo sapiens
agtggtgtcgtgggagtggaag

SEQ ID NO: 7000731 - DNA, 22 bp, Homo sapiens
agcaggcccagggcttctcagc

SEQ ID NO: 7000732 - DNA, 23 bp, Homo sapiens
tgtctggctcatggtgggtctca

SEQ ID NO: 7000733 - DNA, 22 bp, Homo sapiens
agtgatctgactcccagttaga

SEQ ID NO: 7000734 - DNA, 22 bp, Homo sapiens
tggcacagcaagagtttgggaa

SEQ ID NO: 7000735 - DNA, 23 bp, Homo sapiens
aatatctgcagctcctggggagg

SEQ ID NO: 7000736 - DNA, 23 bp, Homo sapiens
ttacagctaactgctgttattag

SEQ ID NO: 7000737 - DNA, 15 bp, Homo sapiens
tgaagacataaggtg

SEQ ID NO: 7000738 - DNA, 18 bp, Homo sapiens
cttcatttgtagagttcc

SEQ ID NO: 7000739 - DNA, 22 bp, Homo sapiens
acacattcatgagtgcatgcac

SEQ ID NO: 7000740 - DNA, 22 bp, Homo sapiens
gctttggagttaggactcggcc

SEQ ID NO: 7000741 - DNA, 20 bp, Homo sapiens
tccagggctagggagctcat

SEQ ID NO: 7000742 - DNA, 22 bp, Homo sapiens
tctgatcctttgtcttcttggg

SEQ ID NO: 7000743 - DNA, 22 bp, Homo sapiens
tgctgatgagtccttctatcgc

SEQ ID NO: 7000744 - DNA, 22 bp, Homo sapiens
tatagatagactgacgatacag

SEQ ID NO: 7000745 - DNA, 20 bp, Homo sapiens
gctgaccataaatcacactg

SEQ ID NO: 7000746 - DNA, 21 bp, Homo sapiens
cacaagacacatagggtgttt

SEQ ID NO: 7000747 - DNA, 22 bp, Homo sapiens
tgctggatgcttgattttgagg

SEQ ID NO: 7000748 - DNA, 22 bp, Homo sapiens
tatacttccctgcagagtaaag

SEQ ID NO: 7000749 - DNA, 22 bp, Homo sapiens
aaccggagtgattcccacctct

SEQ ID NO: 7000750 - DNA, 22 bp, Homo sapiens
ctaagtcatgatcagacagaga

SEQ ID NO: 7000751 - DNA, 20 bp, Homo sapiens
aacaaactacaaaattatgt

SEQ ID NO: 7000752 - DNA, 22 bp, Homo sapiens
ctctggagttcccttgatctga

SEQ ID NO: 7000753 - DNA, 22 bp, Homo sapiens
ccagggcatcctcacatcgcag

SEQ ID NO: 7000754 - DNA, 22 bp, Homo sapiens
attccaggattccaggacaaat

SEQ ID NO: 7000755 - DNA, 22 bp, Homo sapiens
gatacaagactaataggaaaca

SEQ ID NO: 7000756 - DNA, 22 bp, Homo sapiens
tctcaggcatctgtgtggcaca

SEQ ID NO: 7000757 - DNA, 22 bp, Homo sapiens
aaacaacgatgtacacatttat

SEQ ID NO: 7000758 - DNA, 22 bp, Homo sapiens
tggcacttgatatttgatttgc

SEQ ID NO: 7000759 - DNA, 22 bp, Homo sapiens
gctgaataggactgtcatctct

SEQ ID NO: 7000760 - DNA, 20 bp, Homo sapiens
acatatcatggtagagtcct

SEQ ID NO: 7000761 - DNA, 22 bp, Homo sapiens
agaaatgtttatggctgcctat

SEQ ID NO: 7000762 - DNA, 22 bp, Homo sapiens
tctgcctgccagtctggtcctc

SEQ ID NO: 7000763 - DNA, 22 bp, Homo sapiens
tctaaggagcgctccagaaaaa

SEQ ID NO: 7000764 - DNA, 22 bp, Homo sapiens
tcatggctctaaagacatagat

SEQ ID NO: 7000765 - DNA, 22 bp, Homo sapiens
agtcagggcctggcctgctgaa

SEQ ID NO: 7000766 - DNA, 22 bp, Homo sapiens
ttagtgctcatccagatggggg

SEQ ID NO: 7000767 - DNA, 22 bp, Homo sapiens
ttctgggcaggactggggaccc

SEQ ID NO: 7000768 - DNA, 22 bp, Homo sapiens
ttagcacttgggagtatttatt

SEQ ID NO: 7000769 - DNA, 22 bp, Homo sapiens
tgaaagctgggcacaagattct

SEQ ID NO: 7000770 - DNA, 22 bp, Homo sapiens
atgatacacctaggagtgggag

SEQ ID NO: 7000771 - DNA, 22 bp, Homo sapiens
tttctgaaatgctggctttgga

SEQ ID NO: 7000772 - DNA, 22 bp, Homo sapiens
tgtcctgcaagccctaatgaat

SEQ ID NO: 7000773 - DNA, 20 bp, Homo sapiens
tctctctggttggaggagct

SEQ ID NO: 7000774 - DNA, 22 bp, Homo sapiens
gtgccggtcgcagggctcgacg

SEQ ID NO: 7000775 - DNA, 17 bp, Homo sapiens
ccagagctactgagact

SEQ ID NO: 7000776 - DNA, 22 bp, Homo sapiens
tgtatacattctcttgggtttg

SEQ ID NO: 7000777 - DNA, 22 bp, Homo sapiens
aaaggtttttcagcagggagat

SEQ ID NO: 7000778 - DNA, 23 bp, Homo sapiens
tctgggctgagctcgagtgtaga

SEQ ID NO: 7000779 - DNA, 20 bp, Homo sapiens
actgctgtagaccatctgca

SEQ ID NO: 7000780 - DNA, 22 bp, Homo sapiens
ctaggaacagttcaacagttta

SEQ ID NO: 7000781 - DNA, 22 bp, Homo sapiens
agtccatgatgaaaccagatcc

SEQ ID NO: 7000782 - DNA, 22 bp, Homo sapiens
tagccctggagcagggaaatac

SEQ ID NO: 7000783 - DNA, 20 bp, Homo sapiens
cattatggttgggcacagtg

SEQ ID NO: 7000784 - DNA, 23 bp, Homo sapiens
ttaagtggtcagttttagacaac

SEQ ID NO: 7000785 - DNA, 22 bp, Homo sapiens
ttgactgtacaaccttttgtag

SEQ ID NO: 7000786 - DNA, 22 bp, Homo sapiens
gtgcacagaaattggtaagact

SEQ ID NO: 7000787 - DNA, 22 bp, Homo sapiens
ggaactcagtatcagactccag

SEQ ID NO: 7000788 - DNA, 22 bp, Homo sapiens
ttgcttgcattgtccctggtga

SEQ ID NO: 7000789 - DNA, 22 bp, Homo sapiens
tacatatgtatttgtgtatacg

SEQ ID NO: 7000790 - DNA, 22 bp, Homo sapiens
tgggcagacattgagtttgttc

SEQ ID NO: 7000791 - DNA, 22 bp, Homo sapiens
ctgtcagttcttccagatagag

SEQ ID NO: 7000792 - DNA, 22 bp, Homo sapiens
tccaggattgcaggtgcacaac

SEQ ID NO: 7000793 - DNA, 22 bp, Homo sapiens
aagttaacccagtatttctttt

SEQ ID NO: 7000794 - DNA, 22 bp, Homo sapiens
tatcttaaaaatcgaagcagat

SEQ ID NO: 7000795 - DNA, 22 bp, Homo sapiens
caggtgggagcggagactgatt

SEQ ID NO: 7000796 - DNA, 22 bp, Homo sapiens
gtgtaaaaacatactatttcta

SEQ ID NO: 7000797 - DNA, 22 bp, Homo sapiens
tagctaaggcaatcttttgcac

SEQ ID NO: 7000798 - DNA, 22 bp, Homo sapiens
tgtggcagacaagattctatgt

SEQ ID NO: 7000799 - DNA, 22 bp, Homo sapiens
gactgtttaatactgtgagttc

SEQ ID NO: 7000800 - DNA, 22 bp, Homo sapiens
ctgagtgaaagaagccagacat

SEQ ID NO: 7000801 - DNA, 22 bp, Homo sapiens
agtggagcgtgttacctttgct

SEQ ID NO: 7000802 - DNA, 22 bp, Homo sapiens
tcctgggatcaagtgatcctcc

SEQ ID NO: 7000803 - DNA, 22 bp, Homo sapiens
agtgtttaaaaatggaaatgca

SEQ ID NO: 7000804 - DNA, 22 bp, Homo sapiens
agtcccatgtcattatttctgc

SEQ ID NO: 7000805 - DNA, 22 bp, Homo sapiens
tggggctaaacacgcctggcct

SEQ ID NO: 7000806 - DNA, 22 bp, Homo sapiens
ctccagtgagtgagcaggcgac

SEQ ID NO: 7000807 - DNA, 22 bp, Homo sapiens
gatctttgacacagtggattag

SEQ ID NO: 7000808 - DNA, 22 bp, Homo sapiens
aggtctgagctccttcctctga

SEQ ID NO: 7000809 - DNA, 22 bp, Homo sapiens
tcagagaattctcagatgactc

SEQ ID NO: 7000810 - DNA, 22 bp, Homo sapiens
acagaattgaaagtataatctg

SEQ ID NO: 7000811 - DNA, 22 bp, Homo sapiens
cttaggaaatatatactaaact

SEQ ID NO: 7000812 - DNA, 22 bp, Homo sapiens
cccagagctgggtgggcagcgg

SEQ ID NO: 7000813 - DNA, 22 bp, Homo sapiens
tcttgggctagaatagcaggag

SEQ ID NO: 7000814 - DNA, 22 bp, Homo sapiens
acaggcaaggccagtgagaaat

SEQ ID NO: 7000815 - DNA, 22 bp, Homo sapiens
cttgccttcagtgtccctttgc

SEQ ID NO: 7000816 - DNA, 18 bp, Homo sapiens
cctggcttttctacttgc

SEQ ID NO: 7000817 - DNA, 22 bp, Homo sapiens
ctgaggctgggcttgccttctt

SEQ ID NO: 7000818 - DNA, 22 bp, Homo sapiens
gcatgtggatggagctaaataa

SEQ ID NO: 7000819 - DNA, 22 bp, Homo sapiens
gagcttcatatgttgcagagaa

SEQ ID NO: 7000820 - DNA, 20 bp, Homo sapiens
tccaggagaactgggagccg

SEQ ID NO: 7000821 - DNA, 22 bp, Homo sapiens
tccaggctggagtgcagtggcg

SEQ ID NO: 7000822 - DNA, 22 bp, Homo sapiens
atgtcctcaaaactgattgcag

SEQ ID NO: 7000823 - DNA, 19 bp, Homo sapiens
ctgacatcccaggtcagaa

SEQ ID NO: 7000824 - DNA, 22 bp, Homo sapiens
tcctgatggcctctggctccag

SEQ ID NO: 7000825 - DNA, 20 bp, Homo sapiens
taactgatcattttcaccag

SEQ ID NO: 7000826 - DNA, 17 bp, Homo sapiens
tctttgcaatgagactg

SEQ ID NO: 7000827 - DNA, 22 bp, Homo sapiens
gagtttaaataacacatttcca

SEQ ID NO: 7000828 - DNA, 22 bp, Homo sapiens
gtcacttaccagagtattttat

SEQ ID NO: 7000829 - DNA, 20 bp, Homo sapiens
catcttgaaggtcttccaca

SEQ ID NO: 7000830 - DNA, 22 bp, Homo sapiens
gctgtggcgattggtatcgatt

SEQ ID NO: 7000831 - DNA, 22 bp, Homo sapiens
tcctgacccaccaagtctgtaa

SEQ ID NO: 7000832 - DNA, 22 bp, Homo sapiens
ttcttaagcagtttggcatgtt

SEQ ID NO: 7000833 - DNA, 22 bp, Homo sapiens
taattgtcttaggtgtgatgat

SEQ ID NO: 7000834 - DNA, 22 bp, Homo sapiens
tgaaatagtcaagtatttgaac

SEQ ID NO: 7000835 - DNA, 22 bp, Homo sapiens
ttagagattgtctagtattgtg

SEQ ID NO: 7000836 - DNA, 22 bp, Homo sapiens
atcagaggttatgtggagggga

SEQ ID NO: 7000837 - DNA, 22 bp, Homo sapiens
ttctttctgggaagagttcaga

SEQ ID NO: 7000838 - DNA, 22 bp, Homo sapiens
agctgaatgttctcagaccaga

SEQ ID NO: 7000839 - DNA, 22 bp, Homo sapiens
tcaccagggagcttgtcctctg

SEQ ID NO: 7000840 - DNA, 22 bp, Homo sapiens
atggcagccagtgttggaggaa

SEQ ID NO: 7000841 - DNA, 22 bp, Homo sapiens
attaaaattccaaggtatgcca

SEQ ID NO: 7000842 - DNA, 22 bp, Homo sapiens
ggatggcaggacaaggacccag

SEQ ID NO: 7000843 - DNA, 22 bp, Homo sapiens
cctttcaggtacaccagggatg

SEQ ID NO: 7000844 - DNA, 22 bp, Homo sapiens
ttcagcaccacttccagagaag

SEQ ID NO: 7000845 - DNA, 22 bp, Homo sapiens
gggatcttgtttaatattgttt

SEQ ID NO: 7000846 - DNA, 22 bp, Homo sapiens
gccttgtttcattacacgtggt

SEQ ID NO: 7000847 - DNA, 22 bp, Homo sapiens
tctgaagattctttccactatt

SEQ ID NO: 7000848 - DNA, 22 bp, Homo sapiens
acaacaaggcttttcattcata

SEQ ID NO: 7000849 - DNA, 22 bp, Homo sapiens
gcatcctggctctaggtgtcat

SEQ ID NO: 7000850 - DNA, 22 bp, Homo sapiens
tacagaaggaagtttagctaaa

SEQ ID NO: 7000851 - DNA, 22 bp, Homo sapiens
atgcattgctgctttcaaaaca

SEQ ID NO: 7000852 - DNA, 22 bp, Homo sapiens
gggattctgttgggttagtgtc

SEQ ID NO: 7000853 - DNA, 20 bp, Homo sapiens
ttccttaggcattggaagaa

SEQ ID NO: 7000854 - DNA, 22 bp, Homo sapiens
ttctttcagaacacaagtgatt

SEQ ID NO: 7000855 - DNA, 22 bp, Homo sapiens
ttgcattagtgtcataaggtgg

SEQ ID NO: 7000856 - DNA, 22 bp, Homo sapiens
atgaggcacagagatgttaatg

SEQ ID NO: 7000857 - DNA, 22 bp, Homo sapiens
ctgtgctacttagaagctgtgt

SEQ ID NO: 7000858 - DNA, 22 bp, Homo sapiens
caggccaaagatcccattgaca

SEQ ID NO: 7000859 - DNA, 22 bp, Homo sapiens
agtcatatggctatttagtggg

SEQ ID NO: 7000860 - DNA, 22 bp, Homo sapiens
gcagcgagtgcggctgccacag

SEQ ID NO: 7000861 - DNA, 22 bp, Homo sapiens
gctattgcaggttaccttatcc

SEQ ID NO: 7000862 - DNA, 22 bp, Homo sapiens
cagctactcctcccatgacttc

SEQ ID NO: 7000863 - DNA, 22 bp, Homo sapiens
ttgttgcatttcaagtatgaga

SEQ ID NO: 7000864 - DNA, 22 bp, Homo sapiens
aatgttaatttactgtcttcat

SEQ ID NO: 7000865 - DNA, 22 bp, Homo sapiens
agcattgacctagggaaaggac

SEQ ID NO: 7000866 - DNA, 22 bp, Homo sapiens
acagccttactatactaaacag

SEQ ID NO: 7000867 - DNA, 22 bp, Homo sapiens
ggctggcagaggggagtctgtg

SEQ ID NO: 7000868 - DNA, 22 bp, Homo sapiens
gagcaccgcctccacgatgccc

SEQ ID NO: 7000869 - DNA, 22 bp, Homo sapiens
cttctacacgtggctgtgccaa

SEQ ID NO: 7000870 - DNA, 22 bp, Homo sapiens
tcagtttcttctttagataaaa

SEQ ID NO: 7000871 - DNA, 22 bp, Homo sapiens
gttgatacacctcatggttact

SEQ ID NO: 7000872 - DNA, 22 bp, Homo sapiens
tgtcctcttccagtgctccttc

SEQ ID NO: 7000873 - DNA, 20 bp, Homo sapiens
gctctgccacttagaagctg

SEQ ID NO: 7000874 - DNA, 22 bp, Homo sapiens
aagccctggacggcccttcccc

SEQ ID NO: 7000875 - DNA, 22 bp, Homo sapiens
aacagtagtggtcaatatgcca

SEQ ID NO: 7000876 - DNA, 22 bp, Homo sapiens
cagcaggaaagacatctgagca

SEQ ID NO: 7000877 - DNA, 22 bp, Homo sapiens
tctctgtcccctcagctggggt

SEQ ID NO: 7000878 - DNA, 22 bp, Homo sapiens
agacatcaatgatcagaggtag

SEQ ID NO: 7000879 - DNA, 22 bp, Homo sapiens
ggcccagtgtcccggtcgtggc

SEQ ID NO: 7000880 - DNA, 22 bp, Homo sapiens
tacatagttccacttctgtttt

SEQ ID NO: 7000881 - DNA, 22 bp, Homo sapiens
tcctcagaatcacctggcagct

SEQ ID NO: 7000882 - DNA, 22 bp, Homo sapiens
cactgggcaattctgagcctaa

SEQ ID NO: 7000883 - DNA, 22 bp, Homo sapiens
gctgccatgccacagcactcac

SEQ ID NO: 7000884 - DNA, 22 bp, Homo sapiens
ctggaaatcactactagtcaat

SEQ ID NO: 7000885 - DNA, 22 bp, Homo sapiens
caggctaaagctttgagcatgt

SEQ ID NO: 7000886 - DNA, 23 bp, Homo sapiens
actgggctgaaatttttcatggc

SEQ ID NO: 7000887 - DNA, 22 bp, Homo sapiens
aagatagcttggaaaagtacag

SEQ ID NO: 7000888 - DNA, 22 bp, Homo sapiens
tataggaagtgtagtgcttgga

SEQ ID NO: 7000889 - DNA, 22 bp, Homo sapiens
gatttcactttctggatgtgca

SEQ ID NO: 7000890 - DNA, 21 bp, Homo sapiens
ggcactaggcccggaggaagc

SEQ ID NO: 7000891 - DNA, 22 bp, Homo sapiens
tccctgggccacagctgtgagc

SEQ ID NO: 7000892 - DNA, 22 bp, Homo sapiens
attctagataagaaaagggctg

SEQ ID NO: 7000893 - DNA, 22 bp, Homo sapiens
cctctggcatagcaagtggcct

SEQ ID NO: 7000894 - DNA, 22 bp, Homo sapiens
aaggatgtttaagttttgcagt

SEQ ID NO: 7000895 - DNA, 22 bp, Homo sapiens
aaacagttctccaggaagccag

SEQ ID NO: 7000896 - DNA, 22 bp, Homo sapiens
agtgaccaaagatatttttcag

SEQ ID NO: 7000897 - DNA, 22 bp, Homo sapiens
tctctgtaagagaggctttcat

SEQ ID NO: 7000898 - DNA, 22 bp, Homo sapiens
tcctttggttctctaagatgct

SEQ ID NO: 7000899 - DNA, 22 bp, Homo sapiens
ccagctgctctcttctccgcca

SEQ ID NO: 7000900 - DNA, 22 bp, Homo sapiens
tttagggaaattgagggttaag

SEQ ID NO: 7000901 - DNA, 22 bp, Homo sapiens
aaatcaaggagggattatattt

SEQ ID NO: 7000902 - DNA, 22 bp, Homo sapiens
acactgtctgggactcaggagt

SEQ ID NO: 7000903 - DNA, 22 bp, Homo sapiens
gtgccagactgtgtcttgctaa

SEQ ID NO: 7000904 - DNA, 22 bp, Homo sapiens
agacacagtctgtctggaggag

SEQ ID NO: 7000905 - DNA, 22 bp, Homo sapiens
aagtcaagtgttattattgtag

SEQ ID NO: 7000906 - DNA, 22 bp, Homo sapiens
ggcagagcctcagccctccacc

SEQ ID NO: 7000907 - DNA, 22 bp, Homo sapiens
caaattttgtgtgttctctagt

SEQ ID NO: 7000908 - DNA, 22 bp, Homo sapiens
attaagctccaagttgctctga

SEQ ID NO: 7000909 - DNA, 22 bp, Homo sapiens
tctttggtcagaaagattacac

SEQ ID NO: 7000910 - DNA, 22 bp, Homo sapiens
acagggcccttgccagcacaag

SEQ ID NO: 7000911 - DNA, 22 bp, Homo sapiens
ctggccctgtcagcacagaatc

SEQ ID NO: 7000912 - DNA, 22 bp, Homo sapiens
tccacagggcctttctggtgtg

SEQ ID NO: 7000913 - DNA, 19 bp, Homo sapiens
caggcctctggtctgctgt

SEQ ID NO: 7000914 - DNA, 22 bp, Homo sapiens
ttggcgatttctgaaattataa

SEQ ID NO: 7000915 - DNA, 22 bp, Homo sapiens
tgtaacagtaagcctgtgagct

SEQ ID NO: 7000916 - DNA, 22 bp, Homo sapiens
tgttactccttccctactcatg

SEQ ID NO: 7000917 - DNA, 22 bp, Homo sapiens
ttgtatgctgatcaaaagcttc

SEQ ID NO: 7000918 - DNA, 22 bp, Homo sapiens
tgattcatatgtaacatccctg

SEQ ID NO: 7000919 - DNA, 22 bp, Homo sapiens
aagaaggtgtggaaagatgctc

SEQ ID NO: 7000920 - DNA, 22 bp, Homo sapiens
gctgtgaacatgcacatggagt

SEQ ID NO: 7000921 - DNA, 22 bp, Homo sapiens
ttggtcatatgttactccaggg

SEQ ID NO: 7000922 - DNA, 22 bp, Homo sapiens
actcaatgttctcatagcacct

SEQ ID NO: 7000923 - DNA, 22 bp, Homo sapiens
taggcctaagagatactactgt

SEQ ID NO: 7000924 - DNA, 22 bp, Homo sapiens
gtatgtctatttcaaatagctg

SEQ ID NO: 7000925 - DNA, 22 bp, Homo sapiens
gtctgcacagccccatagtggt

SEQ ID NO: 7000926 - DNA, 22 bp, Homo sapiens
aagttaggagagtaaagtggta

SEQ ID NO: 7000927 - DNA, 22 bp, Homo sapiens
aacagaaatcatttagggctct

SEQ ID NO: 7000928 - DNA, 22 bp, Homo sapiens
tgtctttaagcaaacagtgttt

SEQ ID NO: 7000929 - DNA, 22 bp, Homo sapiens
tagctaaatttttcatgtaata

SEQ ID NO: 7000930 - DNA, 22 bp, Homo sapiens
atgacagtactggtgacaatac

SEQ ID NO: 7000931 - DNA, 22 bp, Homo sapiens
tcactgcaagctcagcctcccg

SEQ ID NO: 7000932 - DNA, 22 bp, Homo sapiens
cctgagtggcagggtttgggct

SEQ ID NO: 7000933 - DNA, 22 bp, Homo sapiens
tgcagaggtttccaggcaagtt

SEQ ID NO: 7000934 - DNA, 22 bp, Homo sapiens
ttggaacacagcagctgatttt

SEQ ID NO: 7000935 - DNA, 22 bp, Homo sapiens
agggaagatgtctcatcttagg

SEQ ID NO: 7000936 - DNA, 22 bp, Homo sapiens
caggtggcaaatgagtagcatt

SEQ ID NO: 7000937 - DNA, 22 bp, Homo sapiens
gctcctgccctcttgcaattcc

SEQ ID NO: 7000938 - DNA, 22 bp, Homo sapiens
aggtgtctttcagtcatggctt

SEQ ID NO: 7000939 - DNA, 22 bp, Homo sapiens
atgtaacatatgtgatcgcatt

SEQ ID NO: 7000940 - DNA, 19 bp, Homo sapiens
cctacatgagtaagcttgg

SEQ ID NO: 7000941 - DNA, 22 bp, Homo sapiens
aggatcaagaggcggccggaac

SEQ ID NO: 7000942 - DNA, 22 bp, Homo sapiens
tcagctttgccaccagctgtaa

SEQ ID NO: 7000943 - DNA, 22 bp, Homo sapiens
agcagacatggcttggatgtgg

SEQ ID NO: 7000944 - DNA, 22 bp, Homo sapiens
tgctaactattcctaaagatca

SEQ ID NO: 7000945 - DNA, 22 bp, Homo sapiens
agtccatcttctcttgctggtc

SEQ ID NO: 7000946 - DNA, 22 bp, Homo sapiens
cagattctcactgtattcaggt

SEQ ID NO: 7000947 - DNA, 22 bp, Homo sapiens
tagaggtgagattgtggtgctg

SEQ ID NO: 7000948 - DNA, 22 bp, Homo sapiens
gtcctttcgagggtgagtgaaa

SEQ ID NO: 7000949 - DNA, 22 bp, Homo sapiens
aggcgtattcctgaacctgaag

SEQ ID NO: 7000950 - DNA, 23 bp, Homo sapiens
tccagtagggagtctgcttactt

SEQ ID NO: 7000951 - DNA, 22 bp, Homo sapiens
aattagggagaggtagctaggt

SEQ ID NO: 7000952 - DNA, 22 bp, Homo sapiens
tgtagctctccagccagcaagg

SEQ ID NO: 7000953 - DNA, 22 bp, Homo sapiens
gctctggcagctgatattagga

SEQ ID NO: 7000954 - DNA, 22 bp, Homo sapiens
gaggctgggggctgccttcctc

SEQ ID NO: 7000955 - DNA, 22 bp, Homo sapiens
ccacccagaccagggatctggg

SEQ ID NO: 7000956 - DNA, 22 bp, Homo sapiens
tctgttttagataagaaaggct

SEQ ID NO: 7000957 - DNA, 22 bp, Homo sapiens
ccacagaagatggggagagtgg

SEQ ID NO: 7000958 - DNA, 22 bp, Homo sapiens
ccagtgtgggcccggcctcctc

SEQ ID NO: 7000959 - DNA, 22 bp, Homo sapiens
ggcaggtgagttcattatctgc

SEQ ID NO: 7000960 - DNA, 22 bp, Homo sapiens
aaattagtacattgcaaagtcc

SEQ ID NO: 7000961 - DNA, 22 bp, Homo sapiens
gcttctatccctccactgcact

SEQ ID NO: 7000962 - DNA, 22 bp, Homo sapiens
aagagcattttgtaaaatcctt

SEQ ID NO: 7000963 - DNA, 22 bp, Homo sapiens
tggttcctggttcacttggcag

SEQ ID NO: 7000964 - DNA, 22 bp, Homo sapiens
ggtcagagaaagtggtagtaga

SEQ ID NO: 7000965 - DNA, 22 bp, Homo sapiens
actgtgtcattgatcagaaaca

SEQ ID NO: 7000966 - DNA, 22 bp, Homo sapiens
ggcagaatgagagggaaacatg

SEQ ID NO: 7000967 - DNA, 22 bp, Homo sapiens
tagaacagcatttggctattaa

SEQ ID NO: 7000968 - DNA, 23 bp, Homo sapiens
acaggtacacttgattgcaatcc

SEQ ID NO: 7000969 - DNA, 22 bp, Homo sapiens
agcaagtggaatcatggaaaag

SEQ ID NO: 7000970 - DNA, 22 bp, Homo sapiens
tgctctggagggtgaagctttt

SEQ ID NO: 7000971 - DNA, 22 bp, Homo sapiens
tacttggtctgggcagggggtt

SEQ ID NO: 7000972 - DNA, 22 bp, Homo sapiens
ctggggggctactgacagagga

SEQ ID NO: 7000973 - DNA, 22 bp, Homo sapiens
ttacagaatgttcttccaacag

SEQ ID NO: 7000974 - DNA, 22 bp, Homo sapiens
gactatgtgtgctttgtgaatg

SEQ ID NO: 7000975 - DNA, 22 bp, Homo sapiens
atggcagatggctggagcaggt

SEQ ID NO: 7000976 - DNA, 19 bp, Homo sapiens
acatgtagtagagagagaa

SEQ ID NO: 7000977 - DNA, 22 bp, Homo sapiens
tgaatcctagttgaagataagg

SEQ ID NO: 7000978 - DNA, 22 bp, Homo sapiens
aaagtccaggggctggaggcgg

SEQ ID NO: 7000979 - DNA, 22 bp, Homo sapiens
ctggggcattgggagaggcctg

SEQ ID NO: 7000980 - DNA, 22 bp, Homo sapiens
attctgagtccatgggggcagg

SEQ ID NO: 7000981 - DNA, 22 bp, Homo sapiens
ctattgggccaaagaagatgcc

SEQ ID NO: 7000982 - DNA, 22 bp, Homo sapiens
ctgtgctctgagcgtggggttg

SEQ ID NO: 7000983 - DNA, 22 bp, Homo sapiens
tttcagacatcacatgggtttg

SEQ ID NO: 7000984 - DNA, 17 bp, Homo sapiens
tagtggcaggaaatgaa

SEQ ID NO: 7000985 - DNA, 22 bp, Homo sapiens
aaatagcagaagcagagggggt

SEQ ID NO: 7000986 - DNA, 22 bp, Homo sapiens
gcatgacattcctaatcacagt

SEQ ID NO: 7000987 - DNA, 20 bp, Homo sapiens
agctgaagatctggatgggg

SEQ ID NO: 7000988 - DNA, 22 bp, Homo sapiens
tctggggacggggcccagcaat

SEQ ID NO: 7000989 - DNA, 22 bp, Homo sapiens
tcagaaatgatcgttattcatt

SEQ ID NO: 7000990 - DNA, 22 bp, Homo sapiens
gccagagtgatgtaacatatat

SEQ ID NO: 7000991 - DNA, 22 bp, Homo sapiens
gaatacatccagagcagggctg

SEQ ID NO: 7000992 - DNA, 22 bp, Homo sapiens
accaggagaggcacttgcaatg

SEQ ID NO: 7000993 - DNA, 22 bp, Homo sapiens
aaggttgagggtaatcatatgg

SEQ ID NO: 7000994 - DNA, 22 bp, Homo sapiens
ggggcacttccaggctgaggct

SEQ ID NO: 7000995 - DNA, 22 bp, Homo sapiens
ttgaagagaatcagaaggttga

SEQ ID NO: 7000996 - DNA, 22 bp, Homo sapiens
gctgcctgcctgcatttaatcc

SEQ ID NO: 7000997 - DNA, 20 bp, Homo sapiens
aacacagggttaccatcaga

SEQ ID NO: 7000998 - DNA, 22 bp, Homo sapiens
ctgcccacactcatggggaagg

SEQ ID NO: 7000999 - DNA, 23 bp, Homo sapiens
tgctcaatagaccataatatcca

SEQ ID NO: 7001000 - DNA, 22 bp, Homo sapiens
tgctgcctccaactcctgggct

SEQ ID NO: 7001001 - DNA, 22 bp, Homo sapiens
cagtctggcacagcacactgaa

SEQ ID NO: 7001002 - DNA, 22 bp, Homo sapiens
tccttggctagtactggccagc

SEQ ID NO: 7001003 - DNA, 22 bp, Homo sapiens
tacactttttactacagattct

SEQ ID NO: 7001004 - DNA, 22 bp, Homo sapiens
tgctggcctcggcgctgggcct

SEQ ID NO: 7001005 - DNA, 22 bp, Homo sapiens
aatgtagaatgatccttaggat

SEQ ID NO: 7001006 - DNA, 22 bp, Homo sapiens
cactttataaaattggtgtgag

SEQ ID NO: 7001007 - DNA, 22 bp, Homo sapiens
gccttctttaaaggacgggata

SEQ ID NO: 7001008 - DNA, 22 bp, Homo sapiens
tcttcaaaaactgcaccttgct

SEQ ID NO: 7001009 - DNA, 22 bp, Homo sapiens
aaggaggagtggggtcctggaa

SEQ ID NO: 7001010 - DNA, 22 bp, Homo sapiens
gctctggagatggagccttgag

SEQ ID NO: 7001011 - DNA, 22 bp, Homo sapiens
gcattcactgggtgttcatggg

SEQ ID NO: 7001012 - DNA, 22 bp, Homo sapiens
ctgccatccacggcccactcat

SEQ ID NO: 7001013 - DNA, 22 bp, Homo sapiens
atccacttggctggttgttcta

SEQ ID NO: 7001014 - DNA, 22 bp, Homo sapiens
agtcagttaacctcacagcatc

SEQ ID NO: 7001015 - DNA, 17 bp, Homo sapiens
cactgacttaaaatctt

SEQ ID NO: 7001016 - DNA, 22 bp, Homo sapiens
tggcttcccaggaaaggagaag

SEQ ID NO: 7001017 - DNA, 22 bp, Homo sapiens
gggacgtgagtgaagaaggtct

SEQ ID NO: 7001018 - DNA, 22 bp, Homo sapiens
ccttttgaggcttgggctcaga

SEQ ID NO: 7001019 - DNA, 22 bp, Homo sapiens
cgactgtcatacacaagacatg

SEQ ID NO: 7001020 - DNA, 22 bp, Homo sapiens
tctgccttgttgcaggcgctat

SEQ ID NO: 7001021 - DNA, 22 bp, Homo sapiens
atcagcaagcatggttaggtgt

SEQ ID NO: 7001022 - DNA, 22 bp, Homo sapiens
gcagcagaaggccaaggggagc

SEQ ID NO: 7001023 - DNA, 21 bp, Homo sapiens
tcatggaagtaacaaacatat

SEQ ID NO: 7001024 - DNA, 22 bp, Homo sapiens
taattcagtgttcacttggaca

SEQ ID NO: 7001025 - DNA, 22 bp, Homo sapiens
ggaggcggaggttgcagtgagc

SEQ ID NO: 7001026 - DNA, 22 bp, Homo sapiens
tgcaataaggagtaatagtaaa

SEQ ID NO: 7001027 - DNA, 22 bp, Homo sapiens
tccaggtgggctgcacccaggc

SEQ ID NO: 7001028 - DNA, 21 bp, Homo sapiens
acatggactgtgaatggggac

SEQ ID NO: 7001029 - DNA, 22 bp, Homo sapiens
atgccaagttgacaaggggtgg

SEQ ID NO: 7001030 - DNA, 22 bp, Homo sapiens
ggaacagccagctcagtttcag

SEQ ID NO: 7001031 - DNA, 22 bp, Homo sapiens
agggcctgagctggctgacctc

SEQ ID NO: 7001032 - DNA, 22 bp, Homo sapiens
agcccagcaaaggggtttgaga

SEQ ID NO: 7001033 - DNA, 22 bp, Homo sapiens
ggagtgaggcatttgtagctga

SEQ ID NO: 7001034 - DNA, 22 bp, Homo sapiens
ccaggctgcttagccttatctt

SEQ ID NO: 7001035 - DNA, 22 bp, Homo sapiens
tgccctgcttggtttattttca

SEQ ID NO: 7001036 - DNA, 23 bp, Homo sapiens
actcatccttgatttgcagatgt

SEQ ID NO: 7001037 - DNA, 22 bp, Homo sapiens
gcctccacttctttagtatgac

SEQ ID NO: 7001038 - DNA, 22 bp, Homo sapiens
cagtgggtgccatcgtgccctt

SEQ ID NO: 7001039 - DNA, 22 bp, Homo sapiens
ttggttttgggatgtacaaagg

SEQ ID NO: 7001040 - DNA, 17 bp, Homo sapiens
ctgctggctggggcttg

SEQ ID NO: 7001041 - DNA, 22 bp, Homo sapiens
tcagagtgggagaatgtgccaa

SEQ ID NO: 7001042 - DNA, 22 bp, Homo sapiens
aaggcctcttctctctggagat

SEQ ID NO: 7001043 - DNA, 22 bp, Homo sapiens
gctgttctccgatgaccccgtg

SEQ ID NO: 7001044 - DNA, 23 bp, Homo sapiens
gagatggctggttgtcctctgaa

SEQ ID NO: 7001045 - DNA, 23 bp, Homo sapiens
tgttaatacatctgccactcatt

SEQ ID NO: 7001046 - DNA, 19 bp, Homo sapiens
tcctgcctggggccgcctg

SEQ ID NO: 7001047 - DNA, 22 bp, Homo sapiens
ttgatttttccagcttctagag

SEQ ID NO: 7001048 - DNA, 22 bp, Homo sapiens
aaaaagagaaatgctctagtcc

SEQ ID NO: 7001049 - DNA, 22 bp, Homo sapiens
ttcattctgtttggaaaggtgg

SEQ ID NO: 7001050 - DNA, 22 bp, Homo sapiens
tttggcctcatgaatttcttgc

SEQ ID NO: 7001051 - DNA, 23 bp, Homo sapiens
ggctctgaggatggagctggtgg

SEQ ID NO: 7001052 - DNA, 22 bp, Homo sapiens
gtacagtaaatgtaaatggatt

SEQ ID NO: 7001053 - DNA, 21 bp, Homo sapiens
tcactggacgtgagccagggg

SEQ ID NO: 7001054 - DNA, 22 bp, Homo sapiens
gaggagcttgtgagaagatgtc

SEQ ID NO: 7001055 - DNA, 22 bp, Homo sapiens
tggcatcctttgtgtcagttta

SEQ ID NO: 7001056 - DNA, 22 bp, Homo sapiens
tgtgcaaaataataaatcactg

SEQ ID NO: 7001057 - DNA, 22 bp, Homo sapiens
taagaatacctctcagctcttt

SEQ ID NO: 7001058 - DNA, 22 bp, Homo sapiens
ccgtgtgcacgcgccggtgctg

SEQ ID NO: 7001059 - DNA, 21 bp, Homo sapiens
cgtgactgggtccgtctggct

SEQ ID NO: 7001060 - DNA, 22 bp, Homo sapiens
tcttcaaaaaatatccatcagt

SEQ ID NO: 7001061 - DNA, 22 bp, Homo sapiens
gcagattatatgcatatgtggt

SEQ ID NO: 7001062 - DNA, 22 bp, Homo sapiens
ttctcaggactcctgcctgctt

SEQ ID NO: 7001063 - DNA, 22 bp, Homo sapiens
tcactccatagcttaactcttt

SEQ ID NO: 7001064 - DNA, 22 bp, Homo sapiens
cagctcctcacgagtcttgaaa

SEQ ID NO: 7001065 - DNA, 22 bp, Homo sapiens
agagagcctgagtggcagctat

SEQ ID NO: 7001066 - DNA, 19 bp, Homo sapiens
agcttctttggaaacattt

SEQ ID NO: 7001067 - DNA, 22 bp, Homo sapiens
tataggcttttgttgcagaaca

SEQ ID NO: 7001068 - DNA, 22 bp, Homo sapiens
tgggcagggatctcttttgcaa

SEQ ID NO: 7001069 - DNA, 22 bp, Homo sapiens
acttccttccaaacattcattt

SEQ ID NO: 7001070 - DNA, 22 bp, Homo sapiens
tttgcaaggcagcaggtgcagt

SEQ ID NO: 7001071 - DNA, 22 bp, Homo sapiens
gcgctggggctcaaacctcaca

SEQ ID NO: 7001072 - DNA, 22 bp, Homo sapiens
tcaggacttcattacctcaggt

SEQ ID NO: 7001073 - DNA, 22 bp, Homo sapiens
gtcctgaatgccttcatagtcc

SEQ ID NO: 7001074 - DNA, 22 bp, Homo sapiens
ggggacctaggctctgtctctt

SEQ ID NO: 7001075 - DNA, 22 bp, Homo sapiens
tagaaagagctttgcttccttt

SEQ ID NO: 7001076 - DNA, 22 bp, Homo sapiens
tgtttcactgaaagccttacta

SEQ ID NO: 7001077 - DNA, 22 bp, Homo sapiens
cttctacaggcccagcgagtgt

SEQ ID NO: 7001078 - DNA, 21 bp, Homo sapiens
ttaggtctgagaactgagaga

SEQ ID NO: 7001079 - DNA, 22 bp, Homo sapiens
ccctggaggaccccaatgtggc

SEQ ID NO: 7001080 - DNA, 22 bp, Homo sapiens
aaaccatttgaattattactga

SEQ ID NO: 7001081 - DNA, 22 bp, Homo sapiens
ctgagctatgaactgcagccta

SEQ ID NO: 7001082 - DNA, 22 bp, Homo sapiens
gagtccagttctttccagcagt

SEQ ID NO: 7001083 - DNA, 22 bp, Homo sapiens
tccaggtcttcctattccaggt

SEQ ID NO: 7001084 - DNA, 22 bp, Homo sapiens
atccaggcttaatgggagccac

SEQ ID NO: 7001085 - DNA, 22 bp, Homo sapiens
ggtcacagggaagggctctcaa

SEQ ID NO: 7001086 - DNA, 22 bp, Homo sapiens
ttgttagtgcaatgtttggtga

SEQ ID NO: 7001087 - DNA, 22 bp, Homo sapiens
agagccaagttgtcaaggcact

SEQ ID NO: 7001088 - DNA, 22 bp, Homo sapiens
cttcttgtgcccatacgttaga

SEQ ID NO: 7001089 - DNA, 22 bp, Homo sapiens
aactcaggagtttaaggctgca

SEQ ID NO: 7001090 - DNA, 22 bp, Homo sapiens
aggatgccccgtgtcttcctga

SEQ ID NO: 7001091 - DNA, 22 bp, Homo sapiens
tgctggaggattaaacaagtca

SEQ ID NO: 7001092 - DNA, 22 bp, Homo sapiens
ttctgtctggaaaaggacatag

SEQ ID NO: 7001093 - DNA, 22 bp, Homo sapiens
cagatatattttatttggtcaa

SEQ ID NO: 7001094 - DNA, 22 bp, Homo sapiens
atggaatttctccggctccacc

SEQ ID NO: 7001095 - DNA, 22 bp, Homo sapiens
tttagagctgtgctgccacatg

SEQ ID NO: 7001096 - DNA, 22 bp, Homo sapiens
tttcattcatgtgttaaaggtg

SEQ ID NO: 7001097 - DNA, 22 bp, Homo sapiens
tacaggctgcagggctagaggg

SEQ ID NO: 7001098 - DNA, 22 bp, Homo sapiens
agctatgttatcattggtcctt

SEQ ID NO: 7001099 - DNA, 22 bp, Homo sapiens
cactacaggggtccacagctga

SEQ ID NO: 7001100 - DNA, 22 bp, Homo sapiens
ctgaagaagtctctaggctatt

SEQ ID NO: 7001101 - DNA, 22 bp, Homo sapiens
ttcattgagctgtacacttagg

SEQ ID NO: 7001102 - DNA, 22 bp, Homo sapiens
attgtcatcgatgttagccagt

SEQ ID NO: 7001103 - DNA, 22 bp, Homo sapiens
tgaggctcagtgagccctgcag

SEQ ID NO: 7001104 - DNA, 20 bp, Homo sapiens
taagcatagttgtcagggtc

SEQ ID NO: 7001105 - DNA, 22 bp, Homo sapiens
tggcagtggtgtctgcacaggc

SEQ ID NO: 7001106 - DNA, 22 bp, Homo sapiens
tacactggagcccttggggtct

SEQ ID NO: 7001107 - DNA, 22 bp, Homo sapiens
tattaggttggtgcaaaattaa

SEQ ID NO: 7001108 - DNA, 22 bp, Homo sapiens
tattaggttgttgcaaaagtaa

SEQ ID NO: 7001109 - DNA, 22 bp, Homo sapiens
cctatgaaagacaggagatgcg

SEQ ID NO: 7001110 - DNA, 22 bp, Homo sapiens
ttagcagtcacagtgctaacat

SEQ ID NO: 7001111 - DNA, 22 bp, Homo sapiens
aaacagtgatgttgagtgtaaa

SEQ ID NO: 7001112 - DNA, 22 bp, Homo sapiens
gttgtacagcattccatatagg

SEQ ID NO: 7001113 - DNA, 22 bp, Homo sapiens
ctgctgacaaaataaaatgctc

SEQ ID NO: 7001114 - DNA, 22 bp, Homo sapiens
agtgtattatcagaaactgtgg

SEQ ID NO: 7001115 - DNA, 22 bp, Homo sapiens
tccagtgcctcactgaggattc

SEQ ID NO: 7001116 - DNA, 22 bp, Homo sapiens
atacattcatcacttttggtcc

SEQ ID NO: 7001117 - DNA, 21 bp, Homo sapiens
ctgtgacctttctttcctcct

SEQ ID NO: 7001118 - DNA, 22 bp, Homo sapiens
tggggaccagattagaccatgg

SEQ ID NO: 7001119 - DNA, 22 bp, Homo sapiens
actgggaaaaactgctttgagg

SEQ ID NO: 7001120 - DNA, 22 bp, Homo sapiens
aggtagggctaggctgcgtctg

SEQ ID NO: 7001121 - DNA, 22 bp, Homo sapiens
aattattgagcatctactgtgt

SEQ ID NO: 7001122 - DNA, 22 bp, Homo sapiens
gccctgaattcctcaggctgtg

SEQ ID NO: 7001123 - DNA, 19 bp, Homo sapiens
tgttgaagattatttgtgg

SEQ ID NO: 7001124 - DNA, 22 bp, Homo sapiens
agacagctatcaacaactttct

SEQ ID NO: 7001125 - DNA, 20 bp, Homo sapiens
acagtgttagttatcatctc

SEQ ID NO: 7001126 - DNA, 22 bp, Homo sapiens
gggctggcgggaaaggcaattc

SEQ ID NO: 7001127 - DNA, 22 bp, Homo sapiens
tcactggattagtttgaactgt

SEQ ID NO: 7001128 - DNA, 22 bp, Homo sapiens
aaaacgatgtttaaaagctctg

SEQ ID NO: 7001129 - DNA, 22 bp, Homo sapiens
tgcaggaggattttgtggagct

SEQ ID NO: 7001130 - DNA, 22 bp, Homo sapiens
aggctctgtgcagcctgcatct

SEQ ID NO: 7001131 - DNA, 22 bp, Homo sapiens
gagtttctgctctaggtctggt

SEQ ID NO: 7001132 - DNA, 22 bp, Homo sapiens
aaagtgctaaataagccctgaa

SEQ ID NO: 7001133 - DNA, 22 bp, Homo sapiens
tatgtctgaatcttatttaaat

SEQ ID NO: 7001134 - DNA, 22 bp, Homo sapiens
tgacagactactgcctctattg

SEQ ID NO: 7001135 - DNA, 22 bp, Homo sapiens
gatatcagagacttggctacca

SEQ ID NO: 7001136 - DNA, 18 bp, Homo sapiens
agtgacatcaaaaggcat

SEQ ID NO: 7001137 - DNA, 22 bp, Homo sapiens
gttcactggctgtgtgactctg

SEQ ID NO: 7001138 - DNA, 22 bp, Homo sapiens
ctggatcttgctgcattgagaa

SEQ ID NO: 7001139 - DNA, 22 bp, Homo sapiens
ccagtgcaggtgagcaccaggt

SEQ ID NO: 7001140 - DNA, 22 bp, Homo sapiens
gacatcatggagaggacaaaca

SEQ ID NO: 7001141 - DNA, 22 bp, Homo sapiens
agattagcttgtgtacaaaggt

SEQ ID NO: 7001142 - DNA, 22 bp, Homo sapiens
ctttgaaaggaagccacacagc

SEQ ID NO: 7001143 - DNA, 18 bp, Homo sapiens
tgaggcctctgctgggcc

SEQ ID NO: 7001144 - DNA, 22 bp, Homo sapiens
aggacagttaaaaatagatggc

SEQ ID NO: 7001145 - DNA, 22 bp, Homo sapiens
tggtgcccactccagacaccta

SEQ ID NO: 7001146 - DNA, 22 bp, Homo sapiens
gaggtgtcatgagggcctgctc

SEQ ID NO: 7001147 - DNA, 22 bp, Homo sapiens
gcccatggcagaactgtgagca

SEQ ID NO: 7001148 - DNA, 22 bp, Homo sapiens
tatgaactgtaaccctcaccgc

SEQ ID NO: 7001149 - DNA, 22 bp, Homo sapiens
ctcactgcaagctctgcctcca

SEQ ID NO: 7001150 - DNA, 22 bp, Homo sapiens
aggcctcttgtcttcctcacat

SEQ ID NO: 7001151 - DNA, 22 bp, Homo sapiens
acctgtgactccaaaggacttc

SEQ ID NO: 7001152 - DNA, 22 bp, Homo sapiens
tcctgggtgtgatattcataga

SEQ ID NO: 7001153 - DNA, 22 bp, Homo sapiens
ggcttcttctctgtgtccagca

SEQ ID NO: 7001154 - DNA, 22 bp, Homo sapiens
gctgctgtcagtggtggcagtt

SEQ ID NO: 7001155 - DNA, 22 bp, Homo sapiens
atttcacagctgctgttcaggt

SEQ ID NO: 7001156 - DNA, 22 bp, Homo sapiens
tggcacagttaaagttgtagaa

SEQ ID NO: 7001157 - DNA, 22 bp, Homo sapiens
tgcctggatactcattaatttc

SEQ ID NO: 7001158 - DNA, 22 bp, Homo sapiens
acctagtttttcagcaaataca

SEQ ID NO: 7001159 - DNA, 22 bp, Homo sapiens
tctttgggccgacactcgtcaa

SEQ ID NO: 7001160 - DNA, 22 bp, Homo sapiens
gcaggccctcctctagcaaggc

SEQ ID NO: 7001161 - DNA, 22 bp, Homo sapiens
tttcaagcagcgtgaaaaacga

SEQ ID NO: 7001162 - DNA, 20 bp, Homo sapiens
taactttctatgctttcagc

SEQ ID NO: 7001163 - DNA, 22 bp, Homo sapiens
cctgtgtgcctggccgcgggag

SEQ ID NO: 7001164 - DNA, 22 bp, Homo sapiens
ggatttcttccttcctcagaag

SEQ ID NO: 7001165 - DNA, 22 bp, Homo sapiens
ctcccgtggatgttcttcagtc

SEQ ID NO: 7001166 - DNA, 22 bp, Homo sapiens
ttttcatagtaatggtgcatgt

SEQ ID NO: 7001167 - DNA, 22 bp, Homo sapiens
cagcttattcagtaagcacata

SEQ ID NO: 7001168 - DNA, 22 bp, Homo sapiens
caggaacatgttggaaagaaat

SEQ ID NO: 7001169 - DNA, 22 bp, Homo sapiens
tgagcagatggaggcttctgca

SEQ ID NO: 7001170 - DNA, 20 bp, Homo sapiens
aatgctgcttctttttgcat

SEQ ID NO: 7001171 - DNA, 22 bp, Homo sapiens
gtgggagcttcatcaagcagtt

SEQ ID NO: 7001172 - DNA, 22 bp, Homo sapiens
gaccaaggccctcagtgggagg

SEQ ID NO: 7001173 - DNA, 22 bp, Homo sapiens
ttgcagggcatcgcgtacttct

SEQ ID NO: 7001174 - DNA, 22 bp, Homo sapiens
cttaacaagcccaactttcatt

SEQ ID NO: 7001175 - DNA, 22 bp, Homo sapiens
acattgttcacaggggcttctc

SEQ ID NO: 7001176 - DNA, 22 bp, Homo sapiens
aggtgggtatcatgagagatta

SEQ ID NO: 7001177 - DNA, 22 bp, Homo sapiens
ggctttatcaaatgagaccctg

SEQ ID NO: 7001178 - DNA, 22 bp, Homo sapiens
gcagttctatattattcttggg

SEQ ID NO: 7001179 - DNA, 22 bp, Homo sapiens
tgccacagacaggacagaacag

SEQ ID NO: 7001180 - DNA, 22 bp, Homo sapiens
actcagagtttgcgttccatac

SEQ ID NO: 7001181 - DNA, 22 bp, Homo sapiens
gcagatgcttggcactgacagt

SEQ ID NO: 7001182 - DNA, 22 bp, Homo sapiens
ctgatcccctggaaagttgaat

SEQ ID NO: 7001183 - DNA, 22 bp, Homo sapiens
ggggacctggccacccatcctt

SEQ ID NO: 7001184 - DNA, 22 bp, Homo sapiens
aagagtgagtatttcctgatta

SEQ ID NO: 7001185 - DNA, 22 bp, Homo sapiens
tggggaaaggagagcattattt

SEQ ID NO: 7001186 - DNA, 22 bp, Homo sapiens
tgtcctgtctctttcctaattg

SEQ ID NO: 7001187 - DNA, 22 bp, Homo sapiens
ctctgagcttagtgaaatgata

SEQ ID NO: 7001188 - DNA, 22 bp, Homo sapiens
tgccaggatggccagggggcca

SEQ ID NO: 7001189 - DNA, 22 bp, Homo sapiens
tcattttcaagtttgaacagga

SEQ ID NO: 7001190 - DNA, 22 bp, Homo sapiens
ccagctttctgggtggtttctg

SEQ ID NO: 7001191 - DNA, 22 bp, Homo sapiens
ttggacagaatttatcttcagt

SEQ ID NO: 7001192 - DNA, 22 bp, Homo sapiens
aaacagataatgctataaatgg

SEQ ID NO: 7001193 - DNA, 22 bp, Homo sapiens
agaatatgattcagaccattag

SEQ ID NO: 7001194 - DNA, 22 bp, Homo sapiens
taccattgtaccaaggtaattt

SEQ ID NO: 7001195 - DNA, 22 bp, Homo sapiens
ttgctactggcatctcgtgggt

SEQ ID NO: 7001196 - DNA, 22 bp, Homo sapiens
tgcagcgcataagctattttga

SEQ ID NO: 7001197 - DNA, 21 bp, Homo sapiens
tagaatcactaataagatgta

SEQ ID NO: 7001198 - DNA, 22 bp, Homo sapiens
attagatcctggcaccatccct

SEQ ID NO: 7001199 - DNA, 22 bp, Homo sapiens
aaggggatagagcagacactcc

SEQ ID NO: 7001200 - DNA, 22 bp, Homo sapiens
tggtccagtagcagggatacca

SEQ ID NO: 7001201 - DNA, 18 bp, Homo sapiens
gcagatcattagataatt

SEQ ID NO: 7001202 - DNA, 22 bp, Homo sapiens
tttacagaatgttgaatttggg

SEQ ID NO: 7001203 - DNA, 22 bp, Homo sapiens
cagctggctgcatgatgccaaa

SEQ ID NO: 7001204 - DNA, 22 bp, Homo sapiens
atctgtggccaaaagactgttg

SEQ ID NO: 7001205 - DNA, 22 bp, Homo sapiens
ataaaaccaaagcagcagtgtt

SEQ ID NO: 7001206 - DNA, 22 bp, Homo sapiens
gatcagagtggctagagccttg

SEQ ID NO: 7001207 - DNA, 22 bp, Homo sapiens
tgaagtatggaatgtagaagtg

SEQ ID NO: 7001208 - DNA, 22 bp, Homo sapiens
gccaaggccctgtctgttttac

SEQ ID NO: 7001209 - DNA, 23 bp, Homo sapiens
actgaagatgtcttagtggccct

SEQ ID NO: 7001210 - DNA, 22 bp, Homo sapiens
tcagtttcctggttgtgatatt

SEQ ID NO: 7001211 - DNA, 22 bp, Homo sapiens
ttggtttatttcttcctatgag

SEQ ID NO: 7001212 - DNA, 22 bp, Homo sapiens
ccaggaggtggaggttgcggtg

SEQ ID NO: 7001213 - DNA, 22 bp, Homo sapiens
ccgggaggtggaggttgcagtg

SEQ ID NO: 7001214 - DNA, 22 bp, Homo sapiens
ttatctgtttaacaaagtatct

SEQ ID NO: 7001215 - DNA, 22 bp, Homo sapiens
aactgcctgtaaaatcttgggt

SEQ ID NO: 7001216 - DNA, 22 bp, Homo sapiens
cacatgttcttgaagccaactc

SEQ ID NO: 7001217 - DNA, 21 bp, Homo sapiens
ggggcctctccacacagccgg

SEQ ID NO: 7001218 - DNA, 19 bp, Homo sapiens
gtgtctgcctttgtgccac

SEQ ID NO: 7001219 - DNA, 23 bp, Homo sapiens
tctgtcttgtttaggccactgtt

SEQ ID NO: 7001220 - DNA, 22 bp, Homo sapiens
tcagtggtctaggcaatatata

SEQ ID NO: 7001221 - DNA, 22 bp, Homo sapiens
tgagggcagagcactggggagc

SEQ ID NO: 7001222 - DNA, 20 bp, Homo sapiens
cagtgcctatcattaattcc

SEQ ID NO: 7001223 - DNA, 22 bp, Homo sapiens
gaagcatcagcaatggctggaa

SEQ ID NO: 7001224 - DNA, 23 bp, Homo sapiens
agaaaagttcatacctttttaac

SEQ ID NO: 7001225 - DNA, 22 bp, Homo sapiens
agattggttgaactgatttgca

SEQ ID NO: 7001226 - DNA, 22 bp, Homo sapiens
cctgagggcgtaattaacagtg

SEQ ID NO: 7001227 - DNA, 22 bp, Homo sapiens
ggcagtctagtgtccttgggcc

SEQ ID NO: 7001228 - DNA, 22 bp, Homo sapiens
tcagatgttgaaaaggaaaagt

SEQ ID NO: 7001229 - DNA, 22 bp, Homo sapiens
agcataaaataaatagtttgca

SEQ ID NO: 7001230 - DNA, 22 bp, Homo sapiens
agcatgtgtggagaaatatttt

SEQ ID NO: 7001231 - DNA, 22 bp, Homo sapiens
tatttccttgagacggagtctc

SEQ ID NO: 7001232 - DNA, 22 bp, Homo sapiens
tcagggtcagattccagagcct

SEQ ID NO: 7001233 - DNA, 22 bp, Homo sapiens
agagactggcttctaaaatggc

SEQ ID NO: 7001234 - DNA, 22 bp, Homo sapiens
catcacagggggctagaagtct

SEQ ID NO: 7001235 - DNA, 22 bp, Homo sapiens
atgcctccctgtccttcagttc

SEQ ID NO: 7001236 - DNA, 22 bp, Homo sapiens
tgtcagcagaagtggtgcactc

SEQ ID NO: 7001237 - DNA, 22 bp, Homo sapiens
actctgccttagtcctggggct

SEQ ID NO: 7001238 - DNA, 22 bp, Homo sapiens
atggatgtgaagagggagaagc

SEQ ID NO: 7001239 - DNA, 22 bp, Homo sapiens
tagtcagatatatgacttacgt

SEQ ID NO: 7001240 - DNA, 22 bp, Homo sapiens
tcttggcaatttgatctcagtt

SEQ ID NO: 7001241 - DNA, 22 bp, Homo sapiens
gctggctgagatctgttttcct

SEQ ID NO: 7001242 - DNA, 22 bp, Homo sapiens
attgatgggaatggctaaactt

SEQ ID NO: 7001243 - DNA, 22 bp, Homo sapiens
acataattataaatggtgggct

SEQ ID NO: 7001244 - DNA, 22 bp, Homo sapiens
gagacattttaaagagccatgc

SEQ ID NO: 7001245 - DNA, 22 bp, Homo sapiens
aacatttttaagaccaagtgct

SEQ ID NO: 7001246 - DNA, 22 bp, Homo sapiens
attgtataattgtattgccaaa

SEQ ID NO: 7001247 - DNA, 22 bp, Homo sapiens
gctgataagagggcaatgagtg

SEQ ID NO: 7001248 - DNA, 22 bp, Homo sapiens
atgcaggggccgcctggccagg

SEQ ID NO: 7001249 - DNA, 17 bp, Homo sapiens
ggttcacttggtttgtc

SEQ ID NO: 7001250 - DNA, 22 bp, Homo sapiens
ctagggacagaaagagggtaga

SEQ ID NO: 7001251 - DNA, 22 bp, Homo sapiens
tagtccttgctgggcacagagt

SEQ ID NO: 7001252 - DNA, 19 bp, Homo sapiens
ctcagcaagatagaaatgg

SEQ ID NO: 7001253 - DNA, 22 bp, Homo sapiens
atgaagacaggtctcatcacca

SEQ ID NO: 7001254 - DNA, 22 bp, Homo sapiens
atctttggtcttgagtgcatct

SEQ ID NO: 7001255 - DNA, 22 bp, Homo sapiens
ggtggcctgccctgatccctgg

SEQ ID NO: 7001256 - DNA, 22 bp, Homo sapiens
tcctttggagcttgactggtag

SEQ ID NO: 7001257 - DNA, 22 bp, Homo sapiens
gatttcctagacatggggcaga

SEQ ID NO: 7001258 - DNA, 22 bp, Homo sapiens
aagtttggcaagttggtttagt

SEQ ID NO: 7001259 - DNA, 22 bp, Homo sapiens
tctctcttcaacccttaactag

SEQ ID NO: 7001260 - DNA, 22 bp, Homo sapiens
aagtccagctctaaatatctga

SEQ ID NO: 7001261 - DNA, 22 bp, Homo sapiens
cgggcactgcctttgttgattt

SEQ ID NO: 7001262 - DNA, 22 bp, Homo sapiens
ttaaagcctgactgtggactac

SEQ ID NO: 7001263 - DNA, 19 bp, Homo sapiens
tgggacacgatctgcctgt

SEQ ID NO: 7001264 - DNA, 22 bp, Homo sapiens
atgaacagaggcactaggaggg

SEQ ID NO: 7001265 - DNA, 22 bp, Homo sapiens
ttgtggattctatttcccagaa

SEQ ID NO: 7001266 - DNA, 22 bp, Homo sapiens
agaattctccttcagggcagga

SEQ ID NO: 7001267 - DNA, 22 bp, Homo sapiens
agggaggatctgctccttgtct

SEQ ID NO: 7001268 - DNA, 22 bp, Homo sapiens
aagagcattcctaaaggaccat

SEQ ID NO: 7001269 - DNA, 22 bp, Homo sapiens
atagtagctttgatgcctttat

SEQ ID NO: 7001270 - DNA, 22 bp, Homo sapiens
agtcatatgtggcattttctaa

SEQ ID NO: 7001271 - DNA, 22 bp, Homo sapiens
cgtcctctagagggaagcactt

SEQ ID NO: 7001272 - DNA, 22 bp, Homo sapiens
tctgttgactcctagcagccat

SEQ ID NO: 7001273 - DNA, 22 bp, Homo sapiens
gtgggcagaattgaatctttaa

SEQ ID NO: 7001274 - DNA, 22 bp, Homo sapiens
atagcagtaacactgacatttt

SEQ ID NO: 7001275 - DNA, 22 bp, Homo sapiens
aacatctttgataaacttagtg

SEQ ID NO: 7001276 - DNA, 22 bp, Homo sapiens
ggagcgagcccgatagcgctgg

SEQ ID NO: 7001277 - DNA, 22 bp, Homo sapiens
ttctggcaaggcaagcctggct

SEQ ID NO: 7001278 - DNA, 22 bp, Homo sapiens
gaaacctcttagcctctctttg

SEQ ID NO: 7001279 - DNA, 22 bp, Homo sapiens
tttgctataaaagggtcacacg

SEQ ID NO: 7001280 - DNA, 22 bp, Homo sapiens
gtccagtctctttccaagccca

SEQ ID NO: 7001281 - DNA, 22 bp, Homo sapiens
cagacagcaggcctggatgtgt

SEQ ID NO: 7001282 - DNA, 22 bp, Homo sapiens
taagttttctggaataacttgg

SEQ ID NO: 7001283 - DNA, 22 bp, Homo sapiens
ctgcttcatagccctggtctct

SEQ ID NO: 7001284 - DNA, 21 bp, Homo sapiens
agacactggtttagcattcat

SEQ ID NO: 7001285 - DNA, 22 bp, Homo sapiens
ccagtgtgcaatctctggctta

SEQ ID NO: 7001286 - DNA, 22 bp, Homo sapiens
acagcctggcctgagttaaggc

SEQ ID NO: 7001287 - DNA, 22 bp, Homo sapiens
atgttcctcattcttgcaaccc

SEQ ID NO: 7001288 - DNA, 22 bp, Homo sapiens
aaggctcaggagtcccttaagc

SEQ ID NO: 7001289 - DNA, 20 bp, Homo sapiens
ctgctcagaccaactcttct

SEQ ID NO: 7001290 - DNA, 22 bp, Homo sapiens
cagcaagacaggattcccgtgg

SEQ ID NO: 7001291 - DNA, 22 bp, Homo sapiens
cacaaagtataacttgatggaa

SEQ ID NO: 7001292 - DNA, 22 bp, Homo sapiens
agtgctatcgagttctaatgct

SEQ ID NO: 7001293 - DNA, 22 bp, Homo sapiens
cctggagatttcttcaagcttt

SEQ ID NO: 7001294 - DNA, 22 bp, Homo sapiens
aggctaatatttatgaaaccaa

SEQ ID NO: 7001295 - DNA, 22 bp, Homo sapiens
ccaaacatttcaaatttagaga

SEQ ID NO: 7001296 - DNA, 22 bp, Homo sapiens
tgcctgtcttaatatctggaaa

SEQ ID NO: 7001297 - DNA, 22 bp, Homo sapiens
agccatgtatgagggtttccag

SEQ ID NO: 7001298 - DNA, 22 bp, Homo sapiens
caaagttgcagttatgtgatta

SEQ ID NO: 7001299 - DNA, 22 bp, Homo sapiens
ccagctctgcttgcccagtcag

SEQ ID NO: 7001300 - DNA, 22 bp, Homo sapiens
agctgggaagagttttctgcag

SEQ ID NO: 7001301 - DNA, 22 bp, Homo sapiens
ggctaagggttatacatgaacc

SEQ ID NO: 7001302 - DNA, 22 bp, Homo sapiens
gtggcctttatcttaggtatcc

SEQ ID NO: 7001303 - DNA, 22 bp, Homo sapiens
ctcctctccatcagcgccaccc

SEQ ID NO: 7001304 - DNA, 22 bp, Homo sapiens
acacatgggtggggagctaagt

SEQ ID NO: 7001305 - DNA, 20 bp, Homo sapiens
cctggctgcattcaggacgg

SEQ ID NO: 7001306 - DNA, 22 bp, Homo sapiens
aataatctcactttatgtggaa

SEQ ID NO: 7001307 - DNA, 22 bp, Homo sapiens
caggagctactcaggttgggtt

SEQ ID NO: 7001308 - DNA, 22 bp, Homo sapiens
caagaaccgcaattacttttgc

SEQ ID NO: 7001309 - DNA, 22 bp, Homo sapiens
tgcatttggggcagactagcag

SEQ ID NO: 7001310 - DNA, 22 bp, Homo sapiens
actgagagtcaagatagcatgg

SEQ ID NO: 7001311 - DNA, 23 bp, Homo sapiens
gacctggctttgaatcttgactc

SEQ ID NO: 7001312 - DNA, 22 bp, Homo sapiens
cccagagtcaagcttaccatta

SEQ ID NO: 7001313 - DNA, 22 bp, Homo sapiens
caggctgctccagggtaggaaa

SEQ ID NO: 7001314 - DNA, 22 bp, Homo sapiens
tggtctgggcaaatccttctga

SEQ ID NO: 7001315 - DNA, 22 bp, Homo sapiens
aggaatgtttagaatgtcagaa

SEQ ID NO: 7001316 - DNA, 22 bp, Homo sapiens
ttcagagaattggataattcgt

SEQ ID NO: 7001317 - DNA, 22 bp, Homo sapiens
tcattcatatctctcaagctta

SEQ ID NO: 7001318 - DNA, 22 bp, Homo sapiens
ctgagcaccccaggacctgcgc

SEQ ID NO: 7001319 - DNA, 22 bp, Homo sapiens
aggccagcacgacagccgcagg

SEQ ID NO: 7001320 - DNA, 22 bp, Homo sapiens
tattgtcttcaactctactttt

SEQ ID NO: 7001321 - DNA, 22 bp, Homo sapiens
acaggcactctcattaaaatag

SEQ ID NO: 7001322 - DNA, 22 bp, Homo sapiens
ctccttggttcaaatgataaaa

SEQ ID NO: 7001323 - DNA, 22 bp, Homo sapiens
gacaatttctcaatatagaaac

SEQ ID NO: 7001324 - DNA, 22 bp, Homo sapiens
actctgtgaagtcttattatgc

SEQ ID NO: 7001325 - DNA, 22 bp, Homo sapiens
aatcagaccgttctggctgtcc

SEQ ID NO: 7001326 - DNA, 22 bp, Homo sapiens
agtctgggcatttaggatgttg

SEQ ID NO: 7001327 - DNA, 22 bp, Homo sapiens
ggagcaagaggtggtgaaaaat

SEQ ID NO: 7001328 - DNA, 22 bp, Homo sapiens
aattagtattgcgattcattag

SEQ ID NO: 7001329 - DNA, 22 bp, Homo sapiens
gagtttattcaggaaatagcca

SEQ ID NO: 7001330 - DNA, 22 bp, Homo sapiens
ctttactgtttggtgctctatt

SEQ ID NO: 7001331 - DNA, 20 bp, Homo sapiens
tgatttctcttctattcctt

SEQ ID NO: 7001332 - DNA, 22 bp, Homo sapiens
ctctcctggggagcacacacac

SEQ ID NO: 7001333 - DNA, 22 bp, Homo sapiens
agagtctgcatttctacaagct

SEQ ID NO: 7001334 - DNA, 22 bp, Homo sapiens
tgattgaatattcccttgggcc

SEQ ID NO: 7001335 - DNA, 22 bp, Homo sapiens
tgtcatgtggcaattaaagcag

SEQ ID NO: 7001336 - DNA, 22 bp, Homo sapiens
attgacaaaaacaggtggttga

SEQ ID NO: 7001337 - DNA, 22 bp, Homo sapiens
ggtagccaatgaaatgacagtt

SEQ ID NO: 7001338 - DNA, 22 bp, Homo sapiens
atgaagataatagcattggttg

SEQ ID NO: 7001339 - DNA, 22 bp, Homo sapiens
ctgtcagaggctctctgttgcc

SEQ ID NO: 7001340 - DNA, 22 bp, Homo sapiens
aagtcttaaccaaataaatgtt

SEQ ID NO: 7001341 - DNA, 22 bp, Homo sapiens
ggagccctagctgtgcatcaga

SEQ ID NO: 7001342 - DNA, 22 bp, Homo sapiens
agcacctgggaagctattctca

SEQ ID NO: 7001343 - DNA, 22 bp, Homo sapiens
atctgcccttgattgccctagg

SEQ ID NO: 7001344 - DNA, 21 bp, Homo sapiens
agatccctgaggagagcatcc

SEQ ID NO: 7001345 - DNA, 22 bp, Homo sapiens
cctggctcagaccccagttctg

SEQ ID NO: 7001346 - DNA, 22 bp, Homo sapiens
cgtcttcacatccttcccatgg

SEQ ID NO: 7001347 - DNA, 22 bp, Homo sapiens
aggcatgttaatcatcttaaaa

SEQ ID NO: 7001348 - DNA, 22 bp, Homo sapiens
ctgtttgttggctattgacagt

SEQ ID NO: 7001349 - DNA, 22 bp, Homo sapiens
ctgggtctggctactgcttcct

SEQ ID NO: 7001350 - DNA, 22 bp, Homo sapiens
catcaaagttggtatatttgca

SEQ ID NO: 7001351 - DNA, 20 bp, Homo sapiens
ctcacactggaaaagtctga

SEQ ID NO: 7001352 - DNA, 22 bp, Homo sapiens
ttaagacagtgtatttgttttc

SEQ ID NO: 7001353 - DNA, 22 bp, Homo sapiens
tactgttttctttatagtacag

SEQ ID NO: 7001354 - DNA, 22 bp, Homo sapiens
accagcattgctttgggttata

SEQ ID NO: 7001355 - DNA, 22 bp, Homo sapiens
ttccacagatgtatgaagtggt

SEQ ID NO: 7001356 - DNA, 22 bp, Homo sapiens
gccaaggaaggcttcctggaag

SEQ ID NO: 7001357 - DNA, 19 bp, Homo sapiens
atgtgcttgggccatgcta

SEQ ID NO: 7001358 - DNA, 22 bp, Homo sapiens
acagcattccctttggctgctt

SEQ ID NO: 7001359 - DNA, 22 bp, Homo sapiens
agttgcagacgcagagatgttg

SEQ ID NO: 7001360 - DNA, 22 bp, Homo sapiens
gactatgtgcctgcgagtgtca

SEQ ID NO: 7001361 - DNA, 22 bp, Homo sapiens
cattaggcccttgtcagctagt

SEQ ID NO: 7001362 - DNA, 22 bp, Homo sapiens
aggctctggttcatcatgatgg

SEQ ID NO: 7001363 - DNA, 22 bp, Homo sapiens
agagggctggacgcaggttgga

SEQ ID NO: 7001364 - DNA, 22 bp, Homo sapiens
tttgagaagtaattcaagacat

SEQ ID NO: 7001365 - DNA, 22 bp, Homo sapiens
tggaaacaaagtcataagctca

SEQ ID NO: 7001366 - DNA, 22 bp, Homo sapiens
gaggaggccagtggaaggaagc

SEQ ID NO: 7001367 - DNA, 22 bp, Homo sapiens
tgctctatgggacacttctgct

SEQ ID NO: 7001368 - DNA, 22 bp, Homo sapiens
cgccagaactgtaagagaataa

SEQ ID NO: 7001369 - DNA, 22 bp, Homo sapiens
cctttccccgcgggaggtgcca

SEQ ID NO: 7001370 - DNA, 22 bp, Homo sapiens
gcatttgaaatgcaagaaagtg

SEQ ID NO: 7001371 - DNA, 22 bp, Homo sapiens
acttttgaagaattatgcaaaa

SEQ ID NO: 7001372 - DNA, 18 bp, Homo sapiens
aggcttcccaggcaggcc

SEQ ID NO: 7001373 - DNA, 22 bp, Homo sapiens
tctgaggcccctgggcaggatg

SEQ ID NO: 7001374 - DNA, 22 bp, Homo sapiens
aagccctgccacccattcactg

SEQ ID NO: 7001375 - DNA, 22 bp, Homo sapiens
tacacttttcaatgtagtctgt

SEQ ID NO: 7001376 - DNA, 22 bp, Homo sapiens
caggacagaaataaggaatata

SEQ ID NO: 7001377 - DNA, 22 bp, Homo sapiens
cagtagcatgcttatcttttga

SEQ ID NO: 7001378 - DNA, 22 bp, Homo sapiens
ttcctgcaagatctttaaggag

SEQ ID NO: 7001379 - DNA, 22 bp, Homo sapiens
atccttctccaaaactggctcc

SEQ ID NO: 7001380 - DNA, 22 bp, Homo sapiens
tgaggcaatgtccttcatcctt

SEQ ID NO: 7001381 - DNA, 22 bp, Homo sapiens
taaggtttctagtttctaaact

SEQ ID NO: 7001382 - DNA, 22 bp, Homo sapiens
gatactgttttgtttgtgaggt

SEQ ID NO: 7001383 - DNA, 22 bp, Homo sapiens
ggcagctccaaaaggaaacact

SEQ ID NO: 7001384 - DNA, 22 bp, Homo sapiens
tgcagtgcagctggaagttggc

SEQ ID NO: 7001385 - DNA, 22 bp, Homo sapiens
aatttgtacaaaatgtttataa

SEQ ID NO: 7001386 - DNA, 22 bp, Homo sapiens
atggaaatacagccagagcaga

SEQ ID NO: 7001387 - DNA, 22 bp, Homo sapiens
atttacattccatggtggttac

SEQ ID NO: 7001388 - DNA, 19 bp, Homo sapiens
gcctctgctggggacaggc

SEQ ID NO: 7001389 - DNA, 23 bp, Homo sapiens
aaggtatttattttaaaggtaag

SEQ ID NO: 7001390 - DNA, 22 bp, Homo sapiens
ttccttgaaagctggacatggg

SEQ ID NO: 7001391 - DNA, 22 bp, Homo sapiens
aaagtactttgggctatgtttg

SEQ ID NO: 7001392 - DNA, 22 bp, Homo sapiens
ttcatgaatggaatcaatgctc

SEQ ID NO: 7001393 - DNA, 22 bp, Homo sapiens
gatgaaatgctgagcctgagtt

SEQ ID NO: 7001394 - DNA, 20 bp, Homo sapiens
tgacaactctgagaacgttc

SEQ ID NO: 7001395 - DNA, 22 bp, Homo sapiens
agccttagggattgaggttgct

SEQ ID NO: 7001396 - DNA, 22 bp, Homo sapiens
atccagaagcatgtgtaatttg

SEQ ID NO: 7001397 - DNA, 22 bp, Homo sapiens
aagatgtgaaattgtctctggg

SEQ ID NO: 7001398 - DNA, 22 bp, Homo sapiens
gtgggggacccaggtgctgtcc

SEQ ID NO: 7001399 - DNA, 22 bp, Homo sapiens
cattaacaaatggaagcatgaa

SEQ ID NO: 7001400 - DNA, 22 bp, Homo sapiens
caggaaattctttttaacagaa

SEQ ID NO: 7001401 - DNA, 22 bp, Homo sapiens
tagcagagctgcaatatagacc

SEQ ID NO: 7001402 - DNA, 22 bp, Homo sapiens
agaggccatgctagaggcctgg

SEQ ID NO: 7001403 - DNA, 22 bp, Homo sapiens
ccatgtgttgagattccagcct

SEQ ID NO: 7001404 - DNA, 22 bp, Homo sapiens
tggcacaagggctattccttag

SEQ ID NO: 7001405 - DNA, 22 bp, Homo sapiens
cttcagtgttgccagggcctag

SEQ ID NO: 7001406 - DNA, 22 bp, Homo sapiens
tctctcttgtcaccccatctgc

SEQ ID NO: 7001407 - DNA, 22 bp, Homo sapiens
acagctctgtgtattgtcatct

SEQ ID NO: 7001408 - DNA, 22 bp, Homo sapiens
catagttagtggttcagagcaa

SEQ ID NO: 7001409 - DNA, 22 bp, Homo sapiens
tcataacagctaagtccctttc

SEQ ID NO: 7001410 - DNA, 22 bp, Homo sapiens
agccatgttaaatggacttgat

SEQ ID NO: 7001411 - DNA, 22 bp, Homo sapiens
acagtggaatggtgggcctgca

SEQ ID NO: 7001412 - DNA, 22 bp, Homo sapiens
ctatttatgtccaagtgtttta

SEQ ID NO: 7001413 - DNA, 22 bp, Homo sapiens
aaatctgttgtaatgtttttta

SEQ ID NO: 7001414 - DNA, 22 bp, Homo sapiens
aaccctaggtggcagaggttgc

SEQ ID NO: 7001415 - DNA, 22 bp, Homo sapiens
taggatatgtgaaatcatatta

SEQ ID NO: 7001416 - DNA, 22 bp, Homo sapiens
aagcagaactgggaagtagtgg

SEQ ID NO: 7001417 - DNA, 22 bp, Homo sapiens
tctctccctttccttatcagtt

SEQ ID NO: 7001418 - DNA, 22 bp, Homo sapiens
ttggggagttaatgccaaagat

SEQ ID NO: 7001419 - DNA, 21 bp, Homo sapiens
caggtttgctatggagcagcc

SEQ ID NO: 7001420 - DNA, 22 bp, Homo sapiens
ttcagatgattagaatagtatt

SEQ ID NO: 7001421 - DNA, 22 bp, Homo sapiens
cttcactgcagtcatggctctg

SEQ ID NO: 7001422 - DNA, 22 bp, Homo sapiens
ggaagaaaggtggacaacaggt

SEQ ID NO: 7001423 - DNA, 22 bp, Homo sapiens
attgtgcacctactgtgtgcag

SEQ ID NO: 7001424 - DNA, 22 bp, Homo sapiens
tctgaagctggaggaagctttg

SEQ ID NO: 7001425 - DNA, 22 bp, Homo sapiens
ccatgggcactgggtggaggta

SEQ ID NO: 7001426 - DNA, 22 bp, Homo sapiens
ccctgtgcacacacttcactct

SEQ ID NO: 7001427 - DNA, 21 bp, Homo sapiens
cctattgaatataggaagatt

SEQ ID NO: 7001428 - DNA, 22 bp, Homo sapiens
ggcagtctgcaatttcattagc

SEQ ID NO: 7001429 - DNA, 22 bp, Homo sapiens
ggacctgctctcccagttctct

SEQ ID NO: 7001430 - DNA, 22 bp, Homo sapiens
atctctgtaattacatgatatt

SEQ ID NO: 7001431 - DNA, 22 bp, Homo sapiens
agaagccatgtttagtaggatg

SEQ ID NO: 7001432 - DNA, 22 bp, Homo sapiens
ttcactagcaacattacaagaa

SEQ ID NO: 7001433 - DNA, 22 bp, Homo sapiens
agtccagtcggcctggagaaat

SEQ ID NO: 7001434 - DNA, 22 bp, Homo sapiens
gctgggaagtgcaagatcaagg

SEQ ID NO: 7001435 - DNA, 22 bp, Homo sapiens
cagtgtttccgtcagtatgtga

SEQ ID NO: 7001436 - DNA, 22 bp, Homo sapiens
tgcttctctgttctaacccttg

SEQ ID NO: 7001437 - DNA, 22 bp, Homo sapiens
atttgggcagtccatgaaataa

SEQ ID NO: 7001438 - DNA, 22 bp, Homo sapiens
aaagattatggaacacacatga

SEQ ID NO: 7001439 - DNA, 22 bp, Homo sapiens
ctgagggagggactttgagact

SEQ ID NO: 7001440 - DNA, 22 bp, Homo sapiens
gggcagctggatagttttaaat

SEQ ID NO: 7001441 - DNA, 22 bp, Homo sapiens
ctttacttctcaaaataaagca

SEQ ID NO: 7001442 - DNA, 22 bp, Homo sapiens
gttggctatgagagctttagtg

SEQ ID NO: 7001443 - DNA, 22 bp, Homo sapiens
ggtccctggaagtccctcttct

SEQ ID NO: 7001444 - DNA, 22 bp, Homo sapiens
tttggtgatagtgcagagaaat

SEQ ID NO: 7001445 - DNA, 22 bp, Homo sapiens
aatatgcctgctgtcttcaatt

SEQ ID NO: 7001446 - DNA, 22 bp, Homo sapiens
acacaataaatttatcctttga

SEQ ID NO: 7001447 - DNA, 21 bp, Homo sapiens
tggagctgaatttttggcatc

SEQ ID NO: 7001448 - DNA, 22 bp, Homo sapiens
ttcaaagcaagacacaattcct

SEQ ID NO: 7001449 - DNA, 17 bp, Homo sapiens
acagaggttatacagac

SEQ ID NO: 7001450 - DNA, 21 bp, Homo sapiens
ttaaagcctccctcataagga

SEQ ID NO: 7001451 - DNA, 22 bp, Homo sapiens
tccaaagcagacagggggcgta

SEQ ID NO: 7001452 - DNA, 22 bp, Homo sapiens
gagctctgatgtttagtggaga

SEQ ID NO: 7001453 - DNA, 22 bp, Homo sapiens
gttatgatggcaccactgcact

SEQ ID NO: 7001454 - DNA, 22 bp, Homo sapiens
actctgtacgcaagagatggag

SEQ ID NO: 7001455 - DNA, 21 bp, Homo sapiens
taggacagcccccctgccctc

SEQ ID NO: 7001456 - DNA, 22 bp, Homo sapiens
ggtgcctgatggtgatgaggtc

SEQ ID NO: 7001457 - DNA, 22 bp, Homo sapiens
gctagcaggttgcatctgtctt

SEQ ID NO: 7001458 - DNA, 19 bp, Homo sapiens
tatgacagctggagggctc

SEQ ID NO: 7001459 - DNA, 22 bp, Homo sapiens
atccatttaattgaggggaagg

SEQ ID NO: 7001460 - DNA, 22 bp, Homo sapiens
ttaggtgtgacattttgttcct

SEQ ID NO: 7001461 - DNA, 22 bp, Homo sapiens
taacacatatctacaacatgtg

SEQ ID NO: 7001462 - DNA, 21 bp, Homo sapiens
agaagggattgtggtaaagat

SEQ ID NO: 7001463 - DNA, 22 bp, Homo sapiens
aaccctggccctggaataggca

SEQ ID NO: 7001464 - DNA, 20 bp, Homo sapiens
cacaggccccaagacctgta

SEQ ID NO: 7001465 - DNA, 22 bp, Homo sapiens
gtattaggttggtgcaaaattg

SEQ ID NO: 7001466 - DNA, 22 bp, Homo sapiens
ttaaagctgtagagttacttgc

SEQ ID NO: 7001467 - DNA, 17 bp, Homo sapiens
ttcagctactcaacaca

SEQ ID NO: 7001468 - DNA, 22 bp, Homo sapiens
tttcaaacttaaatacctttcc

SEQ ID NO: 7001469 - DNA, 22 bp, Homo sapiens
ataaggaatgatgtatcagttt

SEQ ID NO: 7001470 - DNA, 22 bp, Homo sapiens
tctaggagcttaaaggaggcca

SEQ ID NO: 7001471 - DNA, 22 bp, Homo sapiens
gcactggagatacagagatgaa

SEQ ID NO: 7001472 - DNA, 22 bp, Homo sapiens
tttcaaagttgggaattgtaat

SEQ ID NO: 7001473 - DNA, 22 bp, Homo sapiens
ttgaaataaggaagctcgaaat

SEQ ID NO: 7001474 - DNA, 22 bp, Homo sapiens
tagcagcacctacacgtcagag

SEQ ID NO: 7001475 - DNA, 22 bp, Homo sapiens
caaccagtagctgagttcaaaa

SEQ ID NO: 7001476 - DNA, 22 bp, Homo sapiens
tgtggtgagaaactggtagatt

SEQ ID NO: 7001477 - DNA, 22 bp, Homo sapiens
tagcccatatgaaatgatttgg

SEQ ID NO: 7001478 - DNA, 20 bp, Homo sapiens
aacagggggctgcagagggc

SEQ ID NO: 7001479 - DNA, 22 bp, Homo sapiens
tccagtagaattttattcaaca

SEQ ID NO: 7001480 - DNA, 18 bp, Homo sapiens
aatatgtctagttacagc

SEQ ID NO: 7001481 - DNA, 22 bp, Homo sapiens
cagcagcctcaagtttattttc

SEQ ID NO: 7001482 - DNA, 22 bp, Homo sapiens
ccaaggtgggcagatcacgagg

SEQ ID NO: 7001483 - DNA, 22 bp, Homo sapiens
tacatcatggcttcatgctgca

SEQ ID NO: 7001484 - DNA, 22 bp, Homo sapiens
tgagaatattgttttagtgagg

SEQ ID NO: 7001485 - DNA, 22 bp, Homo sapiens
gttccagggaagggaaggcaga

SEQ ID NO: 7001486 - DNA, 22 bp, Homo sapiens
gcagaggcctaggtggaaggcc

SEQ ID NO: 7001487 - DNA, 22 bp, Homo sapiens
ggaagattcagttatctcatga

SEQ ID NO: 7001488 - DNA, 22 bp, Homo sapiens
ccatgacattttaattttcact

SEQ ID NO: 7001489 - DNA, 22 bp, Homo sapiens
tcccctctttctggaaacacaa

SEQ ID NO: 7001490 - DNA, 22 bp, Homo sapiens
ttccagaaccttcctgctggaa

SEQ ID NO: 7001491 - DNA, 22 bp, Homo sapiens
ttggcaggaatattgcagaggt

SEQ ID NO: 7001492 - DNA, 22 bp, Homo sapiens
aacaggggctggttgaaagagc

SEQ ID NO: 7001493 - DNA, 22 bp, Homo sapiens
gagcagggagacaactctggtg

SEQ ID NO: 7001494 - DNA, 22 bp, Homo sapiens
gtgtaaggccccaggttcttta

SEQ ID NO: 7001495 - DNA, 18 bp, Homo sapiens
aaatggatgacagtacca

SEQ ID NO: 7001496 - DNA, 20 bp, Homo sapiens
tggaagaggagatgcctctg

SEQ ID NO: 7001497 - DNA, 22 bp, Homo sapiens
agggggtctcctatcatggaag

SEQ ID NO: 7001498 - DNA, 22 bp, Homo sapiens
tggagtcatcttaatctaggca

SEQ ID NO: 7001499 - DNA, 22 bp, Homo sapiens
ctgctcctctgaggtagccaca

SEQ ID NO: 7001500 - DNA, 22 bp, Homo sapiens
ctactgtcttccttggtaacaa

SEQ ID NO: 7001501 - DNA, 22 bp, Homo sapiens
agcttactgccccatggaagga

SEQ ID NO: 7001502 - DNA, 20 bp, Homo sapiens
cagggacagtggcagattca

SEQ ID NO: 7001503 - DNA, 22 bp, Homo sapiens
atagcaatggcaacaactaagc

SEQ ID NO: 7001504 - DNA, 22 bp, Homo sapiens
gcttccttattgttgccatagt

SEQ ID NO: 7001505 - DNA, 22 bp, Homo sapiens
cctgtttacatcatcaaggact

SEQ ID NO: 7001506 - DNA, 22 bp, Homo sapiens
ttacagattaaaatgctgaggt

SEQ ID NO: 7001507 - DNA, 22 bp, Homo sapiens
ctggcagggctctttgggtgct

SEQ ID NO: 7001508 - DNA, 22 bp, Homo sapiens
tgaggtctgtcctgtctttgga

SEQ ID NO: 7001509 - DNA, 22 bp, Homo sapiens
agtgtgtagcacatggtaagca

SEQ ID NO: 7001510 - DNA, 19 bp, Homo sapiens
aaggaatggctttaagtag

SEQ ID NO: 7001511 - DNA, 22 bp, Homo sapiens
gaattacatgaccctgagtaga

SEQ ID NO: 7001512 - DNA, 22 bp, Homo sapiens
tatggacatgctgggctggata

SEQ ID NO: 7001513 - DNA, 22 bp, Homo sapiens
gactttggagtggttctgctgc

SEQ ID NO: 7001514 - DNA, 22 bp, Homo sapiens
tgctggccggccaggtgctgag

SEQ ID NO: 7001515 - DNA, 22 bp, Homo sapiens
ggtctggcctcgggcaccccca

SEQ ID NO: 7001516 - DNA, 23 bp, Homo sapiens
acagtgaaacacgcagtaagagt

SEQ ID NO: 7001517 - DNA, 22 bp, Homo sapiens
taactgtatttttctgagattc

SEQ ID NO: 7001518 - DNA, 22 bp, Homo sapiens
catttgtgtccgtcccagttct

SEQ ID NO: 7001519 - DNA, 22 bp, Homo sapiens
agctgcaagtaagcttgctcct

SEQ ID NO: 7001520 - DNA, 22 bp, Homo sapiens
ttttacacctcagatgagcaga

SEQ ID NO: 7001521 - DNA, 22 bp, Homo sapiens
tccaagcttgctttagccacag

SEQ ID NO: 7001522 - DNA, 22 bp, Homo sapiens
tatgtacacatacacttgtaat

SEQ ID NO: 7001523 - DNA, 22 bp, Homo sapiens
acagggtggggatggtgagctt

SEQ ID NO: 7001524 - DNA, 22 bp, Homo sapiens
caattcctctggttgcaaagct

SEQ ID NO: 7001525 - DNA, 22 bp, Homo sapiens
gcagctgacatctggctgggcc

SEQ ID NO: 7001526 - DNA, 22 bp, Homo sapiens
gttccaaagttagagtgtattg

SEQ ID NO: 7001527 - DNA, 22 bp, Homo sapiens
tgcaggaacagaactcactccc

SEQ ID NO: 7001528 - DNA, 22 bp, Homo sapiens
tgctccactcccaattgcatgt

SEQ ID NO: 7001529 - DNA, 22 bp, Homo sapiens
ggacagacagtgtgagtgaggc

SEQ ID NO: 7001530 - DNA, 22 bp, Homo sapiens
cagcatcatactacctaaatga

SEQ ID NO: 7001531 - DNA, 22 bp, Homo sapiens
tctgttgctttcttcctgtgtg

SEQ ID NO: 7001532 - DNA, 22 bp, Homo sapiens
cctggcttcctggagctcacaa

SEQ ID NO: 7001533 - DNA, 22 bp, Homo sapiens
gtgactgtttttaggaggagta

SEQ ID NO: 7001534 - DNA, 22 bp, Homo sapiens
ctgtgagacctgatttcttcat

SEQ ID NO: 7001535 - DNA, 22 bp, Homo sapiens
tgaaatgtaaataggactagaa

SEQ ID NO: 7001536 - DNA, 22 bp, Homo sapiens
tgaaagcagtgccatgattatg

SEQ ID NO: 7001537 - DNA, 22 bp, Homo sapiens
ggaggaagaggttgttctctca

SEQ ID NO: 7001538 - DNA, 22 bp, Homo sapiens
agctaacatggaggaaaaagtt

SEQ ID NO: 7001539 - DNA, 22 bp, Homo sapiens
ttgggaggtcataaatctgttc

SEQ ID NO: 7001540 - DNA, 22 bp, Homo sapiens
tccaattttctgatttcacttg

SEQ ID NO: 7001541 - DNA, 22 bp, Homo sapiens
ttgtatgagctccaggaactca

SEQ ID NO: 7001542 - DNA, 22 bp, Homo sapiens
attctctgatgcaggtggaaga

SEQ ID NO: 7001543 - DNA, 22 bp, Homo sapiens
agacatcagcttgtgtgcaggg

SEQ ID NO: 7001544 - DNA, 22 bp, Homo sapiens
gggatggctgcctgcatcagga

SEQ ID NO: 7001545 - DNA, 22 bp, Homo sapiens
ctgtagttgatgatttctgata

SEQ ID NO: 7001546 - DNA, 22 bp, Homo sapiens
cctctgccacctcccacgaggc

SEQ ID NO: 7001547 - DNA, 22 bp, Homo sapiens
gctgaggttttctgcctgctca

SEQ ID NO: 7001548 - DNA, 22 bp, Homo sapiens
tctggagtccagatccatttgg

SEQ ID NO: 7001549 - DNA, 22 bp, Homo sapiens
tcaagtatgacatcaagtttct

SEQ ID NO: 7001550 - DNA, 22 bp, Homo sapiens
ggcattaggtgaatgctcagca

SEQ ID NO: 7001551 - DNA, 22 bp, Homo sapiens
tattaataagtgactactagct

SEQ ID NO: 7001552 - DNA, 22 bp, Homo sapiens
cccttagagggctctccttact

SEQ ID NO: 7001553 - DNA, 22 bp, Homo sapiens
ttcttcaattcccatcccggtc

SEQ ID NO: 7001554 - DNA, 22 bp, Homo sapiens
gtctcctgagactgcagtcacc

SEQ ID NO: 7001555 - DNA, 22 bp, Homo sapiens
tggcagtggcatcaccccaata

SEQ ID NO: 7001556 - DNA, 23 bp, Homo sapiens
gaatagttttagaaattggagaa

SEQ ID NO: 7001557 - DNA, 22 bp, Homo sapiens
agagcccctggtggagtgagaa

SEQ ID NO: 7001558 - DNA, 17 bp, Homo sapiens
taagggggaaacggagc

SEQ ID NO: 7001559 - DNA, 22 bp, Homo sapiens
tttttgtgtatcctgctccatg

SEQ ID NO: 7001560 - DNA, 22 bp, Homo sapiens
ccttgcagggaaactggaccca

SEQ ID NO: 7001561 - DNA, 22 bp, Homo sapiens
ttggctcaaaacttagattcca

SEQ ID NO: 7001562 - DNA, 22 bp, Homo sapiens
ataatgtgatatttcatttaca

SEQ ID NO: 7001563 - DNA, 22 bp, Homo sapiens
tttgtcttaaatcttgttactg

SEQ ID NO: 7001564 - DNA, 22 bp, Homo sapiens
tggtctgttcaaggtggctgat

SEQ ID NO: 7001565 - DNA, 22 bp, Homo sapiens
atgaagttctagtgagaaatgc

SEQ ID NO: 7001566 - DNA, 22 bp, Homo sapiens
atctggcttacgaagcactggt

SEQ ID NO: 7001567 - DNA, 22 bp, Homo sapiens
tggcaccaccagacaccaggag

SEQ ID NO: 7001568 - DNA, 22 bp, Homo sapiens
atacacatatgtgtgtatatgt

SEQ ID NO: 7001569 - DNA, 22 bp, Homo sapiens
caactttctgttaaatgttagt

SEQ ID NO: 7001570 - DNA, 22 bp, Homo sapiens
agctttcttctagttgtacagt

SEQ ID NO: 7001571 - DNA, 22 bp, Homo sapiens
tgtcttattttaaaagggaagt

SEQ ID NO: 7001572 - DNA, 17 bp, Homo sapiens
gattagaaaacacatga

SEQ ID NO: 7001573 - DNA, 22 bp, Homo sapiens
ggcatttatctaatatagttta

SEQ ID NO: 7001574 - DNA, 22 bp, Homo sapiens
gaggctcagagggagcatggtc

SEQ ID NO: 7001575 - DNA, 22 bp, Homo sapiens
tgcttgctatgcatcctgaact

SEQ ID NO: 7001576 - DNA, 16 bp, Homo sapiens
ttctgtcacgtacggc

SEQ ID NO: 7001577 - DNA, 22 bp, Homo sapiens
caggccttctccctccctcaac

SEQ ID NO: 7001578 - DNA, 22 bp, Homo sapiens
ggcttcatctcgttgacacctc

SEQ ID NO: 7001579 - DNA, 22 bp, Homo sapiens
aatagaatttgtactgtgtttt

SEQ ID NO: 7001580 - DNA, 22 bp, Homo sapiens
ctgtctcaagactgcaggcact

SEQ ID NO: 7001581 - DNA, 22 bp, Homo sapiens
gaggcctggaattccagcctgg

SEQ ID NO: 7001582 - DNA, 22 bp, Homo sapiens
gacatggatacttgataagggg

SEQ ID NO: 7001583 - DNA, 22 bp, Homo sapiens
agtcttgtcttattttaataga

SEQ ID NO: 7001584 - DNA, 22 bp, Homo sapiens
tgcaagagcccagggccaggaa

SEQ ID NO: 7001585 - DNA, 22 bp, Homo sapiens
aattagctttacctaggattgt

SEQ ID NO: 7001586 - DNA, 22 bp, Homo sapiens
agaataaatgttggacttagga

SEQ ID NO: 7001587 - DNA, 22 bp, Homo sapiens
agggcagcaaagtttgacctca

SEQ ID NO: 7001588 - DNA, 22 bp, Homo sapiens
gctgaatagaagtcttcaaagg

SEQ ID NO: 7001589 - DNA, 22 bp, Homo sapiens
gggcttggctggggccaccaga

SEQ ID NO: 7001590 - DNA, 22 bp, Homo sapiens
tacagagatgtgaaaagctcta

SEQ ID NO: 7001591 - DNA, 23 bp, Homo sapiens
gggtgctgcctgtagtcatgctg

SEQ ID NO: 7001592 - DNA, 22 bp, Homo sapiens
aatgctctttaacctattctga

SEQ ID NO: 7001593 - DNA, 22 bp, Homo sapiens
ccaggcccttgcaagtcccacc

SEQ ID NO: 7001594 - DNA, 22 bp, Homo sapiens
ctctccttgcagatggctgcct

SEQ ID NO: 7001595 - DNA, 22 bp, Homo sapiens
agtgtgtacataattgtacgcc

SEQ ID NO: 7001596 - DNA, 22 bp, Homo sapiens
aggatggggtctgcagcctggt

SEQ ID NO: 7001597 - DNA, 20 bp, Homo sapiens
gccctggagccttgtcctgg

SEQ ID NO: 7001598 - DNA, 22 bp, Homo sapiens
tcatgttttaatgcctttttct

SEQ ID NO: 7001599 - DNA, 22 bp, Homo sapiens
cagtagcactctgtcagtgaag

SEQ ID NO: 7001600 - DNA, 22 bp, Homo sapiens
ttgaggaggtcctgggtttact

SEQ ID NO: 7001601 - DNA, 22 bp, Homo sapiens
tgggtcactatttgcagagacg

SEQ ID NO: 7001602 - DNA, 22 bp, Homo sapiens
tacttttccagggctggctgag

SEQ ID NO: 7001603 - DNA, 22 bp, Homo sapiens
gctcaggacccaggtgtgacct

SEQ ID NO: 7001604 - DNA, 21 bp, Homo sapiens
tccattgttttcccagggttt

SEQ ID NO: 7001605 - DNA, 22 bp, Homo sapiens
cagcagtacttctcagaggtat

SEQ ID NO: 7001606 - DNA, 22 bp, Homo sapiens
tgtaagccttccctgagaaagt

SEQ ID NO: 7001607 - DNA, 22 bp, Homo sapiens
tggaggtactcaggcacagagt

SEQ ID NO: 7001608 - DNA, 22 bp, Homo sapiens
agggtctggtgtagaagttctc

SEQ ID NO: 7001609 - DNA, 22 bp, Homo sapiens
agccacagagcaggagaccttt

SEQ ID NO: 7001610 - DNA, 22 bp, Homo sapiens
aacacaggttcattctgtgagg

SEQ ID NO: 7001611 - DNA, 22 bp, Homo sapiens
ggcctacattttggaagcagcc

SEQ ID NO: 7001612 - DNA, 22 bp, Homo sapiens
gtgcctgctgcagctgagcagt

SEQ ID NO: 7001613 - DNA, 22 bp, Homo sapiens
acaggtgattcaggctctggga

SEQ ID NO: 7001614 - DNA, 22 bp, Homo sapiens
ttacattcttatctcagttatt

SEQ ID NO: 7001615 - DNA, 22 bp, Homo sapiens
tggggaaggatcaccacaatct

SEQ ID NO: 7001616 - DNA, 22 bp, Homo sapiens
ggctctgttctaaattaataag

SEQ ID NO: 7001617 - DNA, 22 bp, Homo sapiens
tcctgggagcatgaagagggat

SEQ ID NO: 7001618 - DNA, 21 bp, Homo sapiens
actgtgcagcctgaggatgtg

SEQ ID NO: 7001619 - DNA, 22 bp, Homo sapiens
gaacatcttatccatttcctct

SEQ ID NO: 7001620 - DNA, 21 bp, Homo sapiens
ctgcaggtgctgccatcaggg

SEQ ID NO: 7001621 - DNA, 22 bp, Homo sapiens
tttgtgttgtacttctgtgcat

SEQ ID NO: 7001622 - DNA, 22 bp, Homo sapiens
gcactgcatctactggcaagta

SEQ ID NO: 7001623 - DNA, 22 bp, Homo sapiens
tgggctcagtctgcttggtcct

SEQ ID NO: 7001624 - DNA, 22 bp, Homo sapiens
agctggcaggtgaagatgattt

SEQ ID NO: 7001625 - DNA, 22 bp, Homo sapiens
atgcaaaagtagttgcagtttt

SEQ ID NO: 7001626 - DNA, 22 bp, Homo sapiens
aaaagacaggtgtctgcggccc

SEQ ID NO: 7001627 - DNA, 22 bp, Homo sapiens
agcccagagggtagcagaagaa

SEQ ID NO: 7001628 - DNA, 22 bp, Homo sapiens
atgttaaatggtttattattaa

SEQ ID NO: 7001629 - DNA, 19 bp, Homo sapiens
gctgtgcccctgccgcttg

SEQ ID NO: 7001630 - DNA, 22 bp, Homo sapiens
aggcatgtcagttgttttagtg

SEQ ID NO: 7001631 - DNA, 22 bp, Homo sapiens
tttataaaatagactgggtcta

SEQ ID NO: 7001632 - DNA, 22 bp, Homo sapiens
gtgacccaggtaggtaagcaat

SEQ ID NO: 7001633 - DNA, 22 bp, Homo sapiens
ttgaggtacaatgggtcagtta

SEQ ID NO: 7001634 - DNA, 22 bp, Homo sapiens
cgtgggaggaaaaatgggcttc

SEQ ID NO: 7001635 - DNA, 22 bp, Homo sapiens
agaaacatttagattatatgtc

SEQ ID NO: 7001636 - DNA, 22 bp, Homo sapiens
gccagcaccttagcatgaatca

SEQ ID NO: 7001637 - DNA, 22 bp, Homo sapiens
taatgtctatgggccagataat

SEQ ID NO: 7001638 - DNA, 22 bp, Homo sapiens
ggtggctcagtgtcaggccctg

SEQ ID NO: 7001639 - DNA, 22 bp, Homo sapiens
acagggcaacctctgggagact

SEQ ID NO: 7001640 - DNA, 22 bp, Homo sapiens
agcaccttgagatcaagcagtg

SEQ ID NO: 7001641 - DNA, 22 bp, Homo sapiens
ggctgacttctccagatctaaa

SEQ ID NO: 7001642 - DNA, 22 bp, Homo sapiens
gcccctgcctttgaacctggag

SEQ ID NO: 7001643 - DNA, 22 bp, Homo sapiens
aatgcagttgaatttgggtatg

SEQ ID NO: 7001644 - DNA, 22 bp, Homo sapiens
tgataatattttgaatcataag

SEQ ID NO: 7001645 - DNA, 22 bp, Homo sapiens
tcatgctagttaagaacacaat

SEQ ID NO: 7001646 - DNA, 22 bp, Homo sapiens
gagttatttggtttgcatgcag

SEQ ID NO: 7001647 - DNA, 22 bp, Homo sapiens
agggtccaactgaggctgaact

SEQ ID NO: 7001648 - DNA, 22 bp, Homo sapiens
caggaaatggctgaataaattc

SEQ ID NO: 7001649 - DNA, 22 bp, Homo sapiens
caggggcaagaatgctgtcagc

SEQ ID NO: 7001650 - DNA, 22 bp, Homo sapiens
gtgctcatatattcctcacata

SEQ ID NO: 7001651 - DNA, 22 bp, Homo sapiens
ctgggatccacgggctcccaag

SEQ ID NO: 7001652 - DNA, 22 bp, Homo sapiens
tgggggtgaaagtctggacagt

SEQ ID NO: 7001653 - DNA, 21 bp, Homo sapiens
tcatgtgtaacttttgaccac

SEQ ID NO: 7001654 - DNA, 22 bp, Homo sapiens
tgcattaaaatgatggagaaat

SEQ ID NO: 7001655 - DNA, 22 bp, Homo sapiens
acagcgttgtgtttgcaggatt

SEQ ID NO: 7001656 - DNA, 22 bp, Homo sapiens
tctgccatcttaattctctttt

SEQ ID NO: 7001657 - DNA, 22 bp, Homo sapiens
tgagcctgggagatggaggctg

SEQ ID NO: 7001658 - DNA, 20 bp, Homo sapiens
attgtttcatttaatgtaca

SEQ ID NO: 7001659 - DNA, 22 bp, Homo sapiens
gaggcagccagaggttctcatt

SEQ ID NO: 7001660 - DNA, 22 bp, Homo sapiens
tctgtcacccgagcaggcgaga

SEQ ID NO: 7001661 - DNA, 22 bp, Homo sapiens
ggcactggaaggatcatgtgag

SEQ ID NO: 7001662 - DNA, 22 bp, Homo sapiens
tccagcacagaatttcctagct

SEQ ID NO: 7001663 - DNA, 22 bp, Homo sapiens
ttgatctctgttgctgtctttg

SEQ ID NO: 7001664 - DNA, 22 bp, Homo sapiens
ctttacagaataagaatactgg

SEQ ID NO: 7001665 - DNA, 22 bp, Homo sapiens
tctctgaaagcagctgctcatc

SEQ ID NO: 7001666 - DNA, 22 bp, Homo sapiens
tatttgtctaagaggctgacag

SEQ ID NO: 7001667 - DNA, 22 bp, Homo sapiens
catacagttttccctagatgtg

SEQ ID NO: 7001668 - DNA, 22 bp, Homo sapiens
gcactggagaatggctgtattc

SEQ ID NO: 7001669 - DNA, 22 bp, Homo sapiens
gggtgctgaggaagacagcagg

SEQ ID NO: 7001670 - DNA, 17 bp, Homo sapiens
tcctgtgggtgcagcag

SEQ ID NO: 7001671 - DNA, 22 bp, Homo sapiens
gagctgagttacctccagatca

SEQ ID NO: 7001672 - DNA, 22 bp, Homo sapiens
agccctgccattctctggagct

SEQ ID NO: 7001673 - DNA, 22 bp, Homo sapiens
agacagcatgatacatgatgct

SEQ ID NO: 7001674 - DNA, 23 bp, Homo sapiens
attcactcagtgagagggcagcc

SEQ ID NO: 7001675 - DNA, 22 bp, Homo sapiens
taggaatgcatgggggattctg

SEQ ID NO: 7001676 - DNA, 22 bp, Homo sapiens
atctcccacaggctgctacttc

SEQ ID NO: 7001677 - DNA, 22 bp, Homo sapiens
atgatgaagcatggttacactg

SEQ ID NO: 7001678 - DNA, 23 bp, Homo sapiens
ccctgagctggtccaggctcaac

SEQ ID NO: 7001679 - DNA, 22 bp, Homo sapiens
ggtccagagctgatggtctttt

SEQ ID NO: 7001680 - DNA, 22 bp, Homo sapiens
acagggccagcctgggacctgg

SEQ ID NO: 7001681 - DNA, 22 bp, Homo sapiens
ggaagccatgagggacagttct

SEQ ID NO: 7001682 - DNA, 22 bp, Homo sapiens
tgccagactctggggtgctaga

SEQ ID NO: 7001683 - DNA, 22 bp, Homo sapiens
catgaattagcaatggtgtgca

SEQ ID NO: 7001684 - DNA, 19 bp, Homo sapiens
ccagagcccgccagatggg

SEQ ID NO: 7001685 - DNA, 22 bp, Homo sapiens
ggccaaatttatttgcagctgg

SEQ ID NO: 7001686 - DNA, 22 bp, Homo sapiens
accttgtcttttatagaacaag

SEQ ID NO: 7001687 - DNA, 22 bp, Homo sapiens
aagtcctgaagacacagaaaag

SEQ ID NO: 7001688 - DNA, 22 bp, Homo sapiens
ttcaaagtaaaaatgtgttcac

SEQ ID NO: 7001689 - DNA, 22 bp, Homo sapiens
tgctgctgggtttgacagtcac

SEQ ID NO: 7001690 - DNA, 22 bp, Homo sapiens
tcagtaaatgagcaaaaatttc

SEQ ID NO: 7001691 - DNA, 22 bp, Homo sapiens
gaggctcctcattcagtatgct

SEQ ID NO: 7001692 - DNA, 19 bp, Homo sapiens
tgccacagataaaaactga

SEQ ID NO: 7001693 - DNA, 23 bp, Homo sapiens
agaggcttatgtttatttcttcc

SEQ ID NO: 7001694 - DNA, 23 bp, Homo sapiens
actggacagagtggacgaggctg

SEQ ID NO: 7001695 - DNA, 20 bp, Homo sapiens
cactgaggtgcagctcatgc

SEQ ID NO: 7001696 - DNA, 22 bp, Homo sapiens
agctttcaggataatgaaaaag

SEQ ID NO: 7001697 - DNA, 22 bp, Homo sapiens
tctctcgactcacaagttttgc

SEQ ID NO: 7001698 - DNA, 22 bp, Homo sapiens
gatgatggtactgtatttgaat

SEQ ID NO: 7001699 - DNA, 22 bp, Homo sapiens
gcagcaagaataatttgggtag

SEQ ID NO: 7001700 - DNA, 22 bp, Homo sapiens
ggcctctcagggcagagaccct

SEQ ID NO: 7001701 - DNA, 18 bp, Homo sapiens
agtctttatttctttcat

SEQ ID NO: 7001702 - DNA, 22 bp, Homo sapiens
cgggcccgagcacggcacccac

SEQ ID NO: 7001703 - DNA, 22 bp, Homo sapiens
gtccttggcacccatgtgattc

SEQ ID NO: 7001704 - DNA, 22 bp, Homo sapiens
gattagaagaacttgttagcct

SEQ ID NO: 7001705 - DNA, 22 bp, Homo sapiens
tatctataagtactaacatggt

SEQ ID NO: 7001706 - DNA, 22 bp, Homo sapiens
gttcagtgattctcggtgttca

SEQ ID NO: 7001707 - DNA, 22 bp, Homo sapiens
cagtcaccatagaataaaacat

SEQ ID NO: 7001708 - DNA, 23 bp, Homo sapiens
agtattcaaaaggcaagctatat

SEQ ID NO: 7001709 - DNA, 22 bp, Homo sapiens
aggccctgggagcagagatgca

SEQ ID NO: 7001710 - DNA, 22 bp, Homo sapiens
acaagttctgggaattaggaca

SEQ ID NO: 7001711 - DNA, 19 bp, Homo sapiens
ggtggcagaacgtgggtcc

SEQ ID NO: 7001712 - DNA, 22 bp, Homo sapiens
acatatgttgtaaacattccaa

SEQ ID NO: 7001713 - DNA, 22 bp, Homo sapiens
gggagcaagccggaggtactgt

SEQ ID NO: 7001714 - DNA, 22 bp, Homo sapiens
catttattcatttgctagggct

SEQ ID NO: 7001715 - DNA, 22 bp, Homo sapiens
agcaaatacttgaataaaaaga

SEQ ID NO: 7001716 - DNA, 22 bp, Homo sapiens
tcttatagacagtggcagcagg

SEQ ID NO: 7001717 - DNA, 22 bp, Homo sapiens
ggagtttgcctattgcttttgg

SEQ ID NO: 7001718 - DNA, 20 bp, Homo sapiens
tctctgcagcagaggctggg

SEQ ID NO: 7001719 - DNA, 21 bp, Homo sapiens
aggatttctgtcatttcagat

SEQ ID NO: 7001720 - DNA, 22 bp, Homo sapiens
ttaaatgtttaatctaacttga

SEQ ID NO: 7001721 - DNA, 22 bp, Homo sapiens
aggcagccagatggcagcctgc

SEQ ID NO: 7001722 - DNA, 22 bp, Homo sapiens
tgacagcattactaatacatgt

SEQ ID NO: 7001723 - DNA, 21 bp, Homo sapiens
tcagaagtgcagcccaggaat

SEQ ID NO: 7001724 - DNA, 22 bp, Homo sapiens
gtttatgaatgtgtcagacata

SEQ ID NO: 7001725 - DNA, 21 bp, Homo sapiens
gggaagactgtcaggattcct

SEQ ID NO: 7001726 - DNA, 22 bp, Homo sapiens
tagccaggctgcagctgatccg

SEQ ID NO: 7001727 - DNA, 19 bp, Homo sapiens
acaataactcattgattgc

SEQ ID NO: 7001728 - DNA, 22 bp, Homo sapiens
tgtgagcactggctgggaaagt

SEQ ID NO: 7001729 - DNA, 22 bp, Homo sapiens
tagattctgtatgtctgctctc

SEQ ID NO: 7001730 - DNA, 22 bp, Homo sapiens
cacaatttgttttatcagtatt

SEQ ID NO: 7001731 - DNA, 22 bp, Homo sapiens
agaggccagaaggcgcaccccg

SEQ ID NO: 7001732 - DNA, 22 bp, Homo sapiens
cccccaccgtgttcctgctcgg

SEQ ID NO: 7001733 - DNA, 23 bp, Homo sapiens
ccagggcccctacaccactgtcc

SEQ ID NO: 7001734 - DNA, 23 bp, Homo sapiens
tgggtcactgtttcaccattgct

SEQ ID NO: 7001735 - DNA, 22 bp, Homo sapiens
tactgctgattagagctgaggt

SEQ ID NO: 7001736 - DNA, 22 bp, Homo sapiens
ggagagagagattgtgtttatt

SEQ ID NO: 7001737 - DNA, 22 bp, Homo sapiens
caggctggagtgcaatgacgcc

SEQ ID NO: 7001738 - DNA, 22 bp, Homo sapiens
accccttttatagaagaacaga

SEQ ID NO: 7001739 - DNA, 22 bp, Homo sapiens
actgccagttgttttgtccagt

SEQ ID NO: 7001740 - DNA, 22 bp, Homo sapiens
ctgctgtctttatttcactgct

SEQ ID NO: 7001741 - DNA, 22 bp, Homo sapiens
cagaagcaaatgccttgctgag

SEQ ID NO: 7001742 - DNA, 22 bp, Homo sapiens
aaattcccatagtctgcttcta

SEQ ID NO: 7001743 - DNA, 22 bp, Homo sapiens
gctgtggctctcacaagcaaat

SEQ ID NO: 7001744 - DNA, 22 bp, Homo sapiens
attagcttcctatagtaagggg

SEQ ID NO: 7001745 - DNA, 21 bp, Homo sapiens
gccttgccacatgtgccacag

SEQ ID NO: 7001746 - DNA, 22 bp, Homo sapiens
agtggtgataaccgctatcata

SEQ ID NO: 7001747 - DNA, 22 bp, Homo sapiens
tcataagctagctgcaccatat

SEQ ID NO: 7001748 - DNA, 22 bp, Homo sapiens
tgggtaagaattgggggctctg

SEQ ID NO: 7001749 - DNA, 18 bp, Homo sapiens
ggcctctggactggcagc

SEQ ID NO: 7001750 - DNA, 22 bp, Homo sapiens
tgaactaatgaggaaatggtct

SEQ ID NO: 7001751 - DNA, 22 bp, Homo sapiens
ataaagtctgggccaggcatgg

SEQ ID NO: 7001752 - DNA, 22 bp, Homo sapiens
gtgccacatggcctaatagaga

SEQ ID NO: 7001753 - DNA, 15 bp, Homo sapiens
gtatttcttttatat

SEQ ID NO: 7001754 - DNA, 22 bp, Homo sapiens
aagtgctaggattacaggtgtg

SEQ ID NO: 7001755 - DNA, 22 bp, Homo sapiens
cagatataaatggatgtggtag

SEQ ID NO: 7001756 - DNA, 22 bp, Homo sapiens
cactggttgggaaaggcagagg

SEQ ID NO: 7001757 - DNA, 22 bp, Homo sapiens
tactttccctcatcaacaatca

SEQ ID NO: 7001758 - DNA, 22 bp, Homo sapiens
gactttgtaggtaattgtgtct

SEQ ID NO: 7001759 - DNA, 22 bp, Homo sapiens
gttggccattaattggaggaca

SEQ ID NO: 7001760 - DNA, 22 bp, Homo sapiens
gctgggtccatggtcctcgggt

SEQ ID NO: 7001761 - DNA, 22 bp, Homo sapiens
ctggtgcaggaaggagctggca

SEQ ID NO: 7001762 - DNA, 22 bp, Homo sapiens
tttacaagtttacagaatgatg

SEQ ID NO: 7001763 - DNA, 20 bp, Homo sapiens
agtaacttgcctaaggtcag

SEQ ID NO: 7001764 - DNA, 22 bp, Homo sapiens
gattccacagcttcgaggtctt

SEQ ID NO: 7001765 - DNA, 22 bp, Homo sapiens
tcttggctggtcatttaaaatc

SEQ ID NO: 7001766 - DNA, 22 bp, Homo sapiens
tgagataagcaaggataaaggt

SEQ ID NO: 7001767 - DNA, 22 bp, Homo sapiens
aagatgttgactcctttgatgt

SEQ ID NO: 7001768 - DNA, 22 bp, Homo sapiens
ctgggctgcatcaaagaggcat

SEQ ID NO: 7001769 - DNA, 22 bp, Homo sapiens
ctttgttctgcacacacagaca

SEQ ID NO: 7001770 - DNA, 22 bp, Homo sapiens
attagtagtagttagcagcctc

SEQ ID NO: 7001771 - DNA, 22 bp, Homo sapiens
cgttagtatacactgcaggcaa

SEQ ID NO: 7001772 - DNA, 15 bp, Homo sapiens
ccaatgtcagatgct

SEQ ID NO: 7001773 - DNA, 21 bp, Homo sapiens
aaggcctgcttactgctagtt

SEQ ID NO: 7001774 - DNA, 22 bp, Homo sapiens
agagtctgcattgtaacaagat

SEQ ID NO: 7001775 - DNA, 22 bp, Homo sapiens
aaacctttaccagactagcaag

SEQ ID NO: 7001776 - DNA, 22 bp, Homo sapiens
tcctgccagcccacagactcat

SEQ ID NO: 7001777 - DNA, 22 bp, Homo sapiens
gcatttcagaaaggttaccaac

SEQ ID NO: 7001778 - DNA, 22 bp, Homo sapiens
attctctggaagaagataaaaa

SEQ ID NO: 7001779 - DNA, 22 bp, Homo sapiens
gtattcctgcaaatagcagtga

SEQ ID NO: 7001780 - DNA, 22 bp, Homo sapiens
gccttaatttatgtctaacata

SEQ ID NO: 7001781 - DNA, 22 bp, Homo sapiens
aactgattgttggatgatagtg

SEQ ID NO: 7001782 - DNA, 22 bp, Homo sapiens
ttgaccttggcttttaaaatat

SEQ ID NO: 7001783 - DNA, 22 bp, Homo sapiens
tcaggagggtctctattttcct

SEQ ID NO: 7001784 - DNA, 22 bp, Homo sapiens
gcctcctggcctttgctcctca

SEQ ID NO: 7001785 - DNA, 22 bp, Homo sapiens
aagtcagaaatcatctagtgta

SEQ ID NO: 7001786 - DNA, 18 bp, Homo sapiens
tggcaagtaatgacaaaa

SEQ ID NO: 7001787 - DNA, 22 bp, Homo sapiens
tcctccctaaatcctagactgt

SEQ ID NO: 7001788 - DNA, 22 bp, Homo sapiens
tcaaaatttcagcactagccct

SEQ ID NO: 7001789 - DNA, 22 bp, Homo sapiens
tcatccttttgcatgggaaggc

SEQ ID NO: 7001790 - DNA, 22 bp, Homo sapiens
ccactgctcggcctcaaagaag

SEQ ID NO: 7001791 - DNA, 22 bp, Homo sapiens
tgcaagaggagactgtactcag

SEQ ID NO: 7001792 - DNA, 22 bp, Homo sapiens
gccttggccttcctaggcctga

SEQ ID NO: 7001793 - DNA, 21 bp, Homo sapiens
agtcttaggcacagctgtgtc

SEQ ID NO: 7001794 - DNA, 22 bp, Homo sapiens
tttcagtcttattttgttgata

SEQ ID NO: 7001795 - DNA, 22 bp, Homo sapiens
tggtaattataaaatgtttttg

SEQ ID NO: 7001796 - DNA, 22 bp, Homo sapiens
agatacagacctcttattaagg

SEQ ID NO: 7001797 - DNA, 19 bp, Homo sapiens
tgaaatggcagttgctaaa

SEQ ID NO: 7001798 - DNA, 18 bp, Homo sapiens
agtctcagcggaggagta

SEQ ID NO: 7001799 - DNA, 20 bp, Homo sapiens
tcatccttggcctctaccca

SEQ ID NO: 7001800 - DNA, 22 bp, Homo sapiens
cttcttgtgctgggccagcttc

SEQ ID NO: 7001801 - DNA, 22 bp, Homo sapiens
agacaatatataattttagttg

SEQ ID NO: 7001802 - DNA, 22 bp, Homo sapiens
gcacctgctggggctgatgaga

SEQ ID NO: 7001803 - DNA, 22 bp, Homo sapiens
aacatgttgctttaataatatt

SEQ ID NO: 7001804 - DNA, 22 bp, Homo sapiens
cgatgtctaaactaaattcatt

SEQ ID NO: 7001805 - DNA, 22 bp, Homo sapiens
tagaacatgctcatgtataaat

SEQ ID NO: 7001806 - DNA, 20 bp, Homo sapiens
ccagaggctgacagactttg

SEQ ID NO: 7001807 - DNA, 21 bp, Homo sapiens
tctggaagaaaaaagtattat

SEQ ID NO: 7001808 - DNA, 22 bp, Homo sapiens
tgcaaattattgggccccaact

SEQ ID NO: 7001809 - DNA, 23 bp, Homo sapiens
tatgatcctccacaccttctctc

SEQ ID NO: 7001810 - DNA, 22 bp, Homo sapiens
atttctgttatacctttctcag

SEQ ID NO: 7001811 - DNA, 22 bp, Homo sapiens
actgtgcacacaaaaatagatt

SEQ ID NO: 7001812 - DNA, 22 bp, Homo sapiens
aaggcaccatgagatgctggtt

SEQ ID NO: 7001813 - DNA, 22 bp, Homo sapiens
aagtgggtacatgatgcacttt

SEQ ID NO: 7001814 - DNA, 22 bp, Homo sapiens
ctcctggggcacttagaagcaa

SEQ ID NO: 7001815 - DNA, 22 bp, Homo sapiens
gaggaaggctaaggggcttaga

SEQ ID NO: 7001816 - DNA, 20 bp, Homo sapiens
ttgacctgcaagtcatcatt

SEQ ID NO: 7001817 - DNA, 22 bp, Homo sapiens
attgtaacaacaatagtttagg

SEQ ID NO: 7001818 - DNA, 22 bp, Homo sapiens
ttttccagattggacttagtcc

SEQ ID NO: 7001819 - DNA, 22 bp, Homo sapiens
tttgcagtgattcttgcagtga

SEQ ID NO: 7001820 - DNA, 22 bp, Homo sapiens
tcctggcaatggcaggttcagg

SEQ ID NO: 7001821 - DNA, 22 bp, Homo sapiens
caggcacacatccgtgagagat

SEQ ID NO: 7001822 - DNA, 22 bp, Homo sapiens
agatgcttaagttttcagtgta

SEQ ID NO: 7001823 - DNA, 15 bp, Homo sapiens
cctgttccttgtgat

SEQ ID NO: 7001824 - DNA, 22 bp, Homo sapiens
atcagacaattgttgagtactg

SEQ ID NO: 7001825 - DNA, 22 bp, Homo sapiens
tcaaatgagaggcagggcagct

SEQ ID NO: 7001826 - DNA, 22 bp, Homo sapiens
gtgtttattttcatagttggcc

SEQ ID NO: 7001827 - DNA, 22 bp, Homo sapiens
gtggctcacagcaatgtttcct

SEQ ID NO: 7001828 - DNA, 19 bp, Homo sapiens
caggaaggggcgaatctgg

SEQ ID NO: 7001829 - DNA, 22 bp, Homo sapiens
atctagcagttcattgtgctat

SEQ ID NO: 7001830 - DNA, 22 bp, Homo sapiens
aaatggtaatgtctttctgttt

SEQ ID NO: 7001831 - DNA, 22 bp, Homo sapiens
ctattgaattaactattaaagt

SEQ ID NO: 7001832 - DNA, 22 bp, Homo sapiens
ggccccaggtagaagatataga

SEQ ID NO: 7001833 - DNA, 20 bp, Homo sapiens
tgctcccttgcgagtcgctg

SEQ ID NO: 7001834 - DNA, 22 bp, Homo sapiens
ttgccgtccttactccagcgga

SEQ ID NO: 7001835 - DNA, 22 bp, Homo sapiens
ccgggccccacggtgacctcag

SEQ ID NO: 7001836 - DNA, 21 bp, Homo sapiens
tcttgtccttgctctcccact

SEQ ID NO: 7001837 - DNA, 22 bp, Homo sapiens
attaggtatttgaaaactgatt

SEQ ID NO: 7001838 - DNA, 22 bp, Homo sapiens
agacttaatagaagcatgacat

SEQ ID NO: 7001839 - DNA, 22 bp, Homo sapiens
gttattgcttttttacaaatca

SEQ ID NO: 7001840 - DNA, 21 bp, Homo sapiens
tctctggagttagcagagaga

SEQ ID NO: 7001841 - DNA, 22 bp, Homo sapiens
gccctgtgtatcccctgtgctt

SEQ ID NO: 7001842 - DNA, 22 bp, Homo sapiens
tcctggcagggaacttgtcagc

SEQ ID NO: 7001843 - DNA, 22 bp, Homo sapiens
aaccaggaattgcagggctgca

SEQ ID NO: 7001844 - DNA, 22 bp, Homo sapiens
gcttcatagcattcattgcctg

SEQ ID NO: 7001845 - DNA, 22 bp, Homo sapiens
aaagccaggttgtgtgcaggaa

SEQ ID NO: 7001846 - DNA, 22 bp, Homo sapiens
tctggcctgtgttggtggcccc

SEQ ID NO: 7001847 - DNA, 22 bp, Homo sapiens
gcaataggcaatagtagatgct

SEQ ID NO: 7001848 - DNA, 22 bp, Homo sapiens
gagctagaattaggccaatttc

SEQ ID NO: 7001849 - DNA, 22 bp, Homo sapiens
ttgaagagtctttctttccccc

SEQ ID NO: 7001850 - DNA, 22 bp, Homo sapiens
gggtggctcctatgggcatagc

SEQ ID NO: 7001851 - DNA, 22 bp, Homo sapiens
ggtttaaaagccatgcatgggg

SEQ ID NO: 7001852 - DNA, 22 bp, Homo sapiens
agttaccctttctggttcatat

SEQ ID NO: 7001853 - DNA, 22 bp, Homo sapiens
gagtggtaatgagcagattagg

SEQ ID NO: 7001854 - DNA, 22 bp, Homo sapiens
atgaggtagtttggagaagagc

SEQ ID NO: 7001855 - DNA, 22 bp, Homo sapiens
gaccctctagatggaagcactg

SEQ ID NO: 7001856 - DNA, 22 bp, Homo sapiens
ttatgctaagtgcaacaagcca

SEQ ID NO: 7001857 - DNA, 22 bp, Homo sapiens
accacagggtaaagttagatat

SEQ ID NO: 7001858 - DNA, 22 bp, Homo sapiens
tcagattttccagcctttctct

SEQ ID NO: 7001859 - DNA, 22 bp, Homo sapiens
tgctctgttgtgcatgtgggat

SEQ ID NO: 7001860 - DNA, 22 bp, Homo sapiens
tgttttggagtggactttgcat

SEQ ID NO: 7001861 - DNA, 22 bp, Homo sapiens
acccatttcataaacatgcttt

SEQ ID NO: 7001862 - DNA, 22 bp, Homo sapiens
ctggcctaaaattgcttctgca

SEQ ID NO: 7001863 - DNA, 22 bp, Homo sapiens
ctcccataattctcatatgtca

SEQ ID NO: 7001864 - DNA, 22 bp, Homo sapiens
tttgtcagggatcagatcggta

SEQ ID NO: 7001865 - DNA, 22 bp, Homo sapiens
tgaaccttttgctaagaagtta

SEQ ID NO: 7001866 - DNA, 22 bp, Homo sapiens
atggagtgctgttgatcaaggt

SEQ ID NO: 7001867 - DNA, 22 bp, Homo sapiens
atgtgtccaaggccacaatagc

SEQ ID NO: 7001868 - DNA, 18 bp, Homo sapiens
agcaacagaaacatatgg

SEQ ID NO: 7001869 - DNA, 21 bp, Homo sapiens
tgcttgttctctgtccttgca

SEQ ID NO: 7001870 - DNA, 23 bp, Homo sapiens
tcactttgatgtaattgaaaagc

SEQ ID NO: 7001871 - DNA, 21 bp, Homo sapiens
ggcaagaaacacaatcaagta

SEQ ID NO: 7001872 - DNA, 21 bp, Homo sapiens
tgcagctgacaccctttggga

SEQ ID NO: 7001873 - DNA, 22 bp, Homo sapiens
gtacatgagcataaacacacat

SEQ ID NO: 7001874 - DNA, 22 bp, Homo sapiens
gtgattaactgcagttagagct

SEQ ID NO: 7001875 - DNA, 22 bp, Homo sapiens
aggtattttatagataagtaaa

SEQ ID NO: 7001876 - DNA, 23 bp, Homo sapiens
ggattggccccaggagtatgggt

SEQ ID NO: 7001877 - DNA, 22 bp, Homo sapiens
tacatgtatgtgtacgtgcatg

SEQ ID NO: 7001878 - DNA, 22 bp, Homo sapiens
atgtacacacacatctttgcgt

SEQ ID NO: 7001879 - DNA, 21 bp, Homo sapiens
gttgtggttggggctgcagct

SEQ ID NO: 7001880 - DNA, 22 bp, Homo sapiens
agtctgtctttggcttcaccac

SEQ ID NO: 7001881 - DNA, 22 bp, Homo sapiens
gttgaaagcttttcatttagtt

SEQ ID NO: 7001882 - DNA, 22 bp, Homo sapiens
attaaactgagcaaattaacat

SEQ ID NO: 7001883 - DNA, 22 bp, Homo sapiens
agtcaatatttcaataacccat

SEQ ID NO: 7001884 - DNA, 22 bp, Homo sapiens
agaaatgtacgatgttatgcag

SEQ ID NO: 7001885 - DNA, 22 bp, Homo sapiens
aaacctttctgctctcagcgta

SEQ ID NO: 7001886 - DNA, 22 bp, Homo sapiens
gtctgttagtgataactgtttt

SEQ ID NO: 7001887 - DNA, 22 bp, Homo sapiens
cagtgcccaagatgtgccatgc

SEQ ID NO: 7001888 - DNA, 22 bp, Homo sapiens
tggctgaggcacagctgccgcc

SEQ ID NO: 7001889 - DNA, 22 bp, Homo sapiens
ggcagtttctcaggcaggggta

SEQ ID NO: 7001890 - DNA, 22 bp, Homo sapiens
tggctttacagtttgcaaacta

SEQ ID NO: 7001891 - DNA, 22 bp, Homo sapiens
ctacagtctggcaggaatgtta

SEQ ID NO: 7001892 - DNA, 22 bp, Homo sapiens
cagacccttttctgagaggacc

SEQ ID NO: 7001893 - DNA, 21 bp, Homo sapiens
tgctaagtgtcacatgtctgc

SEQ ID NO: 7001894 - DNA, 19 bp, Homo sapiens
tgcatccaaagccccacca

SEQ ID NO: 7001895 - DNA, 22 bp, Homo sapiens
acatatgcgatcataggatgca

SEQ ID NO: 7001896 - DNA, 22 bp, Homo sapiens
tcagggagaggtgagagcctgt

SEQ ID NO: 7001897 - DNA, 22 bp, Homo sapiens
tgcattcaaatctccaggctca

SEQ ID NO: 7001898 - DNA, 22 bp, Homo sapiens
agaggcctaattgctacccttt

SEQ ID NO: 7001899 - DNA, 22 bp, Homo sapiens
acagttctagcttttacatttt

SEQ ID NO: 7001900 - DNA, 22 bp, Homo sapiens
ttactgaggagcatatctgagt

SEQ ID NO: 7001901 - DNA, 22 bp, Homo sapiens
caggactgatgttcctccagcc

SEQ ID NO: 7001902 - DNA, 22 bp, Homo sapiens
gaagagctgtcagaaaagctaa

SEQ ID NO: 7001903 - DNA, 22 bp, Homo sapiens
agtgagtatttgttgagtgcta

SEQ ID NO: 7001904 - DNA, 22 bp, Homo sapiens
ggccttggttccaaagcaggca

SEQ ID NO: 7001905 - DNA, 22 bp, Homo sapiens
tcttctcccagggtcgcccaag

SEQ ID NO: 7001906 - DNA, 19 bp, Homo sapiens
gctgttaaggaccctcgga

SEQ ID NO: 7001907 - DNA, 22 bp, Homo sapiens
aaatggttacaatgctttgctt

SEQ ID NO: 7001908 - DNA, 22 bp, Homo sapiens
caaagtaatatggtcccagtga

SEQ ID NO: 7001909 - DNA, 22 bp, Homo sapiens
gcctgcaacatccttgctcctg

SEQ ID NO: 7001910 - DNA, 22 bp, Homo sapiens
tttccagattaagataccactt

SEQ ID NO: 7001911 - DNA, 22 bp, Homo sapiens
cctgagtcttggcttcttggct

SEQ ID NO: 7001912 - DNA, 16 bp, Homo sapiens
agtcccatgtttgagt

SEQ ID NO: 7001913 - DNA, 22 bp, Homo sapiens
gaatgcagtgacggaggcttac

SEQ ID NO: 7001914 - DNA, 22 bp, Homo sapiens
tggtttctctgaactctacgac

SEQ ID NO: 7001915 - DNA, 22 bp, Homo sapiens
agagtatgcatctattgtacct

SEQ ID NO: 7001916 - DNA, 22 bp, Homo sapiens
ctcattaaaggaaatcacctgc

SEQ ID NO: 7001917 - DNA, 22 bp, Homo sapiens
tacctgaggtaaggatgatgag

SEQ ID NO: 7001918 - DNA, 22 bp, Homo sapiens
ccacactggcatgggatggagg

SEQ ID NO: 7001919 - DNA, 21 bp, Homo sapiens
tgaagttcgcgggcaagatta

SEQ ID NO: 7001920 - DNA, 22 bp, Homo sapiens
tggtcactatatttaaatatct

SEQ ID NO: 7001921 - DNA, 22 bp, Homo sapiens
ggacactggccacatttcaaaa

SEQ ID NO: 7001922 - DNA, 22 bp, Homo sapiens
agaccatgggctctgaagagca

SEQ ID NO: 7001923 - DNA, 22 bp, Homo sapiens
tagatcatatacttgccatgac

SEQ ID NO: 7001924 - DNA, 22 bp, Homo sapiens
gaaaaagtgaccttggtagcta

SEQ ID NO: 7001925 - DNA, 22 bp, Homo sapiens
ccccttcagagtagccacatta

SEQ ID NO: 7001926 - DNA, 22 bp, Homo sapiens
gtggcccaggcttggcgctggc

SEQ ID NO: 7001927 - DNA, 22 bp, Homo sapiens
ggctcctggaaagccctcgctc

SEQ ID NO: 7001928 - DNA, 22 bp, Homo sapiens
ttctgggagtttgggtcggctg

SEQ ID NO: 7001929 - DNA, 22 bp, Homo sapiens
aaacttcagggaataaaagagt

SEQ ID NO: 7001930 - DNA, 22 bp, Homo sapiens
tctgtcacttattaagatggat

SEQ ID NO: 7001931 - DNA, 22 bp, Homo sapiens
ggcatttagagggcttttctga

SEQ ID NO: 7001932 - DNA, 20 bp, Homo sapiens
cctgctgtttccatggggcc

SEQ ID NO: 7001933 - DNA, 22 bp, Homo sapiens
cctgggctcgcgcacttcaccc

SEQ ID NO: 7001934 - DNA, 22 bp, Homo sapiens
aggacgctctcgctgaacttct

SEQ ID NO: 7001935 - DNA, 22 bp, Homo sapiens
gatgacagttctagcatctgaa

SEQ ID NO: 7001936 - DNA, 22 bp, Homo sapiens
cgaggaagaagtttgagtcaag

SEQ ID NO: 7001937 - DNA, 22 bp, Homo sapiens
tagctttaggcacgtttgaatt

SEQ ID NO: 7001938 - DNA, 22 bp, Homo sapiens
gtcaggatgctattgttattaa

SEQ ID NO: 7001939 - DNA, 22 bp, Homo sapiens
tatgataacctgttgtagtttg

SEQ ID NO: 7001940 - DNA, 22 bp, Homo sapiens
ccaggtgtttggcctgcatgat

SEQ ID NO: 7001941 - DNA, 22 bp, Homo sapiens
taggaaggaagagcctcagatt

SEQ ID NO: 7001942 - DNA, 22 bp, Homo sapiens
cattttggctattgtaaatagt

SEQ ID NO: 7001943 - DNA, 22 bp, Homo sapiens
ccattagaagatgtaatagaga

SEQ ID NO: 7001944 - DNA, 22 bp, Homo sapiens
taattattctagtcacatagca

SEQ ID NO: 7001945 - DNA, 22 bp, Homo sapiens
tgcttgctgtaaagcttggtca

SEQ ID NO: 7001946 - DNA, 22 bp, Homo sapiens
gctcctgtgaaggcattaggtg

SEQ ID NO: 7001947 - DNA, 22 bp, Homo sapiens
ctggagtgcaatgaacaaggtc

SEQ ID NO: 7001948 - DNA, 22 bp, Homo sapiens
atgtacaccaggtgaagatgaa

SEQ ID NO: 7001949 - DNA, 22 bp, Homo sapiens
tgcagggtagacaggtgaggtc

SEQ ID NO: 7001950 - DNA, 22 bp, Homo sapiens
tggagccatgcctggcctttcc

SEQ ID NO: 7001951 - DNA, 22 bp, Homo sapiens
ttcctctcctcccaccaggtga

SEQ ID NO: 7001952 - DNA, 22 bp, Homo sapiens
cttcttcttttgtgggtggtaa

SEQ ID NO: 7001953 - DNA, 18 bp, Homo sapiens
agggcacggtgccagcct

SEQ ID NO: 7001954 - DNA, 22 bp, Homo sapiens
cagctgtgtagatgcagggtca

SEQ ID NO: 7001955 - DNA, 22 bp, Homo sapiens
agggctgagactaaggccagat

SEQ ID NO: 7001956 - DNA, 22 bp, Homo sapiens
agtgttttggagtgggaaggca

SEQ ID NO: 7001957 - DNA, 22 bp, Homo sapiens
agggttaattggtgtcctgagg

SEQ ID NO: 7001958 - DNA, 22 bp, Homo sapiens
tgtatgtatgtatgtatttggg

SEQ ID NO: 7001959 - DNA, 22 bp, Homo sapiens
caaagtgctaggattacaggcc

SEQ ID NO: 7001960 - DNA, 22 bp, Homo sapiens
aaactgagaccgaaaggggtag

SEQ ID NO: 7001961 - DNA, 20 bp, Homo sapiens
gagatggctaagtgctgaac

SEQ ID NO: 7001962 - DNA, 22 bp, Homo sapiens
aaaggtcttaatgttaacatac

SEQ ID NO: 7001963 - DNA, 22 bp, Homo sapiens
ttagatgaccaagctcggaacg

SEQ ID NO: 7001964 - DNA, 22 bp, Homo sapiens
ttaggcatatggcacatgatag

SEQ ID NO: 7001965 - DNA, 22 bp, Homo sapiens
aaaagtattggccaccatttct

SEQ ID NO: 7001966 - DNA, 22 bp, Homo sapiens
cagcagctgcgtgcccaggccg

SEQ ID NO: 7001967 - DNA, 22 bp, Homo sapiens
aaatggatgttgagttaaatgt

SEQ ID NO: 7001968 - DNA, 22 bp, Homo sapiens
gtgtttgtgagctaggtgacat

SEQ ID NO: 7001969 - DNA, 22 bp, Homo sapiens
gctggctgtgtttcatctctga

SEQ ID NO: 7001970 - DNA, 22 bp, Homo sapiens
gaaggcatctctggacttattt

SEQ ID NO: 7001971 - DNA, 22 bp, Homo sapiens
gctgaggaaaccaatgctcaga

SEQ ID NO: 7001972 - DNA, 20 bp, Homo sapiens
ctggtctgccactcacagtt

SEQ ID NO: 7001973 - DNA, 22 bp, Homo sapiens
actcatctattagatatctgtt

SEQ ID NO: 7001974 - DNA, 22 bp, Homo sapiens
agacatagataggcactgattg

SEQ ID NO: 7001975 - DNA, 22 bp, Homo sapiens
tctctgtccctaggagccttgc

SEQ ID NO: 7001976 - DNA, 22 bp, Homo sapiens
tctgtaagtgttggttattcta

SEQ ID NO: 7001977 - DNA, 22 bp, Homo sapiens
taaatgtaccttctgccttact

SEQ ID NO: 7001978 - DNA, 22 bp, Homo sapiens
atcaggatcacagaaactttta

SEQ ID NO: 7001979 - DNA, 22 bp, Homo sapiens
aaatgatggtactcatgtttag

SEQ ID NO: 7001980 - DNA, 22 bp, Homo sapiens
aggcattaatgtaatacagtga

SEQ ID NO: 7001981 - DNA, 22 bp, Homo sapiens
gtgcacaggtgggaaaatgagt

SEQ ID NO: 7001982 - DNA, 22 bp, Homo sapiens
ccttgctcggggagctgcagga

SEQ ID NO: 7001983 - DNA, 22 bp, Homo sapiens
gggccaggtatcgtctttagta

SEQ ID NO: 7001984 - DNA, 22 bp, Homo sapiens
catccctgctggtggaaggggt

SEQ ID NO: 7001985 - DNA, 22 bp, Homo sapiens
tgcaagatcacggtgttgagag

SEQ ID NO: 7001986 - DNA, 18 bp, Homo sapiens
acttaagatccatgctag

SEQ ID NO: 7001987 - DNA, 22 bp, Homo sapiens
gacataaaattcaataatttgt

SEQ ID NO: 7001988 - DNA, 22 bp, Homo sapiens
ccagaggcatgttcaaagcaat

SEQ ID NO: 7001989 - DNA, 22 bp, Homo sapiens
gtctggctcgctctcgcccgtc

SEQ ID NO: 7001990 - DNA, 22 bp, Homo sapiens
tagaacataagtcattcatttg

SEQ ID NO: 7001991 - DNA, 21 bp, Homo sapiens
aaatcactgtccaatcttggt

SEQ ID NO: 7001992 - DNA, 22 bp, Homo sapiens
gcggctccgaagccaggccgcg

SEQ ID NO: 7001993 - DNA, 22 bp, Homo sapiens
ggtcacattctgaggtattagg

SEQ ID NO: 7001994 - DNA, 22 bp, Homo sapiens
atggcagaaaggcatgtgggcc

SEQ ID NO: 7001995 - DNA, 16 bp, Homo sapiens
gctgggagggagaggt

SEQ ID NO: 7001996 - DNA, 22 bp, Homo sapiens
ctactgtccataaagtataact

SEQ ID NO: 7001997 - DNA, 22 bp, Homo sapiens
ctggccctattccaggccttcc

SEQ ID NO: 7001998 - DNA, 22 bp, Homo sapiens
aaggaagttttcttggttccta

SEQ ID NO: 7001999 - DNA, 17 bp, Homo sapiens
ttacagaggtaattaag

SEQ ID NO: 7002000 - DNA, 22 bp, Homo sapiens
agagccagcatttgggccctgc

SEQ ID NO: 7002001 - DNA, 22 bp, Homo sapiens
agctccgccttcaggaaagtcc

SEQ ID NO: 7002002 - DNA, 23 bp, Homo sapiens
tcttgaaaagcctacagcagttc

SEQ ID NO: 7002003 - DNA, 19 bp, Homo sapiens
tgtggctgagcactcctta

SEQ ID NO: 7002004 - DNA, 22 bp, Homo sapiens
atttattcctgattcctggctt

SEQ ID NO: 7002005 - DNA, 22 bp, Homo sapiens
gcagggtgacgttgcccacctc

SEQ ID NO: 7002006 - DNA, 22 bp, Homo sapiens
aggcaagcagtcagtctatgag

SEQ ID NO: 7002007 - DNA, 22 bp, Homo sapiens
tctgaagggctgagtggaggag

SEQ ID NO: 7002008 - DNA, 22 bp, Homo sapiens
agagtgccactgacaggtccct

SEQ ID NO: 7002009 - DNA, 21 bp, Homo sapiens
ctctgctgagtcctaggattc

SEQ ID NO: 7002010 - DNA, 22 bp, Homo sapiens
cagttttatgaatgcttattag

SEQ ID NO: 7002011 - DNA, 20 bp, Homo sapiens
gaattcctgcagcatttagt

SEQ ID NO: 7002012 - DNA, 22 bp, Homo sapiens
attcttcagatcagcagggcct

SEQ ID NO: 7002013 - DNA, 22 bp, Homo sapiens
taggaattgaaaagtggtctga

SEQ ID NO: 7002014 - DNA, 22 bp, Homo sapiens
taaagcacagtatgagcattgg

SEQ ID NO: 7002015 - DNA, 22 bp, Homo sapiens
cttttccactgagcctcacaaa

SEQ ID NO: 7002016 - DNA, 22 bp, Homo sapiens
tcacaagtttctcttgcatgcg

SEQ ID NO: 7002017 - DNA, 22 bp, Homo sapiens
cagtggcttacaatgaactaga

SEQ ID NO: 7002018 - DNA, 22 bp, Homo sapiens
tacatttgggacaataagagaa

SEQ ID NO: 7002019 - DNA, 22 bp, Homo sapiens
tacctgagcccctgctggtgta

SEQ ID NO: 7002020 - DNA, 22 bp, Homo sapiens
atctgggtaaagtggtatattt

SEQ ID NO: 7002021 - DNA, 20 bp, Homo sapiens
tcagtgggaaagtgagagtg

SEQ ID NO: 7002022 - DNA, 22 bp, Homo sapiens
tggctgctgcttggtcttcttc

SEQ ID NO: 7002023 - DNA, 22 bp, Homo sapiens
ctcccgaggagcctcagcgctc

SEQ ID NO: 7002024 - DNA, 22 bp, Homo sapiens
tctggagttagttataatggtt

SEQ ID NO: 7002025 - DNA, 22 bp, Homo sapiens
aggccctggacactcaagccgg

SEQ ID NO: 7002026 - DNA, 22 bp, Homo sapiens
agacaagtgtggtgagagcagt

SEQ ID NO: 7002027 - DNA, 22 bp, Homo sapiens
aggagagaggttttaaatgggg

SEQ ID NO: 7002028 - DNA, 22 bp, Homo sapiens
tgaaagaagggtggaaaatgta

SEQ ID NO: 7002029 - DNA, 22 bp, Homo sapiens
gccaagagaatgtgagagaaat

SEQ ID NO: 7002030 - DNA, 22 bp, Homo sapiens
tctgagcattgaattttcttcc

SEQ ID NO: 7002031 - DNA, 22 bp, Homo sapiens
gcccaagactgtacagttaaag

SEQ ID NO: 7002032 - DNA, 22 bp, Homo sapiens
ctgtggaaaatttgtatgtaat

SEQ ID NO: 7002033 - DNA, 22 bp, Homo sapiens
tcctgctggcaaggaagggact

SEQ ID NO: 7002034 - DNA, 21 bp, Homo sapiens
tgctcagtctgtctccagctt

SEQ ID NO: 7002035 - DNA, 23 bp, Homo sapiens
gctggctggcagtaaaggttgtt

SEQ ID NO: 7002036 - DNA, 22 bp, Homo sapiens
ggaggccatcagggagggcatt

SEQ ID NO: 7002037 - DNA, 22 bp, Homo sapiens
tcatacacctatctctctgtgc

SEQ ID NO: 7002038 - DNA, 22 bp, Homo sapiens
ttcacctgtgacaggtagagtt

SEQ ID NO: 7002039 - DNA, 22 bp, Homo sapiens
gatgggcagcacagctggccaa

SEQ ID NO: 7002040 - DNA, 18 bp, Homo sapiens
atgctacaggcaggtgtc

SEQ ID NO: 7002041 - DNA, 22 bp, Homo sapiens
aacactttttcctcctgtctgg

SEQ ID NO: 7002042 - DNA, 22 bp, Homo sapiens
aggcctgccttgagcaaccagc

SEQ ID NO: 7002043 - DNA, 22 bp, Homo sapiens
ttaatgcttacagtgtcctgcg

SEQ ID NO: 7002044 - DNA, 22 bp, Homo sapiens
cactgacagtatcagagctgtt

SEQ ID NO: 7002045 - DNA, 22 bp, Homo sapiens
acaatgtaggatatgtacttgt

SEQ ID NO: 7002046 - DNA, 22 bp, Homo sapiens
atgctgtgtcctagtgaaagaa

SEQ ID NO: 7002047 - DNA, 22 bp, Homo sapiens
tattggaagtgaacaccaggct

SEQ ID NO: 7002048 - DNA, 22 bp, Homo sapiens
ttgactgttttcactccctttc

SEQ ID NO: 7002049 - DNA, 22 bp, Homo sapiens
tagaggtactcccctcaaagtt

SEQ ID NO: 7002050 - DNA, 21 bp, Homo sapiens
tatttgctgccatctttgagg

SEQ ID NO: 7002051 - DNA, 22 bp, Homo sapiens
ttgacttgaagctgtggaaaaa

SEQ ID NO: 7002052 - DNA, 22 bp, Homo sapiens
aagccatggtagaaaactcagt

SEQ ID NO: 7002053 - DNA, 21 bp, Homo sapiens
attttctgtgatagctgtctc

SEQ ID NO: 7002054 - DNA, 22 bp, Homo sapiens
ctcagtctgtcttgtctgtgtt

SEQ ID NO: 7002055 - DNA, 22 bp, Homo sapiens
gagagggatactgagttttggt

SEQ ID NO: 7002056 - DNA, 22 bp, Homo sapiens
agagatgtacagttacttatct

SEQ ID NO: 7002057 - DNA, 22 bp, Homo sapiens
agagccagcatttgacactggc

SEQ ID NO: 7002058 - DNA, 22 bp, Homo sapiens
cttcagcctcaactactatggt

SEQ ID NO: 7002059 - DNA, 22 bp, Homo sapiens
ttgagcttgaggagttatttga

SEQ ID NO: 7002060 - DNA, 22 bp, Homo sapiens
taaatctcagggaatatattga

SEQ ID NO: 7002061 - DNA, 23 bp, Homo sapiens
cagcaagtgaattccaagagaga

SEQ ID NO: 7002062 - DNA, 22 bp, Homo sapiens
gttctgcctgtggcttctgtgg

SEQ ID NO: 7002063 - DNA, 22 bp, Homo sapiens
atgaggccatggctgtcactaa

SEQ ID NO: 7002064 - DNA, 22 bp, Homo sapiens
tgaacaacagatgtccattgtt

SEQ ID NO: 7002065 - DNA, 22 bp, Homo sapiens
ctagggagtggcagagctggga

SEQ ID NO: 7002066 - DNA, 22 bp, Homo sapiens
tgcttgtgagagttttttcaga

SEQ ID NO: 7002067 - DNA, 22 bp, Homo sapiens
tagcaaaggtagagttttgaga

SEQ ID NO: 7002068 - DNA, 22 bp, Homo sapiens
ttagacatcagtgcttctcagc

SEQ ID NO: 7002069 - DNA, 22 bp, Homo sapiens
gctgaggaggtgtggttaggtg

SEQ ID NO: 7002070 - DNA, 22 bp, Homo sapiens
catgagatttgggaggggccag

SEQ ID NO: 7002071 - DNA, 22 bp, Homo sapiens
tgacattccgcagtaaggttaa

SEQ ID NO: 7002072 - DNA, 22 bp, Homo sapiens
atacatgtcatcatatgtttgt

SEQ ID NO: 7002073 - DNA, 22 bp, Homo sapiens
aatggctttgagtattttctgg

SEQ ID NO: 7002074 - DNA, 22 bp, Homo sapiens
ttggaacagagccctaaggaca

SEQ ID NO: 7002075 - DNA, 22 bp, Homo sapiens
aagcaagctgttggcaataggg

SEQ ID NO: 7002076 - DNA, 22 bp, Homo sapiens
aacctatgaactcttggtgtgc

SEQ ID NO: 7002077 - DNA, 22 bp, Homo sapiens
ttccagttctgggctggctgct

SEQ ID NO: 7002078 - DNA, 22 bp, Homo sapiens
aatttgatgagtttgtaagtct

SEQ ID NO: 7002079 - DNA, 22 bp, Homo sapiens
tctcctggcatttggttgagta

SEQ ID NO: 7002080 - DNA, 22 bp, Homo sapiens
gctgctctacccatgcatctgt

SEQ ID NO: 7002081 - DNA, 22 bp, Homo sapiens
tgctttcagccagtgtctggat

SEQ ID NO: 7002082 - DNA, 21 bp, Homo sapiens
agggagcatgttagctttcga

SEQ ID NO: 7002083 - DNA, 22 bp, Homo sapiens
gttctctctcttgcctgggtgg

SEQ ID NO: 7002084 - DNA, 22 bp, Homo sapiens
ccaggctgggcggggaacctgg

SEQ ID NO: 7002085 - DNA, 19 bp, Homo sapiens
aatagcaggagcagttccc

SEQ ID NO: 7002086 - DNA, 22 bp, Homo sapiens
acctccctccatctggacacta

SEQ ID NO: 7002087 - DNA, 22 bp, Homo sapiens
cctagacattaagcttgggttt

SEQ ID NO: 7002088 - DNA, 20 bp, Homo sapiens
ttctagaatgcccagggaca

SEQ ID NO: 7002089 - DNA, 22 bp, Homo sapiens
ttgatccagttgaaagtgatga

SEQ ID NO: 7002090 - DNA, 22 bp, Homo sapiens
tatttagaggagaaaagtggct

SEQ ID NO: 7002091 - DNA, 22 bp, Homo sapiens
tttcaaactgtactttccccta

SEQ ID NO: 7002092 - DNA, 22 bp, Homo sapiens
atgagagtactagaaacttcct

SEQ ID NO: 7002093 - DNA, 22 bp, Homo sapiens
acctctttgaacctcagtgtga

SEQ ID NO: 7002094 - DNA, 22 bp, Homo sapiens
tgagtgaggtgcttagggcaca

SEQ ID NO: 7002095 - DNA, 23 bp, Homo sapiens
caggctcccggaccaggatccgc

SEQ ID NO: 7002096 - DNA, 18 bp, Homo sapiens
gaggtggctgggccatct

SEQ ID NO: 7002097 - DNA, 22 bp, Homo sapiens
gatcatcaagcaagaacctgat

SEQ ID NO: 7002098 - DNA, 22 bp, Homo sapiens
tcagcagtgggtcctgagggtg

SEQ ID NO: 7002099 - DNA, 22 bp, Homo sapiens
agatgtggcctttgggagatta

SEQ ID NO: 7002100 - DNA, 22 bp, Homo sapiens
gactgaggtattaagatggctt

SEQ ID NO: 7002101 - DNA, 22 bp, Homo sapiens
ggccctgggccctctagcttgt

SEQ ID NO: 7002102 - DNA, 22 bp, Homo sapiens
cagcagagcttattaactaaaa

SEQ ID NO: 7002103 - DNA, 22 bp, Homo sapiens
atcaacatatgcatgggaaagt

SEQ ID NO: 7002104 - DNA, 22 bp, Homo sapiens
tttgacatcactgacctgtttt

SEQ ID NO: 7002105 - DNA, 22 bp, Homo sapiens
acaggtgagggagctttgtgcc

SEQ ID NO: 7002106 - DNA, 22 bp, Homo sapiens
gagggctgatgttgccacctca

SEQ ID NO: 7002107 - DNA, 22 bp, Homo sapiens
tggcaagttaaaatgtggtctt

SEQ ID NO: 7002108 - DNA, 22 bp, Homo sapiens
aagccaggaatggagtcttcgc

SEQ ID NO: 7002109 - DNA, 19 bp, Homo sapiens
ccatataaccagcaagtgt

SEQ ID NO: 7002110 - DNA, 22 bp, Homo sapiens
gatgtatagctttaactgaccc

SEQ ID NO: 7002111 - DNA, 23 bp, Homo sapiens
ctccctggagtttctggaagatg

SEQ ID NO: 7002112 - DNA, 22 bp, Homo sapiens
aggtgtcccggcctgcggggct

SEQ ID NO: 7002113 - DNA, 21 bp, Homo sapiens
tctgccctccaggagctcata

SEQ ID NO: 7002114 - DNA, 22 bp, Homo sapiens
taatgctttgtcagcctaaggg

SEQ ID NO: 7002115 - DNA, 22 bp, Homo sapiens
aaaacaggtgtcagcaaactat

SEQ ID NO: 7002116 - DNA, 23 bp, Homo sapiens
aagatgtatttttaccaaatgtc

SEQ ID NO: 7002117 - DNA, 22 bp, Homo sapiens
tgcaatttcaaatatcagaaag

SEQ ID NO: 7002118 - DNA, 22 bp, Homo sapiens
aatcttacttatgatttttcgg

SEQ ID NO: 7002119 - DNA, 22 bp, Homo sapiens
agagatgcattcagcatggatg

SEQ ID NO: 7002120 - DNA, 20 bp, Homo sapiens
aggtaggatcggtgtcataa

SEQ ID NO: 7002121 - DNA, 22 bp, Homo sapiens
ttggctgctagatggtgttaga

SEQ ID NO: 7002122 - DNA, 22 bp, Homo sapiens
ataaagctttgaaatggagata

SEQ ID NO: 7002123 - DNA, 22 bp, Homo sapiens
tgcttgagacacatatgaattt

SEQ ID NO: 7002124 - DNA, 22 bp, Homo sapiens
atctttgggatcctgatttact

SEQ ID NO: 7002125 - DNA, 21 bp, Homo sapiens
tcctgggaagcactggggtgg

SEQ ID NO: 7002126 - DNA, 17 bp, Homo sapiens
gtctcttagcaccgtat

SEQ ID NO: 7002127 - DNA, 22 bp, Homo sapiens
gatgttttttaggatctcagca

SEQ ID NO: 7002128 - DNA, 22 bp, Homo sapiens
cagccaggttagtgctaattgt

SEQ ID NO: 7002129 - DNA, 22 bp, Homo sapiens
gcctgcctttgtatgaccctga

SEQ ID NO: 7002130 - DNA, 22 bp, Homo sapiens
taatacttaccttgcagagtct

SEQ ID NO: 7002131 - DNA, 22 bp, Homo sapiens
ttaaagctaggtggaacaaatt

SEQ ID NO: 7002132 - DNA, 22 bp, Homo sapiens
ttaacaaggtgactgcattaaa

SEQ ID NO: 7002133 - DNA, 22 bp, Homo sapiens
atccaccctgtggtggctttct

SEQ ID NO: 7002134 - DNA, 22 bp, Homo sapiens
ttggctttgtgatggtagaact

SEQ ID NO: 7002135 - DNA, 22 bp, Homo sapiens
cacaacttagcaatgttttaga

SEQ ID NO: 7002136 - DNA, 22 bp, Homo sapiens
tcatttctatctatgcagcttc

SEQ ID NO: 7002137 - DNA, 22 bp, Homo sapiens
gtgccaggcccagggagcgggg

SEQ ID NO: 7002138 - DNA, 22 bp, Homo sapiens
tgtttataatatgcagtgagca

SEQ ID NO: 7002139 - DNA, 22 bp, Homo sapiens
tcacatctttaggcttacaggt

SEQ ID NO: 7002140 - DNA, 22 bp, Homo sapiens
ccaggtctttgactaatatgct

SEQ ID NO: 7002141 - DNA, 22 bp, Homo sapiens
tcacaaagtgaagtgtgtcatg

SEQ ID NO: 7002142 - DNA, 22 bp, Homo sapiens
cagggactcgctggacataccg

SEQ ID NO: 7002143 - DNA, 22 bp, Homo sapiens
ttgaaaaaattggtagaggatg

SEQ ID NO: 7002144 - DNA, 22 bp, Homo sapiens
agagggaagatggtccaatctt

SEQ ID NO: 7002145 - DNA, 22 bp, Homo sapiens
actcatttgcatgatgtgctat

SEQ ID NO: 7002146 - DNA, 22 bp, Homo sapiens
acaactttagtctggagggaaa

SEQ ID NO: 7002147 - DNA, 22 bp, Homo sapiens
atcatgactaagtgctgacaca

SEQ ID NO: 7002148 - DNA, 22 bp, Homo sapiens
aggtatgagataaatcaatgaa

SEQ ID NO: 7002149 - DNA, 22 bp, Homo sapiens
ccatgatggctatccttgcttg

SEQ ID NO: 7002150 - DNA, 22 bp, Homo sapiens
cctcatttatagccaaagtaaa

SEQ ID NO: 7002151 - DNA, 22 bp, Homo sapiens
ctgatatttgcccaactgccct

SEQ ID NO: 7002152 - DNA, 22 bp, Homo sapiens
aagcaatgtgttaatgaatgag

SEQ ID NO: 7002153 - DNA, 22 bp, Homo sapiens
ggcttccaaggtcctctccacc

SEQ ID NO: 7002154 - DNA, 22 bp, Homo sapiens
cttcttctggtttatgtggcaa

SEQ ID NO: 7002155 - DNA, 22 bp, Homo sapiens
ctacagtgacagaattaaacag

SEQ ID NO: 7002156 - DNA, 22 bp, Homo sapiens
cagccttttaggactatttgtg

SEQ ID NO: 7002157 - DNA, 20 bp, Homo sapiens
agcctgtgtacttgcctgtg

SEQ ID NO: 7002158 - DNA, 22 bp, Homo sapiens
catttctagggatcataaagta

SEQ ID NO: 7002159 - DNA, 22 bp, Homo sapiens
agtcttggttttcttaggtctg

SEQ ID NO: 7002160 - DNA, 22 bp, Homo sapiens
tagcaagatgatgaattattca

SEQ ID NO: 7002161 - DNA, 22 bp, Homo sapiens
tcacagagagtgacttgttgct

SEQ ID NO: 7002162 - DNA, 22 bp, Homo sapiens
tcagatcaggatgcagcaacat

SEQ ID NO: 7002163 - DNA, 22 bp, Homo sapiens
actaaagtcagactgcattgat

SEQ ID NO: 7002164 - DNA, 22 bp, Homo sapiens
aaggagcggagcctgctttcct

SEQ ID NO: 7002165 - DNA, 22 bp, Homo sapiens
tccagggcatccacgcgtgggg

SEQ ID NO: 7002166 - DNA, 22 bp, Homo sapiens
agtcatctcttctacaatatgg

SEQ ID NO: 7002167 - DNA, 22 bp, Homo sapiens
tcaaagcaatttcaccagtgcc

SEQ ID NO: 7002168 - DNA, 23 bp, Homo sapiens
gccctgctcctggctgggaggga

SEQ ID NO: 7002169 - DNA, 22 bp, Homo sapiens
ggtcgctgagctagcatctgca

SEQ ID NO: 7002170 - DNA, 22 bp, Homo sapiens
acagtggtaggataactgtttt

SEQ ID NO: 7002171 - DNA, 22 bp, Homo sapiens
tgggaaggttagcagtttgtca

SEQ ID NO: 7002172 - DNA, 22 bp, Homo sapiens
atgcagctgctcttcctctatt

SEQ ID NO: 7002173 - DNA, 22 bp, Homo sapiens
ccaggcattgtgagtgggcagg

SEQ ID NO: 7002174 - DNA, 22 bp, Homo sapiens
ttctggaagatacctctcctaa

SEQ ID NO: 7002175 - DNA, 22 bp, Homo sapiens
agcttttagctcctggttgcaa

SEQ ID NO: 7002176 - DNA, 22 bp, Homo sapiens
aaggcaatggcaagagaaagca

SEQ ID NO: 7002177 - DNA, 22 bp, Homo sapiens
gtctggagtggtggatttaaag

SEQ ID NO: 7002178 - DNA, 22 bp, Homo sapiens
aaatcagtccctcttggaattt

SEQ ID NO: 7002179 - DNA, 22 bp, Homo sapiens
ggctgaaattggatccttgggc

SEQ ID NO: 7002180 - DNA, 22 bp, Homo sapiens
cccactgtttccctgaggctct

SEQ ID NO: 7002181 - DNA, 22 bp, Homo sapiens
ctcatgtagctctcaggccaca

SEQ ID NO: 7002182 - DNA, 22 bp, Homo sapiens
ttctgttactctggtctgctgt

SEQ ID NO: 7002183 - DNA, 19 bp, Homo sapiens
tgctttctaaacacatgca

SEQ ID NO: 7002184 - DNA, 22 bp, Homo sapiens
cactgaggcttccttaggcaat

SEQ ID NO: 7002185 - DNA, 22 bp, Homo sapiens
gacatgcattaagacacactga

SEQ ID NO: 7002186 - DNA, 21 bp, Homo sapiens
actcaggagactaactatgtc

SEQ ID NO: 7002187 - DNA, 22 bp, Homo sapiens
tacatgggtaggttaagtcata

SEQ ID NO: 7002188 - DNA, 22 bp, Homo sapiens
tctcctactcactcaaggcttg

SEQ ID NO: 7002189 - DNA, 22 bp, Homo sapiens
ggtgggagagctctgtctccag

SEQ ID NO: 7002190 - DNA, 22 bp, Homo sapiens
gggacttcatagctaggcactt

SEQ ID NO: 7002191 - DNA, 22 bp, Homo sapiens
cttcacagtctttatttcctcc

SEQ ID NO: 7002192 - DNA, 18 bp, Homo sapiens
ccctgccagctcccagca

SEQ ID NO: 7002193 - DNA, 15 bp, Homo sapiens
tgttaacagctggga

SEQ ID NO: 7002194 - DNA, 22 bp, Homo sapiens
gcacacatgcatgcacaggagt

SEQ ID NO: 7002195 - DNA, 17 bp, Homo sapiens
ctggagccaagagggcc

SEQ ID NO: 7002196 - DNA, 22 bp, Homo sapiens
gtttccaggcagggtgattctc

SEQ ID NO: 7002197 - DNA, 22 bp, Homo sapiens
agctctgggggaaagtctgctc

SEQ ID NO: 7002198 - DNA, 22 bp, Homo sapiens
cacagctgcacagaggaggtgc

SEQ ID NO: 7002199 - DNA, 22 bp, Homo sapiens
ggcatgcaaagccccttacaga

SEQ ID NO: 7002200 - DNA, 18 bp, Homo sapiens
ctgaattatctcatcatt

SEQ ID NO: 7002201 - DNA, 22 bp, Homo sapiens
aatgtgtttatttagtgattta

SEQ ID NO: 7002202 - DNA, 22 bp, Homo sapiens
acagtgatttcatccttctggg

SEQ ID NO: 7002203 - DNA, 22 bp, Homo sapiens
ccatctggagcatttgacctgg

SEQ ID NO: 7002204 - DNA, 22 bp, Homo sapiens
aactgagcccctgcacttgtga

SEQ ID NO: 7002205 - DNA, 22 bp, Homo sapiens
tcattgttttgattccttcatg

SEQ ID NO: 7002206 - DNA, 22 bp, Homo sapiens
tgagggagttgggtgtatagga

SEQ ID NO: 7002207 - DNA, 22 bp, Homo sapiens
ttacacatgtctcagtggaaat

SEQ ID NO: 7002208 - DNA, 22 bp, Homo sapiens
ctgttacatagcttttcttaac

SEQ ID NO: 7002209 - DNA, 22 bp, Homo sapiens
ctcttgccagagatgagactct

SEQ ID NO: 7002210 - DNA, 22 bp, Homo sapiens
tagctgggttgaggtcatctac

SEQ ID NO: 7002211 - DNA, 21 bp, Homo sapiens
catttcaaagagctggaaatc

SEQ ID NO: 7002212 - DNA, 22 bp, Homo sapiens
tactacacccccttgtgagtgg

SEQ ID NO: 7002213 - DNA, 22 bp, Homo sapiens
atctagaaagccaggggcctgc

SEQ ID NO: 7002214 - DNA, 16 bp, Homo sapiens
tgtcaatagcttgcct

SEQ ID NO: 7002215 - DNA, 22 bp, Homo sapiens
tatagctaaggtcagactgttt

SEQ ID NO: 7002216 - DNA, 22 bp, Homo sapiens
accccaggtctccaggctctgg

SEQ ID NO: 7002217 - DNA, 22 bp, Homo sapiens
gaaagtatttaagtccatattt

SEQ ID NO: 7002218 - DNA, 22 bp, Homo sapiens
caccagcagcggtgtgagggtg

SEQ ID NO: 7002219 - DNA, 22 bp, Homo sapiens
gtaacagagggtttgcagatat

SEQ ID NO: 7002220 - DNA, 22 bp, Homo sapiens
gggagggccagtgctctctaga

SEQ ID NO: 7002221 - DNA, 22 bp, Homo sapiens
ttcctggtgacctcactggtag

SEQ ID NO: 7002222 - DNA, 22 bp, Homo sapiens
tccaaatattcggtctttctga

SEQ ID NO: 7002223 - DNA, 22 bp, Homo sapiens
ttggccagcgacgaccttctta

SEQ ID NO: 7002224 - DNA, 22 bp, Homo sapiens
ctcacaggcggtaattcaggga

SEQ ID NO: 7002225 - DNA, 22 bp, Homo sapiens
aaaaggctagctagtaacagaa

SEQ ID NO: 7002226 - DNA, 22 bp, Homo sapiens
ttcagagatgacacctggtgtt

SEQ ID NO: 7002227 - DNA, 22 bp, Homo sapiens
actgcacttcaccctgggtgac

SEQ ID NO: 7002228 - DNA, 22 bp, Homo sapiens
ctggagtagccggacgggtctg

SEQ ID NO: 7002229 - DNA, 22 bp, Homo sapiens
cagtttaggagagacgcgttct

SEQ ID NO: 7002230 - DNA, 22 bp, Homo sapiens
tccaaaggaggctgccaagttc

SEQ ID NO: 7002231 - DNA, 22 bp, Homo sapiens
cacatttaattggtttagggtg

SEQ ID NO: 7002232 - DNA, 22 bp, Homo sapiens
taggtaggtaaacaggactaat

SEQ ID NO: 7002233 - DNA, 22 bp, Homo sapiens
ataaagtggaggtagtattcat

SEQ ID NO: 7002234 - DNA, 22 bp, Homo sapiens
gtgagagtggtttatgtccatg

SEQ ID NO: 7002235 - DNA, 22 bp, Homo sapiens
cattgctgaatgagatcaaatc

SEQ ID NO: 7002236 - DNA, 22 bp, Homo sapiens
agaggcctctttgcaagtaggt

SEQ ID NO: 7002237 - DNA, 22 bp, Homo sapiens
accctggcctggttcatgtgat

SEQ ID NO: 7002238 - DNA, 22 bp, Homo sapiens
tcgtttgagataaatacatgta

SEQ ID NO: 7002239 - DNA, 21 bp, Homo sapiens
attttcatttccaggggagga

SEQ ID NO: 7002240 - DNA, 22 bp, Homo sapiens
tttctgacctgcaacagtttac

SEQ ID NO: 7002241 - DNA, 22 bp, Homo sapiens
cactgcaatgtctacctcctgg

SEQ ID NO: 7002242 - DNA, 22 bp, Homo sapiens
atgtgaggtatctaggtcttcg

SEQ ID NO: 7002243 - DNA, 22 bp, Homo sapiens
gagacatcataatgaagtttcc

SEQ ID NO: 7002244 - DNA, 22 bp, Homo sapiens
tcaccatacataaattacattg

SEQ ID NO: 7002245 - DNA, 22 bp, Homo sapiens
gtgggctcccctggcatgtcca

SEQ ID NO: 7002246 - DNA, 22 bp, Homo sapiens
gcctgggtgtcgatcactagtg

SEQ ID NO: 7002247 - DNA, 22 bp, Homo sapiens
tagaggaactgcctttcttctg

SEQ ID NO: 7002248 - DNA, 22 bp, Homo sapiens
cttggcctgcccagccagaagg

SEQ ID NO: 7002249 - DNA, 22 bp, Homo sapiens
atttcagctaaaattcttaatt

SEQ ID NO: 7002250 - DNA, 22 bp, Homo sapiens
caggtcccctcccctaccaggc

SEQ ID NO: 7002251 - DNA, 22 bp, Homo sapiens
gcagtggatggccagcaggggc

SEQ ID NO: 7002252 - DNA, 22 bp, Homo sapiens
aaaggccacacagagcagggag

SEQ ID NO: 7002253 - DNA, 22 bp, Homo sapiens
taatgtcaaggtcattctagag

SEQ ID NO: 7002254 - DNA, 22 bp, Homo sapiens
acttcttgatgaaaatggtact

SEQ ID NO: 7002255 - DNA, 23 bp, Homo sapiens
tctgaggtggctcttgctttgaa

SEQ ID NO: 7002256 - DNA, 22 bp, Homo sapiens
ctcccttgcttctggcattttg

SEQ ID NO: 7002257 - DNA, 22 bp, Homo sapiens
tgctgaattggtagtactgttg

SEQ ID NO: 7002258 - DNA, 21 bp, Homo sapiens
tgggctcagccccagccctgc

SEQ ID NO: 7002259 - DNA, 22 bp, Homo sapiens
caggcataggtaggatgtttct

SEQ ID NO: 7002260 - DNA, 22 bp, Homo sapiens
tgaatgctttggagccttctaa

SEQ ID NO: 7002261 - DNA, 22 bp, Homo sapiens
aggcttcagcctagagctggag

SEQ ID NO: 7002262 - DNA, 22 bp, Homo sapiens
atttggtctacattttccaaat

SEQ ID NO: 7002263 - DNA, 22 bp, Homo sapiens
agtagtgaagaatttgttctac

SEQ ID NO: 7002264 - DNA, 22 bp, Homo sapiens
atggccctaatgagttggtgtt

SEQ ID NO: 7002265 - DNA, 20 bp, Homo sapiens
gagccctctgcactagcgcc

SEQ ID NO: 7002266 - DNA, 22 bp, Homo sapiens
tagcaatgcttcattatttaaa

SEQ ID NO: 7002267 - DNA, 22 bp, Homo sapiens
ctgcagcctaggtgcagctggg

SEQ ID NO: 7002268 - DNA, 22 bp, Homo sapiens
caagaattaagaattttgatgt

SEQ ID NO: 7002269 - DNA, 19 bp, Homo sapiens
tctgcatggcaggaagaga

SEQ ID NO: 7002270 - DNA, 22 bp, Homo sapiens
taaccccgccctcaatgtgaat

SEQ ID NO: 7002271 - DNA, 22 bp, Homo sapiens
caagggtgaaggctcctccagg

SEQ ID NO: 7002272 - DNA, 19 bp, Homo sapiens
agtatagagtattgaggag

SEQ ID NO: 7002273 - DNA, 22 bp, Homo sapiens
ctgaggtccttgactgcttgcc

SEQ ID NO: 7002274 - DNA, 22 bp, Homo sapiens
ctgggagctgtcaggagcgtgt

SEQ ID NO: 7002275 - DNA, 22 bp, Homo sapiens
gttcattctgaaaagcagcttg

SEQ ID NO: 7002276 - DNA, 22 bp, Homo sapiens
tatttaccttgtgcaggtcctg

SEQ ID NO: 7002277 - DNA, 22 bp, Homo sapiens
aggggccaccaccaaggaaggt

SEQ ID NO: 7002278 - DNA, 22 bp, Homo sapiens
gctgaggtaggaggttgcagtg

SEQ ID NO: 7002279 - DNA, 22 bp, Homo sapiens
gcccttcacgatggtatcttag

SEQ ID NO: 7002280 - DNA, 22 bp, Homo sapiens
cctcaagcctagttagatccat

SEQ ID NO: 7002281 - DNA, 22 bp, Homo sapiens
cctttgggaataggttccggct

SEQ ID NO: 7002282 - DNA, 22 bp, Homo sapiens
tgccagctcctgcagctcctgt

SEQ ID NO: 7002283 - DNA, 23 bp, Homo sapiens
agcttcatcttgctgtgtctcag

SEQ ID NO: 7002284 - DNA, 22 bp, Homo sapiens
tcaggtagttgacagaacttag

SEQ ID NO: 7002285 - DNA, 22 bp, Homo sapiens
acagtgaaaagtagctaacaca

SEQ ID NO: 7002286 - DNA, 22 bp, Homo sapiens
aagggcccttctgttagtggca

SEQ ID NO: 7002287 - DNA, 22 bp, Homo sapiens
gtagacaaatttcttctctcaa

SEQ ID NO: 7002288 - DNA, 22 bp, Homo sapiens
atggccaaagccacagcagagg

SEQ ID NO: 7002289 - DNA, 22 bp, Homo sapiens
aggctaagtgggtgtcagggcc

SEQ ID NO: 7002290 - DNA, 22 bp, Homo sapiens
attgtgcagaattggaattgca

SEQ ID NO: 7002291 - DNA, 22 bp, Homo sapiens
actctgtgtttagtgctgccat

SEQ ID NO: 7002292 - DNA, 22 bp, Homo sapiens
ggtgcaaaagtagttctgcttt

SEQ ID NO: 7002293 - DNA, 22 bp, Homo sapiens
tctgcatcaggagaggcgggca

SEQ ID NO: 7002294 - DNA, 22 bp, Homo sapiens
ctgcaggacgaccgcctcatct

SEQ ID NO: 7002295 - DNA, 22 bp, Homo sapiens
tgtccttgatgaatatgaaatt

SEQ ID NO: 7002296 - DNA, 22 bp, Homo sapiens
cagcccagccgagggcctggct

SEQ ID NO: 7002297 - DNA, 22 bp, Homo sapiens
ccttggctaggcagcggctgtc

SEQ ID NO: 7002298 - DNA, 23 bp, Homo sapiens
tgcattatcctctctgaagacca

SEQ ID NO: 7002299 - DNA, 21 bp, Homo sapiens
gtgtaaacggactcatgcagt

SEQ ID NO: 7002300 - DNA, 22 bp, Homo sapiens
aaggggtgctgttggaaaccca

SEQ ID NO: 7002301 - DNA, 22 bp, Homo sapiens
attcagctctgaatcagcagac

SEQ ID NO: 7002302 - DNA, 22 bp, Homo sapiens
gcacacggcagcctcctcctga

SEQ ID NO: 7002303 - DNA, 22 bp, Homo sapiens
gtattccttcagaagacgttta

SEQ ID NO: 7002304 - DNA, 22 bp, Homo sapiens
ctgccctcccagttggtccgtg

SEQ ID NO: 7002305 - DNA, 22 bp, Homo sapiens
ctggtatagtataaattaatgt

SEQ ID NO: 7002306 - DNA, 22 bp, Homo sapiens
gcagagatccagggtataggtt

SEQ ID NO: 7002307 - DNA, 21 bp, Homo sapiens
agatgcagtgacccactgggg

SEQ ID NO: 7002308 - DNA, 22 bp, Homo sapiens
tatgaaggatacacctctgatt

SEQ ID NO: 7002309 - DNA, 22 bp, Homo sapiens
ttctccaggcttgggccaggtc

SEQ ID NO: 7002310 - DNA, 22 bp, Homo sapiens
tagtacaactcacttgatttta

SEQ ID NO: 7002311 - DNA, 19 bp, Homo sapiens
ttcttgagacctcagtctg

SEQ ID NO: 7002312 - DNA, 22 bp, Homo sapiens
atccatcggttcctacattcaa

SEQ ID NO: 7002313 - DNA, 22 bp, Homo sapiens
tttcctaactcatcggatgtac

SEQ ID NO: 7002314 - DNA, 22 bp, Homo sapiens
cagctcttagagggagacagac

SEQ ID NO: 7002315 - DNA, 22 bp, Homo sapiens
caggaaatataggaaaaggaac

SEQ ID NO: 7002316 - DNA, 22 bp, Homo sapiens
aatctacatagagatcaaatga

SEQ ID NO: 7002317 - DNA, 22 bp, Homo sapiens
aacactgagggaaaagagatag

SEQ ID NO: 7002318 - DNA, 22 bp, Homo sapiens
atgtatgtctaaaacggggagg

SEQ ID NO: 7002319 - DNA, 22 bp, Homo sapiens
cgcaggtgttcagtaaatgtat

SEQ ID NO: 7002320 - DNA, 22 bp, Homo sapiens
ggagagtctgagcctgctggag

SEQ ID NO: 7002321 - DNA, 22 bp, Homo sapiens
ctgagcaggatattcacagcag

SEQ ID NO: 7002322 - DNA, 23 bp, Homo sapiens
acagccccatgcaggtgtgtttg

SEQ ID NO: 7002323 - DNA, 22 bp, Homo sapiens
aggtccagactgtgtaccctag

SEQ ID NO: 7002324 - DNA, 19 bp, Homo sapiens
tgagcacacctgtacaccc

SEQ ID NO: 7002325 - DNA, 19 bp, Homo sapiens
tgtgcctcctcgtctccta

SEQ ID NO: 7002326 - DNA, 22 bp, Homo sapiens
ccctttagcccctgcagagact

SEQ ID NO: 7002327 - DNA, 22 bp, Homo sapiens
gtgctttactgtgttgccttta

SEQ ID NO: 7002328 - DNA, 22 bp, Homo sapiens
tgttgggaattgtgagtaatgg

SEQ ID NO: 7002329 - DNA, 22 bp, Homo sapiens
tgcaggagttcccctctgcctg

SEQ ID NO: 7002330 - DNA, 22 bp, Homo sapiens
agtcattatgggtaaagttttt

SEQ ID NO: 7002331 - DNA, 22 bp, Homo sapiens
aagtgggtttgaaatgctttca

SEQ ID NO: 7002332 - DNA, 22 bp, Homo sapiens
cctggcagcgccgaagctggcc

SEQ ID NO: 7002333 - DNA, 22 bp, Homo sapiens
aagcccagcatccctgcaccag

SEQ ID NO: 7002334 - DNA, 22 bp, Homo sapiens
aatgttttgtatgcctctgagc

SEQ ID NO: 7002335 - DNA, 20 bp, Homo sapiens
tagaatctggtgatgtatcg

SEQ ID NO: 7002336 - DNA, 22 bp, Homo sapiens
tcagcccttcctggagctttta

SEQ ID NO: 7002337 - DNA, 22 bp, Homo sapiens
agaagcgttccatttgatgggt

SEQ ID NO: 7002338 - DNA, 22 bp, Homo sapiens
tctatcattcgcactcctactt

SEQ ID NO: 7002339 - DNA, 22 bp, Homo sapiens
tcagagaggttaaatatcttgt

SEQ ID NO: 7002340 - DNA, 22 bp, Homo sapiens
aatagaggagctttggactccc

SEQ ID NO: 7002341 - DNA, 22 bp, Homo sapiens
gcagggaagacccggagcagcg

SEQ ID NO: 7002342 - DNA, 22 bp, Homo sapiens
catccagctcctgggggccacc

SEQ ID NO: 7002343 - DNA, 22 bp, Homo sapiens
aagtttgtgtcagagctgttac

SEQ ID NO: 7002344 - DNA, 16 bp, Homo sapiens
tcacacatttgttggt

SEQ ID NO: 7002345 - DNA, 22 bp, Homo sapiens
atgcttttggtctttggtccgg

SEQ ID NO: 7002346 - DNA, 22 bp, Homo sapiens
tctgctcaggttacctagctag

SEQ ID NO: 7002347 - DNA, 22 bp, Homo sapiens
aacaggcttcttctgggctcct

SEQ ID NO: 7002348 - DNA, 22 bp, Homo sapiens
gtcttctgatctggttagccat

SEQ ID NO: 7002349 - DNA, 22 bp, Homo sapiens
ggtgtttaaaggctcagcagga

SEQ ID NO: 7002350 - DNA, 22 bp, Homo sapiens
cagctaagaatgtctgagatca

SEQ ID NO: 7002351 - DNA, 22 bp, Homo sapiens
tctgaaatggggctgaagcact

SEQ ID NO: 7002352 - DNA, 22 bp, Homo sapiens
caggaaggaaagggtgtggaga

SEQ ID NO: 7002353 - DNA, 22 bp, Homo sapiens
tccaggaggtttggaggaagca

SEQ ID NO: 7002354 - DNA, 22 bp, Homo sapiens
taagcatggtggtaaaagaggt

SEQ ID NO: 7002355 - DNA, 22 bp, Homo sapiens
aaattaactatcacttttgtga

SEQ ID NO: 7002356 - DNA, 22 bp, Homo sapiens
ttttatcattacccagctgaaa

SEQ ID NO: 7002357 - DNA, 20 bp, Homo sapiens
tccagcccctgcatgttgct

SEQ ID NO: 7002358 - DNA, 19 bp, Homo sapiens
atactaggtcatgataatc

SEQ ID NO: 7002359 - DNA, 22 bp, Homo sapiens
tagcacaaagtcttgccctttt

SEQ ID NO: 7002360 - DNA, 22 bp, Homo sapiens
tactcagagtcattgcccttct

SEQ ID NO: 7002361 - DNA, 22 bp, Homo sapiens
tcctagaataagtaacaggaca

SEQ ID NO: 7002362 - DNA, 22 bp, Homo sapiens
tcaatactcacaaagagatttt

SEQ ID NO: 7002363 - DNA, 22 bp, Homo sapiens
gtccctggtctaccgtggcttc

SEQ ID NO: 7002364 - DNA, 22 bp, Homo sapiens
tagcatggtctgacatcctttg

SEQ ID NO: 7002365 - DNA, 22 bp, Homo sapiens
ctctctaacgacattcccattc

SEQ ID NO: 7002366 - DNA, 22 bp, Homo sapiens
ataaagcaggtccccagacact

SEQ ID NO: 7002367 - DNA, 22 bp, Homo sapiens
taggaaatgccagccttcctcc

SEQ ID NO: 7002368 - DNA, 22 bp, Homo sapiens
gtactttcaggctttcccttaa

SEQ ID NO: 7002369 - DNA, 22 bp, Homo sapiens
aactttgggcctaagtactgtt

SEQ ID NO: 7002370 - DNA, 22 bp, Homo sapiens
agggctgctatgttgattcaga

SEQ ID NO: 7002371 - DNA, 22 bp, Homo sapiens
ctttacattaatttctactgat

SEQ ID NO: 7002372 - DNA, 22 bp, Homo sapiens
agcaggaaggggcctagcctgg

SEQ ID NO: 7002373 - DNA, 22 bp, Homo sapiens
tatattaaaccctctctgtagg

SEQ ID NO: 7002374 - DNA, 22 bp, Homo sapiens
ttgacccagttgtaaaagagct

SEQ ID NO: 7002375 - DNA, 22 bp, Homo sapiens
acatacacgggaaacctctttt

SEQ ID NO: 7002376 - DNA, 22 bp, Homo sapiens
acaatagtgcctggcatagagt

SEQ ID NO: 7002377 - DNA, 22 bp, Homo sapiens
ctcacctccaggagctgctggc

SEQ ID NO: 7002378 - DNA, 22 bp, Homo sapiens
actggctgtgcccatagagctc

SEQ ID NO: 7002379 - DNA, 19 bp, Homo sapiens
ttttccttctatatgtttc

SEQ ID NO: 7002380 - DNA, 22 bp, Homo sapiens
tttaggcattgaattagaatag

SEQ ID NO: 7002381 - DNA, 22 bp, Homo sapiens
tctcatgaaaggtctctcctgg

SEQ ID NO: 7002382 - DNA, 22 bp, Homo sapiens
gttcatgtgactactatgacct

SEQ ID NO: 7002383 - DNA, 22 bp, Homo sapiens
aatcatgtgggatagtctgctc

SEQ ID NO: 7002384 - DNA, 18 bp, Homo sapiens
gccaagagcttgcaaaca

SEQ ID NO: 7002385 - DNA, 22 bp, Homo sapiens
cctgtgcagcccttgccagttt

SEQ ID NO: 7002386 - DNA, 22 bp, Homo sapiens
aatgggctttggccagtaggag

SEQ ID NO: 7002387 - DNA, 22 bp, Homo sapiens
ctctgcacctacacaacaggaa

SEQ ID NO: 7002388 - DNA, 22 bp, Homo sapiens
aggggagcatctgtgatggtta

SEQ ID NO: 7002389 - DNA, 22 bp, Homo sapiens
ctattagctgaataatgcattg

SEQ ID NO: 7002390 - DNA, 22 bp, Homo sapiens
ccgccaggatattgtggctttt

SEQ ID NO: 7002391 - DNA, 22 bp, Homo sapiens
tctacagactcctatgtaacac

SEQ ID NO: 7002392 - DNA, 18 bp, Homo sapiens
tgaggaaggggaagtatt

SEQ ID NO: 7002393 - DNA, 22 bp, Homo sapiens
aaatgcagctgggcatgagagg

SEQ ID NO: 7002394 - DNA, 22 bp, Homo sapiens
ctaaggcttggcttaattaatt

SEQ ID NO: 7002395 - DNA, 22 bp, Homo sapiens
gtcctatattcttttaaaattt

SEQ ID NO: 7002396 - DNA, 22 bp, Homo sapiens
tttagcatatcctataaaacta

SEQ ID NO: 7002397 - DNA, 22 bp, Homo sapiens
tccctggggtatcgctgaggca

SEQ ID NO: 7002398 - DNA, 22 bp, Homo sapiens
agtcatttcccattcttcatat

SEQ ID NO: 7002399 - DNA, 22 bp, Homo sapiens
agatggcaggggtacctggaag

SEQ ID NO: 7002400 - DNA, 22 bp, Homo sapiens
agatggtagactatggaacgta

SEQ ID NO: 7002401 - DNA, 22 bp, Homo sapiens
ggacattgaagctggaaaggga

SEQ ID NO: 7002402 - DNA, 22 bp, Homo sapiens
tttccatatttaatcaaaataa

SEQ ID NO: 7002403 - DNA, 22 bp, Homo sapiens
tccttagctgtgaaatgagaat

SEQ ID NO: 7002404 - DNA, 22 bp, Homo sapiens
gtcaacatcggaaagcgtgtaa

SEQ ID NO: 7002405 - DNA, 21 bp, Homo sapiens
tgctgatgtcagagaagcaag

SEQ ID NO: 7002406 - DNA, 22 bp, Homo sapiens
cttaaagtagaatacaagacct

SEQ ID NO: 7002407 - DNA, 22 bp, Homo sapiens
acgtagattcctccatgcgcag

SEQ ID NO: 7002408 - DNA, 22 bp, Homo sapiens
tcccaggaaggattcggcattt

SEQ ID NO: 7002409 - DNA, 22 bp, Homo sapiens
actgggcatgatgagtcaccta

SEQ ID NO: 7002410 - DNA, 22 bp, Homo sapiens
gtattgcattgtttcaagctgt

SEQ ID NO: 7002411 - DNA, 22 bp, Homo sapiens
ctttacagcctccagaaggaac

SEQ ID NO: 7002412 - DNA, 22 bp, Homo sapiens
aggattaaaacagtgggatttg

SEQ ID NO: 7002413 - DNA, 22 bp, Homo sapiens
tgggggagagtttagatgattt

SEQ ID NO: 7002414 - DNA, 22 bp, Homo sapiens
actgagcaggagaatcacttta

SEQ ID NO: 7002415 - DNA, 23 bp, Homo sapiens
ctggaacatagtagatggtcaga

SEQ ID NO: 7002416 - DNA, 22 bp, Homo sapiens
tatctgttggctttggaaataa

SEQ ID NO: 7002417 - DNA, 22 bp, Homo sapiens
tgaaaagactgcaagagagcat

SEQ ID NO: 7002418 - DNA, 22 bp, Homo sapiens
taaaatagcttatgtcttttga

SEQ ID NO: 7002419 - DNA, 22 bp, Homo sapiens
aaggctggggtgcagacggcct

SEQ ID NO: 7002420 - DNA, 16 bp, Homo sapiens
ctatggctagaaacat

SEQ ID NO: 7002421 - DNA, 23 bp, Homo sapiens
ttgtccttctgaaatatatctgg

SEQ ID NO: 7002422 - DNA, 22 bp, Homo sapiens
ttcagttctacaagagctttgt

SEQ ID NO: 7002423 - DNA, 22 bp, Homo sapiens
aacaaattagttgcaagactgg

SEQ ID NO: 7002424 - DNA, 22 bp, Homo sapiens
tggtgtggggataagcactctg

SEQ ID NO: 7002425 - DNA, 22 bp, Homo sapiens
tgtgccaggcacttgcccaggc

SEQ ID NO: 7002426 - DNA, 22 bp, Homo sapiens
tgatttacttcccagctgggtt

SEQ ID NO: 7002427 - DNA, 20 bp, Homo sapiens
cagagccagggttttgtttt

SEQ ID NO: 7002428 - DNA, 22 bp, Homo sapiens
aggtctctaaaatagtcaaact

SEQ ID NO: 7002429 - DNA, 22 bp, Homo sapiens
catggcttgtaataaatttata

SEQ ID NO: 7002430 - DNA, 22 bp, Homo sapiens
aatggcaaaaggataacaagga

SEQ ID NO: 7002431 - DNA, 22 bp, Homo sapiens
aataggcattacatttcctgca

SEQ ID NO: 7002432 - DNA, 22 bp, Homo sapiens
gaccctggcagataccgtcaca

SEQ ID NO: 7002433 - DNA, 22 bp, Homo sapiens
cagtgtctcccccaggttctgt

SEQ ID NO: 7002434 - DNA, 22 bp, Homo sapiens
tacattcaaacgatttattgat

SEQ ID NO: 7002435 - DNA, 22 bp, Homo sapiens
tccaagttgatgtttcttaaat

SEQ ID NO: 7002436 - DNA, 22 bp, Homo sapiens
gtatagaacttttggaggctgc

SEQ ID NO: 7002437 - DNA, 22 bp, Homo sapiens
atttcctaggtgctcgagtgct

SEQ ID NO: 7002438 - DNA, 22 bp, Homo sapiens
ctctaaatgtggtctgcagata

SEQ ID NO: 7002439 - DNA, 22 bp, Homo sapiens
gatggccaaggaccacgcatcg

SEQ ID NO: 7002440 - DNA, 18 bp, Homo sapiens
tcattcaaagtctactga

SEQ ID NO: 7002441 - DNA, 22 bp, Homo sapiens
tgcagctcttacggagggcggg

SEQ ID NO: 7002442 - DNA, 22 bp, Homo sapiens
tcactgcactccagcactcagg

SEQ ID NO: 7002443 - DNA, 22 bp, Homo sapiens
ggtgtcctttgggggctccgag

SEQ ID NO: 7002444 - DNA, 22 bp, Homo sapiens
aaagtctttctcattggccatg

SEQ ID NO: 7002445 - DNA, 22 bp, Homo sapiens
tagtgcaaggattgctgcagag

SEQ ID NO: 7002446 - DNA, 22 bp, Homo sapiens
ccaggtggccctgccctactct

SEQ ID NO: 7002447 - DNA, 22 bp, Homo sapiens
gcttctcgggcctgatgtcgtc

SEQ ID NO: 7002448 - DNA, 22 bp, Homo sapiens
gggtcccaggtctggaaaagca

SEQ ID NO: 7002449 - DNA, 22 bp, Homo sapiens
agcaatgaccagtgatcttgta

SEQ ID NO: 7002450 - DNA, 22 bp, Homo sapiens
gcacagcaatttctataagctc

SEQ ID NO: 7002451 - DNA, 22 bp, Homo sapiens
ctctgcaggcctgtgaagggtg

SEQ ID NO: 7002452 - DNA, 20 bp, Homo sapiens
tggagttgggctggtttacc

SEQ ID NO: 7002453 - DNA, 22 bp, Homo sapiens
tctccaggtggggtcacctttt

SEQ ID NO: 7002454 - DNA, 22 bp, Homo sapiens
tctgacccacaagcatcctgga

SEQ ID NO: 7002455 - DNA, 22 bp, Homo sapiens
tcttcctgcttggtgtgtctgg

SEQ ID NO: 7002456 - DNA, 22 bp, Homo sapiens
atggttgacccatgtgagttag

SEQ ID NO: 7002457 - DNA, 22 bp, Homo sapiens
ttacattttggggtaaggataa

SEQ ID NO: 7002458 - DNA, 22 bp, Homo sapiens
cagcatgaccctggagcctgca

SEQ ID NO: 7002459 - DNA, 22 bp, Homo sapiens
atagctgtttttaggccaaata

SEQ ID NO: 7002460 - DNA, 21 bp, Homo sapiens
agcaggtgaacctccagtaca

SEQ ID NO: 7002461 - DNA, 22 bp, Homo sapiens
atatttgcaggaaactagtttt

SEQ ID NO: 7002462 - DNA, 22 bp, Homo sapiens
cagtccagtgatttttccagtt

SEQ ID NO: 7002463 - DNA, 22 bp, Homo sapiens
atctggactagagcagaatggg

SEQ ID NO: 7002464 - DNA, 22 bp, Homo sapiens
ggctggcagtgtgagagaggga

SEQ ID NO: 7002465 - DNA, 22 bp, Homo sapiens
ttggaacagtgtgaaaaggtta

SEQ ID NO: 7002466 - DNA, 20 bp, Homo sapiens
tctccctgcccatctcagat

SEQ ID NO: 7002467 - DNA, 22 bp, Homo sapiens
tgtctgggttcaaaacctggct

SEQ ID NO: 7002468 - DNA, 22 bp, Homo sapiens
ttcagttttccctcctgcaggt

SEQ ID NO: 7002469 - DNA, 22 bp, Homo sapiens
tcaattcacagctctgctattt

SEQ ID NO: 7002470 - DNA, 19 bp, Homo sapiens
ataaataaaaagtgggaga

SEQ ID NO: 7002471 - DNA, 22 bp, Homo sapiens
ctgcacagcctgtctgggggcc

SEQ ID NO: 7002472 - DNA, 22 bp, Homo sapiens
cttccagagatagggcctcaag

SEQ ID NO: 7002473 - DNA, 22 bp, Homo sapiens
tggcttctggctggtgagaaat

SEQ ID NO: 7002474 - DNA, 22 bp, Homo sapiens
ccaggaagcctgtgtctctgga

SEQ ID NO: 7002475 - DNA, 22 bp, Homo sapiens
gccagaggaacgctgcgcgccc

SEQ ID NO: 7002476 - DNA, 22 bp, Homo sapiens
gaggcctcagcctgccctgaac

SEQ ID NO: 7002477 - DNA, 19 bp, Homo sapiens
aggtctgcagctgcagttt

SEQ ID NO: 7002478 - DNA, 19 bp, Homo sapiens
atcacatgtcaagagcagg

SEQ ID NO: 7002479 - DNA, 22 bp, Homo sapiens
atgtgtctggcatggaaagtgt

SEQ ID NO: 7002480 - DNA, 22 bp, Homo sapiens
attgcttttcagacaatgaggc

SEQ ID NO: 7002481 - DNA, 22 bp, Homo sapiens
aaggcctggatttaggttgtga

SEQ ID NO: 7002482 - DNA, 22 bp, Homo sapiens
aagtatttcagcggttctttgt

SEQ ID NO: 7002483 - DNA, 22 bp, Homo sapiens
cctaggagagggaaaatctagg

SEQ ID NO: 7002484 - DNA, 22 bp, Homo sapiens
tatgcacagaagtttgctgaat

SEQ ID NO: 7002485 - DNA, 22 bp, Homo sapiens
gaaacacatgcagctccataga

SEQ ID NO: 7002486 - DNA, 22 bp, Homo sapiens
tctctggcacataataaggtct

SEQ ID NO: 7002487 - DNA, 22 bp, Homo sapiens
aatgagatggcaatgacttaaa

SEQ ID NO: 7002488 - DNA, 22 bp, Homo sapiens
agctacagctgtactctgcagg

SEQ ID NO: 7002489 - DNA, 22 bp, Homo sapiens
aagggggaaatcctagcgccgc

SEQ ID NO: 7002490 - DNA, 22 bp, Homo sapiens
gcaaagcaatcaggagtagcat

SEQ ID NO: 7002491 - DNA, 22 bp, Homo sapiens
atggcccagaagtttggaaagg

SEQ ID NO: 7002492 - DNA, 22 bp, Homo sapiens
tggtcgtggggcttcccaggat

SEQ ID NO: 7002493 - DNA, 22 bp, Homo sapiens
atgtggctgccacctgcctgaa

SEQ ID NO: 7002494 - DNA, 22 bp, Homo sapiens
ttccttcttcctttagtaacca

SEQ ID NO: 7002495 - DNA, 22 bp, Homo sapiens
tcactgtcactaggcaccaaac

SEQ ID NO: 7002496 - DNA, 22 bp, Homo sapiens
ttctggaagaataatgggcaaa

SEQ ID NO: 7002497 - DNA, 22 bp, Homo sapiens
tctcccctccctggaccagtgc

SEQ ID NO: 7002498 - DNA, 21 bp, Homo sapiens
tttcggtcccagatgcctgtg

SEQ ID NO: 7002499 - DNA, 22 bp, Homo sapiens
aggagttggtcaccgtggccca

SEQ ID NO: 7002500 - DNA, 22 bp, Homo sapiens
tacacatcccagactcccagga

SEQ ID NO: 7002501 - DNA, 22 bp, Homo sapiens
cctcttccactgggccccatcc

SEQ ID NO: 7002502 - DNA, 22 bp, Homo sapiens
gaaagcacgatagtagcaaaag

SEQ ID NO: 7002503 - DNA, 22 bp, Homo sapiens
tctgacagtcacagtggaggat

SEQ ID NO: 7002504 - DNA, 22 bp, Homo sapiens
ttaaactgggttagactgaatt

SEQ ID NO: 7002505 - DNA, 22 bp, Homo sapiens
aggccttaagaacaaaactatt

SEQ ID NO: 7002506 - DNA, 22 bp, Homo sapiens
gcagacttataatctgtcccag

SEQ ID NO: 7002507 - DNA, 22 bp, Homo sapiens
catggacatatgagacctttcc

SEQ ID NO: 7002508 - DNA, 22 bp, Homo sapiens
gcttctgtggtgaggtcacctt

SEQ ID NO: 7002509 - DNA, 21 bp, Homo sapiens
catttgatccctcatcaggat

SEQ ID NO: 7002510 - DNA, 22 bp, Homo sapiens
aagttttactgaggacacatgt

SEQ ID NO: 7002511 - DNA, 22 bp, Homo sapiens
gaaggcccgccctgagcaaggg

SEQ ID NO: 7002512 - DNA, 22 bp, Homo sapiens
agtcacatgagtttctctttat

SEQ ID NO: 7002513 - DNA, 22 bp, Homo sapiens
atacagatgagatcaggcataa

SEQ ID NO: 7002514 - DNA, 22 bp, Homo sapiens
gcccagtgggaagctaaggtgg

SEQ ID NO: 7002515 - DNA, 22 bp, Homo sapiens
cagggctccctgcagcctctgt

SEQ ID NO: 7002516 - DNA, 22 bp, Homo sapiens
gaggtctgggcttgggcctggt

SEQ ID NO: 7002517 - DNA, 17 bp, Homo sapiens
tatctcttcaagtttca

SEQ ID NO: 7002518 - DNA, 22 bp, Homo sapiens
tccacttcatccagggtcacca

SEQ ID NO: 7002519 - DNA, 22 bp, Homo sapiens
tgacaggcaggacagaggtgtg

SEQ ID NO: 7002520 - DNA, 22 bp, Homo sapiens
aacagtagtatttaaactgaac

SEQ ID NO: 7002521 - DNA, 22 bp, Homo sapiens
gaatttgctttcgtgacagggt

SEQ ID NO: 7002522 - DNA, 22 bp, Homo sapiens
agatttgcggctttactttgca

SEQ ID NO: 7002523 - DNA, 22 bp, Homo sapiens
tccagtctgtagtgcacagtga

SEQ ID NO: 7002524 - DNA, 22 bp, Homo sapiens
agagctctgcagctggcctcag

SEQ ID NO: 7002525 - DNA, 22 bp, Homo sapiens
aagacgatggaatggctcccct

SEQ ID NO: 7002526 - DNA, 18 bp, Homo sapiens
tgagagcctgcttgtccc

SEQ ID NO: 7002527 - DNA, 22 bp, Homo sapiens
atcttcaaagaatttcttgtcc

SEQ ID NO: 7002528 - DNA, 22 bp, Homo sapiens
gaacaaacatttttggcagtat

SEQ ID NO: 7002529 - DNA, 22 bp, Homo sapiens
tctgtgtatagggttgtgcgct

SEQ ID NO: 7002530 - DNA, 23 bp, Homo sapiens
tgagtgtggggacagtggtttgc

SEQ ID NO: 7002531 - DNA, 22 bp, Homo sapiens
agattatttaagacaggaacca

SEQ ID NO: 7002532 - DNA, 20 bp, Homo sapiens
ttctccagtgcggtagccat

SEQ ID NO: 7002533 - DNA, 22 bp, Homo sapiens
atctggttttggctgtgtccct

SEQ ID NO: 7002534 - DNA, 22 bp, Homo sapiens
tgcgcccagccaagtctggcac

SEQ ID NO: 7002535 - DNA, 22 bp, Homo sapiens
aaatggtatttactctgtatta

SEQ ID NO: 7002536 - DNA, 22 bp, Homo sapiens
ttctgtatctctgtgtttcttg

SEQ ID NO: 7002537 - DNA, 21 bp, Homo sapiens
agctgggcctcagcctgcagt

SEQ ID NO: 7002538 - DNA, 22 bp, Homo sapiens
gctgtgcagtctttggtgtgcc

SEQ ID NO: 7002539 - DNA, 22 bp, Homo sapiens
gcctggagtgcagtggcgtgat

SEQ ID NO: 7002540 - DNA, 21 bp, Homo sapiens
atatcctgtaactttgctgca

SEQ ID NO: 7002541 - DNA, 22 bp, Homo sapiens
tctggaggggtttagagggaca

SEQ ID NO: 7002542 - DNA, 22 bp, Homo sapiens
gccagtggaggacccatggaga

SEQ ID NO: 7002543 - DNA, 22 bp, Homo sapiens
tgagaagcccaagccgggtggt

SEQ ID NO: 7002544 - DNA, 22 bp, Homo sapiens
ttccaattgtgagattttttaa

SEQ ID NO: 7002545 - DNA, 20 bp, Homo sapiens
agccaatacagcaaaatttg

SEQ ID NO: 7002546 - DNA, 22 bp, Homo sapiens
ttgttcatcgtccttgctctgt

SEQ ID NO: 7002547 - DNA, 19 bp, Homo sapiens
tggcttccatctctctcat

SEQ ID NO: 7002548 - DNA, 22 bp, Homo sapiens
gtgagggcagaacccccaggcc

SEQ ID NO: 7002549 - DNA, 22 bp, Homo sapiens
cagaatgtatatgatctaaggt

SEQ ID NO: 7002550 - DNA, 22 bp, Homo sapiens
gagaacagtgtcatcctataat

SEQ ID NO: 7002551 - DNA, 22 bp, Homo sapiens
atttcctgtaaaatggtactgc

SEQ ID NO: 7002552 - DNA, 22 bp, Homo sapiens
atggcattgcaagggcaggagg

SEQ ID NO: 7002553 - DNA, 22 bp, Homo sapiens
gacttatctatgagtgggtttt

SEQ ID NO: 7002554 - DNA, 22 bp, Homo sapiens
ggaagcctaaagcccaggtctc

SEQ ID NO: 7002555 - DNA, 22 bp, Homo sapiens
tgcagtgttcagtgatctctcc

SEQ ID NO: 7002556 - DNA, 19 bp, Homo sapiens
gcgggcggcgcctgcgagg

SEQ ID NO: 7002557 - DNA, 22 bp, Homo sapiens
cagggttctggaatataatgtg

SEQ ID NO: 7002558 - DNA, 22 bp, Homo sapiens
cagcagcctagggttccatcat

SEQ ID NO: 7002559 - DNA, 22 bp, Homo sapiens
tacaactgcacatctgaatcac

SEQ ID NO: 7002560 - DNA, 22 bp, Homo sapiens
tcaaagaagattaccctcccat

SEQ ID NO: 7002561 - DNA, 22 bp, Homo sapiens
aagaggctgaatgagaaagtac

SEQ ID NO: 7002562 - DNA, 22 bp, Homo sapiens
gcagcagtggctgcaggtccca

SEQ ID NO: 7002563 - DNA, 22 bp, Homo sapiens
ggcagtgtggcctgagtaagtc

SEQ ID NO: 7002564 - DNA, 22 bp, Homo sapiens
aagtgcataagtatgattattt

SEQ ID NO: 7002565 - DNA, 22 bp, Homo sapiens
gtctagaaaatgccgagggatg

SEQ ID NO: 7002566 - DNA, 22 bp, Homo sapiens
tgggcctggacatctgtatttt

SEQ ID NO: 7002567 - DNA, 22 bp, Homo sapiens
ggcaaaaaccacaattactttt

SEQ ID NO: 7002568 - DNA, 22 bp, Homo sapiens
ctcctccactaggcaaaatgtg

SEQ ID NO: 7002569 - DNA, 22 bp, Homo sapiens
ttgtgtctatggtttgagcatc

SEQ ID NO: 7002570 - DNA, 22 bp, Homo sapiens
acaaagtatttttaggtttgta

SEQ ID NO: 7002571 - DNA, 22 bp, Homo sapiens
gttacattaggataatttgctg

SEQ ID NO: 7002572 - DNA, 22 bp, Homo sapiens
ctgaagttcgccagactcgggc

SEQ ID NO: 7002573 - DNA, 22 bp, Homo sapiens
tctttgaaaagggagatagaaa

SEQ ID NO: 7002574 - DNA, 23 bp, Homo sapiens
tagttattttctctgtaatttgc

SEQ ID NO: 7002575 - DNA, 22 bp, Homo sapiens
aaaatgttcaagcatgctggtt

SEQ ID NO: 7002576 - DNA, 19 bp, Homo sapiens
gccctcaggcagctccatc

SEQ ID NO: 7002577 - DNA, 22 bp, Homo sapiens
tgggcaaagtcacatacatgat

SEQ ID NO: 7002578 - DNA, 22 bp, Homo sapiens
cctgaccctccttagagtccag

SEQ ID NO: 7002579 - DNA, 22 bp, Homo sapiens
tctacaaaggttgaggtgccct

SEQ ID NO: 7002580 - DNA, 22 bp, Homo sapiens
agtgcaacagcagttctcttta

SEQ ID NO: 7002581 - DNA, 20 bp, Homo sapiens
agtgtgttcctcttactgtg

SEQ ID NO: 7002582 - DNA, 20 bp, Homo sapiens
atgtcctcagccactgccct

SEQ ID NO: 7002583 - DNA, 22 bp, Homo sapiens
gttgccagccctcagggactga

SEQ ID NO: 7002584 - DNA, 22 bp, Homo sapiens
agcagtggagcgagatgtttaa

SEQ ID NO: 7002585 - DNA, 22 bp, Homo sapiens
agagttgcttatttgagtttct

SEQ ID NO: 7002586 - DNA, 22 bp, Homo sapiens
tggagccaggctggccctgcca

SEQ ID NO: 7002587 - DNA, 22 bp, Homo sapiens
aggaggtgttgatagaaggttt

SEQ ID NO: 7002588 - DNA, 16 bp, Homo sapiens
tctccctgttctccaa

SEQ ID NO: 7002589 - DNA, 22 bp, Homo sapiens
tgcagggaaagtgttggcagca

SEQ ID NO: 7002590 - DNA, 22 bp, Homo sapiens
tttctttgtagtagcataatca

SEQ ID NO: 7002591 - DNA, 18 bp, Homo sapiens
ggcactgctgttcccctt

SEQ ID NO: 7002592 - DNA, 22 bp, Homo sapiens
tggtcctgccccgtgcacagag

SEQ ID NO: 7002593 - DNA, 22 bp, Homo sapiens
tccatggtttcagtctggctgg

SEQ ID NO: 7002594 - DNA, 22 bp, Homo sapiens
taaagcagcgtgggtggggcag

SEQ ID NO: 7002595 - DNA, 22 bp, Homo sapiens
tcaggagcagctgtaggaaggg

SEQ ID NO: 7002596 - DNA, 19 bp, Homo sapiens
aatgcatggaagttggaga

SEQ ID NO: 7002597 - DNA, 22 bp, Homo sapiens
cttaggcagggctggaagatct

SEQ ID NO: 7002598 - DNA, 22 bp, Homo sapiens
gtgcacgtggctaatgacagtt

SEQ ID NO: 7002599 - DNA, 21 bp, Homo sapiens
actgaggcaatggatttttgt

SEQ ID NO: 7002600 - DNA, 20 bp, Homo sapiens
ggtcctgtactctcattgaa

SEQ ID NO: 7002601 - DNA, 22 bp, Homo sapiens
tgtgctgagcaaatccatctgt

SEQ ID NO: 7002602 - DNA, 22 bp, Homo sapiens
ggatgctgactttggagcatgg

SEQ ID NO: 7002603 - DNA, 22 bp, Homo sapiens
gagcagtaggagaaccctgagc

SEQ ID NO: 7002604 - DNA, 22 bp, Homo sapiens
ttagtgttagggcctgttacct

SEQ ID NO: 7002605 - DNA, 22 bp, Homo sapiens
aggaaagcaatggctgagaaca

SEQ ID NO: 7002606 - DNA, 22 bp, Homo sapiens
tgcacacatacatgggaagtgc

SEQ ID NO: 7002607 - DNA, 21 bp, Homo sapiens
taagcatatcagatagactct

SEQ ID NO: 7002608 - DNA, 22 bp, Homo sapiens
tgtgtgcaggcactgtgccaga

SEQ ID NO: 7002609 - DNA, 22 bp, Homo sapiens
gaagatcaagtgtcattctgtg

SEQ ID NO: 7002610 - DNA, 22 bp, Homo sapiens
cttcttgggtcagagaatcatt

SEQ ID NO: 7002611 - DNA, 21 bp, Homo sapiens
ggccccgcagacccagcacgt

SEQ ID NO: 7002612 - DNA, 22 bp, Homo sapiens
ctgggaggcccacgttgggaag

SEQ ID NO: 7002613 - DNA, 22 bp, Homo sapiens
tcctgggaccctgggtgcagag

SEQ ID NO: 7002614 - DNA, 22 bp, Homo sapiens
cttgactctgtgatgaccttga

SEQ ID NO: 7002615 - DNA, 19 bp, Homo sapiens
ggctcctgtggctgcagcc

SEQ ID NO: 7002616 - DNA, 22 bp, Homo sapiens
tcacttgaattcattctgcgaa

SEQ ID NO: 7002617 - DNA, 22 bp, Homo sapiens
tggtcaaaagaaagctcagaac

SEQ ID NO: 7002618 - DNA, 22 bp, Homo sapiens
aaagaagctgtggctctgggag

SEQ ID NO: 7002619 - DNA, 22 bp, Homo sapiens
ccattttctgcagctgccgcgg

SEQ ID NO: 7002620 - DNA, 17 bp, Homo sapiens
agtgagaatgtcatgta

SEQ ID NO: 7002621 - DNA, 22 bp, Homo sapiens
gctggggaccagctgtctctga

SEQ ID NO: 7002622 - DNA, 22 bp, Homo sapiens
tgtgaaattacttaaaggaaat

SEQ ID NO: 7002623 - DNA, 22 bp, Homo sapiens
gacatttagctgttttgcattt

SEQ ID NO: 7002624 - DNA, 22 bp, Homo sapiens
aagtccttggagaatagaaagg

SEQ ID NO: 7002625 - DNA, 23 bp, Homo sapiens
aggtaggttattgctgctacctg

SEQ ID NO: 7002626 - DNA, 22 bp, Homo sapiens
cagagcaacaccctttacatcg

SEQ ID NO: 7002627 - DNA, 22 bp, Homo sapiens
ttctatttccagtccttcagag

SEQ ID NO: 7002628 - DNA, 21 bp, Homo sapiens
ggccagtggaattttatgtca

SEQ ID NO: 7002629 - DNA, 22 bp, Homo sapiens
tctctgtgaagctcccgttagg

SEQ ID NO: 7002630 - DNA, 22 bp, Homo sapiens
ttcagaaatccctcttctaccc

SEQ ID NO: 7002631 - DNA, 22 bp, Homo sapiens
ttgtgcctggggtctgacagcc

SEQ ID NO: 7002632 - DNA, 19 bp, Homo sapiens
acttcctgcccgctccttt

SEQ ID NO: 7002633 - DNA, 22 bp, Homo sapiens
actggctgtggccacggctgct

SEQ ID NO: 7002634 - DNA, 22 bp, Homo sapiens
tcagctctgttttgagtggaac

SEQ ID NO: 7002635 - DNA, 22 bp, Homo sapiens
agcagccagttctctgtggtag

SEQ ID NO: 7002636 - DNA, 22 bp, Homo sapiens
gttaatgaggacaagttttgag

SEQ ID NO: 7002637 - DNA, 22 bp, Homo sapiens
aacagcagggacttgaatggaa

SEQ ID NO: 7002638 - DNA, 22 bp, Homo sapiens
aagagctggatggaatctggga

SEQ ID NO: 7002639 - DNA, 20 bp, Homo sapiens
atgatgtcagtggcggaggt

SEQ ID NO: 7002640 - DNA, 22 bp, Homo sapiens
agtgaaaacactagttcttgcc

SEQ ID NO: 7002641 - DNA, 22 bp, Homo sapiens
gtgccctgaggtcttcactttg

SEQ ID NO: 7002642 - DNA, 22 bp, Homo sapiens
agtcacaggcaagagggctcca

SEQ ID NO: 7002643 - DNA, 22 bp, Homo sapiens
ggtggcagaggtgcatcagccc

SEQ ID NO: 7002644 - DNA, 22 bp, Homo sapiens
tccaggagacacccttgtgtgt

SEQ ID NO: 7002645 - DNA, 22 bp, Homo sapiens
cacgcgcacactcaggtcaagt

SEQ ID NO: 7002646 - DNA, 22 bp, Homo sapiens
tgacctgggcattacaggtgca

SEQ ID NO: 7002647 - DNA, 22 bp, Homo sapiens
gctgtctgactccaagttggag

SEQ ID NO: 7002648 - DNA, 19 bp, Homo sapiens
aggcttggaacagccttat

SEQ ID NO: 7002649 - DNA, 22 bp, Homo sapiens
tacattcagaagaatggacacg

SEQ ID NO: 7002650 - DNA, 19 bp, Homo sapiens
tagataaggcatttaatct

SEQ ID NO: 7002651 - DNA, 22 bp, Homo sapiens
ttatgctaaatgaatcaagtca

SEQ ID NO: 7002652 - DNA, 22 bp, Homo sapiens
tctgtacacttcagcatgcatc

SEQ ID NO: 7002653 - DNA, 22 bp, Homo sapiens
caaaaggccagtactttgtttg

SEQ ID NO: 7002654 - DNA, 21 bp, Homo sapiens
taaatctctgtattcttcagt

SEQ ID NO: 7002655 - DNA, 22 bp, Homo sapiens
gagggtcagaagggcctggttc

SEQ ID NO: 7002656 - DNA, 22 bp, Homo sapiens
acatgcatggagggaaaatgtc

SEQ ID NO: 7002657 - DNA, 22 bp, Homo sapiens
gcagctttagaaacaagggctg

SEQ ID NO: 7002658 - DNA, 22 bp, Homo sapiens
tttcagttcacctgggaacccg

SEQ ID NO: 7002659 - DNA, 22 bp, Homo sapiens
ccacggaaagtcaccctaagga

SEQ ID NO: 7002660 - DNA, 22 bp, Homo sapiens
agctgcaagtccaaaggaatta

SEQ ID NO: 7002661 - DNA, 22 bp, Homo sapiens
tggcacatgatgttgtggcatc

SEQ ID NO: 7002662 - DNA, 22 bp, Homo sapiens
ctgagcttaaccctgttagcaa

SEQ ID NO: 7002663 - DNA, 22 bp, Homo sapiens
ctttgctgatctctggtttaaa

SEQ ID NO: 7002664 - DNA, 22 bp, Homo sapiens
ttagagctgatagtacactggt

SEQ ID NO: 7002665 - DNA, 22 bp, Homo sapiens
ttcctttcccttgcttctgtgc

SEQ ID NO: 7002666 - DNA, 22 bp, Homo sapiens
tctgaacagaaaagatgcacaa

SEQ ID NO: 7002667 - DNA, 22 bp, Homo sapiens
aaggagtctgggccattcagag

SEQ ID NO: 7002668 - DNA, 22 bp, Homo sapiens
tctccagggactgaggctggag

SEQ ID NO: 7002669 - DNA, 22 bp, Homo sapiens
aaagtctaaattattcaataag

SEQ ID NO: 7002670 - DNA, 23 bp, Homo sapiens
ttcagactgccttcagcattgtc

SEQ ID NO: 7002671 - DNA, 22 bp, Homo sapiens
ccatctgtctcctcctcgaatt

SEQ ID NO: 7002672 - DNA, 22 bp, Homo sapiens
tttgttcaaggaatagtaaatg

SEQ ID NO: 7002673 - DNA, 22 bp, Homo sapiens
aatgtgtgaattgagagaagag

SEQ ID NO: 7002674 - DNA, 22 bp, Homo sapiens
gtgatacaaataaacatatgct

SEQ ID NO: 7002675 - DNA, 22 bp, Homo sapiens
cccagacagtcaagaggcctgc

SEQ ID NO: 7002676 - DNA, 22 bp, Homo sapiens
tgtggaactagtattgtcttaa

SEQ ID NO: 7002677 - DNA, 22 bp, Homo sapiens
ggtgacagcgggtcaagaggag

SEQ ID NO: 7002678 - DNA, 22 bp, Homo sapiens
tgcgttattgtgtctggctatg

SEQ ID NO: 7002679 - DNA, 22 bp, Homo sapiens
cagggcagagccaggatttcaa

SEQ ID NO: 7002680 - DNA, 22 bp, Homo sapiens
atcattctattgttgagctgcc

SEQ ID NO: 7002681 - DNA, 22 bp, Homo sapiens
aaagagttacacagtttcagaa

SEQ ID NO: 7002682 - DNA, 22 bp, Homo sapiens
caggtgctctgctgcaggtaag

SEQ ID NO: 7002683 - DNA, 21 bp, Homo sapiens
catttctaagcctggctatag

SEQ ID NO: 7002684 - DNA, 22 bp, Homo sapiens
ctgcctgagtacaagtcccaga

SEQ ID NO: 7002685 - DNA, 22 bp, Homo sapiens
tctcaaggaaaagtgatggcat

SEQ ID NO: 7002686 - DNA, 20 bp, Homo sapiens
cccagcccgggccgcgctcg

SEQ ID NO: 7002687 - DNA, 22 bp, Homo sapiens
tgtggactttagtaggtgagag

SEQ ID NO: 7002688 - DNA, 19 bp, Homo sapiens
cagaaatagcgaagtgtaa

SEQ ID NO: 7002689 - DNA, 22 bp, Homo sapiens
actaagtgggacatttactagg

SEQ ID NO: 7002690 - DNA, 22 bp, Homo sapiens
cttctctggcagatgtgtgtcc

SEQ ID NO: 7002691 - DNA, 22 bp, Homo sapiens
taattccttaagctgaagactt

SEQ ID NO: 7002692 - DNA, 22 bp, Homo sapiens
tggcttccgccgcgggcctcgg

SEQ ID NO: 7002693 - DNA, 22 bp, Homo sapiens
tctctcttcagagataccttgc

SEQ ID NO: 7002694 - DNA, 22 bp, Homo sapiens
cagggtcatggcacctgcacgg

SEQ ID NO: 7002695 - DNA, 22 bp, Homo sapiens
aggtctctgagtactgctggac

SEQ ID NO: 7002696 - DNA, 22 bp, Homo sapiens
acatttggttgagctgttgtca

SEQ ID NO: 7002697 - DNA, 22 bp, Homo sapiens
agagtagttctttgcagagtgg

SEQ ID NO: 7002698 - DNA, 22 bp, Homo sapiens
tcacagacgcatcctcaggtag

SEQ ID NO: 7002699 - DNA, 22 bp, Homo sapiens
ttaaaatgcagattctgattca

SEQ ID NO: 7002700 - DNA, 23 bp, Homo sapiens
ccaattcatggcagatttgaaga

SEQ ID NO: 7002701 - DNA, 22 bp, Homo sapiens
aataaagcctgtctctttagag

SEQ ID NO: 7002702 - DNA, 22 bp, Homo sapiens
tgtctatccagtcagtgccggt

SEQ ID NO: 7002703 - DNA, 22 bp, Homo sapiens
tctctgtgtgttggctgtatat

SEQ ID NO: 7002704 - DNA, 23 bp, Homo sapiens
cccaggaagccaaagaaatatag

SEQ ID NO: 7002705 - DNA, 22 bp, Homo sapiens
agattggagatggaagaaaagt

SEQ ID NO: 7002706 - DNA, 22 bp, Homo sapiens
actgtgtgggccgctcactggg

SEQ ID NO: 7002707 - DNA, 22 bp, Homo sapiens
ctctctgtggtggctgtcccat

SEQ ID NO: 7002708 - DNA, 22 bp, Homo sapiens
agggtagggcccggagacagac

SEQ ID NO: 7002709 - DNA, 22 bp, Homo sapiens
cctgggatttcctgagcactct

SEQ ID NO: 7002710 - DNA, 22 bp, Homo sapiens
tgcaggtgtgggcaggggagca

SEQ ID NO: 7002711 - DNA, 22 bp, Homo sapiens
ttgaagtatagagtttaagaac

SEQ ID NO: 7002712 - DNA, 22 bp, Homo sapiens
atgacttctgctttacagagtt

SEQ ID NO: 7002713 - DNA, 22 bp, Homo sapiens
gggcagaatttgtagatgacat

SEQ ID NO: 7002714 - DNA, 22 bp, Homo sapiens
aaagtaaagattgggaatgtgt

SEQ ID NO: 7002715 - DNA, 22 bp, Homo sapiens
ctgtatgattccatttctataa

SEQ ID NO: 7002716 - DNA, 22 bp, Homo sapiens
caagatgtggtgggctgagttt

SEQ ID NO: 7002717 - DNA, 22 bp, Homo sapiens
agctaagctctcagatactaag

SEQ ID NO: 7002718 - DNA, 22 bp, Homo sapiens
agatgtgagtggctgtacagtg

SEQ ID NO: 7002719 - DNA, 22 bp, Homo sapiens
cctggaaagattgcagttgctg

SEQ ID NO: 7002720 - DNA, 22 bp, Homo sapiens
aaagccagagtgtgttagagac

SEQ ID NO: 7002721 - DNA, 22 bp, Homo sapiens
ctgtcccatactatctgggtga

SEQ ID NO: 7002722 - DNA, 22 bp, Homo sapiens
aggccagtgtggctggagcaca

SEQ ID NO: 7002723 - DNA, 22 bp, Homo sapiens
tgatatctaccataaccattcg

SEQ ID NO: 7002724 - DNA, 22 bp, Homo sapiens
tctgggttttgtaccgtgctcg

SEQ ID NO: 7002725 - DNA, 22 bp, Homo sapiens
tccagggcaggtgctgggctct

SEQ ID NO: 7002726 - DNA, 22 bp, Homo sapiens
gtggcatgatgtcggcttagtg

SEQ ID NO: 7002727 - DNA, 22 bp, Homo sapiens
gctgatgtgatgtcagaagagg

SEQ ID NO: 7002728 - DNA, 23 bp, Homo sapiens
ccagctccgtgagcctcgggctc

SEQ ID NO: 7002729 - DNA, 22 bp, Homo sapiens
tcatgtgtctgccagtgtttat

SEQ ID NO: 7002730 - DNA, 22 bp, Homo sapiens
tcatagttatggagattaagga

SEQ ID NO: 7002731 - DNA, 18 bp, Homo sapiens
aggaaagacgaagagggc

SEQ ID NO: 7002732 - DNA, 22 bp, Homo sapiens
gagctttgctggaagcctgggg

SEQ ID NO: 7002733 - DNA, 22 bp, Homo sapiens
gtagtatatcagtggtttccat

SEQ ID NO: 7002734 - DNA, 22 bp, Homo sapiens
agtgttcctgctctcaggaagc

SEQ ID NO: 7002735 - DNA, 22 bp, Homo sapiens
acggccgatgactccagcatgg

SEQ ID NO: 7002736 - DNA, 22 bp, Homo sapiens
gaaagttcacacatccacatgg

SEQ ID NO: 7002737 - DNA, 20 bp, Homo sapiens
tcagtgtcagtagccactac

SEQ ID NO: 7002738 - DNA, 22 bp, Homo sapiens
gatgaggtctacattgttaaaa

SEQ ID NO: 7002739 - DNA, 22 bp, Homo sapiens
actgtactttcccaagcacaca

SEQ ID NO: 7002740 - DNA, 22 bp, Homo sapiens
atgcctgtctcagggtctgttt

SEQ ID NO: 7002741 - DNA, 18 bp, Homo sapiens
tacagattatagatacat

SEQ ID NO: 7002742 - DNA, 22 bp, Homo sapiens
agtcataattataaacatcagt

SEQ ID NO: 7002743 - DNA, 22 bp, Homo sapiens
tcctccagccctctaggaaaat

SEQ ID NO: 7002744 - DNA, 22 bp, Homo sapiens
gcctagggatgacaaatattct

SEQ ID NO: 7002745 - DNA, 22 bp, Homo sapiens
cagagccctccgctccccggct

SEQ ID NO: 7002746 - DNA, 22 bp, Homo sapiens
gggactcctttaaggagggtga

SEQ ID NO: 7002747 - DNA, 22 bp, Homo sapiens
tcagcagttcaaccccgtcaga

SEQ ID NO: 7002748 - DNA, 21 bp, Homo sapiens
aagtgtgtcccagcagccggg

SEQ ID NO: 7002749 - DNA, 22 bp, Homo sapiens
cttcctagagccggcagtgagg

SEQ ID NO: 7002750 - DNA, 22 bp, Homo sapiens
ccaggctgtaagagtgatgttg

SEQ ID NO: 7002751 - DNA, 22 bp, Homo sapiens
gctgcctgtcctgaggagtccg

SEQ ID NO: 7002752 - DNA, 22 bp, Homo sapiens
agcatacagtaggtgctcagtt

SEQ ID NO: 7002753 - DNA, 22 bp, Homo sapiens
gaagcaatctggctcccagcca

SEQ ID NO: 7002754 - DNA, 22 bp, Homo sapiens
cactgaaatattaatatcttat

SEQ ID NO: 7002755 - DNA, 22 bp, Homo sapiens
tgaaacattatagaatatttat

SEQ ID NO: 7002756 - DNA, 22 bp, Homo sapiens
gggagtgtgcacacatggtata

SEQ ID NO: 7002757 - DNA, 22 bp, Homo sapiens
tgcagtgttcctgtgggtttat

SEQ ID NO: 7002758 - DNA, 22 bp, Homo sapiens
aacagttatctcacatatggaa

SEQ ID NO: 7002759 - DNA, 22 bp, Homo sapiens
ccttggacagcccatgaaccca

SEQ ID NO: 7002760 - DNA, 22 bp, Homo sapiens
gatcttttcaggtttctctagt

SEQ ID NO: 7002761 - DNA, 22 bp, Homo sapiens
tccagactcactcatgtgacta

SEQ ID NO: 7002762 - DNA, 22 bp, Homo sapiens
ggactggggccaacacctccct

SEQ ID NO: 7002763 - DNA, 20 bp, Homo sapiens
ctttctctaatttataagta

SEQ ID NO: 7002764 - DNA, 19 bp, Homo sapiens
tattcctagttagggggga

SEQ ID NO: 7002765 - DNA, 22 bp, Homo sapiens
tcacattctttatttgccatcc

SEQ ID NO: 7002766 - DNA, 22 bp, Homo sapiens
cctgtctccctggcatggctca

SEQ ID NO: 7002767 - DNA, 22 bp, Homo sapiens
agctgtggcaaccttgtcagac

SEQ ID NO: 7002768 - DNA, 22 bp, Homo sapiens
gactaggctctcatagaggtag

SEQ ID NO: 7002769 - DNA, 22 bp, Homo sapiens
ttcagaatattattttaaaggc

SEQ ID NO: 7002770 - DNA, 22 bp, Homo sapiens
tgtgatttcactggtgacatgt

SEQ ID NO: 7002771 - DNA, 22 bp, Homo sapiens
ctggcagctctactcagagcct

SEQ ID NO: 7002772 - DNA, 22 bp, Homo sapiens
tgggagcaagctggtgctggag

SEQ ID NO: 7002773 - DNA, 22 bp, Homo sapiens
tagcagcaagaatgggatgtgt

SEQ ID NO: 7002774 - DNA, 22 bp, Homo sapiens
ggacaaaggggtacgatctagc

SEQ ID NO: 7002775 - DNA, 22 bp, Homo sapiens
ttaccttgggttaaactggctg

SEQ ID NO: 7002776 - DNA, 22 bp, Homo sapiens
actgccttctgctcagggttca

SEQ ID NO: 7002777 - DNA, 18 bp, Homo sapiens
taggccagtatacttttc

SEQ ID NO: 7002778 - DNA, 22 bp, Homo sapiens
actatacagaagaggataggaa

SEQ ID NO: 7002779 - DNA, 22 bp, Homo sapiens
cagcagtcacacaaactctgga

SEQ ID NO: 7002780 - DNA, 22 bp, Homo sapiens
aaagcagccggttccctggtct

SEQ ID NO: 7002781 - DNA, 22 bp, Homo sapiens
ttaaagctgagccctcagaagc

SEQ ID NO: 7002782 - DNA, 22 bp, Homo sapiens
ttgaagtcatttagcttcatca

SEQ ID NO: 7002783 - DNA, 22 bp, Homo sapiens
agagtggcagcaagtcaggtag

SEQ ID NO: 7002784 - DNA, 22 bp, Homo sapiens
ggcctgtggctttggcgtctaa

SEQ ID NO: 7002785 - DNA, 22 bp, Homo sapiens
cttagaaatcgaactcaggtta

SEQ ID NO: 7002786 - DNA, 22 bp, Homo sapiens
acagcacttgggttttcctgtt

SEQ ID NO: 7002787 - DNA, 22 bp, Homo sapiens
cttcttgtaaacggttccccga

SEQ ID NO: 7002788 - DNA, 22 bp, Homo sapiens
gagcagagtctatttccacact

SEQ ID NO: 7002789 - DNA, 22 bp, Homo sapiens
tccccagaggtgaggcagcttt

SEQ ID NO: 7002790 - DNA, 22 bp, Homo sapiens
gccctgctgtcttcagagtata

SEQ ID NO: 7002791 - DNA, 22 bp, Homo sapiens
cagatttcatgcgaaatggggt

SEQ ID NO: 7002792 - DNA, 22 bp, Homo sapiens
gaaaattattgaaaatggctct

SEQ ID NO: 7002793 - DNA, 21 bp, Homo sapiens
caaggacaggttgcagggcaa

SEQ ID NO: 7002794 - DNA, 22 bp, Homo sapiens
tagaacatgtgaaaatatagcc

SEQ ID NO: 7002795 - DNA, 22 bp, Homo sapiens
tttctaaagggtagatttggcc

SEQ ID NO: 7002796 - DNA, 22 bp, Homo sapiens
atgtagaaagttattttactct

SEQ ID NO: 7002797 - DNA, 22 bp, Homo sapiens
ccaacttctccatcagataaga

SEQ ID NO: 7002798 - DNA, 22 bp, Homo sapiens
cattgctcttgctcccaatgtt

SEQ ID NO: 7002799 - DNA, 22 bp, Homo sapiens
tgtgcttgaaattcagttttga

SEQ ID NO: 7002800 - DNA, 22 bp, Homo sapiens
tggggtgagattcagatattca

SEQ ID NO: 7002801 - DNA, 22 bp, Homo sapiens
gatgaaattcagaattgagggg

SEQ ID NO: 7002802 - DNA, 22 bp, Homo sapiens
agaagtgtggtctagcagtggc

SEQ ID NO: 7002803 - DNA, 22 bp, Homo sapiens
agcagcctggtctctcgccaat

SEQ ID NO: 7002804 - DNA, 20 bp, Homo sapiens
tgccacctggtttaagtgtg

SEQ ID NO: 7002805 - DNA, 22 bp, Homo sapiens
tggactttcacatagcaaagga

SEQ ID NO: 7002806 - DNA, 22 bp, Homo sapiens
tacaatgttcgcattctctctg

SEQ ID NO: 7002807 - DNA, 22 bp, Homo sapiens
tcgcccaggctggaagtgcagt

SEQ ID NO: 7002808 - DNA, 22 bp, Homo sapiens
cctctgtgtcctggtcattgaa

SEQ ID NO: 7002809 - DNA, 22 bp, Homo sapiens
agcttcagatttatctttctgt

SEQ ID NO: 7002810 - DNA, 22 bp, Homo sapiens
taggaaatgctgtcttattgta

SEQ ID NO: 7002811 - DNA, 22 bp, Homo sapiens
ggccaggagaggagggcactga

SEQ ID NO: 7002812 - DNA, 22 bp, Homo sapiens
tttatgctgtactcttgggaag

SEQ ID NO: 7002813 - DNA, 22 bp, Homo sapiens
cagcctcctgggacactcaccg

SEQ ID NO: 7002814 - DNA, 22 bp, Homo sapiens
ccaatgatggtgcccacgatga

SEQ ID NO: 7002815 - DNA, 22 bp, Homo sapiens
caggcctcttccatgcagcagc

SEQ ID NO: 7002816 - DNA, 22 bp, Homo sapiens
attggctttcttttgtgaaaat

SEQ ID NO: 7002817 - DNA, 22 bp, Homo sapiens
acagaagttggaattagatact

SEQ ID NO: 7002818 - DNA, 22 bp, Homo sapiens
aacagtgatatcaagacagaca

SEQ ID NO: 7002819 - DNA, 19 bp, Homo sapiens
aaccttgcatgtcattata

SEQ ID NO: 7002820 - DNA, 22 bp, Homo sapiens
ttaattaaattcatgagcattg

SEQ ID NO: 7002821 - DNA, 22 bp, Homo sapiens
caaacattcagatgcaatggta

SEQ ID NO: 7002822 - DNA, 22 bp, Homo sapiens
ctgttactgttggcccagggtg

SEQ ID NO: 7002823 - DNA, 22 bp, Homo sapiens
caatagagacctggattctccc

SEQ ID NO: 7002824 - DNA, 22 bp, Homo sapiens
tgtaggaactcacagatattct

SEQ ID NO: 7002825 - DNA, 22 bp, Homo sapiens
ctctggagttctcatgaggaac

SEQ ID NO: 7002826 - DNA, 22 bp, Homo sapiens
cagttcctatgggcaaaacaca

SEQ ID NO: 7002827 - DNA, 22 bp, Homo sapiens
agagtaaagtacttggaatacc

SEQ ID NO: 7002828 - DNA, 22 bp, Homo sapiens
gggttcagtccctcttgctact

SEQ ID NO: 7002829 - DNA, 22 bp, Homo sapiens
agtgggtgcaaccatggctagg

SEQ ID NO: 7002830 - DNA, 21 bp, Homo sapiens
ttagagtagagaacatgatcc

SEQ ID NO: 7002831 - DNA, 22 bp, Homo sapiens
taggaaatatttgaacatagga

SEQ ID NO: 7002832 - DNA, 22 bp, Homo sapiens
ttgtgcaatttaaaatcttcct

SEQ ID NO: 7002833 - DNA, 22 bp, Homo sapiens
atgtccttccattttgatctgt

SEQ ID NO: 7002834 - DNA, 22 bp, Homo sapiens
aatcaggaggataagggggtcc

SEQ ID NO: 7002835 - DNA, 22 bp, Homo sapiens
tggggctggggatcttgagcct

SEQ ID NO: 7002836 - DNA, 22 bp, Homo sapiens
acatttgtatatatgcagcata

SEQ ID NO: 7002837 - DNA, 22 bp, Homo sapiens
gaaggcttcccacctgatattt

SEQ ID NO: 7002838 - DNA, 22 bp, Homo sapiens
ttgcaacatctgaacatttatc

SEQ ID NO: 7002839 - DNA, 22 bp, Homo sapiens
acccagagtgtctgtctcagtc

SEQ ID NO: 7002840 - DNA, 22 bp, Homo sapiens
gttattctagtgctcagccatt

SEQ ID NO: 7002841 - DNA, 22 bp, Homo sapiens
atggagtaatattaacatgtta

SEQ ID NO: 7002842 - DNA, 23 bp, Homo sapiens
attgagaaggatacattgttctc

SEQ ID NO: 7002843 - DNA, 18 bp, Homo sapiens
agtccttacgaggctata

SEQ ID NO: 7002844 - DNA, 22 bp, Homo sapiens
tctgggtaataggaagtgcagt

SEQ ID NO: 7002845 - DNA, 22 bp, Homo sapiens
ttgacaatgcactgtgctaagt

SEQ ID NO: 7002846 - DNA, 22 bp, Homo sapiens
agtaggcatttaataaacatga

SEQ ID NO: 7002847 - DNA, 22 bp, Homo sapiens
cccagaggtgaaggaggtggga

SEQ ID NO: 7002848 - DNA, 22 bp, Homo sapiens
ttgtattagctgtaaattttct

SEQ ID NO: 7002849 - DNA, 22 bp, Homo sapiens
aatctggagttaatgttttcgc

SEQ ID NO: 7002850 - DNA, 21 bp, Homo sapiens
cttcagcaaatacttggcagg

SEQ ID NO: 7002851 - DNA, 22 bp, Homo sapiens
tctgccctaattcagtgcttag

SEQ ID NO: 7002852 - DNA, 22 bp, Homo sapiens
ctcctggaggatagtgactggg

SEQ ID NO: 7002853 - DNA, 22 bp, Homo sapiens
tgtaattgctttgtaatgaaat

SEQ ID NO: 7002854 - DNA, 22 bp, Homo sapiens
gggcatggtggcaggcacctgt

SEQ ID NO: 7002855 - DNA, 22 bp, Homo sapiens
gggagctgaatggcaatggaga

SEQ ID NO: 7002856 - DNA, 21 bp, Homo sapiens
gcagtgcttcgagactgtggt

SEQ ID NO: 7002857 - DNA, 22 bp, Homo sapiens
gtaaagatggtattttggagtt

SEQ ID NO: 7002858 - DNA, 22 bp, Homo sapiens
cccagcagtgacccagtgatac

SEQ ID NO: 7002859 - DNA, 22 bp, Homo sapiens
tcatatagagggcatacaaatg

SEQ ID NO: 7002860 - DNA, 22 bp, Homo sapiens
agggatgggtctaacccagaac

SEQ ID NO: 7002861 - DNA, 22 bp, Homo sapiens
atttggaagtttggagtgaagg

SEQ ID NO: 7002862 - DNA, 22 bp, Homo sapiens
ctgtaagatgggataagacttt

SEQ ID NO: 7002863 - DNA, 22 bp, Homo sapiens
tccgggggtggtagatttcctt

SEQ ID NO: 7002864 - DNA, 22 bp, Homo sapiens
ttcagcttggagagaattttta

SEQ ID NO: 7002865 - DNA, 22 bp, Homo sapiens
ttgaggcattactgtaatgaga

SEQ ID NO: 7002866 - DNA, 21 bp, Homo sapiens
atctgatgtataaatacctct

SEQ ID NO: 7002867 - DNA, 22 bp, Homo sapiens
tggtaaggcccagctggagtcc

SEQ ID NO: 7002868 - DNA, 22 bp, Homo sapiens
tggtggcatcaattgacttctc

SEQ ID NO: 7002869 - DNA, 23 bp, Homo sapiens
agtttgtaaagaaatatttgcac

SEQ ID NO: 7002870 - DNA, 22 bp, Homo sapiens
cccaaaggttgaggctgcagtg

SEQ ID NO: 7002871 - DNA, 22 bp, Homo sapiens
gcccaggattctttcttcctta

SEQ ID NO: 7002872 - DNA, 22 bp, Homo sapiens
atgcaggattagaaagttgcct

SEQ ID NO: 7002873 - DNA, 22 bp, Homo sapiens
tcttccttgctccttgtcactt

SEQ ID NO: 7002874 - DNA, 16 bp, Homo sapiens
agaggccacagacaga

SEQ ID NO: 7002875 - DNA, 22 bp, Homo sapiens
aggagctggcctagaaaggaga

SEQ ID NO: 7002876 - DNA, 21 bp, Homo sapiens
aatgtatgtttatctcacagt

SEQ ID NO: 7002877 - DNA, 22 bp, Homo sapiens
tgaataatcttgggtattaata

SEQ ID NO: 7002878 - DNA, 22 bp, Homo sapiens
atttggctgactcactaattgt

SEQ ID NO: 7002879 - DNA, 22 bp, Homo sapiens
ttttctagggtgctaaatgaac

SEQ ID NO: 7002880 - DNA, 22 bp, Homo sapiens
gcacctttttctaggagaatgt

SEQ ID NO: 7002881 - DNA, 22 bp, Homo sapiens
aggtccatcttaaatgcactca

SEQ ID NO: 7002882 - DNA, 22 bp, Homo sapiens
gcctggctcacagagcagcctt

SEQ ID NO: 7002883 - DNA, 22 bp, Homo sapiens
ctttggtaaatgtcaaaaagtt

SEQ ID NO: 7002884 - DNA, 19 bp, Homo sapiens
tttgactcctcatttttat

SEQ ID NO: 7002885 - DNA, 22 bp, Homo sapiens
ttacattcccagtgtgcagcat

SEQ ID NO: 7002886 - DNA, 22 bp, Homo sapiens
tctgttcagttgattagacaga

SEQ ID NO: 7002887 - DNA, 20 bp, Homo sapiens
gttaggacttaaataaagga

SEQ ID NO: 7002888 - DNA, 22 bp, Homo sapiens
actgatctgcctgtatgtagct

SEQ ID NO: 7002889 - DNA, 19 bp, Homo sapiens
tgtgtacctaatgtttgtg

SEQ ID NO: 7002890 - DNA, 22 bp, Homo sapiens
ctttcacagtcctgactgagcg

SEQ ID NO: 7002891 - DNA, 22 bp, Homo sapiens
acaaggctatgaagtattagtt

SEQ ID NO: 7002892 - DNA, 22 bp, Homo sapiens
agttagtgtgatggaggtacga

SEQ ID NO: 7002893 - DNA, 22 bp, Homo sapiens
tttcacagcatataggtgtact

SEQ ID NO: 7002894 - DNA, 22 bp, Homo sapiens
gattgagtctgaggatgctgca

SEQ ID NO: 7002895 - DNA, 22 bp, Homo sapiens
tccttgagagctgctctccccc

SEQ ID NO: 7002896 - DNA, 22 bp, Homo sapiens
catggtttcatgagaattaccc

SEQ ID NO: 7002897 - DNA, 22 bp, Homo sapiens
tgcaagtaattccagctactga

SEQ ID NO: 7002898 - DNA, 22 bp, Homo sapiens
atggagttgagctctgttgtcc

SEQ ID NO: 7002899 - DNA, 22 bp, Homo sapiens
cgatggaattggaaagaggaat

SEQ ID NO: 7002900 - DNA, 22 bp, Homo sapiens
tcagggcaggacagtgtaggcc

SEQ ID NO: 7002901 - DNA, 22 bp, Homo sapiens
ctgcccatcgtcatttaataaa

SEQ ID NO: 7002902 - DNA, 22 bp, Homo sapiens
tgattcatcagaataggagttt

SEQ ID NO: 7002903 - DNA, 22 bp, Homo sapiens
tcagagtcttaactattcagag

SEQ ID NO: 7002904 - DNA, 22 bp, Homo sapiens
ggacaaagggtggagcctctga

SEQ ID NO: 7002905 - DNA, 22 bp, Homo sapiens
tgactttacagatatgtttcct

SEQ ID NO: 7002906 - DNA, 22 bp, Homo sapiens
cagcagagtaattctcacctct

SEQ ID NO: 7002907 - DNA, 22 bp, Homo sapiens
cagaactgagtctcatggccat

SEQ ID NO: 7002908 - DNA, 22 bp, Homo sapiens
atggcagcagctttagctgtgg

SEQ ID NO: 7002909 - DNA, 22 bp, Homo sapiens
aggcaattagtcttttgttatt

SEQ ID NO: 7002910 - DNA, 22 bp, Homo sapiens
tacagacagtttttcagatatt

SEQ ID NO: 7002911 - DNA, 22 bp, Homo sapiens
atacttatgataaataattgct

SEQ ID NO: 7002912 - DNA, 22 bp, Homo sapiens
atccattttctctctgtggggt

SEQ ID NO: 7002913 - DNA, 22 bp, Homo sapiens
actgtacttttcttggctagat

SEQ ID NO: 7002914 - DNA, 22 bp, Homo sapiens
ggtggtgtttggaaggaggtgc

SEQ ID NO: 7002915 - DNA, 22 bp, Homo sapiens
tcccatatatgcaaaaatgtaa

SEQ ID NO: 7002916 - DNA, 22 bp, Homo sapiens
tttaaggatgtaaaggaagaag

SEQ ID NO: 7002917 - DNA, 23 bp, Homo sapiens
tcagcagcagaagtgctgggatg

SEQ ID NO: 7002918 - DNA, 22 bp, Homo sapiens
cccagaggttccttagggacca

SEQ ID NO: 7002919 - DNA, 22 bp, Homo sapiens
agcactgcctctgagctccagc

SEQ ID NO: 7002920 - DNA, 22 bp, Homo sapiens
ttctacatatatttttctcact

SEQ ID NO: 7002921 - DNA, 22 bp, Homo sapiens
acaaatggaacaatgaagactg

SEQ ID NO: 7002922 - DNA, 22 bp, Homo sapiens
tttcatctaacactacataggg

SEQ ID NO: 7002923 - DNA, 22 bp, Homo sapiens
attctctgtgtctgctttccca

SEQ ID NO: 7002924 - DNA, 22 bp, Homo sapiens
aggcttctccttcctaccttcc

SEQ ID NO: 7002925 - DNA, 22 bp, Homo sapiens
gtctccactaaaaactttcacg

SEQ ID NO: 7002926 - DNA, 23 bp, Homo sapiens
tggagaatgtgtttacttcgtgt

SEQ ID NO: 7002927 - DNA, 22 bp, Homo sapiens
ttaacattaaaagcagcatttt

SEQ ID NO: 7002928 - DNA, 19 bp, Homo sapiens
ccctcaggtctgagcagtc

SEQ ID NO: 7002929 - DNA, 22 bp, Homo sapiens
ccccaggagatttgggagcaca

SEQ ID NO: 7002930 - DNA, 22 bp, Homo sapiens
cttctgggttgcaggtcttggc

SEQ ID NO: 7002931 - DNA, 22 bp, Homo sapiens
ccagctccttctgtctgtggag

SEQ ID NO: 7002932 - DNA, 22 bp, Homo sapiens
cttctcaaacctgaaaggacaa

SEQ ID NO: 7002933 - DNA, 22 bp, Homo sapiens
tgccagactttaatttgatgat

SEQ ID NO: 7002934 - DNA, 22 bp, Homo sapiens
gctgctgcctgtagccagggtg

SEQ ID NO: 7002935 - DNA, 20 bp, Homo sapiens
tgagaggacatttttcatgt

SEQ ID NO: 7002936 - DNA, 22 bp, Homo sapiens
aggcttgacaattttacatgta

SEQ ID NO: 7002937 - DNA, 20 bp, Homo sapiens
agtaacttagcaactctagg

SEQ ID NO: 7002938 - DNA, 22 bp, Homo sapiens
tccagtctcccagggctgggac

SEQ ID NO: 7002939 - DNA, 22 bp, Homo sapiens
gtttccatggtgtttcttgggt

SEQ ID NO: 7002940 - DNA, 22 bp, Homo sapiens
gcaggtagtgctaaagacttac

SEQ ID NO: 7002941 - DNA, 22 bp, Homo sapiens
tggcttcctggacagatgcggt

SEQ ID NO: 7002942 - DNA, 22 bp, Homo sapiens
gcaattgtactagaaaacaata

SEQ ID NO: 7002943 - DNA, 21 bp, Homo sapiens
tacatcatgctacttctctga

SEQ ID NO: 7002944 - DNA, 22 bp, Homo sapiens
ggattctactgatcagcaccac

SEQ ID NO: 7002945 - DNA, 22 bp, Homo sapiens
ctccagagacacttctcatgat

SEQ ID NO: 7002946 - DNA, 22 bp, Homo sapiens
ggccttatggcaaagtcagttg

SEQ ID NO: 7002947 - DNA, 21 bp, Homo sapiens
cagaaatatgaatgatggtga

SEQ ID NO: 7002948 - DNA, 22 bp, Homo sapiens
taccaagtgataataggaaagc

SEQ ID NO: 7002949 - DNA, 22 bp, Homo sapiens
agggtggaagatggcactatct

SEQ ID NO: 7002950 - DNA, 22 bp, Homo sapiens
caccagcaccagctctgtgcct

SEQ ID NO: 7002951 - DNA, 22 bp, Homo sapiens
gcttgcctatctggtggtcgtt

SEQ ID NO: 7002952 - DNA, 22 bp, Homo sapiens
tggggcagctccatctattcca

SEQ ID NO: 7002953 - DNA, 22 bp, Homo sapiens
aaggataagaatggaaggaaca

SEQ ID NO: 7002954 - DNA, 22 bp, Homo sapiens
gagtttagtttggcttaaactg

SEQ ID NO: 7002955 - DNA, 22 bp, Homo sapiens
gaggttggagggctggcctgca

SEQ ID NO: 7002956 - DNA, 22 bp, Homo sapiens
tgcctgtcttcaggagtgtcac

SEQ ID NO: 7002957 - DNA, 22 bp, Homo sapiens
aatctggtctaagtgaggatag

SEQ ID NO: 7002958 - DNA, 22 bp, Homo sapiens
gggaatgtaatcatggaatgct

SEQ ID NO: 7002959 - DNA, 22 bp, Homo sapiens
aaggggtgcaagttaatcagca

SEQ ID NO: 7002960 - DNA, 22 bp, Homo sapiens
ccctggagggacagctgctcta

SEQ ID NO: 7002961 - DNA, 22 bp, Homo sapiens
ggctcaatgcaacttctgcctc

SEQ ID NO: 7002962 - DNA, 22 bp, Homo sapiens
tgcgatgagcttatgtgtgaat

SEQ ID NO: 7002963 - DNA, 22 bp, Homo sapiens
ctggctgcttgttttgatgggt

SEQ ID NO: 7002964 - DNA, 22 bp, Homo sapiens
atttcctgtgtctctatttatg

SEQ ID NO: 7002965 - DNA, 22 bp, Homo sapiens
ctgctgcccagtgtgcattggg

SEQ ID NO: 7002966 - DNA, 22 bp, Homo sapiens
gcagctgtggtgctgagatagg

SEQ ID NO: 7002967 - DNA, 22 bp, Homo sapiens
atcactgaaatactgaaattac

SEQ ID NO: 7002968 - DNA, 22 bp, Homo sapiens
ggctgggtttgactcctggctt

SEQ ID NO: 7002969 - DNA, 22 bp, Homo sapiens
tgacaactgcatcttggacttc

SEQ ID NO: 7002970 - DNA, 22 bp, Homo sapiens
gttggccttgaggtggtagagt

SEQ ID NO: 7002971 - DNA, 22 bp, Homo sapiens
gcttcctcctggaggtcactca

SEQ ID NO: 7002972 - DNA, 22 bp, Homo sapiens
acaaaagcttttggagggttgt

SEQ ID NO: 7002973 - DNA, 22 bp, Homo sapiens
gtcttctgtaagatgaggtccc

SEQ ID NO: 7002974 - DNA, 22 bp, Homo sapiens
aaaatagctatggaatgtcact

SEQ ID NO: 7002975 - DNA, 22 bp, Homo sapiens
ctaagttaattttctaaaacta

SEQ ID NO: 7002976 - DNA, 22 bp, Homo sapiens
agtgaatatttttagacaccca

SEQ ID NO: 7002977 - DNA, 19 bp, Homo sapiens
gagcatgactggccttgca

SEQ ID NO: 7002978 - DNA, 22 bp, Homo sapiens
attctcagctttcaaatagaca

SEQ ID NO: 7002979 - DNA, 22 bp, Homo sapiens
cagccaatgggggacttggcca

SEQ ID NO: 7002980 - DNA, 23 bp, Homo sapiens
taggctctgtaggtagagatggg

SEQ ID NO: 7002981 - DNA, 22 bp, Homo sapiens
ttctgcattgacttttatttcc

SEQ ID NO: 7002982 - DNA, 22 bp, Homo sapiens
tagtcataattttgatgtttgt

SEQ ID NO: 7002983 - DNA, 22 bp, Homo sapiens
atgaggtgttcgctggcctttt

SEQ ID NO: 7002984 - DNA, 22 bp, Homo sapiens
cagagcctctgccctgggcact

SEQ ID NO: 7002985 - DNA, 22 bp, Homo sapiens
ttgatgaggggatcagggtagc

SEQ ID NO: 7002986 - DNA, 20 bp, Homo sapiens
atcttgggattgagattgcc

SEQ ID NO: 7002987 - DNA, 22 bp, Homo sapiens
tggagctgtagccaccaccctg

SEQ ID NO: 7002988 - DNA, 22 bp, Homo sapiens
atcttagaagtttgataaaatc

SEQ ID NO: 7002989 - DNA, 22 bp, Homo sapiens
ctaaagacacaataagtagctt

SEQ ID NO: 7002990 - DNA, 22 bp, Homo sapiens
ataatttggcttcctagatgta

SEQ ID NO: 7002991 - DNA, 22 bp, Homo sapiens
acatggctaaattagctttact

SEQ ID NO: 7002992 - DNA, 22 bp, Homo sapiens
tggcttcatggcaagtcttagt

SEQ ID NO: 7002993 - DNA, 22 bp, Homo sapiens
ctgagaacatcattcagatatt

SEQ ID NO: 7002994 - DNA, 22 bp, Homo sapiens
gcgagacagctatttgggaagc

SEQ ID NO: 7002995 - DNA, 19 bp, Homo sapiens
aaaaggagagatcagagtt

SEQ ID NO: 7002996 - DNA, 22 bp, Homo sapiens
cctcggtttccacatctgtaca

SEQ ID NO: 7002997 - DNA, 22 bp, Homo sapiens
catcaaacaaatgcttttagat

SEQ ID NO: 7002998 - DNA, 22 bp, Homo sapiens
aagagcatttccactggcactg

SEQ ID NO: 7002999 - DNA, 22 bp, Homo sapiens
atgtttgccatcatgagattgt

SEQ ID NO: 7003000 - DNA, 22 bp, Homo sapiens
gtggtctttaaatttgtgcctg

SEQ ID NO: 7003001 - DNA, 22 bp, Homo sapiens
gactaaataaaagccaaacttc

SEQ ID NO: 7003002 - DNA, 22 bp, Homo sapiens
gcagtggcaccgctggctctgg

SEQ ID NO: 7003003 - DNA, 22 bp, Homo sapiens
ggaagtgtagtccgaagttgcg

SEQ ID NO: 7003004 - DNA, 22 bp, Homo sapiens
acaattgactgtatttttagct

SEQ ID NO: 7003005 - DNA, 22 bp, Homo sapiens
taattgctattggaatgctttg

SEQ ID NO: 7003006 - DNA, 22 bp, Homo sapiens
taggatgaagtagttatacagc

SEQ ID NO: 7003007 - DNA, 22 bp, Homo sapiens
agtccttatgtggtggagagag

SEQ ID NO: 7003008 - DNA, 22 bp, Homo sapiens
agttcacaatagaagaggtggc

SEQ ID NO: 7003009 - DNA, 22 bp, Homo sapiens
aagcttcagtggactgtagtgt

SEQ ID NO: 7003010 - DNA, 22 bp, Homo sapiens
gatcctaggccggcagcagaga

SEQ ID NO: 7003011 - DNA, 22 bp, Homo sapiens
ttgcaggggagaggaacaaaca

SEQ ID NO: 7003012 - DNA, 22 bp, Homo sapiens
actggggagagtcatgccagca

SEQ ID NO: 7003013 - DNA, 22 bp, Homo sapiens
aaatggcattcagcaacctttc

SEQ ID NO: 7003014 - DNA, 19 bp, Homo sapiens
gctcacttcaggttttcac

SEQ ID NO: 7003015 - DNA, 22 bp, Homo sapiens
atacaggatgctgaacatctct

SEQ ID NO: 7003016 - DNA, 22 bp, Homo sapiens
tcagctgggaagttctcgcttg

SEQ ID NO: 7003017 - DNA, 22 bp, Homo sapiens
ttggccaaatacacaccttttg

SEQ ID NO: 7003018 - DNA, 22 bp, Homo sapiens
ctccttcagtctgcgtggctgt

SEQ ID NO: 7003019 - DNA, 22 bp, Homo sapiens
gcaggcagtcatctttcatatt

SEQ ID NO: 7003020 - DNA, 22 bp, Homo sapiens
cagaagactgcagggaagggac

SEQ ID NO: 7003021 - DNA, 22 bp, Homo sapiens
gtctttgctgtctttgctctca

SEQ ID NO: 7003022 - DNA, 22 bp, Homo sapiens
ggcagggccctgattcctgggg

SEQ ID NO: 7003023 - DNA, 22 bp, Homo sapiens
tggtcctgcagtaatagacatc

SEQ ID NO: 7003024 - DNA, 22 bp, Homo sapiens
actgtactccaacctgggcaac

SEQ ID NO: 7003025 - DNA, 22 bp, Homo sapiens
atcaggatgtttggctgtcata

SEQ ID NO: 7003026 - DNA, 22 bp, Homo sapiens
atttacaccttcttcgattctc

SEQ ID NO: 7003027 - DNA, 22 bp, Homo sapiens
aaatttcaagcaaagtagctat

SEQ ID NO: 7003028 - DNA, 22 bp, Homo sapiens
acagacagacagagaactattc

SEQ ID NO: 7003029 - DNA, 22 bp, Homo sapiens
tttcattgacagttgggggaaa

SEQ ID NO: 7003030 - DNA, 22 bp, Homo sapiens
tctcagagtttagagctgagcc

SEQ ID NO: 7003031 - DNA, 22 bp, Homo sapiens
tgctgctgatggatgcctggac

SEQ ID NO: 7003032 - DNA, 22 bp, Homo sapiens
aagaggaccagtagataaattt

SEQ ID NO: 7003033 - DNA, 22 bp, Homo sapiens
gatccagcttctacacagagct

SEQ ID NO: 7003034 - DNA, 22 bp, Homo sapiens
atccttggccctgaatgaagtt

SEQ ID NO: 7003035 - DNA, 22 bp, Homo sapiens
tcaatgaggtaatcagtcaccc

SEQ ID NO: 7003036 - DNA, 22 bp, Homo sapiens
tccacagacgtgttattagttg

SEQ ID NO: 7003037 - DNA, 23 bp, Homo sapiens
ctgttggctgtcagggctggact

SEQ ID NO: 7003038 - DNA, 22 bp, Homo sapiens
agagacaagaaatacctgggac

SEQ ID NO: 7003039 - DNA, 22 bp, Homo sapiens
catggaatggttgaatgacgaa

SEQ ID NO: 7003040 - DNA, 15 bp, Homo sapiens
atgtagagagatatg

SEQ ID NO: 7003041 - DNA, 22 bp, Homo sapiens
gcacatgcttgagtgtgatgtg

SEQ ID NO: 7003042 - DNA, 22 bp, Homo sapiens
cagagggccccctggccacagt

SEQ ID NO: 7003043 - DNA, 22 bp, Homo sapiens
tgccctggagtcagtggctatt

SEQ ID NO: 7003044 - DNA, 22 bp, Homo sapiens
tttattgggtgcagtgcccaca

SEQ ID NO: 7003045 - DNA, 22 bp, Homo sapiens
gtgacagtggtcacttgtagtt

SEQ ID NO: 7003046 - DNA, 19 bp, Homo sapiens
tctgtaacactctagcctt

SEQ ID NO: 7003047 - DNA, 22 bp, Homo sapiens
ctgtgtacccacgtgggcaccc

SEQ ID NO: 7003048 - DNA, 22 bp, Homo sapiens
tagcccagaagagggaagcaac

SEQ ID NO: 7003049 - DNA, 22 bp, Homo sapiens
caggcagagacgtcagtgtagg

SEQ ID NO: 7003050 - DNA, 22 bp, Homo sapiens
ctttaatgagtctttctgctgt

SEQ ID NO: 7003051 - DNA, 21 bp, Homo sapiens
ctcttcagtggtgagctcttc

SEQ ID NO: 7003052 - DNA, 22 bp, Homo sapiens
tcccagcagcatagctcagaat

SEQ ID NO: 7003053 - DNA, 22 bp, Homo sapiens
ccctgttaatgtcaacctgcct

SEQ ID NO: 7003054 - DNA, 21 bp, Homo sapiens
ttgtaaaggtttagaagaatg

SEQ ID NO: 7003055 - DNA, 22 bp, Homo sapiens
cattgattattgaagggtcttt

SEQ ID NO: 7003056 - DNA, 22 bp, Homo sapiens
gaatgaacaaatgtggtggaga

SEQ ID NO: 7003057 - DNA, 22 bp, Homo sapiens
agagcaaagggacatggaagag

SEQ ID NO: 7003058 - DNA, 22 bp, Homo sapiens
ccatgggcgcacaggcctggag

SEQ ID NO: 7003059 - DNA, 22 bp, Homo sapiens
ggggaggaagctctcagttcca

SEQ ID NO: 7003060 - DNA, 22 bp, Homo sapiens
ccagacttcacccactttgctc

SEQ ID NO: 7003061 - DNA, 22 bp, Homo sapiens
tattatctagtaactgatagtg

SEQ ID NO: 7003062 - DNA, 22 bp, Homo sapiens
ctttccttaataagcaggtata

SEQ ID NO: 7003063 - DNA, 22 bp, Homo sapiens
tatatccagaaaatcagttcat

SEQ ID NO: 7003064 - DNA, 22 bp, Homo sapiens
gttgcattttccctccagaggt

SEQ ID NO: 7003065 - DNA, 22 bp, Homo sapiens
ctgtcatttgtctgctccctct

SEQ ID NO: 7003066 - DNA, 22 bp, Homo sapiens
taaaacttaactatccagatta

SEQ ID NO: 7003067 - DNA, 22 bp, Homo sapiens
atccagtatctgtgatgggtta

SEQ ID NO: 7003068 - DNA, 22 bp, Homo sapiens
caattgtcgttgacatccttca

SEQ ID NO: 7003069 - DNA, 22 bp, Homo sapiens
gccccagcctgggaactggagg

SEQ ID NO: 7003070 - DNA, 22 bp, Homo sapiens
aagaagctgatgcagagggttc

SEQ ID NO: 7003071 - DNA, 22 bp, Homo sapiens
ttggaacactagaatctgtact

SEQ ID NO: 7003072 - DNA, 22 bp, Homo sapiens
aggtcaaaatcaggcagggaag

SEQ ID NO: 7003073 - DNA, 22 bp, Homo sapiens
ttgttacatacagcagaacata

SEQ ID NO: 7003074 - DNA, 16 bp, Homo sapiens
tggcttgggtttcatg

SEQ ID NO: 7003075 - DNA, 21 bp, Homo sapiens
tgtatacacgtgttgaaaaca

SEQ ID NO: 7003076 - DNA, 21 bp, Homo sapiens
ttcttcatgatgattaatggc

SEQ ID NO: 7003077 - DNA, 22 bp, Homo sapiens
ggcaatatggaagctacagaga

SEQ ID NO: 7003078 - DNA, 22 bp, Homo sapiens
taacttctggaaatgcatctgc

SEQ ID NO: 7003079 - DNA, 22 bp, Homo sapiens
tacatgtaggtgacattttaat

SEQ ID NO: 7003080 - DNA, 22 bp, Homo sapiens
acagctaagctcccacaacctg

SEQ ID NO: 7003081 - DNA, 22 bp, Homo sapiens
cgcgctgcagacagcggaggcc

SEQ ID NO: 7003082 - DNA, 22 bp, Homo sapiens
agcagggaagcctccagaacct

SEQ ID NO: 7003083 - DNA, 22 bp, Homo sapiens
acatttggtaacacttgagcat

SEQ ID NO: 7003084 - DNA, 22 bp, Homo sapiens
tgggtgcatgtgagcacgtgca

SEQ ID NO: 7003085 - DNA, 22 bp, Homo sapiens
tcagcactgtgtccagtctccc

SEQ ID NO: 7003086 - DNA, 22 bp, Homo sapiens
tttagagagaattttcaaagtg

SEQ ID NO: 7003087 - DNA, 22 bp, Homo sapiens
tttaagggtggaggaacaaatg

SEQ ID NO: 7003088 - DNA, 22 bp, Homo sapiens
aggaatgtattgacctgttgca

SEQ ID NO: 7003089 - DNA, 22 bp, Homo sapiens
agacatttagacccctgtagtt

SEQ ID NO: 7003090 - DNA, 22 bp, Homo sapiens
aactttcttgtgacatttgggg

SEQ ID NO: 7003091 - DNA, 22 bp, Homo sapiens
ggaccggtggcttcctcgggtc

SEQ ID NO: 7003092 - DNA, 22 bp, Homo sapiens
gtgaattacatgtatttttaag

SEQ ID NO: 7003093 - DNA, 22 bp, Homo sapiens
gcagaaggtcaaagcaagatgt

SEQ ID NO: 7003094 - DNA, 22 bp, Homo sapiens
gtcctgggaggggctggtcctg

SEQ ID NO: 7003095 - DNA, 22 bp, Homo sapiens
gacactttaggccaccatgcaa

SEQ ID NO: 7003096 - DNA, 19 bp, Homo sapiens
ccaggacctttccagggtc

SEQ ID NO: 7003097 - DNA, 22 bp, Homo sapiens
ttcctgatcccccaggacaaag

SEQ ID NO: 7003098 - DNA, 22 bp, Homo sapiens
taaagctgttagagtagtaaga

SEQ ID NO: 7003099 - DNA, 22 bp, Homo sapiens
taatagcgaacattattttccc

SEQ ID NO: 7003100 - DNA, 22 bp, Homo sapiens
ctactgaattagactgcatttt

SEQ ID NO: 7003101 - DNA, 22 bp, Homo sapiens
ggaagactagtgttttaagtta

SEQ ID NO: 7003102 - DNA, 22 bp, Homo sapiens
tggatgtcaaaggagtttccag

SEQ ID NO: 7003103 - DNA, 22 bp, Homo sapiens
aagggcacagggaaagagtgca

SEQ ID NO: 7003104 - DNA, 22 bp, Homo sapiens
cagcagtgacaagactaagaag

SEQ ID NO: 7003105 - DNA, 22 bp, Homo sapiens
tcatacaactaagagtttcaga

SEQ ID NO: 7003106 - DNA, 22 bp, Homo sapiens
agagagtctttctcttcctgtt

SEQ ID NO: 7003107 - DNA, 22 bp, Homo sapiens
tatctgttgtccatgcagaaag

SEQ ID NO: 7003108 - DNA, 22 bp, Homo sapiens
ctgaacagtacttggccagttt

SEQ ID NO: 7003109 - DNA, 22 bp, Homo sapiens
atttccatgaaggcagatttta

SEQ ID NO: 7003110 - DNA, 23 bp, Homo sapiens
gctctatgtgttatagctgtttt

SEQ ID NO: 7003111 - DNA, 22 bp, Homo sapiens
gtgccctcatgaaacgaaggat

SEQ ID NO: 7003112 - DNA, 22 bp, Homo sapiens
atgtgcgtgtgtacatatatat

SEQ ID NO: 7003113 - DNA, 22 bp, Homo sapiens
gttatataagacaaatcagagt

SEQ ID NO: 7003114 - DNA, 22 bp, Homo sapiens
tcctgggcggttatgtgatctg

SEQ ID NO: 7003115 - DNA, 22 bp, Homo sapiens
ggcttgcttcacctacccccag

SEQ ID NO: 7003116 - DNA, 22 bp, Homo sapiens
gggggctgtcctgtgcattgta

SEQ ID NO: 7003117 - DNA, 22 bp, Homo sapiens
gcctctggaagtgggaaggggt

SEQ ID NO: 7003118 - DNA, 22 bp, Homo sapiens
agtgccctgtcactggaactga

SEQ ID NO: 7003119 - DNA, 22 bp, Homo sapiens
tcctagaagatggatcagagaa

SEQ ID NO: 7003120 - DNA, 17 bp, Homo sapiens
gcagaaaagtcaaggga

SEQ ID NO: 7003121 - DNA, 22 bp, Homo sapiens
acctgtcaagtccagcgcaaca

SEQ ID NO: 7003122 - DNA, 22 bp, Homo sapiens
accagccccaccgggactgcag

SEQ ID NO: 7003123 - DNA, 22 bp, Homo sapiens
tgccctgtgggtatctgatggc

SEQ ID NO: 7003124 - DNA, 22 bp, Homo sapiens
agcaagcaggatggtcaaacta

SEQ ID NO: 7003125 - DNA, 22 bp, Homo sapiens
gcccataattcaaatataacac

SEQ ID NO: 7003126 - DNA, 22 bp, Homo sapiens
ctgagataaatgcctccagtca

SEQ ID NO: 7003127 - DNA, 23 bp, Homo sapiens
gcatttacagactcacttttcta

SEQ ID NO: 7003128 - DNA, 22 bp, Homo sapiens
acagcagacacaggcacgctgt

SEQ ID NO: 7003129 - DNA, 18 bp, Homo sapiens
ttactttgtatagcctag

SEQ ID NO: 7003130 - DNA, 22 bp, Homo sapiens
agtggcatctaagttttagaaa

SEQ ID NO: 7003131 - DNA, 22 bp, Homo sapiens
caccagcttgcagtcttaaccc

SEQ ID NO: 7003132 - DNA, 22 bp, Homo sapiens
ctcatttatgtaatgattaagg

SEQ ID NO: 7003133 - DNA, 22 bp, Homo sapiens
tcagtcagtgcgcaagtggtta

SEQ ID NO: 7003134 - DNA, 22 bp, Homo sapiens
ttgtttccatgcatgcatttat

SEQ ID NO: 7003135 - DNA, 22 bp, Homo sapiens
gaggaaatggttgttcaggtgg

SEQ ID NO: 7003136 - DNA, 22 bp, Homo sapiens
tctgacaggtgttcttccaggc

SEQ ID NO: 7003137 - DNA, 22 bp, Homo sapiens
ctgggagtgaaaggagggctgc

SEQ ID NO: 7003138 - DNA, 22 bp, Homo sapiens
gaccctgccatgagtgacaggg

SEQ ID NO: 7003139 - DNA, 22 bp, Homo sapiens
tctgctgtacttttggtctgtt

SEQ ID NO: 7003140 - DNA, 22 bp, Homo sapiens
tccagcttgcctggtcttttgg

SEQ ID NO: 7003141 - DNA, 22 bp, Homo sapiens
acaccatgatgagtgatgtagc

SEQ ID NO: 7003142 - DNA, 22 bp, Homo sapiens
gggctgaggaacatattttgtt

SEQ ID NO: 7003143 - DNA, 22 bp, Homo sapiens
agtgcatatatgaagagtatga

SEQ ID NO: 7003144 - DNA, 22 bp, Homo sapiens
gttgcagcatcactgctgagtg

SEQ ID NO: 7003145 - DNA, 22 bp, Homo sapiens
gcctgggaaatggtggggtcag

SEQ ID NO: 7003146 - DNA, 22 bp, Homo sapiens
agattgcaattccttacatgca

SEQ ID NO: 7003147 - DNA, 22 bp, Homo sapiens
agttatttcagtaacataatag

SEQ ID NO: 7003148 - DNA, 22 bp, Homo sapiens
aatgcatacgtgtttgtggcaa

SEQ ID NO: 7003149 - DNA, 22 bp, Homo sapiens
gaaatcattatatggtattgct

SEQ ID NO: 7003150 - DNA, 22 bp, Homo sapiens
tgtaaatggtcagataaaccta

SEQ ID NO: 7003151 - DNA, 22 bp, Homo sapiens
cacaggggcaaactgtagggga

SEQ ID NO: 7003152 - DNA, 22 bp, Homo sapiens
atctaaaaggagctctttatct

SEQ ID NO: 7003153 - DNA, 22 bp, Homo sapiens
tctagagctggagtagaatgtg

SEQ ID NO: 7003154 - DNA, 22 bp, Homo sapiens
tctcctgggtgctttatcagaa

SEQ ID NO: 7003155 - DNA, 23 bp, Homo sapiens
tggataaaatacttacattcaac

SEQ ID NO: 7003156 - DNA, 22 bp, Homo sapiens
tccttgtaaaggagctctaaca

SEQ ID NO: 7003157 - DNA, 22 bp, Homo sapiens
ccctccagctcaaagcaaccgg

SEQ ID NO: 7003158 - DNA, 22 bp, Homo sapiens
tatagtgtgtgagagagtgaaa

SEQ ID NO: 7003159 - DNA, 22 bp, Homo sapiens
ccaagcctagtcgtgcacacag

SEQ ID NO: 7003160 - DNA, 22 bp, Homo sapiens
tttccctctgtgccagcttctc

SEQ ID NO: 7003161 - DNA, 22 bp, Homo sapiens
ttccagtgatgggcaatttggt

SEQ ID NO: 7003162 - DNA, 22 bp, Homo sapiens
gctctgctgatccgcagccatc

SEQ ID NO: 7003163 - DNA, 19 bp, Homo sapiens
agcagcaactgttgattca

SEQ ID NO: 7003164 - DNA, 22 bp, Homo sapiens
acattgttcctgagaacttggg

SEQ ID NO: 7003165 - DNA, 22 bp, Homo sapiens
tgggagataaagcatctgttct

SEQ ID NO: 7003166 - DNA, 22 bp, Homo sapiens
tgaaggggttcagcatgggggt

SEQ ID NO: 7003167 - DNA, 22 bp, Homo sapiens
gacactctcctccagtggatag

SEQ ID NO: 7003168 - DNA, 22 bp, Homo sapiens
ccctccctgtgtgcctcatttg

SEQ ID NO: 7003169 - DNA, 22 bp, Homo sapiens
tatggctaattctttactgacc

SEQ ID NO: 7003170 - DNA, 19 bp, Homo sapiens
agtcacagggaagaggaac

SEQ ID NO: 7003171 - DNA, 22 bp, Homo sapiens
agaaccagctagtcttgctttt

SEQ ID NO: 7003172 - DNA, 22 bp, Homo sapiens
ggtcagtgtttcatctgtgaaa

SEQ ID NO: 7003173 - DNA, 22 bp, Homo sapiens
gctggctggaactagcagttgg

SEQ ID NO: 7003174 - DNA, 22 bp, Homo sapiens
atttagaaattccaaaagtatt

SEQ ID NO: 7003175 - DNA, 22 bp, Homo sapiens
gtggccctggagttgtgacact

SEQ ID NO: 7003176 - DNA, 22 bp, Homo sapiens
tagacaaactgatacttggcga

SEQ ID NO: 7003177 - DNA, 22 bp, Homo sapiens
ctctgtgtgctggtggggtcct

SEQ ID NO: 7003178 - DNA, 22 bp, Homo sapiens
ctccaccccgtgccggtgctgg

SEQ ID NO: 7003179 - DNA, 22 bp, Homo sapiens
ggcgctgtcgtgagctcgcccg

SEQ ID NO: 7003180 - DNA, 22 bp, Homo sapiens
agtgttcttgtttctaagcaaa

SEQ ID NO: 7003181 - DNA, 22 bp, Homo sapiens
gagcttagaactgtcctcgtaa

SEQ ID NO: 7003182 - DNA, 22 bp, Homo sapiens
agcagtcagtcctgaatgaagg

SEQ ID NO: 7003183 - DNA, 22 bp, Homo sapiens
tctgctgtgaaaggtgaatatt

SEQ ID NO: 7003184 - DNA, 22 bp, Homo sapiens
gtgtttatgtttgtgtagggga

SEQ ID NO: 7003185 - DNA, 22 bp, Homo sapiens
ctcccagaggtgtcattcgagc

SEQ ID NO: 7003186 - DNA, 22 bp, Homo sapiens
agatatgttactgcatcatggg

SEQ ID NO: 7003187 - DNA, 22 bp, Homo sapiens
tttagtactgtttaaaaatgga

SEQ ID NO: 7003188 - DNA, 22 bp, Homo sapiens
atgaggttttgattggcacagg

SEQ ID NO: 7003189 - DNA, 22 bp, Homo sapiens
gctgagccacccttgcttccct

SEQ ID NO: 7003190 - DNA, 22 bp, Homo sapiens
aggccttgggagcagtgtttgt

SEQ ID NO: 7003191 - DNA, 22 bp, Homo sapiens
agctatgtccctatgaattctg

SEQ ID NO: 7003192 - DNA, 22 bp, Homo sapiens
gccccagcagcaatgcggttga

SEQ ID NO: 7003193 - DNA, 22 bp, Homo sapiens
gaatactgatgctcagccccct

SEQ ID NO: 7003194 - DNA, 22 bp, Homo sapiens
tgtcttcactcaagtctcttgg

SEQ ID NO: 7003195 - DNA, 22 bp, Homo sapiens
gggaattgaggtatgctgggct

SEQ ID NO: 7003196 - DNA, 22 bp, Homo sapiens
gcagaagctgttcgaaggccgc

SEQ ID NO: 7003197 - DNA, 22 bp, Homo sapiens
atacttacttttcttcagacta

SEQ ID NO: 7003198 - DNA, 22 bp, Homo sapiens
cagacatatgttttaacagatt

SEQ ID NO: 7003199 - DNA, 19 bp, Homo sapiens
ctgggtcttattctgtgaa

SEQ ID NO: 7003200 - DNA, 22 bp, Homo sapiens
gtttatgaatgttactatagag

SEQ ID NO: 7003201 - DNA, 22 bp, Homo sapiens
tggcagggcctgctcatcatcc

SEQ ID NO: 7003202 - DNA, 22 bp, Homo sapiens
ttcttaagaaaccatcacattc

SEQ ID NO: 7003203 - DNA, 22 bp, Homo sapiens
tggtctgacttgctttggacag

SEQ ID NO: 7003204 - DNA, 22 bp, Homo sapiens
gaaaagagaacatctgaggatc

SEQ ID NO: 7003205 - DNA, 22 bp, Homo sapiens
attcagtgctgtaatacgctaa

SEQ ID NO: 7003206 - DNA, 22 bp, Homo sapiens
gcatggatgggagtggacagat

SEQ ID NO: 7003207 - DNA, 22 bp, Homo sapiens
gtcttctgttctgtgaggcttc

SEQ ID NO: 7003208 - DNA, 22 bp, Homo sapiens
tttaacagatagtttcttctgt

SEQ ID NO: 7003209 - DNA, 22 bp, Homo sapiens
tattaggtgtaccttgttaaac

SEQ ID NO: 7003210 - DNA, 22 bp, Homo sapiens
agcagccacacgcctccttctc

SEQ ID NO: 7003211 - DNA, 22 bp, Homo sapiens
atggctaatacgccactggaca

SEQ ID NO: 7003212 - DNA, 22 bp, Homo sapiens
cagcagctcctctgcggctatg

SEQ ID NO: 7003213 - DNA, 22 bp, Homo sapiens
aaggaggcctgcgagaaggggc

SEQ ID NO: 7003214 - DNA, 22 bp, Homo sapiens
tggccttgagaatgtccctagg

SEQ ID NO: 7003215 - DNA, 17 bp, Homo sapiens
gacaagacagaattcat

SEQ ID NO: 7003216 - DNA, 22 bp, Homo sapiens
tccagcttataggtagatttaa

SEQ ID NO: 7003217 - DNA, 22 bp, Homo sapiens
ctgcttgacctgttgttctcac

SEQ ID NO: 7003218 - DNA, 22 bp, Homo sapiens
tgccaggcttagagcaggggct

SEQ ID NO: 7003219 - DNA, 21 bp, Homo sapiens
cattagggcagaagcaggaag

SEQ ID NO: 7003220 - DNA, 22 bp, Homo sapiens
atggctccatagcttcgtttag

SEQ ID NO: 7003221 - DNA, 22 bp, Homo sapiens
gtcccagggatgcagacatgag

SEQ ID NO: 7003222 - DNA, 22 bp, Homo sapiens
tgtctggaggtcaggtcctggg

SEQ ID NO: 7003223 - DNA, 22 bp, Homo sapiens
cacttctgttgccttgtgcaat

SEQ ID NO: 7003224 - DNA, 22 bp, Homo sapiens
attagttgtacagttcattttg

SEQ ID NO: 7003225 - DNA, 22 bp, Homo sapiens
tggcagtgtcctactggttggt

SEQ ID NO: 7003226 - DNA, 22 bp, Homo sapiens
gagctgggcctgcgagtgctgc

SEQ ID NO: 7003227 - DNA, 22 bp, Homo sapiens
ctgcatgtgatgtggttagcta

SEQ ID NO: 7003228 - DNA, 22 bp, Homo sapiens
ttgcagatatatggagtgcatt

SEQ ID NO: 7003229 - DNA, 22 bp, Homo sapiens
cttggaggatgtgcggctgccc

SEQ ID NO: 7003230 - DNA, 22 bp, Homo sapiens
attaaattttcactaggctccc

SEQ ID NO: 7003231 - DNA, 22 bp, Homo sapiens
ggaggttctctctttgcagagc

SEQ ID NO: 7003232 - DNA, 22 bp, Homo sapiens
tcagaagtctggactgcttctc

SEQ ID NO: 7003233 - DNA, 19 bp, Homo sapiens
ttttcacatactggatcct

SEQ ID NO: 7003234 - DNA, 22 bp, Homo sapiens
ataaaatcaactggctccagtt

SEQ ID NO: 7003235 - DNA, 22 bp, Homo sapiens
ttagaaacaaaatagttatttg

SEQ ID NO: 7003236 - DNA, 22 bp, Homo sapiens
ccagagctaaacacacaggctg

SEQ ID NO: 7003237 - DNA, 21 bp, Homo sapiens
agctgctttcagctcctagag

SEQ ID NO: 7003238 - DNA, 22 bp, Homo sapiens
gaacagtaaatttatgcagcac

SEQ ID NO: 7003239 - DNA, 22 bp, Homo sapiens
gcccagtgccctagaatgcact

SEQ ID NO: 7003240 - DNA, 22 bp, Homo sapiens
tcccaaagaactgaatagtaat

SEQ ID NO: 7003241 - DNA, 22 bp, Homo sapiens
caagggctgctatcagctactg

SEQ ID NO: 7003242 - DNA, 22 bp, Homo sapiens
gagctgcactgggggtggaatg

SEQ ID NO: 7003243 - DNA, 22 bp, Homo sapiens
tcctttaacttgattattttca

SEQ ID NO: 7003244 - DNA, 22 bp, Homo sapiens
agaaacctcacagcaattctga

SEQ ID NO: 7003245 - DNA, 22 bp, Homo sapiens
agaggggcccggttctccgtct

SEQ ID NO: 7003246 - DNA, 19 bp, Homo sapiens
ccagcagctttgattctct

SEQ ID NO: 7003247 - DNA, 22 bp, Homo sapiens
tcaagcacttacagtctggtaa

SEQ ID NO: 7003248 - DNA, 22 bp, Homo sapiens
tggcatttctggccatttgtgt

SEQ ID NO: 7003249 - DNA, 22 bp, Homo sapiens
ttacacaagttctttaacctat

SEQ ID NO: 7003250 - DNA, 22 bp, Homo sapiens
ttccctggccctggcacgctct

SEQ ID NO: 7003251 - DNA, 22 bp, Homo sapiens
aacaagatcctggaaggggcca

SEQ ID NO: 7003252 - DNA, 22 bp, Homo sapiens
agaatagagaaaaaggttattt

SEQ ID NO: 7003253 - DNA, 22 bp, Homo sapiens
gtccagttgtatgtccagtgtc

SEQ ID NO: 7003254 - DNA, 22 bp, Homo sapiens
ggccctctctacatgttagacg

SEQ ID NO: 7003255 - DNA, 22 bp, Homo sapiens
atcaggattcaccccagagctg

SEQ ID NO: 7003256 - DNA, 22 bp, Homo sapiens
caaggctgagaaattctgccct

SEQ ID NO: 7003257 - DNA, 22 bp, Homo sapiens
ccacattctcatgtaatccttt

SEQ ID NO: 7003258 - DNA, 22 bp, Homo sapiens
ttctttgttgtactttcctaca

SEQ ID NO: 7003259 - DNA, 22 bp, Homo sapiens
cagtctagatgctagaaaatat

SEQ ID NO: 7003260 - DNA, 22 bp, Homo sapiens
ctgggttctatttttggcttca

SEQ ID NO: 7003261 - DNA, 22 bp, Homo sapiens
ccctgagatgtgaatttcagag

SEQ ID NO: 7003262 - DNA, 22 bp, Homo sapiens
ccccagctgcatacttgccaag

SEQ ID NO: 7003263 - DNA, 22 bp, Homo sapiens
agggcaaagccagtgactccca

SEQ ID NO: 7003264 - DNA, 22 bp, Homo sapiens
caggagcagttagaagcccact

SEQ ID NO: 7003265 - DNA, 22 bp, Homo sapiens
agaatgtgttttaacatgggaa

SEQ ID NO: 7003266 - DNA, 22 bp, Homo sapiens
tgctcagtaagtaaacagtaac

SEQ ID NO: 7003267 - DNA, 22 bp, Homo sapiens
tttccaagtgtcaggtgcaaaa

SEQ ID NO: 7003268 - DNA, 22 bp, Homo sapiens
acaggtacatacttgggatcca

SEQ ID NO: 7003269 - DNA, 22 bp, Homo sapiens
taggctgggcctgccttccagg

SEQ ID NO: 7003270 - DNA, 21 bp, Homo sapiens
tccttcagttctgcactttct

SEQ ID NO: 7003271 - DNA, 22 bp, Homo sapiens
atccttggcagctcagacctac

SEQ ID NO: 7003272 - DNA, 22 bp, Homo sapiens
ttcaggcagctgaggagaaagt

SEQ ID NO: 7003273 - DNA, 18 bp, Homo sapiens
gggctttacagagtggag

SEQ ID NO: 7003274 - DNA, 22 bp, Homo sapiens
atattctgcctcactacagttg

SEQ ID NO: 7003275 - DNA, 22 bp, Homo sapiens
aaggccatgtaggaggcatgcg

SEQ ID NO: 7003276 - DNA, 22 bp, Homo sapiens
tgtctctgtcttccagggctgt

SEQ ID NO: 7003277 - DNA, 22 bp, Homo sapiens
gtacttgaaatgtccctccatt

SEQ ID NO: 7003278 - DNA, 22 bp, Homo sapiens
tgcgtttagtttcaagacacgt

SEQ ID NO: 7003279 - DNA, 22 bp, Homo sapiens
gactatttttatctaactgggt

SEQ ID NO: 7003280 - DNA, 22 bp, Homo sapiens
ctcctcccaattgccaagtgct

SEQ ID NO: 7003281 - DNA, 22 bp, Homo sapiens
gtcctctgaaagatgaaccatg

SEQ ID NO: 7003282 - DNA, 22 bp, Homo sapiens
tgattaacgttttaggcatact

SEQ ID NO: 7003283 - DNA, 22 bp, Homo sapiens
ctaataatagaggtggcatttg

SEQ ID NO: 7003284 - DNA, 22 bp, Homo sapiens
aggctctctagaaactgtgcct

SEQ ID NO: 7003285 - DNA, 22 bp, Homo sapiens
tttcaagtaagatacatttcag

SEQ ID NO: 7003286 - DNA, 22 bp, Homo sapiens
gtgggcagcaccagggaagtgt

SEQ ID NO: 7003287 - DNA, 22 bp, Homo sapiens
gccagtgcctcgccgcgctcct

SEQ ID NO: 7003288 - DNA, 23 bp, Homo sapiens
tgttcctgtcaaattttcttccc

SEQ ID NO: 7003289 - DNA, 22 bp, Homo sapiens
ctggaacccaggcctggaagcc

SEQ ID NO: 7003290 - DNA, 22 bp, Homo sapiens
ttgcagttaaaaatcattagtt

SEQ ID NO: 7003291 - DNA, 22 bp, Homo sapiens
ggagctgcatttagggagcctt

SEQ ID NO: 7003292 - DNA, 22 bp, Homo sapiens
ggcagaagtgatgggatataac

SEQ ID NO: 7003293 - DNA, 22 bp, Homo sapiens
tactgtaggtgggtcactagta

SEQ ID NO: 7003294 - DNA, 22 bp, Homo sapiens
tgctgtggattcagagatgaaa

SEQ ID NO: 7003295 - DNA, 22 bp, Homo sapiens
tgaatgtgatgctaaacatatg

SEQ ID NO: 7003296 - DNA, 22 bp, Homo sapiens
actggcacaagaagagtcgtgg

SEQ ID NO: 7003297 - DNA, 22 bp, Homo sapiens
gggtgtgcaggtcatggcgtct

SEQ ID NO: 7003298 - DNA, 22 bp, Homo sapiens
aactccagggcattgtctcctg

SEQ ID NO: 7003299 - DNA, 20 bp, Homo sapiens
ggcaccaggctaggattgga

SEQ ID NO: 7003300 - DNA, 19 bp, Homo sapiens
agggctttgtgtgctgctc

SEQ ID NO: 7003301 - DNA, 22 bp, Homo sapiens
accctcgatatgatctgatgaa

SEQ ID NO: 7003302 - DNA, 22 bp, Homo sapiens
attagtttggtgcaaaagtaat

SEQ ID NO: 7003303 - DNA, 22 bp, Homo sapiens
ccagaccagactgacttgagcc

SEQ ID NO: 7003304 - DNA, 21 bp, Homo sapiens
tgaggcaggggtgcttttgtc

SEQ ID NO: 7003305 - DNA, 22 bp, Homo sapiens
gacatttaaattgcaggcagcc

SEQ ID NO: 7003306 - DNA, 22 bp, Homo sapiens
gccacctctttgtctctgccgc

SEQ ID NO: 7003307 - DNA, 22 bp, Homo sapiens
acatccatgttgtaatgttcct

SEQ ID NO: 7003308 - DNA, 22 bp, Homo sapiens
tctgtttattcaatttctatat

SEQ ID NO: 7003309 - DNA, 22 bp, Homo sapiens
ttttggcagccacatgcacttg

SEQ ID NO: 7003310 - DNA, 22 bp, Homo sapiens
actcttcaccgctactgaaata

SEQ ID NO: 7003311 - DNA, 22 bp, Homo sapiens
ctaatgtaaagcatttgttcag

SEQ ID NO: 7003312 - DNA, 22 bp, Homo sapiens
tgtcatctgatattacttatag

SEQ ID NO: 7003313 - DNA, 22 bp, Homo sapiens
ctgtggcacatgtggcaaggcc

SEQ ID NO: 7003314 - DNA, 22 bp, Homo sapiens
gactttggttcagggctcagag

SEQ ID NO: 7003315 - DNA, 23 bp, Homo sapiens
atgaatgaataaggcaggaaagc

SEQ ID NO: 7003316 - DNA, 23 bp, Homo sapiens
tctgtggtctcatctgaaggctc

SEQ ID NO: 7003317 - DNA, 22 bp, Homo sapiens
acaaggagaagaaattggtcat

SEQ ID NO: 7003318 - DNA, 22 bp, Homo sapiens
atctacaatgtctggctgcact

SEQ ID NO: 7003319 - DNA, 22 bp, Homo sapiens
atgaaagtgaaggtttactaag

SEQ ID NO: 7003320 - DNA, 19 bp, Homo sapiens
atgtctgggtaacagctgc

SEQ ID NO: 7003321 - DNA, 22 bp, Homo sapiens
gtcctctgatttctaggtatat

SEQ ID NO: 7003322 - DNA, 22 bp, Homo sapiens
gctggagccattggcttggcct

SEQ ID NO: 7003323 - DNA, 22 bp, Homo sapiens
tgggcctcagtttccttaggat

SEQ ID NO: 7003324 - DNA, 22 bp, Homo sapiens
tcactgaaagtaattctagtga

SEQ ID NO: 7003325 - DNA, 22 bp, Homo sapiens
ctgcagtcagcttttaagatct

SEQ ID NO: 7003326 - DNA, 22 bp, Homo sapiens
catccctgccctcatgcctata

SEQ ID NO: 7003327 - DNA, 22 bp, Homo sapiens
aaagtcatctgtcctaggctct

SEQ ID NO: 7003328 - DNA, 22 bp, Homo sapiens
tgcccatgtttctctgtatccc

SEQ ID NO: 7003329 - DNA, 22 bp, Homo sapiens
cctcaagatgcactgaacatat

SEQ ID NO: 7003330 - DNA, 22 bp, Homo sapiens
tcctctgaattcgctctgtgat

SEQ ID NO: 7003331 - DNA, 22 bp, Homo sapiens
caccctgcccactagcaatctg

SEQ ID NO: 7003332 - DNA, 22 bp, Homo sapiens
ctttcatgcacttctttagatc

SEQ ID NO: 7003333 - DNA, 22 bp, Homo sapiens
aaggctttcagctaacttgatt

SEQ ID NO: 7003334 - DNA, 22 bp, Homo sapiens
tgctcaggtgccttggctgctg

SEQ ID NO: 7003335 - DNA, 22 bp, Homo sapiens
tcctgagccctgtaggaccctg

SEQ ID NO: 7003336 - DNA, 22 bp, Homo sapiens
attctctcttctgctgcccgtg

SEQ ID NO: 7003337 - DNA, 22 bp, Homo sapiens
attgtgacaaatgtgccatact

SEQ ID NO: 7003338 - DNA, 22 bp, Homo sapiens
ttcaccgagatcagatgttaag

SEQ ID NO: 7003339 - DNA, 22 bp, Homo sapiens
agataatgattctgcatttcta

SEQ ID NO: 7003340 - DNA, 22 bp, Homo sapiens
cactctggccactgctaaaggc

SEQ ID NO: 7003341 - DNA, 22 bp, Homo sapiens
tttttcccaaaggcaattgcct

SEQ ID NO: 7003342 - DNA, 22 bp, Homo sapiens
acctcccctcaccaatctggtt

SEQ ID NO: 7003343 - DNA, 22 bp, Homo sapiens
ccaaaggcggaactgagtctct

SEQ ID NO: 7003344 - DNA, 22 bp, Homo sapiens
tctgcagagcctcaggagaaca

SEQ ID NO: 7003345 - DNA, 22 bp, Homo sapiens
tcagccctgaggacagaggcag

SEQ ID NO: 7003346 - DNA, 22 bp, Homo sapiens
gcctttatttacgaaagggaaa

SEQ ID NO: 7003347 - DNA, 22 bp, Homo sapiens
ggctgagggccagggctagtct

SEQ ID NO: 7003348 - DNA, 22 bp, Homo sapiens
ataacttattagattggagctg

SEQ ID NO: 7003349 - DNA, 22 bp, Homo sapiens
actggtaacaatggaagcttct

SEQ ID NO: 7003350 - DNA, 22 bp, Homo sapiens
gagaaagggaacttacagagtg

SEQ ID NO: 7003351 - DNA, 22 bp, Homo sapiens
caatgctatcatgtcagagata

SEQ ID NO: 7003352 - DNA, 22 bp, Homo sapiens
aatcaactgtttccacagggag

SEQ ID NO: 7003353 - DNA, 22 bp, Homo sapiens
ctttcccacgcagtggatgaga

SEQ ID NO: 7003354 - DNA, 22 bp, Homo sapiens
atggggagagaagggctgagct

SEQ ID NO: 7003355 - DNA, 22 bp, Homo sapiens
caggagggggtggagtttcgcc

SEQ ID NO: 7003356 - DNA, 22 bp, Homo sapiens
gcagaggacacaggagggcaag

SEQ ID NO: 7003357 - DNA, 22 bp, Homo sapiens
caatgtggtggcagatgtcagt

SEQ ID NO: 7003358 - DNA, 22 bp, Homo sapiens
ctgtcacactgatatcaggctt

SEQ ID NO: 7003359 - DNA, 22 bp, Homo sapiens
acaattcaagaagagagatgaa

SEQ ID NO: 7003360 - DNA, 22 bp, Homo sapiens
agtctgactagactctgctcac

SEQ ID NO: 7003361 - DNA, 22 bp, Homo sapiens
agagacccagactgatcattgc

SEQ ID NO: 7003362 - DNA, 22 bp, Homo sapiens
aggcgcctgcgggatccttgcc

SEQ ID NO: 7003363 - DNA, 22 bp, Homo sapiens
accttagctgttaaaactaagt

SEQ ID NO: 7003364 - DNA, 19 bp, Homo sapiens
aagcatctttgaaactggg

SEQ ID NO: 7003365 - DNA, 22 bp, Homo sapiens
agcagtgtgaaatgatttaagg

SEQ ID NO: 7003366 - DNA, 22 bp, Homo sapiens
tgcttgactctggaataaaatg

SEQ ID NO: 7003367 - DNA, 22 bp, Homo sapiens
gtgcccagttgaggccaggact

SEQ ID NO: 7003368 - DNA, 22 bp, Homo sapiens
ccattctgccatgcttcatcta

SEQ ID NO: 7003369 - DNA, 17 bp, Homo sapiens
ggattgcatatacagtg

SEQ ID NO: 7003370 - DNA, 22 bp, Homo sapiens
aagtctaaacacatatttaaaa

SEQ ID NO: 7003371 - DNA, 19 bp, Homo sapiens
tattttcgtggaggcctat

SEQ ID NO: 7003372 - DNA, 20 bp, Homo sapiens
gaagtcctgttatatccttt

SEQ ID NO: 7003373 - DNA, 22 bp, Homo sapiens
aataagattgacacaagtacct

SEQ ID NO: 7003374 - DNA, 22 bp, Homo sapiens
cacagtgagtatttagtaccta

SEQ ID NO: 7003375 - DNA, 22 bp, Homo sapiens
ttcgagtctttgtttggatagt

SEQ ID NO: 7003376 - DNA, 22 bp, Homo sapiens
tgagcaccgccgcatttccaag

SEQ ID NO: 7003377 - DNA, 22 bp, Homo sapiens
taactgcctactgtgcaaatat

SEQ ID NO: 7003378 - DNA, 22 bp, Homo sapiens
ccatgggacctacctcctgtgc

SEQ ID NO: 7003379 - DNA, 22 bp, Homo sapiens
aaatcttcctgaaatttgttca

SEQ ID NO: 7003380 - DNA, 22 bp, Homo sapiens
tcacaagataaacatagctcca

SEQ ID NO: 7003381 - DNA, 22 bp, Homo sapiens
agacaatggaccaagcaccttc

SEQ ID NO: 7003382 - DNA, 22 bp, Homo sapiens
aaagtgtagagactttggaacc

SEQ ID NO: 7003383 - DNA, 22 bp, Homo sapiens
gaggccagaatgagctgaatgc

SEQ ID NO: 7003384 - DNA, 22 bp, Homo sapiens
tggccagtaatagcttctggtg

SEQ ID NO: 7003385 - DNA, 22 bp, Homo sapiens
cagccctgaaacaacctcctct

SEQ ID NO: 7003386 - DNA, 22 bp, Homo sapiens
ccagtccagtgccatgcatggc

SEQ ID NO: 7003387 - DNA, 22 bp, Homo sapiens
aacagcagctgaggagctgggc

SEQ ID NO: 7003388 - DNA, 22 bp, Homo sapiens
ctatccattaaagccttggaaa

SEQ ID NO: 7003389 - DNA, 22 bp, Homo sapiens
ccacccttgggttcggaggccg

SEQ ID NO: 7003390 - DNA, 22 bp, Homo sapiens
cttgggagtagaggcaggagca

SEQ ID NO: 7003391 - DNA, 22 bp, Homo sapiens
atgcaacagagaaaatattgag

SEQ ID NO: 7003392 - DNA, 22 bp, Homo sapiens
agtttttctgggaggcactgct

SEQ ID NO: 7003393 - DNA, 20 bp, Homo sapiens
ggcagcaggagtttcctctt

SEQ ID NO: 7003394 - DNA, 22 bp, Homo sapiens
ctgagaggatgctgcagtggag

SEQ ID NO: 7003395 - DNA, 22 bp, Homo sapiens
attagagattatgaattcctag

SEQ ID NO: 7003396 - DNA, 22 bp, Homo sapiens
agaatagaattctcatagaatt

SEQ ID NO: 7003397 - DNA, 22 bp, Homo sapiens
ccagccttgcaccgagccagcc

SEQ ID NO: 7003398 - DNA, 22 bp, Homo sapiens
tccccagtcccggcggtgggtg

SEQ ID NO: 7003399 - DNA, 22 bp, Homo sapiens
acaaaaccagaaaatctctacc

SEQ ID NO: 7003400 - DNA, 22 bp, Homo sapiens
tggtggcaatgtcctggagaag

SEQ ID NO: 7003401 - DNA, 22 bp, Homo sapiens
gttgaatattttaagagttttg

SEQ ID NO: 7003402 - DNA, 22 bp, Homo sapiens
tcaggacagactagactagcgt

SEQ ID NO: 7003403 - DNA, 22 bp, Homo sapiens
aagattcacagagtgaatgaaa

SEQ ID NO: 7003404 - DNA, 19 bp, Homo sapiens
atgttctatcctccaagtt

SEQ ID NO: 7003405 - DNA, 21 bp, Homo sapiens
tcaaagactggggctgtgtgc

SEQ ID NO: 7003406 - DNA, 22 bp, Homo sapiens
cctaatttgattttaaatagcc

SEQ ID NO: 7003407 - DNA, 22 bp, Homo sapiens
ctgtaaataatgacagttgact

SEQ ID NO: 7003408 - DNA, 22 bp, Homo sapiens
ttcttggcaatggtattcatcc

SEQ ID NO: 7003409 - DNA, 22 bp, Homo sapiens
tacgtttggaagatagaaacaa

SEQ ID NO: 7003410 - DNA, 22 bp, Homo sapiens
ctgacagctatttttgtagata

SEQ ID NO: 7003411 - DNA, 21 bp, Homo sapiens
gctctccagggccagcccagg

SEQ ID NO: 7003412 - DNA, 22 bp, Homo sapiens
tacgggcacgcaccacgatgcc

SEQ ID NO: 7003413 - DNA, 22 bp, Homo sapiens
gaatcccttgcattatcccttt

SEQ ID NO: 7003414 - DNA, 22 bp, Homo sapiens
agaggccaggtccagagtttgt

SEQ ID NO: 7003415 - DNA, 22 bp, Homo sapiens
ttctggaagcagtggggagtga

SEQ ID NO: 7003416 - DNA, 22 bp, Homo sapiens
ttcaaagcagagggtcaataca

SEQ ID NO: 7003417 - DNA, 23 bp, Homo sapiens
ggacactgtgcagatgctagtgc

SEQ ID NO: 7003418 - DNA, 22 bp, Homo sapiens
atttgccttgtgaattggatat

SEQ ID NO: 7003419 - DNA, 22 bp, Homo sapiens
cagcccctcacagagctgtcct

SEQ ID NO: 7003420 - DNA, 22 bp, Homo sapiens
tatcacagccttttggtgaggg

SEQ ID NO: 7003421 - DNA, 22 bp, Homo sapiens
gctaggaaaggaagaactttga

SEQ ID NO: 7003422 - DNA, 22 bp, Homo sapiens
ccacagagtcttccttctcttc

SEQ ID NO: 7003423 - DNA, 22 bp, Homo sapiens
acagcttttctgatagatcctg

SEQ ID NO: 7003424 - DNA, 22 bp, Homo sapiens
cccctaggaggcgatggtggaa

SEQ ID NO: 7003425 - DNA, 22 bp, Homo sapiens
aaacaagtcactttatcttgaa

SEQ ID NO: 7003426 - DNA, 22 bp, Homo sapiens
tcggcgctggaacgcagtagct

SEQ ID NO: 7003427 - DNA, 22 bp, Homo sapiens
ttttgcaaagtacattatcagg

SEQ ID NO: 7003428 - DNA, 22 bp, Homo sapiens
atgtgctttgctggaaatgtca

SEQ ID NO: 7003429 - DNA, 22 bp, Homo sapiens
gtctctagattgggagagagaa

SEQ ID NO: 7003430 - DNA, 22 bp, Homo sapiens
ccaggtgtgctctgcagtggat

SEQ ID NO: 7003431 - DNA, 22 bp, Homo sapiens
tgggagtgtaaattagttcaac

SEQ ID NO: 7003432 - DNA, 23 bp, Homo sapiens
ttacaacagtgtccatatttgta

SEQ ID NO: 7003433 - DNA, 22 bp, Homo sapiens
tttaccatctgccacagatatg

SEQ ID NO: 7003434 - DNA, 22 bp, Homo sapiens
ggaggggagatgtttgggctca

SEQ ID NO: 7003435 - DNA, 22 bp, Homo sapiens
tcagagatgcagtgccacctac

SEQ ID NO: 7003436 - DNA, 22 bp, Homo sapiens
tagtcagacccaagagagccat

SEQ ID NO: 7003437 - DNA, 22 bp, Homo sapiens
gctgagggctgtaacagcagag

SEQ ID NO: 7003438 - DNA, 22 bp, Homo sapiens
cctggctgtggcggtgctctca

SEQ ID NO: 7003439 - DNA, 22 bp, Homo sapiens
ctgacagtcttgccaagtttct

SEQ ID NO: 7003440 - DNA, 15 bp, Homo sapiens
ccaggcaagcaggaa

SEQ ID NO: 7003441 - DNA, 22 bp, Homo sapiens
caggtgaccctctcacctgctt

SEQ ID NO: 7003442 - DNA, 22 bp, Homo sapiens
cactgcaacctccagctctcag

SEQ ID NO: 7003443 - DNA, 22 bp, Homo sapiens
ggcacgatttttgagttgtgtc

SEQ ID NO: 7003444 - DNA, 22 bp, Homo sapiens
ctgtgtcctcccgctgcaccca

SEQ ID NO: 7003445 - DNA, 22 bp, Homo sapiens
tttgctaaaaggccattgattt

SEQ ID NO: 7003446 - DNA, 22 bp, Homo sapiens
tacagataggaggaatctgaaa

SEQ ID NO: 7003447 - DNA, 22 bp, Homo sapiens
tttagaggaggaagaaattttg

SEQ ID NO: 7003448 - DNA, 17 bp, Homo sapiens
gcaatctcagtctcctt

SEQ ID NO: 7003449 - DNA, 18 bp, Homo sapiens
ttcaagagtttctctagg

SEQ ID NO: 7003450 - DNA, 22 bp, Homo sapiens
gagagaaagcccctgcatccct

SEQ ID NO: 7003451 - DNA, 22 bp, Homo sapiens
gccatgactctccataccaaag

SEQ ID NO: 7003452 - DNA, 22 bp, Homo sapiens
gaccccatctggctgccccagg

SEQ ID NO: 7003453 - DNA, 21 bp, Homo sapiens
attcagagtaattcatcttta

SEQ ID NO: 7003454 - DNA, 22 bp, Homo sapiens
agagctctggcctattggggcc

SEQ ID NO: 7003455 - DNA, 22 bp, Homo sapiens
atcctaaactggggaaatggat

SEQ ID NO: 7003456 - DNA, 22 bp, Homo sapiens
tccgtgttccaagacagggtgg

SEQ ID NO: 7003457 - DNA, 22 bp, Homo sapiens
acaatgaccaaaatgtttccag

SEQ ID NO: 7003458 - DNA, 22 bp, Homo sapiens
ttattgtggcagaggtatggtt

SEQ ID NO: 7003459 - DNA, 22 bp, Homo sapiens
tattggtgggggcagagagaga

SEQ ID NO: 7003460 - DNA, 22 bp, Homo sapiens
gagggaagaggcctgacatttt

SEQ ID NO: 7003461 - DNA, 22 bp, Homo sapiens
gaacaggaacatattggctctc

SEQ ID NO: 7003462 - DNA, 22 bp, Homo sapiens
agtgcacagcctgctgcagaat

SEQ ID NO: 7003463 - DNA, 20 bp, Homo sapiens
tcctggccttctcgggcagt

SEQ ID NO: 7003464 - DNA, 22 bp, Homo sapiens
gtctggtaggctgtctgtgcct

SEQ ID NO: 7003465 - DNA, 22 bp, Homo sapiens
tatgtagatttctctgtttttc

SEQ ID NO: 7003466 - DNA, 22 bp, Homo sapiens
ccagcctggttcagaattggct

SEQ ID NO: 7003467 - DNA, 22 bp, Homo sapiens
ccaagtacagattcctccactg

SEQ ID NO: 7003468 - DNA, 22 bp, Homo sapiens
aaagtatatatgcactttagaa

SEQ ID NO: 7003469 - DNA, 22 bp, Homo sapiens
tgttctcttttcctgctgagcc

SEQ ID NO: 7003470 - DNA, 22 bp, Homo sapiens
tgcacattgaaatgaccagctg

SEQ ID NO: 7003471 - DNA, 22 bp, Homo sapiens
gtctctgtgtctgagagagccc

SEQ ID NO: 7003472 - DNA, 22 bp, Homo sapiens
gttccttcctatcccgagagcc

SEQ ID NO: 7003473 - DNA, 17 bp, Homo sapiens
ctggggatgtgggactc

SEQ ID NO: 7003474 - DNA, 22 bp, Homo sapiens
aggtccctgcagcagactgcca

SEQ ID NO: 7003475 - DNA, 22 bp, Homo sapiens
ttctgtatgtatgccagagcat

SEQ ID NO: 7003476 - DNA, 22 bp, Homo sapiens
gaggaaaatattcagggaggtt

SEQ ID NO: 7003477 - DNA, 21 bp, Homo sapiens
atgctgaatcttgttgtgctc

SEQ ID NO: 7003478 - DNA, 22 bp, Homo sapiens
tagacgtggccgtgttcccaat

SEQ ID NO: 7003479 - DNA, 22 bp, Homo sapiens
acctgagcctagggaggttgag

SEQ ID NO: 7003480 - DNA, 22 bp, Homo sapiens
atagatacttaactgaaatctt

SEQ ID NO: 7003481 - DNA, 22 bp, Homo sapiens
tttcaaacatagatctgaatat

SEQ ID NO: 7003482 - DNA, 22 bp, Homo sapiens
agcagggtatgttagagctgta

SEQ ID NO: 7003483 - DNA, 22 bp, Homo sapiens
agtggttcttgatctgtagagt

SEQ ID NO: 7003484 - DNA, 22 bp, Homo sapiens
agtcaacaaaaatgtggagcct

SEQ ID NO: 7003485 - DNA, 22 bp, Homo sapiens
tgaagtcctaaccctctagtcc

SEQ ID NO: 7003486 - DNA, 22 bp, Homo sapiens
tacagtgcgggtgcgggcctct

SEQ ID NO: 7003487 - DNA, 22 bp, Homo sapiens
caggaaagtctgtaaaggaacc

SEQ ID NO: 7003488 - DNA, 22 bp, Homo sapiens
agcaaaataaggtaatttattg

SEQ ID NO: 7003489 - DNA, 22 bp, Homo sapiens
gcagagtgaagcatttctttct

SEQ ID NO: 7003490 - DNA, 22 bp, Homo sapiens
ttgtttccagcaaatagtccat

SEQ ID NO: 7003491 - DNA, 22 bp, Homo sapiens
cactgaaggacagtaggaaggg

SEQ ID NO: 7003492 - DNA, 22 bp, Homo sapiens
aatgttctgtgctggttctggg

SEQ ID NO: 7003493 - DNA, 22 bp, Homo sapiens
acactgagtgagaaaaggaaat

SEQ ID NO: 7003494 - DNA, 21 bp, Homo sapiens
gccttgccgtgaaagcccttt

SEQ ID NO: 7003495 - DNA, 22 bp, Homo sapiens
tttcagtcatggattcactgag

SEQ ID NO: 7003496 - DNA, 22 bp, Homo sapiens
ggaagtcctcatacctgattct

SEQ ID NO: 7003497 - DNA, 22 bp, Homo sapiens
tcttggactcaaaattgcctta

SEQ ID NO: 7003498 - DNA, 22 bp, Homo sapiens
ggcagcaactcggagagaagag

SEQ ID NO: 7003499 - DNA, 22 bp, Homo sapiens
tataagaagtgaagaagagtta

SEQ ID NO: 7003500 - DNA, 22 bp, Homo sapiens
ttcagagggttttagggtcaga

SEQ ID NO: 7003501 - DNA, 22 bp, Homo sapiens
tgccacctggacaaccttatgc

SEQ ID NO: 7003502 - DNA, 22 bp, Homo sapiens
tcaggctgtgggcactggccat

SEQ ID NO: 7003503 - DNA, 21 bp, Homo sapiens
tatttctttgactctctccct

SEQ ID NO: 7003504 - DNA, 22 bp, Homo sapiens
gccagcccattaacccctgtcc

SEQ ID NO: 7003505 - DNA, 22 bp, Homo sapiens
actgttatttcaccactactga

SEQ ID NO: 7003506 - DNA, 22 bp, Homo sapiens
cttcacaggcaagtctgttttt

SEQ ID NO: 7003507 - DNA, 22 bp, Homo sapiens
gaagccaagtcctcgagtttca

SEQ ID NO: 7003508 - DNA, 22 bp, Homo sapiens
gtggctgcagcccagcggcacg

SEQ ID NO: 7003509 - DNA, 22 bp, Homo sapiens
gagtgaatgcgtggaggttgca

SEQ ID NO: 7003510 - DNA, 22 bp, Homo sapiens
tttggccttagtccagaagaag

SEQ ID NO: 7003511 - DNA, 22 bp, Homo sapiens
agaaatgcaaattttcatagag

SEQ ID NO: 7003512 - DNA, 22 bp, Homo sapiens
ccatttgttgagaacgtgcctt

SEQ ID NO: 7003513 - DNA, 22 bp, Homo sapiens
gtggcctggcgagctggcgcgg

SEQ ID NO: 7003514 - DNA, 20 bp, Homo sapiens
tctaaacagttggcatgggg

SEQ ID NO: 7003515 - DNA, 18 bp, Homo sapiens
tgttactgagttatgttc

SEQ ID NO: 7003516 - DNA, 19 bp, Homo sapiens
aaattctgacagtctttta

SEQ ID NO: 7003517 - DNA, 22 bp, Homo sapiens
gtcccattgctcattagctttc

SEQ ID NO: 7003518 - DNA, 22 bp, Homo sapiens
gctggctcgggaagcaggggat

SEQ ID NO: 7003519 - DNA, 22 bp, Homo sapiens
gggagccagccatccagaacct

SEQ ID NO: 7003520 - DNA, 22 bp, Homo sapiens
tctcattggaaaagagtttaat

SEQ ID NO: 7003521 - DNA, 22 bp, Homo sapiens
ccggggacttaaagtgaaggaa

SEQ ID NO: 7003522 - DNA, 22 bp, Homo sapiens
ttttgctggggtggctagctta

SEQ ID NO: 7003523 - DNA, 22 bp, Homo sapiens
tagtaatcagaggtaaacttta

SEQ ID NO: 7003524 - DNA, 22 bp, Homo sapiens
taactgctcagtgagtattttt

SEQ ID NO: 7003525 - DNA, 22 bp, Homo sapiens
gaggcaggaggattgcttgagc

SEQ ID NO: 7003526 - DNA, 22 bp, Homo sapiens
tgggcagtgtgtaatgcataga

SEQ ID NO: 7003527 - DNA, 22 bp, Homo sapiens
atctggaagtaggagagtgggc

SEQ ID NO: 7003528 - DNA, 22 bp, Homo sapiens
gatgattttagttgactaaact

SEQ ID NO: 7003529 - DNA, 22 bp, Homo sapiens
catcttgtgaggaccttcttgc

SEQ ID NO: 7003530 - DNA, 22 bp, Homo sapiens
tggagaatggaatgttgtgcag

SEQ ID NO: 7003531 - DNA, 20 bp, Homo sapiens
gattccagttctatccactt

SEQ ID NO: 7003532 - DNA, 22 bp, Homo sapiens
gacaggtaccggtcagactacg

SEQ ID NO: 7003533 - DNA, 22 bp, Homo sapiens
ggtccaggatcaaggcatcacc

SEQ ID NO: 7003534 - DNA, 22 bp, Homo sapiens
ttaaacagtcccagaggctgac

SEQ ID NO: 7003535 - DNA, 22 bp, Homo sapiens
tttgtttagaaagagattggtg

SEQ ID NO: 7003536 - DNA, 22 bp, Homo sapiens
aatgtttcgtaaattgtctatg

SEQ ID NO: 7003537 - DNA, 22 bp, Homo sapiens
tccaggctccctcaggatgcac

SEQ ID NO: 7003538 - DNA, 22 bp, Homo sapiens
ggtgtcctcatgattttctaga

SEQ ID NO: 7003539 - DNA, 22 bp, Homo sapiens
tcaggatgttaatatagcatta

SEQ ID NO: 7003540 - DNA, 22 bp, Homo sapiens
gcagctttgtcacggagtgtcg

SEQ ID NO: 7003541 - DNA, 22 bp, Homo sapiens
acaggctctcagccagttggca

SEQ ID NO: 7003542 - DNA, 22 bp, Homo sapiens
attcagttagatcatcctaatt

SEQ ID NO: 7003543 - DNA, 22 bp, Homo sapiens
gtaaactgtctactctgtgcta

SEQ ID NO: 7003544 - DNA, 22 bp, Homo sapiens
agccaatctggggagacgggag

SEQ ID NO: 7003545 - DNA, 22 bp, Homo sapiens
tgtctcctgggccctggccctg

SEQ ID NO: 7003546 - DNA, 22 bp, Homo sapiens
gcaggtctatcaggctgcaggt

SEQ ID NO: 7003547 - DNA, 22 bp, Homo sapiens
tggcctgatacttccagagttc

SEQ ID NO: 7003548 - DNA, 21 bp, Homo sapiens
cctgaggtttctggcctctgt

SEQ ID NO: 7003549 - DNA, 22 bp, Homo sapiens
tttgggaaagtgtcttttgtat

SEQ ID NO: 7003550 - DNA, 22 bp, Homo sapiens
attttgtgaaccctcaagcaat

SEQ ID NO: 7003551 - DNA, 19 bp, Homo sapiens
gcagcagcatttggtaata

SEQ ID NO: 7003552 - DNA, 22 bp, Homo sapiens
tatgagtacaaggactctgtct

SEQ ID NO: 7003553 - DNA, 22 bp, Homo sapiens
ctgctgaatgtctctttggttt

SEQ ID NO: 7003554 - DNA, 22 bp, Homo sapiens
gcattctttgaatgcttctaat

SEQ ID NO: 7003555 - DNA, 22 bp, Homo sapiens
gtgggctttggcctctttctcc

SEQ ID NO: 7003556 - DNA, 21 bp, Homo sapiens
ttctgctaagaaaacattatt

SEQ ID NO: 7003557 - DNA, 22 bp, Homo sapiens
agaattcttggtggttagaata

SEQ ID NO: 7003558 - DNA, 22 bp, Homo sapiens
ccagtgtgttccctgcctcact

SEQ ID NO: 7003559 - DNA, 22 bp, Homo sapiens
gctggcaggagcctttcccttt

SEQ ID NO: 7003560 - DNA, 22 bp, Homo sapiens
gtagtgcgcatggcctgtttgt

SEQ ID NO: 7003561 - DNA, 22 bp, Homo sapiens
tccacagcttttaaatgtctag

SEQ ID NO: 7003562 - DNA, 22 bp, Homo sapiens
gtcagattaatagcaataataa

SEQ ID NO: 7003563 - DNA, 22 bp, Homo sapiens
gtctaaacacagccttttctgt

SEQ ID NO: 7003564 - DNA, 22 bp, Homo sapiens
ttgggctcaggagtttgagacc

SEQ ID NO: 7003565 - DNA, 22 bp, Homo sapiens
cagcccaggctcagatgttggg

SEQ ID NO: 7003566 - DNA, 22 bp, Homo sapiens
accaattttagagcaccaagaa

SEQ ID NO: 7003567 - DNA, 22 bp, Homo sapiens
aaattgagacttttttcctcca

SEQ ID NO: 7003568 - DNA, 22 bp, Homo sapiens
cagtgagtaagtagacagctta

SEQ ID NO: 7003569 - DNA, 22 bp, Homo sapiens
acagtcattagatacaatgtct

SEQ ID NO: 7003570 - DNA, 22 bp, Homo sapiens
ggcttcccaaggagccaggatg

SEQ ID NO: 7003571 - DNA, 22 bp, Homo sapiens
gggacctggacatgtgtgtgct

SEQ ID NO: 7003572 - DNA, 22 bp, Homo sapiens
acaggcttttacggatatcttt

SEQ ID NO: 7003573 - DNA, 22 bp, Homo sapiens
tgtttacttaaatgttttcata

SEQ ID NO: 7003574 - DNA, 22 bp, Homo sapiens
aattcagaaaaattcactccta

SEQ ID NO: 7003575 - DNA, 22 bp, Homo sapiens
cactgtccatgcttgctaaccc

SEQ ID NO: 7003576 - DNA, 22 bp, Homo sapiens
aaagtcttcacggcactagtgt

SEQ ID NO: 7003577 - DNA, 22 bp, Homo sapiens
tcaactagttcaggctttagat

SEQ ID NO: 7003578 - DNA, 22 bp, Homo sapiens
aagccctgacctgagagtccgt

SEQ ID NO: 7003579 - DNA, 17 bp, Homo sapiens
tcaaatcctctgtctgg

SEQ ID NO: 7003580 - DNA, 22 bp, Homo sapiens
acagtagtctcaggaataggca

SEQ ID NO: 7003581 - DNA, 22 bp, Homo sapiens
gctgcagcaagccctccagggg

SEQ ID NO: 7003582 - DNA, 22 bp, Homo sapiens
actttggtttccctgttcgtaa

SEQ ID NO: 7003583 - DNA, 22 bp, Homo sapiens
attgttaactatagcatctggt

SEQ ID NO: 7003584 - DNA, 22 bp, Homo sapiens
catttgttggttgctgtcttat

SEQ ID NO: 7003585 - DNA, 22 bp, Homo sapiens
tggaacaactccctcggagcct

SEQ ID NO: 7003586 - DNA, 22 bp, Homo sapiens
ttgctgctctgccggtacagct

SEQ ID NO: 7003587 - DNA, 22 bp, Homo sapiens
gcagcctgatgatctgggttgt

SEQ ID NO: 7003588 - DNA, 22 bp, Homo sapiens
ttgcaaagaattttacattcta

SEQ ID NO: 7003589 - DNA, 21 bp, Homo sapiens
atatgaactgtggactttgga

SEQ ID NO: 7003590 - DNA, 22 bp, Homo sapiens
tcaaggagacagaaagcaatgg

SEQ ID NO: 7003591 - DNA, 22 bp, Homo sapiens
gacttctccagactgcctggta

SEQ ID NO: 7003592 - DNA, 22 bp, Homo sapiens
taaatgataataatgctagtgt

SEQ ID NO: 7003593 - DNA, 20 bp, Homo sapiens
atgattttgcactaacttca

SEQ ID NO: 7003594 - DNA, 18 bp, Homo sapiens
ctgggcctttgtattttt

SEQ ID NO: 7003595 - DNA, 22 bp, Homo sapiens
ggctggcgggtgggtgaaagac

SEQ ID NO: 7003596 - DNA, 22 bp, Homo sapiens
cagagctgctcatggtggccag

SEQ ID NO: 7003597 - DNA, 22 bp, Homo sapiens
gtatgcttattccttgttgtga

SEQ ID NO: 7003598 - DNA, 22 bp, Homo sapiens
ccatagatgagacaaagtagag

SEQ ID NO: 7003599 - DNA, 22 bp, Homo sapiens
tccagaaatgcaagccaggtgt

SEQ ID NO: 7003600 - DNA, 22 bp, Homo sapiens
tcccagaaacgcatatgttcat

SEQ ID NO: 7003601 - DNA, 22 bp, Homo sapiens
cccaggaacagggctcagaccc

SEQ ID NO: 7003602 - DNA, 22 bp, Homo sapiens
ctgtcatggtcagattgtcatc

SEQ ID NO: 7003603 - DNA, 22 bp, Homo sapiens
tgggtaggtgctggggattcag

SEQ ID NO: 7003604 - DNA, 22 bp, Homo sapiens
agaggcaggaggttgacttgag

SEQ ID NO: 7003605 - DNA, 21 bp, Homo sapiens
tgctcacagatgtgctcagtg

SEQ ID NO: 7003606 - DNA, 22 bp, Homo sapiens
tagcaccttgacttcaggattt

SEQ ID NO: 7003607 - DNA, 22 bp, Homo sapiens
gacagcagatactttcattgaa

SEQ ID NO: 7003608 - DNA, 22 bp, Homo sapiens
aggttcaggcacttgcccaaca

SEQ ID NO: 7003609 - DNA, 22 bp, Homo sapiens
tgaacttacaaattaaaagact

SEQ ID NO: 7003610 - DNA, 22 bp, Homo sapiens
ctcttctttagtccagaccatc

SEQ ID NO: 7003611 - DNA, 22 bp, Homo sapiens
gggcctgctccccatcgctgct

SEQ ID NO: 7003612 - DNA, 22 bp, Homo sapiens
tccgggtgcccacgtgccccta

SEQ ID NO: 7003613 - DNA, 22 bp, Homo sapiens
aaggaaacagaggatgaccttg

SEQ ID NO: 7003614 - DNA, 22 bp, Homo sapiens
atggttattgacctgttgtgct

SEQ ID NO: 7003615 - DNA, 22 bp, Homo sapiens
cagggcaaagagagcacatgct

SEQ ID NO: 7003616 - DNA, 22 bp, Homo sapiens
cctctgaggtcatggacttggc

SEQ ID NO: 7003617 - DNA, 22 bp, Homo sapiens
gcccaggagtttgcattttaac

SEQ ID NO: 7003618 - DNA, 22 bp, Homo sapiens
ggtgagactttagaagagccag

SEQ ID NO: 7003619 - DNA, 22 bp, Homo sapiens
agtaataatagtagccggcatt

SEQ ID NO: 7003620 - DNA, 22 bp, Homo sapiens
aagaggaggatgctttacagct

SEQ ID NO: 7003621 - DNA, 22 bp, Homo sapiens
cttacactttccgaaagcttgt

SEQ ID NO: 7003622 - DNA, 22 bp, Homo sapiens
acacacttcacccttgagctaa

SEQ ID NO: 7003623 - DNA, 22 bp, Homo sapiens
atcgcatttgagcaatcttttc

SEQ ID NO: 7003624 - DNA, 22 bp, Homo sapiens
aggatcttgctgtagaggatag

SEQ ID NO: 7003625 - DNA, 22 bp, Homo sapiens
ggtaatggatcgtagccataga

SEQ ID NO: 7003626 - DNA, 22 bp, Homo sapiens
aaacttgtgtatgtatatgcaa

SEQ ID NO: 7003627 - DNA, 22 bp, Homo sapiens
gaaggctacttctcctcagggc

SEQ ID NO: 7003628 - DNA, 22 bp, Homo sapiens
aaagagctgagacctggtggag

SEQ ID NO: 7003629 - DNA, 22 bp, Homo sapiens
ttcaagtcaaggaaagaggtct

SEQ ID NO: 7003630 - DNA, 22 bp, Homo sapiens
aagtgaggtttctgctttcaga

SEQ ID NO: 7003631 - DNA, 22 bp, Homo sapiens
gttgatttagtgagtgagcagt

SEQ ID NO: 7003632 - DNA, 22 bp, Homo sapiens
cctctctctgcatctggagggc

SEQ ID NO: 7003633 - DNA, 22 bp, Homo sapiens
atctgccaatgccatgagaaga

SEQ ID NO: 7003634 - DNA, 22 bp, Homo sapiens
accctgttatggtgtaacattt

SEQ ID NO: 7003635 - DNA, 22 bp, Homo sapiens
ttaccaaatgaaatagagattt

SEQ ID NO: 7003636 - DNA, 22 bp, Homo sapiens
ttctcagtatgtgacgaggacc

SEQ ID NO: 7003637 - DNA, 22 bp, Homo sapiens
tctgacccagatggcaccgtgg

SEQ ID NO: 7003638 - DNA, 22 bp, Homo sapiens
ctctcatgagcattcctaaggg

SEQ ID NO: 7003639 - DNA, 22 bp, Homo sapiens
ggagctagcctgtctctgttta

SEQ ID NO: 7003640 - DNA, 22 bp, Homo sapiens
gccaggcagcaggaagccagtg

SEQ ID NO: 7003641 - DNA, 22 bp, Homo sapiens
catgtacagtttttctgtcctg

SEQ ID NO: 7003642 - DNA, 20 bp, Homo sapiens
ggccgaaataatagtggctt

SEQ ID NO: 7003643 - DNA, 22 bp, Homo sapiens
atttcacattaatttgatgctc

SEQ ID NO: 7003644 - DNA, 22 bp, Homo sapiens
ttccaccaggagatatttcaaa

SEQ ID NO: 7003645 - DNA, 22 bp, Homo sapiens
tgcccccttttcttgttacact

SEQ ID NO: 7003646 - DNA, 22 bp, Homo sapiens
ctttgattcagactttgtcggc

SEQ ID NO: 7003647 - DNA, 18 bp, Homo sapiens
gccaccctcctcgtctcc

SEQ ID NO: 7003648 - DNA, 19 bp, Homo sapiens
aggctctgtaggagagggc

SEQ ID NO: 7003649 - DNA, 22 bp, Homo sapiens
aggccgtctgcaggcctgcagg

SEQ ID NO: 7003650 - DNA, 22 bp, Homo sapiens
agtgctgaggccatactccata

SEQ ID NO: 7003651 - DNA, 18 bp, Homo sapiens
cagtttttatatctggca

SEQ ID NO: 7003652 - DNA, 22 bp, Homo sapiens
attttgacagaagaggccctaa

SEQ ID NO: 7003653 - DNA, 22 bp, Homo sapiens
atgcatgttactgcccccgtct

SEQ ID NO: 7003654 - DNA, 22 bp, Homo sapiens
aaaaatcacttttataggcagc

SEQ ID NO: 7003655 - DNA, 22 bp, Homo sapiens
gactgaggcctttattgagaca

SEQ ID NO: 7003656 - DNA, 22 bp, Homo sapiens
ccagcactgctctcagactgag

SEQ ID NO: 7003657 - DNA, 22 bp, Homo sapiens
ggtgcccgccggcaaccctcgg

SEQ ID NO: 7003658 - DNA, 22 bp, Homo sapiens
gaccagctacttgtacagttca

SEQ ID NO: 7003659 - DNA, 22 bp, Homo sapiens
gccctgcaccccaatggcatga

SEQ ID NO: 7003660 - DNA, 22 bp, Homo sapiens
gaactgtcattggggacatcag

SEQ ID NO: 7003661 - DNA, 20 bp, Homo sapiens
gaaattctcgtattagttta

SEQ ID NO: 7003662 - DNA, 22 bp, Homo sapiens
gcagctgctggagggaggcagg

SEQ ID NO: 7003663 - DNA, 22 bp, Homo sapiens
tgctagaatttgcagaagcata

SEQ ID NO: 7003664 - DNA, 22 bp, Homo sapiens
ttatgtatggatggctgaaagt

SEQ ID NO: 7003665 - DNA, 22 bp, Homo sapiens
atttcagtgagaaagcaatcaa

SEQ ID NO: 7003666 - DNA, 22 bp, Homo sapiens
gcttagaaagtgattgatacat

SEQ ID NO: 7003667 - DNA, 22 bp, Homo sapiens
tgctcccagggactctggctgg

SEQ ID NO: 7003668 - DNA, 22 bp, Homo sapiens
attcacaaagaagggaagtaca

SEQ ID NO: 7003669 - DNA, 22 bp, Homo sapiens
tacactattttactgatacaaa

SEQ ID NO: 7003670 - DNA, 22 bp, Homo sapiens
gagttataacctagtttaactg

SEQ ID NO: 7003671 - DNA, 22 bp, Homo sapiens
cagcatctaatcttcatgccgg

SEQ ID NO: 7003672 - DNA, 22 bp, Homo sapiens
aacatatcatttaaccctcacc

SEQ ID NO: 7003673 - DNA, 22 bp, Homo sapiens
ctagcacttagggattgttatg

SEQ ID NO: 7003674 - DNA, 22 bp, Homo sapiens
gcattcttcactaggtgagagc

SEQ ID NO: 7003675 - DNA, 22 bp, Homo sapiens
ggccccaggacctccacggtcc

SEQ ID NO: 7003676 - DNA, 22 bp, Homo sapiens
tcagagccctgctcctccccaa

SEQ ID NO: 7003677 - DNA, 22 bp, Homo sapiens
ttgggacagaaaaggagaagat

SEQ ID NO: 7003678 - DNA, 22 bp, Homo sapiens
tgtgtctctcctggaagcacgt

SEQ ID NO: 7003679 - DNA, 22 bp, Homo sapiens
aggagggtggcctcatgtgagt

SEQ ID NO: 7003680 - DNA, 22 bp, Homo sapiens
gtcacaggaagcagcaggcact

SEQ ID NO: 7003681 - DNA, 22 bp, Homo sapiens
gtctgggctcctggcaggcagc

SEQ ID NO: 7003682 - DNA, 22 bp, Homo sapiens
ccctggaacccatggccagtgt

SEQ ID NO: 7003683 - DNA, 22 bp, Homo sapiens
ttgtagcagggatcagaataca

SEQ ID NO: 7003684 - DNA, 18 bp, Homo sapiens
aatcaagagctggctgta

SEQ ID NO: 7003685 - DNA, 22 bp, Homo sapiens
aaattgtggcgtctgtaagagt

SEQ ID NO: 7003686 - DNA, 22 bp, Homo sapiens
cacacagtggagtattactcag

SEQ ID NO: 7003687 - DNA, 22 bp, Homo sapiens
ttaggctgttcttgtgttgtta

SEQ ID NO: 7003688 - DNA, 22 bp, Homo sapiens
atgagcaaggctttgtgatagt

SEQ ID NO: 7003689 - DNA, 22 bp, Homo sapiens
tggcagatgtatatcacagctt

SEQ ID NO: 7003690 - DNA, 22 bp, Homo sapiens
atgctttaaatgtcttttgctt

SEQ ID NO: 7003691 - DNA, 22 bp, Homo sapiens
tggccttaattatgtaatttat

SEQ ID NO: 7003692 - DNA, 22 bp, Homo sapiens
ttttatgtgtcaaagcagtggt

SEQ ID NO: 7003693 - DNA, 22 bp, Homo sapiens
gaaatgaaatagcaccaaggtt

SEQ ID NO: 7003694 - DNA, 22 bp, Homo sapiens
agtatgtggcacagaatttctt

SEQ ID NO: 7003695 - DNA, 22 bp, Homo sapiens
tttgaagtacctggttctgact

SEQ ID NO: 7003696 - DNA, 22 bp, Homo sapiens
agaggcaaggcaggattcttct

SEQ ID NO: 7003697 - DNA, 17 bp, Homo sapiens
ggaagcccttctgcctg

SEQ ID NO: 7003698 - DNA, 22 bp, Homo sapiens
tgtcagctggagatggcatggg

SEQ ID NO: 7003699 - DNA, 22 bp, Homo sapiens
cctgctggctctgttgctcggc

SEQ ID NO: 7003700 - DNA, 22 bp, Homo sapiens
aaggtctgttctaggtgagggt

SEQ ID NO: 7003701 - DNA, 22 bp, Homo sapiens
acttatgaggagaaaatatata

SEQ ID NO: 7003702 - DNA, 22 bp, Homo sapiens
tcatctgaccactttatctctc

SEQ ID NO: 7003703 - DNA, 22 bp, Homo sapiens
tattagctcatgatttcggtgg

SEQ ID NO: 7003704 - DNA, 22 bp, Homo sapiens
gtttgcttttttgaatcaggag

SEQ ID NO: 7003705 - DNA, 22 bp, Homo sapiens
aaatgaactcaatgatctccca

SEQ ID NO: 7003706 - DNA, 22 bp, Homo sapiens
tatagcatctaggatgattgca

SEQ ID NO: 7003707 - DNA, 22 bp, Homo sapiens
tccacgtgacctttgtggtgga

SEQ ID NO: 7003708 - DNA, 22 bp, Homo sapiens
tctgagacccatacaggcccac

SEQ ID NO: 7003709 - DNA, 22 bp, Homo sapiens
taaaggcacggagttgttatgg

SEQ ID NO: 7003710 - DNA, 22 bp, Homo sapiens
gggcagtgacaaaggggatgaa

SEQ ID NO: 7003711 - DNA, 22 bp, Homo sapiens
aagtgtgttctctgataaactc

SEQ ID NO: 7003712 - DNA, 22 bp, Homo sapiens
agaaagccaatctgtaaagtct

SEQ ID NO: 7003713 - DNA, 22 bp, Homo sapiens
tagccgcttaattatttggtga

SEQ ID NO: 7003714 - DNA, 22 bp, Homo sapiens
agtcaataaaagctttagattc

SEQ ID NO: 7003715 - DNA, 22 bp, Homo sapiens
ttgattcatggacaggccaggt

SEQ ID NO: 7003716 - DNA, 22 bp, Homo sapiens
gcagaggactcaatcaaggtat

SEQ ID NO: 7003717 - DNA, 22 bp, Homo sapiens
actgcccttgtcctggcacacc

SEQ ID NO: 7003718 - DNA, 17 bp, Homo sapiens
ggcagagctgacagggc

SEQ ID NO: 7003719 - DNA, 22 bp, Homo sapiens
acttctaagctcaaattggtat

SEQ ID NO: 7003720 - DNA, 21 bp, Homo sapiens
tgaatgaggaggatggcattt

SEQ ID NO: 7003721 - DNA, 22 bp, Homo sapiens
ctctaagtgtcaaacagatatg

SEQ ID NO: 7003722 - DNA, 22 bp, Homo sapiens
cgggctcagcccggcccctcgc

SEQ ID NO: 7003723 - DNA, 22 bp, Homo sapiens
caggacaacctcaggttgctgc

SEQ ID NO: 7003724 - DNA, 22 bp, Homo sapiens
cgagtgtccctaccatttccta

SEQ ID NO: 7003725 - DNA, 22 bp, Homo sapiens
cgtatttcatctcctttctgct

SEQ ID NO: 7003726 - DNA, 22 bp, Homo sapiens
accagctgaactgcagcccagg

SEQ ID NO: 7003727 - DNA, 22 bp, Homo sapiens
atacttctggtgacaaagtctt

SEQ ID NO: 7003728 - DNA, 22 bp, Homo sapiens
gtttgtaattactgcagcatgg

SEQ ID NO: 7003729 - DNA, 22 bp, Homo sapiens
atgtacagccacttcacagtta

SEQ ID NO: 7003730 - DNA, 22 bp, Homo sapiens
tctggccagcatgagacctggt

SEQ ID NO: 7003731 - DNA, 22 bp, Homo sapiens
ggcaggtggaaggtctccattc

SEQ ID NO: 7003732 - DNA, 22 bp, Homo sapiens
cactgtgggcctgtcgtgggtg

SEQ ID NO: 7003733 - DNA, 22 bp, Homo sapiens
ctcagggaggcctctgctggtt

SEQ ID NO: 7003734 - DNA, 22 bp, Homo sapiens
accctcagacagctgtggccag

SEQ ID NO: 7003735 - DNA, 22 bp, Homo sapiens
gcaatgtgcacgcccttgggga

SEQ ID NO: 7003736 - DNA, 22 bp, Homo sapiens
aaatactcatcccaggaactgg

SEQ ID NO: 7003737 - DNA, 19 bp, Homo sapiens
ataaggcagtgactttttt

SEQ ID NO: 7003738 - DNA, 22 bp, Homo sapiens
tacttgtatctttaccaatttt

SEQ ID NO: 7003739 - DNA, 22 bp, Homo sapiens
cacaggtttcaaggataagatg

SEQ ID NO: 7003740 - DNA, 22 bp, Homo sapiens
cttccttctcactagcagcgcc

SEQ ID NO: 7003741 - DNA, 18 bp, Homo sapiens
tggggtctctcaggtaag

SEQ ID NO: 7003742 - DNA, 22 bp, Homo sapiens
tagtcaagattggaataatgta

SEQ ID NO: 7003743 - DNA, 23 bp, Homo sapiens
cctgtctgtgctgggtggacaca

SEQ ID NO: 7003744 - DNA, 22 bp, Homo sapiens
caaggctataatgttgctggaa

SEQ ID NO: 7003745 - DNA, 22 bp, Homo sapiens
aggacattcatttcaaggagga

SEQ ID NO: 7003746 - DNA, 22 bp, Homo sapiens
gaaggagctaccaagactgaat

SEQ ID NO: 7003747 - DNA, 22 bp, Homo sapiens
attgctgaatctaaggcttcca

SEQ ID NO: 7003748 - DNA, 22 bp, Homo sapiens
tgaggtgaccgcagatgggaag

SEQ ID NO: 7003749 - DNA, 22 bp, Homo sapiens
atgaatcaagtgagaacagcat

SEQ ID NO: 7003750 - DNA, 21 bp, Homo sapiens
cagaggtggcctgacctctga

SEQ ID NO: 7003751 - DNA, 20 bp, Homo sapiens
ggaccaggtggggcggtggc

SEQ ID NO: 7003752 - DNA, 22 bp, Homo sapiens
atcttcatcaagttcacagtgg

SEQ ID NO: 7003753 - DNA, 22 bp, Homo sapiens
tggagcaggccggaagtggctt

SEQ ID NO: 7003754 - DNA, 22 bp, Homo sapiens
ttcagcaaaatatctcagatag

SEQ ID NO: 7003755 - DNA, 22 bp, Homo sapiens
cccagcccacggtcctgggtgg

SEQ ID NO: 7003756 - DNA, 22 bp, Homo sapiens
tttcataagggtttctagactt

SEQ ID NO: 7003757 - DNA, 22 bp, Homo sapiens
ttcacagtgagctatgtcttgt

SEQ ID NO: 7003758 - DNA, 19 bp, Homo sapiens
ctctggagggaccgccgtt

SEQ ID NO: 7003759 - DNA, 22 bp, Homo sapiens
ctccagggttccccgatccact

SEQ ID NO: 7003760 - DNA, 17 bp, Homo sapiens
ggaaaagaagagtagga

SEQ ID NO: 7003761 - DNA, 22 bp, Homo sapiens
gcaatgggcacagcccagccca

SEQ ID NO: 7003762 - DNA, 22 bp, Homo sapiens
agagctgccgagctggggccat

SEQ ID NO: 7003763 - DNA, 22 bp, Homo sapiens
aacaactgcttattgagtgact

SEQ ID NO: 7003764 - DNA, 22 bp, Homo sapiens
taagccaaaatcaggacacaga

SEQ ID NO: 7003765 - DNA, 22 bp, Homo sapiens
atctggagaaaccgccaaggga

SEQ ID NO: 7003766 - DNA, 22 bp, Homo sapiens
ccggagagtcagagcgcggccc

SEQ ID NO: 7003767 - DNA, 22 bp, Homo sapiens
attaggttgtgctttgtggaca

SEQ ID NO: 7003768 - DNA, 22 bp, Homo sapiens
tccaggctttttcatgctgtct

SEQ ID NO: 7003769 - DNA, 22 bp, Homo sapiens
acctagaactgcaggctatttt

SEQ ID NO: 7003770 - DNA, 22 bp, Homo sapiens
tttagagagcactgtagacact

SEQ ID NO: 7003771 - DNA, 22 bp, Homo sapiens
tttccctttagcctgagaatcc

SEQ ID NO: 7003772 - DNA, 22 bp, Homo sapiens
tttcattacttgttaagggtag

SEQ ID NO: 7003773 - DNA, 22 bp, Homo sapiens
caggtgttaattgttggagcaa

SEQ ID NO: 7003774 - DNA, 22 bp, Homo sapiens
acttggctagtgatgcagggtg

SEQ ID NO: 7003775 - DNA, 22 bp, Homo sapiens
tcagcctggtgattcctctgtc

SEQ ID NO: 7003776 - DNA, 22 bp, Homo sapiens
agtgcacaccttagtacaaagt

SEQ ID NO: 7003777 - DNA, 22 bp, Homo sapiens
ctgaggtgtgagccacttcccc

SEQ ID NO: 7003778 - DNA, 22 bp, Homo sapiens
ggccttaggttccctgcctcca

SEQ ID NO: 7003779 - DNA, 22 bp, Homo sapiens
ctgaagccatgtgctcactggt

SEQ ID NO: 7003780 - DNA, 22 bp, Homo sapiens
tatgtgctaagctccagatcag

SEQ ID NO: 7003781 - DNA, 22 bp, Homo sapiens
gtagtctgagcaagcagtgtgt

SEQ ID NO: 7003782 - DNA, 22 bp, Homo sapiens
atgctaaaggggtaggcctcct

SEQ ID NO: 7003783 - DNA, 22 bp, Homo sapiens
tctgaacatccagcaatgcaca

SEQ ID NO: 7003784 - DNA, 22 bp, Homo sapiens
tggctggagcattccttgtctt

SEQ ID NO: 7003785 - DNA, 22 bp, Homo sapiens
caactttatgattggtttgtca

SEQ ID NO: 7003786 - DNA, 21 bp, Homo sapiens
accctgggttctccataccct

SEQ ID NO: 7003787 - DNA, 23 bp, Homo sapiens
atctctctggtggtcacagtcag

SEQ ID NO: 7003788 - DNA, 22 bp, Homo sapiens
tcccatggtctatatagaggca

SEQ ID NO: 7003789 - DNA, 22 bp, Homo sapiens
tttgaaacaggtgattcagcta

SEQ ID NO: 7003790 - DNA, 22 bp, Homo sapiens
cggacccactcggatcccagcc

SEQ ID NO: 7003791 - DNA, 17 bp, Homo sapiens
tatgcttttcttctcca

SEQ ID NO: 7003792 - DNA, 22 bp, Homo sapiens
ttacagaaggaacactactcag

SEQ ID NO: 7003793 - DNA, 22 bp, Homo sapiens
tatgatatgcactttatcagaa

SEQ ID NO: 7003794 - DNA, 22 bp, Homo sapiens
atactctttatgacattccagc

SEQ ID NO: 7003795 - DNA, 22 bp, Homo sapiens
gtatgtatgtatatgtttaaga

SEQ ID NO: 7003796 - DNA, 23 bp, Homo sapiens
cctctctccctgtttggcaaata

SEQ ID NO: 7003797 - DNA, 22 bp, Homo sapiens
taatgtctttaagagcattggg

SEQ ID NO: 7003798 - DNA, 22 bp, Homo sapiens
ccactgagtgagcagagcaggg

SEQ ID NO: 7003799 - DNA, 19 bp, Homo sapiens
gagggctcatttgaacaat

SEQ ID NO: 7003800 - DNA, 22 bp, Homo sapiens
ggctcttccgccaccagccaca

SEQ ID NO: 7003801 - DNA, 22 bp, Homo sapiens
ctgtggaagctgacacggtggt

SEQ ID NO: 7003802 - DNA, 22 bp, Homo sapiens
tcaattaagaggctaagttact

SEQ ID NO: 7003803 - DNA, 22 bp, Homo sapiens
ctgagcttggccaggaatgaat

SEQ ID NO: 7003804 - DNA, 21 bp, Homo sapiens
gcaagtgtttctgacagtggc

SEQ ID NO: 7003805 - DNA, 22 bp, Homo sapiens
attcagttctggctgccttcct

SEQ ID NO: 7003806 - DNA, 23 bp, Homo sapiens
atgttaagtgaaataggccagga

SEQ ID NO: 7003807 - DNA, 22 bp, Homo sapiens
agctatcaccttaataaactga

SEQ ID NO: 7003808 - DNA, 22 bp, Homo sapiens
ggacatgatatttcaggaagac

SEQ ID NO: 7003809 - DNA, 22 bp, Homo sapiens
atgctggtgctagaaactggaa

SEQ ID NO: 7003810 - DNA, 22 bp, Homo sapiens
tgtggcctgggagctgaggtct

SEQ ID NO: 7003811 - DNA, 22 bp, Homo sapiens
agtcagtgtagaaagcccaggc

SEQ ID NO: 7003812 - DNA, 22 bp, Homo sapiens
acaggctgcccgctccccacct

SEQ ID NO: 7003813 - DNA, 22 bp, Homo sapiens
aatggccagcaacaggagtgaa

SEQ ID NO: 7003814 - DNA, 22 bp, Homo sapiens
aatgaattcgagtgaaggaaag

SEQ ID NO: 7003815 - DNA, 22 bp, Homo sapiens
agtgctttgaacgaaaggctga

SEQ ID NO: 7003816 - DNA, 22 bp, Homo sapiens
aatgtgtgttcggggcccagag

SEQ ID NO: 7003817 - DNA, 22 bp, Homo sapiens
attgtgtatgtatgagacagct

SEQ ID NO: 7003818 - DNA, 23 bp, Homo sapiens
tattcagcagtgggatttgttgt

SEQ ID NO: 7003819 - DNA, 22 bp, Homo sapiens
cagtgcttggggagcggagaga

SEQ ID NO: 7003820 - DNA, 22 bp, Homo sapiens
tggatggttctgggcggcagca

SEQ ID NO: 7003821 - DNA, 22 bp, Homo sapiens
agggcccagtggagagctgagc

SEQ ID NO: 7003822 - DNA, 22 bp, Homo sapiens
aagagctagattgcaaacctgg

SEQ ID NO: 7003823 - DNA, 22 bp, Homo sapiens
acttcctgggtgttgtaaggtc

SEQ ID NO: 7003824 - DNA, 17 bp, Homo sapiens
cagctgtgagagcctta

SEQ ID NO: 7003825 - DNA, 22 bp, Homo sapiens
tcatataccagagagtttatat

SEQ ID NO: 7003826 - DNA, 22 bp, Homo sapiens
atgagcagcattgctcctctta

SEQ ID NO: 7003827 - DNA, 22 bp, Homo sapiens
gaatagattagaaagagtatgt

SEQ ID NO: 7003828 - DNA, 22 bp, Homo sapiens
ttcctaagtccaccccggctct

SEQ ID NO: 7003829 - DNA, 22 bp, Homo sapiens
tgaagccatcaggaagccagca

SEQ ID NO: 7003830 - DNA, 22 bp, Homo sapiens
atgtgtattgagcacctactgc

SEQ ID NO: 7003831 - DNA, 22 bp, Homo sapiens
tgcctggccctgacagccctgg

SEQ ID NO: 7003832 - DNA, 20 bp, Homo sapiens
tgagtgctccattctgccca

SEQ ID NO: 7003833 - DNA, 22 bp, Homo sapiens
gcaattaaccagaccttgattc

SEQ ID NO: 7003834 - DNA, 22 bp, Homo sapiens
atttattatgggatttggcaca

SEQ ID NO: 7003835 - DNA, 22 bp, Homo sapiens
gcctggcagtgtaattcctgtc

SEQ ID NO: 7003836 - DNA, 20 bp, Homo sapiens
ggaccctgggttcttctgag

SEQ ID NO: 7003837 - DNA, 22 bp, Homo sapiens
cagtggagtgggactggtctga

SEQ ID NO: 7003838 - DNA, 21 bp, Homo sapiens
tacatcagttttcttggctca

SEQ ID NO: 7003839 - DNA, 22 bp, Homo sapiens
taattgtcaggttttagtatca

SEQ ID NO: 7003840 - DNA, 22 bp, Homo sapiens
gctgccttagagggagtggttc

SEQ ID NO: 7003841 - DNA, 20 bp, Homo sapiens
gtgatgcatgataacatcaa

SEQ ID NO: 7003842 - DNA, 22 bp, Homo sapiens
agacctgggtgccctgtgcttt

SEQ ID NO: 7003843 - DNA, 20 bp, Homo sapiens
tgcacagctgtgaataggat

SEQ ID NO: 7003844 - DNA, 20 bp, Homo sapiens
gggcttggaggactcgaggg

SEQ ID NO: 7003845 - DNA, 22 bp, Homo sapiens
ataatgcgaggagaaaatgaag

SEQ ID NO: 7003846 - DNA, 22 bp, Homo sapiens
aacaatgtgaagtgctgttcag

SEQ ID NO: 7003847 - DNA, 22 bp, Homo sapiens
gtgaggtgagtagtgagaagcc

SEQ ID NO: 7003848 - DNA, 22 bp, Homo sapiens
attcagtgtctactccattgcc

SEQ ID NO: 7003849 - DNA, 22 bp, Homo sapiens
aggccagaagtcaaaaactcta

SEQ ID NO: 7003850 - DNA, 22 bp, Homo sapiens
agaagctaggctagacaagtga

SEQ ID NO: 7003851 - DNA, 22 bp, Homo sapiens
tttcatgctcatggaacacagc

SEQ ID NO: 7003852 - DNA, 18 bp, Homo sapiens
cctggcttccatcttggt

SEQ ID NO: 7003853 - DNA, 22 bp, Homo sapiens
agtgtcaagtgaggagggaaag

SEQ ID NO: 7003854 - DNA, 22 bp, Homo sapiens
gtgggcaggccccaaagcaggg

SEQ ID NO: 7003855 - DNA, 22 bp, Homo sapiens
tcggtggcgcccgcgcgggacc

SEQ ID NO: 7003856 - DNA, 22 bp, Homo sapiens
tttccactcctattgcatctca

SEQ ID NO: 7003857 - DNA, 22 bp, Homo sapiens
aatgagacacgtgaagcagatg

SEQ ID NO: 7003858 - DNA, 22 bp, Homo sapiens
agcatacaccctaaactgctta

SEQ ID NO: 7003859 - DNA, 22 bp, Homo sapiens
gagagggtgcctggaagccagg

SEQ ID NO: 7003860 - DNA, 23 bp, Homo sapiens
ctgggctgtcctgaggtcacctc

SEQ ID NO: 7003861 - DNA, 22 bp, Homo sapiens
ctgtccctctcacacctcacca

SEQ ID NO: 7003862 - DNA, 22 bp, Homo sapiens
acataataaaaataacagctca

SEQ ID NO: 7003863 - DNA, 22 bp, Homo sapiens
ttctggaatatttgacacaatt

SEQ ID NO: 7003864 - DNA, 22 bp, Homo sapiens
tgatttgcatggagaataacag

SEQ ID NO: 7003865 - DNA, 22 bp, Homo sapiens
ttgaaagatatgttaatctttc

SEQ ID NO: 7003866 - DNA, 22 bp, Homo sapiens
actgagaggaaattgagactat

SEQ ID NO: 7003867 - DNA, 22 bp, Homo sapiens
cagataaaggcttactagtagt

SEQ ID NO: 7003868 - DNA, 22 bp, Homo sapiens
tgtgcgcgtgcagcggagtgtt

SEQ ID NO: 7003869 - DNA, 22 bp, Homo sapiens
cctgagctttaaaagccatgta

SEQ ID NO: 7003870 - DNA, 22 bp, Homo sapiens
tagtttaatggtcaactaatga

SEQ ID NO: 7003871 - DNA, 22 bp, Homo sapiens
atgccctggactagctatactt

SEQ ID NO: 7003872 - DNA, 22 bp, Homo sapiens
atgttcatttgacaagtagtga

SEQ ID NO: 7003873 - DNA, 22 bp, Homo sapiens
atggcagttgcccagccaatcc

SEQ ID NO: 7003874 - DNA, 22 bp, Homo sapiens
gggcatgtaggaatccatggag

SEQ ID NO: 7003875 - DNA, 22 bp, Homo sapiens
gaggagcttgaggctaggagcc

SEQ ID NO: 7003876 - DNA, 17 bp, Homo sapiens
tgtctactctgactaaa

SEQ ID NO: 7003877 - DNA, 22 bp, Homo sapiens
agggcagcattgcctttctcca

SEQ ID NO: 7003878 - DNA, 22 bp, Homo sapiens
atctgttatgaaatttggttgt

SEQ ID NO: 7003879 - DNA, 19 bp, Homo sapiens
tagtacacactctaattcc

SEQ ID NO: 7003880 - DNA, 22 bp, Homo sapiens
aaattccattatgataatttcg

SEQ ID NO: 7003881 - DNA, 22 bp, Homo sapiens
accctggtctctacttcacaga

SEQ ID NO: 7003882 - DNA, 18 bp, Homo sapiens
ggttgataacttgtgatt

SEQ ID NO: 7003883 - DNA, 22 bp, Homo sapiens
gactttgccacttgctccagct

SEQ ID NO: 7003884 - DNA, 22 bp, Homo sapiens
gccctgctgcgcagcacgcatg

SEQ ID NO: 7003885 - DNA, 22 bp, Homo sapiens
gttataaaatgcacagttgttt

SEQ ID NO: 7003886 - DNA, 22 bp, Homo sapiens
cagtgcaaactccctgaggtgg

SEQ ID NO: 7003887 - DNA, 22 bp, Homo sapiens
atctgcccatctgtcctgcttc

SEQ ID NO: 7003888 - DNA, 22 bp, Homo sapiens
tgtgtgggcatgcttttaattt

SEQ ID NO: 7003889 - DNA, 22 bp, Homo sapiens
atctccttggatcacgtttagt

SEQ ID NO: 7003890 - DNA, 22 bp, Homo sapiens
tgcaggagcaccagctcaccct

SEQ ID NO: 7003891 - DNA, 22 bp, Homo sapiens
tgtttaaatagaacatactgca

SEQ ID NO: 7003892 - DNA, 22 bp, Homo sapiens
ggtgtgctaagagcactttcaa

SEQ ID NO: 7003893 - DNA, 22 bp, Homo sapiens
gcccctctccttgtgcacctgc

SEQ ID NO: 7003894 - DNA, 22 bp, Homo sapiens
agcttgccagttgaagatcttc

SEQ ID NO: 7003895 - DNA, 22 bp, Homo sapiens
aagcacaatttaggactgaaat

SEQ ID NO: 7003896 - DNA, 17 bp, Homo sapiens
gcctgcaggcccgcaga

SEQ ID NO: 7003897 - DNA, 22 bp, Homo sapiens
taggacatgctacataaatagg

SEQ ID NO: 7003898 - DNA, 22 bp, Homo sapiens
caagggcattgcttgggacctt

SEQ ID NO: 7003899 - DNA, 22 bp, Homo sapiens
ttatactaaaacgcattgaatt

SEQ ID NO: 7003900 - DNA, 22 bp, Homo sapiens
ccctccagggagccatgctggg

SEQ ID NO: 7003901 - DNA, 22 bp, Homo sapiens
ctgcagggttcggagagttccc

SEQ ID NO: 7003902 - DNA, 22 bp, Homo sapiens
ggtgggaaggccactgaaggtt

SEQ ID NO: 7003903 - DNA, 21 bp, Homo sapiens
tccagggcgggcgcacggaga

SEQ ID NO: 7003904 - DNA, 22 bp, Homo sapiens
cggggcctagctgcacaccctc

SEQ ID NO: 7003905 - DNA, 22 bp, Homo sapiens
aattcagttgtgtctgacctcg

SEQ ID NO: 7003906 - DNA, 22 bp, Homo sapiens
tctgatatcgcactaaactctg

SEQ ID NO: 7003907 - DNA, 22 bp, Homo sapiens
tgaaataatatctggatcaatc

SEQ ID NO: 7003908 - DNA, 22 bp, Homo sapiens
cagtaaattatctcatctctgt

SEQ ID NO: 7003909 - DNA, 22 bp, Homo sapiens
tgacctttctctgggtgcttgg

SEQ ID NO: 7003910 - DNA, 19 bp, Homo sapiens
ccatggcaatgatctgatg

SEQ ID NO: 7003911 - DNA, 22 bp, Homo sapiens
atatttagctcatttccagtgc

SEQ ID NO: 7003912 - DNA, 22 bp, Homo sapiens
tgtttacagcactgcacactgc

SEQ ID NO: 7003913 - DNA, 22 bp, Homo sapiens
gaatcagactacaaatgacccc

SEQ ID NO: 7003914 - DNA, 22 bp, Homo sapiens
ctgtcctgcccaccctgcaggg

SEQ ID NO: 7003915 - DNA, 22 bp, Homo sapiens
gtactttgttaccatagctcca

SEQ ID NO: 7003916 - DNA, 22 bp, Homo sapiens
tgtggtggctattctggtctca

SEQ ID NO: 7003917 - DNA, 22 bp, Homo sapiens
tccaagggctcatggacacttt

SEQ ID NO: 7003918 - DNA, 22 bp, Homo sapiens
aggctgagcaaagggccttacc

SEQ ID NO: 7003919 - DNA, 20 bp, Homo sapiens
gaagtcctttcactcttccc

SEQ ID NO: 7003920 - DNA, 22 bp, Homo sapiens
tgcttctgtttgtttctgtcat

SEQ ID NO: 7003921 - DNA, 22 bp, Homo sapiens
cttcacaattctaacagggcaa

SEQ ID NO: 7003922 - DNA, 22 bp, Homo sapiens
agcacctccttagctatgacca

SEQ ID NO: 7003923 - DNA, 20 bp, Homo sapiens
tgggctctgcttcctggagt

SEQ ID NO: 7003924 - DNA, 22 bp, Homo sapiens
tagcttgtactgcagtagagaa

SEQ ID NO: 7003925 - DNA, 22 bp, Homo sapiens
aaatgcttgcaacatcccaggt

SEQ ID NO: 7003926 - DNA, 22 bp, Homo sapiens
agctatgaagccacttttaaca

SEQ ID NO: 7003927 - DNA, 22 bp, Homo sapiens
atattttctggaactatgcctg

SEQ ID NO: 7003928 - DNA, 22 bp, Homo sapiens
gccctgaagctgagggtgttaa

SEQ ID NO: 7003929 - DNA, 21 bp, Homo sapiens
taaagaagatgaatgtgatca

SEQ ID NO: 7003930 - DNA, 22 bp, Homo sapiens
gttgagagttaagcgggctaat

SEQ ID NO: 7003931 - DNA, 22 bp, Homo sapiens
aggagtcagatatgggaaagtt

SEQ ID NO: 7003932 - DNA, 22 bp, Homo sapiens
tggagacatttctcattaaaaa

SEQ ID NO: 7003933 - DNA, 22 bp, Homo sapiens
tgacataatgctttgaagttgc

SEQ ID NO: 7003934 - DNA, 22 bp, Homo sapiens
tggaagacattgctttcctttg

SEQ ID NO: 7003935 - DNA, 22 bp, Homo sapiens
tgtcattttaatcacctttcca

SEQ ID NO: 7003936 - DNA, 22 bp, Homo sapiens
ccctcaggagatgtcagctgga

SEQ ID NO: 7003937 - DNA, 22 bp, Homo sapiens
ctacagtgactgtgacagagca

SEQ ID NO: 7003938 - DNA, 22 bp, Homo sapiens
agagtttgtgtcctttatcagg

SEQ ID NO: 7003939 - DNA, 22 bp, Homo sapiens
tttcttgggttccagttcccag

SEQ ID NO: 7003940 - DNA, 22 bp, Homo sapiens
gttaaacattgctccacgggtt

SEQ ID NO: 7003941 - DNA, 22 bp, Homo sapiens
aggcgctgagtaggcaaggagg

SEQ ID NO: 7003942 - DNA, 22 bp, Homo sapiens
tttgcaaacattcagggctcca

SEQ ID NO: 7003943 - DNA, 22 bp, Homo sapiens
cggcttcatgagaaatgacaga

SEQ ID NO: 7003944 - DNA, 22 bp, Homo sapiens
atgtagagggtttggccaggag

SEQ ID NO: 7003945 - DNA, 22 bp, Homo sapiens
ctttggcaacacatgtgggaca

SEQ ID NO: 7003946 - DNA, 22 bp, Homo sapiens
gcctcacagactgactgaaagc

SEQ ID NO: 7003947 - DNA, 22 bp, Homo sapiens
cgtggtctcccacagaaagaag

SEQ ID NO: 7003948 - DNA, 22 bp, Homo sapiens
cgcaggctcggttcacagagca

SEQ ID NO: 7003949 - DNA, 22 bp, Homo sapiens
attctaaatgtaatttagaatt

SEQ ID NO: 7003950 - DNA, 22 bp, Homo sapiens
ttcattctgcagttctcagctc

SEQ ID NO: 7003951 - DNA, 17 bp, Homo sapiens
accacctctcaccagca

SEQ ID NO: 7003952 - DNA, 19 bp, Homo sapiens
tctctggatgacagacact

SEQ ID NO: 7003953 - DNA, 22 bp, Homo sapiens
agtttaggcaggctcctatggt

SEQ ID NO: 7003954 - DNA, 22 bp, Homo sapiens
gagggagggactagcattctct

SEQ ID NO: 7003955 - DNA, 22 bp, Homo sapiens
ggtgaagtaataccaggtgtac

SEQ ID NO: 7003956 - DNA, 22 bp, Homo sapiens
agtctgattcagagttggagaa

SEQ ID NO: 7003957 - DNA, 21 bp, Homo sapiens
cctcatcaaactttcacttgc

SEQ ID NO: 7003958 - DNA, 22 bp, Homo sapiens
cagacatccaggtacgagcttt

SEQ ID NO: 7003959 - DNA, 22 bp, Homo sapiens
tgggctctggacaaacccttgc

SEQ ID NO: 7003960 - DNA, 20 bp, Homo sapiens
aatgagatgacttagaggaa

SEQ ID NO: 7003961 - DNA, 23 bp, Homo sapiens
agtcagagagtgtgagacaactg

SEQ ID NO: 7003962 - DNA, 22 bp, Homo sapiens
tgctttattcgacatctggtag

SEQ ID NO: 7003963 - DNA, 22 bp, Homo sapiens
agcagcttcctgctcttcgcct

SEQ ID NO: 7003964 - DNA, 22 bp, Homo sapiens
acagtctttcagtaataatact

SEQ ID NO: 7003965 - DNA, 23 bp, Homo sapiens
agcagtgagtaaacagataggat

SEQ ID NO: 7003966 - DNA, 22 bp, Homo sapiens
ctacaaatataaaacacagata

SEQ ID NO: 7003967 - DNA, 22 bp, Homo sapiens
tggacagagctgacagtatata

SEQ ID NO: 7003968 - DNA, 22 bp, Homo sapiens
tcaggcgaggcttaatccaagg

SEQ ID NO: 7003969 - DNA, 22 bp, Homo sapiens
tatgagatttggattcagtgaa

SEQ ID NO: 7003970 - DNA, 22 bp, Homo sapiens
aaacagctacttctgtataatg

SEQ ID NO: 7003971 - DNA, 22 bp, Homo sapiens
atctggaggctaagtcatttgc

SEQ ID NO: 7003972 - DNA, 22 bp, Homo sapiens
ttacataggtatgtttgctttg

SEQ ID NO: 7003973 - DNA, 22 bp, Homo sapiens
aggcagcagggccactggctga

SEQ ID NO: 7003974 - DNA, 20 bp, Homo sapiens
tgtgacaaaggcatatttta

SEQ ID NO: 7003975 - DNA, 22 bp, Homo sapiens
gggatggatcttggctgaggct

SEQ ID NO: 7003976 - DNA, 21 bp, Homo sapiens
acagttctgccggcatctttc

SEQ ID NO: 7003977 - DNA, 22 bp, Homo sapiens
cagcatgttcttgtctcactgg

SEQ ID NO: 7003978 - DNA, 22 bp, Homo sapiens
ttgctgggcatgtcttaattct

SEQ ID NO: 7003979 - DNA, 23 bp, Homo sapiens
tgtgctggcatctcaggctttgg

SEQ ID NO: 7003980 - DNA, 22 bp, Homo sapiens
gctgctttgatatgcaaggaac

SEQ ID NO: 7003981 - DNA, 22 bp, Homo sapiens
cagagtgataaatatagaaatt

SEQ ID NO: 7003982 - DNA, 22 bp, Homo sapiens
agcacacagtattagccattgt

SEQ ID NO: 7003983 - DNA, 22 bp, Homo sapiens
ctcactgtgacctcagcagaca

SEQ ID NO: 7003984 - DNA, 22 bp, Homo sapiens
tgacacttgggctttgagaggt

SEQ ID NO: 7003985 - DNA, 22 bp, Homo sapiens
gacacagtttttctcacggtgg

SEQ ID NO: 7003986 - DNA, 22 bp, Homo sapiens
tgttaaacagatattgcccaca

SEQ ID NO: 7003987 - DNA, 22 bp, Homo sapiens
cctctgaggtgagcccagctgg

SEQ ID NO: 7003988 - DNA, 22 bp, Homo sapiens
agagccctgtggactgtcaagt

SEQ ID NO: 7003989 - DNA, 22 bp, Homo sapiens
cccatgattcaattgtctccat

SEQ ID NO: 7003990 - DNA, 19 bp, Homo sapiens
cagccctcttaccactgtg

SEQ ID NO: 7003991 - DNA, 22 bp, Homo sapiens
tgcagatacagtatgtggaagc

SEQ ID NO: 7003992 - DNA, 22 bp, Homo sapiens
tttcctaacacaatgcatgaga

SEQ ID NO: 7003993 - DNA, 22 bp, Homo sapiens
ttgcttgcccaagtgtcaattt

SEQ ID NO: 7003994 - DNA, 22 bp, Homo sapiens
atgtgaggtagataggatgcag

SEQ ID NO: 7003995 - DNA, 22 bp, Homo sapiens
tttgtgaacaaacatgaagatg

SEQ ID NO: 7003996 - DNA, 22 bp, Homo sapiens
ttaatgacttatatttaaagca

SEQ ID NO: 7003997 - DNA, 23 bp, Homo sapiens
ggtctggaattcgcggagttaac

SEQ ID NO: 7003998 - DNA, 22 bp, Homo sapiens
gtgggccaggacccgctgtccg

SEQ ID NO: 7003999 - DNA, 22 bp, Homo sapiens
ggcaggtgaggcatgtgcctgg

SEQ ID NO: 7004000 - DNA, 22 bp, Homo sapiens
aattgaaaatattgtagaccat

SEQ ID NO: 7004001 - DNA, 22 bp, Homo sapiens
cagccccttgtccggtagccac

SEQ ID NO: 7004002 - DNA, 22 bp, Homo sapiens
tttagttctcccagtcttgatt

SEQ ID NO: 7004003 - DNA, 19 bp, Homo sapiens
tttaaagtgactggtattt

SEQ ID NO: 7004004 - DNA, 22 bp, Homo sapiens
gcagagcccctcaagccagcct

SEQ ID NO: 7004005 - DNA, 22 bp, Homo sapiens
gaaggaggtgtcagttggactg

SEQ ID NO: 7004006 - DNA, 22 bp, Homo sapiens
atggccagtcaagcctctggct

SEQ ID NO: 7004007 - DNA, 19 bp, Homo sapiens
ttacaagcattgaaagaaa

SEQ ID NO: 7004008 - DNA, 22 bp, Homo sapiens
cctgtgaggtcttgcatgtgaa

SEQ ID NO: 7004009 - DNA, 22 bp, Homo sapiens
gggcagcatgaggaccctcatc

SEQ ID NO: 7004010 - DNA, 22 bp, Homo sapiens
ggaaaccaggactgcaccgtct

SEQ ID NO: 7004011 - DNA, 22 bp, Homo sapiens
ttgcagctgctgttcctcatgg

SEQ ID NO: 7004012 - DNA, 22 bp, Homo sapiens
agcagggctctgccatgggccc

SEQ ID NO: 7004013 - DNA, 22 bp, Homo sapiens
aggccacaggtggaagccagag

SEQ ID NO: 7004014 - DNA, 22 bp, Homo sapiens
tggctcagtagcagtgtggtca

SEQ ID NO: 7004015 - DNA, 20 bp, Homo sapiens
agttccacatggctggggag

SEQ ID NO: 7004016 - DNA, 22 bp, Homo sapiens
tggtggcgggcagggccgtcac

SEQ ID NO: 7004017 - DNA, 22 bp, Homo sapiens
ccctctcttagaagaaacacag

SEQ ID NO: 7004018 - DNA, 22 bp, Homo sapiens
catttgtagttaaaaatgtctc

SEQ ID NO: 7004019 - DNA, 22 bp, Homo sapiens
ttgttttagtaggtacactgag

SEQ ID NO: 7004020 - DNA, 22 bp, Homo sapiens
tggtttctttccactctccacc

SEQ ID NO: 7004021 - DNA, 22 bp, Homo sapiens
gaggttttaagttgaaggggga

SEQ ID NO: 7004022 - DNA, 22 bp, Homo sapiens
atttccagtgcactgaatagaa

SEQ ID NO: 7004023 - DNA, 22 bp, Homo sapiens
gggtggagagaaagaaacgtga

SEQ ID NO: 7004024 - DNA, 22 bp, Homo sapiens
ccctgccttgtctgggctaggt

SEQ ID NO: 7004025 - DNA, 22 bp, Homo sapiens
actacatttcctgacccctgtg

SEQ ID NO: 7004026 - DNA, 22 bp, Homo sapiens
atagtctttactgctgaattga

SEQ ID NO: 7004027 - DNA, 22 bp, Homo sapiens
actgttcatcctttttgaacaa

SEQ ID NO: 7004028 - DNA, 22 bp, Homo sapiens
tatttattggacagtgttgctg

SEQ ID NO: 7004029 - DNA, 22 bp, Homo sapiens
ccagtggagtttttatacccag

SEQ ID NO: 7004030 - DNA, 22 bp, Homo sapiens
agctggtggggaagctgcaggt

SEQ ID NO: 7004031 - DNA, 22 bp, Homo sapiens
tgggtcccaaactcctagaggt

SEQ ID NO: 7004032 - DNA, 22 bp, Homo sapiens
aagagagaacacagcttgggca

SEQ ID NO: 7004033 - DNA, 22 bp, Homo sapiens
ttgcatggctgtgaaaatttgg

SEQ ID NO: 7004034 - DNA, 22 bp, Homo sapiens
cagctgtggagggaggaaatgc

SEQ ID NO: 7004035 - DNA, 20 bp, Homo sapiens
agcctctgcccttcccactg

SEQ ID NO: 7004036 - DNA, 22 bp, Homo sapiens
tattccagataccttgtgtaag

SEQ ID NO: 7004037 - DNA, 22 bp, Homo sapiens
tggctcaggtgtgagctgaaga

SEQ ID NO: 7004038 - DNA, 22 bp, Homo sapiens
tggcctgggtgctgctgacatc

SEQ ID NO: 7004039 - DNA, 22 bp, Homo sapiens
gaagcccaggcttccttggctt

SEQ ID NO: 7004040 - DNA, 23 bp, Homo sapiens
atgaggtcagccataagacggaa

SEQ ID NO: 7004041 - DNA, 22 bp, Homo sapiens
ttccagagtcagccactgggag

SEQ ID NO: 7004042 - DNA, 22 bp, Homo sapiens
agtcacagttcctacccagtaa

SEQ ID NO: 7004043 - DNA, 22 bp, Homo sapiens
acagatagatgataatggcttt

SEQ ID NO: 7004044 - DNA, 22 bp, Homo sapiens
aggctaaggaccaggagggcca

SEQ ID NO: 7004045 - DNA, 18 bp, Homo sapiens
tttccaagaagagagctc

SEQ ID NO: 7004046 - DNA, 22 bp, Homo sapiens
tattcagattacttgtgcctgc

SEQ ID NO: 7004047 - DNA, 23 bp, Homo sapiens
catgaaggtagcacaaagcctct

SEQ ID NO: 7004048 - DNA, 22 bp, Homo sapiens
cctggagaggagaaagggccca

SEQ ID NO: 7004049 - DNA, 22 bp, Homo sapiens
agggtttcttgcttatggtgct

SEQ ID NO: 7004050 - DNA, 22 bp, Homo sapiens
gcagtagaaggtgctttctgga

SEQ ID NO: 7004051 - DNA, 22 bp, Homo sapiens
tctgagcttttattatcaacct

SEQ ID NO: 7004052 - DNA, 22 bp, Homo sapiens
agggccagttctacctctgaat

SEQ ID NO: 7004053 - DNA, 22 bp, Homo sapiens
cagtggattagccagagctgga

SEQ ID NO: 7004054 - DNA, 22 bp, Homo sapiens
tgagatggagtctcgctctgtt

SEQ ID NO: 7004055 - DNA, 22 bp, Homo sapiens
tctgagagtctctgaggcagat

SEQ ID NO: 7004056 - DNA, 22 bp, Homo sapiens
aactcagttacatattagaata

SEQ ID NO: 7004057 - DNA, 23 bp, Homo sapiens
gcacaagacctggcagcttccat

SEQ ID NO: 7004058 - DNA, 22 bp, Homo sapiens
ttcaggatatgtgatatctgaa

SEQ ID NO: 7004059 - DNA, 22 bp, Homo sapiens
acagctgtggtctccttagtgt

SEQ ID NO: 7004060 - DNA, 22 bp, Homo sapiens
aggaaactaattagtagaataa

SEQ ID NO: 7004061 - DNA, 22 bp, Homo sapiens
ctacatactgtgtgtaaagaat

SEQ ID NO: 7004062 - DNA, 22 bp, Homo sapiens
tggtttctcagactctttgcag

SEQ ID NO: 7004063 - DNA, 22 bp, Homo sapiens
attggtctggggaaatgaagag

SEQ ID NO: 7004064 - DNA, 22 bp, Homo sapiens
attagcttctgaagcccttgaa

SEQ ID NO: 7004065 - DNA, 22 bp, Homo sapiens
tactgaggctgggttaagcatc

SEQ ID NO: 7004066 - DNA, 18 bp, Homo sapiens
tgcaggagtgaccccggc

SEQ ID NO: 7004067 - DNA, 22 bp, Homo sapiens
ggaggccaaggcaggtggatca

SEQ ID NO: 7004068 - DNA, 22 bp, Homo sapiens
cagggtgacaagtggcaaggag

SEQ ID NO: 7004069 - DNA, 22 bp, Homo sapiens
ctggggctggtgaggcaggctc

SEQ ID NO: 7004070 - DNA, 22 bp, Homo sapiens
ggagcaggctctgtggtttcca

SEQ ID NO: 7004071 - DNA, 22 bp, Homo sapiens
gccaggctggtgtcacaactct

SEQ ID NO: 7004072 - DNA, 21 bp, Homo sapiens
ttacattcagaggagtggaag

SEQ ID NO: 7004073 - DNA, 19 bp, Homo sapiens
aggatttattatgtgctca

SEQ ID NO: 7004074 - DNA, 22 bp, Homo sapiens
aaactctgtagctaaacataat

SEQ ID NO: 7004075 - DNA, 22 bp, Homo sapiens
ttatggtagcttaatttgcctg

SEQ ID NO: 7004076 - DNA, 22 bp, Homo sapiens
aggaagggttctttctgtttat

SEQ ID NO: 7004077 - DNA, 22 bp, Homo sapiens
accagccagccacagtggctcc

SEQ ID NO: 7004078 - DNA, 22 bp, Homo sapiens
tcaaatattggctatttcacat

SEQ ID NO: 7004079 - DNA, 22 bp, Homo sapiens
agctgggaagactggaagacag

SEQ ID NO: 7004080 - DNA, 17 bp, Homo sapiens
gctttggcagtttcaag

SEQ ID NO: 7004081 - DNA, 20 bp, Homo sapiens
cttaaaacctctttttctgt

SEQ ID NO: 7004082 - DNA, 22 bp, Homo sapiens
tgtttcttacgtttttagaggc

SEQ ID NO: 7004083 - DNA, 22 bp, Homo sapiens
gctgagcccccctgcgtgggtc

SEQ ID NO: 7004084 - DNA, 22 bp, Homo sapiens
acctgtcagtgctgcaggctct

SEQ ID NO: 7004085 - DNA, 22 bp, Homo sapiens
agtctcttttgcgaagagtgtt

SEQ ID NO: 7004086 - DNA, 16 bp, Homo sapiens
acaaatacaactgctg

SEQ ID NO: 7004087 - DNA, 21 bp, Homo sapiens
atccttagcacttagaagagt

SEQ ID NO: 7004088 - DNA, 22 bp, Homo sapiens
agatattgtgcatactgctgtt

SEQ ID NO: 7004089 - DNA, 22 bp, Homo sapiens
agggatgcctcattttaagtga

SEQ ID NO: 7004090 - DNA, 19 bp, Homo sapiens
atcacagacgtgcctcatc

SEQ ID NO: 7004091 - DNA, 22 bp, Homo sapiens
attgtgactttgagctgaaagc

SEQ ID NO: 7004092 - DNA, 23 bp, Homo sapiens
gccatctggtatttcctgacttc

SEQ ID NO: 7004093 - DNA, 22 bp, Homo sapiens
tagtccacaaaaagtcttgacc

SEQ ID NO: 7004094 - DNA, 22 bp, Homo sapiens
gactctgctgactagttgacta

SEQ ID NO: 7004095 - DNA, 22 bp, Homo sapiens
caatgtatcaaccagaaagttc

SEQ ID NO: 7004096 - DNA, 22 bp, Homo sapiens
taggcacttaataaatggtata

SEQ ID NO: 7004097 - DNA, 22 bp, Homo sapiens
agatgcagaaaaactaagtgat

SEQ ID NO: 7004098 - DNA, 22 bp, Homo sapiens
aggttgaaataggttatctaag

SEQ ID NO: 7004099 - DNA, 22 bp, Homo sapiens
gctcagactctggcctgatgat

SEQ ID NO: 7004100 - DNA, 22 bp, Homo sapiens
tgaggtgatacagaccctactt

SEQ ID NO: 7004101 - DNA, 20 bp, Homo sapiens
gcctggcacccggggctggc

SEQ ID NO: 7004102 - DNA, 18 bp, Homo sapiens
tctctctgataacatttt

SEQ ID NO: 7004103 - DNA, 22 bp, Homo sapiens
atgtttttggaaatgggaacat

SEQ ID NO: 7004104 - DNA, 22 bp, Homo sapiens
ttgccattgctcagtgaacaga

SEQ ID NO: 7004105 - DNA, 19 bp, Homo sapiens
ggagaggctggagggatgc

SEQ ID NO: 7004106 - DNA, 22 bp, Homo sapiens
caaacttactgtgtttaaagag

SEQ ID NO: 7004107 - DNA, 22 bp, Homo sapiens
gggctctgatagagattattgc

SEQ ID NO: 7004108 - DNA, 22 bp, Homo sapiens
tctccagtgaatctcctcctgg

SEQ ID NO: 7004109 - DNA, 22 bp, Homo sapiens
catgacagatgcaaaggattgg

SEQ ID NO: 7004110 - DNA, 22 bp, Homo sapiens
ggtctaatgttatcactactct

SEQ ID NO: 7004111 - DNA, 22 bp, Homo sapiens
tatggcatatctgggagactct

SEQ ID NO: 7004112 - DNA, 22 bp, Homo sapiens
agtgtttcctgagtgttatcat

SEQ ID NO: 7004113 - DNA, 22 bp, Homo sapiens
tgtgacagatctctatacatga

SEQ ID NO: 7004114 - DNA, 22 bp, Homo sapiens
tgtaacagtagataaggtcttg

SEQ ID NO: 7004115 - DNA, 22 bp, Homo sapiens
ttgttaaaatgcatattctggt

SEQ ID NO: 7004116 - DNA, 22 bp, Homo sapiens
atagctttacagaagagtttag

SEQ ID NO: 7004117 - DNA, 22 bp, Homo sapiens
atgagcagtaggttcatggctg

SEQ ID NO: 7004118 - DNA, 22 bp, Homo sapiens
ggcatcggttgcttttcatatc

SEQ ID NO: 7004119 - DNA, 22 bp, Homo sapiens
tgttccaagctgctggataagc

SEQ ID NO: 7004120 - DNA, 22 bp, Homo sapiens
cagctgaattcttcagactcca

SEQ ID NO: 7004121 - DNA, 22 bp, Homo sapiens
ttaggcaatgaattattccaag

SEQ ID NO: 7004122 - DNA, 22 bp, Homo sapiens
accttcaatgaaaataatagtc

SEQ ID NO: 7004123 - DNA, 22 bp, Homo sapiens
ttccagctaactcacatccctt

SEQ ID NO: 7004124 - DNA, 22 bp, Homo sapiens
tctcatggttctaaaggtcgca

SEQ ID NO: 7004125 - DNA, 22 bp, Homo sapiens
cagggcttcactaggaaccctc

SEQ ID NO: 7004126 - DNA, 22 bp, Homo sapiens
atttgtcaaaacacagagaaca

SEQ ID NO: 7004127 - DNA, 18 bp, Homo sapiens
cccagcactttgggagcc

SEQ ID NO: 7004128 - DNA, 22 bp, Homo sapiens
ttatttgtggcatatgagacga

SEQ ID NO: 7004129 - DNA, 22 bp, Homo sapiens
atgtgtgtatatatagtcattt

SEQ ID NO: 7004130 - DNA, 22 bp, Homo sapiens
tacacagtgagtcctctctgcc

SEQ ID NO: 7004131 - DNA, 19 bp, Homo sapiens
ttgctaaatggaaaagcac

SEQ ID NO: 7004132 - DNA, 22 bp, Homo sapiens
attacagtaggattggaaagga

SEQ ID NO: 7004133 - DNA, 22 bp, Homo sapiens
ctctggctcccgcagcccccat

SEQ ID NO: 7004134 - DNA, 21 bp, Homo sapiens
gctactgtagagacggaagca

SEQ ID NO: 7004135 - DNA, 22 bp, Homo sapiens
atgagattttatagtgtcttga

SEQ ID NO: 7004136 - DNA, 22 bp, Homo sapiens
aattgtcttggtgcaatcatga

SEQ ID NO: 7004137 - DNA, 22 bp, Homo sapiens
agtgtctggaggcattcttggt

SEQ ID NO: 7004138 - DNA, 22 bp, Homo sapiens
aacttatcagactgatgtatgg

SEQ ID NO: 7004139 - DNA, 22 bp, Homo sapiens
taaagcagtctgtgtatgtgaa

SEQ ID NO: 7004140 - DNA, 22 bp, Homo sapiens
tttgttcaaacagaccctttgt

SEQ ID NO: 7004141 - DNA, 22 bp, Homo sapiens
tcgttcttgtcagtttataaag

SEQ ID NO: 7004142 - DNA, 22 bp, Homo sapiens
atgactctccagagctgcagat

SEQ ID NO: 7004143 - DNA, 22 bp, Homo sapiens
tggatggctgtggtctttgccc

SEQ ID NO: 7004144 - DNA, 22 bp, Homo sapiens
cccattttgcttatgctgctgt

SEQ ID NO: 7004145 - DNA, 22 bp, Homo sapiens
cctgggctgcatgatggcattt

SEQ ID NO: 7004146 - DNA, 22 bp, Homo sapiens
atattgaaccctacagactgta

SEQ ID NO: 7004147 - DNA, 19 bp, Homo sapiens
acagtgcttctgagtgagg

SEQ ID NO: 7004148 - DNA, 22 bp, Homo sapiens
cagtttctacgacttaagcaca

SEQ ID NO: 7004149 - DNA, 22 bp, Homo sapiens
agtgttaagagaaaattctgct

SEQ ID NO: 7004150 - DNA, 22 bp, Homo sapiens
cagctctgtaaattccttcatc

SEQ ID NO: 7004151 - DNA, 20 bp, Homo sapiens
cagctctgggaaagaggcca

SEQ ID NO: 7004152 - DNA, 22 bp, Homo sapiens
gacaagacattggtaaagatat

SEQ ID NO: 7004153 - DNA, 22 bp, Homo sapiens
atacaagtcaatccatgtgatt

SEQ ID NO: 7004154 - DNA, 22 bp, Homo sapiens
gcccaggactcagggtgtcgcg

SEQ ID NO: 7004155 - DNA, 20 bp, Homo sapiens
tacagcccctgcttctgttg

SEQ ID NO: 7004156 - DNA, 22 bp, Homo sapiens
ctgtgagggcagggaccagagg

SEQ ID NO: 7004157 - DNA, 22 bp, Homo sapiens
ggtaagcacttcatgtacatga

SEQ ID NO: 7004158 - DNA, 22 bp, Homo sapiens
aaagagctcttactctagtgta

SEQ ID NO: 7004159 - DNA, 22 bp, Homo sapiens
taggatgtgccaggaaagaaag

SEQ ID NO: 7004160 - DNA, 22 bp, Homo sapiens
agtgctggagggaggcaggttc

SEQ ID NO: 7004161 - DNA, 22 bp, Homo sapiens
acagacattcatatcctcggta

SEQ ID NO: 7004162 - DNA, 22 bp, Homo sapiens
tggtcaatgaagatacactatt

SEQ ID NO: 7004163 - DNA, 21 bp, Homo sapiens
cagtgctcaatctgacagtgg

SEQ ID NO: 7004164 - DNA, 22 bp, Homo sapiens
tatcatcattggcaggtgagaa

SEQ ID NO: 7004165 - DNA, 22 bp, Homo sapiens
ggagcccagtcggggtgtaggt

SEQ ID NO: 7004166 - DNA, 22 bp, Homo sapiens
gcctggcagttgacagtttgct

SEQ ID NO: 7004167 - DNA, 22 bp, Homo sapiens
aggtaaggtttggaggcagtgg

SEQ ID NO: 7004168 - DNA, 22 bp, Homo sapiens
acactttgggctggataattat

SEQ ID NO: 7004169 - DNA, 22 bp, Homo sapiens
gtcaacaaggtttgcttatctt

SEQ ID NO: 7004170 - DNA, 22 bp, Homo sapiens
ctcacatgagatctgtacatcc

SEQ ID NO: 7004171 - DNA, 22 bp, Homo sapiens
aaggtgggtggatcacgaggtc

SEQ ID NO: 7004172 - DNA, 22 bp, Homo sapiens
actggaatgaagttaatctgat

SEQ ID NO: 7004173 - DNA, 22 bp, Homo sapiens
gtgctctacatgctccatgttt

SEQ ID NO: 7004174 - DNA, 22 bp, Homo sapiens
tccagctgccaaccgggccccg

SEQ ID NO: 7004175 - DNA, 22 bp, Homo sapiens
ttaaagcatcacactattaatt

SEQ ID NO: 7004176 - DNA, 22 bp, Homo sapiens
cgcgaggtggaggttgcagtga

SEQ ID NO: 7004177 - DNA, 21 bp, Homo sapiens
tgatttctagatattggccca

SEQ ID NO: 7004178 - DNA, 20 bp, Homo sapiens
tgtctgtgccacggcactcc

SEQ ID NO: 7004179 - DNA, 22 bp, Homo sapiens
atctgggtccaagttctgagca

SEQ ID NO: 7004180 - DNA, 22 bp, Homo sapiens
ggcattataattggcaggctgt

SEQ ID NO: 7004181 - DNA, 22 bp, Homo sapiens
atctccagtgcccaaaggaaat

SEQ ID NO: 7004182 - DNA, 22 bp, Homo sapiens
acctggcataagggcttgagtc

SEQ ID NO: 7004183 - DNA, 22 bp, Homo sapiens
gagctacaggcagctgagccct

SEQ ID NO: 7004184 - DNA, 22 bp, Homo sapiens
taaaaccaggtcttgggattta

SEQ ID NO: 7004185 - DNA, 22 bp, Homo sapiens
aacatgatgtattttcttgtct

SEQ ID NO: 7004186 - DNA, 22 bp, Homo sapiens
atgtcttgggtttcagtttact

SEQ ID NO: 7004187 - DNA, 22 bp, Homo sapiens
agacaacatcactaaagctgag

SEQ ID NO: 7004188 - DNA, 22 bp, Homo sapiens
ccaggctctgcgctggacatgg

SEQ ID NO: 7004189 - DNA, 22 bp, Homo sapiens
cacttcaatctctgcctccatc

SEQ ID NO: 7004190 - DNA, 22 bp, Homo sapiens
cagcatgaaacaattgagccca

SEQ ID NO: 7004191 - DNA, 22 bp, Homo sapiens
taggatatgagtaagcctttgt

SEQ ID NO: 7004192 - DNA, 22 bp, Homo sapiens
atggcttggcaccatctccttg

SEQ ID NO: 7004193 - DNA, 22 bp, Homo sapiens
aaggctcggcaatgtgcggctc

SEQ ID NO: 7004194 - DNA, 22 bp, Homo sapiens
tgctgccacatttaaagagggg

SEQ ID NO: 7004195 - DNA, 22 bp, Homo sapiens
tccttcagggggccgcctgcac

SEQ ID NO: 7004196 - DNA, 22 bp, Homo sapiens
gaggggcctggcgaggacatgt

SEQ ID NO: 7004197 - DNA, 22 bp, Homo sapiens
aaacaatgtacatttataatgc

SEQ ID NO: 7004198 - DNA, 22 bp, Homo sapiens
attattgttttaatagtagaga

SEQ ID NO: 7004199 - DNA, 22 bp, Homo sapiens
tacatgcatacttgtgtgtgta

SEQ ID NO: 7004200 - DNA, 22 bp, Homo sapiens
ttagatttacaagcactgttta

SEQ ID NO: 7004201 - DNA, 22 bp, Homo sapiens
ctcctctctggagttatgcaga

SEQ ID NO: 7004202 - DNA, 21 bp, Homo sapiens
gttttgctggtatctggggat

SEQ ID NO: 7004203 - DNA, 22 bp, Homo sapiens
aagtggttttaagaggttcctt

SEQ ID NO: 7004204 - DNA, 22 bp, Homo sapiens
caggagccgccaggcacgttgg

SEQ ID NO: 7004205 - DNA, 22 bp, Homo sapiens
atactgtgtgcagagtcctaat

SEQ ID NO: 7004206 - DNA, 22 bp, Homo sapiens
agtaaattagcgggatccacaa

SEQ ID NO: 7004207 - DNA, 22 bp, Homo sapiens
caacctggccctagccctggga

SEQ ID NO: 7004208 - DNA, 22 bp, Homo sapiens
aaggcaatattgagtttccctt

SEQ ID NO: 7004209 - DNA, 17 bp, Homo sapiens
tgtggccttctgagctt

SEQ ID NO: 7004210 - DNA, 22 bp, Homo sapiens
gccaggagccagcttcttagca

SEQ ID NO: 7004211 - DNA, 16 bp, Homo sapiens
tccagttttcagcact

SEQ ID NO: 7004212 - DNA, 22 bp, Homo sapiens
ccgggggaggcaagagacatgc

SEQ ID NO: 7004213 - DNA, 22 bp, Homo sapiens
atgctctgatgctgttaaatgt

SEQ ID NO: 7004214 - DNA, 17 bp, Homo sapiens
aggcctcaggtgaaacc

SEQ ID NO: 7004215 - DNA, 22 bp, Homo sapiens
taccatgagaatactaagagag

SEQ ID NO: 7004216 - DNA, 22 bp, Homo sapiens
ttgcacagtagcgcgtgattgt

SEQ ID NO: 7004217 - DNA, 21 bp, Homo sapiens
tcattgttgcatggtaggggg

SEQ ID NO: 7004218 - DNA, 22 bp, Homo sapiens
ctcccaagctgtgctgaactgt

SEQ ID NO: 7004219 - DNA, 22 bp, Homo sapiens
cgtgctctggactcgtggcaca

SEQ ID NO: 7004220 - DNA, 22 bp, Homo sapiens
ataacatgagccagattgaaag

SEQ ID NO: 7004221 - DNA, 22 bp, Homo sapiens
aaaaggatgttttcatgaaaca

SEQ ID NO: 7004222 - DNA, 22 bp, Homo sapiens
taaaactttgaaggtgctcagt

SEQ ID NO: 7004223 - DNA, 22 bp, Homo sapiens
aaagttctttgcatctttgctc

SEQ ID NO: 7004224 - DNA, 22 bp, Homo sapiens
gcagggattgtgcagggggcta

SEQ ID NO: 7004225 - DNA, 23 bp, Homo sapiens
agaatttctaactctagctctgt

SEQ ID NO: 7004226 - DNA, 22 bp, Homo sapiens
ttcatagtgtctttgctctctg

SEQ ID NO: 7004227 - DNA, 22 bp, Homo sapiens
gaccctgataggagtagaagaa

SEQ ID NO: 7004228 - DNA, 22 bp, Homo sapiens
aattatccacctttgcatgatt

SEQ ID NO: 7004229 - DNA, 22 bp, Homo sapiens
agcagggctttgcagacttggg

SEQ ID NO: 7004230 - DNA, 22 bp, Homo sapiens
tcttcagggtctgccccagggg

SEQ ID NO: 7004231 - DNA, 22 bp, Homo sapiens
tgtttacaaggagtttatattg

SEQ ID NO: 7004232 - DNA, 22 bp, Homo sapiens
gctctgagatcattcactgtaa

SEQ ID NO: 7004233 - DNA, 22 bp, Homo sapiens
caccagtctttattttgttatt

SEQ ID NO: 7004234 - DNA, 22 bp, Homo sapiens
ggaaaactgtatttgaataact

SEQ ID NO: 7004235 - DNA, 22 bp, Homo sapiens
cccctcattctctgagctagtt

SEQ ID NO: 7004236 - DNA, 22 bp, Homo sapiens
cagtctttgacaagccctttca

SEQ ID NO: 7004237 - DNA, 22 bp, Homo sapiens
gccctcagatgggaaaggaggg

SEQ ID NO: 7004238 - DNA, 22 bp, Homo sapiens
tacacttataactctgtgtgtg

SEQ ID NO: 7004239 - DNA, 22 bp, Homo sapiens
ctcaggctgtgatgtgatggca

SEQ ID NO: 7004240 - DNA, 22 bp, Homo sapiens
tactgtttcaagccctcacaga

SEQ ID NO: 7004241 - DNA, 22 bp, Homo sapiens
ggatgtgaatctgggctgagac

SEQ ID NO: 7004242 - DNA, 22 bp, Homo sapiens
cctgtgtgaaggttaggcaggt

SEQ ID NO: 7004243 - DNA, 22 bp, Homo sapiens
atgaatgcaaactagtttgtgt

SEQ ID NO: 7004244 - DNA, 22 bp, Homo sapiens
caggtagcttttgatattaggg

SEQ ID NO: 7004245 - DNA, 22 bp, Homo sapiens
tgggcacaggggaatggatgaa

SEQ ID NO: 7004246 - DNA, 22 bp, Homo sapiens
ttgctactactcaactctgcca

SEQ ID NO: 7004247 - DNA, 22 bp, Homo sapiens
tgctgagcttccactgcttctg

SEQ ID NO: 7004248 - DNA, 22 bp, Homo sapiens
gcctctgcggggcccgagcccg

SEQ ID NO: 7004249 - DNA, 22 bp, Homo sapiens
ctcccaggttacatctgagcct

SEQ ID NO: 7004250 - DNA, 22 bp, Homo sapiens
gctgcacatggcagaggccttt

SEQ ID NO: 7004251 - DNA, 22 bp, Homo sapiens
aggcttgtaggattgagggggc

SEQ ID NO: 7004252 - DNA, 22 bp, Homo sapiens
ttggcagccaggacccgcctgg

SEQ ID NO: 7004253 - DNA, 21 bp, Homo sapiens
cacaccaggcatgtcttgagc

SEQ ID NO: 7004254 - DNA, 22 bp, Homo sapiens
cagtttctcagacttcccttgt

SEQ ID NO: 7004255 - DNA, 22 bp, Homo sapiens
tcccagagcagatgtgctaaag

SEQ ID NO: 7004256 - DNA, 22 bp, Homo sapiens
ggaatatccactctttcttgaa

SEQ ID NO: 7004257 - DNA, 19 bp, Homo sapiens
ttaagagtaggcattgtgc

SEQ ID NO: 7004258 - DNA, 22 bp, Homo sapiens
agagccacagtggataggagcc

SEQ ID NO: 7004259 - DNA, 22 bp, Homo sapiens
agatggctgggagctctgtttg

SEQ ID NO: 7004260 - DNA, 22 bp, Homo sapiens
gagttttatttggtgctaagta

SEQ ID NO: 7004261 - DNA, 22 bp, Homo sapiens
agctctgaaagttatgtcgccg

SEQ ID NO: 7004262 - DNA, 22 bp, Homo sapiens
tctgttatatgttttttctaaa

SEQ ID NO: 7004263 - DNA, 22 bp, Homo sapiens
attgcactttcccctgtgagaa

SEQ ID NO: 7004264 - DNA, 22 bp, Homo sapiens
cggcttccaacaagctttgctg

SEQ ID NO: 7004265 - DNA, 23 bp, Homo sapiens
ctcagaggtgtttttcacttact

SEQ ID NO: 7004266 - DNA, 22 bp, Homo sapiens
tgatgaattggaaattctgatt

SEQ ID NO: 7004267 - DNA, 22 bp, Homo sapiens
tatcataggttctgaatgtttc

SEQ ID NO: 7004268 - DNA, 22 bp, Homo sapiens
accacatctagattgcagccct

SEQ ID NO: 7004269 - DNA, 22 bp, Homo sapiens
tctggcagcagcatcagtggct

SEQ ID NO: 7004270 - DNA, 22 bp, Homo sapiens
tgaaagcactgattctcaactc

SEQ ID NO: 7004271 - DNA, 22 bp, Homo sapiens
taagtttaaatgtacatgaagc

SEQ ID NO: 7004272 - DNA, 22 bp, Homo sapiens
tcatgctctggtttagctgttt

SEQ ID NO: 7004273 - DNA, 22 bp, Homo sapiens
atatagattccatggttccttt

SEQ ID NO: 7004274 - DNA, 22 bp, Homo sapiens
gtaggaaagggagtgaagggaa

SEQ ID NO: 7004275 - DNA, 22 bp, Homo sapiens
aggcactgaaaggtggccagag

SEQ ID NO: 7004276 - DNA, 22 bp, Homo sapiens
cttctgctgccgcctcggcaca

SEQ ID NO: 7004277 - DNA, 22 bp, Homo sapiens
gggcatcttgtagccttcactt

SEQ ID NO: 7004278 - DNA, 22 bp, Homo sapiens
taagggctcctgtcctggcttg

SEQ ID NO: 7004279 - DNA, 17 bp, Homo sapiens
agcctgggaaggagtga

SEQ ID NO: 7004280 - DNA, 22 bp, Homo sapiens
tgaaattagaaatatgtatggg

SEQ ID NO: 7004281 - DNA, 22 bp, Homo sapiens
gaatttctggaccctttgagaa

SEQ ID NO: 7004282 - DNA, 22 bp, Homo sapiens
gctgccttaacttcttcgctgt

SEQ ID NO: 7004283 - DNA, 22 bp, Homo sapiens
tttacaattctctaccagtgtt

SEQ ID NO: 7004284 - DNA, 22 bp, Homo sapiens
gccttttgatctataactgtgt

SEQ ID NO: 7004285 - DNA, 22 bp, Homo sapiens
tacagtaaccagtctacttaga

SEQ ID NO: 7004286 - DNA, 22 bp, Homo sapiens
gtttatgaggaaaagttatgat

SEQ ID NO: 7004287 - DNA, 22 bp, Homo sapiens
tggctgcagttgggccctcaga

SEQ ID NO: 7004288 - DNA, 22 bp, Homo sapiens
tggtgtgggcagcagcaggtac

SEQ ID NO: 7004289 - DNA, 22 bp, Homo sapiens
ctctttgtggccacctaatctt

SEQ ID NO: 7004290 - DNA, 22 bp, Homo sapiens
taaacatggctgtttcagttat

SEQ ID NO: 7004291 - DNA, 22 bp, Homo sapiens
ttggagatgtaaaattcagaga

SEQ ID NO: 7004292 - DNA, 22 bp, Homo sapiens
tattagcaaccaagagcctcta

SEQ ID NO: 7004293 - DNA, 18 bp, Homo sapiens
agcttgcctcaagctttt

SEQ ID NO: 7004294 - DNA, 22 bp, Homo sapiens
tctacttgtcagtcttcaaatc

SEQ ID NO: 7004295 - DNA, 22 bp, Homo sapiens
tgactgaggaagaccaggtagc

SEQ ID NO: 7004296 - DNA, 22 bp, Homo sapiens
cacaatgtctggtaggccactt

SEQ ID NO: 7004297 - DNA, 22 bp, Homo sapiens
gcctgcagatatataggatggt

SEQ ID NO: 7004298 - DNA, 22 bp, Homo sapiens
atcctcatctggttttaggctg

SEQ ID NO: 7004299 - DNA, 19 bp, Homo sapiens
tcctggggaggggcatggc

SEQ ID NO: 7004300 - DNA, 20 bp, Homo sapiens
tatttagattcaagtatgga

SEQ ID NO: 7004301 - DNA, 22 bp, Homo sapiens
tgtatacaggattactcatagc

SEQ ID NO: 7004302 - DNA, 22 bp, Homo sapiens
ggcgtgttggatctggattggc

SEQ ID NO: 7004303 - DNA, 22 bp, Homo sapiens
ttactacattgtaacacagtac

SEQ ID NO: 7004304 - DNA, 22 bp, Homo sapiens
gtttgtgtaacatgatgatgat

SEQ ID NO: 7004305 - DNA, 22 bp, Homo sapiens
ataaagatttctttttctctac

SEQ ID NO: 7004306 - DNA, 22 bp, Homo sapiens
agcctgcctcagactcaggata

SEQ ID NO: 7004307 - DNA, 22 bp, Homo sapiens
tttccaaaggagtaccacgcat

SEQ ID NO: 7004308 - DNA, 22 bp, Homo sapiens
aacagcttagaaatgttgctaa

SEQ ID NO: 7004309 - DNA, 22 bp, Homo sapiens
ccagaagaaaaagctggtatta

SEQ ID NO: 7004310 - DNA, 22 bp, Homo sapiens
attaagctctccaggaaatgta

SEQ ID NO: 7004311 - DNA, 22 bp, Homo sapiens
ctttctggagtggaaaggtatt

SEQ ID NO: 7004312 - DNA, 22 bp, Homo sapiens
ctccccaagccttggcttctcc

SEQ ID NO: 7004313 - DNA, 17 bp, Homo sapiens
ctggagaagcctgtgga

SEQ ID NO: 7004314 - DNA, 22 bp, Homo sapiens
gctgagagcggccagctgggaa

SEQ ID NO: 7004315 - DNA, 22 bp, Homo sapiens
actgtgcagtgttgtaacccga

SEQ ID NO: 7004316 - DNA, 22 bp, Homo sapiens
gtactgtgctagttgatgggag

SEQ ID NO: 7004317 - DNA, 22 bp, Homo sapiens
aatgtgcttctggctgtggtca

SEQ ID NO: 7004318 - DNA, 22 bp, Homo sapiens
ccctgggtctaggttatgtgct

SEQ ID NO: 7004319 - DNA, 22 bp, Homo sapiens
agctggtaagtggcagagattc

SEQ ID NO: 7004320 - DNA, 22 bp, Homo sapiens
tgatagagcactaagtagtgta

SEQ ID NO: 7004321 - DNA, 22 bp, Homo sapiens
aaattagaccagggctcctgga

SEQ ID NO: 7004322 - DNA, 22 bp, Homo sapiens
gctctctaattaagcattgtat

SEQ ID NO: 7004323 - DNA, 22 bp, Homo sapiens
cctgggtcactcaggcaggcgg

SEQ ID NO: 7004324 - DNA, 20 bp, Homo sapiens
gtggagaggctggcgggact

SEQ ID NO: 7004325 - DNA, 22 bp, Homo sapiens
ttattccaagataggatagcat

SEQ ID NO: 7004326 - DNA, 22 bp, Homo sapiens
tatctgttgtcttttacatgta

SEQ ID NO: 7004327 - DNA, 22 bp, Homo sapiens
cagacagtggacttgataaagg

SEQ ID NO: 7004328 - DNA, 22 bp, Homo sapiens
ctgcagacctctgaggtccatg

SEQ ID NO: 7004329 - DNA, 22 bp, Homo sapiens
tggcacaaatctagtccctggt

SEQ ID NO: 7004330 - DNA, 22 bp, Homo sapiens
tcaaagtaccattatcagtgga

SEQ ID NO: 7004331 - DNA, 22 bp, Homo sapiens
atctgtctatgtggctatgtat

SEQ ID NO: 7004332 - DNA, 20 bp, Homo sapiens
ctgtagagcacaagtggagg

SEQ ID NO: 7004333 - DNA, 22 bp, Homo sapiens
ttctctggggacttggttggag

SEQ ID NO: 7004334 - DNA, 23 bp, Homo sapiens
acactttcaaatatgcacagagc

SEQ ID NO: 7004335 - DNA, 22 bp, Homo sapiens
gctgacagcgtttccagtgatg

SEQ ID NO: 7004336 - DNA, 22 bp, Homo sapiens
ccatgcaaggagaactctcact

SEQ ID NO: 7004337 - DNA, 22 bp, Homo sapiens
cagtcctttcaatggtgacctt

SEQ ID NO: 7004338 - DNA, 22 bp, Homo sapiens
agatgggtaactggagtctgct

SEQ ID NO: 7004339 - DNA, 22 bp, Homo sapiens
tgcacttcaaaaatgtcactga

SEQ ID NO: 7004340 - DNA, 22 bp, Homo sapiens
ttaggacatggacagctttggt

SEQ ID NO: 7004341 - DNA, 22 bp, Homo sapiens
ttggttcagatgggatctgcga

SEQ ID NO: 7004342 - DNA, 22 bp, Homo sapiens
aaagtgtttttgagctgtagtt

SEQ ID NO: 7004343 - DNA, 22 bp, Homo sapiens
actggagtgtttggaggatgca

SEQ ID NO: 7004344 - DNA, 22 bp, Homo sapiens
tccctcagggtgcagttgcttt

SEQ ID NO: 7004345 - DNA, 22 bp, Homo sapiens
ccagaaaagcatctggttcttt

SEQ ID NO: 7004346 - DNA, 21 bp, Homo sapiens
gctggctgtcccagggaagca

SEQ ID NO: 7004347 - DNA, 22 bp, Homo sapiens
ttggaactggaggaacatgcta

SEQ ID NO: 7004348 - DNA, 22 bp, Homo sapiens
aagctgctggtgactgggctga

SEQ ID NO: 7004349 - DNA, 22 bp, Homo sapiens
cacagagctggaaaggctgggc

SEQ ID NO: 7004350 - DNA, 22 bp, Homo sapiens
attagggaaggatttggcctga

SEQ ID NO: 7004351 - DNA, 22 bp, Homo sapiens
tagggctcagagtccagtttct

SEQ ID NO: 7004352 - DNA, 22 bp, Homo sapiens
ttaatcaaatttacaacccagt

SEQ ID NO: 7004353 - DNA, 22 bp, Homo sapiens
tgggctgagcactgaggaagga

SEQ ID NO: 7004354 - DNA, 22 bp, Homo sapiens
ctgctgggctcctcatgtgact

SEQ ID NO: 7004355 - DNA, 22 bp, Homo sapiens
ctgagcccgttgtgaatattcc

SEQ ID NO: 7004356 - DNA, 22 bp, Homo sapiens
gagtgtaaaaacttagtgagat

SEQ ID NO: 7004357 - DNA, 22 bp, Homo sapiens
tatagaggccaccaacatgaaa

SEQ ID NO: 7004358 - DNA, 21 bp, Homo sapiens
ccctgcttggggcagaacaac

SEQ ID NO: 7004359 - DNA, 22 bp, Homo sapiens
tttcagtgtaaggtttccagga

SEQ ID NO: 7004360 - DNA, 22 bp, Homo sapiens
ctctgtacctggcatagcaacc

SEQ ID NO: 7004361 - DNA, 22 bp, Homo sapiens
gacagtgctatggtaggacatt

SEQ ID NO: 7004362 - DNA, 16 bp, Homo sapiens
gtaacattctgtagcc

SEQ ID NO: 7004363 - DNA, 22 bp, Homo sapiens
aaggaaccatttgtgtgcatgg

SEQ ID NO: 7004364 - DNA, 22 bp, Homo sapiens
cgctcacccgcccgcctgttgt

SEQ ID NO: 7004365 - DNA, 22 bp, Homo sapiens
tttccttctcagggagcttcaa

SEQ ID NO: 7004366 - DNA, 22 bp, Homo sapiens
ggtgtatacctacacatttttg

SEQ ID NO: 7004367 - DNA, 22 bp, Homo sapiens
cttgccagcaggcgctgtgtac

SEQ ID NO: 7004368 - DNA, 22 bp, Homo sapiens
tctacatgatgtaccatctaag

SEQ ID NO: 7004369 - DNA, 22 bp, Homo sapiens
ggaaagctttgtacttgaaaac

SEQ ID NO: 7004370 - DNA, 22 bp, Homo sapiens
atttgtgataatttgttacagc

SEQ ID NO: 7004371 - DNA, 16 bp, Homo sapiens
tgccttgctgtcagtc

SEQ ID NO: 7004372 - DNA, 22 bp, Homo sapiens
tgagtgcctgcaacggaccaga

SEQ ID NO: 7004373 - DNA, 22 bp, Homo sapiens
ttcctgcaaagccagatgtcga

SEQ ID NO: 7004374 - DNA, 19 bp, Homo sapiens
ttgagggcattctggtgtt

SEQ ID NO: 7004375 - DNA, 22 bp, Homo sapiens
aatttaaggaggccttcactct

SEQ ID NO: 7004376 - DNA, 20 bp, Homo sapiens
tctcctggtgacagtaccca

SEQ ID NO: 7004377 - DNA, 22 bp, Homo sapiens
tgacttgaaacgtgaacagatc

SEQ ID NO: 7004378 - DNA, 22 bp, Homo sapiens
gaaatgcagaacctgagaccat

SEQ ID NO: 7004379 - DNA, 22 bp, Homo sapiens
acagaatagtagcttaaagtca

SEQ ID NO: 7004380 - DNA, 22 bp, Homo sapiens
cgaggcaggcaggcggaggata

SEQ ID NO: 7004381 - DNA, 21 bp, Homo sapiens
atggcttttttaaagcttgtg

SEQ ID NO: 7004382 - DNA, 22 bp, Homo sapiens
tgtgtttagagagcacattcag

SEQ ID NO: 7004383 - DNA, 22 bp, Homo sapiens
gggggccatcttcaaggatgtg

SEQ ID NO: 7004384 - DNA, 22 bp, Homo sapiens
gctgatggcttgctggctgaca

SEQ ID NO: 7004385 - DNA, 22 bp, Homo sapiens
taactggtagattttaaatcgg

SEQ ID NO: 7004386 - DNA, 22 bp, Homo sapiens
tctcaagaccccatttatttta

SEQ ID NO: 7004387 - DNA, 22 bp, Homo sapiens
tctcagagatgtcaagagtcta

SEQ ID NO: 7004388 - DNA, 22 bp, Homo sapiens
gctcaaaggccaggtagcagca

SEQ ID NO: 7004389 - DNA, 18 bp, Homo sapiens
tgtctgcttctccaactc

SEQ ID NO: 7004390 - DNA, 22 bp, Homo sapiens
tgagccagagtggagtgtgcct

SEQ ID NO: 7004391 - DNA, 22 bp, Homo sapiens
ctctgccatctcactgggtcct

SEQ ID NO: 7004392 - DNA, 22 bp, Homo sapiens
gcccctccatccatcaccgggg

SEQ ID NO: 7004393 - DNA, 22 bp, Homo sapiens
acctgggaacgctttgtggagg

SEQ ID NO: 7004394 - DNA, 22 bp, Homo sapiens
agggtctgaccaccagtaggga

SEQ ID NO: 7004395 - DNA, 22 bp, Homo sapiens
catgttttgtgtacagaatatt

SEQ ID NO: 7004396 - DNA, 22 bp, Homo sapiens
caaggcaggcagttcacttgag

SEQ ID NO: 7004397 - DNA, 22 bp, Homo sapiens
agaattctggagttgggaggaa

SEQ ID NO: 7004398 - DNA, 22 bp, Homo sapiens
ggccagagaagtcagacccttg

SEQ ID NO: 7004399 - DNA, 22 bp, Homo sapiens
acactatttaaatctaacctgt

SEQ ID NO: 7004400 - DNA, 22 bp, Homo sapiens
gatgtcttactaactagccttt

SEQ ID NO: 7004401 - DNA, 21 bp, Homo sapiens
agcaggctttggagtggggct

SEQ ID NO: 7004402 - DNA, 22 bp, Homo sapiens
cttctcagagcttccagaaaac

SEQ ID NO: 7004403 - DNA, 22 bp, Homo sapiens
gttcagatttgactggtttctc

SEQ ID NO: 7004404 - DNA, 22 bp, Homo sapiens
tggccaatcactgacaaaatgc

SEQ ID NO: 7004405 - DNA, 22 bp, Homo sapiens
attcagcacatctttgtacagc

SEQ ID NO: 7004406 - DNA, 22 bp, Homo sapiens
atggcttcctctggattggatt

SEQ ID NO: 7004407 - DNA, 20 bp, Homo sapiens
ttcctcaggagaggatgtta

SEQ ID NO: 7004408 - DNA, 22 bp, Homo sapiens
tgttaaactcgtaggttaggct

SEQ ID NO: 7004409 - DNA, 22 bp, Homo sapiens
caagtttacaatgtgtatgtgt

SEQ ID NO: 7004410 - DNA, 22 bp, Homo sapiens
cttggaatggggcagaaaatgg

SEQ ID NO: 7004411 - DNA, 22 bp, Homo sapiens
cagagaaagggtgaattccttc

SEQ ID NO: 7004412 - DNA, 22 bp, Homo sapiens
gtggcctgccagcagatggcgc

SEQ ID NO: 7004413 - DNA, 22 bp, Homo sapiens
gccctatcattcattgagtgct

SEQ ID NO: 7004414 - DNA, 22 bp, Homo sapiens
gggccaagggtgcgtggcagga

SEQ ID NO: 7004415 - DNA, 22 bp, Homo sapiens
tttgtatgtgataagactattc

SEQ ID NO: 7004416 - DNA, 22 bp, Homo sapiens
ggtagtacatggaagagtacac

SEQ ID NO: 7004417 - DNA, 22 bp, Homo sapiens
cagctggctgcggtgaggggac

SEQ ID NO: 7004418 - DNA, 21 bp, Homo sapiens
aggcccaggaatatgcatttt

SEQ ID NO: 7004419 - DNA, 23 bp, Homo sapiens
acaaggctctgttctgcagtttc

SEQ ID NO: 7004420 - DNA, 22 bp, Homo sapiens
catttcacacataaacttgggt

SEQ ID NO: 7004421 - DNA, 22 bp, Homo sapiens
tgccagtcagttggtgtgggac

SEQ ID NO: 7004422 - DNA, 22 bp, Homo sapiens
atgaagaaaaatccagctgtcc

SEQ ID NO: 7004423 - DNA, 22 bp, Homo sapiens
gccaaatttgtgagcccccaag

SEQ ID NO: 7004424 - DNA, 21 bp, Homo sapiens
tacagtaagttgggtggtcct

SEQ ID NO: 7004425 - DNA, 21 bp, Homo sapiens
gcacttggggattcagggagg

SEQ ID NO: 7004426 - DNA, 22 bp, Homo sapiens
tggctgtcatgcccttcttacc

SEQ ID NO: 7004427 - DNA, 22 bp, Homo sapiens
ggatcctgatatgtgtttctca

SEQ ID NO: 7004428 - DNA, 22 bp, Homo sapiens
ttgctttatctcttatgcctca

SEQ ID NO: 7004429 - DNA, 22 bp, Homo sapiens
gctgaggctcaatccccttctg

SEQ ID NO: 7004430 - DNA, 22 bp, Homo sapiens
cctgactcctgggcaaaaccaa

SEQ ID NO: 7004431 - DNA, 20 bp, Homo sapiens
ttggctcagatttttatggg

SEQ ID NO: 7004432 - DNA, 22 bp, Homo sapiens
tgcctgccaatgatgcttgtgt

SEQ ID NO: 7004433 - DNA, 22 bp, Homo sapiens
tcaccaggattgggctgtaggc

SEQ ID NO: 7004434 - DNA, 22 bp, Homo sapiens
agtgagggactccatgactcct

SEQ ID NO: 7004435 - DNA, 22 bp, Homo sapiens
tatttgcttggaaacctaatcc

SEQ ID NO: 7004436 - DNA, 22 bp, Homo sapiens
agttttcttcattttgtggcca

SEQ ID NO: 7004437 - DNA, 22 bp, Homo sapiens
gctacctgagcaagagcttcaa

SEQ ID NO: 7004438 - DNA, 21 bp, Homo sapiens
ggccttcccctgcagtctccg

SEQ ID NO: 7004439 - DNA, 22 bp, Homo sapiens
tcagccaggtaatgtggagatg

SEQ ID NO: 7004440 - DNA, 22 bp, Homo sapiens
agtatcaataatagaggagcta

SEQ ID NO: 7004441 - DNA, 22 bp, Homo sapiens
tgtaggcagcacacctgtgcaa

SEQ ID NO: 7004442 - DNA, 22 bp, Homo sapiens
tacactggctgttttgcagaaa

SEQ ID NO: 7004443 - DNA, 22 bp, Homo sapiens
ccagagcctgctgagccccatt

SEQ ID NO: 7004444 - DNA, 22 bp, Homo sapiens
gttcacagatccttgaagccag

SEQ ID NO: 7004445 - DNA, 22 bp, Homo sapiens
tcagtgctcaggggagccgagg

SEQ ID NO: 7004446 - DNA, 22 bp, Homo sapiens
aatgagtcaaaacagcatatag

SEQ ID NO: 7004447 - DNA, 23 bp, Homo sapiens
tgtctggagttttgcactgttgc

SEQ ID NO: 7004448 - DNA, 22 bp, Homo sapiens
tatgaccataagattactgtta

SEQ ID NO: 7004449 - DNA, 22 bp, Homo sapiens
gggagctgatcaggtggattca

SEQ ID NO: 7004450 - DNA, 22 bp, Homo sapiens
tactgacaggattgacagtaaa

SEQ ID NO: 7004451 - DNA, 22 bp, Homo sapiens
aaatgcagtggttctacttctc

SEQ ID NO: 7004452 - DNA, 22 bp, Homo sapiens
gagatgatcgtacttgcaagaa

SEQ ID NO: 7004453 - DNA, 21 bp, Homo sapiens
tcagcatcctgagctgtcctc

SEQ ID NO: 7004454 - DNA, 22 bp, Homo sapiens
cagaacagtcgcctgcatggat

SEQ ID NO: 7004455 - DNA, 20 bp, Homo sapiens
tactttgatctgataagcaa

SEQ ID NO: 7004456 - DNA, 22 bp, Homo sapiens
ttggaagacattaaagagagtg

SEQ ID NO: 7004457 - DNA, 22 bp, Homo sapiens
atcaagaatgttcattcttcta

SEQ ID NO: 7004458 - DNA, 22 bp, Homo sapiens
tagatttcctcttcctcattcc

SEQ ID NO: 7004459 - DNA, 22 bp, Homo sapiens
cacactgcttacacaaaatgat

SEQ ID NO: 7004460 - DNA, 23 bp, Homo sapiens
attctaagatgtgatcttataac

SEQ ID NO: 7004461 - DNA, 22 bp, Homo sapiens
ttgtcaagtaaggctgacattt

SEQ ID NO: 7004462 - DNA, 22 bp, Homo sapiens
acagtctgcttgtctccatggt

SEQ ID NO: 7004463 - DNA, 22 bp, Homo sapiens
ggtggcagtgcttgcgggtcta

SEQ ID NO: 7004464 - DNA, 22 bp, Homo sapiens
tattagattaactttaatgtct

SEQ ID NO: 7004465 - DNA, 22 bp, Homo sapiens
agctaacacattccagctattt

SEQ ID NO: 7004466 - DNA, 22 bp, Homo sapiens
cgtcctgctcggcgcgcctcgg

SEQ ID NO: 7004467 - DNA, 22 bp, Homo sapiens
tcacttctgaaggtagttggca

SEQ ID NO: 7004468 - DNA, 22 bp, Homo sapiens
gctgccagccagggtgggatcc

SEQ ID NO: 7004469 - DNA, 22 bp, Homo sapiens
tagggatgtcctgagacttggc

SEQ ID NO: 7004470 - DNA, 22 bp, Homo sapiens
tgtcagcacatctgtaatcaca

SEQ ID NO: 7004471 - DNA, 22 bp, Homo sapiens
acagagaggtaaaatatatagt

SEQ ID NO: 7004472 - DNA, 20 bp, Homo sapiens
ttgctgggacctttttcaac

SEQ ID NO: 7004473 - DNA, 22 bp, Homo sapiens
aatgtcctggagggcggccgct

SEQ ID NO: 7004474 - DNA, 22 bp, Homo sapiens
agttagtatttgttgttctcca

SEQ ID NO: 7004475 - DNA, 19 bp, Homo sapiens
ttcagtttcctcatctgga

SEQ ID NO: 7004476 - DNA, 22 bp, Homo sapiens
accaggcttgatgatttgctta

SEQ ID NO: 7004477 - DNA, 22 bp, Homo sapiens
tgcattgttgatgagttgaata

SEQ ID NO: 7004478 - DNA, 22 bp, Homo sapiens
tttagttattgttacagtatga

SEQ ID NO: 7004479 - DNA, 22 bp, Homo sapiens
agccctggattctgaggtccaa

SEQ ID NO: 7004480 - DNA, 22 bp, Homo sapiens
tgtggaaaagaataagggagat

SEQ ID NO: 7004481 - DNA, 22 bp, Homo sapiens
taattccaagttgagacatgca

SEQ ID NO: 7004482 - DNA, 22 bp, Homo sapiens
ctgaataattttatagttgctg

SEQ ID NO: 7004483 - DNA, 20 bp, Homo sapiens
aagaggctgtggatcctact

SEQ ID NO: 7004484 - DNA, 22 bp, Homo sapiens
agtcacatgaggaaggggaagg

SEQ ID NO: 7004485 - DNA, 23 bp, Homo sapiens
gttaataatgaacactttctccc

SEQ ID NO: 7004486 - DNA, 22 bp, Homo sapiens
acctctgcttcccgggttcaag

SEQ ID NO: 7004487 - DNA, 22 bp, Homo sapiens
aaagcaatgatggtagacacgt

SEQ ID NO: 7004488 - DNA, 22 bp, Homo sapiens
tttactaacaccatacatgctg

SEQ ID NO: 7004489 - DNA, 19 bp, Homo sapiens
agaattgttttgagacccc

SEQ ID NO: 7004490 - DNA, 22 bp, Homo sapiens
gttccgtttatatgctggatta

SEQ ID NO: 7004491 - DNA, 22 bp, Homo sapiens
aaatatgaatgataagagttat

SEQ ID NO: 7004492 - DNA, 22 bp, Homo sapiens
agtcctggctctacgggcttca

SEQ ID NO: 7004493 - DNA, 22 bp, Homo sapiens
gcctgccagtgtttgaggattg

SEQ ID NO: 7004494 - DNA, 18 bp, Homo sapiens
tcctggccacactacctt

SEQ ID NO: 7004495 - DNA, 22 bp, Homo sapiens
catgctacttgctatgcaaaaa

SEQ ID NO: 7004496 - DNA, 22 bp, Homo sapiens
cttctgacccctggtctacagc

SEQ ID NO: 7004497 - DNA, 21 bp, Homo sapiens
aacacatccagagtatttgac

SEQ ID NO: 7004498 - DNA, 22 bp, Homo sapiens
actctgtagggacggttctccc

SEQ ID NO: 7004499 - DNA, 22 bp, Homo sapiens
ctcgggttgtaagtatctatta

SEQ ID NO: 7004500 - DNA, 22 bp, Homo sapiens
ttgtttaatccttgtacccatg

SEQ ID NO: 7004501 - DNA, 22 bp, Homo sapiens
tacagattgaggtttttaatat

SEQ ID NO: 7004502 - DNA, 22 bp, Homo sapiens
tgtctgaactgcactgaaagac

SEQ ID NO: 7004503 - DNA, 22 bp, Homo sapiens
agttccagtgtgagagaacatg

SEQ ID NO: 7004504 - DNA, 22 bp, Homo sapiens
actgtacacattcgtcaagact

SEQ ID NO: 7004505 - DNA, 22 bp, Homo sapiens
ctgcaagcaaatcaactctttg

SEQ ID NO: 7004506 - DNA, 22 bp, Homo sapiens
acttgccagctaaagcctggtg

SEQ ID NO: 7004507 - DNA, 22 bp, Homo sapiens
tagcaatgtaagatgttaacac

SEQ ID NO: 7004508 - DNA, 22 bp, Homo sapiens
agctgtgttaggatgttaataa

SEQ ID NO: 7004509 - DNA, 22 bp, Homo sapiens
gggctggaccgctcgcctccct

SEQ ID NO: 7004510 - DNA, 21 bp, Homo sapiens
ccgccgctgatagctctgggc

SEQ ID NO: 7004511 - DNA, 22 bp, Homo sapiens
acaggtgtgcggaaagctgtga

SEQ ID NO: 7004512 - DNA, 22 bp, Homo sapiens
atgcaatgttacagaatgtact

SEQ ID NO: 7004513 - DNA, 22 bp, Homo sapiens
tttcaaatggatccctcagcct

SEQ ID NO: 7004514 - DNA, 22 bp, Homo sapiens
agctttcagttactaatgaagg

SEQ ID NO: 7004515 - DNA, 22 bp, Homo sapiens
tattgtgagttcagactaaaaa

SEQ ID NO: 7004516 - DNA, 19 bp, Homo sapiens
tctgtggctgtggggagga

SEQ ID NO: 7004517 - DNA, 22 bp, Homo sapiens
tgagcagaagattggaacttac

SEQ ID NO: 7004518 - DNA, 22 bp, Homo sapiens
ataatatcgctcctttttttga

SEQ ID NO: 7004519 - DNA, 22 bp, Homo sapiens
gcattgatctgtatgcattaag

SEQ ID NO: 7004520 - DNA, 23 bp, Homo sapiens
gaggaccaaatatatacatggaa

SEQ ID NO: 7004521 - DNA, 22 bp, Homo sapiens
tcttcaggttaacttgtctttt

SEQ ID NO: 7004522 - DNA, 22 bp, Homo sapiens
gccccttcgtggaagtgcattc

SEQ ID NO: 7004523 - DNA, 22 bp, Homo sapiens
attaggtatgattctcatttca

SEQ ID NO: 7004524 - DNA, 22 bp, Homo sapiens
catgctgtactctgtgtcagaa

SEQ ID NO: 7004525 - DNA, 22 bp, Homo sapiens
accccagcgcatatggtctgcg

SEQ ID NO: 7004526 - DNA, 20 bp, Homo sapiens
ataatttaccctgcaccact

SEQ ID NO: 7004527 - DNA, 22 bp, Homo sapiens
cctggggtcacttgcagccgca

SEQ ID NO: 7004528 - DNA, 22 bp, Homo sapiens
agtggtcctcagcctcggctca

SEQ ID NO: 7004529 - DNA, 22 bp, Homo sapiens
aggaggccatcagttccttcct

SEQ ID NO: 7004530 - DNA, 22 bp, Homo sapiens
atgcgtgcaggggtcctcctgg

SEQ ID NO: 7004531 - DNA, 22 bp, Homo sapiens
caccagctttgcccactgccca

SEQ ID NO: 7004532 - DNA, 22 bp, Homo sapiens
ttcctggtttgcctggaatcca

SEQ ID NO: 7004533 - DNA, 22 bp, Homo sapiens
ccagttcttcttgacacgaaag

SEQ ID NO: 7004534 - DNA, 22 bp, Homo sapiens
tgtttttactgtgatccagaaa

SEQ ID NO: 7004535 - DNA, 21 bp, Homo sapiens
acacaggcagtgtcccgaggt

SEQ ID NO: 7004536 - DNA, 22 bp, Homo sapiens
ttgtctctcattcctgcaactc

SEQ ID NO: 7004537 - DNA, 22 bp, Homo sapiens
aagagcagattcctagtggagc

SEQ ID NO: 7004538 - DNA, 22 bp, Homo sapiens
aatagctcactgatttctcttt

SEQ ID NO: 7004539 - DNA, 22 bp, Homo sapiens
acagtaagggtaaataagaaca

SEQ ID NO: 7004540 - DNA, 22 bp, Homo sapiens
ttcacattgttttaatgtgaat

SEQ ID NO: 7004541 - DNA, 22 bp, Homo sapiens
aatcacttcagtttttggacag

SEQ ID NO: 7004542 - DNA, 22 bp, Homo sapiens
tgcttctgctttacttggttca

SEQ ID NO: 7004543 - DNA, 22 bp, Homo sapiens
gaatgctgtagacagactctat

SEQ ID NO: 7004544 - DNA, 21 bp, Homo sapiens
tcaaatcaggtatcactattg

SEQ ID NO: 7004545 - DNA, 19 bp, Homo sapiens
tctgagctgatatgacatt

SEQ ID NO: 7004546 - DNA, 22 bp, Homo sapiens
atgggacagggctggctggtcc

SEQ ID NO: 7004547 - DNA, 22 bp, Homo sapiens
ggagggtgggtcattcttacat

SEQ ID NO: 7004548 - DNA, 22 bp, Homo sapiens
tcacccagggtgtttggtgtct

SEQ ID NO: 7004549 - DNA, 22 bp, Homo sapiens
tccagctctgcttcacagtctc

SEQ ID NO: 7004550 - DNA, 22 bp, Homo sapiens
tatgcagagcatgactgtacca

SEQ ID NO: 7004551 - DNA, 22 bp, Homo sapiens
ccagaggggtgggcctggttta

SEQ ID NO: 7004552 - DNA, 22 bp, Homo sapiens
tctggattagatgctttcaaga

SEQ ID NO: 7004553 - DNA, 22 bp, Homo sapiens
tttgtaaaattagggaattcaa

SEQ ID NO: 7004554 - DNA, 22 bp, Homo sapiens
tattcaaagtgcgaggtcaggg

SEQ ID NO: 7004555 - DNA, 22 bp, Homo sapiens
tttagtcatttggatttgatct

SEQ ID NO: 7004556 - DNA, 23 bp, Homo sapiens
tagctgtggcgtaaggctcagct

SEQ ID NO: 7004557 - DNA, 22 bp, Homo sapiens
aaaatgtgcagtttttaagctg

SEQ ID NO: 7004558 - DNA, 17 bp, Homo sapiens
cttatactttacggaag

SEQ ID NO: 7004559 - DNA, 22 bp, Homo sapiens
gcacagtgtaccacagtcccta

SEQ ID NO: 7004560 - DNA, 22 bp, Homo sapiens
tgagttagaggctgtattagtt

SEQ ID NO: 7004561 - DNA, 22 bp, Homo sapiens
ttacagattcaagctctttgaa

SEQ ID NO: 7004562 - DNA, 22 bp, Homo sapiens
tggaggtgacggggcctcgttg

SEQ ID NO: 7004563 - DNA, 18 bp, Homo sapiens
cccacacagcagtagctc

SEQ ID NO: 7004564 - DNA, 22 bp, Homo sapiens
ttcattagcaaggtcttcaagt

SEQ ID NO: 7004565 - DNA, 22 bp, Homo sapiens
actgaggattagcccaggctag

SEQ ID NO: 7004566 - DNA, 22 bp, Homo sapiens
tttggcagaggttgtcaggcca

SEQ ID NO: 7004567 - DNA, 22 bp, Homo sapiens
tatcaccctacataagaaataa

SEQ ID NO: 7004568 - DNA, 22 bp, Homo sapiens
gcatttttgatcccactaggat

SEQ ID NO: 7004569 - DNA, 22 bp, Homo sapiens
gagattctcgagggcttccagc

SEQ ID NO: 7004570 - DNA, 22 bp, Homo sapiens
actttgtaggaaaaagtcacaa

SEQ ID NO: 7004571 - DNA, 22 bp, Homo sapiens
aattgcatatatatgaggccat

SEQ ID NO: 7004572 - DNA, 22 bp, Homo sapiens
tgacagtagtgttagaactgat

SEQ ID NO: 7004573 - DNA, 22 bp, Homo sapiens
gagtcctcagatagaaagtgcg

SEQ ID NO: 7004574 - DNA, 22 bp, Homo sapiens
atctgtcctctctacctttgac

SEQ ID NO: 7004575 - DNA, 22 bp, Homo sapiens
ttcatgaataccccttctgtaa

SEQ ID NO: 7004576 - DNA, 22 bp, Homo sapiens
gtttcatggagagctgaatatt

SEQ ID NO: 7004577 - DNA, 22 bp, Homo sapiens
ggaggatgccaagctgtgcaca

SEQ ID NO: 7004578 - DNA, 22 bp, Homo sapiens
acactccagggagggagggaat

SEQ ID NO: 7004579 - DNA, 22 bp, Homo sapiens
ttgagtgccagatgtgggggat

SEQ ID NO: 7004580 - DNA, 22 bp, Homo sapiens
agggagtccattttagaggtgg

SEQ ID NO: 7004581 - DNA, 22 bp, Homo sapiens
gactactcaaactttctctata

SEQ ID NO: 7004582 - DNA, 22 bp, Homo sapiens
tcatggatggccgggaggtgat

SEQ ID NO: 7004583 - DNA, 22 bp, Homo sapiens
gtcttcttgtgttgcctgtctt

SEQ ID NO: 7004584 - DNA, 22 bp, Homo sapiens
gggttactgcttcaaaaaatta

SEQ ID NO: 7004585 - DNA, 22 bp, Homo sapiens
cagcactatgacatttaattct

SEQ ID NO: 7004586 - DNA, 22 bp, Homo sapiens
ctgtcctgtggtgacaggtaca

SEQ ID NO: 7004587 - DNA, 22 bp, Homo sapiens
gacccacctcaccaagcatgtg

SEQ ID NO: 7004588 - DNA, 22 bp, Homo sapiens
ttggctttcaggctggaaatct

SEQ ID NO: 7004589 - DNA, 22 bp, Homo sapiens
acagtggtgagtgactgatagg

SEQ ID NO: 7004590 - DNA, 22 bp, Homo sapiens
cacaattacttttgcaccaaca

SEQ ID NO: 7004591 - DNA, 22 bp, Homo sapiens
atattgccagcttagtggattc

SEQ ID NO: 7004592 - DNA, 22 bp, Homo sapiens
aaggtgctcacgggctcaggga

SEQ ID NO: 7004593 - DNA, 22 bp, Homo sapiens
atcagaggtgttgaaacatgac

SEQ ID NO: 7004594 - DNA, 22 bp, Homo sapiens
tccttttctctagtaagcttta

SEQ ID NO: 7004595 - DNA, 22 bp, Homo sapiens
agcagatgcgtctgagtgggag

SEQ ID NO: 7004596 - DNA, 22 bp, Homo sapiens
gcctctgcaactccgccttggt

SEQ ID NO: 7004597 - DNA, 22 bp, Homo sapiens
agcaaagtatgtgctgggagct

SEQ ID NO: 7004598 - DNA, 22 bp, Homo sapiens
ttgcactccagcccgagcaaca

SEQ ID NO: 7004599 - DNA, 22 bp, Homo sapiens
gagttatagatggactattatt

SEQ ID NO: 7004600 - DNA, 22 bp, Homo sapiens
taccattattcacatgatcttt

SEQ ID NO: 7004601 - DNA, 22 bp, Homo sapiens
tatcaaaaggagttgaaagggg

SEQ ID NO: 7004602 - DNA, 22 bp, Homo sapiens
tcagctgtaggtatggatgtcc

SEQ ID NO: 7004603 - DNA, 22 bp, Homo sapiens
atagtcttagatcagataaagt

SEQ ID NO: 7004604 - DNA, 23 bp, Homo sapiens
atcccttctccagtgtggtgagg

SEQ ID NO: 7004605 - DNA, 17 bp, Homo sapiens
ggctgcaaaggctctgg

SEQ ID NO: 7004606 - DNA, 22 bp, Homo sapiens
gacatcatagggtgggaggaaa

SEQ ID NO: 7004607 - DNA, 22 bp, Homo sapiens
gggttcttatagtatcagagct

SEQ ID NO: 7004608 - DNA, 22 bp, Homo sapiens
gtaaacaacacaaatcatttga

SEQ ID NO: 7004609 - DNA, 22 bp, Homo sapiens
ttttttccagcttctagaggcc

SEQ ID NO: 7004610 - DNA, 21 bp, Homo sapiens
gtgcacagtcctgcacacagg

SEQ ID NO: 7004611 - DNA, 22 bp, Homo sapiens
gcccactgagtgactccctcag

SEQ ID NO: 7004612 - DNA, 20 bp, Homo sapiens
gctctgtggtttgagtctcc

SEQ ID NO: 7004613 - DNA, 22 bp, Homo sapiens
tagctatttgagcatattccag

SEQ ID NO: 7004614 - DNA, 20 bp, Homo sapiens
caggcagtttgtggttaggg

SEQ ID NO: 7004615 - DNA, 22 bp, Homo sapiens
tgtgtgcatgttaatgagaaaa

SEQ ID NO: 7004616 - DNA, 22 bp, Homo sapiens
ctgccctgggatggtctgtgcg

SEQ ID NO: 7004617 - DNA, 22 bp, Homo sapiens
ccaggtaccagtcaaatctgta

SEQ ID NO: 7004618 - DNA, 22 bp, Homo sapiens
catgctaagtcataaaagagta

SEQ ID NO: 7004619 - DNA, 22 bp, Homo sapiens
gaggcagcaggctgaggaggat

SEQ ID NO: 7004620 - DNA, 20 bp, Homo sapiens
agggcctgttgcaagcgttt

SEQ ID NO: 7004621 - DNA, 22 bp, Homo sapiens
taggtgaggttacaagagttca

SEQ ID NO: 7004622 - DNA, 17 bp, Homo sapiens
gcttgggctgcctgttg

SEQ ID NO: 7004623 - DNA, 22 bp, Homo sapiens
tgaaagagtttgacatgattct

SEQ ID NO: 7004624 - DNA, 22 bp, Homo sapiens
agttgaaaattaagtgaatttc

SEQ ID NO: 7004625 - DNA, 22 bp, Homo sapiens
gagtctctgaccagggtgccaa

SEQ ID NO: 7004626 - DNA, 20 bp, Homo sapiens
ctcagtaaaagcacagggtc

SEQ ID NO: 7004627 - DNA, 22 bp, Homo sapiens
tggctctttctagacttaatta

SEQ ID NO: 7004628 - DNA, 22 bp, Homo sapiens
actgtacacacttctctgtctt

SEQ ID NO: 7004629 - DNA, 22 bp, Homo sapiens
agggaacatttgcactgttggt

SEQ ID NO: 7004630 - DNA, 22 bp, Homo sapiens
agcaatgtgacccctgacagca

SEQ ID NO: 7004631 - DNA, 22 bp, Homo sapiens
cgaggcggcggaagtgcccgta

SEQ ID NO: 7004632 - DNA, 22 bp, Homo sapiens
ttccaagaagtcaacaggtagt

SEQ ID NO: 7004633 - DNA, 22 bp, Homo sapiens
cagcttctgctatcgaacatct

SEQ ID NO: 7004634 - DNA, 22 bp, Homo sapiens
tcctgaataaattagctgtcac

SEQ ID NO: 7004635 - DNA, 22 bp, Homo sapiens
cagcacttggtgccattgagtg

SEQ ID NO: 7004636 - DNA, 23 bp, Homo sapiens
aagatacaggtgtggaatggttt

SEQ ID NO: 7004637 - DNA, 22 bp, Homo sapiens
acattgctgcattctccttccc

SEQ ID NO: 7004638 - DNA, 22 bp, Homo sapiens
tatttcactcagtataccatag

SEQ ID NO: 7004639 - DNA, 22 bp, Homo sapiens
atgttttcctgggagagcactc

SEQ ID NO: 7004640 - DNA, 22 bp, Homo sapiens
ttacagatggggttgcaataaa

SEQ ID NO: 7004641 - DNA, 20 bp, Homo sapiens
gtgctgagtgtctaactcct

SEQ ID NO: 7004642 - DNA, 22 bp, Homo sapiens
atgaggcaggatattaactttt

SEQ ID NO: 7004643 - DNA, 22 bp, Homo sapiens
tgatgaggtggattcaaagcag

SEQ ID NO: 7004644 - DNA, 22 bp, Homo sapiens
gaggccttcagaaggcattagt

SEQ ID NO: 7004645 - DNA, 22 bp, Homo sapiens
tgttggaaaggccaggctgtgg

SEQ ID NO: 7004646 - DNA, 22 bp, Homo sapiens
agccattgttgtcttcatcttc

SEQ ID NO: 7004647 - DNA, 22 bp, Homo sapiens
agcatctctaaatccagtaagt

SEQ ID NO: 7004648 - DNA, 22 bp, Homo sapiens
agatgtctcccatggttttgac

SEQ ID NO: 7004649 - DNA, 22 bp, Homo sapiens
tgcaagaggtaaaatgaaagga

SEQ ID NO: 7004650 - DNA, 22 bp, Homo sapiens
tagtacagtttactttcagcgc

SEQ ID NO: 7004651 - DNA, 22 bp, Homo sapiens
cagagtgagggcctgcacctgc

SEQ ID NO: 7004652 - DNA, 22 bp, Homo sapiens
gggtgttgattttacactaaaa

SEQ ID NO: 7004653 - DNA, 22 bp, Homo sapiens
tttatagtagcatgatttatag

SEQ ID NO: 7004654 - DNA, 22 bp, Homo sapiens
gaaggcttcctggaggaggtgg

SEQ ID NO: 7004655 - DNA, 22 bp, Homo sapiens
gtggaagcctactcttgtggtt

SEQ ID NO: 7004656 - DNA, 22 bp, Homo sapiens
atttggtttcaggattctcagg

SEQ ID NO: 7004657 - DNA, 22 bp, Homo sapiens
ttctgcataggctatatttgtt

SEQ ID NO: 7004658 - DNA, 23 bp, Homo sapiens
ggggaaagaccatgcttgaggac

SEQ ID NO: 7004659 - DNA, 22 bp, Homo sapiens
ccaacaacatagggctagttgg

SEQ ID NO: 7004660 - DNA, 20 bp, Homo sapiens
agaagctgatactgatggaa

SEQ ID NO: 7004661 - DNA, 22 bp, Homo sapiens
tgggaagggtcaacagctggaa

SEQ ID NO: 7004662 - DNA, 22 bp, Homo sapiens
ggcgggaggctgaggagttggt

SEQ ID NO: 7004663 - DNA, 23 bp, Homo sapiens
tttcagcattctagttcaggttc

SEQ ID NO: 7004664 - DNA, 22 bp, Homo sapiens
tacattcatatgtgtgcataca

SEQ ID NO: 7004665 - DNA, 22 bp, Homo sapiens
agaggctctaatcccctccaca

SEQ ID NO: 7004666 - DNA, 22 bp, Homo sapiens
gtccacagagggctgggcaggc

SEQ ID NO: 7004667 - DNA, 20 bp, Homo sapiens
aggaggaagaaagcacactg

SEQ ID NO: 7004668 - DNA, 22 bp, Homo sapiens
cagcagtaactcccgtgcagca

SEQ ID NO: 7004669 - DNA, 22 bp, Homo sapiens
agggtcaaatgggcaggaagag

SEQ ID NO: 7004670 - DNA, 22 bp, Homo sapiens
tacagtggaaaactcagtgtgt

SEQ ID NO: 7004671 - DNA, 22 bp, Homo sapiens
gggcactgctttgctctgtcac

SEQ ID NO: 7004672 - DNA, 22 bp, Homo sapiens
tcagggaaaagtcacactgggt

SEQ ID NO: 7004673 - DNA, 22 bp, Homo sapiens
gaggcagtgaacaattcctgtg

SEQ ID NO: 7004674 - DNA, 22 bp, Homo sapiens
agaccaagaaaggatgaggatc

SEQ ID NO: 7004675 - DNA, 22 bp, Homo sapiens
caaaggttggaaatgtttacca

SEQ ID NO: 7004676 - DNA, 22 bp, Homo sapiens
tttcccatggcagaagccctgt

SEQ ID NO: 7004677 - DNA, 22 bp, Homo sapiens
agttggagtgaacatgagattg

SEQ ID NO: 7004678 - DNA, 22 bp, Homo sapiens
tcagaaaggttgagtcatgtgc

SEQ ID NO: 7004679 - DNA, 22 bp, Homo sapiens
gaaagctaaatgaggtcttaca

SEQ ID NO: 7004680 - DNA, 22 bp, Homo sapiens
cttctggaggctccagggaggt

SEQ ID NO: 7004681 - DNA, 22 bp, Homo sapiens
agagctggaagctgctcttaga

SEQ ID NO: 7004682 - DNA, 22 bp, Homo sapiens
acaggcagttgaggtttgtgtg

SEQ ID NO: 7004683 - DNA, 22 bp, Homo sapiens
taaagctagaattgttccagca

SEQ ID NO: 7004684 - DNA, 22 bp, Homo sapiens
catgaacaccaggcatgaacaa

SEQ ID NO: 7004685 - DNA, 22 bp, Homo sapiens
gagttgaagaaatagttttgat

SEQ ID NO: 7004686 - DNA, 22 bp, Homo sapiens
ctttgcaaaagttaattgttga

SEQ ID NO: 7004687 - DNA, 22 bp, Homo sapiens
tctctgagttcctgtggatttt

SEQ ID NO: 7004688 - DNA, 22 bp, Homo sapiens
atgaggacaaagtgtagcagcc

SEQ ID NO: 7004689 - DNA, 22 bp, Homo sapiens
taggatgactgatagtgattcc

SEQ ID NO: 7004690 - DNA, 22 bp, Homo sapiens
ctgcagcttaagggaggggttg

SEQ ID NO: 7004691 - DNA, 22 bp, Homo sapiens
aaccctgggaggcagctcagtt

SEQ ID NO: 7004692 - DNA, 22 bp, Homo sapiens
ggagtgcaatggcttgatcttg

SEQ ID NO: 7004693 - DNA, 22 bp, Homo sapiens
ttcaagttttatattgaagcaa

SEQ ID NO: 7004694 - DNA, 22 bp, Homo sapiens
caggctcttccatcctgctgag

SEQ ID NO: 7004695 - DNA, 22 bp, Homo sapiens
agctgcctgcttatgagctcca

SEQ ID NO: 7004696 - DNA, 22 bp, Homo sapiens
taacatccacattagatgattc

SEQ ID NO: 7004697 - DNA, 22 bp, Homo sapiens
gcggtaggagagacagaagtta

SEQ ID NO: 7004698 - DNA, 22 bp, Homo sapiens
ggtctgagcttgagcccatgct

SEQ ID NO: 7004699 - DNA, 22 bp, Homo sapiens
tctgggctgaaatgaaggcctt

SEQ ID NO: 7004700 - DNA, 22 bp, Homo sapiens
attgtataatcagttactggaa

SEQ ID NO: 7004701 - DNA, 22 bp, Homo sapiens
atggaaatgttccatatattga

SEQ ID NO: 7004702 - DNA, 22 bp, Homo sapiens
cctggggccccgagccagaagc

SEQ ID NO: 7004703 - DNA, 20 bp, Homo sapiens
tggctcctcttggctgtggc

SEQ ID NO: 7004704 - DNA, 22 bp, Homo sapiens
atggtgttgagtctctcttcac

SEQ ID NO: 7004705 - DNA, 22 bp, Homo sapiens
tctctgggttgagaactaggac

SEQ ID NO: 7004706 - DNA, 18 bp, Homo sapiens
gaggtagataagattttc

SEQ ID NO: 7004707 - DNA, 22 bp, Homo sapiens
tccatgggaagattttgagtgg

SEQ ID NO: 7004708 - DNA, 20 bp, Homo sapiens
tttatagtgatcaatttata

SEQ ID NO: 7004709 - DNA, 19 bp, Homo sapiens
tgagctgctgctgcccatc

SEQ ID NO: 7004710 - DNA, 21 bp, Homo sapiens
ccagatgcaaatgcagacatt

SEQ ID NO: 7004711 - DNA, 22 bp, Homo sapiens
atctgttcccctatgctctcta

SEQ ID NO: 7004712 - DNA, 22 bp, Homo sapiens
tggaaggcaggacctgccttgg

SEQ ID NO: 7004713 - DNA, 22 bp, Homo sapiens
acagcagtcttaacacattgca

SEQ ID NO: 7004714 - DNA, 22 bp, Homo sapiens
tgagccaggtctcactcacctt

SEQ ID NO: 7004715 - DNA, 22 bp, Homo sapiens
cagatgtttgtctatatgcttt

SEQ ID NO: 7004716 - DNA, 22 bp, Homo sapiens
caggcgggacgtgggaggatca

SEQ ID NO: 7004717 - DNA, 22 bp, Homo sapiens
cttcttgcaattttcatcttat

SEQ ID NO: 7004718 - DNA, 20 bp, Homo sapiens
tgtgaggagcatggccgctg

SEQ ID NO: 7004719 - DNA, 22 bp, Homo sapiens
tagatgtttccttccatgtgga

SEQ ID NO: 7004720 - DNA, 22 bp, Homo sapiens
ggagtaggagtagaactcatca

SEQ ID NO: 7004721 - DNA, 21 bp, Homo sapiens
aagtccaatacctaaggctcc

SEQ ID NO: 7004722 - DNA, 22 bp, Homo sapiens
caaggccaagtctctgtgaaga

SEQ ID NO: 7004723 - DNA, 22 bp, Homo sapiens
agatacagcttttttgtcagtc

SEQ ID NO: 7004724 - DNA, 21 bp, Homo sapiens
aatcaaatgtcatatccccag

SEQ ID NO: 7004725 - DNA, 22 bp, Homo sapiens
tgacacaagagccctgtttgct

SEQ ID NO: 7004726 - DNA, 22 bp, Homo sapiens
gcactgcagcctcagatggtgg

SEQ ID NO: 7004727 - DNA, 22 bp, Homo sapiens
caagacttagagcatcttgaaa

SEQ ID NO: 7004728 - DNA, 22 bp, Homo sapiens
gctaagaggagcctccttctga

SEQ ID NO: 7004729 - DNA, 21 bp, Homo sapiens
ccataaacagatggtaactgt

SEQ ID NO: 7004730 - DNA, 22 bp, Homo sapiens
gcggaggtgaggaagtggggca

SEQ ID NO: 7004731 - DNA, 22 bp, Homo sapiens
cacattatgctactaccaaatg

SEQ ID NO: 7004732 - DNA, 22 bp, Homo sapiens
tcaaggactattgcatgactcc

SEQ ID NO: 7004733 - DNA, 22 bp, Homo sapiens
acatggctaaagcaagtctaga

SEQ ID NO: 7004734 - DNA, 22 bp, Homo sapiens
tgccagaagtgctttataagtg

SEQ ID NO: 7004735 - DNA, 17 bp, Homo sapiens
tggctttcctgacacag

SEQ ID NO: 7004736 - DNA, 22 bp, Homo sapiens
acctctgccaagatgtgctccc

SEQ ID NO: 7004737 - DNA, 22 bp, Homo sapiens
gtttccagctcttagcaaaggc

SEQ ID NO: 7004738 - DNA, 22 bp, Homo sapiens
ctaattctgtatttggtcattg

SEQ ID NO: 7004739 - DNA, 20 bp, Homo sapiens
gacaggtgctaaagaggggc

SEQ ID NO: 7004740 - DNA, 22 bp, Homo sapiens
ccaggctttaagaggtggaaac

SEQ ID NO: 7004741 - DNA, 22 bp, Homo sapiens
ttgccagtttccctggatgtgt

SEQ ID NO: 7004742 - DNA, 22 bp, Homo sapiens
aaatagattgctgaggcattac

SEQ ID NO: 7004743 - DNA, 22 bp, Homo sapiens
tcctctgaaggttccgagggag

SEQ ID NO: 7004744 - DNA, 21 bp, Homo sapiens
gtctttctacctctatgtggc

SEQ ID NO: 7004745 - DNA, 22 bp, Homo sapiens
gagatgcagaaccctcaggagc

SEQ ID NO: 7004746 - DNA, 22 bp, Homo sapiens
agggtaatagcaaacaaaaggt

SEQ ID NO: 7004747 - DNA, 22 bp, Homo sapiens
tggcagttggggatgaagtgag

SEQ ID NO: 7004748 - DNA, 23 bp, Homo sapiens
tcatcaaacagctgctcaagaaa

SEQ ID NO: 7004749 - DNA, 22 bp, Homo sapiens
actaaacacatgagattcctgc

SEQ ID NO: 7004750 - DNA, 22 bp, Homo sapiens
agccagagatccatccctagga

SEQ ID NO: 7004751 - DNA, 23 bp, Homo sapiens
tccctcaggccttatctccatct

SEQ ID NO: 7004752 - DNA, 22 bp, Homo sapiens
gtgaacaaaatagcacatatta

SEQ ID NO: 7004753 - DNA, 22 bp, Homo sapiens
tctctcaccctggaaaagccaa

SEQ ID NO: 7004754 - DNA, 22 bp, Homo sapiens
aaaatcttgtgacttaggaagg

SEQ ID NO: 7004755 - DNA, 22 bp, Homo sapiens
ccctgtgacagtatctgcttga

SEQ ID NO: 7004756 - DNA, 22 bp, Homo sapiens
ccacccacaaccagctggctgt

SEQ ID NO: 7004757 - DNA, 22 bp, Homo sapiens
acaggtaccggtcagattacgg

SEQ ID NO: 7004758 - DNA, 22 bp, Homo sapiens
ttaaagatgcagctttagagaa

SEQ ID NO: 7004759 - DNA, 22 bp, Homo sapiens
atgtgtatatttggtgtcaata

SEQ ID NO: 7004760 - DNA, 22 bp, Homo sapiens
gacccagggtatccagagctgc

SEQ ID NO: 7004761 - DNA, 22 bp, Homo sapiens
ttctgttttagaaataagtagt

SEQ ID NO: 7004762 - DNA, 22 bp, Homo sapiens
caggctcaagccctgcttatat

SEQ ID NO: 7004763 - DNA, 22 bp, Homo sapiens
ttaagagacaggagaatgatgt

SEQ ID NO: 7004764 - DNA, 22 bp, Homo sapiens
aacaactgctaaggtgtgtcct

SEQ ID NO: 7004765 - DNA, 22 bp, Homo sapiens
gtctctgacctgcgtccctcct

SEQ ID NO: 7004766 - DNA, 22 bp, Homo sapiens
tatgctttaacattaaacaaca

SEQ ID NO: 7004767 - DNA, 22 bp, Homo sapiens
tcatataactggatattttcaa

SEQ ID NO: 7004768 - DNA, 22 bp, Homo sapiens
tctggagtaattacagtgactg

SEQ ID NO: 7004769 - DNA, 22 bp, Homo sapiens
gacactggcttgtcccgccatc

SEQ ID NO: 7004770 - DNA, 23 bp, Homo sapiens
ttccagagtcttcgacggtaggc

SEQ ID NO: 7004771 - DNA, 22 bp, Homo sapiens
acgatcagcttagtctaccatg

SEQ ID NO: 7004772 - DNA, 22 bp, Homo sapiens
actttttgcatagtaagtgtct

SEQ ID NO: 7004773 - DNA, 23 bp, Homo sapiens
tggcagcagatcttaaagtgacc

SEQ ID NO: 7004774 - DNA, 22 bp, Homo sapiens
ttgacatgtagtatagttgcat

SEQ ID NO: 7004775 - DNA, 22 bp, Homo sapiens
agcttctcctggtacagaactg

SEQ ID NO: 7004776 - DNA, 21 bp, Homo sapiens
gatgatgccatcctccatctc

SEQ ID NO: 7004777 - DNA, 22 bp, Homo sapiens
cagggcataagatgaggctgta

SEQ ID NO: 7004778 - DNA, 22 bp, Homo sapiens
cagttcatagtcttcatgtctc

SEQ ID NO: 7004779 - DNA, 22 bp, Homo sapiens
gtgaggtccatgttaatgggtt

SEQ ID NO: 7004780 - DNA, 22 bp, Homo sapiens
gaggcctggtgctgtgtccaca

SEQ ID NO: 7004781 - DNA, 22 bp, Homo sapiens
ctgctacttccagaagtgtcga

SEQ ID NO: 7004782 - DNA, 22 bp, Homo sapiens
gataaacattcttgcacatgtg

SEQ ID NO: 7004783 - DNA, 22 bp, Homo sapiens
aaaggctggaaactgaagataa

SEQ ID NO: 7004784 - DNA, 22 bp, Homo sapiens
tgctgaatgctgcatgccgtat

SEQ ID NO: 7004785 - DNA, 22 bp, Homo sapiens
acaaccatgtcagttcaaacca

SEQ ID NO: 7004786 - DNA, 22 bp, Homo sapiens
attcagtcaaaaatgatggaga

SEQ ID NO: 7004787 - DNA, 22 bp, Homo sapiens
tgattgttttagttccctgatg

SEQ ID NO: 7004788 - DNA, 22 bp, Homo sapiens
aaatgaacagttgcattctctg

SEQ ID NO: 7004789 - DNA, 22 bp, Homo sapiens
taggcttggctttagtttctgt

SEQ ID NO: 7004790 - DNA, 22 bp, Homo sapiens
tcaggatcaggggcctttcctt

SEQ ID NO: 7004791 - DNA, 22 bp, Homo sapiens
tagggagatgcaagggacggag

SEQ ID NO: 7004792 - DNA, 22 bp, Homo sapiens
aactgaaatcaatcagtgattc

SEQ ID NO: 7004793 - DNA, 22 bp, Homo sapiens
caggtgttgatactaatcgtgg

SEQ ID NO: 7004794 - DNA, 22 bp, Homo sapiens
ggctccctggaaatcccgaggc

SEQ ID NO: 7004795 - DNA, 22 bp, Homo sapiens
gctgttctttgcatctctggtg

SEQ ID NO: 7004796 - DNA, 21 bp, Homo sapiens
agctgcctccacttctgaggc

SEQ ID NO: 7004797 - DNA, 22 bp, Homo sapiens
ttgattctagaatcttccctct

SEQ ID NO: 7004798 - DNA, 22 bp, Homo sapiens
aaagtggcgaagctgagtttta

SEQ ID NO: 7004799 - DNA, 22 bp, Homo sapiens
ttgtgtgtgtaactttatgaga

SEQ ID NO: 7004800 - DNA, 22 bp, Homo sapiens
attgaagagttgattattatct

SEQ ID NO: 7004801 - DNA, 22 bp, Homo sapiens
agccagctttcacaaatgaaga

SEQ ID NO: 7004802 - DNA, 22 bp, Homo sapiens
atttgaagaaagttttctagat

SEQ ID NO: 7004803 - DNA, 22 bp, Homo sapiens
ccacatctggtggccagtgcta

SEQ ID NO: 7004804 - DNA, 22 bp, Homo sapiens
aggtcagctagacagctctctg

SEQ ID NO: 7004805 - DNA, 22 bp, Homo sapiens
tggcaagctgggttgggtagcc

SEQ ID NO: 7004806 - DNA, 22 bp, Homo sapiens
agacagcatttcccggaaccgc

SEQ ID NO: 7004807 - DNA, 19 bp, Homo sapiens
gtaatatgtgctgagtcct

SEQ ID NO: 7004808 - DNA, 22 bp, Homo sapiens
aactctggagcacgccctggcc

SEQ ID NO: 7004809 - DNA, 22 bp, Homo sapiens
cagggacattggtggccaggtt

SEQ ID NO: 7004810 - DNA, 22 bp, Homo sapiens
agtggcaattgacaacaaagga

SEQ ID NO: 7004811 - DNA, 20 bp, Homo sapiens
ccagatgtttacattcatac

SEQ ID NO: 7004812 - DNA, 22 bp, Homo sapiens
tgatttctctccgttatttcag

SEQ ID NO: 7004813 - DNA, 22 bp, Homo sapiens
atgggctggcctttcccgctct

SEQ ID NO: 7004814 - DNA, 22 bp, Homo sapiens
gtctccccagggccctcttcat

SEQ ID NO: 7004815 - DNA, 22 bp, Homo sapiens
tgagcaagacccggcctctgcc

SEQ ID NO: 7004816 - DNA, 22 bp, Homo sapiens
aggtggcagccgagacataagg

SEQ ID NO: 7004817 - DNA, 22 bp, Homo sapiens
ggtgcaaacgtaattgtggttt

SEQ ID NO: 7004818 - DNA, 22 bp, Homo sapiens
ggctatgtctcataaatcgctg

SEQ ID NO: 7004819 - DNA, 22 bp, Homo sapiens
agagattagcctggattatgca

SEQ ID NO: 7004820 - DNA, 22 bp, Homo sapiens
ctcttgcatgagatccaggagt

SEQ ID NO: 7004821 - DNA, 21 bp, Homo sapiens
gggtggtctagctcaggaact

SEQ ID NO: 7004822 - DNA, 22 bp, Homo sapiens
gacagaagaggaacttggacag

SEQ ID NO: 7004823 - DNA, 22 bp, Homo sapiens
cgctccaagcttgatgggacca

SEQ ID NO: 7004824 - DNA, 22 bp, Homo sapiens
cagtgtatcattagtgtgatga

SEQ ID NO: 7004825 - DNA, 22 bp, Homo sapiens
tctgtgtgggatagtttgagga

SEQ ID NO: 7004826 - DNA, 22 bp, Homo sapiens
agaggctcttgcccttcccaca

SEQ ID NO: 7004827 - DNA, 22 bp, Homo sapiens
tttggtttattaaattgtaggc

SEQ ID NO: 7004828 - DNA, 22 bp, Homo sapiens
atctgtccagtcatctcgggat

SEQ ID NO: 7004829 - DNA, 17 bp, Homo sapiens
tagaaatcatagggttg

SEQ ID NO: 7004830 - DNA, 22 bp, Homo sapiens
tcagcactttttaaagcagcat

SEQ ID NO: 7004831 - DNA, 22 bp, Homo sapiens
gagatataagatctagaaagga

SEQ ID NO: 7004832 - DNA, 22 bp, Homo sapiens
tgtttattttcaggatggattg

SEQ ID NO: 7004833 - DNA, 22 bp, Homo sapiens
aagctacaatgtgtttttgaaa

SEQ ID NO: 7004834 - DNA, 22 bp, Homo sapiens
acctttatgtttgattacaatt

SEQ ID NO: 7004835 - DNA, 20 bp, Homo sapiens
gggtacagatatgcagtgaa

SEQ ID NO: 7004836 - DNA, 22 bp, Homo sapiens
ctcttgcattctatccctccag

SEQ ID NO: 7004837 - DNA, 22 bp, Homo sapiens
tgtgtcaagacatttagtcatt

SEQ ID NO: 7004838 - DNA, 22 bp, Homo sapiens
acagatgaggaaacagggtcag

SEQ ID NO: 7004839 - DNA, 22 bp, Homo sapiens
ttgaggtatattcacatatatc

SEQ ID NO: 7004840 - DNA, 22 bp, Homo sapiens
tcagaggaaagggaacatagtc

SEQ ID NO: 7004841 - DNA, 22 bp, Homo sapiens
cagaaagctctttcaatcttgc

SEQ ID NO: 7004842 - DNA, 22 bp, Homo sapiens
atccaacaggacaaagaaagga

SEQ ID NO: 7004843 - DNA, 22 bp, Homo sapiens
tgccactggacccagaactctt

SEQ ID NO: 7004844 - DNA, 22 bp, Homo sapiens
gtggatgattgactctgtagac

SEQ ID NO: 7004845 - DNA, 22 bp, Homo sapiens
gcagaggcagggccctcctcca

SEQ ID NO: 7004846 - DNA, 22 bp, Homo sapiens
taggctttggaggattaagggg

SEQ ID NO: 7004847 - DNA, 22 bp, Homo sapiens
caggagatgtacctgtttttga

SEQ ID NO: 7004848 - DNA, 19 bp, Homo sapiens
cctgctgcaccacttgtta

SEQ ID NO: 7004849 - DNA, 22 bp, Homo sapiens
gggggccagtgtctcttccttg

SEQ ID NO: 7004850 - DNA, 20 bp, Homo sapiens
tcaggcagtggggaaaggca

SEQ ID NO: 7004851 - DNA, 22 bp, Homo sapiens
agaccccctttaatggaagtgc

SEQ ID NO: 7004852 - DNA, 21 bp, Homo sapiens
cttttctctccgcaggacatt

SEQ ID NO: 7004853 - DNA, 22 bp, Homo sapiens
gaggccacagtcctgaggcatc

SEQ ID NO: 7004854 - DNA, 22 bp, Homo sapiens
gccttgggattcttggatgctc

SEQ ID NO: 7004855 - DNA, 22 bp, Homo sapiens
ctggagttcttgttttgcctac

SEQ ID NO: 7004856 - DNA, 22 bp, Homo sapiens
agcctgggggcgcagaaaccgg

SEQ ID NO: 7004857 - DNA, 22 bp, Homo sapiens
tgcagatgaatgctgagacact

SEQ ID NO: 7004858 - DNA, 22 bp, Homo sapiens
gaaggctgtcagagaggagggc

SEQ ID NO: 7004859 - DNA, 22 bp, Homo sapiens
agcagtgggtggtttttgagca

SEQ ID NO: 7004860 - DNA, 23 bp, Homo sapiens
gagttgggtgctgaacgaccata

SEQ ID NO: 7004861 - DNA, 22 bp, Homo sapiens
ggaggctgagaggtcgcagtgg

SEQ ID NO: 7004862 - DNA, 22 bp, Homo sapiens
ttctggagctctcgaccccact

SEQ ID NO: 7004863 - DNA, 22 bp, Homo sapiens
acaactgtcttcttcatgctcc

SEQ ID NO: 7004864 - DNA, 22 bp, Homo sapiens
tgggcagagtagctcagaagaa

SEQ ID NO: 7004865 - DNA, 22 bp, Homo sapiens
atttgtgggactataatgcagg

SEQ ID NO: 7004866 - DNA, 22 bp, Homo sapiens
ctgggcctggtgtggcacctgc

SEQ ID NO: 7004867 - DNA, 22 bp, Homo sapiens
ccagagccagagaggtgcctgc

SEQ ID NO: 7004868 - DNA, 22 bp, Homo sapiens
gggtccaggtttagtcatttgt

SEQ ID NO: 7004869 - DNA, 22 bp, Homo sapiens
tccaacatttatcaaggttgtt

SEQ ID NO: 7004870 - DNA, 22 bp, Homo sapiens
ccttttttctatgccaactctg

SEQ ID NO: 7004871 - DNA, 20 bp, Homo sapiens
aagaagccgggaaggcaggc

SEQ ID NO: 7004872 - DNA, 22 bp, Homo sapiens
tgtcatgggcatttattgaggg

SEQ ID NO: 7004873 - DNA, 18 bp, Homo sapiens
ctcagagatgcccttatt

SEQ ID NO: 7004874 - DNA, 23 bp, Homo sapiens
acctggctgctcaacctgcaggg

SEQ ID NO: 7004875 - DNA, 22 bp, Homo sapiens
aactgaaacttaggaagtaatc

SEQ ID NO: 7004876 - DNA, 22 bp, Homo sapiens
gctgtggccgtcagggaaatgg

SEQ ID NO: 7004877 - DNA, 22 bp, Homo sapiens
ttccagtgatatattagtgcaa

SEQ ID NO: 7004878 - DNA, 18 bp, Homo sapiens
gctcaggtatagacaggg

SEQ ID NO: 7004879 - DNA, 22 bp, Homo sapiens
gaggagaagggcacggagaaaa

SEQ ID NO: 7004880 - DNA, 22 bp, Homo sapiens
ggagtgctccgcgagagggatg

SEQ ID NO: 7004881 - DNA, 18 bp, Homo sapiens
gatggggtccaggcatag

SEQ ID NO: 7004882 - DNA, 22 bp, Homo sapiens
atgtcaaatcagttttatcaga

SEQ ID NO: 7004883 - DNA, 22 bp, Homo sapiens
aagatgtgtctcatcagggtgt

SEQ ID NO: 7004884 - DNA, 22 bp, Homo sapiens
catgtataggtccatagtgaat

SEQ ID NO: 7004885 - DNA, 22 bp, Homo sapiens
ttatatgagtatcatatcactt

SEQ ID NO: 7004886 - DNA, 22 bp, Homo sapiens
tctaaactacgtcaaaactagt

SEQ ID NO: 7004887 - DNA, 22 bp, Homo sapiens
gctcaatcctagaggctcaggg

SEQ ID NO: 7004888 - DNA, 22 bp, Homo sapiens
tgaaatggaggttttttctctc

SEQ ID NO: 7004889 - DNA, 22 bp, Homo sapiens
tgaatttatattgctgagagtt

SEQ ID NO: 7004890 - DNA, 19 bp, Homo sapiens
actcaggcaatgagaaaca

SEQ ID NO: 7004891 - DNA, 22 bp, Homo sapiens
ggcttcctggagaaggtctgag

SEQ ID NO: 7004892 - DNA, 22 bp, Homo sapiens
agagattggggatgaatctttc

SEQ ID NO: 7004893 - DNA, 22 bp, Homo sapiens
ttctgtgcccattttaaaatgg

SEQ ID NO: 7004894 - DNA, 22 bp, Homo sapiens
ctgtgtgtgtctgcagcatact

SEQ ID NO: 7004895 - DNA, 22 bp, Homo sapiens
aggagctgcactgggagttttt

SEQ ID NO: 7004896 - DNA, 19 bp, Homo sapiens
aacatggaactggagaggg

SEQ ID NO: 7004897 - DNA, 22 bp, Homo sapiens
cctcaggcctgccagagcccca

SEQ ID NO: 7004898 - DNA, 22 bp, Homo sapiens
cagtggtgaagagcaggggctc

SEQ ID NO: 7004899 - DNA, 22 bp, Homo sapiens
taacctttgttcaatgtaagat

SEQ ID NO: 7004900 - DNA, 22 bp, Homo sapiens
agtcccatgccaaatgcatcct

SEQ ID NO: 7004901 - DNA, 22 bp, Homo sapiens
gccagttacccacaactactga

SEQ ID NO: 7004902 - DNA, 22 bp, Homo sapiens
ttgtctgaaccatctccctggc

SEQ ID NO: 7004903 - DNA, 22 bp, Homo sapiens
atgggctgaggaagctcctgag

SEQ ID NO: 7004904 - DNA, 22 bp, Homo sapiens
ttacagtgaagattcaggttcc

SEQ ID NO: 7004905 - DNA, 22 bp, Homo sapiens
ctgatggagactccactgtgat

SEQ ID NO: 7004906 - DNA, 22 bp, Homo sapiens
ctctgtgttcagcctagcagaa

SEQ ID NO: 7004907 - DNA, 23 bp, Homo sapiens
gcagccaagagaccagggcaggc

SEQ ID NO: 7004908 - DNA, 23 bp, Homo sapiens
agtagcacatcttgtgtggtttg

SEQ ID NO: 7004909 - DNA, 20 bp, Homo sapiens
cagatggcacgtcagggcat

SEQ ID NO: 7004910 - DNA, 19 bp, Homo sapiens
actggagcctgatggagga

SEQ ID NO: 7004911 - DNA, 22 bp, Homo sapiens
tcattgtttctgcttttcatga

SEQ ID NO: 7004912 - DNA, 22 bp, Homo sapiens
aggcaggattgctgacaacaat

SEQ ID NO: 7004913 - DNA, 22 bp, Homo sapiens
caggaaccatgaagacatatac

SEQ ID NO: 7004914 - DNA, 21 bp, Homo sapiens
tgacaacagaactgggcaagc

SEQ ID NO: 7004915 - DNA, 22 bp, Homo sapiens
gctctggccagaccctcagtgg

SEQ ID NO: 7004916 - DNA, 22 bp, Homo sapiens
tcctgggtcctgggaagccctg

SEQ ID NO: 7004917 - DNA, 22 bp, Homo sapiens
ccaaagtgctaggattacaggt

SEQ ID NO: 7004918 - DNA, 19 bp, Homo sapiens
tctcagaattggcaatcat

SEQ ID NO: 7004919 - DNA, 22 bp, Homo sapiens
gttagtgcttattaaatagtat

SEQ ID NO: 7004920 - DNA, 22 bp, Homo sapiens
aagtgactccattgcgggcaca

SEQ ID NO: 7004921 - DNA, 22 bp, Homo sapiens
tcagctgccccagtggccccag

SEQ ID NO: 7004922 - DNA, 22 bp, Homo sapiens
aaaattatagatctagtgcctg

SEQ ID NO: 7004923 - DNA, 22 bp, Homo sapiens
gtaagattagtgagtcacagtg

SEQ ID NO: 7004924 - DNA, 22 bp, Homo sapiens
tgctgcagctaaggtgaggtgc

SEQ ID NO: 7004925 - DNA, 22 bp, Homo sapiens
cttatgtatgctactttgtggt

SEQ ID NO: 7004926 - DNA, 22 bp, Homo sapiens
tccctgaatctcgaactagcct

SEQ ID NO: 7004927 - DNA, 22 bp, Homo sapiens
ctggagtgaagcttatttttca

SEQ ID NO: 7004928 - DNA, 22 bp, Homo sapiens
ccttccaagtgcttgccgcttt

SEQ ID NO: 7004929 - DNA, 22 bp, Homo sapiens
ggcagctgtctctgagttagca

SEQ ID NO: 7004930 - DNA, 22 bp, Homo sapiens
agtacctggtatatgattatga

SEQ ID NO: 7004931 - DNA, 22 bp, Homo sapiens
aggcggtgtgctttgcagagca

SEQ ID NO: 7004932 - DNA, 22 bp, Homo sapiens
gtgggtgctgtcaggcagggaa

SEQ ID NO: 7004933 - DNA, 20 bp, Homo sapiens
gcctgcctcagctagctgag

SEQ ID NO: 7004934 - DNA, 17 bp, Homo sapiens
ctgctttgtgcaacgct

SEQ ID NO: 7004935 - DNA, 22 bp, Homo sapiens
ttctactaggatgtcttgaaca

SEQ ID NO: 7004936 - DNA, 22 bp, Homo sapiens
tcacaggcctggggcagagggc

SEQ ID NO: 7004937 - DNA, 19 bp, Homo sapiens
gagaggcctgtgcttgaag

SEQ ID NO: 7004938 - DNA, 22 bp, Homo sapiens
aggtccttggttgtctgaagaa

SEQ ID NO: 7004939 - DNA, 22 bp, Homo sapiens
agatgtgagaatcaagtgacca

SEQ ID NO: 7004940 - DNA, 22 bp, Homo sapiens
tattgtcagtgcctgcctcata

SEQ ID NO: 7004941 - DNA, 22 bp, Homo sapiens
gccaccagggggctccagtgag

SEQ ID NO: 7004942 - DNA, 22 bp, Homo sapiens
gggtcaaatgataattgcttct

SEQ ID NO: 7004943 - DNA, 22 bp, Homo sapiens
gaagccatctttgttccccacc

SEQ ID NO: 7004944 - DNA, 22 bp, Homo sapiens
ctgggcagttttacatcattgc

SEQ ID NO: 7004945 - DNA, 22 bp, Homo sapiens
aaacctggacttgtaatgataa

SEQ ID NO: 7004946 - DNA, 23 bp, Homo sapiens
aatgtatgttagtatcttagaga

SEQ ID NO: 7004947 - DNA, 22 bp, Homo sapiens
accagaaaggatgcctccttcc

SEQ ID NO: 7004948 - DNA, 22 bp, Homo sapiens
tccttctgtagtccctgtccct

SEQ ID NO: 7004949 - DNA, 22 bp, Homo sapiens
cacagcttctccttgatatcgc

SEQ ID NO: 7004950 - DNA, 22 bp, Homo sapiens
tggctgtggactcagatggctc

SEQ ID NO: 7004951 - DNA, 22 bp, Homo sapiens
tctattgtccaatctttcacct

SEQ ID NO: 7004952 - DNA, 22 bp, Homo sapiens
ttcacagtggctgacaggctgg

SEQ ID NO: 7004953 - DNA, 22 bp, Homo sapiens
ctgcctcttaagtggatggagt

SEQ ID NO: 7004954 - DNA, 22 bp, Homo sapiens
agagttaggtccagaatgttgc

SEQ ID NO: 7004955 - DNA, 22 bp, Homo sapiens
tattttaggtaatatccattgt

SEQ ID NO: 7004956 - DNA, 22 bp, Homo sapiens
aatgcttaattcaatactgtgt

SEQ ID NO: 7004957 - DNA, 22 bp, Homo sapiens
gccaagaggctcattagcattc

SEQ ID NO: 7004958 - DNA, 22 bp, Homo sapiens
tcaggagagagaaattggggct

SEQ ID NO: 7004959 - DNA, 22 bp, Homo sapiens
gtagaggctcagagagccgcag

SEQ ID NO: 7004960 - DNA, 22 bp, Homo sapiens
cacaggagaggttaatgggggc

SEQ ID NO: 7004961 - DNA, 19 bp, Homo sapiens
agcagcgtttaaaaaatgc

SEQ ID NO: 7004962 - DNA, 22 bp, Homo sapiens
ctcctgggcttcgaaggctccc

SEQ ID NO: 7004963 - DNA, 22 bp, Homo sapiens
cactagaggttgatgagaggtg

SEQ ID NO: 7004964 - DNA, 22 bp, Homo sapiens
caaagaggttttgagggcagct

SEQ ID NO: 7004965 - DNA, 22 bp, Homo sapiens
gcagctttctaagctttattgc

SEQ ID NO: 7004966 - DNA, 20 bp, Homo sapiens
gtttcctatttacctcctca

SEQ ID NO: 7004967 - DNA, 22 bp, Homo sapiens
ggtctggattttgaacaaaatt

SEQ ID NO: 7004968 - DNA, 22 bp, Homo sapiens
gcacctccaggggccgcccacc

SEQ ID NO: 7004969 - DNA, 22 bp, Homo sapiens
caagaatcctgttcttgaagat

SEQ ID NO: 7004970 - DNA, 22 bp, Homo sapiens
tgacagagatggaatgaatctt

SEQ ID NO: 7004971 - DNA, 22 bp, Homo sapiens
cctggctgtttgagcggggaat

SEQ ID NO: 7004972 - DNA, 22 bp, Homo sapiens
tgtagtagcattcacgaagtgt

SEQ ID NO: 7004973 - DNA, 22 bp, Homo sapiens
atgctttcttctttcctgtaag

SEQ ID NO: 7004974 - DNA, 22 bp, Homo sapiens
cttctagagctggagcaaatgt

SEQ ID NO: 7004975 - DNA, 22 bp, Homo sapiens
tgaggacatgagtgggacagag

SEQ ID NO: 7004976 - DNA, 20 bp, Homo sapiens
aagattctgatttgtagcgt

SEQ ID NO: 7004977 - DNA, 22 bp, Homo sapiens
atgacagaggattgtaaagagg

SEQ ID NO: 7004978 - DNA, 22 bp, Homo sapiens
tcagaagactgtcttttccatg

SEQ ID NO: 7004979 - DNA, 22 bp, Homo sapiens
tgctgggcggtgggctcatccc

SEQ ID NO: 7004980 - DNA, 22 bp, Homo sapiens
attaacactttggagtctgctc

SEQ ID NO: 7004981 - DNA, 22 bp, Homo sapiens
gactattacatgctttcaagac

SEQ ID NO: 7004982 - DNA, 22 bp, Homo sapiens
tagagctagcttcaaaatgcga

SEQ ID NO: 7004983 - DNA, 22 bp, Homo sapiens
tggctcaggcttgaaaatagat

SEQ ID NO: 7004984 - DNA, 22 bp, Homo sapiens
agtgcagcaacaaactgccctc

SEQ ID NO: 7004985 - DNA, 22 bp, Homo sapiens
gtatttaattctgtgcttctag

SEQ ID NO: 7004986 - DNA, 22 bp, Homo sapiens
gccctccatggtgatccaggcc

SEQ ID NO: 7004987 - DNA, 22 bp, Homo sapiens
tttccacactgcagccagcaaa

SEQ ID NO: 7004988 - DNA, 22 bp, Homo sapiens
aggctggctgacttctgaagca

SEQ ID NO: 7004989 - DNA, 22 bp, Homo sapiens
ccaggtcttggcccccggacct

SEQ ID NO: 7004990 - DNA, 21 bp, Homo sapiens
ctctttatatagtaaagatat

SEQ ID NO: 7004991 - DNA, 22 bp, Homo sapiens
agaggcttttctggtctttggc

SEQ ID NO: 7004992 - DNA, 19 bp, Homo sapiens
ctgggagttcactgctgcc

SEQ ID NO: 7004993 - DNA, 22 bp, Homo sapiens
ctgacaaaggcaaggcaggggg

SEQ ID NO: 7004994 - DNA, 22 bp, Homo sapiens
tttctaagaaagtaatggttat

SEQ ID NO: 7004995 - DNA, 22 bp, Homo sapiens
ctcaagtctattgataagtgca

SEQ ID NO: 7004996 - DNA, 19 bp, Homo sapiens
ggctttaactcttgtagct

SEQ ID NO: 7004997 - DNA, 22 bp, Homo sapiens
cggaaacttgagaaccagccag

SEQ ID NO: 7004998 - DNA, 20 bp, Homo sapiens
aggtagctttgcatttttgt

SEQ ID NO: 7004999 - DNA, 22 bp, Homo sapiens
cctgtgtttctgttggaattaa

SEQ ID NO: 7005000 - DNA, 22 bp, Homo sapiens
aataactggcacatatcacata

SEQ ID NO: 7005001 - DNA, 22 bp, Homo sapiens
tcacctctctggccgtctacct

SEQ ID NO: 7005002 - DNA, 22 bp, Homo sapiens
tctcctggaagaataccacact

SEQ ID NO: 7005003 - DNA, 22 bp, Homo sapiens
gggagacaagaagtagcctgct

SEQ ID NO: 7005004 - DNA, 22 bp, Homo sapiens
tcttattttagagccccgagcc

SEQ ID NO: 7005005 - DNA, 22 bp, Homo sapiens
ttcttaatcccacaaatcttca

SEQ ID NO: 7005006 - DNA, 22 bp, Homo sapiens
agacttatgcttcaaatagtaa

SEQ ID NO: 7005007 - DNA, 22 bp, Homo sapiens
acagctgctttctcttactatg

SEQ ID NO: 7005008 - DNA, 19 bp, Homo sapiens
tctctgccgatcagggccc

SEQ ID NO: 7005009 - DNA, 22 bp, Homo sapiens
taggaattgcccgtggggtcct

SEQ ID NO: 7005010 - DNA, 18 bp, Homo sapiens
tcagtctattgtataaga

SEQ ID NO: 7005011 - DNA, 22 bp, Homo sapiens
atttctctaagcatccgtttgc

SEQ ID NO: 7005012 - DNA, 22 bp, Homo sapiens
tgtgtgacccccagtgaagcct

SEQ ID NO: 7005013 - DNA, 22 bp, Homo sapiens
aatgtgatcgctttagaagctt

SEQ ID NO: 7005014 - DNA, 22 bp, Homo sapiens
actttgcagggcttgatatcca

SEQ ID NO: 7005015 - DNA, 22 bp, Homo sapiens
tctgtgtcgttctgtgctctgg

SEQ ID NO: 7005016 - DNA, 23 bp, Homo sapiens
tgccagggtttgtttgtggttca

SEQ ID NO: 7005017 - DNA, 22 bp, Homo sapiens
gtggcttgtgtgggaagtgcag

SEQ ID NO: 7005018 - DNA, 22 bp, Homo sapiens
agatatgactagaagctcattt

SEQ ID NO: 7005019 - DNA, 22 bp, Homo sapiens
ggagttgctgagacagaacaca

SEQ ID NO: 7005020 - DNA, 22 bp, Homo sapiens
tgtaactataaaattaattgct

SEQ ID NO: 7005021 - DNA, 18 bp, Homo sapiens
tggcatcccttctcttac

SEQ ID NO: 7005022 - DNA, 22 bp, Homo sapiens
agcatttaagggtggatacagg

SEQ ID NO: 7005023 - DNA, 22 bp, Homo sapiens
cagggctggatcctccagactc

SEQ ID NO: 7005024 - DNA, 22 bp, Homo sapiens
tcagcagggaggctctgtgccc

SEQ ID NO: 7005025 - DNA, 22 bp, Homo sapiens
cttcctctgaggcttctgagtc

SEQ ID NO: 7005026 - DNA, 21 bp, Homo sapiens
cacaggtgggtcagtgaggcc

SEQ ID NO: 7005027 - DNA, 20 bp, Homo sapiens
aggacagcagctgccacttg

SEQ ID NO: 7005028 - DNA, 22 bp, Homo sapiens
gtcagcagtggcagctcccggg

SEQ ID NO: 7005029 - DNA, 22 bp, Homo sapiens
atggaaaagggtctttcatttc

SEQ ID NO: 7005030 - DNA, 22 bp, Homo sapiens
ctcacctgggtcagacagttgt

SEQ ID NO: 7005031 - DNA, 22 bp, Homo sapiens
gtccaaacaggtcaaaatatta

SEQ ID NO: 7005032 - DNA, 21 bp, Homo sapiens
aggcctcttcatggccatgat

SEQ ID NO: 7005033 - DNA, 22 bp, Homo sapiens
taacactgaaaatgatgcatgt

SEQ ID NO: 7005034 - DNA, 21 bp, Homo sapiens
tcccatcaggtctttttatag

SEQ ID NO: 7005035 - DNA, 22 bp, Homo sapiens
gctccctggcttttacagtgta

SEQ ID NO: 7005036 - DNA, 22 bp, Homo sapiens
ctttagaaatctggatgtattt

SEQ ID NO: 7005037 - DNA, 22 bp, Homo sapiens
gctcagctgagcgaaggacatg

SEQ ID NO: 7005038 - DNA, 23 bp, Homo sapiens
tctcccaagcctggcaggggcac

SEQ ID NO: 7005039 - DNA, 22 bp, Homo sapiens
tttaattaggaaatgggcaggg

SEQ ID NO: 7005040 - DNA, 19 bp, Homo sapiens
aataatgccagatgtctgt

SEQ ID NO: 7005041 - DNA, 21 bp, Homo sapiens
tgcaggctgtgcgctcctgcc

SEQ ID NO: 7005042 - DNA, 22 bp, Homo sapiens
aaagatggcccatgatctcttg

SEQ ID NO: 7005043 - DNA, 22 bp, Homo sapiens
atgaatgagaaacaggtgagat

SEQ ID NO: 7005044 - DNA, 19 bp, Homo sapiens
ttgaagttacagtcatgcc

SEQ ID NO: 7005045 - DNA, 22 bp, Homo sapiens
atcttcaattgaaaactagcct

SEQ ID NO: 7005046 - DNA, 22 bp, Homo sapiens
cacataagtgggttccattgca

SEQ ID NO: 7005047 - DNA, 22 bp, Homo sapiens
cagatgtcatttcccatgcagc

SEQ ID NO: 7005048 - DNA, 22 bp, Homo sapiens
aaacatcaattgcatctcccaa

SEQ ID NO: 7005049 - DNA, 22 bp, Homo sapiens
ttcctatggctcagttgcattt

SEQ ID NO: 7005050 - DNA, 22 bp, Homo sapiens
tgtgctgccagaaactatggaa

SEQ ID NO: 7005051 - DNA, 22 bp, Homo sapiens
atacaatctagtctgtcagcaa

SEQ ID NO: 7005052 - DNA, 22 bp, Homo sapiens
gtctgaggcgaggcctgagaac

SEQ ID NO: 7005053 - DNA, 22 bp, Homo sapiens
agcaaggtctccctgcacctgg

SEQ ID NO: 7005054 - DNA, 22 bp, Homo sapiens
aattcccatttgcagaaaatca

SEQ ID NO: 7005055 - DNA, 22 bp, Homo sapiens
tgagtatatacccagaagtgga

SEQ ID NO: 7005056 - DNA, 22 bp, Homo sapiens
caccttttgtgtctgcgtttgt

SEQ ID NO: 7005057 - DNA, 22 bp, Homo sapiens
gccagagcttggtttttattta

SEQ ID NO: 7005058 - DNA, 20 bp, Homo sapiens
cctgtggctcttgtaattca

SEQ ID NO: 7005059 - DNA, 22 bp, Homo sapiens
ctctctggggttccagacgtgg

SEQ ID NO: 7005060 - DNA, 22 bp, Homo sapiens
aactttctataggttgggattt

SEQ ID NO: 7005061 - DNA, 22 bp, Homo sapiens
agtcttagataagtgaccaatg

SEQ ID NO: 7005062 - DNA, 22 bp, Homo sapiens
tgctctggaccatgactatgtg

SEQ ID NO: 7005063 - DNA, 22 bp, Homo sapiens
catgaaatctgagtatgtttcc

SEQ ID NO: 7005064 - DNA, 22 bp, Homo sapiens
caggaatgtttgtgctccttta

SEQ ID NO: 7005065 - DNA, 17 bp, Homo sapiens
ctctgtggaggtgttta

SEQ ID NO: 7005066 - DNA, 22 bp, Homo sapiens
gtgccctgcatgccccgggtat

SEQ ID NO: 7005067 - DNA, 22 bp, Homo sapiens
atgcttcctctacggcctctga

SEQ ID NO: 7005068 - DNA, 22 bp, Homo sapiens
cagaaatagacaatggcagtgg

SEQ ID NO: 7005069 - DNA, 22 bp, Homo sapiens
tcttccaatggtttctagattt

SEQ ID NO: 7005070 - DNA, 19 bp, Homo sapiens
tagactctaatgttaagct

SEQ ID NO: 7005071 - DNA, 22 bp, Homo sapiens
aggctccaaattaccaagctct

SEQ ID NO: 7005072 - DNA, 22 bp, Homo sapiens
tgtgtatgtaagcatgtgcata

SEQ ID NO: 7005073 - DNA, 22 bp, Homo sapiens
tcagtgttctggatttggggca

SEQ ID NO: 7005074 - DNA, 22 bp, Homo sapiens
cccagctgatttttgcagagat

SEQ ID NO: 7005075 - DNA, 22 bp, Homo sapiens
tctgatatctctccctgggtca

SEQ ID NO: 7005076 - DNA, 22 bp, Homo sapiens
tttggtcagcagttggtggcgt

SEQ ID NO: 7005077 - DNA, 22 bp, Homo sapiens
aagtcctgaaacttctttctga

SEQ ID NO: 7005078 - DNA, 22 bp, Homo sapiens
ctcctgggaatttagttgtgag

SEQ ID NO: 7005079 - DNA, 22 bp, Homo sapiens
agctgcttttagggccgggctc

SEQ ID NO: 7005080 - DNA, 22 bp, Homo sapiens
ttctctaatacattttgacaaa

SEQ ID NO: 7005081 - DNA, 22 bp, Homo sapiens
tgggtactgttacatgtaggac

SEQ ID NO: 7005082 - DNA, 22 bp, Homo sapiens
agaaactcacctttccagccat

SEQ ID NO: 7005083 - DNA, 22 bp, Homo sapiens
ttgtgcctttgcttttacaagt

SEQ ID NO: 7005084 - DNA, 22 bp, Homo sapiens
cagctgatttgagaaagaatga

SEQ ID NO: 7005085 - DNA, 22 bp, Homo sapiens
ctggtgctgtagcctgattgag

SEQ ID NO: 7005086 - DNA, 21 bp, Homo sapiens
tggaccaggaaggtggtggtg

SEQ ID NO: 7005087 - DNA, 18 bp, Homo sapiens
cttcagtgacagtctggc

SEQ ID NO: 7005088 - DNA, 22 bp, Homo sapiens
cctgagcaaaggcccagaggga

SEQ ID NO: 7005089 - DNA, 22 bp, Homo sapiens
ttggctggctacctgggccgag

SEQ ID NO: 7005090 - DNA, 22 bp, Homo sapiens
tgaaaatggcctgaagaagcaa

SEQ ID NO: 7005091 - DNA, 22 bp, Homo sapiens
tctcctgggaggacaaggaagg

SEQ ID NO: 7005092 - DNA, 22 bp, Homo sapiens
aagttggagctggagctatgga

SEQ ID NO: 7005093 - DNA, 22 bp, Homo sapiens
gggatacatgagtgactttatg

SEQ ID NO: 7005094 - DNA, 22 bp, Homo sapiens
acagcaataggaaatacttgca

SEQ ID NO: 7005095 - DNA, 22 bp, Homo sapiens
tagtttaaaagttagggatgat

SEQ ID NO: 7005096 - DNA, 22 bp, Homo sapiens
gtggatggacatgggcaagagg

SEQ ID NO: 7005097 - DNA, 22 bp, Homo sapiens
aggtccacagttcagctgccca

SEQ ID NO: 7005098 - DNA, 22 bp, Homo sapiens
agaggggagtcctaatctgatt

SEQ ID NO: 7005099 - DNA, 22 bp, Homo sapiens
acatttctgctagaataggtga

SEQ ID NO: 7005100 - DNA, 22 bp, Homo sapiens
tatttaatttgctcattgtgat

SEQ ID NO: 7005101 - DNA, 22 bp, Homo sapiens
ggcctttaagcaattgaaaaga

SEQ ID NO: 7005102 - DNA, 22 bp, Homo sapiens
gctgcagactgggaggcaggtg

SEQ ID NO: 7005103 - DNA, 22 bp, Homo sapiens
tgccttttccagcttccagagg

SEQ ID NO: 7005104 - DNA, 22 bp, Homo sapiens
tggggaaaatgcagaagattac

SEQ ID NO: 7005105 - DNA, 22 bp, Homo sapiens
cctgtctgcatgatccctgcca

SEQ ID NO: 7005106 - DNA, 22 bp, Homo sapiens
gttctcagtggggagcagggtt

SEQ ID NO: 7005107 - DNA, 22 bp, Homo sapiens
ttgcatgtttttgtaatacacc

SEQ ID NO: 7005108 - DNA, 22 bp, Homo sapiens
gcccacagtacgaggctcaggc

SEQ ID NO: 7005109 - DNA, 22 bp, Homo sapiens
agctgacataagcactttctaa

SEQ ID NO: 7005110 - DNA, 22 bp, Homo sapiens
taatgctcaccctgcatcaggc

SEQ ID NO: 7005111 - DNA, 22 bp, Homo sapiens
aaggtcacacagtgattaagtg

SEQ ID NO: 7005112 - DNA, 22 bp, Homo sapiens
gagccaggagatacctaagggg

SEQ ID NO: 7005113 - DNA, 22 bp, Homo sapiens
ggagagcattcttagtctgttt

SEQ ID NO: 7005114 - DNA, 22 bp, Homo sapiens
gtaatacaagctccctgggttc

SEQ ID NO: 7005115 - DNA, 22 bp, Homo sapiens
atttaccatcctgtgaatggcc

SEQ ID NO: 7005116 - DNA, 22 bp, Homo sapiens
aggtaccatatgcgggagcaac

SEQ ID NO: 7005117 - DNA, 22 bp, Homo sapiens
ttctaatctgggcttctgcagt

SEQ ID NO: 7005118 - DNA, 18 bp, Homo sapiens
ctctctttccactctttg

SEQ ID NO: 7005119 - DNA, 22 bp, Homo sapiens
tccctctggtctggacgccata

SEQ ID NO: 7005120 - DNA, 22 bp, Homo sapiens
agcagctttcctctggggtcag

SEQ ID NO: 7005121 - DNA, 22 bp, Homo sapiens
gcaggtctggagggcactgggg

SEQ ID NO: 7005122 - DNA, 22 bp, Homo sapiens
caggtgggattttgctgcttga

SEQ ID NO: 7005123 - DNA, 22 bp, Homo sapiens
gttattgggtgcctcaggccct

SEQ ID NO: 7005124 - DNA, 22 bp, Homo sapiens
actgatacggttttagagtcca

SEQ ID NO: 7005125 - DNA, 22 bp, Homo sapiens
ccactgagcagtagctgcgtcg

SEQ ID NO: 7005126 - DNA, 20 bp, Homo sapiens
tggcaggaatagggccagag

SEQ ID NO: 7005127 - DNA, 19 bp, Homo sapiens
agccagggtgagaaggagc

SEQ ID NO: 7005128 - DNA, 21 bp, Homo sapiens
tggtatcaaactatacaatat

SEQ ID NO: 7005129 - DNA, 22 bp, Homo sapiens
tacaaccttctccccaaaagct

SEQ ID NO: 7005130 - DNA, 22 bp, Homo sapiens
gttctgggttcaaaccccggcc

SEQ ID NO: 7005131 - DNA, 22 bp, Homo sapiens
attgctgtgtctggggcagatg

SEQ ID NO: 7005132 - DNA, 22 bp, Homo sapiens
taattgcagctatcattttagt

SEQ ID NO: 7005133 - DNA, 22 bp, Homo sapiens
attgcccaataataaaatggta

SEQ ID NO: 7005134 - DNA, 22 bp, Homo sapiens
cagtccagcaaagaactttcac

SEQ ID NO: 7005135 - DNA, 22 bp, Homo sapiens
cagctggcaagtggagcagggt

SEQ ID NO: 7005136 - DNA, 22 bp, Homo sapiens
tggtttactctgtaaaccagga

SEQ ID NO: 7005137 - DNA, 22 bp, Homo sapiens
ccatgccatactggccacccgg

SEQ ID NO: 7005138 - DNA, 22 bp, Homo sapiens
cctgcttaacattgccatgaca

SEQ ID NO: 7005139 - DNA, 22 bp, Homo sapiens
tttggcaatttgactgtatagg

SEQ ID NO: 7005140 - DNA, 22 bp, Homo sapiens
tttaagcaagttgacatagcat

SEQ ID NO: 7005141 - DNA, 22 bp, Homo sapiens
acagtggcttttgtgtctgcag

SEQ ID NO: 7005142 - DNA, 22 bp, Homo sapiens
ctgacctggccttggtgggcca

SEQ ID NO: 7005143 - DNA, 22 bp, Homo sapiens
cagaggaacgtttggattgatt

SEQ ID NO: 7005144 - DNA, 22 bp, Homo sapiens
tggcagcagtggaggtagaaag

SEQ ID NO: 7005145 - DNA, 22 bp, Homo sapiens
tgaggcaagtactttccctttt

SEQ ID NO: 7005146 - DNA, 22 bp, Homo sapiens
aatgagagaagacaggcaagtg

SEQ ID NO: 7005147 - DNA, 22 bp, Homo sapiens
tgtgaccttatttagaaatacc

SEQ ID NO: 7005148 - DNA, 22 bp, Homo sapiens
gaggcttgcaccatgagcacca

SEQ ID NO: 7005149 - DNA, 22 bp, Homo sapiens
agctgacttcttgatccaatga

SEQ ID NO: 7005150 - DNA, 22 bp, Homo sapiens
acagaattctctctgcagaggc

SEQ ID NO: 7005151 - DNA, 22 bp, Homo sapiens
gctggctggtccagcaggggct

SEQ ID NO: 7005152 - DNA, 22 bp, Homo sapiens
tctacagctgaacagtgtctca

SEQ ID NO: 7005153 - DNA, 22 bp, Homo sapiens
gtacactattaaacctgctcat

SEQ ID NO: 7005154 - DNA, 22 bp, Homo sapiens
ggccagactgagtgaggtcaag

SEQ ID NO: 7005155 - DNA, 22 bp, Homo sapiens
ttttcctctgtatgcgtgagat

SEQ ID NO: 7005156 - DNA, 22 bp, Homo sapiens
tcaggtctgatgcctcatccat

SEQ ID NO: 7005157 - DNA, 22 bp, Homo sapiens
tggcaggtggagacagcagagc

SEQ ID NO: 7005158 - DNA, 22 bp, Homo sapiens
tatgccagactgtgagcttctt

SEQ ID NO: 7005159 - DNA, 22 bp, Homo sapiens
gctcctggctccaggcagccaa

SEQ ID NO: 7005160 - DNA, 22 bp, Homo sapiens
tgctttttccccttctggcgag

SEQ ID NO: 7005161 - DNA, 22 bp, Homo sapiens
tggcagagaacctgggctttgt

SEQ ID NO: 7005162 - DNA, 22 bp, Homo sapiens
tgatagtattggtgatttatag

SEQ ID NO: 7005163 - DNA, 22 bp, Homo sapiens
ataatgacattcttagactgga

SEQ ID NO: 7005164 - DNA, 22 bp, Homo sapiens
gctctaattgaaaaatactgca

SEQ ID NO: 7005165 - DNA, 22 bp, Homo sapiens
atttccagaatagaaggttctc

SEQ ID NO: 7005166 - DNA, 22 bp, Homo sapiens
ggccccaaatgtcaatagtact

SEQ ID NO: 7005167 - DNA, 22 bp, Homo sapiens
agtcagtgaatggtgtatgcta

SEQ ID NO: 7005168 - DNA, 22 bp, Homo sapiens
actgaaacatatatttgagttt

SEQ ID NO: 7005169 - DNA, 22 bp, Homo sapiens
gcttccagacgatcatgtaaga

SEQ ID NO: 7005170 - DNA, 22 bp, Homo sapiens
aaggccttccctttgagccgca

SEQ ID NO: 7005171 - DNA, 22 bp, Homo sapiens
agtatctgcatgattttgagaa

SEQ ID NO: 7005172 - DNA, 22 bp, Homo sapiens
ctgagccagggccacacatgga

SEQ ID NO: 7005173 - DNA, 22 bp, Homo sapiens
gcacttgttttatgttcctgag

SEQ ID NO: 7005174 - DNA, 22 bp, Homo sapiens
aaatgtctacttcccatctgta

SEQ ID NO: 7005175 - DNA, 22 bp, Homo sapiens
aagtggcagccttagaaggaga

SEQ ID NO: 7005176 - DNA, 22 bp, Homo sapiens
tgcaaatattgggacagtctag

SEQ ID NO: 7005177 - DNA, 22 bp, Homo sapiens
gctgtctggcatggcgtggctg

SEQ ID NO: 7005178 - DNA, 22 bp, Homo sapiens
cagagtcagagctccatggagt

SEQ ID NO: 7005179 - DNA, 23 bp, Homo sapiens
tggaaacattctgaatgtccatc

SEQ ID NO: 7005180 - DNA, 22 bp, Homo sapiens
acagggattttccaggctaccc

SEQ ID NO: 7005181 - DNA, 19 bp, Homo sapiens
cctggctgctgtgggatgc

SEQ ID NO: 7005182 - DNA, 22 bp, Homo sapiens
aaagtgctgggattacaagtgt

SEQ ID NO: 7005183 - DNA, 22 bp, Homo sapiens
cagtcctggggaccaggctgag

SEQ ID NO: 7005184 - DNA, 22 bp, Homo sapiens
tatattgtagctgatgacaaat

SEQ ID NO: 7005185 - DNA, 22 bp, Homo sapiens
ctagccagactcaagggccacc

SEQ ID NO: 7005186 - DNA, 22 bp, Homo sapiens
tccatccaggccagcagtaatc

SEQ ID NO: 7005187 - DNA, 19 bp, Homo sapiens
ggctgggccctgtttctcc

SEQ ID NO: 7005188 - DNA, 22 bp, Homo sapiens
cctggctctagaggccactcct

SEQ ID NO: 7005189 - DNA, 21 bp, Homo sapiens
ccaaagaactgccatttgtca

SEQ ID NO: 7005190 - DNA, 22 bp, Homo sapiens
tttcagatgcatccattagcag

SEQ ID NO: 7005191 - DNA, 22 bp, Homo sapiens
ctgtcatttctttagcaatggg

SEQ ID NO: 7005192 - DNA, 22 bp, Homo sapiens
actggcagaattgaatagttgt

SEQ ID NO: 7005193 - DNA, 22 bp, Homo sapiens
aattgagtgcagccagcccagt

SEQ ID NO: 7005194 - DNA, 19 bp, Homo sapiens
aggtagctcagactcaaag

SEQ ID NO: 7005195 - DNA, 22 bp, Homo sapiens
ataagcttttaaagctactttg

SEQ ID NO: 7005196 - DNA, 22 bp, Homo sapiens
gctctgcccaatgtccctacac

SEQ ID NO: 7005197 - DNA, 15 bp, Homo sapiens
gctctgggtatttga

SEQ ID NO: 7005198 - DNA, 22 bp, Homo sapiens
acaagtcactctatcattttca

SEQ ID NO: 7005199 - DNA, 22 bp, Homo sapiens
ctgctttggcagaagtcagcta

SEQ ID NO: 7005200 - DNA, 22 bp, Homo sapiens
tcatgatacccaagtacctaga

SEQ ID NO: 7005201 - DNA, 22 bp, Homo sapiens
tggcctgctctgactttggggg

SEQ ID NO: 7005202 - DNA, 22 bp, Homo sapiens
agagttgtattggaatagctat

SEQ ID NO: 7005203 - DNA, 22 bp, Homo sapiens
ccctcctttctaggcttccagc

SEQ ID NO: 7005204 - DNA, 22 bp, Homo sapiens
ctaccttactttaaccctgcaa

SEQ ID NO: 7005205 - DNA, 22 bp, Homo sapiens
ggctgtggtcattaggaggttg

SEQ ID NO: 7005206 - DNA, 22 bp, Homo sapiens
aaatgcattctgttttcactag

SEQ ID NO: 7005207 - DNA, 19 bp, Homo sapiens
cagagccttcagtgactcc

SEQ ID NO: 7005208 - DNA, 22 bp, Homo sapiens
attgagaatctgagagcctagg

SEQ ID NO: 7005209 - DNA, 22 bp, Homo sapiens
ataaagcctttctgttttcagg

SEQ ID NO: 7005210 - DNA, 21 bp, Homo sapiens
acacagaggcatcatcacttt

SEQ ID NO: 7005211 - DNA, 22 bp, Homo sapiens
tcactgcacttcagcttgggca

SEQ ID NO: 7005212 - DNA, 22 bp, Homo sapiens
aacaggcactaagcatgtgggg

SEQ ID NO: 7005213 - DNA, 22 bp, Homo sapiens
gagtaattgtgtctggcacact

SEQ ID NO: 7005214 - DNA, 22 bp, Homo sapiens
taagactagttgaatggttttc

SEQ ID NO: 7005215 - DNA, 22 bp, Homo sapiens
atacaatgacccgggtccaagg

SEQ ID NO: 7005216 - DNA, 22 bp, Homo sapiens
tgccgcctggtttctccgcccc

SEQ ID NO: 7005217 - DNA, 22 bp, Homo sapiens
taactgtgtgaacgtgatcatt

SEQ ID NO: 7005218 - DNA, 22 bp, Homo sapiens
acagtagagtaaatggttagat

SEQ ID NO: 7005219 - DNA, 19 bp, Homo sapiens
tgagcatgcgagctgagaa

SEQ ID NO: 7005220 - DNA, 22 bp, Homo sapiens
cggaggcctgccaggagcttct

SEQ ID NO: 7005221 - DNA, 22 bp, Homo sapiens
aagcagaatagaggcccttccc

SEQ ID NO: 7005222 - DNA, 22 bp, Homo sapiens
ctttggaacaagaagaaatggc

SEQ ID NO: 7005223 - DNA, 22 bp, Homo sapiens
tggctaaggggaacaggcttag

SEQ ID NO: 7005224 - DNA, 22 bp, Homo sapiens
tctgggagctggctttgcctca

SEQ ID NO: 7005225 - DNA, 22 bp, Homo sapiens
aggagtggaattactgggttct

SEQ ID NO: 7005226 - DNA, 22 bp, Homo sapiens
ggcagcaggcgacttccctatt

SEQ ID NO: 7005227 - DNA, 17 bp, Homo sapiens
agctgccttgcttgagc

SEQ ID NO: 7005228 - DNA, 22 bp, Homo sapiens
tgagtccaagagccagtgggaa

SEQ ID NO: 7005229 - DNA, 22 bp, Homo sapiens
atacatgcgccatgttggtgtg

SEQ ID NO: 7005230 - DNA, 22 bp, Homo sapiens
gcttcatttctctctgtagacc

SEQ ID NO: 7005231 - DNA, 22 bp, Homo sapiens
tctgtccggcaggcaggcaagt

SEQ ID NO: 7005232 - DNA, 22 bp, Homo sapiens
tccatgaggaccaaattcgtag

SEQ ID NO: 7005233 - DNA, 22 bp, Homo sapiens
ggggcagctcccgagggcagga

SEQ ID NO: 7005234 - DNA, 22 bp, Homo sapiens
tattccagcagtctgccccgct

SEQ ID NO: 7005235 - DNA, 22 bp, Homo sapiens
cacttggaggccccctgtgccc

SEQ ID NO: 7005236 - DNA, 22 bp, Homo sapiens
caagcccactgctcagagccaa

SEQ ID NO: 7005237 - DNA, 22 bp, Homo sapiens
gaggacaaagcccaggtgctgg

SEQ ID NO: 7005238 - DNA, 22 bp, Homo sapiens
tggagatggcctcaggccctca

SEQ ID NO: 7005239 - DNA, 22 bp, Homo sapiens
agtacacagagttattttgtgt

SEQ ID NO: 7005240 - DNA, 22 bp, Homo sapiens
cctgtggaggctgctcagctgg

SEQ ID NO: 7005241 - DNA, 22 bp, Homo sapiens
tggatggggcagcttaggtgtg

SEQ ID NO: 7005242 - DNA, 22 bp, Homo sapiens
tcctttccatgcttctagaggc

SEQ ID NO: 7005243 - DNA, 21 bp, Homo sapiens
agctgagcccagaagactggt

SEQ ID NO: 7005244 - DNA, 22 bp, Homo sapiens
ttacacagtgaatttactcaag

SEQ ID NO: 7005245 - DNA, 23 bp, Homo sapiens
taagttctatgagaagagaaatc

SEQ ID NO: 7005246 - DNA, 22 bp, Homo sapiens
tactgcatggtggagtggagct

SEQ ID NO: 7005247 - DNA, 22 bp, Homo sapiens
acatagatttaagagcaattag

SEQ ID NO: 7005248 - DNA, 19 bp, Homo sapiens
tcctctggtaccacccttg

SEQ ID NO: 7005249 - DNA, 22 bp, Homo sapiens
tttaacactcagtttaatagcc

SEQ ID NO: 7005250 - DNA, 19 bp, Homo sapiens
ggccgcggcccgcagtggg

SEQ ID NO: 7005251 - DNA, 22 bp, Homo sapiens
aaaggctattcagggacttgcc

SEQ ID NO: 7005252 - DNA, 22 bp, Homo sapiens
aattgaaagaagtgggattgcc

SEQ ID NO: 7005253 - DNA, 22 bp, Homo sapiens
gcctgagattggacattattta

SEQ ID NO: 7005254 - DNA, 22 bp, Homo sapiens
gctctcttgacagcttgctgtt

SEQ ID NO: 7005255 - DNA, 22 bp, Homo sapiens
tcttgtgtggaactgcttttct

SEQ ID NO: 7005256 - DNA, 18 bp, Homo sapiens
aggacttgcctcagttgc

SEQ ID NO: 7005257 - DNA, 22 bp, Homo sapiens
ctgggctctagaaaggaaagaa

SEQ ID NO: 7005258 - DNA, 17 bp, Homo sapiens
ggcctgcacctcctgct

SEQ ID NO: 7005259 - DNA, 22 bp, Homo sapiens
cggccttgacaagcttagcagc

SEQ ID NO: 7005260 - DNA, 22 bp, Homo sapiens
ccaggtgttctttgtccctgtt

SEQ ID NO: 7005261 - DNA, 22 bp, Homo sapiens
tcaattacagcaatgactgtac

SEQ ID NO: 7005262 - DNA, 22 bp, Homo sapiens
atgagatgtgtctaatggaacc

SEQ ID NO: 7005263 - DNA, 22 bp, Homo sapiens
agcccaggtctcaaagtacagg

SEQ ID NO: 7005264 - DNA, 22 bp, Homo sapiens
tgcagagagccctgccttcctc

SEQ ID NO: 7005265 - DNA, 22 bp, Homo sapiens
attctacaaaagaactggatct

SEQ ID NO: 7005266 - DNA, 22 bp, Homo sapiens
acaaatgttacataagtttgga

SEQ ID NO: 7005267 - DNA, 22 bp, Homo sapiens
ttgaattagactttgctacagg

SEQ ID NO: 7005268 - DNA, 22 bp, Homo sapiens
cagggagatcttggctcctggt

SEQ ID NO: 7005269 - DNA, 22 bp, Homo sapiens
aggctagttagtatttacaaaa

SEQ ID NO: 7005270 - DNA, 19 bp, Homo sapiens
tttctcaggaagtttgtgt

SEQ ID NO: 7005271 - DNA, 22 bp, Homo sapiens
cagcagctttgccaagtcagcc

SEQ ID NO: 7005272 - DNA, 22 bp, Homo sapiens
gggttgtagagctggaagggga

SEQ ID NO: 7005273 - DNA, 22 bp, Homo sapiens
cagtctccaaatcaatctgaat

SEQ ID NO: 7005274 - DNA, 22 bp, Homo sapiens
atgctccagtgtgatgcttcat

SEQ ID NO: 7005275 - DNA, 22 bp, Homo sapiens
tgcctggccagaccctatagag

SEQ ID NO: 7005276 - DNA, 22 bp, Homo sapiens
tgatgacagtgttacagctcca

SEQ ID NO: 7005277 - DNA, 22 bp, Homo sapiens
ttcttgaaggggatataaatag

SEQ ID NO: 7005278 - DNA, 22 bp, Homo sapiens
tccatacataaaatgtttaatg

SEQ ID NO: 7005279 - DNA, 22 bp, Homo sapiens
tggattcacaccattctcctgc

SEQ ID NO: 7005280 - DNA, 22 bp, Homo sapiens
ataaactctattttgaggagat

SEQ ID NO: 7005281 - DNA, 22 bp, Homo sapiens
cctcctgtctccttcctatatt

SEQ ID NO: 7005282 - DNA, 22 bp, Homo sapiens
tgagtaaatatttatgactaga

SEQ ID NO: 7005283 - DNA, 22 bp, Homo sapiens
aacatagaattgttatattttc

SEQ ID NO: 7005284 - DNA, 22 bp, Homo sapiens
aatccacggcaacactgggccc

SEQ ID NO: 7005285 - DNA, 22 bp, Homo sapiens
gaccaaatgaatggtaatgagt

SEQ ID NO: 7005286 - DNA, 22 bp, Homo sapiens
tttgtagaactgtagaacaatg

SEQ ID NO: 7005287 - DNA, 22 bp, Homo sapiens
cagctgttatgaggtgtacatg

SEQ ID NO: 7005288 - DNA, 20 bp, Homo sapiens
acatagatcagtgattgaca

SEQ ID NO: 7005289 - DNA, 22 bp, Homo sapiens
gcagggcggcccagagcaggcc

SEQ ID NO: 7005290 - DNA, 22 bp, Homo sapiens
tagcaaagcccttgctgtgtaa

SEQ ID NO: 7005291 - DNA, 22 bp, Homo sapiens
tcctggcatttacaaacccacc

SEQ ID NO: 7005292 - DNA, 19 bp, Homo sapiens
agttaatgagcttttgatc

SEQ ID NO: 7005293 - DNA, 22 bp, Homo sapiens
ctcagccccaatttgccctctt

SEQ ID NO: 7005294 - DNA, 22 bp, Homo sapiens
atatctttgtatggttcagcag

SEQ ID NO: 7005295 - DNA, 22 bp, Homo sapiens
agctttgcagactcttttatct

SEQ ID NO: 7005296 - DNA, 22 bp, Homo sapiens
ggagcctgagcggcccagggcc

SEQ ID NO: 7005297 - DNA, 22 bp, Homo sapiens
atggctgtaaattcagagatgg

SEQ ID NO: 7005298 - DNA, 22 bp, Homo sapiens
agggtcagctggctgtcagggg

SEQ ID NO: 7005299 - DNA, 22 bp, Homo sapiens
taagaaatttagttatagaatg

SEQ ID NO: 7005300 - DNA, 22 bp, Homo sapiens
agcaaacacaagaggtaatttc

SEQ ID NO: 7005301 - DNA, 22 bp, Homo sapiens
ttattccacagctcagaatttt

SEQ ID NO: 7005302 - DNA, 22 bp, Homo sapiens
aaatgctgcagctagtgtgttt

SEQ ID NO: 7005303 - DNA, 22 bp, Homo sapiens
tgtgtgaggactcagtgaaaca

SEQ ID NO: 7005304 - DNA, 22 bp, Homo sapiens
ttcccacagtcactgggagaag

SEQ ID NO: 7005305 - DNA, 22 bp, Homo sapiens
cagagggagtttctgaggttgc

SEQ ID NO: 7005306 - DNA, 22 bp, Homo sapiens
tgctctgtattctatggcagtt

SEQ ID NO: 7005307 - DNA, 22 bp, Homo sapiens
tcttttcctcctcttgttggcc

SEQ ID NO: 7005308 - DNA, 22 bp, Homo sapiens
gtctttgcttttaaccagaggt

SEQ ID NO: 7005309 - DNA, 22 bp, Homo sapiens
cataatgttaatcttgactcca

SEQ ID NO: 7005310 - DNA, 22 bp, Homo sapiens
tccggactcacctgacaatggc

SEQ ID NO: 7005311 - DNA, 22 bp, Homo sapiens
tcagggccaggactaggatgag

SEQ ID NO: 7005312 - DNA, 22 bp, Homo sapiens
tcatgacataaacctgtggggt

SEQ ID NO: 7005313 - DNA, 22 bp, Homo sapiens
gaattagtgttgaaatcagggc

SEQ ID NO: 7005314 - DNA, 22 bp, Homo sapiens
cagacctaggctctgtgagagc

SEQ ID NO: 7005315 - DNA, 22 bp, Homo sapiens
cctgtatggctattccttggac

SEQ ID NO: 7005316 - DNA, 22 bp, Homo sapiens
gtggccatgttgctttcctttg

SEQ ID NO: 7005317 - DNA, 22 bp, Homo sapiens
tccaagggcaacaatggaacac

SEQ ID NO: 7005318 - DNA, 22 bp, Homo sapiens
acatagttgatgagcgtgtacg

SEQ ID NO: 7005319 - DNA, 22 bp, Homo sapiens
atggatctgtatccaaaaatac

SEQ ID NO: 7005320 - DNA, 22 bp, Homo sapiens
gtagtattttctgtgatgtagg

SEQ ID NO: 7005321 - DNA, 22 bp, Homo sapiens
aaaaggcagtgcaagagagggt

SEQ ID NO: 7005322 - DNA, 22 bp, Homo sapiens
cacccaggctggagtgcagggg

SEQ ID NO: 7005323 - DNA, 22 bp, Homo sapiens
ccatgcctttcactgaaccagt

SEQ ID NO: 7005324 - DNA, 22 bp, Homo sapiens
agtccggggtctggacacctgg

SEQ ID NO: 7005325 - DNA, 22 bp, Homo sapiens
ccagttactaacacctttggct

SEQ ID NO: 7005326 - DNA, 22 bp, Homo sapiens
ggagaatggccatcttttcaga

SEQ ID NO: 7005327 - DNA, 22 bp, Homo sapiens
ggctgctttgtagcttttgcca

SEQ ID NO: 7005328 - DNA, 21 bp, Homo sapiens
acttgaagttggagtttctgt

SEQ ID NO: 7005329 - DNA, 22 bp, Homo sapiens
tatagcactgcaatatttccct

SEQ ID NO: 7005330 - DNA, 21 bp, Homo sapiens
cctgtgtgtctgactgggcta

SEQ ID NO: 7005331 - DNA, 22 bp, Homo sapiens
gacccttggctgcagcatcaca

SEQ ID NO: 7005332 - DNA, 22 bp, Homo sapiens
tgtgtacgtgtataaattcaca

SEQ ID NO: 7005333 - DNA, 22 bp, Homo sapiens
ccatggcaatggtaaactgaca

SEQ ID NO: 7005334 - DNA, 22 bp, Homo sapiens
gagggctggggcttaggcttag

SEQ ID NO: 7005335 - DNA, 22 bp, Homo sapiens
aaatgcatgtgctatagatgtg

SEQ ID NO: 7005336 - DNA, 22 bp, Homo sapiens
aaaagcaaggcagtctgtctga

SEQ ID NO: 7005337 - DNA, 22 bp, Homo sapiens
tccccagatgacatcaaaaggc

SEQ ID NO: 7005338 - DNA, 22 bp, Homo sapiens
acagccagtcctcccacagggt

SEQ ID NO: 7005339 - DNA, 22 bp, Homo sapiens
tccagtcaacttaatctcttta

SEQ ID NO: 7005340 - DNA, 22 bp, Homo sapiens
tataattttagaagagatggaa

SEQ ID NO: 7005341 - DNA, 22 bp, Homo sapiens
agtctcaaactcctaggctcga

SEQ ID NO: 7005342 - DNA, 22 bp, Homo sapiens
aattgacaaatcatacttgtat

SEQ ID NO: 7005343 - DNA, 22 bp, Homo sapiens
tgtggacactacgataggggaa

SEQ ID NO: 7005344 - DNA, 22 bp, Homo sapiens
gctggccaaagtgtacctggag

SEQ ID NO: 7005345 - DNA, 22 bp, Homo sapiens
tcaatactatgattttgtacat

SEQ ID NO: 7005346 - DNA, 22 bp, Homo sapiens
agggcgcatctctggggtgaat

SEQ ID NO: 7005347 - DNA, 22 bp, Homo sapiens
ctgagagcagggacttgagcca

SEQ ID NO: 7005348 - DNA, 22 bp, Homo sapiens
tttctcctgcccagatgcctgg

SEQ ID NO: 7005349 - DNA, 22 bp, Homo sapiens
taagtgatgaagacctgtttgg

SEQ ID NO: 7005350 - DNA, 22 bp, Homo sapiens
aaacaactcggcaactgctttt

SEQ ID NO: 7005351 - DNA, 22 bp, Homo sapiens
ggtacaatccactgtgggttag

SEQ ID NO: 7005352 - DNA, 22 bp, Homo sapiens
tataatcctgcttcacattgaa

SEQ ID NO: 7005353 - DNA, 22 bp, Homo sapiens
ttccaggactgggtgtttgaag

SEQ ID NO: 7005354 - DNA, 22 bp, Homo sapiens
ctatttgaattatgaagcactg

SEQ ID NO: 7005355 - DNA, 22 bp, Homo sapiens
atgaatgactgtctactttggg

SEQ ID NO: 7005356 - DNA, 22 bp, Homo sapiens
gttcctcacgtggacagatgat

SEQ ID NO: 7005357 - DNA, 22 bp, Homo sapiens
tgttcctgctatggtttgttgc

SEQ ID NO: 7005358 - DNA, 22 bp, Homo sapiens
ctgctggggaggcgcctcgacg

SEQ ID NO: 7005359 - DNA, 22 bp, Homo sapiens
ctaacctgcatggcagctagaa

SEQ ID NO: 7005360 - DNA, 20 bp, Homo sapiens
aacggctgctttggggttgt

SEQ ID NO: 7005361 - DNA, 22 bp, Homo sapiens
agccagtcttacgctcgttttt

SEQ ID NO: 7005362 - DNA, 22 bp, Homo sapiens
cagtaaatgatgatagtgcctt

SEQ ID NO: 7005363 - DNA, 22 bp, Homo sapiens
agttggcactgagctgtgattg

SEQ ID NO: 7005364 - DNA, 22 bp, Homo sapiens
aggagacccagaatgttgctgt

SEQ ID NO: 7005365 - DNA, 22 bp, Homo sapiens
atttagtaagtacttgttgaat

SEQ ID NO: 7005366 - DNA, 22 bp, Homo sapiens
aggcacacagcttgcataaatc

SEQ ID NO: 7005367 - DNA, 22 bp, Homo sapiens
caagcttgtttctcctgggggt

SEQ ID NO: 7005368 - DNA, 22 bp, Homo sapiens
tgctggcacatagagactggct

SEQ ID NO: 7005369 - DNA, 20 bp, Homo sapiens
tgcccacaattcacaatgcc

SEQ ID NO: 7005370 - DNA, 22 bp, Homo sapiens
gctgggtctctccctggtcctg

SEQ ID NO: 7005371 - DNA, 22 bp, Homo sapiens
atatgagagaggaaagatttta

SEQ ID NO: 7005372 - DNA, 22 bp, Homo sapiens
catggcttggagcaggatgaga

SEQ ID NO: 7005373 - DNA, 22 bp, Homo sapiens
tggcagccatctgagggtgggg

SEQ ID NO: 7005374 - DNA, 22 bp, Homo sapiens
tctgggctgtctacaggttggc

SEQ ID NO: 7005375 - DNA, 22 bp, Homo sapiens
agcaggccactgcagctggagc

SEQ ID NO: 7005376 - DNA, 22 bp, Homo sapiens
gtttcctgaaaagtaagggaca

SEQ ID NO: 7005377 - DNA, 22 bp, Homo sapiens
ttagggcttttctgaataggcc

SEQ ID NO: 7005378 - DNA, 20 bp, Homo sapiens
tatgaagactcaagtagggc

SEQ ID NO: 7005379 - DNA, 22 bp, Homo sapiens
agaggccagggacactgctcaa

SEQ ID NO: 7005380 - DNA, 21 bp, Homo sapiens
agctggctatagttagtgatg

SEQ ID NO: 7005381 - DNA, 22 bp, Homo sapiens
atgtattgaccatactactaaa

SEQ ID NO: 7005382 - DNA, 22 bp, Homo sapiens
taggatttattctacaatattg

SEQ ID NO: 7005383 - DNA, 22 bp, Homo sapiens
cacatgggtgtgcctggaggaa

SEQ ID NO: 7005384 - DNA, 22 bp, Homo sapiens
aggcacttgcattgatgaggtc

SEQ ID NO: 7005385 - DNA, 22 bp, Homo sapiens
ataagcatgttagaatatttga

SEQ ID NO: 7005386 - DNA, 22 bp, Homo sapiens
aaaaccacaaaagtggcttggt

SEQ ID NO: 7005387 - DNA, 19 bp, Homo sapiens
ccagccctgtcacttcttg

SEQ ID NO: 7005388 - DNA, 20 bp, Homo sapiens
tgaaaggtgggaattgtggg

SEQ ID NO: 7005389 - DNA, 22 bp, Homo sapiens
acttggcaagtatctataaagt

SEQ ID NO: 7005390 - DNA, 22 bp, Homo sapiens
agagcctctgtcatggagagaa

SEQ ID NO: 7005391 - DNA, 21 bp, Homo sapiens
gagctctcaggcaagaagcag

SEQ ID NO: 7005392 - DNA, 22 bp, Homo sapiens
tgcaccccattttacatttaca

SEQ ID NO: 7005393 - DNA, 22 bp, Homo sapiens
ctgcctgagtggaggtcgaggg

SEQ ID NO: 7005394 - DNA, 18 bp, Homo sapiens
gcctggcttcggagccgc

SEQ ID NO: 7005395 - DNA, 22 bp, Homo sapiens
agtaccctagggtgggagctca

SEQ ID NO: 7005396 - DNA, 22 bp, Homo sapiens
aagttgttgttgaggtgggtaa

SEQ ID NO: 7005397 - DNA, 22 bp, Homo sapiens
aagacctattttaggatatgaa

SEQ ID NO: 7005398 - DNA, 22 bp, Homo sapiens
ttcaggatcatttgttttatct

SEQ ID NO: 7005399 - DNA, 22 bp, Homo sapiens
tttcctctccggggcctccagg

SEQ ID NO: 7005400 - DNA, 22 bp, Homo sapiens
ccagtaaattacttgatgtcat

SEQ ID NO: 7005401 - DNA, 22 bp, Homo sapiens
aatgtatgacagttctagtggt

SEQ ID NO: 7005402 - DNA, 20 bp, Homo sapiens
ccagtctctatcagaaataa

SEQ ID NO: 7005403 - DNA, 22 bp, Homo sapiens
tggatgctgtaggacacgctct

SEQ ID NO: 7005404 - DNA, 22 bp, Homo sapiens
cgttcctctactccagctaccc

SEQ ID NO: 7005405 - DNA, 19 bp, Homo sapiens
ggctgcctttccttaccag

SEQ ID NO: 7005406 - DNA, 22 bp, Homo sapiens
tgtcaatgaagatatgaataat

SEQ ID NO: 7005407 - DNA, 22 bp, Homo sapiens
cccaggaggcggaggttgtggt

SEQ ID NO: 7005408 - DNA, 22 bp, Homo sapiens
cctgggaggcggaggttgcagt

SEQ ID NO: 7005409 - DNA, 22 bp, Homo sapiens
ttcagcctgtctgcagacccct

SEQ ID NO: 7005410 - DNA, 20 bp, Homo sapiens
ttgctagcttttgtgtcact

SEQ ID NO: 7005411 - DNA, 22 bp, Homo sapiens
tagcacaatatcatgtctgtga

SEQ ID NO: 7005412 - DNA, 22 bp, Homo sapiens
ttagaaatgtcacagatctgat

SEQ ID NO: 7005413 - DNA, 22 bp, Homo sapiens
ctggaagaggggaaatgccatg

SEQ ID NO: 7005414 - DNA, 22 bp, Homo sapiens
aagaggtttaactgactcacag

SEQ ID NO: 7005415 - DNA, 22 bp, Homo sapiens
acatatgctcatctgcattccc

SEQ ID NO: 7005416 - DNA, 22 bp, Homo sapiens
tattcatgagataggcagtttt

SEQ ID NO: 7005417 - DNA, 22 bp, Homo sapiens
tattgcatcttagtgtaagtca

SEQ ID NO: 7005418 - DNA, 22 bp, Homo sapiens
ttatgatttagaaagattcact

SEQ ID NO: 7005419 - DNA, 22 bp, Homo sapiens
gttctacatgacactcaacatt

SEQ ID NO: 7005420 - DNA, 22 bp, Homo sapiens
aggactttgattttgtaagatc

SEQ ID NO: 7005421 - DNA, 21 bp, Homo sapiens
tagaccagctgtgctcctcgg

SEQ ID NO: 7005422 - DNA, 22 bp, Homo sapiens
ctgaggctggagtgcagtggtg

SEQ ID NO: 7005423 - DNA, 22 bp, Homo sapiens
tgctgtctgattcagggtgatt

SEQ ID NO: 7005424 - DNA, 22 bp, Homo sapiens
atctggagcaagattaagagat

SEQ ID NO: 7005425 - DNA, 19 bp, Homo sapiens
aggcttggattgtggccaa

SEQ ID NO: 7005426 - DNA, 22 bp, Homo sapiens
ttcagacttcttgactggcttt

SEQ ID NO: 7005427 - DNA, 22 bp, Homo sapiens
ctggcagagtctgctgtctgca

SEQ ID NO: 7005428 - DNA, 22 bp, Homo sapiens
atatggaaatagcaatatggtt

SEQ ID NO: 7005429 - DNA, 22 bp, Homo sapiens
gcctgggattgtgtaagtgaat

SEQ ID NO: 7005430 - DNA, 22 bp, Homo sapiens
gtccagagggtcaagtttcttg

SEQ ID NO: 7005431 - DNA, 22 bp, Homo sapiens
ttagctgtcaaggtggctgcag

SEQ ID NO: 7005432 - DNA, 22 bp, Homo sapiens
gtgctccctccttcctcaagga

SEQ ID NO: 7005433 - DNA, 22 bp, Homo sapiens
cttcagctgacgtcaaaacacc

SEQ ID NO: 7005434 - DNA, 22 bp, Homo sapiens
gccacttatattcccactgtgc

SEQ ID NO: 7005435 - DNA, 22 bp, Homo sapiens
ggattaaggggaaaaagcagct

SEQ ID NO: 7005436 - DNA, 20 bp, Homo sapiens
gcctcagtcacatggcctac

SEQ ID NO: 7005437 - DNA, 22 bp, Homo sapiens
aagagatgtggaatcatttaca

SEQ ID NO: 7005438 - DNA, 23 bp, Homo sapiens
tgtttgtttctatgagagatagc

SEQ ID NO: 7005439 - DNA, 22 bp, Homo sapiens
agtgtgctgagcaggtgggggt

SEQ ID NO: 7005440 - DNA, 22 bp, Homo sapiens
aggaagagggtggcagataatc

SEQ ID NO: 7005441 - DNA, 22 bp, Homo sapiens
tgggcacagtgagttgccttta

SEQ ID NO: 7005442 - DNA, 22 bp, Homo sapiens
ttgattaaaatgagacatcatt

SEQ ID NO: 7005443 - DNA, 22 bp, Homo sapiens
agcagcctattcttctcttgga

SEQ ID NO: 7005444 - DNA, 22 bp, Homo sapiens
ctgtgctggagatgggccagag

SEQ ID NO: 7005445 - DNA, 22 bp, Homo sapiens
cctcactctgcaccctgcagca

SEQ ID NO: 7005446 - DNA, 18 bp, Homo sapiens
ctccaggtaattctgata

SEQ ID NO: 7005447 - DNA, 22 bp, Homo sapiens
tagaggtgagaggaactttgga

SEQ ID NO: 7005448 - DNA, 22 bp, Homo sapiens
ttcagaggtttccgggccatgc

SEQ ID NO: 7005449 - DNA, 22 bp, Homo sapiens
aggggcgggacatgcactgagc

SEQ ID NO: 7005450 - DNA, 21 bp, Homo sapiens
ctctgctgagctccattttca

SEQ ID NO: 7005451 - DNA, 22 bp, Homo sapiens
tagaccagaattgtcagcacct

SEQ ID NO: 7005452 - DNA, 22 bp, Homo sapiens
ctctgcccacgtcttgcccaga

SEQ ID NO: 7005453 - DNA, 22 bp, Homo sapiens
aggtgacatgaaaaatgttgag

SEQ ID NO: 7005454 - DNA, 22 bp, Homo sapiens
acagagtatctatcaggagtat

SEQ ID NO: 7005455 - DNA, 21 bp, Homo sapiens
ttatacatatgttctctgcct

SEQ ID NO: 7005456 - DNA, 22 bp, Homo sapiens
atgtctttattaatatcatgcc

SEQ ID NO: 7005457 - DNA, 22 bp, Homo sapiens
gtagggcaacatgggcactagg

SEQ ID NO: 7005458 - DNA, 22 bp, Homo sapiens
attgcactccatcctgggcaat

SEQ ID NO: 7005459 - DNA, 22 bp, Homo sapiens
actagaacttctaactaaggtc

SEQ ID NO: 7005460 - DNA, 21 bp, Homo sapiens
ttgagcatgtactttgtgctt

SEQ ID NO: 7005461 - DNA, 21 bp, Homo sapiens
ttctccttcttgatccaagca

SEQ ID NO: 7005462 - DNA, 22 bp, Homo sapiens
tgtgctaagtattttcttattt

SEQ ID NO: 7005463 - DNA, 15 bp, Homo sapiens
atgccagatggcctc

SEQ ID NO: 7005464 - DNA, 22 bp, Homo sapiens
atagaacacagatgggcgtggc

SEQ ID NO: 7005465 - DNA, 22 bp, Homo sapiens
tgctgctctgtaaagtgatgag

SEQ ID NO: 7005466 - DNA, 22 bp, Homo sapiens
tacccaggggctgagcagaggt

SEQ ID NO: 7005467 - DNA, 22 bp, Homo sapiens
ggaactttaggatcctggctca

SEQ ID NO: 7005468 - DNA, 15 bp, Homo sapiens
tctcacagatcagtc

SEQ ID NO: 7005469 - DNA, 22 bp, Homo sapiens
ctgctgaggggaggaaagacgg

SEQ ID NO: 7005470 - DNA, 22 bp, Homo sapiens
ataaaggccaaaatttgcattt

SEQ ID NO: 7005471 - DNA, 17 bp, Homo sapiens
tctggatgtcatggaag

SEQ ID NO: 7005472 - DNA, 22 bp, Homo sapiens
gagctgtgttgtctagtaccga

SEQ ID NO: 7005473 - DNA, 22 bp, Homo sapiens
atggcactgacctcccttgtaa

SEQ ID NO: 7005474 - DNA, 22 bp, Homo sapiens
acctggctttggggataggctt

SEQ ID NO: 7005475 - DNA, 22 bp, Homo sapiens
tgttaaatgctcagctcgggga

SEQ ID NO: 7005476 - DNA, 21 bp, Homo sapiens
agctgctgtggccagaatcca

SEQ ID NO: 7005477 - DNA, 22 bp, Homo sapiens
tccagtctggtatgaatcctag

SEQ ID NO: 7005478 - DNA, 22 bp, Homo sapiens
agattccttatctgtccaatgg

SEQ ID NO: 7005479 - DNA, 23 bp, Homo sapiens
tcagagaatggtatgcttttcct

SEQ ID NO: 7005480 - DNA, 21 bp, Homo sapiens
acagaagcggcgagtggcccc

SEQ ID NO: 7005481 - DNA, 22 bp, Homo sapiens
gacagagttgttgatgtatgct

SEQ ID NO: 7005482 - DNA, 22 bp, Homo sapiens
ggcccagctgggcggggacacg

SEQ ID NO: 7005483 - DNA, 22 bp, Homo sapiens
ctggaaattggagatgatgttt

SEQ ID NO: 7005484 - DNA, 22 bp, Homo sapiens
ctactctgtggtgtatttgcat

SEQ ID NO: 7005485 - DNA, 22 bp, Homo sapiens
tttgctaaaagtgatgaagaca

SEQ ID NO: 7005486 - DNA, 22 bp, Homo sapiens
tttcttgtaaaagctgtgggaa

SEQ ID NO: 7005487 - DNA, 22 bp, Homo sapiens
aactgttctacccttcatttca

SEQ ID NO: 7005488 - DNA, 22 bp, Homo sapiens
actcaaaagaccagagagctga

SEQ ID NO: 7005489 - DNA, 22 bp, Homo sapiens
cactatccaataaatatttatt

SEQ ID NO: 7005490 - DNA, 22 bp, Homo sapiens
tttggggctcagcaggctgttt

SEQ ID NO: 7005491 - DNA, 22 bp, Homo sapiens
gattttacatgtcatatctatt

SEQ ID NO: 7005492 - DNA, 20 bp, Homo sapiens
aggctctgcatttctgagtg

SEQ ID NO: 7005493 - DNA, 21 bp, Homo sapiens
agtgactctgaaccacttgaa

SEQ ID NO: 7005494 - DNA, 22 bp, Homo sapiens
gacttaatgcttcattacctta

SEQ ID NO: 7005495 - DNA, 22 bp, Homo sapiens
aatttcctgggataaaaagcca

SEQ ID NO: 7005496 - DNA, 22 bp, Homo sapiens
tgtgagtaataaagtcattttt

SEQ ID NO: 7005497 - DNA, 22 bp, Homo sapiens
atgcagcagtttacaaagcaat

SEQ ID NO: 7005498 - DNA, 22 bp, Homo sapiens
tctctgtaagctgccttctcgt

SEQ ID NO: 7005499 - DNA, 22 bp, Homo sapiens
tcaaatctcactctgcatttct

SEQ ID NO: 7005500 - DNA, 22 bp, Homo sapiens
ctaataccctgtattcacattt

SEQ ID NO: 7005501 - DNA, 22 bp, Homo sapiens
tcattgacttgaagaaaacaat

SEQ ID NO: 7005502 - DNA, 22 bp, Homo sapiens
tttggacaagttactggtttcc

SEQ ID NO: 7005503 - DNA, 22 bp, Homo sapiens
gcagctttaaacattggaaata

SEQ ID NO: 7005504 - DNA, 22 bp, Homo sapiens
actcttcatgctatgctcaact

SEQ ID NO: 7005505 - DNA, 22 bp, Homo sapiens
tctgcgtggcgtggttctgtgc

SEQ ID NO: 7005506 - DNA, 22 bp, Homo sapiens
gttgtgcagtcagactgcctgg

SEQ ID NO: 7005507 - DNA, 22 bp, Homo sapiens
aaaggctattgctgataatgtt

SEQ ID NO: 7005508 - DNA, 22 bp, Homo sapiens
tatacagatatctaagatgtaa

SEQ ID NO: 7005509 - DNA, 22 bp, Homo sapiens
tacaggtagagtctctagttta

SEQ ID NO: 7005510 - DNA, 22 bp, Homo sapiens
aatttggtgtcttagtttccct

SEQ ID NO: 7005511 - DNA, 22 bp, Homo sapiens
cccagtgtggttctttggagaa

SEQ ID NO: 7005512 - DNA, 22 bp, Homo sapiens
gagccaccatgtctcacgcgct

SEQ ID NO: 7005513 - DNA, 22 bp, Homo sapiens
gggctgtgggacccggcacttt

SEQ ID NO: 7005514 - DNA, 22 bp, Homo sapiens
ttggccaggtgtaggtcacacc

SEQ ID NO: 7005515 - DNA, 22 bp, Homo sapiens
atcagtttaactgtcaagagcc

SEQ ID NO: 7005516 - DNA, 22 bp, Homo sapiens
agcttctcggctgggagtattt

SEQ ID NO: 7005517 - DNA, 22 bp, Homo sapiens
tctgaggcctagagaggggctt

SEQ ID NO: 7005518 - DNA, 22 bp, Homo sapiens
acaagtgggtcctacataaagc

SEQ ID NO: 7005519 - DNA, 22 bp, Homo sapiens
ggcatcggaggctgaagtttcc

SEQ ID NO: 7005520 - DNA, 22 bp, Homo sapiens
catcctgagaaaataaaggaga

SEQ ID NO: 7005521 - DNA, 22 bp, Homo sapiens
acttctgcttgcccagtgacta

SEQ ID NO: 7005522 - DNA, 22 bp, Homo sapiens
ataaattcaaagcatttaggac

SEQ ID NO: 7005523 - DNA, 22 bp, Homo sapiens
tctctgaggacttggggttgcc

SEQ ID NO: 7005524 - DNA, 22 bp, Homo sapiens
ttcacactctcactccctgacc

SEQ ID NO: 7005525 - DNA, 22 bp, Homo sapiens
aatagcatgttcatgataaaat

SEQ ID NO: 7005526 - DNA, 22 bp, Homo sapiens
aagcacttagaagagtgcctgc

SEQ ID NO: 7005527 - DNA, 22 bp, Homo sapiens
tgctgctgttgacggctgtcca

SEQ ID NO: 7005528 - DNA, 21 bp, Homo sapiens
ttagaacaatatttggtatag

SEQ ID NO: 7005529 - DNA, 22 bp, Homo sapiens
agcaggcacaagaaagggaggt

SEQ ID NO: 7005530 - DNA, 22 bp, Homo sapiens
cacattgctccacagggttaac

SEQ ID NO: 7005531 - DNA, 22 bp, Homo sapiens
gaaagggataccatgttacttg

SEQ ID NO: 7005532 - DNA, 22 bp, Homo sapiens
gcattagaaactattgctgcaa

SEQ ID NO: 7005533 - DNA, 22 bp, Homo sapiens
gagctgggacttggaatccaca

SEQ ID NO: 7005534 - DNA, 22 bp, Homo sapiens
caggaagctgatgtctagtcat

SEQ ID NO: 7005535 - DNA, 20 bp, Homo sapiens
tctgtagtctatgaggctta

SEQ ID NO: 7005536 - DNA, 22 bp, Homo sapiens
aaggccagcttgtagggctggt

SEQ ID NO: 7005537 - DNA, 22 bp, Homo sapiens
agctgactcactcactcacaat

SEQ ID NO: 7005538 - DNA, 22 bp, Homo sapiens
cttaatctcacctgcaaagtcc

SEQ ID NO: 7005539 - DNA, 22 bp, Homo sapiens
accaagctagaacattacaggc

SEQ ID NO: 7005540 - DNA, 22 bp, Homo sapiens
gaagctggggtgctgagggcaa

SEQ ID NO: 7005541 - DNA, 22 bp, Homo sapiens
atcagaaaaacataatgttatt

SEQ ID NO: 7005542 - DNA, 22 bp, Homo sapiens
acaggtgtctgcaagttactgg

SEQ ID NO: 7005543 - DNA, 22 bp, Homo sapiens
actagtttgaaaatatctgatt

SEQ ID NO: 7005544 - DNA, 22 bp, Homo sapiens
tctgagatttgtatggtgagac

SEQ ID NO: 7005545 - DNA, 22 bp, Homo sapiens
tagtttctaaagcttcctaggt

SEQ ID NO: 7005546 - DNA, 23 bp, Homo sapiens
tgggaaatgtagccttggcatga

SEQ ID NO: 7005547 - DNA, 20 bp, Homo sapiens
tgagtcagctgcatgggtgg

SEQ ID NO: 7005548 - DNA, 22 bp, Homo sapiens
gtcttattttctgtctactaaa

SEQ ID NO: 7005549 - DNA, 20 bp, Homo sapiens
cagtgaggaggtgctggggg

SEQ ID NO: 7005550 - DNA, 22 bp, Homo sapiens
agtcaggttgcattttaagtaa

SEQ ID NO: 7005551 - DNA, 22 bp, Homo sapiens
gaagacctcataattcacatgc

SEQ ID NO: 7005552 - DNA, 22 bp, Homo sapiens
aagacccttctctgaggaggaa

SEQ ID NO: 7005553 - DNA, 22 bp, Homo sapiens
cctgaacatttctgctccagcc

SEQ ID NO: 7005554 - DNA, 22 bp, Homo sapiens
gtaatgctgtacaccattaaca

SEQ ID NO: 7005555 - DNA, 18 bp, Homo sapiens
gattctgattctggaggc

SEQ ID NO: 7005556 - DNA, 22 bp, Homo sapiens
agacgcgcagaaggaagcggcc

SEQ ID NO: 7005557 - DNA, 22 bp, Homo sapiens
aggctaaggagtgtgatgctca

SEQ ID NO: 7005558 - DNA, 22 bp, Homo sapiens
agcacagttggtaaaattgtta

SEQ ID NO: 7005559 - DNA, 21 bp, Homo sapiens
ctattggaaaagaaaatattt

SEQ ID NO: 7005560 - DNA, 22 bp, Homo sapiens
attcccacaatgtgtgcttcat

SEQ ID NO: 7005561 - DNA, 22 bp, Homo sapiens
caaacattttctacttccagga

SEQ ID NO: 7005562 - DNA, 22 bp, Homo sapiens
aacagcagctttcaggatcatc

SEQ ID NO: 7005563 - DNA, 22 bp, Homo sapiens
tagctctgaggccatctccggt

SEQ ID NO: 7005564 - DNA, 22 bp, Homo sapiens
agtggtctatttaatagttttc

SEQ ID NO: 7005565 - DNA, 22 bp, Homo sapiens
tataactacttgaagagttcag

SEQ ID NO: 7005566 - DNA, 19 bp, Homo sapiens
tcatctcacagggcctggc

SEQ ID NO: 7005567 - DNA, 22 bp, Homo sapiens
agagacccgcagcctcggagct

SEQ ID NO: 7005568 - DNA, 22 bp, Homo sapiens
ctggctcgcattatattttggg

SEQ ID NO: 7005569 - DNA, 22 bp, Homo sapiens
ttcagcaagaatttactgagct

SEQ ID NO: 7005570 - DNA, 22 bp, Homo sapiens
cttgaagattgatccagtttga

SEQ ID NO: 7005571 - DNA, 22 bp, Homo sapiens
ttgtgtctgggggagtgacatc

SEQ ID NO: 7005572 - DNA, 22 bp, Homo sapiens
ctgttacacggaccttcaaatc

SEQ ID NO: 7005573 - DNA, 22 bp, Homo sapiens
ctctgcacccccggctcctcgt

SEQ ID NO: 7005574 - DNA, 22 bp, Homo sapiens
gaaatgtttgggaggagtcaac

SEQ ID NO: 7005575 - DNA, 22 bp, Homo sapiens
gagttatatcctgagtcatatt

SEQ ID NO: 7005576 - DNA, 22 bp, Homo sapiens
tttctacatgttttctattgaa

SEQ ID NO: 7005577 - DNA, 22 bp, Homo sapiens
actgagcagaacaatgggagcc

SEQ ID NO: 7005578 - DNA, 22 bp, Homo sapiens
atgctatcttcagcacctaggg

SEQ ID NO: 7005579 - DNA, 22 bp, Homo sapiens
ggtaccatgagatgccactaat

SEQ ID NO: 7005580 - DNA, 22 bp, Homo sapiens
ctcttgtattggagttagtggg

SEQ ID NO: 7005581 - DNA, 22 bp, Homo sapiens
tcctccctgggagcttctgagt

SEQ ID NO: 7005582 - DNA, 22 bp, Homo sapiens
ttggaagcaataaatggaaaga

SEQ ID NO: 7005583 - DNA, 22 bp, Homo sapiens
ggctgccttcatagaccatggg

SEQ ID NO: 7005584 - DNA, 22 bp, Homo sapiens
tgtctcagctgtgcttcattgg

SEQ ID NO: 7005585 - DNA, 22 bp, Homo sapiens
agagcctgcagctgtgaagaaa

SEQ ID NO: 7005586 - DNA, 22 bp, Homo sapiens
gcagctcccatcagggcacaga

SEQ ID NO: 7005587 - DNA, 22 bp, Homo sapiens
gttgtttgtaatgacaggagac

SEQ ID NO: 7005588 - DNA, 22 bp, Homo sapiens
ctggctggaacgccgaggcggc

SEQ ID NO: 7005589 - DNA, 22 bp, Homo sapiens
ttaggaaacaaatacacccagt

SEQ ID NO: 7005590 - DNA, 22 bp, Homo sapiens
ttacagaggcttccagggccca

SEQ ID NO: 7005591 - DNA, 22 bp, Homo sapiens
ccacaagactctgtcagcataa

SEQ ID NO: 7005592 - DNA, 22 bp, Homo sapiens
ttttctattaactcattttgca

SEQ ID NO: 7005593 - DNA, 22 bp, Homo sapiens
ttgcaaattaaagaggatagca

SEQ ID NO: 7005594 - DNA, 22 bp, Homo sapiens
gtcaggattattttattaaaag

SEQ ID NO: 7005595 - DNA, 22 bp, Homo sapiens
taaaattgcggtgaatatttcc

SEQ ID NO: 7005596 - DNA, 22 bp, Homo sapiens
aatgaaactgtatatagactgt

SEQ ID NO: 7005597 - DNA, 22 bp, Homo sapiens
tatgtcctgctactctctcatg

SEQ ID NO: 7005598 - DNA, 22 bp, Homo sapiens
tctgtggtctggctttagtcta

SEQ ID NO: 7005599 - DNA, 22 bp, Homo sapiens
tgccctgttcacttcatggttc

SEQ ID NO: 7005600 - DNA, 22 bp, Homo sapiens
ttgcactttgaaataacagtgg

SEQ ID NO: 7005601 - DNA, 21 bp, Homo sapiens
tgcctgcctcctttggctagg

SEQ ID NO: 7005602 - DNA, 21 bp, Homo sapiens
ctcttgctgatgtctccttta

SEQ ID NO: 7005603 - DNA, 22 bp, Homo sapiens
aggaacacactgagcaactcct

SEQ ID NO: 7005604 - DNA, 22 bp, Homo sapiens
agtggcaggcggagatgtagga

SEQ ID NO: 7005605 - DNA, 22 bp, Homo sapiens
tgtcaagagtgcacacatctgc

SEQ ID NO: 7005606 - DNA, 22 bp, Homo sapiens
tatgcagaagtagggattggag

SEQ ID NO: 7005607 - DNA, 22 bp, Homo sapiens
cagggtggggaaatagcgccct

SEQ ID NO: 7005608 - DNA, 22 bp, Homo sapiens
agccccaaacaccaggattact

SEQ ID NO: 7005609 - DNA, 22 bp, Homo sapiens
tttagcaccttcactttctctg

SEQ ID NO: 7005610 - DNA, 22 bp, Homo sapiens
tacagtagtatcttcatttgtt

SEQ ID NO: 7005611 - DNA, 22 bp, Homo sapiens
tcagagtttggatcattccttg

SEQ ID NO: 7005612 - DNA, 22 bp, Homo sapiens
acattcagaatcttgtagcagt

SEQ ID NO: 7005613 - DNA, 22 bp, Homo sapiens
agttcttttctagattctggat

SEQ ID NO: 7005614 - DNA, 15 bp, Homo sapiens
gatacacatgactgg

SEQ ID NO: 7005615 - DNA, 19 bp, Homo sapiens
agtggtagatgagcaggag

SEQ ID NO: 7005616 - DNA, 22 bp, Homo sapiens
ctggctgtgctgcaggctttgg

SEQ ID NO: 7005617 - DNA, 22 bp, Homo sapiens
agcaacaggaatattatggcaa

SEQ ID NO: 7005618 - DNA, 22 bp, Homo sapiens
ttttggcaaaggcattctcttt

SEQ ID NO: 7005619 - DNA, 22 bp, Homo sapiens
taagcaccactccaaaattgtt

SEQ ID NO: 7005620 - DNA, 22 bp, Homo sapiens
atagtgcagccccttttctatt

SEQ ID NO: 7005621 - DNA, 22 bp, Homo sapiens
tgttttgttcactgcattgtcc

SEQ ID NO: 7005622 - DNA, 22 bp, Homo sapiens
agtcagagttttgaggtgtgac

SEQ ID NO: 7005623 - DNA, 22 bp, Homo sapiens
acagttgggctgtagcatgctt

SEQ ID NO: 7005624 - DNA, 18 bp, Homo sapiens
gacagcagcttttgttct

SEQ ID NO: 7005625 - DNA, 22 bp, Homo sapiens
tagctgtacaaacttgtgcaag

SEQ ID NO: 7005626 - DNA, 22 bp, Homo sapiens
atcatttacaaactcagcattg

SEQ ID NO: 7005627 - DNA, 22 bp, Homo sapiens
tgcagagaagaggacagttcta

SEQ ID NO: 7005628 - DNA, 21 bp, Homo sapiens
ggaagggctctgaggacggct

SEQ ID NO: 7005629 - DNA, 22 bp, Homo sapiens
cttgcaaacactcaaagccatc

SEQ ID NO: 7005630 - DNA, 22 bp, Homo sapiens
ttgatttcaaaatatatgcttg

SEQ ID NO: 7005631 - DNA, 22 bp, Homo sapiens
ccctgagaggttgagtgtctgc

SEQ ID NO: 7005632 - DNA, 21 bp, Homo sapiens
attctgtcatcccagctactt

SEQ ID NO: 7005633 - DNA, 22 bp, Homo sapiens
agcacctggatttgatagtcag

SEQ ID NO: 7005634 - DNA, 22 bp, Homo sapiens
gcagtccaaagtggctctcacc

SEQ ID NO: 7005635 - DNA, 22 bp, Homo sapiens
acttgtaagctctgtatttgag

SEQ ID NO: 7005636 - DNA, 22 bp, Homo sapiens
tctggattaactgctgtttatt

SEQ ID NO: 7005637 - DNA, 17 bp, Homo sapiens
ctgggcctcccctgtcc

SEQ ID NO: 7005638 - DNA, 22 bp, Homo sapiens
ttgctgaagtattgtgaatcct

SEQ ID NO: 7005639 - DNA, 22 bp, Homo sapiens
gtgtctgcatattcaaacttgt

SEQ ID NO: 7005640 - DNA, 22 bp, Homo sapiens
ttcatccatgtggttgtgtata

SEQ ID NO: 7005641 - DNA, 22 bp, Homo sapiens
tgaatctgatttccctggaggc

SEQ ID NO: 7005642 - DNA, 22 bp, Homo sapiens
aacatcattatgtccattaatg

SEQ ID NO: 7005643 - DNA, 22 bp, Homo sapiens
atattacataaacatgagtgaa

SEQ ID NO: 7005644 - DNA, 22 bp, Homo sapiens
gaacaaacagaagaggcggaac

SEQ ID NO: 7005645 - DNA, 21 bp, Homo sapiens
gctctaagctttgggaagaat

SEQ ID NO: 7005646 - DNA, 22 bp, Homo sapiens
caatcttagagagattctttta

SEQ ID NO: 7005647 - DNA, 22 bp, Homo sapiens
gggcttggccccagaagagcta

SEQ ID NO: 7005648 - DNA, 22 bp, Homo sapiens
ggtctctgaagcttttagtccc

SEQ ID NO: 7005649 - DNA, 22 bp, Homo sapiens
gtattgggattatgggtgtgag

SEQ ID NO: 7005650 - DNA, 22 bp, Homo sapiens
atgtgcaaattattttgccaga

SEQ ID NO: 7005651 - DNA, 22 bp, Homo sapiens
ttccagaacaatgtggacgtat

SEQ ID NO: 7005652 - DNA, 18 bp, Homo sapiens
gtctctgtgggaattggc

SEQ ID NO: 7005653 - DNA, 22 bp, Homo sapiens
gaagggagaaggttgggtgacg

SEQ ID NO: 7005654 - DNA, 22 bp, Homo sapiens
tgacagggggcagaggtggctg

SEQ ID NO: 7005655 - DNA, 22 bp, Homo sapiens
tctgacaggattttttcaggca

SEQ ID NO: 7005656 - DNA, 22 bp, Homo sapiens
tctggctgtgtaaggtagcacc

SEQ ID NO: 7005657 - DNA, 22 bp, Homo sapiens
ctgtaacctcctctttccattc

SEQ ID NO: 7005658 - DNA, 22 bp, Homo sapiens
ctctgaaagttagagaaaatag

SEQ ID NO: 7005659 - DNA, 22 bp, Homo sapiens
tcaatgatagacaagatctaag

SEQ ID NO: 7005660 - DNA, 22 bp, Homo sapiens
tatcagcatatttactttcttg

SEQ ID NO: 7005661 - DNA, 22 bp, Homo sapiens
tgaaagaagccttcgaggctcg

SEQ ID NO: 7005662 - DNA, 22 bp, Homo sapiens
taacatgcattgacaaatattt

SEQ ID NO: 7005663 - DNA, 22 bp, Homo sapiens
agggcagtgtggtgggactgac

SEQ ID NO: 7005664 - DNA, 22 bp, Homo sapiens
tacaccagtatcttaagcatga

SEQ ID NO: 7005665 - DNA, 23 bp, Homo sapiens
catgtctgctttcatgctacaac

SEQ ID NO: 7005666 - DNA, 22 bp, Homo sapiens
tcaatagctcagtgtggaagct

SEQ ID NO: 7005667 - DNA, 22 bp, Homo sapiens
ggccctgggacacaacaccgaa

SEQ ID NO: 7005668 - DNA, 22 bp, Homo sapiens
aaaggcagagtgctcagctggc

SEQ ID NO: 7005669 - DNA, 22 bp, Homo sapiens
gagaagccgagtcagctgagcc

SEQ ID NO: 7005670 - DNA, 22 bp, Homo sapiens
aatgtctgtgccttaaaacttc

SEQ ID NO: 7005671 - DNA, 22 bp, Homo sapiens
actctttagaggtacatctctt

SEQ ID NO: 7005672 - DNA, 22 bp, Homo sapiens
cttgatgcaaggtatgttattg

SEQ ID NO: 7005673 - DNA, 22 bp, Homo sapiens
ataaagcttctgagtctagatc

SEQ ID NO: 7005674 - DNA, 22 bp, Homo sapiens
gtctcctggcctccagtttctc

SEQ ID NO: 7005675 - DNA, 22 bp, Homo sapiens
cctgctgggacgtgtggttgcc

SEQ ID NO: 7005676 - DNA, 22 bp, Homo sapiens
agcagcatttaaggatccaagt

SEQ ID NO: 7005677 - DNA, 17 bp, Homo sapiens
catctttaaaatcctga

SEQ ID NO: 7005678 - DNA, 22 bp, Homo sapiens
aattcacacctccggtttttct

SEQ ID NO: 7005679 - DNA, 22 bp, Homo sapiens
gagctgaagcgctacagcatcc

SEQ ID NO: 7005680 - DNA, 17 bp, Homo sapiens
ggcctgcaagaacgaga

SEQ ID NO: 7005681 - DNA, 22 bp, Homo sapiens
tagaatctggatctgggcgcat

SEQ ID NO: 7005682 - DNA, 22 bp, Homo sapiens
ttcaaggcagagtgtagttaaa

SEQ ID NO: 7005683 - DNA, 22 bp, Homo sapiens
cttgccagcatttatagggatt

SEQ ID NO: 7005684 - DNA, 22 bp, Homo sapiens
gaagagcatttgcccaggctgt

SEQ ID NO: 7005685 - DNA, 22 bp, Homo sapiens
tgggctgccggcaggctctgcc

SEQ ID NO: 7005686 - DNA, 20 bp, Homo sapiens
atgttaaatagcatttagag

SEQ ID NO: 7005687 - DNA, 22 bp, Homo sapiens
atctggctgctgtgcttaagct

SEQ ID NO: 7005688 - DNA, 22 bp, Homo sapiens
gcaggaacccagacaaccaggg

SEQ ID NO: 7005689 - DNA, 22 bp, Homo sapiens
agcactggagtttagtgggatt

SEQ ID NO: 7005690 - DNA, 22 bp, Homo sapiens
ttctcacaggctggaatgatga

SEQ ID NO: 7005691 - DNA, 22 bp, Homo sapiens
gcttcatgaaaatcactggtca

SEQ ID NO: 7005692 - DNA, 22 bp, Homo sapiens
cccattgcccaaatagtaaaca

SEQ ID NO: 7005693 - DNA, 22 bp, Homo sapiens
ttggccaagactcatgtcctat

SEQ ID NO: 7005694 - DNA, 22 bp, Homo sapiens
tgcagtccaagagtctcctggt

SEQ ID NO: 7005695 - DNA, 22 bp, Homo sapiens
ctggtgtttattacaggtgctc

SEQ ID NO: 7005696 - DNA, 22 bp, Homo sapiens
ccactgagaccttttggaggag

SEQ ID NO: 7005697 - DNA, 22 bp, Homo sapiens
gtctggactgcaaaataaggat

SEQ ID NO: 7005698 - DNA, 22 bp, Homo sapiens
agctgccagcaagtttcaaaca

SEQ ID NO: 7005699 - DNA, 22 bp, Homo sapiens
caccgagtgacagtagccatca

SEQ ID NO: 7005700 - DNA, 22 bp, Homo sapiens
gtccaaggatgcaggatgctgt

SEQ ID NO: 7005701 - DNA, 22 bp, Homo sapiens
aagaaagggagaaggatggtgt

SEQ ID NO: 7005702 - DNA, 22 bp, Homo sapiens
ttagatgactgaaaagagcaca

SEQ ID NO: 7005703 - DNA, 22 bp, Homo sapiens
taattgctgaactactatccct

SEQ ID NO: 7005704 - DNA, 22 bp, Homo sapiens
aagagtttccagttgtggctca

SEQ ID NO: 7005705 - DNA, 22 bp, Homo sapiens
cttaggaatgtcccttcccaca

SEQ ID NO: 7005706 - DNA, 22 bp, Homo sapiens
atcttattgctgttgccagata

SEQ ID NO: 7005707 - DNA, 22 bp, Homo sapiens
cgtcttggagatattctgggct

SEQ ID NO: 7005708 - DNA, 22 bp, Homo sapiens
atcttggggactgtctcttgta

SEQ ID NO: 7005709 - DNA, 22 bp, Homo sapiens
cagctgctcttctggcctgtca

SEQ ID NO: 7005710 - DNA, 21 bp, Homo sapiens
atatttctcataaggttatgg

SEQ ID NO: 7005711 - DNA, 22 bp, Homo sapiens
ggtccagtcctgctcaccactt

SEQ ID NO: 7005712 - DNA, 22 bp, Homo sapiens
tttgattcaaaaaccactccac

SEQ ID NO: 7005713 - DNA, 18 bp, Homo sapiens
agaaggagctatgggcag

SEQ ID NO: 7005714 - DNA, 22 bp, Homo sapiens
acagaataaggtttatctctcc

SEQ ID NO: 7005715 - DNA, 22 bp, Homo sapiens
tagaggttgacagtgactgtga

SEQ ID NO: 7005716 - DNA, 22 bp, Homo sapiens
tgcttctttttatcttggagta

SEQ ID NO: 7005717 - DNA, 22 bp, Homo sapiens
ttggaggggccactgcagagct

SEQ ID NO: 7005718 - DNA, 22 bp, Homo sapiens
gacaatgagtgaggcacctggg

SEQ ID NO: 7005719 - DNA, 23 bp, Homo sapiens
catcaagtacttttgacaagtgt

SEQ ID NO: 7005720 - DNA, 22 bp, Homo sapiens
ttcctaatggcaaaacatgttt

SEQ ID NO: 7005721 - DNA, 22 bp, Homo sapiens
tgccccagacctactgaatggg

SEQ ID NO: 7005722 - DNA, 22 bp, Homo sapiens
gcttggagaagatgttctcaat

SEQ ID NO: 7005723 - DNA, 22 bp, Homo sapiens
ttctgggcccaaccctagagtg

SEQ ID NO: 7005724 - DNA, 22 bp, Homo sapiens
ggtgtgcctggggcttagctgc

SEQ ID NO: 7005725 - DNA, 22 bp, Homo sapiens
tcattgaacgaagagctccatt

SEQ ID NO: 7005726 - DNA, 22 bp, Homo sapiens
gtagcagctctccagggttcac

SEQ ID NO: 7005727 - DNA, 20 bp, Homo sapiens
agctggcctgtcctaggcct

SEQ ID NO: 7005728 - DNA, 22 bp, Homo sapiens
tcaatacttaagcttaattcta

SEQ ID NO: 7005729 - DNA, 21 bp, Homo sapiens
tctgtggcagcatgatgaggt

SEQ ID NO: 7005730 - DNA, 20 bp, Homo sapiens
ccaggcaactatcctgtctc

SEQ ID NO: 7005731 - DNA, 22 bp, Homo sapiens
ttgggacagcactgctacccct

SEQ ID NO: 7005732 - DNA, 21 bp, Homo sapiens
aagtagaagggagaagggtta

SEQ ID NO: 7005733 - DNA, 22 bp, Homo sapiens
agctttgtttgctcacccgccg

SEQ ID NO: 7005734 - DNA, 22 bp, Homo sapiens
agcccccaggagtctccacgcc

SEQ ID NO: 7005735 - DNA, 22 bp, Homo sapiens
cagggtgtgaacagtgtaaaac

SEQ ID NO: 7005736 - DNA, 22 bp, Homo sapiens
acagagggtgtggaggaagacg

SEQ ID NO: 7005737 - DNA, 22 bp, Homo sapiens
agagcagcctcagctccctgtg

SEQ ID NO: 7005738 - DNA, 22 bp, Homo sapiens
caggctggtcccagagcattgc

SEQ ID NO: 7005739 - DNA, 22 bp, Homo sapiens
tcagctggtgtttcttctcctt

SEQ ID NO: 7005740 - DNA, 22 bp, Homo sapiens
aatagagtcagttctacattct

SEQ ID NO: 7005741 - DNA, 22 bp, Homo sapiens
taggaacatatgcagtgctttt

SEQ ID NO: 7005742 - DNA, 22 bp, Homo sapiens
tcatttatttataccattgcct

SEQ ID NO: 7005743 - DNA, 22 bp, Homo sapiens
tgagaaacacaggcatgaatag

SEQ ID NO: 7005744 - DNA, 22 bp, Homo sapiens
agtgacagctgggaaggtgaaa

SEQ ID NO: 7005745 - DNA, 22 bp, Homo sapiens
attctgtaattgaactgtgttg

SEQ ID NO: 7005746 - DNA, 22 bp, Homo sapiens
ggctgtccttggccaaggcact

SEQ ID NO: 7005747 - DNA, 22 bp, Homo sapiens
agtgtgtaattcagtgcccagc

SEQ ID NO: 7005748 - DNA, 22 bp, Homo sapiens
tcctgctgagcatgttctgccc

SEQ ID NO: 7005749 - DNA, 22 bp, Homo sapiens
actcttcatacagtcatctaat

SEQ ID NO: 7005750 - DNA, 19 bp, Homo sapiens
gctaggctggccttgaggg

SEQ ID NO: 7005751 - DNA, 22 bp, Homo sapiens
ggcaagtggaggtgttcatcag

SEQ ID NO: 7005752 - DNA, 22 bp, Homo sapiens
cagaggtcaagatctgaagtga

SEQ ID NO: 7005753 - DNA, 19 bp, Homo sapiens
tatgagctgacaaaggcct

SEQ ID NO: 7005754 - DNA, 22 bp, Homo sapiens
tccaagaagagcctttctcctc

SEQ ID NO: 7005755 - DNA, 22 bp, Homo sapiens
atggagctgtagggagcagtgg

SEQ ID NO: 7005756 - DNA, 19 bp, Homo sapiens
gctgtgggacagcagggtg

SEQ ID NO: 7005757 - DNA, 22 bp, Homo sapiens
aattcacagcatttgcccatct

SEQ ID NO: 7005758 - DNA, 22 bp, Homo sapiens
tttcatgttggatactgtttca

SEQ ID NO: 7005759 - DNA, 22 bp, Homo sapiens
tctaccaccccgggcctggaga

SEQ ID NO: 7005760 - DNA, 22 bp, Homo sapiens
tttggaattggaaagtgctgtg

SEQ ID NO: 7005761 - DNA, 22 bp, Homo sapiens
ttcctgtgaagccggtggtctc

SEQ ID NO: 7005762 - DNA, 22 bp, Homo sapiens
cagagccaaaaccgtaacagcc

SEQ ID NO: 7005763 - DNA, 22 bp, Homo sapiens
tgaggctccagccaggccagca

SEQ ID NO: 7005764 - DNA, 18 bp, Homo sapiens
aagtgactggcaggccaa

SEQ ID NO: 7005765 - DNA, 22 bp, Homo sapiens
tgaccaaggacagtcacgctgt

SEQ ID NO: 7005766 - DNA, 23 bp, Homo sapiens
actgtctgtgcttttttagggct

SEQ ID NO: 7005767 - DNA, 22 bp, Homo sapiens
catgaccctgaccctgtgctcc

SEQ ID NO: 7005768 - DNA, 22 bp, Homo sapiens
ccacaggaggaacaattagatg

SEQ ID NO: 7005769 - DNA, 22 bp, Homo sapiens
tctttagtaatgtagcagttta

SEQ ID NO: 7005770 - DNA, 22 bp, Homo sapiens
tatgctaaatatgttcacattg

SEQ ID NO: 7005771 - DNA, 16 bp, Homo sapiens
tggattagaatgtcat

SEQ ID NO: 7005772 - DNA, 22 bp, Homo sapiens
ttttttatctatggtagtacca

SEQ ID NO: 7005773 - DNA, 22 bp, Homo sapiens
tgactaattgataactctgtaa

SEQ ID NO: 7005774 - DNA, 22 bp, Homo sapiens
tgatgaaactgaggttccaaga

SEQ ID NO: 7005775 - DNA, 15 bp, Homo sapiens
gagcaaacattaatc

SEQ ID NO: 7005776 - DNA, 18 bp, Homo sapiens
gcccgtgtggagaccatg

SEQ ID NO: 7005777 - DNA, 21 bp, Homo sapiens
cttgagaattaactgttcatt

SEQ ID NO: 7005778 - DNA, 22 bp, Homo sapiens
acatgtttgcctgcaggcttag

SEQ ID NO: 7005779 - DNA, 22 bp, Homo sapiens
aaatgacagagtaagctgttta

SEQ ID NO: 7005780 - DNA, 22 bp, Homo sapiens
gtagtcttatcagaatttttaa

SEQ ID NO: 7005781 - DNA, 22 bp, Homo sapiens
tttccaataaggtcaccttcct

SEQ ID NO: 7005782 - DNA, 15 bp, Homo sapiens
gccctcaggcgacac

SEQ ID NO: 7005783 - DNA, 22 bp, Homo sapiens
gaggctgagtagctttgtgctc

SEQ ID NO: 7005784 - DNA, 22 bp, Homo sapiens
gtcttctttaacctactaaagc

SEQ ID NO: 7005785 - DNA, 23 bp, Homo sapiens
ctgaagagccaacaaaaagcttg

SEQ ID NO: 7005786 - DNA, 22 bp, Homo sapiens
atgggaggcagcagagcccagc

SEQ ID NO: 7005787 - DNA, 22 bp, Homo sapiens
agctcctggtgcctcagccgaa

SEQ ID NO: 7005788 - DNA, 22 bp, Homo sapiens
cattgtgctttcattcaatata

SEQ ID NO: 7005789 - DNA, 22 bp, Homo sapiens
cctcccaccgtatctcagtggc

SEQ ID NO: 7005790 - DNA, 22 bp, Homo sapiens
ttcaagcagagatatttcaaga

SEQ ID NO: 7005791 - DNA, 22 bp, Homo sapiens
tttagaagttcacacatttaaa

SEQ ID NO: 7005792 - DNA, 22 bp, Homo sapiens
cagtggctggttagggacagga

SEQ ID NO: 7005793 - DNA, 22 bp, Homo sapiens
atttttctctttccactgagat

SEQ ID NO: 7005794 - DNA, 22 bp, Homo sapiens
gctcaaaggctatcaatagtgt

SEQ ID NO: 7005795 - DNA, 22 bp, Homo sapiens
atttcttccattgcctcttcaa

SEQ ID NO: 7005796 - DNA, 22 bp, Homo sapiens
attcatgaatctacattgtggt

SEQ ID NO: 7005797 - DNA, 22 bp, Homo sapiens
gaaggcttgccgggaagcggca

SEQ ID NO: 7005798 - DNA, 22 bp, Homo sapiens
gtcagcattgcagatatatggc

SEQ ID NO: 7005799 - DNA, 22 bp, Homo sapiens
atgagctcttttcgtggcttct

SEQ ID NO: 7005800 - DNA, 22 bp, Homo sapiens
ttggccttccctacctgggcca

SEQ ID NO: 7005801 - DNA, 22 bp, Homo sapiens
tatgtcttccctagcaggcaga

SEQ ID NO: 7005802 - DNA, 22 bp, Homo sapiens
acatagatctgtgattcattct

SEQ ID NO: 7005803 - DNA, 22 bp, Homo sapiens
gcacagagagggaaggtaactt

SEQ ID NO: 7005804 - DNA, 22 bp, Homo sapiens
caggccctgtgctgggtgatgt

SEQ ID NO: 7005805 - DNA, 22 bp, Homo sapiens
tatattcttaccagtgtatgta

SEQ ID NO: 7005806 - DNA, 22 bp, Homo sapiens
atgtaaaagattattttcctgt

SEQ ID NO: 7005807 - DNA, 22 bp, Homo sapiens
aacatgcaggttttagggttgc

SEQ ID NO: 7005808 - DNA, 22 bp, Homo sapiens
tgtcacaatatcccaatctgcc

SEQ ID NO: 7005809 - DNA, 22 bp, Homo sapiens
gtacagaaatgtgatgacgcaa

SEQ ID NO: 7005810 - DNA, 20 bp, Homo sapiens
ctcttgggcccaaagggcct

SEQ ID NO: 7005811 - DNA, 22 bp, Homo sapiens
ctgacatggggatccaccttag

SEQ ID NO: 7005812 - DNA, 17 bp, Homo sapiens
atggctcacctgtgggc

SEQ ID NO: 7005813 - DNA, 22 bp, Homo sapiens
atcctaaagaaatatttattaa

SEQ ID NO: 7005814 - DNA, 22 bp, Homo sapiens
atagaattcgtgtttgtaattc

SEQ ID NO: 7005815 - DNA, 22 bp, Homo sapiens
acagagcatttgggacagagag

SEQ ID NO: 7005816 - DNA, 20 bp, Homo sapiens
gtccaggacccagcaggagg

SEQ ID NO: 7005817 - DNA, 22 bp, Homo sapiens
aggcttgtttgaggatagtaat

SEQ ID NO: 7005818 - DNA, 22 bp, Homo sapiens
gagaagaaaattccgtgaacac

SEQ ID NO: 7005819 - DNA, 22 bp, Homo sapiens
tgctttctgctcttgtccacac

SEQ ID NO: 7005820 - DNA, 22 bp, Homo sapiens
aggcacaaagacagaaaagcac

SEQ ID NO: 7005821 - DNA, 22 bp, Homo sapiens
tttttagagtgttaccagtata

SEQ ID NO: 7005822 - DNA, 22 bp, Homo sapiens
agggagtctggcagtctaagag

SEQ ID NO: 7005823 - DNA, 22 bp, Homo sapiens
catttatgttttacttggtcac

SEQ ID NO: 7005824 - DNA, 22 bp, Homo sapiens
tttggaaattactcattgtcct

SEQ ID NO: 7005825 - DNA, 22 bp, Homo sapiens
ggctgtggggccgggtacagtg

SEQ ID NO: 7005826 - DNA, 19 bp, Homo sapiens
cctgaggtggggtggaagg

SEQ ID NO: 7005827 - DNA, 20 bp, Homo sapiens
gttcactgagcttaaatgtt

SEQ ID NO: 7005828 - DNA, 22 bp, Homo sapiens
aacatctgaaaaggcttcactc

SEQ ID NO: 7005829 - DNA, 22 bp, Homo sapiens
ttccagagtgactgtgccactt

SEQ ID NO: 7005830 - DNA, 22 bp, Homo sapiens
tcatgtttgttggaaatgtggc

SEQ ID NO: 7005831 - DNA, 22 bp, Homo sapiens
caagaatagctacctcccatat

SEQ ID NO: 7005832 - DNA, 22 bp, Homo sapiens
tctggcttttatgggatgagag

SEQ ID NO: 7005833 - DNA, 22 bp, Homo sapiens
tgaagcccaggaatctacattt

SEQ ID NO: 7005834 - DNA, 22 bp, Homo sapiens
tattccaagtgcctagaagagt

SEQ ID NO: 7005835 - DNA, 22 bp, Homo sapiens
cataattagtcatgttatgcat

SEQ ID NO: 7005836 - DNA, 22 bp, Homo sapiens
gtgcacatcgtgcaggtttgtt

SEQ ID NO: 7005837 - DNA, 22 bp, Homo sapiens
aagggccagggcagggttgtga

SEQ ID NO: 7005838 - DNA, 22 bp, Homo sapiens
tttcacattctctggttatcga

SEQ ID NO: 7005839 - DNA, 22 bp, Homo sapiens
aggcacagcctcccccaactcc

SEQ ID NO: 7005840 - DNA, 22 bp, Homo sapiens
gagtcagtaatggatatgtcat

SEQ ID NO: 7005841 - DNA, 18 bp, Homo sapiens
tgggctgcctggcctctg

SEQ ID NO: 7005842 - DNA, 22 bp, Homo sapiens
agggccaggaacacctgaaggg

SEQ ID NO: 7005843 - DNA, 22 bp, Homo sapiens
tggcttcagagtctgagttctt

SEQ ID NO: 7005844 - DNA, 22 bp, Homo sapiens
ttaggaaaagaagacatttcta

SEQ ID NO: 7005845 - DNA, 22 bp, Homo sapiens
caggctggagtacaattgtgtg

SEQ ID NO: 7005846 - DNA, 22 bp, Homo sapiens
gggtagcatgtgtcagagtttg

SEQ ID NO: 7005847 - DNA, 22 bp, Homo sapiens
tagtgtgtggtctctcccttgt

SEQ ID NO: 7005848 - DNA, 22 bp, Homo sapiens
gcaggtggggctgctaccagaa

SEQ ID NO: 7005849 - DNA, 22 bp, Homo sapiens
gttctgagtggcccaagccctg

SEQ ID NO: 7005850 - DNA, 22 bp, Homo sapiens
ggttcctgtgtactgtggctta

SEQ ID NO: 7005851 - DNA, 22 bp, Homo sapiens
tggaatcccgcaatggaggatt

SEQ ID NO: 7005852 - DNA, 22 bp, Homo sapiens
ttgcttcctggcagggcgagcg

SEQ ID NO: 7005853 - DNA, 22 bp, Homo sapiens
gggcacagctgctacccagtgc

SEQ ID NO: 7005854 - DNA, 21 bp, Homo sapiens
gcctgcctgcgtgaccctctt

SEQ ID NO: 7005855 - DNA, 20 bp, Homo sapiens
tttaggtcctgtgcctgggt

SEQ ID NO: 7005856 - DNA, 19 bp, Homo sapiens
tggaggcaagacatggagg

SEQ ID NO: 7005857 - DNA, 22 bp, Homo sapiens
acattctgaataggcattttat

SEQ ID NO: 7005858 - DNA, 22 bp, Homo sapiens
ccacaattctgctttaatttct

SEQ ID NO: 7005859 - DNA, 22 bp, Homo sapiens
agcacagattctgaagagtcct

SEQ ID NO: 7005860 - DNA, 22 bp, Homo sapiens
taagtcataagtcatgatgtta

SEQ ID NO: 7005861 - DNA, 22 bp, Homo sapiens
atggctggtagtgaattaatct

SEQ ID NO: 7005862 - DNA, 22 bp, Homo sapiens
tgcagcttctccaaatattaca

SEQ ID NO: 7005863 - DNA, 22 bp, Homo sapiens
ctgctggactacaggaagagtt

SEQ ID NO: 7005864 - DNA, 23 bp, Homo sapiens
cccagctgcagacaagggagggt

SEQ ID NO: 7005865 - DNA, 22 bp, Homo sapiens
gagtagggtttccaggttagag

SEQ ID NO: 7005866 - DNA, 22 bp, Homo sapiens
acagttacattccagcaacatc

SEQ ID NO: 7005867 - DNA, 22 bp, Homo sapiens
cattgaatccttccttcagaag

SEQ ID NO: 7005868 - DNA, 22 bp, Homo sapiens
ctcatccaccgcagcccctcag

SEQ ID NO: 7005869 - DNA, 22 bp, Homo sapiens
gggagtaaactatggtgaggat

SEQ ID NO: 7005870 - DNA, 22 bp, Homo sapiens
gtgcttccatctagagggtcac

SEQ ID NO: 7005871 - DNA, 22 bp, Homo sapiens
taaagctgcaggctcagaaaac

SEQ ID NO: 7005872 - DNA, 23 bp, Homo sapiens
aggactgctcacttgaggcttcc

SEQ ID NO: 7005873 - DNA, 23 bp, Homo sapiens
tgctgatgttgtattcctgactt

SEQ ID NO: 7005874 - DNA, 22 bp, Homo sapiens
agacttctttgtgagcattttc

SEQ ID NO: 7005875 - DNA, 22 bp, Homo sapiens
tggactctgaactggcactgac

SEQ ID NO: 7005876 - DNA, 22 bp, Homo sapiens
aggtcattgaagttattttctt

SEQ ID NO: 7005877 - DNA, 22 bp, Homo sapiens
ctcaggccaataagctccagcc

SEQ ID NO: 7005878 - DNA, 22 bp, Homo sapiens
tctctgaataatgctattcttt

SEQ ID NO: 7005879 - DNA, 22 bp, Homo sapiens
ttacatgttagaaaaggctgtt

SEQ ID NO: 7005880 - DNA, 22 bp, Homo sapiens
tggcatttagttgcgtattgca

SEQ ID NO: 7005881 - DNA, 22 bp, Homo sapiens
tcacactaagacaaaataattt

SEQ ID NO: 7005882 - DNA, 22 bp, Homo sapiens
acagaacttccagggaacatac

SEQ ID NO: 7005883 - DNA, 22 bp, Homo sapiens
tgagggtgggccctgggcatct

SEQ ID NO: 7005884 - DNA, 22 bp, Homo sapiens
gggggaagaggcatgaagtcct

SEQ ID NO: 7005885 - DNA, 22 bp, Homo sapiens
tttgctttgggaggttgtctgg

SEQ ID NO: 7005886 - DNA, 22 bp, Homo sapiens
tcaggaggtctgctgcggggtg

SEQ ID NO: 7005887 - DNA, 22 bp, Homo sapiens
gtcaaggcatctctagagcaat

SEQ ID NO: 7005888 - DNA, 20 bp, Homo sapiens
aggctcagctgagctcttgg

SEQ ID NO: 7005889 - DNA, 22 bp, Homo sapiens
gagagacagcagaacgtgcagc

SEQ ID NO: 7005890 - DNA, 21 bp, Homo sapiens
gcttccaagatggcaccttga

SEQ ID NO: 7005891 - DNA, 22 bp, Homo sapiens
ctagaaagatacttaaatcaag

SEQ ID NO: 7005892 - DNA, 19 bp, Homo sapiens
ctctagggtctaagggcag

SEQ ID NO: 7005893 - DNA, 22 bp, Homo sapiens
tgggatgataggtaagtaatta

SEQ ID NO: 7005894 - DNA, 20 bp, Homo sapiens
tccatgagttagagactata

SEQ ID NO: 7005895 - DNA, 22 bp, Homo sapiens
gaggctttgaatgcacggttca

SEQ ID NO: 7005896 - DNA, 22 bp, Homo sapiens
ggacccaggaattaattaagag

SEQ ID NO: 7005897 - DNA, 22 bp, Homo sapiens
agacagacggctttatacacag

SEQ ID NO: 7005898 - DNA, 22 bp, Homo sapiens
acagactgaagatatttccccc

SEQ ID NO: 7005899 - DNA, 22 bp, Homo sapiens
tcagccactacccaccttaaca

SEQ ID NO: 7005900 - DNA, 22 bp, Homo sapiens
gccagaaggggtggatccaggc

SEQ ID NO: 7005901 - DNA, 22 bp, Homo sapiens
tttcaaacattcctgggagact

SEQ ID NO: 7005902 - DNA, 22 bp, Homo sapiens
atttaccatatgtactgagtat

SEQ ID NO: 7005903 - DNA, 22 bp, Homo sapiens
tcactgggtaggacatgctgat

SEQ ID NO: 7005904 - DNA, 22 bp, Homo sapiens
gtgaggggagtaaagccatgtt

SEQ ID NO: 7005905 - DNA, 20 bp, Homo sapiens
ctgcagggtgagtgggcgat

SEQ ID NO: 7005906 - DNA, 22 bp, Homo sapiens
ctctggaggcagcaccagccag

SEQ ID NO: 7005907 - DNA, 22 bp, Homo sapiens
aggtgatgtccacagcttgcag

SEQ ID NO: 7005908 - DNA, 22 bp, Homo sapiens
ctctgctgttttgtatacaggc

SEQ ID NO: 7005909 - DNA, 22 bp, Homo sapiens
gtgtccttataagaagagatgc

SEQ ID NO: 7005910 - DNA, 22 bp, Homo sapiens
accatattagaaagcacagctc

SEQ ID NO: 7005911 - DNA, 20 bp, Homo sapiens
cgggacactcaagctctggg

SEQ ID NO: 7005912 - DNA, 22 bp, Homo sapiens
tctgtggaaatttcctgaggca

SEQ ID NO: 7005913 - DNA, 22 bp, Homo sapiens
aagagacatgaatactcgaagg

SEQ ID NO: 7005914 - DNA, 22 bp, Homo sapiens
ttttttggtgctcctaggaagg

SEQ ID NO: 7005915 - DNA, 22 bp, Homo sapiens
agtgatttcctggcaccctaca

SEQ ID NO: 7005916 - DNA, 22 bp, Homo sapiens
gctgtacagggttatcctttcc

SEQ ID NO: 7005917 - DNA, 22 bp, Homo sapiens
gatgcagaaagtagacaccatc

SEQ ID NO: 7005918 - DNA, 22 bp, Homo sapiens
aacaattatcatatacattgca

SEQ ID NO: 7005919 - DNA, 22 bp, Homo sapiens
gctcagggagtttcacagtgta

SEQ ID NO: 7005920 - DNA, 23 bp, Homo sapiens
ggagccctgagctgtccccatgc

SEQ ID NO: 7005921 - DNA, 22 bp, Homo sapiens
ggaggtcctaagttataaatgt

SEQ ID NO: 7005922 - DNA, 22 bp, Homo sapiens
aatagtcctgatttaatctggg

SEQ ID NO: 7005923 - DNA, 22 bp, Homo sapiens
ccagaatagaaggcagctgtca

SEQ ID NO: 7005924 - DNA, 22 bp, Homo sapiens
cctgcagggaatcgaggcagaa

SEQ ID NO: 7005925 - DNA, 22 bp, Homo sapiens
atgacaccatattagcctagag

SEQ ID NO: 7005926 - DNA, 22 bp, Homo sapiens
tgagaaagacagacattcctaa

SEQ ID NO: 7005927 - DNA, 22 bp, Homo sapiens
gcacatacacataagcgaactg

SEQ ID NO: 7005928 - DNA, 19 bp, Homo sapiens
ctggacctggaggcccgga

SEQ ID NO: 7005929 - DNA, 22 bp, Homo sapiens
gccaggggacgcggagcgacga

SEQ ID NO: 7005930 - DNA, 22 bp, Homo sapiens
gcacacaggcagtttccagcca

SEQ ID NO: 7005931 - DNA, 16 bp, Homo sapiens
ttcagagcggctcata

SEQ ID NO: 7005932 - DNA, 22 bp, Homo sapiens
tctgcccctgctgggcacagag

SEQ ID NO: 7005933 - DNA, 22 bp, Homo sapiens
ttgtagaagcagggtgccctct

SEQ ID NO: 7005934 - DNA, 22 bp, Homo sapiens
aatcagctttagtgtccttggc

SEQ ID NO: 7005935 - DNA, 22 bp, Homo sapiens
tctgggagagtagataaaggaa

SEQ ID NO: 7005936 - DNA, 22 bp, Homo sapiens
gatatgttgttgcctataccta

SEQ ID NO: 7005937 - DNA, 22 bp, Homo sapiens
atcgctttacagcctgcttcct

SEQ ID NO: 7005938 - DNA, 22 bp, Homo sapiens
gatttagtggcccttggtacac

SEQ ID NO: 7005939 - DNA, 22 bp, Homo sapiens
tcaggagcttagatgctttgac

SEQ ID NO: 7005940 - DNA, 22 bp, Homo sapiens
ctggctttgttctgattgcttc

SEQ ID NO: 7005941 - DNA, 22 bp, Homo sapiens
tctcagagcttcagttattttc

SEQ ID NO: 7005942 - DNA, 22 bp, Homo sapiens
atggggtgagactaggattaaa

SEQ ID NO: 7005943 - DNA, 22 bp, Homo sapiens
actgtagaggcctggattgagg

SEQ ID NO: 7005944 - DNA, 22 bp, Homo sapiens
gagctgggaggactgggaactt

SEQ ID NO: 7005945 - DNA, 22 bp, Homo sapiens
ttagcattttctgggctgaaat

SEQ ID NO: 7005946 - DNA, 22 bp, Homo sapiens
ctgtcctgcagttgggggcagg

SEQ ID NO: 7005947 - DNA, 22 bp, Homo sapiens
taatgtacctccagatgttgta

SEQ ID NO: 7005948 - DNA, 22 bp, Homo sapiens
gcacaagcacgagcagcgtgcg

SEQ ID NO: 7005949 - DNA, 22 bp, Homo sapiens
tcactacaaaagtctccctttc

SEQ ID NO: 7005950 - DNA, 22 bp, Homo sapiens
tccctgggaacaaaggatgaga

SEQ ID NO: 7005951 - DNA, 22 bp, Homo sapiens
atttctcctccagatggtggtt

SEQ ID NO: 7005952 - DNA, 22 bp, Homo sapiens
tacgtggtaggtatttacctta

SEQ ID NO: 7005953 - DNA, 22 bp, Homo sapiens
atggcagagaaagcgagccaca

SEQ ID NO: 7005954 - DNA, 22 bp, Homo sapiens
tttcagttcatctgtgaagatt

SEQ ID NO: 7005955 - DNA, 22 bp, Homo sapiens
aagacattcacaaatgttcact

SEQ ID NO: 7005956 - DNA, 17 bp, Homo sapiens
aagaccctagtctaccc

SEQ ID NO: 7005957 - DNA, 22 bp, Homo sapiens
ggtctagatcaagaacagaact

SEQ ID NO: 7005958 - DNA, 22 bp, Homo sapiens
gtgcaggagccaggggtaggaa

SEQ ID NO: 7005959 - DNA, 22 bp, Homo sapiens
ctgatgaccttggcaagtcaca

SEQ ID NO: 7005960 - DNA, 22 bp, Homo sapiens
cagaagatgctttgtaaaatga

SEQ ID NO: 7005961 - DNA, 22 bp, Homo sapiens
tggagctggcagcggaaaaggg

SEQ ID NO: 7005962 - DNA, 22 bp, Homo sapiens
gctcagagaagcggtttcgcct

SEQ ID NO: 7005963 - DNA, 22 bp, Homo sapiens
gatactgtatcctaaaagcttt

SEQ ID NO: 7005964 - DNA, 22 bp, Homo sapiens
tgtggcagagagagcttccttg

SEQ ID NO: 7005965 - DNA, 22 bp, Homo sapiens
agatttactccctgcttccgcc

SEQ ID NO: 7005966 - DNA, 23 bp, Homo sapiens
ggttccaggaacacagcctgatg

SEQ ID NO: 7005967 - DNA, 19 bp, Homo sapiens
gcaggcctcttgggaatta

SEQ ID NO: 7005968 - DNA, 22 bp, Homo sapiens
atccctggaagcaatgtttatt

SEQ ID NO: 7005969 - DNA, 22 bp, Homo sapiens
gatttccattttcaactcctgc

SEQ ID NO: 7005970 - DNA, 22 bp, Homo sapiens
gtggaaggtaatgcagcttact

SEQ ID NO: 7005971 - DNA, 20 bp, Homo sapiens
tgctgaagaatcacagatgg

SEQ ID NO: 7005972 - DNA, 22 bp, Homo sapiens
aatttctaattgaatctctctt

SEQ ID NO: 7005973 - DNA, 22 bp, Homo sapiens
agatggagaccttggatgaact

SEQ ID NO: 7005974 - DNA, 22 bp, Homo sapiens
aagactctatctttagagatca

SEQ ID NO: 7005975 - DNA, 22 bp, Homo sapiens
agtgattctcctgcctcagcct

SEQ ID NO: 7005976 - DNA, 22 bp, Homo sapiens
ctattaggttggtgcaaaagta

SEQ ID NO: 7005977 - DNA, 22 bp, Homo sapiens
agatgaataatttgttagcttt

SEQ ID NO: 7005978 - DNA, 22 bp, Homo sapiens
tttatctgatattcagcgattt

SEQ ID NO: 7005979 - DNA, 23 bp, Homo sapiens
ttcatacagaaacatcacttcat

SEQ ID NO: 7005980 - DNA, 22 bp, Homo sapiens
actaaagaacagttcgttcatg

SEQ ID NO: 7005981 - DNA, 22 bp, Homo sapiens
acatgagacaattgttgatgtt

SEQ ID NO: 7005982 - DNA, 22 bp, Homo sapiens
cctcagggaggcctctgtggct

SEQ ID NO: 7005983 - DNA, 22 bp, Homo sapiens
gctttaagtctcagtttgttag

SEQ ID NO: 7005984 - DNA, 19 bp, Homo sapiens
cgcaggtggaaggagccgc

SEQ ID NO: 7005985 - DNA, 22 bp, Homo sapiens
aagtgcaatttgaaattctgca

SEQ ID NO: 7005986 - DNA, 22 bp, Homo sapiens
taaagctattatagttatgttt

SEQ ID NO: 7005987 - DNA, 22 bp, Homo sapiens
tttcattatgttcctggaagag

SEQ ID NO: 7005988 - DNA, 22 bp, Homo sapiens
agatacatgtcaagagacttat

SEQ ID NO: 7005989 - DNA, 22 bp, Homo sapiens
gggactggaactactggtgcag

SEQ ID NO: 7005990 - DNA, 22 bp, Homo sapiens
tttaagattcagtaaggcaaac

SEQ ID NO: 7005991 - DNA, 22 bp, Homo sapiens
gagctggaggcagtgctgaggt

SEQ ID NO: 7005992 - DNA, 17 bp, Homo sapiens
gctaggagagggaggag

SEQ ID NO: 7005993 - DNA, 22 bp, Homo sapiens
aagtcatgagtcctcttctgtg

SEQ ID NO: 7005994 - DNA, 22 bp, Homo sapiens
tagctctgccaaatggaggctg

SEQ ID NO: 7005995 - DNA, 22 bp, Homo sapiens
gagaggccaagggatccgtgag

SEQ ID NO: 7005996 - DNA, 22 bp, Homo sapiens
tctctgtggtactgagagtcta

SEQ ID NO: 7005997 - DNA, 22 bp, Homo sapiens
aaggtaggctcagggttgttct

SEQ ID NO: 7005998 - DNA, 22 bp, Homo sapiens
ccagaggtctcctgcacgggat

SEQ ID NO: 7005999 - DNA, 22 bp, Homo sapiens
gaagggaatttggagggtttca

SEQ ID NO: 7006000 - DNA, 22 bp, Homo sapiens
gaacatctttaggggaccatca

SEQ ID NO: 7006001 - DNA, 22 bp, Homo sapiens
cttagaacagtgtctgccagag

SEQ ID NO: 7006002 - DNA, 22 bp, Homo sapiens
agggcagactaggatggaagtg

SEQ ID NO: 7006003 - DNA, 22 bp, Homo sapiens
tgaaagaaacaggtatattggg

SEQ ID NO: 7006004 - DNA, 22 bp, Homo sapiens
tgatgaggcttcttggtgaaca

SEQ ID NO: 7006005 - DNA, 22 bp, Homo sapiens
tctaaggtcaggggaaagtttg

SEQ ID NO: 7006006 - DNA, 22 bp, Homo sapiens
aatgctaacattggtttatatc

SEQ ID NO: 7006007 - DNA, 22 bp, Homo sapiens
ttctcagaaaatgtagagaaaa

SEQ ID NO: 7006008 - DNA, 21 bp, Homo sapiens
actaagagatctctgtctcat

SEQ ID NO: 7006009 - DNA, 22 bp, Homo sapiens
tggtagatacaactagtcagga

SEQ ID NO: 7006010 - DNA, 22 bp, Homo sapiens
acataatgaaatgcagaaatca

SEQ ID NO: 7006011 - DNA, 22 bp, Homo sapiens
aggttatatgtcatactgaagt

SEQ ID NO: 7006012 - DNA, 22 bp, Homo sapiens
gaggagactgacagcagattct

SEQ ID NO: 7006013 - DNA, 22 bp, Homo sapiens
tgctttcatattgcctatgact

SEQ ID NO: 7006014 - DNA, 22 bp, Homo sapiens
ctatttcagctgcctttgactg

SEQ ID NO: 7006015 - DNA, 22 bp, Homo sapiens
gacctggtgcaggtggacagag

SEQ ID NO: 7006016 - DNA, 22 bp, Homo sapiens
cagtgtgtctcttgtcctggct

SEQ ID NO: 7006017 - DNA, 22 bp, Homo sapiens
ctttttacaaagcctgtcttct

SEQ ID NO: 7006018 - DNA, 22 bp, Homo sapiens
atgcaacaaatgctacgaatcg

SEQ ID NO: 7006019 - DNA, 20 bp, Homo sapiens
gagatcctcatctgtaaagt

SEQ ID NO: 7006020 - DNA, 22 bp, Homo sapiens
ttcaaactgaggagaggatggc

SEQ ID NO: 7006021 - DNA, 22 bp, Homo sapiens
agttactttctgatcagtgtgt

SEQ ID NO: 7006022 - DNA, 21 bp, Homo sapiens
tgacaggcaccctggctgtga

SEQ ID NO: 7006023 - DNA, 22 bp, Homo sapiens
aggggctcctttgtgctgcgtc

SEQ ID NO: 7006024 - DNA, 22 bp, Homo sapiens
aatccatttactctttacaaga

SEQ ID NO: 7006025 - DNA, 22 bp, Homo sapiens
agtcccctctcgcttggctgag

SEQ ID NO: 7006026 - DNA, 22 bp, Homo sapiens
aggactaactgaactctaacgt

SEQ ID NO: 7006027 - DNA, 22 bp, Homo sapiens
gcaaattgggaaatttctctag

SEQ ID NO: 7006028 - DNA, 22 bp, Homo sapiens
tgctgtcctgttttggagtaat

SEQ ID NO: 7006029 - DNA, 22 bp, Homo sapiens
atagttcacagccatgcagtgg

SEQ ID NO: 7006030 - DNA, 22 bp, Homo sapiens
ttgaagttgcacattataattt

SEQ ID NO: 7006031 - DNA, 20 bp, Homo sapiens
aaaagagtgcttcaactgct

SEQ ID NO: 7006032 - DNA, 22 bp, Homo sapiens
tacagtagaatcttatagccca

SEQ ID NO: 7006033 - DNA, 21 bp, Homo sapiens
ctgagcttattgaaaggaaga

SEQ ID NO: 7006034 - DNA, 22 bp, Homo sapiens
tcagtgcagcggcagcagctct

SEQ ID NO: 7006035 - DNA, 22 bp, Homo sapiens
gactcctggctttccctcttag

SEQ ID NO: 7006036 - DNA, 22 bp, Homo sapiens
tgaaaattaagcagatgaatga

SEQ ID NO: 7006037 - DNA, 19 bp, Homo sapiens
tacatgcagcaggcacgca

SEQ ID NO: 7006038 - DNA, 22 bp, Homo sapiens
agagtttagggctgagagcttg

SEQ ID NO: 7006039 - DNA, 17 bp, Homo sapiens
gtcaatattgttgacag

SEQ ID NO: 7006040 - DNA, 22 bp, Homo sapiens
atccaggctgggtgtggctact

SEQ ID NO: 7006041 - DNA, 22 bp, Homo sapiens
agccttgcctgggaaactgggt

SEQ ID NO: 7006042 - DNA, 22 bp, Homo sapiens
ggagaggatgttttagtaactt

SEQ ID NO: 7006043 - DNA, 22 bp, Homo sapiens
cagcaagatttttaaagcaagg

SEQ ID NO: 7006044 - DNA, 22 bp, Homo sapiens
aggttggctgctcttttcctaa

SEQ ID NO: 7006045 - DNA, 22 bp, Homo sapiens
ggtggccctaaccgcagcctcc

SEQ ID NO: 7006046 - DNA, 22 bp, Homo sapiens
ttcagctatggagtcttagtta

SEQ ID NO: 7006047 - DNA, 22 bp, Homo sapiens
tatttgaccgtgaggaatatga

SEQ ID NO: 7006048 - DNA, 22 bp, Homo sapiens
actggcaatagcaaatgcttgg

SEQ ID NO: 7006049 - DNA, 22 bp, Homo sapiens
gactgcttcccagtaagggttt

SEQ ID NO: 7006050 - DNA, 22 bp, Homo sapiens
gcactgacatttcaagaacagc

SEQ ID NO: 7006051 - DNA, 22 bp, Homo sapiens
aggggttggacataagacagaa

SEQ ID NO: 7006052 - DNA, 22 bp, Homo sapiens
gacctgcctgagctgcctctgc

SEQ ID NO: 7006053 - DNA, 22 bp, Homo sapiens
aaggatctttctttttaccatt

SEQ ID NO: 7006054 - DNA, 23 bp, Homo sapiens
aggtgcccagggcaggtttactg

SEQ ID NO: 7006055 - DNA, 22 bp, Homo sapiens
acatttgtgcacatgtgcatgg

SEQ ID NO: 7006056 - DNA, 22 bp, Homo sapiens
tgtggctcggccagctgctgaa

SEQ ID NO: 7006057 - DNA, 22 bp, Homo sapiens
catcttgaaggtttctttagct

SEQ ID NO: 7006058 - DNA, 22 bp, Homo sapiens
tagtttactcatctataaaatg

SEQ ID NO: 7006059 - DNA, 22 bp, Homo sapiens
agaagaaatgtgaaggccactg

SEQ ID NO: 7006060 - DNA, 22 bp, Homo sapiens
aagatggcttagagtcctggtg

SEQ ID NO: 7006061 - DNA, 22 bp, Homo sapiens
tattcttgtatactacaatctt

SEQ ID NO: 7006062 - DNA, 22 bp, Homo sapiens
gctgcggctgtggaggtaccac

SEQ ID NO: 7006063 - DNA, 22 bp, Homo sapiens
gacaatgcattgtgattgtgac

SEQ ID NO: 7006064 - DNA, 22 bp, Homo sapiens
attgaaaggttttgagcagata

SEQ ID NO: 7006065 - DNA, 22 bp, Homo sapiens
atatttgttagagtctatgtgt

SEQ ID NO: 7006066 - DNA, 22 bp, Homo sapiens
tctgggccggagccgacggcag

SEQ ID NO: 7006067 - DNA, 22 bp, Homo sapiens
ctgctttttgtaggtcccagag

SEQ ID NO: 7006068 - DNA, 22 bp, Homo sapiens
caaggaaggagagatgatgggt

SEQ ID NO: 7006069 - DNA, 22 bp, Homo sapiens
tgcatgcaaagtgtctgctttg

SEQ ID NO: 7006070 - DNA, 22 bp, Homo sapiens
aaactgtttccctccataacct

SEQ ID NO: 7006071 - DNA, 17 bp, Homo sapiens
tgtaacaactcctatta

SEQ ID NO: 7006072 - DNA, 22 bp, Homo sapiens
gaccatttgttgaaaagattat

SEQ ID NO: 7006073 - DNA, 22 bp, Homo sapiens
tggcttcaggagcacctggctt

SEQ ID NO: 7006074 - DNA, 18 bp, Homo sapiens
ctccaaggtctctggctt

SEQ ID NO: 7006075 - DNA, 22 bp, Homo sapiens
tgcagttttcaaaagtttacag

SEQ ID NO: 7006076 - DNA, 22 bp, Homo sapiens
tctgtattctatggcagttggt

SEQ ID NO: 7006077 - DNA, 22 bp, Homo sapiens
tccaggagtgtgtgctaatggg

SEQ ID NO: 7006078 - DNA, 22 bp, Homo sapiens
gtgtgtctttcatttcatgagg

SEQ ID NO: 7006079 - DNA, 22 bp, Homo sapiens
gcttcctgagaaacaatctgat

SEQ ID NO: 7006080 - DNA, 22 bp, Homo sapiens
agcacaatgtgaaaagagctct

SEQ ID NO: 7006081 - DNA, 21 bp, Homo sapiens
tcccactctaaatggactgaa

SEQ ID NO: 7006082 - DNA, 22 bp, Homo sapiens
agcaccccatagtcagtcacgt

SEQ ID NO: 7006083 - DNA, 22 bp, Homo sapiens
tgcattaatttttgccaggttc

SEQ ID NO: 7006084 - DNA, 22 bp, Homo sapiens
gttgatgaaaatgaattgcatg

SEQ ID NO: 7006085 - DNA, 22 bp, Homo sapiens
gaagagctatgtccagggagca

SEQ ID NO: 7006086 - DNA, 22 bp, Homo sapiens
agggctttgtttaggtgaccac

SEQ ID NO: 7006087 - DNA, 22 bp, Homo sapiens
aatcagttgtccaaagttcaca

SEQ ID NO: 7006088 - DNA, 22 bp, Homo sapiens
ctatttggccagaagagggtca

SEQ ID NO: 7006089 - DNA, 22 bp, Homo sapiens
tgcattgttgaatatttcatag

SEQ ID NO: 7006090 - DNA, 22 bp, Homo sapiens
caaagtgctaggattataggtg

SEQ ID NO: 7006091 - DNA, 22 bp, Homo sapiens
cactgtaacctccacctcctgg

SEQ ID NO: 7006092 - DNA, 22 bp, Homo sapiens
gcctgctgggagacacccccag

SEQ ID NO: 7006093 - DNA, 22 bp, Homo sapiens
tagattttacttctgtcattac

SEQ ID NO: 7006094 - DNA, 22 bp, Homo sapiens
ctgagccatgggtctaagcact

SEQ ID NO: 7006095 - DNA, 22 bp, Homo sapiens
ctcagagtccccacatctgggt

SEQ ID NO: 7006096 - DNA, 17 bp, Homo sapiens
acatgggctgagactcc

SEQ ID NO: 7006097 - DNA, 22 bp, Homo sapiens
gggggcgccccatggaggtgag

SEQ ID NO: 7006098 - DNA, 22 bp, Homo sapiens
caggttcaagcgattctcctgc

SEQ ID NO: 7006099 - DNA, 22 bp, Homo sapiens
ggctgcctcagatttgctgact

SEQ ID NO: 7006100 - DNA, 22 bp, Homo sapiens
ggctgcctctgatgtgcagacg

SEQ ID NO: 7006101 - DNA, 22 bp, Homo sapiens
ctgggtcagtctgtccctaggg

SEQ ID NO: 7006102 - DNA, 22 bp, Homo sapiens
cactctgggggctgccgctgcc

SEQ ID NO: 7006103 - DNA, 22 bp, Homo sapiens
ctgcctgtgaacatactggggg

SEQ ID NO: 7006104 - DNA, 22 bp, Homo sapiens
gccgccatatcatctgcctctt

SEQ ID NO: 7006105 - DNA, 22 bp, Homo sapiens
tgtatgcagcaaaacaattagt

SEQ ID NO: 7006106 - DNA, 22 bp, Homo sapiens
aactgagcaccactgatgttat

SEQ ID NO: 7006107 - DNA, 19 bp, Homo sapiens
acagtgtctgtatataaat

SEQ ID NO: 7006108 - DNA, 22 bp, Homo sapiens
tctcttaataagtaaatactga

SEQ ID NO: 7006109 - DNA, 22 bp, Homo sapiens
cccagctccttggatgggcagg

SEQ ID NO: 7006110 - DNA, 22 bp, Homo sapiens
gttacaaaggactgggggccac

SEQ ID NO: 7006111 - DNA, 22 bp, Homo sapiens
taagacatttgaaatgtgatcc

SEQ ID NO: 7006112 - DNA, 22 bp, Homo sapiens
aatacagaggcttccagtaaaa

SEQ ID NO: 7006113 - DNA, 22 bp, Homo sapiens
aagctgttctccagtgactcag

SEQ ID NO: 7006114 - DNA, 22 bp, Homo sapiens
ctcagtttgtgtgatattgtct

SEQ ID NO: 7006115 - DNA, 22 bp, Homo sapiens
tttcttgagctaggaacctggg

SEQ ID NO: 7006116 - DNA, 20 bp, Homo sapiens
tctctgagtttcctaatttg

SEQ ID NO: 7006117 - DNA, 22 bp, Homo sapiens
aaaagcaattgcagttcttgcc

SEQ ID NO: 7006118 - DNA, 22 bp, Homo sapiens
gcactagttctactgccagcaa

SEQ ID NO: 7006119 - DNA, 22 bp, Homo sapiens
gccctgaggatttgcatttcct

SEQ ID NO: 7006120 - DNA, 22 bp, Homo sapiens
ctgccttggaaaatgtggtaat

SEQ ID NO: 7006121 - DNA, 22 bp, Homo sapiens
gttttggcagccgtgttcacat

SEQ ID NO: 7006122 - DNA, 22 bp, Homo sapiens
ttcagtatccctgcttggacag

SEQ ID NO: 7006123 - DNA, 22 bp, Homo sapiens
tctcatggatccccctgtatag

SEQ ID NO: 7006124 - DNA, 22 bp, Homo sapiens
tctgtgccatcagtctccagag

SEQ ID NO: 7006125 - DNA, 22 bp, Homo sapiens
tatcgagctggacgggctggtc

SEQ ID NO: 7006126 - DNA, 22 bp, Homo sapiens
agtgcaaaattcagaagcaatt

SEQ ID NO: 7006127 - DNA, 23 bp, Homo sapiens
gcactcatctgaagctatggtgc

SEQ ID NO: 7006128 - DNA, 22 bp, Homo sapiens
ttaggcacagatgctgggtgct

SEQ ID NO: 7006129 - DNA, 22 bp, Homo sapiens
gctttagatagatttagtcttt

SEQ ID NO: 7006130 - DNA, 17 bp, Homo sapiens
gccctggagccaggcta

SEQ ID NO: 7006131 - DNA, 18 bp, Homo sapiens
tcagtcctccatagagct

SEQ ID NO: 7006132 - DNA, 22 bp, Homo sapiens
tttagcaggcagggatgggtgt

SEQ ID NO: 7006133 - DNA, 22 bp, Homo sapiens
gtgattgtgaaaacattaagaa

SEQ ID NO: 7006134 - DNA, 22 bp, Homo sapiens
agaaggcaggttttaaaatgtc

SEQ ID NO: 7006135 - DNA, 22 bp, Homo sapiens
aatgttcagcgagggatgctag

SEQ ID NO: 7006136 - DNA, 22 bp, Homo sapiens
aggctacagcctcaagagtgca

SEQ ID NO: 7006137 - DNA, 22 bp, Homo sapiens
gaagtctgacaggtctgaatca

SEQ ID NO: 7006138 - DNA, 22 bp, Homo sapiens
catttagagagtaaaaattagc

SEQ ID NO: 7006139 - DNA, 22 bp, Homo sapiens
tgttatgagtcctcatatacta

SEQ ID NO: 7006140 - DNA, 22 bp, Homo sapiens
aaggaactgctgatgtggtgac

SEQ ID NO: 7006141 - DNA, 22 bp, Homo sapiens
aaggcattatgatttgagtacc

SEQ ID NO: 7006142 - DNA, 22 bp, Homo sapiens
tagatgctacaattttgtactc

SEQ ID NO: 7006143 - DNA, 22 bp, Homo sapiens
aatgttgtgcatgtattttgta

SEQ ID NO: 7006144 - DNA, 22 bp, Homo sapiens
agtggcagagctgtgtcttgaa

SEQ ID NO: 7006145 - DNA, 22 bp, Homo sapiens
agaatctgcatttctaataagc

SEQ ID NO: 7006146 - DNA, 22 bp, Homo sapiens
ttgatctcttgtgtatggtaga

SEQ ID NO: 7006147 - DNA, 22 bp, Homo sapiens
tgccttggttctctacttggag

SEQ ID NO: 7006148 - DNA, 22 bp, Homo sapiens
cagggctggctcatgaaaagtt

SEQ ID NO: 7006149 - DNA, 22 bp, Homo sapiens
ctctgtgaacccctcctttctt

SEQ ID NO: 7006150 - DNA, 20 bp, Homo sapiens
tgagcttcagatatcgtgca

SEQ ID NO: 7006151 - DNA, 22 bp, Homo sapiens
aaagtcatcagaaccttccaga

SEQ ID NO: 7006152 - DNA, 22 bp, Homo sapiens
tctaacttgaactcatgactgt

SEQ ID NO: 7006153 - DNA, 22 bp, Homo sapiens
ttgcagaaaacagttttcttgt

SEQ ID NO: 7006154 - DNA, 22 bp, Homo sapiens
ccagccagggaaactttttctt

SEQ ID NO: 7006155 - DNA, 22 bp, Homo sapiens
atgctaaaaacttgatcattat

SEQ ID NO: 7006156 - DNA, 22 bp, Homo sapiens
tgaatccttcgcacttagacat

SEQ ID NO: 7006157 - DNA, 22 bp, Homo sapiens
ctgtggctatggtgtacatact

SEQ ID NO: 7006158 - DNA, 22 bp, Homo sapiens
tctgggccaacccttccatggg

SEQ ID NO: 7006159 - DNA, 22 bp, Homo sapiens
actgtgtgctggacatgatgtt

SEQ ID NO: 7006160 - DNA, 22 bp, Homo sapiens
ctggcagtgccctcagccccca

SEQ ID NO: 7006161 - DNA, 22 bp, Homo sapiens
aaccagctctgcaaaatgtcat

SEQ ID NO: 7006162 - DNA, 22 bp, Homo sapiens
aaacattccctaatgtgtccgt

SEQ ID NO: 7006163 - DNA, 23 bp, Homo sapiens
atcctgctgatggccctccagga

SEQ ID NO: 7006164 - DNA, 22 bp, Homo sapiens
attccagtgtgcttccttgcta

SEQ ID NO: 7006165 - DNA, 22 bp, Homo sapiens
ctggtttagtcataatggagaa

SEQ ID NO: 7006166 - DNA, 22 bp, Homo sapiens
aatatcagctctgtcacttact

SEQ ID NO: 7006167 - DNA, 22 bp, Homo sapiens
ccaggaggaaattctaaaggta

SEQ ID NO: 7006168 - DNA, 22 bp, Homo sapiens
tgacatgtggctttgacccagg

SEQ ID NO: 7006169 - DNA, 22 bp, Homo sapiens
gctcagaccccaccctggcaga

SEQ ID NO: 7006170 - DNA, 22 bp, Homo sapiens
gggcccggaccttcctctctga

SEQ ID NO: 7006171 - DNA, 22 bp, Homo sapiens
aatggccatatcattgcagagc

SEQ ID NO: 7006172 - DNA, 22 bp, Homo sapiens
tccttcagcttgttagagtgac

SEQ ID NO: 7006173 - DNA, 22 bp, Homo sapiens
tgcaggctcacctgccagggcc

SEQ ID NO: 7006174 - DNA, 22 bp, Homo sapiens
aaggccttttcagttcctcctt

SEQ ID NO: 7006175 - DNA, 18 bp, Homo sapiens
tgggcttgaaagcaaggt

SEQ ID NO: 7006176 - DNA, 22 bp, Homo sapiens
aggcttctccacataaagttac

SEQ ID NO: 7006177 - DNA, 22 bp, Homo sapiens
aatgtgtttagttaatgagttg

SEQ ID NO: 7006178 - DNA, 23 bp, Homo sapiens
taaagtggcgctgttactgccag

SEQ ID NO: 7006179 - DNA, 22 bp, Homo sapiens
ctctttgacgtgcccatgtccc

SEQ ID NO: 7006180 - DNA, 22 bp, Homo sapiens
taacagaggtagaattcaaggt

SEQ ID NO: 7006181 - DNA, 22 bp, Homo sapiens
cactaattccatctccttttcc

SEQ ID NO: 7006182 - DNA, 22 bp, Homo sapiens
cccttagccaggaaatcgacct

SEQ ID NO: 7006183 - DNA, 22 bp, Homo sapiens
aagataagtaacgagcctcagt

SEQ ID NO: 7006184 - DNA, 21 bp, Homo sapiens
tcagaagagctgcctcttggt

SEQ ID NO: 7006185 - DNA, 22 bp, Homo sapiens
gtccaggccccagggattcttg

SEQ ID NO: 7006186 - DNA, 22 bp, Homo sapiens
cttgattctcagaatgcttgct

SEQ ID NO: 7006187 - DNA, 22 bp, Homo sapiens
cccctcataggtcagacacgca

SEQ ID NO: 7006188 - DNA, 22 bp, Homo sapiens
cagtgcagctgccccgctggta

SEQ ID NO: 7006189 - DNA, 22 bp, Homo sapiens
actctaaaagtgaagtgtggtc

SEQ ID NO: 7006190 - DNA, 22 bp, Homo sapiens
gtgcttaacctagtttctagta

SEQ ID NO: 7006191 - DNA, 22 bp, Homo sapiens
taggttcacacatcttccagat

SEQ ID NO: 7006192 - DNA, 22 bp, Homo sapiens
aaaggataaggttatcaatttt

SEQ ID NO: 7006193 - DNA, 22 bp, Homo sapiens
agttaacacagtcaggagtaac

SEQ ID NO: 7006194 - DNA, 22 bp, Homo sapiens
tctggcagctcagttcaggtct

SEQ ID NO: 7006195 - DNA, 22 bp, Homo sapiens
tagggctctggtgggctctgtt

SEQ ID NO: 7006196 - DNA, 23 bp, Homo sapiens
aaacaagtctctcaatggcttgc

SEQ ID NO: 7006197 - DNA, 22 bp, Homo sapiens
gacacgtttctgaattctgaag

SEQ ID NO: 7006198 - DNA, 19 bp, Homo sapiens
acctctgagaatgccagtc

SEQ ID NO: 7006199 - DNA, 22 bp, Homo sapiens
cctgtctgtcctctcatgagcc

SEQ ID NO: 7006200 - DNA, 22 bp, Homo sapiens
tatcaccagagggatagtctct

SEQ ID NO: 7006201 - DNA, 22 bp, Homo sapiens
tatcttgtgcagatgaaagaat

SEQ ID NO: 7006202 - DNA, 22 bp, Homo sapiens
agaggccagcccaggccaccga

SEQ ID NO: 7006203 - DNA, 22 bp, Homo sapiens
agcagggcagctgatgcgcacg

SEQ ID NO: 7006204 - DNA, 22 bp, Homo sapiens
tgtatttgttgttaaatggaga

SEQ ID NO: 7006205 - DNA, 22 bp, Homo sapiens
gtgtgccctggctccagcacca

SEQ ID NO: 7006206 - DNA, 22 bp, Homo sapiens
ggagcactttctaggagaagcc

SEQ ID NO: 7006207 - DNA, 22 bp, Homo sapiens
tggcagcagggaggccagtgtt

SEQ ID NO: 7006208 - DNA, 22 bp, Homo sapiens
cttagtagccattatataattt

SEQ ID NO: 7006209 - DNA, 22 bp, Homo sapiens
cagtcccaaggaggaagcagtc

SEQ ID NO: 7006210 - DNA, 22 bp, Homo sapiens
gctccaagatcattttcccatt

SEQ ID NO: 7006211 - DNA, 22 bp, Homo sapiens
gcttccaggggctgtgggctga

SEQ ID NO: 7006212 - DNA, 22 bp, Homo sapiens
agcctctgatgatcacaggggg

SEQ ID NO: 7006213 - DNA, 22 bp, Homo sapiens
acatctttatactagtccttga

SEQ ID NO: 7006214 - DNA, 22 bp, Homo sapiens
tttctgaacttggtactggagc

SEQ ID NO: 7006215 - DNA, 16 bp, Homo sapiens
actggagtggggatgc

SEQ ID NO: 7006216 - DNA, 22 bp, Homo sapiens
cattgcactccagcttgggcaa

SEQ ID NO: 7006217 - DNA, 22 bp, Homo sapiens
ccgggaggctaaggttgcagtg

SEQ ID NO: 7006218 - DNA, 22 bp, Homo sapiens
acccatcacttttaggctttgc

SEQ ID NO: 7006219 - DNA, 17 bp, Homo sapiens
tatgtagtacttataaa

SEQ ID NO: 7006220 - DNA, 22 bp, Homo sapiens
acagcagcgtcaacttaaaatt

SEQ ID NO: 7006221 - DNA, 18 bp, Homo sapiens
ttggggtgaggccaggaa

SEQ ID NO: 7006222 - DNA, 22 bp, Homo sapiens
atttgtcacacatagtttatcc

SEQ ID NO: 7006223 - DNA, 22 bp, Homo sapiens
ttgagactgagtctcgccctgt

SEQ ID NO: 7006224 - DNA, 22 bp, Homo sapiens
ccagaggctgggttcacctcag

SEQ ID NO: 7006225 - DNA, 22 bp, Homo sapiens
tgcatgcatgatgtttggtagc

SEQ ID NO: 7006226 - DNA, 22 bp, Homo sapiens
ccatccatatggtgacaaggtg

SEQ ID NO: 7006227 - DNA, 22 bp, Homo sapiens
ctgaaggatttagttctttgct

SEQ ID NO: 7006228 - DNA, 22 bp, Homo sapiens
tcacagagcacgtatcatgcct

SEQ ID NO: 7006229 - DNA, 22 bp, Homo sapiens
gatggtttatgatagatgggaa

SEQ ID NO: 7006230 - DNA, 22 bp, Homo sapiens
tcttcctctagatctgaggccc

SEQ ID NO: 7006231 - DNA, 22 bp, Homo sapiens
ttcctctgtagttgctgatgaa

SEQ ID NO: 7006232 - DNA, 22 bp, Homo sapiens
agccttgcagaataatttgaag

SEQ ID NO: 7006233 - DNA, 22 bp, Homo sapiens
taatttaattccatggattcta

SEQ ID NO: 7006234 - DNA, 22 bp, Homo sapiens
atgttacattgagaggtggttg

SEQ ID NO: 7006235 - DNA, 22 bp, Homo sapiens
tagctttgtgaagtttacagac

SEQ ID NO: 7006236 - DNA, 22 bp, Homo sapiens
ttgaaagtagcagctgcatatg

SEQ ID NO: 7006237 - DNA, 18 bp, Homo sapiens
gtgacagctgctagctca

SEQ ID NO: 7006238 - DNA, 22 bp, Homo sapiens
ggagctcagaagtgagtgagtt

SEQ ID NO: 7006239 - DNA, 22 bp, Homo sapiens
aacattcttaagatttgtgtct

SEQ ID NO: 7006240 - DNA, 22 bp, Homo sapiens
ctgctcggcgcgcatggctgcc

SEQ ID NO: 7006241 - DNA, 22 bp, Homo sapiens
tcacagcaccctgaggtgctgg

SEQ ID NO: 7006242 - DNA, 22 bp, Homo sapiens
gagagagaggtgctgccaggca

SEQ ID NO: 7006243 - DNA, 22 bp, Homo sapiens
tattgaaatccattacgttctt

SEQ ID NO: 7006244 - DNA, 22 bp, Homo sapiens
tgtctgagctttatgatggaag

SEQ ID NO: 7006245 - DNA, 22 bp, Homo sapiens
tgaagatttaagcatctcaatt

SEQ ID NO: 7006246 - DNA, 22 bp, Homo sapiens
catttctcctgggtgataaatt

SEQ ID NO: 7006247 - DNA, 22 bp, Homo sapiens
tctgtagcattcaccagccctg

SEQ ID NO: 7006248 - DNA, 21 bp, Homo sapiens
tgcaggctgtttaagaggcaa

SEQ ID NO: 7006249 - DNA, 22 bp, Homo sapiens
atgcagttccacaggcgcatgg

SEQ ID NO: 7006250 - DNA, 22 bp, Homo sapiens
tctttggggcatctgggagatt

SEQ ID NO: 7006251 - DNA, 22 bp, Homo sapiens
ggctggacatagacatagccat

SEQ ID NO: 7006252 - DNA, 22 bp, Homo sapiens
tgtccagttgtttgaccacggc

SEQ ID NO: 7006253 - DNA, 22 bp, Homo sapiens
agtttcacaaattgtcaatagc

SEQ ID NO: 7006254 - DNA, 22 bp, Homo sapiens
attacttcaatttctcagtgaa

SEQ ID NO: 7006255 - DNA, 17 bp, Homo sapiens
tcatttcagtaaatcca

SEQ ID NO: 7006256 - DNA, 22 bp, Homo sapiens
gttcttcagattccatttcagt

SEQ ID NO: 7006257 - DNA, 22 bp, Homo sapiens
tgcttcgccccctggtgcagct

SEQ ID NO: 7006258 - DNA, 22 bp, Homo sapiens
cacaaatccaatttaattctgg

SEQ ID NO: 7006259 - DNA, 22 bp, Homo sapiens
atcataattgctccagtgatat

SEQ ID NO: 7006260 - DNA, 22 bp, Homo sapiens
ttgaggtccagtctccacccac

SEQ ID NO: 7006261 - DNA, 22 bp, Homo sapiens
agaggcaagggacctttctggg

SEQ ID NO: 7006262 - DNA, 22 bp, Homo sapiens
caaaggaggtaatgggtgtgag

SEQ ID NO: 7006263 - DNA, 22 bp, Homo sapiens
gtcgctgaggagatgtgcaagg

SEQ ID NO: 7006264 - DNA, 22 bp, Homo sapiens
tgccaggcacgtgagagtggcc

SEQ ID NO: 7006265 - DNA, 22 bp, Homo sapiens
tgccagtgagccctgggatgtg

SEQ ID NO: 7006266 - DNA, 22 bp, Homo sapiens
tgcacttcattgtaaattgtac

SEQ ID NO: 7006267 - DNA, 22 bp, Homo sapiens
atgaagctctaaatgtacttag

SEQ ID NO: 7006268 - DNA, 20 bp, Homo sapiens
tagcttgaagaactccagag

SEQ ID NO: 7006269 - DNA, 21 bp, Homo sapiens
tcctgagtgtgcccaggctct

SEQ ID NO: 7006270 - DNA, 22 bp, Homo sapiens
gcccagggctgcaagtggacgc

SEQ ID NO: 7006271 - DNA, 22 bp, Homo sapiens
ccctctacagggaagcgctttc

SEQ ID NO: 7006272 - DNA, 22 bp, Homo sapiens
aacacagcatcccttaggtcgt

SEQ ID NO: 7006273 - DNA, 22 bp, Homo sapiens
tcctggggtttagagggaagtg

SEQ ID NO: 7006274 - DNA, 22 bp, Homo sapiens
acattgatgaaaaggtatcatt

SEQ ID NO: 7006275 - DNA, 22 bp, Homo sapiens
gtgatgtcttgtacatatgatt

SEQ ID NO: 7006276 - DNA, 22 bp, Homo sapiens
tatgcagcaccactcactgcag

SEQ ID NO: 7006277 - DNA, 22 bp, Homo sapiens
tacagaatatttctgccctgag

SEQ ID NO: 7006278 - DNA, 22 bp, Homo sapiens
tatccttgtactatagtattta

SEQ ID NO: 7006279 - DNA, 22 bp, Homo sapiens
atcttgcatttgctaaaatgca

SEQ ID NO: 7006280 - DNA, 21 bp, Homo sapiens
tccttgctattttcctcagct

SEQ ID NO: 7006281 - DNA, 23 bp, Homo sapiens
atacaaaccttgcaggacatgtt

SEQ ID NO: 7006282 - DNA, 22 bp, Homo sapiens
tgggcagtggctgggcctctct

SEQ ID NO: 7006283 - DNA, 22 bp, Homo sapiens
gcaaggcagcatccttttgagg

SEQ ID NO: 7006284 - DNA, 22 bp, Homo sapiens
atgcacaggtgctgatgcacgc

SEQ ID NO: 7006285 - DNA, 22 bp, Homo sapiens
ctgtgagtgagatggccacagg

SEQ ID NO: 7006286 - DNA, 22 bp, Homo sapiens
atgcatgcaagtgcacatatgc

SEQ ID NO: 7006287 - DNA, 22 bp, Homo sapiens
aaactttggtatgtagcaaaac

SEQ ID NO: 7006288 - DNA, 22 bp, Homo sapiens
agtgccctgtggcttcagcaat

SEQ ID NO: 7006289 - DNA, 22 bp, Homo sapiens
ctgctggttgcacagagctagg

SEQ ID NO: 7006290 - DNA, 22 bp, Homo sapiens
gcagcgtggggctgagtcagct

SEQ ID NO: 7006291 - DNA, 22 bp, Homo sapiens
ggctacagtggcactgggcttt

SEQ ID NO: 7006292 - DNA, 22 bp, Homo sapiens
tttggagaagttgctaaagtgt

SEQ ID NO: 7006293 - DNA, 22 bp, Homo sapiens
ctcagggatggtgaagcaccca

SEQ ID NO: 7006294 - DNA, 21 bp, Homo sapiens
ttgcttgaaccaaaaggcata

SEQ ID NO: 7006295 - DNA, 22 bp, Homo sapiens
aatcacttgtaaggaattcaat

SEQ ID NO: 7006296 - DNA, 22 bp, Homo sapiens
cataatcagatgtgtacataag

SEQ ID NO: 7006297 - DNA, 18 bp, Homo sapiens
aacttcaactacaatgga

SEQ ID NO: 7006298 - DNA, 22 bp, Homo sapiens
gtgccagagacatgactagctg

SEQ ID NO: 7006299 - DNA, 22 bp, Homo sapiens
gcaccgttcactctccgccaga

SEQ ID NO: 7006300 - DNA, 22 bp, Homo sapiens
aaggcattgagcagttacagta

SEQ ID NO: 7006301 - DNA, 22 bp, Homo sapiens
catttgctctggttccttctgg

SEQ ID NO: 7006302 - DNA, 22 bp, Homo sapiens
tcccagattcttctgtgtgggc

SEQ ID NO: 7006303 - DNA, 16 bp, Homo sapiens
tctctgcttcataggt

SEQ ID NO: 7006304 - DNA, 20 bp, Homo sapiens
gggtgtgggcccggccaggc

SEQ ID NO: 7006305 - DNA, 22 bp, Homo sapiens
tgggagagtaaccaattccttc

SEQ ID NO: 7006306 - DNA, 22 bp, Homo sapiens
catcttaacaggtctctgaggg

SEQ ID NO: 7006307 - DNA, 22 bp, Homo sapiens
tgctacttttgaaatcttcctt

SEQ ID NO: 7006308 - DNA, 22 bp, Homo sapiens
tgggaccacactttgaacaaca

SEQ ID NO: 7006309 - DNA, 22 bp, Homo sapiens
ggaaaggctaacagtcatggaa

SEQ ID NO: 7006310 - DNA, 22 bp, Homo sapiens
tacatagagaagttacagtgga

SEQ ID NO: 7006311 - DNA, 22 bp, Homo sapiens
ctgggatgtgaggagcgcctct

SEQ ID NO: 7006312 - DNA, 22 bp, Homo sapiens
actccccaaaactaaccatgca

SEQ ID NO: 7006313 - DNA, 19 bp, Homo sapiens
gccagtgtgtggtacagtg

SEQ ID NO: 7006314 - DNA, 23 bp, Homo sapiens
tgttacaagcaccacaggtggct

SEQ ID NO: 7006315 - DNA, 22 bp, Homo sapiens
gtgtgttcgtatcaacagagga

SEQ ID NO: 7006316 - DNA, 22 bp, Homo sapiens
gccagcaactaggagctgaatt

SEQ ID NO: 7006317 - DNA, 18 bp, Homo sapiens
tctggggtgtgctgtgta

SEQ ID NO: 7006318 - DNA, 22 bp, Homo sapiens
catgatctggtcctactgtggg

SEQ ID NO: 7006319 - DNA, 22 bp, Homo sapiens
atgactttgttgttttccagcg

SEQ ID NO: 7006320 - DNA, 22 bp, Homo sapiens
ggtgagaggcctgagagctgga

SEQ ID NO: 7006321 - DNA, 22 bp, Homo sapiens
tttcaacagaatatgatcagag

SEQ ID NO: 7006322 - DNA, 22 bp, Homo sapiens
gtaataatttgctacctggtgg

SEQ ID NO: 7006323 - DNA, 22 bp, Homo sapiens
aggtattccagtggtcaccaag

SEQ ID NO: 7006324 - DNA, 22 bp, Homo sapiens
gctcctttattttctctcgtgt

SEQ ID NO: 7006325 - DNA, 22 bp, Homo sapiens
aaagatgtcagtcagataggat

SEQ ID NO: 7006326 - DNA, 22 bp, Homo sapiens
ctgtgcttccaggatggcagct

SEQ ID NO: 7006327 - DNA, 22 bp, Homo sapiens
ctgaacttctctgagcctcagt

SEQ ID NO: 7006328 - DNA, 17 bp, Homo sapiens
ctacagtgtgtttcctg

SEQ ID NO: 7006329 - DNA, 22 bp, Homo sapiens
gtctcctccatggagatggtat

SEQ ID NO: 7006330 - DNA, 22 bp, Homo sapiens
agaattaggtaagttcatctga

SEQ ID NO: 7006331 - DNA, 22 bp, Homo sapiens
aagtgcataataactcccaagt

SEQ ID NO: 7006332 - DNA, 21 bp, Homo sapiens
tttcagtgtatgacagtgaaa

SEQ ID NO: 7006333 - DNA, 21 bp, Homo sapiens
actcagtaattccttggtgca

SEQ ID NO: 7006334 - DNA, 22 bp, Homo sapiens
tctggctccactttcttcattt

SEQ ID NO: 7006335 - DNA, 22 bp, Homo sapiens
acaggccagaggtggggcagcc

SEQ ID NO: 7006336 - DNA, 22 bp, Homo sapiens
gacttattcacgcagctatact

SEQ ID NO: 7006337 - DNA, 22 bp, Homo sapiens
gtggccagctgtcagcaccctt

SEQ ID NO: 7006338 - DNA, 22 bp, Homo sapiens
ttgactttatgtgtatgtttac

SEQ ID NO: 7006339 - DNA, 22 bp, Homo sapiens
aggtctggaggcggagtcagga

SEQ ID NO: 7006340 - DNA, 23 bp, Homo sapiens
tagagcagccccgaggtgctgtc

SEQ ID NO: 7006341 - DNA, 22 bp, Homo sapiens
tgactctggagatccgaaataa

SEQ ID NO: 7006342 - DNA, 22 bp, Homo sapiens
tgagctacacactaggcatggg

SEQ ID NO: 7006343 - DNA, 22 bp, Homo sapiens
ctgaggatctactgtgggctca

SEQ ID NO: 7006344 - DNA, 22 bp, Homo sapiens
gctcttgacagctacatctggc

SEQ ID NO: 7006345 - DNA, 22 bp, Homo sapiens
ctccatcatgtttgatcctgag

SEQ ID NO: 7006346 - DNA, 22 bp, Homo sapiens
ctctttaactcccattctgtcc

SEQ ID NO: 7006347 - DNA, 20 bp, Homo sapiens
ctaaactctgcagatttagt

SEQ ID NO: 7006348 - DNA, 22 bp, Homo sapiens
cactgtggatacagaaattagt

SEQ ID NO: 7006349 - DNA, 22 bp, Homo sapiens
caggcactcagtctggatccct

SEQ ID NO: 7006350 - DNA, 22 bp, Homo sapiens
ggctgcttaaacagatgtgctg

SEQ ID NO: 7006351 - DNA, 22 bp, Homo sapiens
aaacagactgcactgccagtca

SEQ ID NO: 7006352 - DNA, 22 bp, Homo sapiens
gccacagggcagatgcgcagag

SEQ ID NO: 7006353 - DNA, 22 bp, Homo sapiens
tccaggaaaaggcttgcagggg

SEQ ID NO: 7006354 - DNA, 22 bp, Homo sapiens
agaccaccaaaactttctccat

SEQ ID NO: 7006355 - DNA, 22 bp, Homo sapiens
ggtggcctgcaagtgcagatgg

SEQ ID NO: 7006356 - DNA, 22 bp, Homo sapiens
gtgtgtggaatgctcatttatt

SEQ ID NO: 7006357 - DNA, 23 bp, Homo sapiens
agccaaatcttaacttctgttac

SEQ ID NO: 7006358 - DNA, 22 bp, Homo sapiens
atgcaggggctgtgttttgggt

SEQ ID NO: 7006359 - DNA, 22 bp, Homo sapiens
acatacatggattcatggattc

SEQ ID NO: 7006360 - DNA, 17 bp, Homo sapiens
atttggaatttctcttc

SEQ ID NO: 7006361 - DNA, 22 bp, Homo sapiens
accagcatcacctggaggcctg

SEQ ID NO: 7006362 - DNA, 22 bp, Homo sapiens
tcactttggattatgtaatttc

SEQ ID NO: 7006363 - DNA, 19 bp, Homo sapiens
agcaggctaggctgcctct

SEQ ID NO: 7006364 - DNA, 22 bp, Homo sapiens
ggcctgactaatcaggatgaat

SEQ ID NO: 7006365 - DNA, 19 bp, Homo sapiens
ttatctgtgttgcagtggt

SEQ ID NO: 7006366 - DNA, 22 bp, Homo sapiens
tcagtgcagtgaaaggtttact

SEQ ID NO: 7006367 - DNA, 22 bp, Homo sapiens
ccatggcagcctggcctggctt

SEQ ID NO: 7006368 - DNA, 22 bp, Homo sapiens
tgagtctaggtagagaaatgca

SEQ ID NO: 7006369 - DNA, 22 bp, Homo sapiens
ccatttagtaaggaagaacagc

SEQ ID NO: 7006370 - DNA, 22 bp, Homo sapiens
tctctgaaggctgtgttgatgg

SEQ ID NO: 7006371 - DNA, 20 bp, Homo sapiens
tgtgcacctgctagggagca

SEQ ID NO: 7006372 - DNA, 22 bp, Homo sapiens
tatctgtagtctcatggttcct

SEQ ID NO: 7006373 - DNA, 22 bp, Homo sapiens
ggtctggagcttggctaaggga

SEQ ID NO: 7006374 - DNA, 22 bp, Homo sapiens
aactcctgttctatgacaagag

SEQ ID NO: 7006375 - DNA, 21 bp, Homo sapiens
ggccacagttagggctcagga

SEQ ID NO: 7006376 - DNA, 22 bp, Homo sapiens
taggattcaagatagtagactg

SEQ ID NO: 7006377 - DNA, 22 bp, Homo sapiens
tcttcctatggggctgcaggaa

SEQ ID NO: 7006378 - DNA, 22 bp, Homo sapiens
agatgatatactacatggcttc

SEQ ID NO: 7006379 - DNA, 22 bp, Homo sapiens
gcagtagcagtatccagaagca

SEQ ID NO: 7006380 - DNA, 22 bp, Homo sapiens
acagactggagcccttttgccc

SEQ ID NO: 7006381 - DNA, 22 bp, Homo sapiens
gtagtaaagcggaaagggtgat

SEQ ID NO: 7006382 - DNA, 22 bp, Homo sapiens
attggctgtgtccgaatatttt

SEQ ID NO: 7006383 - DNA, 22 bp, Homo sapiens
tggatacctggtttttatttac

SEQ ID NO: 7006384 - DNA, 19 bp, Homo sapiens
ggacatcactctaagcctt

SEQ ID NO: 7006385 - DNA, 22 bp, Homo sapiens
gtctgagggacagagtcctggc

SEQ ID NO: 7006386 - DNA, 22 bp, Homo sapiens
caagagctgggtggcaagctag

SEQ ID NO: 7006387 - DNA, 22 bp, Homo sapiens
ctgaatgataatcttttgctgg

SEQ ID NO: 7006388 - DNA, 22 bp, Homo sapiens
cagctcttaacacagcttgtat

SEQ ID NO: 7006389 - DNA, 22 bp, Homo sapiens
tcatcattctgacaagtctaca

SEQ ID NO: 7006390 - DNA, 22 bp, Homo sapiens
ctcttttacaccaaaaggccta

SEQ ID NO: 7006391 - DNA, 22 bp, Homo sapiens
cttgacaactggcagatatata

SEQ ID NO: 7006392 - DNA, 22 bp, Homo sapiens
gtgactctacttaagattaagc

SEQ ID NO: 7006393 - DNA, 22 bp, Homo sapiens
gacagcagtcctggagttccca

SEQ ID NO: 7006394 - DNA, 22 bp, Homo sapiens
gccagtgtgcaagaaaacagaa

SEQ ID NO: 7006395 - DNA, 21 bp, Homo sapiens
gctctcagctgcctgctggtt

SEQ ID NO: 7006396 - DNA, 22 bp, Homo sapiens
agttagtgagctcttgggacct

SEQ ID NO: 7006397 - DNA, 23 bp, Homo sapiens
gaggtgtgaattctgggtgctgc

SEQ ID NO: 7006398 - DNA, 22 bp, Homo sapiens
aattctcaggtaaaagttaagt

SEQ ID NO: 7006399 - DNA, 20 bp, Homo sapiens
tctgtactggagacctttat

SEQ ID NO: 7006400 - DNA, 22 bp, Homo sapiens
ggcagatggaaggacagacgga

SEQ ID NO: 7006401 - DNA, 22 bp, Homo sapiens
tcagaggactaccttctccagt

SEQ ID NO: 7006402 - DNA, 22 bp, Homo sapiens
ttgaagagtgtccttgtaaaaa

SEQ ID NO: 7006403 - DNA, 22 bp, Homo sapiens
gtgtggcctcaacgggatgcaa

SEQ ID NO: 7006404 - DNA, 22 bp, Homo sapiens
agtttacagatgctacaggagc

SEQ ID NO: 7006405 - DNA, 22 bp, Homo sapiens
tttgactgtgccacccagggtg

SEQ ID NO: 7006406 - DNA, 22 bp, Homo sapiens
taagcaatgctgtagttcagtc

SEQ ID NO: 7006407 - DNA, 22 bp, Homo sapiens
ttggcaatgaaagctgcccggg

SEQ ID NO: 7006408 - DNA, 22 bp, Homo sapiens
tagcaaaatgtggatgtagttg

SEQ ID NO: 7006409 - DNA, 22 bp, Homo sapiens
ccagtagtagctctttgtgctc

SEQ ID NO: 7006410 - DNA, 22 bp, Homo sapiens
ggggcagagtagctggggtgtg

SEQ ID NO: 7006411 - DNA, 22 bp, Homo sapiens
gcagagtttgaagtcaagatgt

SEQ ID NO: 7006412 - DNA, 22 bp, Homo sapiens
tgacagtgaatgacaaggttct

SEQ ID NO: 7006413 - DNA, 20 bp, Homo sapiens
atgtttaatgttgtccaccc

SEQ ID NO: 7006414 - DNA, 22 bp, Homo sapiens
gatgtggatgatcttagatggt

SEQ ID NO: 7006415 - DNA, 22 bp, Homo sapiens
tctcctgatgactttatcttgg

SEQ ID NO: 7006416 - DNA, 22 bp, Homo sapiens
ggtaccaaatagttgggattac

SEQ ID NO: 7006417 - DNA, 22 bp, Homo sapiens
caggtaggccaatgttttccaa

SEQ ID NO: 7006418 - DNA, 20 bp, Homo sapiens
tgcaaggaagcaggcaagtg

SEQ ID NO: 7006419 - DNA, 22 bp, Homo sapiens
ttttggcatcacttgccatcta

SEQ ID NO: 7006420 - DNA, 22 bp, Homo sapiens
gtagtccatcttgagcagcgta

SEQ ID NO: 7006421 - DNA, 22 bp, Homo sapiens
ccagcccctatcctcgctccac

SEQ ID NO: 7006422 - DNA, 22 bp, Homo sapiens
aagcaaatgaaccagaggtaat

SEQ ID NO: 7006423 - DNA, 22 bp, Homo sapiens
tgaaggcccagccacagaatgg

SEQ ID NO: 7006424 - DNA, 22 bp, Homo sapiens
agtttcacagagggttagacgc

SEQ ID NO: 7006425 - DNA, 22 bp, Homo sapiens
aaatccatggtaatctgttaca

SEQ ID NO: 7006426 - DNA, 22 bp, Homo sapiens
agcgctatgaggggtcagccac

SEQ ID NO: 7006427 - DNA, 18 bp, Homo sapiens
gaggaaacaaggcagagg

SEQ ID NO: 7006428 - DNA, 22 bp, Homo sapiens
ttctggaaccagcctgcctggg

SEQ ID NO: 7006429 - DNA, 22 bp, Homo sapiens
ttagatacgcaggcagttttaa

SEQ ID NO: 7006430 - DNA, 22 bp, Homo sapiens
agtctctgcatgatgcagcaca

SEQ ID NO: 7006431 - DNA, 22 bp, Homo sapiens
cccagggacagatgggcagcta

SEQ ID NO: 7006432 - DNA, 22 bp, Homo sapiens
tggcattttctcctttgagttt

SEQ ID NO: 7006433 - DNA, 22 bp, Homo sapiens
agggtggagggagtccctgagc

SEQ ID NO: 7006434 - DNA, 23 bp, Homo sapiens
tgaaagcaatgggtctatagtat

SEQ ID NO: 7006435 - DNA, 22 bp, Homo sapiens
ccacactgcctgttatctccca

SEQ ID NO: 7006436 - DNA, 23 bp, Homo sapiens
tagggcagctgggagggacatgc

SEQ ID NO: 7006437 - DNA, 22 bp, Homo sapiens
tgattttgaggtttcaggtctt

SEQ ID NO: 7006438 - DNA, 22 bp, Homo sapiens
aaacagctggtctcaaatgttc

SEQ ID NO: 7006439 - DNA, 22 bp, Homo sapiens
tttcaagctcttcagtgttatt

SEQ ID NO: 7006440 - DNA, 22 bp, Homo sapiens
gaatgaattttggatggtgaag

SEQ ID NO: 7006441 - DNA, 22 bp, Homo sapiens
ttccaagtgttgagattagagg

SEQ ID NO: 7006442 - DNA, 22 bp, Homo sapiens
tgctggaactcagtgaatcatt

SEQ ID NO: 7006443 - DNA, 19 bp, Homo sapiens
aggctctgagctcctggag

SEQ ID NO: 7006444 - DNA, 22 bp, Homo sapiens
aggaatgtgtttctaggctgtt

SEQ ID NO: 7006445 - DNA, 22 bp, Homo sapiens
atgaaactaaactacataagtt

SEQ ID NO: 7006446 - DNA, 22 bp, Homo sapiens
agcacaatatgggttttatagt

SEQ ID NO: 7006447 - DNA, 22 bp, Homo sapiens
ccagctccaggtagatgggcag

SEQ ID NO: 7006448 - DNA, 22 bp, Homo sapiens
ctgaggctgagacaggtgaaat

SEQ ID NO: 7006449 - DNA, 22 bp, Homo sapiens
gaactgtatgcacgttgccatt

SEQ ID NO: 7006450 - DNA, 22 bp, Homo sapiens
atggcaatgaatgactttatgt

SEQ ID NO: 7006451 - DNA, 22 bp, Homo sapiens
ctcccttttggatatggggaga

SEQ ID NO: 7006452 - DNA, 22 bp, Homo sapiens
aagggatgtaaacatgaataag

SEQ ID NO: 7006453 - DNA, 22 bp, Homo sapiens
tctgtgccacctctccagtgtc

SEQ ID NO: 7006454 - DNA, 22 bp, Homo sapiens
attgaacagaaaccatcagagt

SEQ ID NO: 7006455 - DNA, 22 bp, Homo sapiens
ctgtggctggccttattgctgc

SEQ ID NO: 7006456 - DNA, 22 bp, Homo sapiens
gaatgtctaaacatagctttta

SEQ ID NO: 7006457 - DNA, 22 bp, Homo sapiens
caggtaaagcttcaaatcactt

SEQ ID NO: 7006458 - DNA, 22 bp, Homo sapiens
ttctcatagagacatgattata

SEQ ID NO: 7006459 - DNA, 22 bp, Homo sapiens
aatagtagtcgccttttgtaag

SEQ ID NO: 7006460 - DNA, 22 bp, Homo sapiens
gaatctgcattttaacaagatc

SEQ ID NO: 7006461 - DNA, 22 bp, Homo sapiens
gagacagtgaggaaggctaggt

SEQ ID NO: 7006462 - DNA, 22 bp, Homo sapiens
gcactgtgctaaacatgtatca

SEQ ID NO: 7006463 - DNA, 23 bp, Homo sapiens
aagagcagggaatatttatttgc

SEQ ID NO: 7006464 - DNA, 22 bp, Homo sapiens
aatggcacctgctatatactga

SEQ ID NO: 7006465 - DNA, 20 bp, Homo sapiens
agacagaatcagagataaag

SEQ ID NO: 7006466 - DNA, 22 bp, Homo sapiens
tacaaaccaaggaacagtgatc

SEQ ID NO: 7006467 - DNA, 22 bp, Homo sapiens
agggccagggaaacgatcagca

SEQ ID NO: 7006468 - DNA, 22 bp, Homo sapiens
cagcagcagagatactggtttc

SEQ ID NO: 7006469 - DNA, 22 bp, Homo sapiens
ttagaaatgatttcacctcttt

SEQ ID NO: 7006470 - DNA, 20 bp, Homo sapiens
tgtgcctggctttgtcctga

SEQ ID NO: 7006471 - DNA, 22 bp, Homo sapiens
cctcctccttatggtggcccag

SEQ ID NO: 7006472 - DNA, 21 bp, Homo sapiens
cctgccaggaaactgagtgtc

SEQ ID NO: 7006473 - DNA, 22 bp, Homo sapiens
ctgtgcccataatctggtattt

SEQ ID NO: 7006474 - DNA, 22 bp, Homo sapiens
tccttagggatttttccagtca

SEQ ID NO: 7006475 - DNA, 22 bp, Homo sapiens
cagagagaggggctgcctggcc

SEQ ID NO: 7006476 - DNA, 22 bp, Homo sapiens
acacataagcctaatcatctcc

SEQ ID NO: 7006477 - DNA, 22 bp, Homo sapiens
gttcccttctcatggggtccag

SEQ ID NO: 7006478 - DNA, 22 bp, Homo sapiens
ctggctgcaggaaggagtgggc

SEQ ID NO: 7006479 - DNA, 22 bp, Homo sapiens
gattcctgggctacaccccaga

SEQ ID NO: 7006480 - DNA, 22 bp, Homo sapiens
tacaagtcacttcctttctaaa

SEQ ID NO: 7006481 - DNA, 22 bp, Homo sapiens
cctcactcttgtcctggcaggt

SEQ ID NO: 7006482 - DNA, 22 bp, Homo sapiens
ttattcagcatttagaggaagg

SEQ ID NO: 7006483 - DNA, 22 bp, Homo sapiens
ctgcaatagtttagaataattg

SEQ ID NO: 7006484 - DNA, 20 bp, Homo sapiens
aactactctgggttgtcttt

SEQ ID NO: 7006485 - DNA, 22 bp, Homo sapiens
gactttcttaggccccctaata

SEQ ID NO: 7006486 - DNA, 22 bp, Homo sapiens
aactgctgcatcttagaatgca

SEQ ID NO: 7006487 - DNA, 22 bp, Homo sapiens
acagctctgttgccagatctgc

SEQ ID NO: 7006488 - DNA, 22 bp, Homo sapiens
accaaacttctgggctcctttg

SEQ ID NO: 7006489 - DNA, 22 bp, Homo sapiens
tgccaagatgtaggcaggcata

SEQ ID NO: 7006490 - DNA, 22 bp, Homo sapiens
tcagggtttcggctcaacagaa

SEQ ID NO: 7006491 - DNA, 22 bp, Homo sapiens
agtggacttttagtatccttat

SEQ ID NO: 7006492 - DNA, 18 bp, Homo sapiens
tcttttccttccacttcc

SEQ ID NO: 7006493 - DNA, 21 bp, Homo sapiens
agtacaaaaattcctttctca

SEQ ID NO: 7006494 - DNA, 22 bp, Homo sapiens
agagaagctgacaggggcgtgc

SEQ ID NO: 7006495 - DNA, 22 bp, Homo sapiens
gctgtcttgggtagaaagaggt

SEQ ID NO: 7006496 - DNA, 22 bp, Homo sapiens
ctggcaggcggaggttgcagtg

SEQ ID NO: 7006497 - DNA, 22 bp, Homo sapiens
agtcctgggtccagcaggtcct

SEQ ID NO: 7006498 - DNA, 22 bp, Homo sapiens
agcgaggtttgttctattcagt

SEQ ID NO: 7006499 - DNA, 22 bp, Homo sapiens
ccagactgagggtccctgagct

SEQ ID NO: 7006500 - DNA, 22 bp, Homo sapiens
ggcttggcccaggcctcactcc

SEQ ID NO: 7006501 - DNA, 22 bp, Homo sapiens
ttaaccaggacatcagatggct

SEQ ID NO: 7006502 - DNA, 22 bp, Homo sapiens
aggaacagaagagcaatgcagg

SEQ ID NO: 7006503 - DNA, 22 bp, Homo sapiens
gatctagaaggcaaatatagtg

SEQ ID NO: 7006504 - DNA, 22 bp, Homo sapiens
tgcaaatttgacttcacacatc

SEQ ID NO: 7006505 - DNA, 22 bp, Homo sapiens
tcctggctcctggagacctgct

SEQ ID NO: 7006506 - DNA, 22 bp, Homo sapiens
tctgggaactatatctggtggt

SEQ ID NO: 7006507 - DNA, 22 bp, Homo sapiens
gcagatgttgatgcaagaagag

SEQ ID NO: 7006508 - DNA, 22 bp, Homo sapiens
cttcttgacttctgggtgccct

SEQ ID NO: 7006509 - DNA, 22 bp, Homo sapiens
gggccctggacgtggcggcaga

SEQ ID NO: 7006510 - DNA, 22 bp, Homo sapiens
tgatgaaaatatgattctgagg

SEQ ID NO: 7006511 - DNA, 22 bp, Homo sapiens
caaagttatgaatgataagatt

SEQ ID NO: 7006512 - DNA, 22 bp, Homo sapiens
gactcctcagtcaccctcagct

SEQ ID NO: 7006513 - DNA, 22 bp, Homo sapiens
catggctggccagtgggagtgg

SEQ ID NO: 7006514 - DNA, 22 bp, Homo sapiens
aataggaaaatatttaacaaga

SEQ ID NO: 7006515 - DNA, 22 bp, Homo sapiens
actttgatctaagtttctttga

SEQ ID NO: 7006516 - DNA, 22 bp, Homo sapiens
tacagaggaggtggttgggagt

SEQ ID NO: 7006517 - DNA, 22 bp, Homo sapiens
atggagccattcctgaagactt

SEQ ID NO: 7006518 - DNA, 22 bp, Homo sapiens
tcttcgcttactgtgtaaggag

SEQ ID NO: 7006519 - DNA, 22 bp, Homo sapiens
gtctttggatgtaagataaagt

SEQ ID NO: 7006520 - DNA, 22 bp, Homo sapiens
gatgagggcctggtggctgtgc

SEQ ID NO: 7006521 - DNA, 22 bp, Homo sapiens
ggtgactggtttatctggcagt

SEQ ID NO: 7006522 - DNA, 22 bp, Homo sapiens
caggcagagccaatcgtggggt

SEQ ID NO: 7006523 - DNA, 19 bp, Homo sapiens
tctgcctgcttgtaggggc

SEQ ID NO: 7006524 - DNA, 22 bp, Homo sapiens
gtctgagaaagaattctgggga

SEQ ID NO: 7006525 - DNA, 22 bp, Homo sapiens
atatctacctagcttaggctga

SEQ ID NO: 7006526 - DNA, 22 bp, Homo sapiens
ccaatattatgaaagtgtgaca

SEQ ID NO: 7006527 - DNA, 22 bp, Homo sapiens
cagcactgttcccagaccactg

SEQ ID NO: 7006528 - DNA, 22 bp, Homo sapiens
gctgtccatgtctggcctcagt

SEQ ID NO: 7006529 - DNA, 22 bp, Homo sapiens
acagcagggaatatgggaattg

SEQ ID NO: 7006530 - DNA, 22 bp, Homo sapiens
accatgatgccactatgcagaa

SEQ ID NO: 7006531 - DNA, 22 bp, Homo sapiens
atcagaatactatcaacagtga

SEQ ID NO: 7006532 - DNA, 22 bp, Homo sapiens
acaagaagtcacatctaggagt

SEQ ID NO: 7006533 - DNA, 22 bp, Homo sapiens
cccagagctgagtctgatatat

SEQ ID NO: 7006534 - DNA, 22 bp, Homo sapiens
gggagagagaaaacgtggcgca

SEQ ID NO: 7006535 - DNA, 22 bp, Homo sapiens
atggccagcctggtacttggca

SEQ ID NO: 7006536 - DNA, 22 bp, Homo sapiens
tcacccagcagctgcttctgct

SEQ ID NO: 7006537 - DNA, 22 bp, Homo sapiens
ctccaggaacagcaccctgctg

SEQ ID NO: 7006538 - DNA, 22 bp, Homo sapiens
cagatgtgcatgatgggaaggg

SEQ ID NO: 7006539 - DNA, 22 bp, Homo sapiens
caagcagagactagatagctgt

SEQ ID NO: 7006540 - DNA, 22 bp, Homo sapiens
tccagtacaggtctctcatttc

SEQ ID NO: 7006541 - DNA, 22 bp, Homo sapiens
tttcttgagcccaggaggtgga

SEQ ID NO: 7006542 - DNA, 22 bp, Homo sapiens
ctgccactttggagtgctcaga

SEQ ID NO: 7006543 - DNA, 22 bp, Homo sapiens
cactctggggatgcaaggagag

SEQ ID NO: 7006544 - DNA, 22 bp, Homo sapiens
atatctcaatacagctgtttta

SEQ ID NO: 7006545 - DNA, 22 bp, Homo sapiens
cttctttccttcctccagtggc

SEQ ID NO: 7006546 - DNA, 22 bp, Homo sapiens
agacacttcatgtaagtggaat

SEQ ID NO: 7006547 - DNA, 22 bp, Homo sapiens
ctctagcttttgataccagtgt

SEQ ID NO: 7006548 - DNA, 22 bp, Homo sapiens
agtgacaaagattctccttgtt

SEQ ID NO: 7006549 - DNA, 22 bp, Homo sapiens
cacgcctgtaatcccagcactt

SEQ ID NO: 7006550 - DNA, 22 bp, Homo sapiens
ttaatgacatcataggtgaagt

SEQ ID NO: 7006551 - DNA, 22 bp, Homo sapiens
ggaaaagacaggttaactgtga

SEQ ID NO: 7006552 - DNA, 22 bp, Homo sapiens
ctcacagtctgcctttcccttg

SEQ ID NO: 7006553 - DNA, 20 bp, Homo sapiens
acagtgggtggggagcactg

SEQ ID NO: 7006554 - DNA, 21 bp, Homo sapiens
tgaacaaagttcttatcgtga

SEQ ID NO: 7006555 - DNA, 22 bp, Homo sapiens
gttattctgcgatgcaatcctg

SEQ ID NO: 7006556 - DNA, 22 bp, Homo sapiens
tagtgggtagaggccagggacg

SEQ ID NO: 7006557 - DNA, 22 bp, Homo sapiens
gctctcaggtacaaagctgtgt

SEQ ID NO: 7006558 - DNA, 22 bp, Homo sapiens
tctatgaagtgcaattaactgt

SEQ ID NO: 7006559 - DNA, 22 bp, Homo sapiens
tcttcatctcagattaacagga

SEQ ID NO: 7006560 - DNA, 21 bp, Homo sapiens
ttcatcattggtaaaaagtgg

SEQ ID NO: 7006561 - DNA, 22 bp, Homo sapiens
taaagtagcaagtttagactga

SEQ ID NO: 7006562 - DNA, 22 bp, Homo sapiens
gggggctgatcatttactgggc

SEQ ID NO: 7006563 - DNA, 22 bp, Homo sapiens
tctcccatgaggctgcggtcaa

SEQ ID NO: 7006564 - DNA, 19 bp, Homo sapiens
tagtagtagaaaacaatac

SEQ ID NO: 7006565 - DNA, 22 bp, Homo sapiens
agtcacttgggaagcaaagcct

SEQ ID NO: 7006566 - DNA, 22 bp, Homo sapiens
taatactgtgcttcattttcct

SEQ ID NO: 7006567 - DNA, 22 bp, Homo sapiens
tattgattctgtcccaagttga

SEQ ID NO: 7006568 - DNA, 22 bp, Homo sapiens
ataaaagatcccttctgagctc

SEQ ID NO: 7006569 - DNA, 22 bp, Homo sapiens
attgcagctggtcagggtaatt

SEQ ID NO: 7006570 - DNA, 22 bp, Homo sapiens
gttaatttagtagagtccagat

SEQ ID NO: 7006571 - DNA, 22 bp, Homo sapiens
tgggaaggtgattttccaaaag

SEQ ID NO: 7006572 - DNA, 22 bp, Homo sapiens
tgcttcagagaagaatggaaag

SEQ ID NO: 7006573 - DNA, 22 bp, Homo sapiens
cttctctgtcacagggttacgt

SEQ ID NO: 7006574 - DNA, 18 bp, Homo sapiens
aaactgtatttctttcta

SEQ ID NO: 7006575 - DNA, 22 bp, Homo sapiens
ctattctgattaccagatattg

SEQ ID NO: 7006576 - DNA, 22 bp, Homo sapiens
tggaatttagttaattccattt

SEQ ID NO: 7006577 - DNA, 22 bp, Homo sapiens
tcaaagatcagatggttgtagg

SEQ ID NO: 7006578 - DNA, 22 bp, Homo sapiens
tcagggttgaaataattcagtt

SEQ ID NO: 7006579 - DNA, 22 bp, Homo sapiens
attagcatattaaatagtcatt

SEQ ID NO: 7006580 - DNA, 22 bp, Homo sapiens
gatgaggaatttgaggttagaa

SEQ ID NO: 7006581 - DNA, 16 bp, Homo sapiens
cagctttatgtcagtg

SEQ ID NO: 7006582 - DNA, 22 bp, Homo sapiens
atgtatgcatgtatgtatcgct

SEQ ID NO: 7006583 - DNA, 22 bp, Homo sapiens
gaactttaaaacaaagtacagt

SEQ ID NO: 7006584 - DNA, 22 bp, Homo sapiens
tgtaagtctcttggttgagttg

SEQ ID NO: 7006585 - DNA, 22 bp, Homo sapiens
attcacatgtgcttcttatcac

SEQ ID NO: 7006586 - DNA, 22 bp, Homo sapiens
aggaaagatggaaggaggataa

SEQ ID NO: 7006587 - DNA, 22 bp, Homo sapiens
gaaattgtggggttaaaaggct

SEQ ID NO: 7006588 - DNA, 22 bp, Homo sapiens
ctatctgtaaatttgaggttct

SEQ ID NO: 7006589 - DNA, 22 bp, Homo sapiens
ggagcccttggcacctagtagg

SEQ ID NO: 7006590 - DNA, 22 bp, Homo sapiens
gctttgcttcctgttctagcct

SEQ ID NO: 7006591 - DNA, 22 bp, Homo sapiens
agggtgcctggaagccactcac

SEQ ID NO: 7006592 - DNA, 22 bp, Homo sapiens
tgtgtgcctgagccgtgcctgg

SEQ ID NO: 7006593 - DNA, 22 bp, Homo sapiens
agcacagtaattgatattactg

SEQ ID NO: 7006594 - DNA, 20 bp, Homo sapiens
ccccttcatctacagcctga

SEQ ID NO: 7006595 - DNA, 17 bp, Homo sapiens
tatcaagaagtctggcc

SEQ ID NO: 7006596 - DNA, 22 bp, Homo sapiens
ttggaacttaaccctgataggt

SEQ ID NO: 7006597 - DNA, 22 bp, Homo sapiens
gggtggtggccagcagtgggca

SEQ ID NO: 7006598 - DNA, 22 bp, Homo sapiens
ggtatagtattatttgaaagag

SEQ ID NO: 7006599 - DNA, 22 bp, Homo sapiens
acagacaagtagttcagacaag

SEQ ID NO: 7006600 - DNA, 22 bp, Homo sapiens
gccccaccttgagagcagaaac

SEQ ID NO: 7006601 - DNA, 22 bp, Homo sapiens
aatgacagagatagaagggatg

SEQ ID NO: 7006602 - DNA, 22 bp, Homo sapiens
tcccgttgatgacggtgcatcc

SEQ ID NO: 7006603 - DNA, 22 bp, Homo sapiens
tctggacagtagagcaatgatt

SEQ ID NO: 7006604 - DNA, 22 bp, Homo sapiens
atgtgtcaattttcaaatgctt

SEQ ID NO: 7006605 - DNA, 22 bp, Homo sapiens
gcctggggccagcttgggctga

SEQ ID NO: 7006606 - DNA, 21 bp, Homo sapiens
ccttctcttgcttcagcttca

SEQ ID NO: 7006607 - DNA, 22 bp, Homo sapiens
tccactgtggtcccttgctgcc

SEQ ID NO: 7006608 - DNA, 22 bp, Homo sapiens
ggcttgcttcttgtccaggaat

SEQ ID NO: 7006609 - DNA, 22 bp, Homo sapiens
acactgagaggtgacagcgtgc

SEQ ID NO: 7006610 - DNA, 22 bp, Homo sapiens
aggctcgcatgccctgcaccac

SEQ ID NO: 7006611 - DNA, 22 bp, Homo sapiens
aagtttcaaatgttgattatgc

SEQ ID NO: 7006612 - DNA, 22 bp, Homo sapiens
atatttgttgagttcttatgat

SEQ ID NO: 7006613 - DNA, 22 bp, Homo sapiens
aacacatgggtgtttattgtac

SEQ ID NO: 7006614 - DNA, 22 bp, Homo sapiens
ttagaagtacataagacaagga

SEQ ID NO: 7006615 - DNA, 23 bp, Homo sapiens
acagtgtctgctgcaagatatct

SEQ ID NO: 7006616 - DNA, 22 bp, Homo sapiens
agtctcatcaggcatgtagtca

SEQ ID NO: 7006617 - DNA, 22 bp, Homo sapiens
aagaatgtgctaatgaaaactt

SEQ ID NO: 7006618 - DNA, 22 bp, Homo sapiens
gaggctgctgccatcattaggt

SEQ ID NO: 7006619 - DNA, 22 bp, Homo sapiens
tttgacagtcccctgatgtttg

SEQ ID NO: 7006620 - DNA, 22 bp, Homo sapiens
ggtgggcacccgagactggatc

SEQ ID NO: 7006621 - DNA, 22 bp, Homo sapiens
aaacagcttgtaaggtgtaatt

SEQ ID NO: 7006622 - DNA, 19 bp, Homo sapiens
tcatcacttcagaggaaaa

SEQ ID NO: 7006623 - DNA, 22 bp, Homo sapiens
aaaacattttactgccatctca

SEQ ID NO: 7006624 - DNA, 15 bp, Homo sapiens
aggttttcagagtaa

SEQ ID NO: 7006625 - DNA, 22 bp, Homo sapiens
atgtatccttatacacatttat

SEQ ID NO: 7006626 - DNA, 22 bp, Homo sapiens
acagccttctgtgtgtgtacaa

SEQ ID NO: 7006627 - DNA, 22 bp, Homo sapiens
gtgctgagaacaaaagtggaca

SEQ ID NO: 7006628 - DNA, 22 bp, Homo sapiens
tgcttaaaatagttcatttttg

SEQ ID NO: 7006629 - DNA, 22 bp, Homo sapiens
acactgtgacggaaataaagaa

SEQ ID NO: 7006630 - DNA, 22 bp, Homo sapiens
tgtaagagaaaagtgatcgtgg

SEQ ID NO: 7006631 - DNA, 22 bp, Homo sapiens
tctttcttaaataggtggattg

SEQ ID NO: 7006632 - DNA, 22 bp, Homo sapiens
gttcctgatgctttgaaattca

SEQ ID NO: 7006633 - DNA, 22 bp, Homo sapiens
atccaaacatgtaccacactaa

SEQ ID NO: 7006634 - DNA, 22 bp, Homo sapiens
tataattagtaaatggcagatt

SEQ ID NO: 7006635 - DNA, 22 bp, Homo sapiens
tacacgatatttttacagatac

SEQ ID NO: 7006636 - DNA, 22 bp, Homo sapiens
aaatgtagttgaaaagttaagg

SEQ ID NO: 7006637 - DNA, 22 bp, Homo sapiens
tctctggctcctgccgggtcca

SEQ ID NO: 7006638 - DNA, 22 bp, Homo sapiens
ggccgctgcgcctccaaccgag

SEQ ID NO: 7006639 - DNA, 22 bp, Homo sapiens
agtaacaaatattcattggatt

SEQ ID NO: 7006640 - DNA, 22 bp, Homo sapiens
tatttgctcaaccctgcctcca

SEQ ID NO: 7006641 - DNA, 22 bp, Homo sapiens
cagctgagaaggtctgatcagg

SEQ ID NO: 7006642 - DNA, 20 bp, Homo sapiens
ctagtctttgctatctgcta

SEQ ID NO: 7006643 - DNA, 22 bp, Homo sapiens
tggtcaggctgctctgcggcgt

SEQ ID NO: 7006644 - DNA, 20 bp, Homo sapiens
ccaccctccaggaacacata

SEQ ID NO: 7006645 - DNA, 22 bp, Homo sapiens
agctacaaaattactaagtcct

SEQ ID NO: 7006646 - DNA, 22 bp, Homo sapiens
ccaaggagcaaggctcaacaag

SEQ ID NO: 7006647 - DNA, 22 bp, Homo sapiens
gctcttatgtatgtatacgatg

SEQ ID NO: 7006648 - DNA, 22 bp, Homo sapiens
ttacatccttcaaagtcactca

SEQ ID NO: 7006649 - DNA, 22 bp, Homo sapiens
catgcattacaattgcatagta

SEQ ID NO: 7006650 - DNA, 22 bp, Homo sapiens
tttgtctttcccctcctcattg

SEQ ID NO: 7006651 - DNA, 22 bp, Homo sapiens
cacaaatgtgcagaaatgtgag

SEQ ID NO: 7006652 - DNA, 22 bp, Homo sapiens
agatgtcagcagggttggtttc

SEQ ID NO: 7006653 - DNA, 22 bp, Homo sapiens
gtcctggttttcacagaccttt

SEQ ID NO: 7006654 - DNA, 22 bp, Homo sapiens
aatataattttattcctagagt

SEQ ID NO: 7006655 - DNA, 22 bp, Homo sapiens
aagtccatctctgccccacaca

SEQ ID NO: 7006656 - DNA, 22 bp, Homo sapiens
cagctgagtgttggcatgttca

SEQ ID NO: 7006657 - DNA, 22 bp, Homo sapiens
agggactcggttgagtgcccct

SEQ ID NO: 7006658 - DNA, 22 bp, Homo sapiens
tattgcaatttggctaaagaat

SEQ ID NO: 7006659 - DNA, 22 bp, Homo sapiens
tttgtgcctatacatgcgactg

SEQ ID NO: 7006660 - DNA, 22 bp, Homo sapiens
agtcttgggttgcctgatattg

SEQ ID NO: 7006661 - DNA, 22 bp, Homo sapiens
cctctgtaatgattcactgaat

SEQ ID NO: 7006662 - DNA, 22 bp, Homo sapiens
atactttaacgtggcgaacctt

SEQ ID NO: 7006663 - DNA, 22 bp, Homo sapiens
gactggagcccccaaggacacc

SEQ ID NO: 7006664 - DNA, 23 bp, Homo sapiens
ttgtcctgccgatctctgagaat

SEQ ID NO: 7006665 - DNA, 18 bp, Homo sapiens
atatcagctacttcatgg

SEQ ID NO: 7006666 - DNA, 22 bp, Homo sapiens
agtcctggacttggagtcaggg

SEQ ID NO: 7006667 - DNA, 22 bp, Homo sapiens
ggagtcatctcagctgagaggc

SEQ ID NO: 7006668 - DNA, 22 bp, Homo sapiens
tcactctgtgtttccctgggac

SEQ ID NO: 7006669 - DNA, 22 bp, Homo sapiens
ttgtgccaagaacatggaattt

SEQ ID NO: 7006670 - DNA, 22 bp, Homo sapiens
gggctccagaggctcaccctgg

SEQ ID NO: 7006671 - DNA, 22 bp, Homo sapiens
tgatgatttcatttctagctgt

SEQ ID NO: 7006672 - DNA, 22 bp, Homo sapiens
ccactgtggaaagcagttcaga

SEQ ID NO: 7006673 - DNA, 22 bp, Homo sapiens
acagggcctcagctgattctgg

SEQ ID NO: 7006674 - DNA, 22 bp, Homo sapiens
ttggaagattacttagttttct

SEQ ID NO: 7006675 - DNA, 22 bp, Homo sapiens
ctttttgcaagagtttctcatc

SEQ ID NO: 7006676 - DNA, 23 bp, Homo sapiens
gaagtcagccctacagagagcag

SEQ ID NO: 7006677 - DNA, 22 bp, Homo sapiens
atgagtaagataggcaatgtgt

SEQ ID NO: 7006678 - DNA, 22 bp, Homo sapiens
gtagcagcagagcaggtcctcc

SEQ ID NO: 7006679 - DNA, 22 bp, Homo sapiens
ggaagccagagtgctgggcagg

SEQ ID NO: 7006680 - DNA, 22 bp, Homo sapiens
ttccggacgcccgtcttccagc

SEQ ID NO: 7006681 - DNA, 23 bp, Homo sapiens
tatctcagaggaatgtagttact

SEQ ID NO: 7006682 - DNA, 22 bp, Homo sapiens
gaataactaaatggcagttctt

SEQ ID NO: 7006683 - DNA, 22 bp, Homo sapiens
cttctgtgacgtatgtgaggac

SEQ ID NO: 7006684 - DNA, 22 bp, Homo sapiens
tccaggctgccacagtgcaacg

SEQ ID NO: 7006685 - DNA, 22 bp, Homo sapiens
gcaccaggtgcagccgggcccc

SEQ ID NO: 7006686 - DNA, 22 bp, Homo sapiens
acttgcagatggtatggaatgt

SEQ ID NO: 7006687 - DNA, 22 bp, Homo sapiens
ctgtatgttttctcctttggtt

SEQ ID NO: 7006688 - DNA, 22 bp, Homo sapiens
cagctgttactctgagtaaatg

SEQ ID NO: 7006689 - DNA, 22 bp, Homo sapiens
gtcacagtatcatgtttgaatg

SEQ ID NO: 7006690 - DNA, 20 bp, Homo sapiens
tccaagttataaagtgccaa

SEQ ID NO: 7006691 - DNA, 22 bp, Homo sapiens
tgcagtttatctagtcatccat

SEQ ID NO: 7006692 - DNA, 21 bp, Homo sapiens
ttgagcagaaatgtgtatgcc

SEQ ID NO: 7006693 - DNA, 22 bp, Homo sapiens
cagggcttgccttgccccggcg

SEQ ID NO: 7006694 - DNA, 22 bp, Homo sapiens
ggccaccttaagttaaggatat

SEQ ID NO: 7006695 - DNA, 22 bp, Homo sapiens
tgccagccagggaagctcaccc

SEQ ID NO: 7006696 - DNA, 22 bp, Homo sapiens
ttctttggtgttacccagctca

SEQ ID NO: 7006697 - DNA, 22 bp, Homo sapiens
ccctactctgccactttttctg

SEQ ID NO: 7006698 - DNA, 22 bp, Homo sapiens
cagagttttgtgaacaacttgg

SEQ ID NO: 7006699 - DNA, 23 bp, Homo sapiens
tgggcctctccacccttttctgt

SEQ ID NO: 7006700 - DNA, 22 bp, Homo sapiens
atccaggctgctttctatgccc

SEQ ID NO: 7006701 - DNA, 22 bp, Homo sapiens
cactagagaaacgcccaggctc

SEQ ID NO: 7006702 - DNA, 22 bp, Homo sapiens
ctggaatttttgtcgtggagta

SEQ ID NO: 7006703 - DNA, 22 bp, Homo sapiens
cgcaggtgaactgttctgcagt

SEQ ID NO: 7006704 - DNA, 19 bp, Homo sapiens
aggtgaggggcaccatgtc

SEQ ID NO: 7006705 - DNA, 22 bp, Homo sapiens
atggcagcagtttggagtcttt

SEQ ID NO: 7006706 - DNA, 22 bp, Homo sapiens
gctccctgcatttcccaccctt

SEQ ID NO: 7006707 - DNA, 22 bp, Homo sapiens
ataggcacaaccattaaaataa

SEQ ID NO: 7006708 - DNA, 17 bp, Homo sapiens
cgggcatggagggcagg

SEQ ID NO: 7006709 - DNA, 22 bp, Homo sapiens
tcctcagaagaacccctagatt

SEQ ID NO: 7006710 - DNA, 22 bp, Homo sapiens
ctggccagttgccttcctgggt

SEQ ID NO: 7006711 - DNA, 22 bp, Homo sapiens
ggtcaaatatacataaaaactt

SEQ ID NO: 7006712 - DNA, 22 bp, Homo sapiens
ggtaaattttatgttatgtata

SEQ ID NO: 7006713 - DNA, 22 bp, Homo sapiens
aggttcccagagatagagctgt

SEQ ID NO: 7006714 - DNA, 22 bp, Homo sapiens
atgtgtcatttttctgtgcata

SEQ ID NO: 7006715 - DNA, 22 bp, Homo sapiens
gcacttttcaaagcttcctgtg

SEQ ID NO: 7006716 - DNA, 22 bp, Homo sapiens
attagctgttgtgaaaggggtg

SEQ ID NO: 7006717 - DNA, 22 bp, Homo sapiens
ctaggaatagcaaagtaggaca

SEQ ID NO: 7006718 - DNA, 22 bp, Homo sapiens
gccaggaaggctccctggtcac

SEQ ID NO: 7006719 - DNA, 22 bp, Homo sapiens
tagatgttttaactcttggtta

SEQ ID NO: 7006720 - DNA, 19 bp, Homo sapiens
gttaatgggctgggaagga

SEQ ID NO: 7006721 - DNA, 22 bp, Homo sapiens
ctcagggacttggatcctggcc

SEQ ID NO: 7006722 - DNA, 22 bp, Homo sapiens
cctttgtaccttaaatcctgtg

SEQ ID NO: 7006723 - DNA, 22 bp, Homo sapiens
gtggttttctccaacccagaac

SEQ ID NO: 7006724 - DNA, 22 bp, Homo sapiens
attcatctctgcatatagagtc

SEQ ID NO: 7006725 - DNA, 22 bp, Homo sapiens
atcatcttgctttctgtttact

SEQ ID NO: 7006726 - DNA, 22 bp, Homo sapiens
tatcatgtccctaaagagagga

SEQ ID NO: 7006727 - DNA, 22 bp, Homo sapiens
cggtggagtgctcagctgaacc

SEQ ID NO: 7006728 - DNA, 22 bp, Homo sapiens
actgtgctgctctccgcagccc

SEQ ID NO: 7006729 - DNA, 22 bp, Homo sapiens
cactctcactgagctcatgcca

SEQ ID NO: 7006730 - DNA, 19 bp, Homo sapiens
tcccaggaaccttttattt

SEQ ID NO: 7006731 - DNA, 22 bp, Homo sapiens
acacacagcgcctaccatgtgc

SEQ ID NO: 7006732 - DNA, 22 bp, Homo sapiens
tctgggctgctatgaggcagag

SEQ ID NO: 7006733 - DNA, 21 bp, Homo sapiens
ttaaagctatggtagtgggct

SEQ ID NO: 7006734 - DNA, 22 bp, Homo sapiens
actcattaaataggatgatttt

SEQ ID NO: 7006735 - DNA, 22 bp, Homo sapiens
aaagttgctggctttggttcat

SEQ ID NO: 7006736 - DNA, 22 bp, Homo sapiens
taggtgtctttctgtccttgtt

SEQ ID NO: 7006737 - DNA, 22 bp, Homo sapiens
tcaaagtaagattgttgaagct

SEQ ID NO: 7006738 - DNA, 22 bp, Homo sapiens
ctacccaggcttagagggctgg

SEQ ID NO: 7006739 - DNA, 22 bp, Homo sapiens
cttggtcagaggggctggcatg

SEQ ID NO: 7006740 - DNA, 22 bp, Homo sapiens
aatcaagagctgactatatttt

SEQ ID NO: 7006741 - DNA, 22 bp, Homo sapiens
agaagtttatttatgccccaat

SEQ ID NO: 7006742 - DNA, 23 bp, Homo sapiens
ccacaggcacagaggcttgcatc

SEQ ID NO: 7006743 - DNA, 22 bp, Homo sapiens
ttaaggaggacgttcctggtgg

SEQ ID NO: 7006744 - DNA, 22 bp, Homo sapiens
cctggctgctgtcactgaccat

SEQ ID NO: 7006745 - DNA, 22 bp, Homo sapiens
acaggcctcaaatagggtgcct

SEQ ID NO: 7006746 - DNA, 22 bp, Homo sapiens
acagttttttcaacattggaat

SEQ ID NO: 7006747 - DNA, 22 bp, Homo sapiens
actgcactccagcctgggtaac

SEQ ID NO: 7006748 - DNA, 22 bp, Homo sapiens
actgcactccaacctgggtgac

SEQ ID NO: 7006749 - DNA, 22 bp, Homo sapiens
tattccatgccagagtttattg

SEQ ID NO: 7006750 - DNA, 22 bp, Homo sapiens
actgaagccagagggaggacat

SEQ ID NO: 7006751 - DNA, 22 bp, Homo sapiens
acagggttgtggccttaaaggc

SEQ ID NO: 7006752 - DNA, 22 bp, Homo sapiens
aagtgcttagaagttgcattag

SEQ ID NO: 7006753 - DNA, 22 bp, Homo sapiens
tcagagactgtaggagcagcct

SEQ ID NO: 7006754 - DNA, 22 bp, Homo sapiens
ttggtttaggaactggcttgga

SEQ ID NO: 7006755 - DNA, 22 bp, Homo sapiens
gcacagagaggctgtgagcgcc

SEQ ID NO: 7006756 - DNA, 22 bp, Homo sapiens
caattcaacctaagtgcatcca

SEQ ID NO: 7006757 - DNA, 22 bp, Homo sapiens
tttgactcttgcccagtttggc

SEQ ID NO: 7006758 - DNA, 22 bp, Homo sapiens
acaaaaaccgtggattcagcat

SEQ ID NO: 7006759 - DNA, 22 bp, Homo sapiens
gagtgtggatcccagaagcaga

SEQ ID NO: 7006760 - DNA, 22 bp, Homo sapiens
attctgctgcacaccttccccc

SEQ ID NO: 7006761 - DNA, 22 bp, Homo sapiens
tctgaagagctttggaagtatg

SEQ ID NO: 7006762 - DNA, 22 bp, Homo sapiens
tggtaaatgctattcctatatt

SEQ ID NO: 7006763 - DNA, 22 bp, Homo sapiens
gagaggcttgtgtgaagaacaa

SEQ ID NO: 7006764 - DNA, 22 bp, Homo sapiens
tgaggacattaggaagtgaagg

SEQ ID NO: 7006765 - DNA, 22 bp, Homo sapiens
ctggggtggaggagctcccctg

SEQ ID NO: 7006766 - DNA, 22 bp, Homo sapiens
ccactggcttttcctaggtctc

SEQ ID NO: 7006767 - DNA, 22 bp, Homo sapiens
cctctgagtctcactgtaacct

SEQ ID NO: 7006768 - DNA, 22 bp, Homo sapiens
ttgttagctgatcttgagtgca

SEQ ID NO: 7006769 - DNA, 19 bp, Homo sapiens
gtaatgcatctgtgtatga

SEQ ID NO: 7006770 - DNA, 22 bp, Homo sapiens
tacaacagttcatgaaatgaaa

SEQ ID NO: 7006771 - DNA, 16 bp, Homo sapiens
gagccaggtgccttga

SEQ ID NO: 7006772 - DNA, 22 bp, Homo sapiens
ttacaatgggagcccttggact

SEQ ID NO: 7006773 - DNA, 23 bp, Homo sapiens
tttcacagcttttattctgcatc

SEQ ID NO: 7006774 - DNA, 22 bp, Homo sapiens
atggtgctcctgcaggaagcag

SEQ ID NO: 7006775 - DNA, 22 bp, Homo sapiens
taggcagcatggattctgaata

SEQ ID NO: 7006776 - DNA, 22 bp, Homo sapiens
tttagtttgatgttctactcct

SEQ ID NO: 7006777 - DNA, 22 bp, Homo sapiens
atgcatcaattaggggcagaca

SEQ ID NO: 7006778 - DNA, 22 bp, Homo sapiens
aaattagtgttttcttactggt

SEQ ID NO: 7006779 - DNA, 22 bp, Homo sapiens
ctgctgagagatgccaatctca

SEQ ID NO: 7006780 - DNA, 22 bp, Homo sapiens
tccttcacctcaagcttttgaa

SEQ ID NO: 7006781 - DNA, 22 bp, Homo sapiens
aggtgattttctccttacgatt

SEQ ID NO: 7006782 - DNA, 22 bp, Homo sapiens
tagagggttattaggacagaag

SEQ ID NO: 7006783 - DNA, 22 bp, Homo sapiens
aacctggaccttttgggtattg

SEQ ID NO: 7006784 - DNA, 22 bp, Homo sapiens
gccctgtggacccaggaactct

SEQ ID NO: 7006785 - DNA, 22 bp, Homo sapiens
acaggcctgggttcaaatttgg

SEQ ID NO: 7006786 - DNA, 22 bp, Homo sapiens
catcaatagggtttgaaagcaa

SEQ ID NO: 7006787 - DNA, 22 bp, Homo sapiens
agcttattcatcttgtgaccta

SEQ ID NO: 7006788 - DNA, 22 bp, Homo sapiens
catcttgtctttttgggcctga

SEQ ID NO: 7006789 - DNA, 22 bp, Homo sapiens
ttgagcatatgcatttccaatt

SEQ ID NO: 7006790 - DNA, 22 bp, Homo sapiens
tccaaggacgctggacccctgc

SEQ ID NO: 7006791 - DNA, 22 bp, Homo sapiens
gtttgaaagaccaattagattt

SEQ ID NO: 7006792 - DNA, 22 bp, Homo sapiens
ttccttagctcctcatggcctg

SEQ ID NO: 7006793 - DNA, 22 bp, Homo sapiens
tgtgacttgatgtttgcaccag

SEQ ID NO: 7006794 - DNA, 22 bp, Homo sapiens
agacaacatgatcagcagtcct

SEQ ID NO: 7006795 - DNA, 22 bp, Homo sapiens
cagggacagcactaaactcttg

SEQ ID NO: 7006796 - DNA, 22 bp, Homo sapiens
tcaataatggcaggataaattt

SEQ ID NO: 7006797 - DNA, 22 bp, Homo sapiens
tgctcagcacagaccaggccag

SEQ ID NO: 7006798 - DNA, 22 bp, Homo sapiens
atgagccctggaggcatttttt

SEQ ID NO: 7006799 - DNA, 22 bp, Homo sapiens
tctgggtaatcagggctgggag

SEQ ID NO: 7006800 - DNA, 22 bp, Homo sapiens
ctttggatttttatcaggcaat

SEQ ID NO: 7006801 - DNA, 22 bp, Homo sapiens
cttctgcaggccttattttagt

SEQ ID NO: 7006802 - DNA, 22 bp, Homo sapiens
agaacacttttaaatggcttgt

SEQ ID NO: 7006803 - DNA, 22 bp, Homo sapiens
tgggagtccaaggcaggcggat

SEQ ID NO: 7006804 - DNA, 22 bp, Homo sapiens
ttgcttcagagacagggctcac

SEQ ID NO: 7006805 - DNA, 22 bp, Homo sapiens
agctctgcttcttgggaagatg

SEQ ID NO: 7006806 - DNA, 22 bp, Homo sapiens
ttgttaacggaaaactgttttc

SEQ ID NO: 7006807 - DNA, 22 bp, Homo sapiens
aatagacaagcaccctggtaaa

SEQ ID NO: 7006808 - DNA, 19 bp, Homo sapiens
aggcaaccaatgaggcaaa

SEQ ID NO: 7006809 - DNA, 22 bp, Homo sapiens
ctttctttcgaagacgtgatta

SEQ ID NO: 7006810 - DNA, 22 bp, Homo sapiens
agcggtgtgcagcccctgcctg

SEQ ID NO: 7006811 - DNA, 20 bp, Homo sapiens
tggctcatcctttctgcgcc

SEQ ID NO: 7006812 - DNA, 22 bp, Homo sapiens
atagtggaaactggagggaaga

SEQ ID NO: 7006813 - DNA, 22 bp, Homo sapiens
ctgtgcctggggggcagagctg

SEQ ID NO: 7006814 - DNA, 22 bp, Homo sapiens
cccatgctgagtggcctgagat

SEQ ID NO: 7006815 - DNA, 22 bp, Homo sapiens
ggaaagctcagatcttgttgga

SEQ ID NO: 7006816 - DNA, 22 bp, Homo sapiens
cagttctaattaataggagtaa

SEQ ID NO: 7006817 - DNA, 22 bp, Homo sapiens
actgtcaaatttatggaaagag

SEQ ID NO: 7006818 - DNA, 22 bp, Homo sapiens
gcaaagctgggtgtgaatgcac

SEQ ID NO: 7006819 - DNA, 22 bp, Homo sapiens
cagagggaaaaggggagtaata

SEQ ID NO: 7006820 - DNA, 22 bp, Homo sapiens
ccacagattatttctaaacagg

SEQ ID NO: 7006821 - DNA, 16 bp, Homo sapiens
aggaggggaattagga

SEQ ID NO: 7006822 - DNA, 22 bp, Homo sapiens
cagtgaggagtccagggcagag

SEQ ID NO: 7006823 - DNA, 22 bp, Homo sapiens
tcatgtggcaaatatttctgag

SEQ ID NO: 7006824 - DNA, 22 bp, Homo sapiens
agcacctccgtgcagcgtggcc

SEQ ID NO: 7006825 - DNA, 22 bp, Homo sapiens
ctaagactctgcaaatcagctt

SEQ ID NO: 7006826 - DNA, 22 bp, Homo sapiens
tacttctctgcgatcacttgat

SEQ ID NO: 7006827 - DNA, 18 bp, Homo sapiens
atttatcctttgtattac

SEQ ID NO: 7006828 - DNA, 22 bp, Homo sapiens
tgatagaatcagataaaaggat

SEQ ID NO: 7006829 - DNA, 22 bp, Homo sapiens
agcaatgcttattgctgactat

SEQ ID NO: 7006830 - DNA, 22 bp, Homo sapiens
tcagtgctgctttatgacagtt

SEQ ID NO: 7006831 - DNA, 22 bp, Homo sapiens
acttgccccagaattgctgctg

SEQ ID NO: 7006832 - DNA, 22 bp, Homo sapiens
tccagcaggtccgagacaagtt

SEQ ID NO: 7006833 - DNA, 22 bp, Homo sapiens
ctacaaagaaagtatactggac

SEQ ID NO: 7006834 - DNA, 22 bp, Homo sapiens
agatccagttaatagcttcatt

SEQ ID NO: 7006835 - DNA, 22 bp, Homo sapiens
aaagtccagggaaagagcgtct

SEQ ID NO: 7006836 - DNA, 18 bp, Homo sapiens
agtggaaaacaaatacac

SEQ ID NO: 7006837 - DNA, 22 bp, Homo sapiens
tccatttggcctctgtattgta

SEQ ID NO: 7006838 - DNA, 19 bp, Homo sapiens
tacaattggctttccattg

SEQ ID NO: 7006839 - DNA, 22 bp, Homo sapiens
ttctggacttccaaatggcttc

SEQ ID NO: 7006840 - DNA, 22 bp, Homo sapiens
cattgcacaccagcctgggcaa

SEQ ID NO: 7006841 - DNA, 23 bp, Homo sapiens
cacaggcagaaatcaagacggta

SEQ ID NO: 7006842 - DNA, 22 bp, Homo sapiens
ccatccattttcttgcttgcct

SEQ ID NO: 7006843 - DNA, 18 bp, Homo sapiens
tagaggggaagaccttta

SEQ ID NO: 7006844 - DNA, 22 bp, Homo sapiens
tgaggaggcccaggttggggct

SEQ ID NO: 7006845 - DNA, 22 bp, Homo sapiens
tcttattggtaatgatggcatt

SEQ ID NO: 7006846 - DNA, 22 bp, Homo sapiens
agctgggtgtgtatcagataaa

SEQ ID NO: 7006847 - DNA, 22 bp, Homo sapiens
gggtaactgtctgtgaaataag

SEQ ID NO: 7006848 - DNA, 22 bp, Homo sapiens
caaatagtgtcacattgtgagg

SEQ ID NO: 7006849 - DNA, 22 bp, Homo sapiens
tgtatacactatgctatatggt

SEQ ID NO: 7006850 - DNA, 19 bp, Homo sapiens
gaggcaaggagtttaagcc

SEQ ID NO: 7006851 - DNA, 22 bp, Homo sapiens
tctcaggctgacattgggactc

SEQ ID NO: 7006852 - DNA, 22 bp, Homo sapiens
gttacatggagcaatgatgcat

SEQ ID NO: 7006853 - DNA, 22 bp, Homo sapiens
gcactttcagcaggcagacaga

SEQ ID NO: 7006854 - DNA, 22 bp, Homo sapiens
agtccaaagcagatgagggcca

SEQ ID NO: 7006855 - DNA, 20 bp, Homo sapiens
actaatcatccagtcacagt

SEQ ID NO: 7006856 - DNA, 19 bp, Homo sapiens
aaattggcatgctgacctc

SEQ ID NO: 7006857 - DNA, 22 bp, Homo sapiens
aggctacaggagacgccaggag

SEQ ID NO: 7006858 - DNA, 20 bp, Homo sapiens
agctaagaggaaaagtgaga

SEQ ID NO: 7006859 - DNA, 22 bp, Homo sapiens
ggctctgcctctgaccctctgg

SEQ ID NO: 7006860 - DNA, 20 bp, Homo sapiens
atgtgtctgtaaacaactct

SEQ ID NO: 7006861 - DNA, 22 bp, Homo sapiens
tgccaggcgattgctatcagca

SEQ ID NO: 7006862 - DNA, 23 bp, Homo sapiens
tgattcagcaagtccacttctgg

SEQ ID NO: 7006863 - DNA, 21 bp, Homo sapiens
cactgaggtcaggggtagggt

SEQ ID NO: 7006864 - DNA, 22 bp, Homo sapiens
atgtgtgtgtatatacacacat

SEQ ID NO: 7006865 - DNA, 22 bp, Homo sapiens
tggtgaccaatgctatggccag

SEQ ID NO: 7006866 - DNA, 22 bp, Homo sapiens
tacccagttattttgtctttgt

SEQ ID NO: 7006867 - DNA, 20 bp, Homo sapiens
aaatggcctcagataagcag

SEQ ID NO: 7006868 - DNA, 22 bp, Homo sapiens
tattcctcctttctgctcagcc

SEQ ID NO: 7006869 - DNA, 22 bp, Homo sapiens
tgaaatgtgtccatgttatttc

SEQ ID NO: 7006870 - DNA, 22 bp, Homo sapiens
tcccagccttccagtctggttt

SEQ ID NO: 7006871 - DNA, 22 bp, Homo sapiens
cctggcccacatggcttctccc

SEQ ID NO: 7006872 - DNA, 22 bp, Homo sapiens
tagagagtcgggaacttacctg

SEQ ID NO: 7006873 - DNA, 22 bp, Homo sapiens
tgctgcagctttgtcacatgca

SEQ ID NO: 7006874 - DNA, 22 bp, Homo sapiens
aaacactgcagggtttacttga

SEQ ID NO: 7006875 - DNA, 22 bp, Homo sapiens
ctcttcaaatgatttccttagg

SEQ ID NO: 7006876 - DNA, 21 bp, Homo sapiens
gggctctgccctcctggagct

SEQ ID NO: 7006877 - DNA, 22 bp, Homo sapiens
aggaagagcatctttgggtctg

SEQ ID NO: 7006878 - DNA, 22 bp, Homo sapiens
gaggagcatgggaaggctctgg

SEQ ID NO: 7006879 - DNA, 22 bp, Homo sapiens
gtatttgagctttatgtatatt

SEQ ID NO: 7006880 - DNA, 23 bp, Homo sapiens
gtgttcatcccagtctgtgcaat

SEQ ID NO: 7006881 - DNA, 19 bp, Homo sapiens
ctggtgagggttattgata

SEQ ID NO: 7006882 - DNA, 22 bp, Homo sapiens
cttctggataattgtgtgatta

SEQ ID NO: 7006883 - DNA, 22 bp, Homo sapiens
tgtccatggggaaggggaagtg

SEQ ID NO: 7006884 - DNA, 22 bp, Homo sapiens
atgccagtaagtctcagctagg

SEQ ID NO: 7006885 - DNA, 22 bp, Homo sapiens
ccaggagatgatgttggggatt

SEQ ID NO: 7006886 - DNA, 22 bp, Homo sapiens
ggtttccaaagatagagtagta

SEQ ID NO: 7006887 - DNA, 22 bp, Homo sapiens
tgtgttcaagattagttctagt

SEQ ID NO: 7006888 - DNA, 22 bp, Homo sapiens
ggaaggagccatatcatatcca

SEQ ID NO: 7006889 - DNA, 22 bp, Homo sapiens
acttaggccttgctaagcattt

SEQ ID NO: 7006890 - DNA, 22 bp, Homo sapiens
ggaattctgcatgttcagttgg

SEQ ID NO: 7006891 - DNA, 22 bp, Homo sapiens
aggaggaaaaaggccacagcaa

SEQ ID NO: 7006892 - DNA, 22 bp, Homo sapiens
gcctgtttatctatcatgaact

SEQ ID NO: 7006893 - DNA, 22 bp, Homo sapiens
ctgagtctgtacgttagccata

SEQ ID NO: 7006894 - DNA, 22 bp, Homo sapiens
tcttttgtgattcttcagttac

SEQ ID NO: 7006895 - DNA, 22 bp, Homo sapiens
gggtgcaaacccgttctgcacc

SEQ ID NO: 7006896 - DNA, 22 bp, Homo sapiens
tgtcatttgtttaggcaataat

SEQ ID NO: 7006897 - DNA, 22 bp, Homo sapiens
tagctctgtcacctggcaaagt

SEQ ID NO: 7006898 - DNA, 22 bp, Homo sapiens
tcctgagggactggttcctcgc

SEQ ID NO: 7006899 - DNA, 22 bp, Homo sapiens
tgagacaatattaacctatctt

SEQ ID NO: 7006900 - DNA, 22 bp, Homo sapiens
acagcccaggactccagtgggc

SEQ ID NO: 7006901 - DNA, 22 bp, Homo sapiens
acacatgaatcactggtggaag

SEQ ID NO: 7006902 - DNA, 22 bp, Homo sapiens
tcagtgtttacatgcatccttg

SEQ ID NO: 7006903 - DNA, 22 bp, Homo sapiens
ttgcatttttagatgcttctgt

SEQ ID NO: 7006904 - DNA, 22 bp, Homo sapiens
tgaacttagagtatatgaaagg

SEQ ID NO: 7006905 - DNA, 23 bp, Homo sapiens
tcctcctgagtgagagtgccagc

SEQ ID NO: 7006906 - DNA, 22 bp, Homo sapiens
actacactgccctggggatcaa

SEQ ID NO: 7006907 - DNA, 22 bp, Homo sapiens
tttacgaatggggtgacaactt

SEQ ID NO: 7006908 - DNA, 22 bp, Homo sapiens
catgctaaaccagaacatagga

SEQ ID NO: 7006909 - DNA, 20 bp, Homo sapiens
agcggcagcttcctgcttcg

SEQ ID NO: 7006910 - DNA, 22 bp, Homo sapiens
tgagtaacacagtatgcttaca

SEQ ID NO: 7006911 - DNA, 22 bp, Homo sapiens
tacaagagaactaatgtaagtc

SEQ ID NO: 7006912 - DNA, 22 bp, Homo sapiens
acaatgttctgtctgacttgtc

SEQ ID NO: 7006913 - DNA, 22 bp, Homo sapiens
ctcccacatggaatagcaggga

SEQ ID NO: 7006914 - DNA, 22 bp, Homo sapiens
tattatggcagcattcagtatg

SEQ ID NO: 7006915 - DNA, 22 bp, Homo sapiens
tatgacattataaaggattatt

SEQ ID NO: 7006916 - DNA, 21 bp, Homo sapiens
tagcaaatggagagtaagaga

SEQ ID NO: 7006917 - DNA, 22 bp, Homo sapiens
ggcagatgttatatgatctgag

SEQ ID NO: 7006918 - DNA, 22 bp, Homo sapiens
gtcccattcatctccctaggga

SEQ ID NO: 7006919 - DNA, 22 bp, Homo sapiens
ccagcatggcacctgagatgag

SEQ ID NO: 7006920 - DNA, 22 bp, Homo sapiens
acagaatttaaagctctagact

SEQ ID NO: 7006921 - DNA, 22 bp, Homo sapiens
ttgtaacaggcactctgtgcca

SEQ ID NO: 7006922 - DNA, 22 bp, Homo sapiens
atgtatcaattatctgtctgca

SEQ ID NO: 7006923 - DNA, 23 bp, Homo sapiens
agctgaggtgcagatccaaagaa

SEQ ID NO: 7006924 - DNA, 23 bp, Homo sapiens
tctttacagcagcaggatttgga

SEQ ID NO: 7006925 - DNA, 17 bp, Homo sapiens
tgtcttatctgtcctgt

SEQ ID NO: 7006926 - DNA, 22 bp, Homo sapiens
taggaaccagagcactctgggc

SEQ ID NO: 7006927 - DNA, 22 bp, Homo sapiens
gcctccactgatcagacttgac

SEQ ID NO: 7006928 - DNA, 17 bp, Homo sapiens
tggcagctgaaagctct

SEQ ID NO: 7006929 - DNA, 22 bp, Homo sapiens
tagagtgttttgttaggcagca

SEQ ID NO: 7006930 - DNA, 22 bp, Homo sapiens
aggacagtgtggaagagggtgc

SEQ ID NO: 7006931 - DNA, 22 bp, Homo sapiens
gtgtacagatatctcacgttct

SEQ ID NO: 7006932 - DNA, 22 bp, Homo sapiens
caggaaatggggtttagttatt

SEQ ID NO: 7006933 - DNA, 22 bp, Homo sapiens
acaggcagcgtcattgctgctc

SEQ ID NO: 7006934 - DNA, 22 bp, Homo sapiens
tgtgttcctctgcttcctcccc

SEQ ID NO: 7006935 - DNA, 22 bp, Homo sapiens
aatggacaggagagcatagtca

SEQ ID NO: 7006936 - DNA, 22 bp, Homo sapiens
agaactctgaacactgtctgga

SEQ ID NO: 7006937 - DNA, 22 bp, Homo sapiens
aacatgatgacaaaggtatatt

SEQ ID NO: 7006938 - DNA, 22 bp, Homo sapiens
tccaggctctaggctgctctcc

SEQ ID NO: 7006939 - DNA, 21 bp, Homo sapiens
cactctcccaatccttgctga

SEQ ID NO: 7006940 - DNA, 22 bp, Homo sapiens
gaagtcatgctcccatcttgct

SEQ ID NO: 7006941 - DNA, 22 bp, Homo sapiens
tggccccccagagctggaggac

SEQ ID NO: 7006942 - DNA, 22 bp, Homo sapiens
tatcttcttgccaggctggtgt

SEQ ID NO: 7006943 - DNA, 22 bp, Homo sapiens
atcaggattcagtatctccagc

SEQ ID NO: 7006944 - DNA, 21 bp, Homo sapiens
ccccagcaccttgccagcctg

SEQ ID NO: 7006945 - DNA, 22 bp, Homo sapiens
ttacaatgatgaataaatggca

SEQ ID NO: 7006946 - DNA, 22 bp, Homo sapiens
atgccatcgtgaagtaagacat

SEQ ID NO: 7006947 - DNA, 22 bp, Homo sapiens
cctccagccttcctgaagagcc

SEQ ID NO: 7006948 - DNA, 22 bp, Homo sapiens
actgaagggtaatgtgggagcc

SEQ ID NO: 7006949 - DNA, 22 bp, Homo sapiens
gaggcacatatatacagagccc

SEQ ID NO: 7006950 - DNA, 20 bp, Homo sapiens
attagcttggagacagtggc

SEQ ID NO: 7006951 - DNA, 22 bp, Homo sapiens
ttcagctaaggagtttcactgt

SEQ ID NO: 7006952 - DNA, 22 bp, Homo sapiens
tttattgctgtgttagggacag

SEQ ID NO: 7006953 - DNA, 22 bp, Homo sapiens
tagtacagaattaataattgtg

SEQ ID NO: 7006954 - DNA, 22 bp, Homo sapiens
tcaggctttttctcaacctctt

SEQ ID NO: 7006955 - DNA, 22 bp, Homo sapiens
ggagagttgtttttgcctagat

SEQ ID NO: 7006956 - DNA, 22 bp, Homo sapiens
tagaagattctaaagtggagag

SEQ ID NO: 7006957 - DNA, 22 bp, Homo sapiens
ctttctttgcagtgagccagag

SEQ ID NO: 7006958 - DNA, 22 bp, Homo sapiens
gtcaaacagcctcctgttctaa

SEQ ID NO: 7006959 - DNA, 22 bp, Homo sapiens
gcaggacagacccaagcagtct

SEQ ID NO: 7006960 - DNA, 22 bp, Homo sapiens
cttggcctgggccgcagccact

SEQ ID NO: 7006961 - DNA, 22 bp, Homo sapiens
cagttttatgtcgaatgtatac

SEQ ID NO: 7006962 - DNA, 22 bp, Homo sapiens
ggtgcaataaagttgtagaacc

SEQ ID NO: 7006963 - DNA, 21 bp, Homo sapiens
gcagaggaatggtatacataa

SEQ ID NO: 7006964 - DNA, 22 bp, Homo sapiens
accaagaaacaaccctcttctg

SEQ ID NO: 7006965 - DNA, 22 bp, Homo sapiens
atagcagtgacattttaatgtg

SEQ ID NO: 7006966 - DNA, 22 bp, Homo sapiens
agctgggtacacgttgtcacaa

SEQ ID NO: 7006967 - DNA, 22 bp, Homo sapiens
acaaaattatgaagaggccttg

SEQ ID NO: 7006968 - DNA, 22 bp, Homo sapiens
tttaatatccagtggatacaaa

SEQ ID NO: 7006969 - DNA, 22 bp, Homo sapiens
tccctttggatccaagcttatg

SEQ ID NO: 7006970 - DNA, 22 bp, Homo sapiens
gacatcatgttctgctaatagt

SEQ ID NO: 7006971 - DNA, 22 bp, Homo sapiens
tggacccatattgtctgcattc

SEQ ID NO: 7006972 - DNA, 22 bp, Homo sapiens
gaggctgtctgttagcctggga

SEQ ID NO: 7006973 - DNA, 22 bp, Homo sapiens
ctcacattcacaggacagaagg

SEQ ID NO: 7006974 - DNA, 22 bp, Homo sapiens
tttcagtgaaagctactgttag

SEQ ID NO: 7006975 - DNA, 22 bp, Homo sapiens
agttgaacttcctttctgggat

SEQ ID NO: 7006976 - DNA, 22 bp, Homo sapiens
tccttccatggtggggctgctt

SEQ ID NO: 7006977 - DNA, 19 bp, Homo sapiens
tggtcatttctaatggttc

SEQ ID NO: 7006978 - DNA, 22 bp, Homo sapiens
tgcgggggaagctgtgggagaa

SEQ ID NO: 7006979 - DNA, 19 bp, Homo sapiens
tggcaggcccaggatggac

SEQ ID NO: 7006980 - DNA, 22 bp, Homo sapiens
tcctctttaaatgcttttatct

SEQ ID NO: 7006981 - DNA, 22 bp, Homo sapiens
gagaatctccagatgaagtcct

SEQ ID NO: 7006982 - DNA, 22 bp, Homo sapiens
agtgattttgtagctatgagat

SEQ ID NO: 7006983 - DNA, 22 bp, Homo sapiens
ctgcaagatgttgtcatatgct

SEQ ID NO: 7006984 - DNA, 22 bp, Homo sapiens
tggttcataatttgcactactg

SEQ ID NO: 7006985 - DNA, 23 bp, Homo sapiens
tctgtacaattgagaagagaaca

SEQ ID NO: 7006986 - DNA, 22 bp, Homo sapiens
tgtacatgaataaaagatcttg

SEQ ID NO: 7006987 - DNA, 22 bp, Homo sapiens
agcatctctccattcctccttt

SEQ ID NO: 7006988 - DNA, 17 bp, Homo sapiens
caaatcctaggatgtct

SEQ ID NO: 7006989 - DNA, 22 bp, Homo sapiens
aactctgcaacctatgtagacc

SEQ ID NO: 7006990 - DNA, 22 bp, Homo sapiens
ggctaattttcagtgttcatag

SEQ ID NO: 7006991 - DNA, 22 bp, Homo sapiens
tcagggagtagtttgtgctatg

SEQ ID NO: 7006992 - DNA, 22 bp, Homo sapiens
gtgatagccacctgaattctga

SEQ ID NO: 7006993 - DNA, 22 bp, Homo sapiens
agtgctttggatgatgtgggat

SEQ ID NO: 7006994 - DNA, 22 bp, Homo sapiens
tctgattgacctgtgaagcagc

SEQ ID NO: 7006995 - DNA, 22 bp, Homo sapiens
atctgaagggaagtggaaggca

SEQ ID NO: 7006996 - DNA, 22 bp, Homo sapiens
ggggacagtcgatctagtgatt

SEQ ID NO: 7006997 - DNA, 22 bp, Homo sapiens
aggcagatattggggtgatgtg

SEQ ID NO: 7006998 - DNA, 22 bp, Homo sapiens
cgcattatccgtccagcagact

SEQ ID NO: 7006999 - DNA, 22 bp, Homo sapiens
agtattttcaaccatagcctgg

SEQ ID NO: 7007000 - DNA, 21 bp, Homo sapiens
tcaggcaggcgcagagggaag

SEQ ID NO: 7007001 - DNA, 22 bp, Homo sapiens
tctgagccacctgccagtgctg

SEQ ID NO: 7007002 - DNA, 22 bp, Homo sapiens
accaggcccatgtggattacta

SEQ ID NO: 7007003 - DNA, 22 bp, Homo sapiens
atgtcctgttttggcttgctct

SEQ ID NO: 7007004 - DNA, 22 bp, Homo sapiens
agtccccaggggatgcccacgc

SEQ ID NO: 7007005 - DNA, 22 bp, Homo sapiens
ctggcctggggggacacatccc

SEQ ID NO: 7007006 - DNA, 22 bp, Homo sapiens
gcagatgctgtgtgaatgttgg

SEQ ID NO: 7007007 - DNA, 22 bp, Homo sapiens
gagcttggtgctgcctgttgtc

SEQ ID NO: 7007008 - DNA, 22 bp, Homo sapiens
caagcaggcctggctggaccgt

SEQ ID NO: 7007009 - DNA, 22 bp, Homo sapiens
tcccctgcagatgagggcagtg

SEQ ID NO: 7007010 - DNA, 22 bp, Homo sapiens
gaagttatcaggattaaagttg

SEQ ID NO: 7007011 - DNA, 22 bp, Homo sapiens
aggctgtgacagggtcatggag

SEQ ID NO: 7007012 - DNA, 22 bp, Homo sapiens
tgcagatattctcccaagtgtt

SEQ ID NO: 7007013 - DNA, 22 bp, Homo sapiens
ttctctaggagttctgggatca

SEQ ID NO: 7007014 - DNA, 22 bp, Homo sapiens
aaagtagttagtcatgtgaaaa

SEQ ID NO: 7007015 - DNA, 22 bp, Homo sapiens
tttgtcctctccatgtacaata

SEQ ID NO: 7007016 - DNA, 22 bp, Homo sapiens
agagatccttcaatctagtttt

SEQ ID NO: 7007017 - DNA, 18 bp, Homo sapiens
tcaggagtttgtggatgg

SEQ ID NO: 7007018 - DNA, 18 bp, Homo sapiens
acaaaggatcatgaggga

SEQ ID NO: 7007019 - DNA, 22 bp, Homo sapiens
tgctgccacaaattcagctgcc

SEQ ID NO: 7007020 - DNA, 22 bp, Homo sapiens
cagccttgatggatgaggaagt

SEQ ID NO: 7007021 - DNA, 22 bp, Homo sapiens
tttgacattttctcactgtgtt

SEQ ID NO: 7007022 - DNA, 22 bp, Homo sapiens
agtgcaacttcacgtagagtac

SEQ ID NO: 7007023 - DNA, 22 bp, Homo sapiens
tagacagatttcttgttagaca

SEQ ID NO: 7007024 - DNA, 22 bp, Homo sapiens
acctgcagctgagaaaatgact

SEQ ID NO: 7007025 - DNA, 22 bp, Homo sapiens
agtgaactgtggcccgtgaact

SEQ ID NO: 7007026 - DNA, 22 bp, Homo sapiens
aagtttgtctcatttgatcttc

SEQ ID NO: 7007027 - DNA, 15 bp, Homo sapiens
aagcagcaatatata

SEQ ID NO: 7007028 - DNA, 22 bp, Homo sapiens
tgttcatctggcaggcatagcc

SEQ ID NO: 7007029 - DNA, 22 bp, Homo sapiens
acagtttggttgctacagtaaa

SEQ ID NO: 7007030 - DNA, 22 bp, Homo sapiens
ttgtattcattgcttacccaat

SEQ ID NO: 7007031 - DNA, 22 bp, Homo sapiens
tgaggcaggactgagcgggatg

SEQ ID NO: 7007032 - DNA, 22 bp, Homo sapiens
actcttacagagtaaatggcca

SEQ ID NO: 7007033 - DNA, 22 bp, Homo sapiens
acatgttcatgcatgcacaggt

SEQ ID NO: 7007034 - DNA, 22 bp, Homo sapiens
cctaagattggtgtgcactgtg

SEQ ID NO: 7007035 - DNA, 23 bp, Homo sapiens
tatcctaaaggcaacaggaagtc

SEQ ID NO: 7007036 - DNA, 22 bp, Homo sapiens
gttttctttgaatgcttctaga

SEQ ID NO: 7007037 - DNA, 22 bp, Homo sapiens
ctggcacatagcaaatctcaac

SEQ ID NO: 7007038 - DNA, 22 bp, Homo sapiens
ggcaccatcagctgtgcagggg

SEQ ID NO: 7007039 - DNA, 22 bp, Homo sapiens
ttccccagtaacatacatgtga

SEQ ID NO: 7007040 - DNA, 22 bp, Homo sapiens
cacaaggactggatggagtggg

SEQ ID NO: 7007041 - DNA, 23 bp, Homo sapiens
ctgaagcaatatcccctcacttc

SEQ ID NO: 7007042 - DNA, 22 bp, Homo sapiens
ctgggcttgtgttagctgacaa

SEQ ID NO: 7007043 - DNA, 22 bp, Homo sapiens
agaattgtaagcaatttgatta

SEQ ID NO: 7007044 - DNA, 22 bp, Homo sapiens
agtattgtaaacttcctaagga

SEQ ID NO: 7007045 - DNA, 22 bp, Homo sapiens
tatctctaggctgccacttaaa

SEQ ID NO: 7007046 - DNA, 22 bp, Homo sapiens
caagtgacagtttgaaagccag

SEQ ID NO: 7007047 - DNA, 20 bp, Homo sapiens
agcattctactagacttttc

SEQ ID NO: 7007048 - DNA, 22 bp, Homo sapiens
taaatgccattcgtttcataca

SEQ ID NO: 7007049 - DNA, 22 bp, Homo sapiens
tgactttgtgccatttttataa

SEQ ID NO: 7007050 - DNA, 23 bp, Homo sapiens
cttattcattcatgtagcccatt

SEQ ID NO: 7007051 - DNA, 22 bp, Homo sapiens
tgacactgcaaatataaatatt

SEQ ID NO: 7007052 - DNA, 22 bp, Homo sapiens
gatgcaggtgtgccacagagct

SEQ ID NO: 7007053 - DNA, 22 bp, Homo sapiens
gggcagttgctacaatatggct

SEQ ID NO: 7007054 - DNA, 22 bp, Homo sapiens
ataatgtaggctcctgggagaa

SEQ ID NO: 7007055 - DNA, 22 bp, Homo sapiens
atccaaaggtgacacagaatac

SEQ ID NO: 7007056 - DNA, 22 bp, Homo sapiens
agagtcttctggggccactttc

SEQ ID NO: 7007057 - DNA, 19 bp, Homo sapiens
cattggtctatatgtctat

SEQ ID NO: 7007058 - DNA, 22 bp, Homo sapiens
tagaaagacaatgggaagtgct

SEQ ID NO: 7007059 - DNA, 22 bp, Homo sapiens
aagggcccggctgtgggcagag

SEQ ID NO: 7007060 - DNA, 22 bp, Homo sapiens
gcccatgctctcaggcgggcct

SEQ ID NO: 7007061 - DNA, 22 bp, Homo sapiens
agggggagtttcagttagaaag

SEQ ID NO: 7007062 - DNA, 22 bp, Homo sapiens
aggcacagaatggcattcagtg

SEQ ID NO: 7007063 - DNA, 21 bp, Homo sapiens
gctgcaaggaagttttggtct

SEQ ID NO: 7007064 - DNA, 22 bp, Homo sapiens
aggtcctgggagttctagtgtg

SEQ ID NO: 7007065 - DNA, 22 bp, Homo sapiens
gggctgtgttaggtgcggttac

SEQ ID NO: 7007066 - DNA, 22 bp, Homo sapiens
tggctcagtggcagccgcagct

SEQ ID NO: 7007067 - DNA, 22 bp, Homo sapiens
cagagcttgaatgtccatggtt

SEQ ID NO: 7007068 - DNA, 22 bp, Homo sapiens
tacagtgcgatttttaggcctc

SEQ ID NO: 7007069 - DNA, 22 bp, Homo sapiens
ttctatgtggcatcaagctcag

SEQ ID NO: 7007070 - DNA, 22 bp, Homo sapiens
ctcacagatatttgcttcaggt

SEQ ID NO: 7007071 - DNA, 22 bp, Homo sapiens
ttttagaatcaggttgtctggg

SEQ ID NO: 7007072 - DNA, 22 bp, Homo sapiens
gctagaaatcgacttcagaatt

SEQ ID NO: 7007073 - DNA, 21 bp, Homo sapiens
agattacaggtgtgatccacc

SEQ ID NO: 7007074 - DNA, 22 bp, Homo sapiens
ggggaggaagctggaacacggg

SEQ ID NO: 7007075 - DNA, 22 bp, Homo sapiens
aatcaggccatggagaagagat

SEQ ID NO: 7007076 - DNA, 22 bp, Homo sapiens
tgctgaaggcaggggaggtggc

SEQ ID NO: 7007077 - DNA, 22 bp, Homo sapiens
atttgcaattactcatgtcatt

SEQ ID NO: 7007078 - DNA, 22 bp, Homo sapiens
actgagaacttggggacagagg

SEQ ID NO: 7007079 - DNA, 22 bp, Homo sapiens
cctgccttccagccttgggctc

SEQ ID NO: 7007080 - DNA, 22 bp, Homo sapiens
ttacactatgaatgagaatata

SEQ ID NO: 7007081 - DNA, 22 bp, Homo sapiens
gtttagtgtttcaagactcttt

SEQ ID NO: 7007082 - DNA, 22 bp, Homo sapiens
gctgccagttccttcttactcc

SEQ ID NO: 7007083 - DNA, 18 bp, Homo sapiens
tggcataaaatcagagtc

SEQ ID NO: 7007084 - DNA, 22 bp, Homo sapiens
atgcactgggccacagtatgac

SEQ ID NO: 7007085 - DNA, 22 bp, Homo sapiens
agctaaatgcatttcaagactg

SEQ ID NO: 7007086 - DNA, 22 bp, Homo sapiens
tatgtgtgtatgacagacagag

SEQ ID NO: 7007087 - DNA, 22 bp, Homo sapiens
ttagaacatctgtgtctttatg

SEQ ID NO: 7007088 - DNA, 22 bp, Homo sapiens
aggaatgtttacacgacagaaa

SEQ ID NO: 7007089 - DNA, 22 bp, Homo sapiens
aacaactgaaaagctttttctg

SEQ ID NO: 7007090 - DNA, 22 bp, Homo sapiens
agttttattaaatccacagaag

SEQ ID NO: 7007091 - DNA, 22 bp, Homo sapiens
acagtagtttataaaaatgttg

SEQ ID NO: 7007092 - DNA, 22 bp, Homo sapiens
tctagaaattttgccttgtatt

SEQ ID NO: 7007093 - DNA, 19 bp, Homo sapiens
ggctgcttccaccaatatg

SEQ ID NO: 7007094 - DNA, 22 bp, Homo sapiens
acaggaaatgaaatggtatcta

SEQ ID NO: 7007095 - DNA, 21 bp, Homo sapiens
ctgtcctggtctagaggcaca

SEQ ID NO: 7007096 - DNA, 23 bp, Homo sapiens
tgtagcatctcttatttctcagc

SEQ ID NO: 7007097 - DNA, 22 bp, Homo sapiens
gagaaggccaggaacccagtgt

SEQ ID NO: 7007098 - DNA, 22 bp, Homo sapiens
caggccacagctaaagaggatt

SEQ ID NO: 7007099 - DNA, 22 bp, Homo sapiens
tgtagatgagtcagggtgcatg

SEQ ID NO: 7007100 - DNA, 22 bp, Homo sapiens
tgggttaacctgggcaggtgac

SEQ ID NO: 7007101 - DNA, 22 bp, Homo sapiens
tctgggctttacactgtgctta

SEQ ID NO: 7007102 - DNA, 22 bp, Homo sapiens
agtgtgtttggagcgagggagg

SEQ ID NO: 7007103 - DNA, 22 bp, Homo sapiens
aattcacaggaggtatttgtcc

SEQ ID NO: 7007104 - DNA, 22 bp, Homo sapiens
aggactaaaaagatgctctccc

SEQ ID NO: 7007105 - DNA, 22 bp, Homo sapiens
gcagtgtgtctcttggcttcct

SEQ ID NO: 7007106 - DNA, 22 bp, Homo sapiens
gctgctggatgcgcttgatggt

SEQ ID NO: 7007107 - DNA, 22 bp, Homo sapiens
agataagtcttccatatttcta

SEQ ID NO: 7007108 - DNA, 22 bp, Homo sapiens
ctgagggatgtggattttggtc

SEQ ID NO: 7007109 - DNA, 22 bp, Homo sapiens
ctcactgtccaacaggctttac

SEQ ID NO: 7007110 - DNA, 22 bp, Homo sapiens
gtttcaagagtggctcaaaact

SEQ ID NO: 7007111 - DNA, 22 bp, Homo sapiens
ctgactcagcagctgatgatcc

SEQ ID NO: 7007112 - DNA, 21 bp, Homo sapiens
ccactggtggggaacggtggc

SEQ ID NO: 7007113 - DNA, 22 bp, Homo sapiens
tgtctaagagtgcaatgcatga

SEQ ID NO: 7007114 - DNA, 22 bp, Homo sapiens
gggctgtcatgtgtcagtgacc

SEQ ID NO: 7007115 - DNA, 22 bp, Homo sapiens
attcaccttgataaggggatca

SEQ ID NO: 7007116 - DNA, 19 bp, Homo sapiens
gtgaacacttacttggctg

SEQ ID NO: 7007117 - DNA, 22 bp, Homo sapiens
aactccaggcagggaggccact

SEQ ID NO: 7007118 - DNA, 22 bp, Homo sapiens
tcagtaaaagggtgctttactc

SEQ ID NO: 7007119 - DNA, 22 bp, Homo sapiens
ttagttagaataatacaagtaa

SEQ ID NO: 7007120 - DNA, 22 bp, Homo sapiens
ctgctgcaggatgggcactctg

SEQ ID NO: 7007121 - DNA, 22 bp, Homo sapiens
aaaggcagtgggtatgtggatc

SEQ ID NO: 7007122 - DNA, 22 bp, Homo sapiens
tctgccgactataagccaacta

SEQ ID NO: 7007123 - DNA, 22 bp, Homo sapiens
ctcttcaggatggcttgtgatg

SEQ ID NO: 7007124 - DNA, 22 bp, Homo sapiens
aacttaggaaaataaggcatga

SEQ ID NO: 7007125 - DNA, 22 bp, Homo sapiens
tgcagggaatctgtggctggac

SEQ ID NO: 7007126 - DNA, 20 bp, Homo sapiens
tgcaggaatttgcattcctt

SEQ ID NO: 7007127 - DNA, 22 bp, Homo sapiens
tgaagagttaattatgaggtgc

SEQ ID NO: 7007128 - DNA, 22 bp, Homo sapiens
ttagatacctttgtgttgtaga

SEQ ID NO: 7007129 - DNA, 22 bp, Homo sapiens
ctgtttatacgacaggtggagg

SEQ ID NO: 7007130 - DNA, 22 bp, Homo sapiens
tagaaggaggactggcagtgtt

SEQ ID NO: 7007131 - DNA, 22 bp, Homo sapiens
atcctgggaagctgacattgaa

SEQ ID NO: 7007132 - DNA, 22 bp, Homo sapiens
tttcatcttgattctatatggc

SEQ ID NO: 7007133 - DNA, 22 bp, Homo sapiens
tcaggcagtagaattgcttgaa

SEQ ID NO: 7007134 - DNA, 22 bp, Homo sapiens
ttgatggctttttggcagagct

SEQ ID NO: 7007135 - DNA, 22 bp, Homo sapiens
acattcttataagagtgaggca

SEQ ID NO: 7007136 - DNA, 16 bp, Homo sapiens
aatgccatttagaggt

SEQ ID NO: 7007137 - DNA, 22 bp, Homo sapiens
tcttcctggatgggggttgatg

SEQ ID NO: 7007138 - DNA, 22 bp, Homo sapiens
aggggtcagtgaccattgagga

SEQ ID NO: 7007139 - DNA, 22 bp, Homo sapiens
tactagttctcatatgaaataa

SEQ ID NO: 7007140 - DNA, 22 bp, Homo sapiens
aacatgaaacccaaacagaata

SEQ ID NO: 7007141 - DNA, 22 bp, Homo sapiens
tctggcagtgaagtcatgaggt

SEQ ID NO: 7007142 - DNA, 22 bp, Homo sapiens
tggcagctggagggcaatggcc

SEQ ID NO: 7007143 - DNA, 22 bp, Homo sapiens
tcagatttgaatattcctttcg

SEQ ID NO: 7007144 - DNA, 22 bp, Homo sapiens
tctgcaccctgtggtcctctag

SEQ ID NO: 7007145 - DNA, 22 bp, Homo sapiens
tgctggaggccagaagtctgag

SEQ ID NO: 7007146 - DNA, 22 bp, Homo sapiens
ttcatgaagggtgaatatagtc

SEQ ID NO: 7007147 - DNA, 22 bp, Homo sapiens
agcacagatttgtcaacataga

SEQ ID NO: 7007148 - DNA, 21 bp, Homo sapiens
gcccacagtgaggaggatccc

SEQ ID NO: 7007149 - DNA, 22 bp, Homo sapiens
agggcagtgggaaagcctgctc

SEQ ID NO: 7007150 - DNA, 22 bp, Homo sapiens
cctttaaatggatgttcaactg

SEQ ID NO: 7007151 - DNA, 22 bp, Homo sapiens
gttttctgattagcaaatctga

SEQ ID NO: 7007152 - DNA, 22 bp, Homo sapiens
tcatgtaaatgtggatgcttcc

SEQ ID NO: 7007153 - DNA, 22 bp, Homo sapiens
gctctaggttcctagccaagtc

SEQ ID NO: 7007154 - DNA, 22 bp, Homo sapiens
ctcccatgctctctctgagaag

SEQ ID NO: 7007155 - DNA, 22 bp, Homo sapiens
gggaatgagagtcagcccagga

SEQ ID NO: 7007156 - DNA, 22 bp, Homo sapiens
agactttcatctcttctgggca

SEQ ID NO: 7007157 - DNA, 22 bp, Homo sapiens
aaataaaggtccactttagggc

SEQ ID NO: 7007158 - DNA, 22 bp, Homo sapiens
agctgtgggatttgggtgtgcc

SEQ ID NO: 7007159 - DNA, 22 bp, Homo sapiens
aaagctcttaaattgacctgct

SEQ ID NO: 7007160 - DNA, 19 bp, Homo sapiens
aatggtaattagagaaatg

SEQ ID NO: 7007161 - DNA, 22 bp, Homo sapiens
gcgcgtctgtgtgtgcaggcat

SEQ ID NO: 7007162 - DNA, 22 bp, Homo sapiens
aaatgtccttagagaaaagtca

SEQ ID NO: 7007163 - DNA, 21 bp, Homo sapiens
ttcttggttacgctgtagtgc

SEQ ID NO: 7007164 - DNA, 22 bp, Homo sapiens
gccagccacgttagactggccc

SEQ ID NO: 7007165 - DNA, 22 bp, Homo sapiens
tgccctgctgtggctctgccca

SEQ ID NO: 7007166 - DNA, 22 bp, Homo sapiens
aggttatttcatccttccctgg

SEQ ID NO: 7007167 - DNA, 22 bp, Homo sapiens
cagggatgtctctggaagggag

SEQ ID NO: 7007168 - DNA, 22 bp, Homo sapiens
tattgcataaaatcaggttaga

SEQ ID NO: 7007169 - DNA, 22 bp, Homo sapiens
cagcactgggaccactagaaca

SEQ ID NO: 7007170 - DNA, 22 bp, Homo sapiens
agaatgtgtgcaagcaagtgtg

SEQ ID NO: 7007171 - DNA, 22 bp, Homo sapiens
atgaggtacttacattgagctt

SEQ ID NO: 7007172 - DNA, 22 bp, Homo sapiens
ttataggaatctgcatgtgtga

SEQ ID NO: 7007173 - DNA, 22 bp, Homo sapiens
aatatttgttagtgttttaatg

SEQ ID NO: 7007174 - DNA, 22 bp, Homo sapiens
cctttagaatacagactttcta

SEQ ID NO: 7007175 - DNA, 22 bp, Homo sapiens
gtaacaaagtttctaggtgctg

SEQ ID NO: 7007176 - DNA, 22 bp, Homo sapiens
tctgagaacatcatttcctaca

SEQ ID NO: 7007177 - DNA, 22 bp, Homo sapiens
catcatttgttcacttgattcc

SEQ ID NO: 7007178 - DNA, 22 bp, Homo sapiens
tggccccattttacagatgaaa

SEQ ID NO: 7007179 - DNA, 22 bp, Homo sapiens
cctcctgggagagcacggaggg

SEQ ID NO: 7007180 - DNA, 22 bp, Homo sapiens
agtttgtaacctaagattcagg

SEQ ID NO: 7007181 - DNA, 22 bp, Homo sapiens
cctgtggcctgaatttggtaaa

SEQ ID NO: 7007182 - DNA, 22 bp, Homo sapiens
gttggtggatgtgggcagagca

SEQ ID NO: 7007183 - DNA, 22 bp, Homo sapiens
ttgtcaggaaatctatttctta

SEQ ID NO: 7007184 - DNA, 22 bp, Homo sapiens
gctttgctgaggtctgaggatt

SEQ ID NO: 7007185 - DNA, 16 bp, Homo sapiens
agccacctcagaggac

SEQ ID NO: 7007186 - DNA, 22 bp, Homo sapiens
agttcaaagtcaaggaaactgt

SEQ ID NO: 7007187 - DNA, 22 bp, Homo sapiens
aggcctgagcagaggagtggac

SEQ ID NO: 7007188 - DNA, 22 bp, Homo sapiens
tttgaagtggaaaaggatttaa

SEQ ID NO: 7007189 - DNA, 22 bp, Homo sapiens
aatggtttatggggaccgcaaa

SEQ ID NO: 7007190 - DNA, 22 bp, Homo sapiens
tgtcagccttgctttagcggtt

SEQ ID NO: 7007191 - DNA, 22 bp, Homo sapiens
tgcaatgagaatatattaacca

SEQ ID NO: 7007192 - DNA, 22 bp, Homo sapiens
tgcaagggcttagggggctgtg

SEQ ID NO: 7007193 - DNA, 19 bp, Homo sapiens
acctgccatgacagcctga

SEQ ID NO: 7007194 - DNA, 22 bp, Homo sapiens
gtcaggcatttaggatgagttc

SEQ ID NO: 7007195 - DNA, 22 bp, Homo sapiens
gtatgtgtaagtatgccacctt

SEQ ID NO: 7007196 - DNA, 22 bp, Homo sapiens
gccccctatgaagaagggcaca

SEQ ID NO: 7007197 - DNA, 21 bp, Homo sapiens
agacagcagatagtcgaaagg

SEQ ID NO: 7007198 - DNA, 18 bp, Homo sapiens
tgcatttagtacatctag

SEQ ID NO: 7007199 - DNA, 22 bp, Homo sapiens
tcagcaacctgcttgaggaggc

SEQ ID NO: 7007200 - DNA, 22 bp, Homo sapiens
caatttcatgccatgtattgct

SEQ ID NO: 7007201 - DNA, 19 bp, Homo sapiens
tggaaaatggattgaatca

SEQ ID NO: 7007202 - DNA, 22 bp, Homo sapiens
aggtgtctttgcggcccgccgc

SEQ ID NO: 7007203 - DNA, 22 bp, Homo sapiens
agtgtcccctccaagggcctgg

SEQ ID NO: 7007204 - DNA, 22 bp, Homo sapiens
tgagcagtgatgcgttttgttt

SEQ ID NO: 7007205 - DNA, 22 bp, Homo sapiens
cctggcagactgtgagggcagg

SEQ ID NO: 7007206 - DNA, 22 bp, Homo sapiens
ttctagaagaactagccaggaa

SEQ ID NO: 7007207 - DNA, 22 bp, Homo sapiens
tgtcatcagcatataagacagt

SEQ ID NO: 7007208 - DNA, 22 bp, Homo sapiens
atgaaatgaagttggcctggct

SEQ ID NO: 7007209 - DNA, 23 bp, Homo sapiens
gcactgggctctcagcaaggtgt

SEQ ID NO: 7007210 - DNA, 22 bp, Homo sapiens
gtgtttaataggtagctgaatc

SEQ ID NO: 7007211 - DNA, 22 bp, Homo sapiens
acaatagacaaagtgaatggct

SEQ ID NO: 7007212 - DNA, 22 bp, Homo sapiens
acagaagaaagggaggttttgc

SEQ ID NO: 7007213 - DNA, 22 bp, Homo sapiens
acagtggaagcatgatgctatc

SEQ ID NO: 7007214 - DNA, 22 bp, Homo sapiens
accctgttggtggatcagattg

SEQ ID NO: 7007215 - DNA, 22 bp, Homo sapiens
attggtcacctccctcagctct

SEQ ID NO: 7007216 - DNA, 22 bp, Homo sapiens
ttccaggatgggctgtcctact

SEQ ID NO: 7007217 - DNA, 22 bp, Homo sapiens
atcatggaagcctatcttgaga

SEQ ID NO: 7007218 - DNA, 23 bp, Homo sapiens
taaagtcacatattagagtgagc

SEQ ID NO: 7007219 - DNA, 22 bp, Homo sapiens
ccactagtttaataccttcctt

SEQ ID NO: 7007220 - DNA, 22 bp, Homo sapiens
ggcatggggtgtatgtggcacg

SEQ ID NO: 7007221 - DNA, 21 bp, Homo sapiens
gttcttcctgactagagtagt

SEQ ID NO: 7007222 - DNA, 21 bp, Homo sapiens
acattttctgttttaggaagt

SEQ ID NO: 7007223 - DNA, 20 bp, Homo sapiens
tgtagccagcctctcaatgc

SEQ ID NO: 7007224 - DNA, 22 bp, Homo sapiens
tggggaaaggaaagttaacctg

SEQ ID NO: 7007225 - DNA, 18 bp, Homo sapiens
aatgcatttatggagatg

SEQ ID NO: 7007226 - DNA, 22 bp, Homo sapiens
agccctgggatacagtaaaagc

SEQ ID NO: 7007227 - DNA, 22 bp, Homo sapiens
aagttagaaataagggctctcc

SEQ ID NO: 7007228 - DNA, 22 bp, Homo sapiens
caggtgacctgggatccgctgc

SEQ ID NO: 7007229 - DNA, 22 bp, Homo sapiens
tgtcaaagggtaagctggataa

SEQ ID NO: 7007230 - DNA, 22 bp, Homo sapiens
agctgtgccttgctgcacggtg

SEQ ID NO: 7007231 - DNA, 22 bp, Homo sapiens
acagaacatggatttttgaagt

SEQ ID NO: 7007232 - DNA, 22 bp, Homo sapiens
aaaatgatatcctgacttttat

SEQ ID NO: 7007233 - DNA, 18 bp, Homo sapiens
atttggcagatgatgaac

SEQ ID NO: 7007234 - DNA, 22 bp, Homo sapiens
caaggaaacatgaaatgcattg

SEQ ID NO: 7007235 - DNA, 22 bp, Homo sapiens
ggtatttccttgcctctgccta

SEQ ID NO: 7007236 - DNA, 22 bp, Homo sapiens
tgctgctgtatccttagtgtca

SEQ ID NO: 7007237 - DNA, 22 bp, Homo sapiens
cctgctctgccaagtcctcttt

SEQ ID NO: 7007238 - DNA, 20 bp, Homo sapiens
tgctgaggttgacatgccca

SEQ ID NO: 7007239 - DNA, 21 bp, Homo sapiens
aagcagacctgagcacagaac

SEQ ID NO: 7007240 - DNA, 22 bp, Homo sapiens
cttcagaaccagccagaagagg

SEQ ID NO: 7007241 - DNA, 22 bp, Homo sapiens
gctgataagaagacccatcctg

SEQ ID NO: 7007242 - DNA, 22 bp, Homo sapiens
gccaataggaagagaaagatgg

SEQ ID NO: 7007243 - DNA, 22 bp, Homo sapiens
aaagatgtcatacacattaaga

SEQ ID NO: 7007244 - DNA, 22 bp, Homo sapiens
agggcctgggccagcacccttt

SEQ ID NO: 7007245 - DNA, 22 bp, Homo sapiens
gtgagaaatggaacttcatacg

SEQ ID NO: 7007246 - DNA, 22 bp, Homo sapiens
cagtgggtagtggggattagca

SEQ ID NO: 7007247 - DNA, 22 bp, Homo sapiens
aatagaaaggaggggctcttgt

SEQ ID NO: 7007248 - DNA, 22 bp, Homo sapiens
tcagtggtcttggctgattgtt

SEQ ID NO: 7007249 - DNA, 22 bp, Homo sapiens
catatccaatatgactagtgtt

SEQ ID NO: 7007250 - DNA, 20 bp, Homo sapiens
agtgtgtctcggaggtaagt

SEQ ID NO: 7007251 - DNA, 22 bp, Homo sapiens
gtttcaaagtcagaaaaggagg

SEQ ID NO: 7007252 - DNA, 22 bp, Homo sapiens
gcagaggccaggccaccagcaa

SEQ ID NO: 7007253 - DNA, 22 bp, Homo sapiens
aaagcatagaattagagttagg

SEQ ID NO: 7007254 - DNA, 22 bp, Homo sapiens
taatggtatttgttgaaaaact

SEQ ID NO: 7007255 - DNA, 22 bp, Homo sapiens
gagtttcttcatggtgcagagg

SEQ ID NO: 7007256 - DNA, 22 bp, Homo sapiens
atagagactatagagcacttac

SEQ ID NO: 7007257 - DNA, 18 bp, Homo sapiens
ttgagggaggggcagagt

SEQ ID NO: 7007258 - DNA, 22 bp, Homo sapiens
ttactgggcggggagtggaagc

SEQ ID NO: 7007259 - DNA, 22 bp, Homo sapiens
attctgtcagatcttactggat

SEQ ID NO: 7007260 - DNA, 22 bp, Homo sapiens
tcacattttagtaccatgattt

SEQ ID NO: 7007261 - DNA, 22 bp, Homo sapiens
gtcattctccaagaacccgctg

SEQ ID NO: 7007262 - DNA, 22 bp, Homo sapiens
catcattttgtatccaagggga

SEQ ID NO: 7007263 - DNA, 22 bp, Homo sapiens
ttacagatcatcaaggtataat

SEQ ID NO: 7007264 - DNA, 22 bp, Homo sapiens
attaagactattgatatttaca

SEQ ID NO: 7007265 - DNA, 22 bp, Homo sapiens
ggagctctcctgatgtgaagat

SEQ ID NO: 7007266 - DNA, 19 bp, Homo sapiens
cacattttgagtctgagat

SEQ ID NO: 7007267 - DNA, 22 bp, Homo sapiens
ggccaattccaggagccggcgg

SEQ ID NO: 7007268 - DNA, 22 bp, Homo sapiens
tagaaggtaatgaaatgctgat

SEQ ID NO: 7007269 - DNA, 22 bp, Homo sapiens
ctgctctaggtattgaggctaa

SEQ ID NO: 7007270 - DNA, 22 bp, Homo sapiens
tgtttgtatctctctctgtggc

SEQ ID NO: 7007271 - DNA, 22 bp, Homo sapiens
atgcattcattcattctttcta

SEQ ID NO: 7007272 - DNA, 22 bp, Homo sapiens
agaaggaaggctgagtgctgat

SEQ ID NO: 7007273 - DNA, 22 bp, Homo sapiens
tctctgtctgagcctggcagac

SEQ ID NO: 7007274 - DNA, 22 bp, Homo sapiens
ctgaggctgcccagggccaggt

SEQ ID NO: 7007275 - DNA, 22 bp, Homo sapiens
ctggcagtattaagagaagtga

SEQ ID NO: 7007276 - DNA, 22 bp, Homo sapiens
gagggccacgttcagggctctc

SEQ ID NO: 7007277 - DNA, 22 bp, Homo sapiens
tgaggtgacaattcattctcca

SEQ ID NO: 7007278 - DNA, 22 bp, Homo sapiens
tcctcattcttggtgcatcaaa

SEQ ID NO: 7007279 - DNA, 22 bp, Homo sapiens
gaaatagaggacagctggatca

SEQ ID NO: 7007280 - DNA, 22 bp, Homo sapiens
tctgaagagtcatctttgggtg

SEQ ID NO: 7007281 - DNA, 22 bp, Homo sapiens
gcaggcagtttgcttttccctc

SEQ ID NO: 7007282 - DNA, 22 bp, Homo sapiens
ataccttttactcattatccat

SEQ ID NO: 7007283 - DNA, 22 bp, Homo sapiens
acatagaaggaagagtagtagg

SEQ ID NO: 7007284 - DNA, 22 bp, Homo sapiens
ccttttggccaggtcagtgcag

SEQ ID NO: 7007285 - DNA, 22 bp, Homo sapiens
gcaggcttgttgaagtaaaata

SEQ ID NO: 7007286 - DNA, 22 bp, Homo sapiens
tgtaaactcagtatgttttact

SEQ ID NO: 7007287 - DNA, 22 bp, Homo sapiens
tatgtagtgttgagaatgcttg

SEQ ID NO: 7007288 - DNA, 22 bp, Homo sapiens
tcagaacactttctctactgac

SEQ ID NO: 7007289 - DNA, 23 bp, Homo sapiens
tggttacaggaacagggtttcgg

SEQ ID NO: 7007290 - DNA, 22 bp, Homo sapiens
tactgaaatggcagatatataa

SEQ ID NO: 7007291 - DNA, 22 bp, Homo sapiens
ccaaggagaaatgctgtgcttt

SEQ ID NO: 7007292 - DNA, 18 bp, Homo sapiens
gggaggccccagcaggag

SEQ ID NO: 7007293 - DNA, 22 bp, Homo sapiens
gagtaatgctgttccatcttgg

SEQ ID NO: 7007294 - DNA, 22 bp, Homo sapiens
gaaagaatgctgggagccatct

SEQ ID NO: 7007295 - DNA, 22 bp, Homo sapiens
ttggcgtcttttccatggaaag

SEQ ID NO: 7007296 - DNA, 22 bp, Homo sapiens
ttgtgttggcgaaagcatgtca

SEQ ID NO: 7007297 - DNA, 22 bp, Homo sapiens
acttccaagtttattcatgtga

SEQ ID NO: 7007298 - DNA, 22 bp, Homo sapiens
taagaacatctgtccccagatt

SEQ ID NO: 7007299 - DNA, 22 bp, Homo sapiens
ttgagcacaggtgaacagcatc

SEQ ID NO: 7007300 - DNA, 22 bp, Homo sapiens
ttaggtaggaaatgagtagctt

SEQ ID NO: 7007301 - DNA, 22 bp, Homo sapiens
ttcccatagtgaccgatgctga

SEQ ID NO: 7007302 - DNA, 22 bp, Homo sapiens
tctttttctgcacacgtgtccc

SEQ ID NO: 7007303 - DNA, 22 bp, Homo sapiens
ctgtgtgtcctcggacgagttt

SEQ ID NO: 7007304 - DNA, 21 bp, Homo sapiens
tgacaggtttaggattaaaat

SEQ ID NO: 7007305 - DNA, 22 bp, Homo sapiens
aaatgtgttcctttgctacaga

SEQ ID NO: 7007306 - DNA, 22 bp, Homo sapiens
aagtaggaatccgaatgagtag

SEQ ID NO: 7007307 - DNA, 22 bp, Homo sapiens
agcattttctgagagtatagat

SEQ ID NO: 7007308 - DNA, 22 bp, Homo sapiens
gtttccaggcgatatcagctgc

SEQ ID NO: 7007309 - DNA, 22 bp, Homo sapiens
ctttctcttcgaaaacctgccc

SEQ ID NO: 7007310 - DNA, 22 bp, Homo sapiens
aagtcatgtggaagaataacct

SEQ ID NO: 7007311 - DNA, 21 bp, Homo sapiens
tgacagcacatgcaatcggag

SEQ ID NO: 7007312 - DNA, 22 bp, Homo sapiens
cacatgaagacctaattggatt

SEQ ID NO: 7007313 - DNA, 21 bp, Homo sapiens
tctttacatttgcctcttgca

SEQ ID NO: 7007314 - DNA, 22 bp, Homo sapiens
caattcaatggcaaagtattgt

SEQ ID NO: 7007315 - DNA, 22 bp, Homo sapiens
tttcataatgtcacagtcaaaa

SEQ ID NO: 7007316 - DNA, 22 bp, Homo sapiens
gccagccagagtggctgtgtgt

SEQ ID NO: 7007317 - DNA, 22 bp, Homo sapiens
actgtgtgccaggcgctggtct

SEQ ID NO: 7007318 - DNA, 19 bp, Homo sapiens
tcttctgacttgagaaaga

SEQ ID NO: 7007319 - DNA, 22 bp, Homo sapiens
gagagaaatgtgcagtttgggc

SEQ ID NO: 7007320 - DNA, 22 bp, Homo sapiens
cttcctgcaggacagccatctg

SEQ ID NO: 7007321 - DNA, 22 bp, Homo sapiens
atacaatcatcattatattccc

SEQ ID NO: 7007322 - DNA, 22 bp, Homo sapiens
gtggcccatcacgtttcgcctt

SEQ ID NO: 7007323 - DNA, 22 bp, Homo sapiens
tctgtgggtagagtgagtactt

SEQ ID NO: 7007324 - DNA, 22 bp, Homo sapiens
aggcagtggtgtttgctggtgg

SEQ ID NO: 7007325 - DNA, 22 bp, Homo sapiens
gtgaaggtgtgagccagctgca

SEQ ID NO: 7007326 - DNA, 18 bp, Homo sapiens
aatggaaggggtgctgtt

SEQ ID NO: 7007327 - DNA, 20 bp, Homo sapiens
ggccttgctctgtgaccccc

SEQ ID NO: 7007328 - DNA, 22 bp, Homo sapiens
aagtaaatcttatgtcagggag

SEQ ID NO: 7007329 - DNA, 20 bp, Homo sapiens
gtataagatttcacacatta

SEQ ID NO: 7007330 - DNA, 22 bp, Homo sapiens
ccgtggccttgatggctccggt

SEQ ID NO: 7007331 - DNA, 22 bp, Homo sapiens
ggcctctggtcaagacaagcat

SEQ ID NO: 7007332 - DNA, 22 bp, Homo sapiens
tgtcctgttctggcgtgagtgg

SEQ ID NO: 7007333 - DNA, 22 bp, Homo sapiens
tgctctgcacatccctcacaaa

SEQ ID NO: 7007334 - DNA, 22 bp, Homo sapiens
caagtccatgttagatgctggc

SEQ ID NO: 7007335 - DNA, 22 bp, Homo sapiens
tccagtttgggtgtgagctgcg

SEQ ID NO: 7007336 - DNA, 22 bp, Homo sapiens
taacctttctcttgtggctgac

SEQ ID NO: 7007337 - DNA, 22 bp, Homo sapiens
ggccgcggattttcccgctggc

SEQ ID NO: 7007338 - DNA, 22 bp, Homo sapiens
ctctgcagtgtaacagcgcttg

SEQ ID NO: 7007339 - DNA, 22 bp, Homo sapiens
tagttagggttctgcagagaca

SEQ ID NO: 7007340 - DNA, 22 bp, Homo sapiens
catcatgtctgcaggaatgtgt

SEQ ID NO: 7007341 - DNA, 22 bp, Homo sapiens
gcctcctatcatttccttgctt

SEQ ID NO: 7007342 - DNA, 22 bp, Homo sapiens
agggcagctaaggtgctgactg

SEQ ID NO: 7007343 - DNA, 22 bp, Homo sapiens
gtgggtggattccagcaacgct

SEQ ID NO: 7007344 - DNA, 22 bp, Homo sapiens
tctcatggcttaacaagcccac

SEQ ID NO: 7007345 - DNA, 18 bp, Homo sapiens
taaacctgagaagcgtgt

SEQ ID NO: 7007346 - DNA, 22 bp, Homo sapiens
tctgaccacagacaacctgcta

SEQ ID NO: 7007347 - DNA, 21 bp, Homo sapiens
acacaattcttgcttggcctt

SEQ ID NO: 7007348 - DNA, 22 bp, Homo sapiens
tctgtttgctggtgcatgggtt

SEQ ID NO: 7007349 - DNA, 22 bp, Homo sapiens
gatcaattcaaactattttcct

SEQ ID NO: 7007350 - DNA, 22 bp, Homo sapiens
ggctgcctggtttcttgtaagg

SEQ ID NO: 7007351 - DNA, 22 bp, Homo sapiens
tacagcttttgcagctgttttg

SEQ ID NO: 7007352 - DNA, 22 bp, Homo sapiens
tgccaagtagcctgcagtgact

SEQ ID NO: 7007353 - DNA, 22 bp, Homo sapiens
gtcacctggaggctgattaatg

SEQ ID NO: 7007354 - DNA, 22 bp, Homo sapiens
ctggagggacaaggtatgcatt

SEQ ID NO: 7007355 - DNA, 22 bp, Homo sapiens
ctctactccaaaaggctacaat

SEQ ID NO: 7007356 - DNA, 22 bp, Homo sapiens
cctggtgtggccctgtgacatg

SEQ ID NO: 7007357 - DNA, 22 bp, Homo sapiens
aagatgcacaatgtggcaatta

SEQ ID NO: 7007358 - DNA, 22 bp, Homo sapiens
gataggaccaggtaacctctaa

SEQ ID NO: 7007359 - DNA, 23 bp, Homo sapiens
aacttaccaaccaatacttggta

SEQ ID NO: 7007360 - DNA, 22 bp, Homo sapiens
ttcccagtattaccttcaggaa

SEQ ID NO: 7007361 - DNA, 22 bp, Homo sapiens
catgatgttatctaaatctggt

SEQ ID NO: 7007362 - DNA, 22 bp, Homo sapiens
tggaacactgatcattgccttt

SEQ ID NO: 7007363 - DNA, 21 bp, Homo sapiens
ggcagctcccagtttgggtgt

SEQ ID NO: 7007364 - DNA, 22 bp, Homo sapiens
aagcaatatactgatatgatta

SEQ ID NO: 7007365 - DNA, 22 bp, Homo sapiens
ttgtgcatttctctgagtgtgt

SEQ ID NO: 7007366 - DNA, 22 bp, Homo sapiens
tcgcccaggctggagtgcagtg

SEQ ID NO: 7007367 - DNA, 22 bp, Homo sapiens
ggtgccctggaagctgctgcat

SEQ ID NO: 7007368 - DNA, 20 bp, Homo sapiens
tgccttgccaagcctcctaa

SEQ ID NO: 7007369 - DNA, 22 bp, Homo sapiens
gtcccagagagcactagtccat

SEQ ID NO: 7007370 - DNA, 22 bp, Homo sapiens
cccaggcagaattagtgtttca

SEQ ID NO: 7007371 - DNA, 18 bp, Homo sapiens
tctctgagaatattaatg

SEQ ID NO: 7007372 - DNA, 19 bp, Homo sapiens
tggcttctggcaacagatg

SEQ ID NO: 7007373 - DNA, 22 bp, Homo sapiens
tataaacttaatggttccgaat

SEQ ID NO: 7007374 - DNA, 23 bp, Homo sapiens
aggcactgaatgtgtcagtgagt

SEQ ID NO: 7007375 - DNA, 22 bp, Homo sapiens
ctcatgagacagagggagaaaa

SEQ ID NO: 7007376 - DNA, 22 bp, Homo sapiens
gagggcaccagaagagccagat

SEQ ID NO: 7007377 - DNA, 22 bp, Homo sapiens
tgtgtcagaagtacttttggaa

SEQ ID NO: 7007378 - DNA, 22 bp, Homo sapiens
ggagtgctcctctccccagtgc

SEQ ID NO: 7007379 - DNA, 22 bp, Homo sapiens
ttcctggtctatttagaattgc

SEQ ID NO: 7007380 - DNA, 22 bp, Homo sapiens
tctggtcagtctccattctacc

SEQ ID NO: 7007381 - DNA, 18 bp, Homo sapiens
ggagagtgagatcaaaca

SEQ ID NO: 7007382 - DNA, 22 bp, Homo sapiens
cacagcttgtttagtgactcac

SEQ ID NO: 7007383 - DNA, 22 bp, Homo sapiens
ggagagggggctccctgcttgg

SEQ ID NO: 7007384 - DNA, 22 bp, Homo sapiens
ggccagctgggccaccaggtgc

SEQ ID NO: 7007385 - DNA, 22 bp, Homo sapiens
cagcctctgtggctgccacacc

SEQ ID NO: 7007386 - DNA, 22 bp, Homo sapiens
ggaaagtccttctaaagccaga

SEQ ID NO: 7007387 - DNA, 22 bp, Homo sapiens
tgaatgttctctaaatactcct

SEQ ID NO: 7007388 - DNA, 22 bp, Homo sapiens
aagaagttctgcctaagggaca

SEQ ID NO: 7007389 - DNA, 22 bp, Homo sapiens
gaggagagggctgcgggcccac

SEQ ID NO: 7007390 - DNA, 22 bp, Homo sapiens
tctgtgagaaccagtgccaggg

SEQ ID NO: 7007391 - DNA, 22 bp, Homo sapiens
cctgacaggcggaggctgcagt

SEQ ID NO: 7007392 - DNA, 22 bp, Homo sapiens
tggacctcactgtctgctggta

SEQ ID NO: 7007393 - DNA, 22 bp, Homo sapiens
gtcaacatgttctgggtgaatg

SEQ ID NO: 7007394 - DNA, 22 bp, Homo sapiens
aaagaatagttaagtttagggc

SEQ ID NO: 7007395 - DNA, 22 bp, Homo sapiens
aagggccacatgccatttaaaa

SEQ ID NO: 7007396 - DNA, 22 bp, Homo sapiens
tcttgcagagggcccttctgct

SEQ ID NO: 7007397 - DNA, 22 bp, Homo sapiens
aaggaacttggtgcccgtgccc

SEQ ID NO: 7007398 - DNA, 22 bp, Homo sapiens
tgctatttggaaaagcatttgg

SEQ ID NO: 7007399 - DNA, 19 bp, Homo sapiens
atggaaaatgccagactga

SEQ ID NO: 7007400 - DNA, 22 bp, Homo sapiens
gttatgaaataaatatagatca

SEQ ID NO: 7007401 - DNA, 22 bp, Homo sapiens
acattagttgtttctccatgta

SEQ ID NO: 7007402 - DNA, 22 bp, Homo sapiens
gatgtctctgactaaggcagtg

SEQ ID NO: 7007403 - DNA, 22 bp, Homo sapiens
acagagaaagtgggctgaagat

SEQ ID NO: 7007404 - DNA, 22 bp, Homo sapiens
aggcagccctgtgctggatgct

SEQ ID NO: 7007405 - DNA, 22 bp, Homo sapiens
tttcccaggccctcagggctgc

SEQ ID NO: 7007406 - DNA, 22 bp, Homo sapiens
ttgggggcagagggagcatctg

SEQ ID NO: 7007407 - DNA, 22 bp, Homo sapiens
tgtcaatgaagtcatccttgtg

SEQ ID NO: 7007408 - DNA, 22 bp, Homo sapiens
ttacagttgtagaaagtggttg

SEQ ID NO: 7007409 - DNA, 22 bp, Homo sapiens
catgaatatacatcctgatggc

SEQ ID NO: 7007410 - DNA, 22 bp, Homo sapiens
atgttgtacattctatgggttt

SEQ ID NO: 7007411 - DNA, 22 bp, Homo sapiens
ctgggctgcgggcgcccctcca

SEQ ID NO: 7007412 - DNA, 22 bp, Homo sapiens
tcctcagttataaataggaaac

SEQ ID NO: 7007413 - DNA, 22 bp, Homo sapiens
atgtgtctagattgctgtaccg

SEQ ID NO: 7007414 - DNA, 22 bp, Homo sapiens
agggagccctgaaccagagggt

SEQ ID NO: 7007415 - DNA, 22 bp, Homo sapiens
tcaggtggagacctccttggcc

SEQ ID NO: 7007416 - DNA, 22 bp, Homo sapiens
atgcacaggaccacacataatg

SEQ ID NO: 7007417 - DNA, 22 bp, Homo sapiens
cctgggcaggtgtggcttcccc

SEQ ID NO: 7007418 - DNA, 22 bp, Homo sapiens
tgctatttgtgagtgtcttcgt

SEQ ID NO: 7007419 - DNA, 22 bp, Homo sapiens
ttaacaatcataggaccattta

SEQ ID NO: 7007420 - DNA, 22 bp, Homo sapiens
ggataatgaaatggtagtggtt

SEQ ID NO: 7007421 - DNA, 22 bp, Homo sapiens
tttgtaagcagtgtttttacag

SEQ ID NO: 7007422 - DNA, 22 bp, Homo sapiens
cccttggaaggtagctggcagt

SEQ ID NO: 7007423 - DNA, 22 bp, Homo sapiens
tagatcctgagccctatctact

SEQ ID NO: 7007424 - DNA, 22 bp, Homo sapiens
cttcagcagatgtgctagagat

SEQ ID NO: 7007425 - DNA, 22 bp, Homo sapiens
tctgctctagttgcttcctgcc

SEQ ID NO: 7007426 - DNA, 22 bp, Homo sapiens
ttattgcaccatgcctcagttt

SEQ ID NO: 7007427 - DNA, 22 bp, Homo sapiens
gcagctggaagtgacactctgt

SEQ ID NO: 7007428 - DNA, 22 bp, Homo sapiens
cacggtcacccatcagagtcca

SEQ ID NO: 7007429 - DNA, 22 bp, Homo sapiens
ctggcagttggcattggcatct

SEQ ID NO: 7007430 - DNA, 22 bp, Homo sapiens
ctcagaggtcaagagcagagct

SEQ ID NO: 7007431 - DNA, 22 bp, Homo sapiens
attccagagaaaggcctggctg

SEQ ID NO: 7007432 - DNA, 22 bp, Homo sapiens
tggcgaggtttcagagagcggc

SEQ ID NO: 7007433 - DNA, 22 bp, Homo sapiens
tctagttctagatccctgagga

SEQ ID NO: 7007434 - DNA, 22 bp, Homo sapiens
ttgtttcctttctatacaggat

SEQ ID NO: 7007435 - DNA, 22 bp, Homo sapiens
atttctcagcacttcctatctc

SEQ ID NO: 7007436 - DNA, 22 bp, Homo sapiens
ttagataggactcatagattgg

SEQ ID NO: 7007437 - DNA, 22 bp, Homo sapiens
aaggactagattatacaatagg

SEQ ID NO: 7007438 - DNA, 22 bp, Homo sapiens
tttttaacctaccttaagagca

SEQ ID NO: 7007439 - DNA, 22 bp, Homo sapiens
cctgctggcggggacccagtga

SEQ ID NO: 7007440 - DNA, 22 bp, Homo sapiens
atgagtcactcagcagaaaagg

SEQ ID NO: 7007441 - DNA, 22 bp, Homo sapiens
gggactgtgaggcctaactggg

SEQ ID NO: 7007442 - DNA, 22 bp, Homo sapiens
ccaaggagaatgacaccatgga

SEQ ID NO: 7007443 - DNA, 22 bp, Homo sapiens
aaaatagcaatcagggactctc

SEQ ID NO: 7007444 - DNA, 22 bp, Homo sapiens
ggcagtggtgggaggctcgctc

SEQ ID NO: 7007445 - DNA, 22 bp, Homo sapiens
acagtgtctgacacattgtagc

SEQ ID NO: 7007446 - DNA, 22 bp, Homo sapiens
gccttttttgttgctctgtcac

SEQ ID NO: 7007447 - DNA, 22 bp, Homo sapiens
cagcagagctgtgtgggaaggg

SEQ ID NO: 7007448 - DNA, 22 bp, Homo sapiens
ataaagcatgcttgtttggaga

SEQ ID NO: 7007449 - DNA, 22 bp, Homo sapiens
ctagagaagaggctcagccagc

SEQ ID NO: 7007450 - DNA, 22 bp, Homo sapiens
cctttgcatttatgtgtccatt

SEQ ID NO: 7007451 - DNA, 22 bp, Homo sapiens
cccttggccactgcgccagtga

SEQ ID NO: 7007452 - DNA, 22 bp, Homo sapiens
caccaggtggaaatgtcacagc

SEQ ID NO: 7007453 - DNA, 21 bp, Homo sapiens
tccagggaatttcaactttta

SEQ ID NO: 7007454 - DNA, 22 bp, Homo sapiens
ctggttttaatgttatgtttat

SEQ ID NO: 7007455 - DNA, 22 bp, Homo sapiens
ggtcctctccagcgccacagtg

SEQ ID NO: 7007456 - DNA, 22 bp, Homo sapiens
ttcttgttccatgaaagacaga

SEQ ID NO: 7007457 - DNA, 22 bp, Homo sapiens
gagtcctgtaactttcttccta

SEQ ID NO: 7007458 - DNA, 22 bp, Homo sapiens
atgtcctttgtgtgtagctctc

SEQ ID NO: 7007459 - DNA, 21 bp, Homo sapiens
atcagtaaggttggaggaaga

SEQ ID NO: 7007460 - DNA, 22 bp, Homo sapiens
acttcacagaaattttatgagg

SEQ ID NO: 7007461 - DNA, 22 bp, Homo sapiens
tgcagagatagaactactttct

SEQ ID NO: 7007462 - DNA, 22 bp, Homo sapiens
tctggggtcacctggggtgctt

SEQ ID NO: 7007463 - DNA, 22 bp, Homo sapiens
gttgtacagacatgaaacttgc

SEQ ID NO: 7007464 - DNA, 22 bp, Homo sapiens
cagatgttgttcctgcctgtag

SEQ ID NO: 7007465 - DNA, 22 bp, Homo sapiens
cataatgaacattagctactgt

SEQ ID NO: 7007466 - DNA, 22 bp, Homo sapiens
ggtctgagtgggcaggggccgg

SEQ ID NO: 7007467 - DNA, 22 bp, Homo sapiens
cgtggcctctatggctcccgcc

SEQ ID NO: 7007468 - DNA, 22 bp, Homo sapiens
tagggcagattcggtggagttt

SEQ ID NO: 7007469 - DNA, 22 bp, Homo sapiens
agtcctttgggaaaaatgacta

SEQ ID NO: 7007470 - DNA, 22 bp, Homo sapiens
tcagttttctcatctgtgaaat

SEQ ID NO: 7007471 - DNA, 22 bp, Homo sapiens
tgacagtttagtgtaatagtta

SEQ ID NO: 7007472 - DNA, 22 bp, Homo sapiens
aagtaatggttaaataattcta

SEQ ID NO: 7007473 - DNA, 22 bp, Homo sapiens
ccaagtgttttataagggacag

SEQ ID NO: 7007474 - DNA, 22 bp, Homo sapiens
tcctttctcccaggttagttgt

SEQ ID NO: 7007475 - DNA, 22 bp, Homo sapiens
aagcatggagcaatagaatgac

SEQ ID NO: 7007476 - DNA, 22 bp, Homo sapiens
gtccctgggggtttaggactca

SEQ ID NO: 7007477 - DNA, 22 bp, Homo sapiens
tgcttctaatctactgcattag

SEQ ID NO: 7007478 - DNA, 22 bp, Homo sapiens
tccaggcaaggataataaacat

SEQ ID NO: 7007479 - DNA, 22 bp, Homo sapiens
tccttgagattaattaatcacc

SEQ ID NO: 7007480 - DNA, 22 bp, Homo sapiens
tgttagcatagctcagaaggag

SEQ ID NO: 7007481 - DNA, 22 bp, Homo sapiens
gcagagatttcagtaacagcag

SEQ ID NO: 7007482 - DNA, 22 bp, Homo sapiens
taatgtctgatagtgatggctc

SEQ ID NO: 7007483 - DNA, 22 bp, Homo sapiens
tcctgaatgagttgatcacaat

SEQ ID NO: 7007484 - DNA, 21 bp, Homo sapiens
actgttcatttgatgaactgg

SEQ ID NO: 7007485 - DNA, 22 bp, Homo sapiens
taccctgggagcttagaagaat

SEQ ID NO: 7007486 - DNA, 22 bp, Homo sapiens
tgctccgttcttctgcttcttg

SEQ ID NO: 7007487 - DNA, 22 bp, Homo sapiens
caatggatattttatgtgagaa

SEQ ID NO: 7007488 - DNA, 17 bp, Homo sapiens
ttcctgtggtttgatct

SEQ ID NO: 7007489 - DNA, 22 bp, Homo sapiens
aggtggctcctcccatggctgg

SEQ ID NO: 7007490 - DNA, 22 bp, Homo sapiens
tatttggagctgtgtgagctca

SEQ ID NO: 7007491 - DNA, 22 bp, Homo sapiens
tgcaggaactgggagggatagt

SEQ ID NO: 7007492 - DNA, 22 bp, Homo sapiens
gttaggcatttgccttaatttt

SEQ ID NO: 7007493 - DNA, 22 bp, Homo sapiens
gaagcatataggtactgaacta

SEQ ID NO: 7007494 - DNA, 22 bp, Homo sapiens
tgctagggatatagtggcgagt

SEQ ID NO: 7007495 - DNA, 21 bp, Homo sapiens
ttcagctcggtctggcatgat

SEQ ID NO: 7007496 - DNA, 17 bp, Homo sapiens
catcttaactatggact

SEQ ID NO: 7007497 - DNA, 22 bp, Homo sapiens
ttagccatttgaggtcttcatt

SEQ ID NO: 7007498 - DNA, 22 bp, Homo sapiens
tctttgaactttttgtaagtta

SEQ ID NO: 7007499 - DNA, 22 bp, Homo sapiens
cttggtgccacagcagcttgcg

SEQ ID NO: 7007500 - DNA, 22 bp, Homo sapiens
atgatgtaagggtaattgtcta

SEQ ID NO: 7007501 - DNA, 22 bp, Homo sapiens
taatccaggtaagacataatag

SEQ ID NO: 7007502 - DNA, 22 bp, Homo sapiens
tttggctctgtgtctccaccca

SEQ ID NO: 7007503 - DNA, 22 bp, Homo sapiens
ttttatgttcctgaagctatct

SEQ ID NO: 7007504 - DNA, 22 bp, Homo sapiens
cctcccatccctgcaagagagc

SEQ ID NO: 7007505 - DNA, 22 bp, Homo sapiens
catgggggtctggacaacaggc

SEQ ID NO: 7007506 - DNA, 22 bp, Homo sapiens
aggctaagaggccttcagatac

SEQ ID NO: 7007507 - DNA, 19 bp, Homo sapiens
ccctggagaataccctgga

SEQ ID NO: 7007508 - DNA, 22 bp, Homo sapiens
tgaagctttaggatgggttcat

SEQ ID NO: 7007509 - DNA, 22 bp, Homo sapiens
gacccggctccaggcccagcag

SEQ ID NO: 7007510 - DNA, 22 bp, Homo sapiens
tttctgctgtgtaaaatgaggg

SEQ ID NO: 7007511 - DNA, 20 bp, Homo sapiens
tagatgtttcctgtcataaa

SEQ ID NO: 7007512 - DNA, 22 bp, Homo sapiens
tgtctacaaagtccgcagtcat

SEQ ID NO: 7007513 - DNA, 20 bp, Homo sapiens
attctctgctcaagtggcac

SEQ ID NO: 7007514 - DNA, 22 bp, Homo sapiens
caaggccacgttctgcatgcgg

SEQ ID NO: 7007515 - DNA, 22 bp, Homo sapiens
aatgacaatattaatttggagg

SEQ ID NO: 7007516 - DNA, 22 bp, Homo sapiens
cggctgcttctgagccccggcg

SEQ ID NO: 7007517 - DNA, 22 bp, Homo sapiens
agcatccaactttgattagaga

SEQ ID NO: 7007518 - DNA, 22 bp, Homo sapiens
gtgtatctgttaagtataaaaa

SEQ ID NO: 7007519 - DNA, 17 bp, Homo sapiens
gctccaggcgtgagtga

SEQ ID NO: 7007520 - DNA, 22 bp, Homo sapiens
agctggttcactaagcataata

SEQ ID NO: 7007521 - DNA, 22 bp, Homo sapiens
acagttctgagctataattgct

SEQ ID NO: 7007522 - DNA, 22 bp, Homo sapiens
caaggcctaatcatactgctaa

SEQ ID NO: 7007523 - DNA, 22 bp, Homo sapiens
ttcaggtgtcaaggataggctg

SEQ ID NO: 7007524 - DNA, 22 bp, Homo sapiens
tacagcaataatgacaccgctc

SEQ ID NO: 7007525 - DNA, 20 bp, Homo sapiens
tatctcagtttgtcctaaac

SEQ ID NO: 7007526 - DNA, 22 bp, Homo sapiens
gtccagcccttgcagcttcttt

SEQ ID NO: 7007527 - DNA, 22 bp, Homo sapiens
ttgaaggtttaactgagaggca

SEQ ID NO: 7007528 - DNA, 22 bp, Homo sapiens
ctcagggacggcatctcatttc

SEQ ID NO: 7007529 - DNA, 22 bp, Homo sapiens
tagtgaaatgagaatgtatgac

SEQ ID NO: 7007530 - DNA, 22 bp, Homo sapiens
cttcatgtcggcggctctcggg

SEQ ID NO: 7007531 - DNA, 22 bp, Homo sapiens
tcacatctctgttttctaaatc

SEQ ID NO: 7007532 - DNA, 22 bp, Homo sapiens
ctctgaactcttgggcagcatg

SEQ ID NO: 7007533 - DNA, 22 bp, Homo sapiens
gtgcatactttattttaatact

SEQ ID NO: 7007534 - DNA, 22 bp, Homo sapiens
acagtacataatcctgagtctg

SEQ ID NO: 7007535 - DNA, 22 bp, Homo sapiens
cagcaccaggcagacctggagc

SEQ ID NO: 7007536 - DNA, 22 bp, Homo sapiens
aagcactaggtcacacaagtta

SEQ ID NO: 7007537 - DNA, 22 bp, Homo sapiens
aaggctcttggagtgaatgcag

SEQ ID NO: 7007538 - DNA, 22 bp, Homo sapiens
tagctgttctctgtaaattgga

SEQ ID NO: 7007539 - DNA, 22 bp, Homo sapiens
atcctgttttagataagcttat

SEQ ID NO: 7007540 - DNA, 22 bp, Homo sapiens
aagactcttgcctaatacatct

SEQ ID NO: 7007541 - DNA, 22 bp, Homo sapiens
gtggggtgtccagcagcgagct

SEQ ID NO: 7007542 - DNA, 22 bp, Homo sapiens
ggaggcaggaaagacaggttca

SEQ ID NO: 7007543 - DNA, 22 bp, Homo sapiens
atccctgtgacgagcatcccta

SEQ ID NO: 7007544 - DNA, 22 bp, Homo sapiens
ggctggtgttgagtgcctgtag

SEQ ID NO: 7007545 - DNA, 22 bp, Homo sapiens
cttccagtgcataggtagatca

SEQ ID NO: 7007546 - DNA, 22 bp, Homo sapiens
ttcattactgaattctcactac

SEQ ID NO: 7007547 - DNA, 22 bp, Homo sapiens
gctgtcacacatgggatctcag

SEQ ID NO: 7007548 - DNA, 22 bp, Homo sapiens
gtcctgggtccccgcaggtcag

SEQ ID NO: 7007549 - DNA, 22 bp, Homo sapiens
tgtggacatactaggcctaggc

SEQ ID NO: 7007550 - DNA, 22 bp, Homo sapiens
catttccacttctgaaaactgg

SEQ ID NO: 7007551 - DNA, 22 bp, Homo sapiens
ttattcatcagtgcattaattt

SEQ ID NO: 7007552 - DNA, 22 bp, Homo sapiens
tgggctgaggggccttgatgac

SEQ ID NO: 7007553 - DNA, 23 bp, Homo sapiens
cgctcagaggttctgtccttggt

SEQ ID NO: 7007554 - DNA, 22 bp, Homo sapiens
aacactttctattattatggtt

SEQ ID NO: 7007555 - DNA, 22 bp, Homo sapiens
atgcactacttggctttactga

SEQ ID NO: 7007556 - DNA, 22 bp, Homo sapiens
tcatgtctctatgtgcctatta

SEQ ID NO: 7007557 - DNA, 22 bp, Homo sapiens
agctaggggaccaaggtggccc

SEQ ID NO: 7007558 - DNA, 17 bp, Homo sapiens
ctgagcactttatcctg

SEQ ID NO: 7007559 - DNA, 22 bp, Homo sapiens
atgaggcatgggatcaaaatga

SEQ ID NO: 7007560 - DNA, 22 bp, Homo sapiens
gtgataaaatagaaacagtggt

SEQ ID NO: 7007561 - DNA, 22 bp, Homo sapiens
cgctctggcaggcacaggaggg

SEQ ID NO: 7007562 - DNA, 20 bp, Homo sapiens
agatcctgtctccaccttgg

SEQ ID NO: 7007563 - DNA, 22 bp, Homo sapiens
gagaacagatttttctgctgtc

SEQ ID NO: 7007564 - DNA, 21 bp, Homo sapiens
cttggagttggttgaggatgc

SEQ ID NO: 7007565 - DNA, 22 bp, Homo sapiens
tctggcccaagttttcggtgag

SEQ ID NO: 7007566 - DNA, 22 bp, Homo sapiens
tctgccttcgctgctccctgaa

SEQ ID NO: 7007567 - DNA, 22 bp, Homo sapiens
tttgacaaatgtatctgcatta

SEQ ID NO: 7007568 - DNA, 22 bp, Homo sapiens
ttcagctattatacccactttt

SEQ ID NO: 7007569 - DNA, 22 bp, Homo sapiens
cctcaggaaatgaataaatggc

SEQ ID NO: 7007570 - DNA, 22 bp, Homo sapiens
gagtaattccttagtgtgctta

SEQ ID NO: 7007571 - DNA, 22 bp, Homo sapiens
taaggccaggctgtggtcggca

SEQ ID NO: 7007572 - DNA, 22 bp, Homo sapiens
aaggaagacttgagaaggttcc

SEQ ID NO: 7007573 - DNA, 22 bp, Homo sapiens
gccctcctgagctagcacgtgt

SEQ ID NO: 7007574 - DNA, 22 bp, Homo sapiens
aggtacataatgatggtgatga

SEQ ID NO: 7007575 - DNA, 22 bp, Homo sapiens
ctgggccagcaactgcaatgga

SEQ ID NO: 7007576 - DNA, 22 bp, Homo sapiens
tccctagtagacccagatcatt

SEQ ID NO: 7007577 - DNA, 22 bp, Homo sapiens
tgccactggctcaatggtgcag

SEQ ID NO: 7007578 - DNA, 22 bp, Homo sapiens
ttctacagttggtggaggtctt

SEQ ID NO: 7007579 - DNA, 22 bp, Homo sapiens
aagttttattggaacatagcca

SEQ ID NO: 7007580 - DNA, 22 bp, Homo sapiens
attcttcatacagacaagtcct

SEQ ID NO: 7007581 - DNA, 22 bp, Homo sapiens
cagcaggaccattgaggcatca

SEQ ID NO: 7007582 - DNA, 22 bp, Homo sapiens
tttcaaatgcatgtctttcctc

SEQ ID NO: 7007583 - DNA, 22 bp, Homo sapiens
tctgaaaactccatgagctcgt

SEQ ID NO: 7007584 - DNA, 22 bp, Homo sapiens
tgtgcacatatactcatattcc

SEQ ID NO: 7007585 - DNA, 22 bp, Homo sapiens
aacatgcatataggtaaatgga

SEQ ID NO: 7007586 - DNA, 22 bp, Homo sapiens
taggaattatgatgctatcaag

SEQ ID NO: 7007587 - DNA, 19 bp, Homo sapiens
acaaactgagtacacttgt

SEQ ID NO: 7007588 - DNA, 22 bp, Homo sapiens
ggcaggagctctccagtttgcc

SEQ ID NO: 7007589 - DNA, 22 bp, Homo sapiens
gctgatgcagggttgagaggag

SEQ ID NO: 7007590 - DNA, 22 bp, Homo sapiens
ggagttgccaaggcttgaaaat

SEQ ID NO: 7007591 - DNA, 22 bp, Homo sapiens
agtcattgtatgaagtgtactc

SEQ ID NO: 7007592 - DNA, 22 bp, Homo sapiens
gattaagtggaatgagtatttg

SEQ ID NO: 7007593 - DNA, 22 bp, Homo sapiens
ccctgcagagaccactgacctt

SEQ ID NO: 7007594 - DNA, 22 bp, Homo sapiens
atagatactgggtatggagatg

SEQ ID NO: 7007595 - DNA, 19 bp, Homo sapiens
ggtgaccacctggtcagtg

SEQ ID NO: 7007596 - DNA, 22 bp, Homo sapiens
atgaagtggttctattggtttt

SEQ ID NO: 7007597 - DNA, 22 bp, Homo sapiens
ttcttgattagtctcatgccaa

SEQ ID NO: 7007598 - DNA, 22 bp, Homo sapiens
tcagagaacacagaggtgatgt

SEQ ID NO: 7007599 - DNA, 22 bp, Homo sapiens
ctgcctcacattggctgtgtga

SEQ ID NO: 7007600 - DNA, 22 bp, Homo sapiens
atctcagagaaatttgaatgca

SEQ ID NO: 7007601 - DNA, 22 bp, Homo sapiens
tgctttctctctaccccacttt

SEQ ID NO: 7007602 - DNA, 22 bp, Homo sapiens
caactatagggagagtggttaa

SEQ ID NO: 7007603 - DNA, 18 bp, Homo sapiens
aaggcagtatgattgcac

SEQ ID NO: 7007604 - DNA, 22 bp, Homo sapiens
aacatttgtttggcttcaatta

SEQ ID NO: 7007605 - DNA, 20 bp, Homo sapiens
gcaattaatttttggttaca

SEQ ID NO: 7007606 - DNA, 22 bp, Homo sapiens
ggctcctgatttgagggggctg

SEQ ID NO: 7007607 - DNA, 22 bp, Homo sapiens
tacagcctgatttggagccact

SEQ ID NO: 7007608 - DNA, 22 bp, Homo sapiens
ctttgccatgggcttgataggt

SEQ ID NO: 7007609 - DNA, 22 bp, Homo sapiens
tggcagataacctgctgtgccc

SEQ ID NO: 7007610 - DNA, 22 bp, Homo sapiens
tcagggcccagagctcaggcaa

SEQ ID NO: 7007611 - DNA, 22 bp, Homo sapiens
cccctgccagctatccctgaac

SEQ ID NO: 7007612 - DNA, 22 bp, Homo sapiens
cccaggaagaaattctgatttg

SEQ ID NO: 7007613 - DNA, 22 bp, Homo sapiens
ataaagaggatgtatttacagc

SEQ ID NO: 7007614 - DNA, 22 bp, Homo sapiens
ggcaggctgggtgtcatggagt

SEQ ID NO: 7007615 - DNA, 22 bp, Homo sapiens
tatggccatgatggccaattgg

SEQ ID NO: 7007616 - DNA, 22 bp, Homo sapiens
tcgctgcatgaagccaggccag

SEQ ID NO: 7007617 - DNA, 22 bp, Homo sapiens
aaatagtaaagtggtagccatc

SEQ ID NO: 7007618 - DNA, 22 bp, Homo sapiens
gtttcactgcactatagcacca

SEQ ID NO: 7007619 - DNA, 22 bp, Homo sapiens
gagttgatcattatttggtttc

SEQ ID NO: 7007620 - DNA, 22 bp, Homo sapiens
taaacaagggttactgagcatg

SEQ ID NO: 7007621 - DNA, 22 bp, Homo sapiens
aattcacagaaccatggtgctc

SEQ ID NO: 7007622 - DNA, 22 bp, Homo sapiens
agacaagtgtttctgggtaact

SEQ ID NO: 7007623 - DNA, 22 bp, Homo sapiens
cccaggaatgggaaggaggaat

SEQ ID NO: 7007624 - DNA, 21 bp, Homo sapiens
taattccagaggtcactgaag

SEQ ID NO: 7007625 - DNA, 19 bp, Homo sapiens
cctgaggaaaagatgattg

SEQ ID NO: 7007626 - DNA, 22 bp, Homo sapiens
aaatggaatgtgtttataattc

SEQ ID NO: 7007627 - DNA, 22 bp, Homo sapiens
cccagagctccggtcctgccca

SEQ ID NO: 7007628 - DNA, 22 bp, Homo sapiens
gcagctaccacccaggaaggac

SEQ ID NO: 7007629 - DNA, 22 bp, Homo sapiens
catttgaatgagattgctgtaa

SEQ ID NO: 7007630 - DNA, 22 bp, Homo sapiens
tttcctcttcgattaagtttgg

SEQ ID NO: 7007631 - DNA, 22 bp, Homo sapiens
tactctctggaaattatagtga

SEQ ID NO: 7007632 - DNA, 22 bp, Homo sapiens
agccaggacgttgctcagctcc

SEQ ID NO: 7007633 - DNA, 22 bp, Homo sapiens
gcctctgctctcaggtagcctc

SEQ ID NO: 7007634 - DNA, 22 bp, Homo sapiens
gtattgcatagacctgggatga

SEQ ID NO: 7007635 - DNA, 22 bp, Homo sapiens
ttttagttgtactgtcaacagt

SEQ ID NO: 7007636 - DNA, 22 bp, Homo sapiens
ggttggtgctgcatttgcctca

SEQ ID NO: 7007637 - DNA, 22 bp, Homo sapiens
tcacagaaggaccttgtttcat

SEQ ID NO: 7007638 - DNA, 22 bp, Homo sapiens
acctgtttgtgtccattagtga

SEQ ID NO: 7007639 - DNA, 22 bp, Homo sapiens
gccagggctcgcggtccctcgt

SEQ ID NO: 7007640 - DNA, 22 bp, Homo sapiens
aagggctcccaactcatctttt

SEQ ID NO: 7007641 - DNA, 22 bp, Homo sapiens
agcagagcagaatgtgaaggtg

SEQ ID NO: 7007642 - DNA, 22 bp, Homo sapiens
tgggagcagttgcatctccagt

SEQ ID NO: 7007643 - DNA, 22 bp, Homo sapiens
ccatccaggctgtgggtgagct

SEQ ID NO: 7007644 - DNA, 22 bp, Homo sapiens
gcttcctggagggagagagctg

SEQ ID NO: 7007645 - DNA, 22 bp, Homo sapiens
cagcatcttattttctatggaa

SEQ ID NO: 7007646 - DNA, 22 bp, Homo sapiens
gccagatgtagatagcaaggta

SEQ ID NO: 7007647 - DNA, 22 bp, Homo sapiens
tgctttaagagattgttagtac

SEQ ID NO: 7007648 - DNA, 22 bp, Homo sapiens
gaaactgtgaggatcttaactt

SEQ ID NO: 7007649 - DNA, 22 bp, Homo sapiens
agtcagttgtggagatttaact

SEQ ID NO: 7007650 - DNA, 22 bp, Homo sapiens
ttgattctgctgatctcggacg

SEQ ID NO: 7007651 - DNA, 22 bp, Homo sapiens
gtgctgtattgagacaaggtcg

SEQ ID NO: 7007652 - DNA, 22 bp, Homo sapiens
tgagcagcttgttccgagtgtt

SEQ ID NO: 7007653 - DNA, 22 bp, Homo sapiens
tacatggtggtggtgtctcggc

SEQ ID NO: 7007654 - DNA, 22 bp, Homo sapiens
ggcagctgacctagcaccatcc

SEQ ID NO: 7007655 - DNA, 22 bp, Homo sapiens
tatttgaagattcttctgatgt

SEQ ID NO: 7007656 - DNA, 22 bp, Homo sapiens
ttttatacttaagacagagttt

SEQ ID NO: 7007657 - DNA, 22 bp, Homo sapiens
ttccaagagtaaattcaaattg

SEQ ID NO: 7007658 - DNA, 22 bp, Homo sapiens
cagagtcagtattgaattgaaa

SEQ ID NO: 7007659 - DNA, 22 bp, Homo sapiens
aactgataatggacacataaaa

SEQ ID NO: 7007660 - DNA, 22 bp, Homo sapiens
agcctgagccccatccagctga

SEQ ID NO: 7007661 - DNA, 22 bp, Homo sapiens
gataacaatatgaagtagatat

SEQ ID NO: 7007662 - DNA, 22 bp, Homo sapiens
gcttcctccatctggggcttgc

SEQ ID NO: 7007663 - DNA, 22 bp, Homo sapiens
gtgaaactgctttgtaaactgt

SEQ ID NO: 7007664 - DNA, 22 bp, Homo sapiens
taacaactgaggaagaggcaga

SEQ ID NO: 7007665 - DNA, 22 bp, Homo sapiens
tggagttctcaggtgagggctt

SEQ ID NO: 7007666 - DNA, 22 bp, Homo sapiens
agatacaccggaacctgaggct

SEQ ID NO: 7007667 - DNA, 22 bp, Homo sapiens
tgtgtccactgaatgtgtatta

SEQ ID NO: 7007668 - DNA, 22 bp, Homo sapiens
ggcccagttgagaatgaatgat

SEQ ID NO: 7007669 - DNA, 22 bp, Homo sapiens
ggctttggtagacacagattga

SEQ ID NO: 7007670 - DNA, 22 bp, Homo sapiens
tctggggtttgtggttcttctg

SEQ ID NO: 7007671 - DNA, 22 bp, Homo sapiens
ctttggaacatactgctgagct

SEQ ID NO: 7007672 - DNA, 22 bp, Homo sapiens
ctggctggccggaggcatccct

SEQ ID NO: 7007673 - DNA, 22 bp, Homo sapiens
tagctagaaagtgaagatcaca

SEQ ID NO: 7007674 - DNA, 22 bp, Homo sapiens
cattaaattccttgttctcaaa

SEQ ID NO: 7007675 - DNA, 22 bp, Homo sapiens
tgtgaatgcttgttatggagtg

SEQ ID NO: 7007676 - DNA, 22 bp, Homo sapiens
tgtctttagttgcttagatttg

SEQ ID NO: 7007677 - DNA, 21 bp, Homo sapiens
cctcagagacagatacgggtg

SEQ ID NO: 7007678 - DNA, 22 bp, Homo sapiens
gaggaaggtcccatcagaattt

SEQ ID NO: 7007679 - DNA, 22 bp, Homo sapiens
ttattagggtggtttatgttct

SEQ ID NO: 7007680 - DNA, 17 bp, Homo sapiens
ttagagctacatgttga

SEQ ID NO: 7007681 - DNA, 22 bp, Homo sapiens
aagatgtatcagttaagtcttc

SEQ ID NO: 7007682 - DNA, 22 bp, Homo sapiens
ttactgaaagtatacatttctg

SEQ ID NO: 7007683 - DNA, 22 bp, Homo sapiens
gcaggctgtgaggctcagatgg

SEQ ID NO: 7007684 - DNA, 22 bp, Homo sapiens
atgagactacctgtaatgtggc

SEQ ID NO: 7007685 - DNA, 22 bp, Homo sapiens
agagttctgcggtatgtgagaa

SEQ ID NO: 7007686 - DNA, 22 bp, Homo sapiens
ccccagagagcaccatgaagcc

SEQ ID NO: 7007687 - DNA, 22 bp, Homo sapiens
gccacccttgcgtcactgacat

SEQ ID NO: 7007688 - DNA, 22 bp, Homo sapiens
tgtgttctccaactgtagattt

SEQ ID NO: 7007689 - DNA, 22 bp, Homo sapiens
ttgtgtagctaaaaccaagaaa

SEQ ID NO: 7007690 - DNA, 22 bp, Homo sapiens
attcacaagttctagggattag

SEQ ID NO: 7007691 - DNA, 22 bp, Homo sapiens
cagtgggggggccatgctgcag

SEQ ID NO: 7007692 - DNA, 20 bp, Homo sapiens
gtggtattcagtaacagtga

SEQ ID NO: 7007693 - DNA, 22 bp, Homo sapiens
cagcaggttaacagaggctggt

SEQ ID NO: 7007694 - DNA, 21 bp, Homo sapiens
acagttttaaggagcacatgg

SEQ ID NO: 7007695 - DNA, 22 bp, Homo sapiens
aggccagatattgtgctaccca

SEQ ID NO: 7007696 - DNA, 22 bp, Homo sapiens
catctctgtgtccccacaccca

SEQ ID NO: 7007697 - DNA, 22 bp, Homo sapiens
gggaggagctgagtgtgtgtgc

SEQ ID NO: 7007698 - DNA, 22 bp, Homo sapiens
tctcaggcttcctggtgctgtg

SEQ ID NO: 7007699 - DNA, 22 bp, Homo sapiens
gggagctgtaagggacaggtag

SEQ ID NO: 7007700 - DNA, 22 bp, Homo sapiens
ttgcatgtgactctatttatgc

SEQ ID NO: 7007701 - DNA, 22 bp, Homo sapiens
agtgacatttaaagacccaccc

SEQ ID NO: 7007702 - DNA, 22 bp, Homo sapiens
tgctccagaacctgaccatgct

SEQ ID NO: 7007703 - DNA, 22 bp, Homo sapiens
ggcctcagaccggagctggcca

SEQ ID NO: 7007704 - DNA, 17 bp, Homo sapiens
tctgggcttcagtggtc

SEQ ID NO: 7007705 - DNA, 22 bp, Homo sapiens
tcagtttttctatactttgtag

SEQ ID NO: 7007706 - DNA, 22 bp, Homo sapiens
agctctgtggccttgggtgaat

SEQ ID NO: 7007707 - DNA, 22 bp, Homo sapiens
aattagaatcttatttggggaa

SEQ ID NO: 7007708 - DNA, 22 bp, Homo sapiens
gattctttagcccagaaagtta

SEQ ID NO: 7007709 - DNA, 22 bp, Homo sapiens
agtgacttctccgtggcaggat

SEQ ID NO: 7007710 - DNA, 22 bp, Homo sapiens
ggccacctgggttcgactgggc

SEQ ID NO: 7007711 - DNA, 22 bp, Homo sapiens
agcctagaagaagtggctactt

SEQ ID NO: 7007712 - DNA, 22 bp, Homo sapiens
taggaaatcagagaaagaggtg

SEQ ID NO: 7007713 - DNA, 22 bp, Homo sapiens
cctcactggccagccaggggtg

SEQ ID NO: 7007714 - DNA, 22 bp, Homo sapiens
tgtaatataagcattaatagtt

SEQ ID NO: 7007715 - DNA, 22 bp, Homo sapiens
aaattgtcagaattcagaaagt

SEQ ID NO: 7007716 - DNA, 21 bp, Homo sapiens
agttttctgagttataaaata

SEQ ID NO: 7007717 - DNA, 22 bp, Homo sapiens
tgtgtttacttctatgcagttt

SEQ ID NO: 7007718 - DNA, 22 bp, Homo sapiens
cacaaggctttcatctggcata

SEQ ID NO: 7007719 - DNA, 22 bp, Homo sapiens
agacagtgtgtgtatatatggt

SEQ ID NO: 7007720 - DNA, 22 bp, Homo sapiens
ggcttcctggggcctcctgcaa

SEQ ID NO: 7007721 - DNA, 22 bp, Homo sapiens
ctaattgtaccagatttctctt

SEQ ID NO: 7007722 - DNA, 23 bp, Homo sapiens
tccaggagaacccctgtctgtcc

SEQ ID NO: 7007723 - DNA, 18 bp, Homo sapiens
gtgtgcagttgcaggggt

SEQ ID NO: 7007724 - DNA, 20 bp, Homo sapiens
ctttggcaatgagaacaggg

SEQ ID NO: 7007725 - DNA, 22 bp, Homo sapiens
tgtgcaatagaaagtggcatgg

SEQ ID NO: 7007726 - DNA, 22 bp, Homo sapiens
actctataaagatacctcaatt

SEQ ID NO: 7007727 - DNA, 22 bp, Homo sapiens
cccgagcgggccctggggtgac

SEQ ID NO: 7007728 - DNA, 22 bp, Homo sapiens
accactgtacagcagatatagt

SEQ ID NO: 7007729 - DNA, 22 bp, Homo sapiens
tacacagactcttcaattcaga

SEQ ID NO: 7007730 - DNA, 22 bp, Homo sapiens
attaatgtgtagccaacttaat

SEQ ID NO: 7007731 - DNA, 22 bp, Homo sapiens
tttaccaactgtagatctgcta

SEQ ID NO: 7007732 - DNA, 22 bp, Homo sapiens
tgcaccatacccattcccctct

SEQ ID NO: 7007733 - DNA, 22 bp, Homo sapiens
actgcagactctacagttataa

SEQ ID NO: 7007734 - DNA, 21 bp, Homo sapiens
agcatgcactacttcatctta

SEQ ID NO: 7007735 - DNA, 22 bp, Homo sapiens
acagaacaggctgagaaaaaca

SEQ ID NO: 7007736 - DNA, 20 bp, Homo sapiens
ttcagaaataaggaatgagg

SEQ ID NO: 7007737 - DNA, 22 bp, Homo sapiens
ggctcgatgtccagctccttgt

SEQ ID NO: 7007738 - DNA, 23 bp, Homo sapiens
aaagtgcagttgaggaatcatag

SEQ ID NO: 7007739 - DNA, 22 bp, Homo sapiens
ataaggcatatagtcacttttt

SEQ ID NO: 7007740 - DNA, 22 bp, Homo sapiens
aagagtcgtttcaggacagagg

SEQ ID NO: 7007741 - DNA, 22 bp, Homo sapiens
ccacaattttatgatttaggag

SEQ ID NO: 7007742 - DNA, 22 bp, Homo sapiens
gcagtggtggagcttacatatc

SEQ ID NO: 7007743 - DNA, 22 bp, Homo sapiens
actttactcaacaaatatttat

SEQ ID NO: 7007744 - DNA, 22 bp, Homo sapiens
ttacatcatgcttatccctttc

SEQ ID NO: 7007745 - DNA, 22 bp, Homo sapiens
aaacagcagctgtttaatttgc

SEQ ID NO: 7007746 - DNA, 22 bp, Homo sapiens
aggcccgaggttcgtgtgcacc

SEQ ID NO: 7007747 - DNA, 22 bp, Homo sapiens
cccagggatgtggcagatgtta

SEQ ID NO: 7007748 - DNA, 22 bp, Homo sapiens
tctgtgataggaaaataaatgg

SEQ ID NO: 7007749 - DNA, 22 bp, Homo sapiens
ctcagctagggaaggttagctt

SEQ ID NO: 7007750 - DNA, 22 bp, Homo sapiens
tccacatgaccattgtgctcct

SEQ ID NO: 7007751 - DNA, 22 bp, Homo sapiens
ccgagatgggctcgcctgggaa

SEQ ID NO: 7007752 - DNA, 22 bp, Homo sapiens
acagttcaagcaagtttctgtt

SEQ ID NO: 7007753 - DNA, 19 bp, Homo sapiens
atctcctttcttcaagctt

SEQ ID NO: 7007754 - DNA, 19 bp, Homo sapiens
agatttacctcatatagtt

SEQ ID NO: 7007755 - DNA, 22 bp, Homo sapiens
acatgtgtacttttaaggatgt

SEQ ID NO: 7007756 - DNA, 22 bp, Homo sapiens
taaagacacccagggagggact

SEQ ID NO: 7007757 - DNA, 22 bp, Homo sapiens
atgatagaaaggacacttggtg

SEQ ID NO: 7007758 - DNA, 22 bp, Homo sapiens
tttttaatgcagtctgagacat

SEQ ID NO: 7007759 - DNA, 22 bp, Homo sapiens
ggtctttcattacatgggttaa

SEQ ID NO: 7007760 - DNA, 22 bp, Homo sapiens
agaggtcttttggtctgcagaa

SEQ ID NO: 7007761 - DNA, 22 bp, Homo sapiens
tcttcagaggagctgaatatat

SEQ ID NO: 7007762 - DNA, 21 bp, Homo sapiens
ggaagcttccttggtgatcac

SEQ ID NO: 7007763 - DNA, 22 bp, Homo sapiens
gttgtcccttcaggtttcactg

SEQ ID NO: 7007764 - DNA, 22 bp, Homo sapiens
acagaactttctgatcctgagc

SEQ ID NO: 7007765 - DNA, 22 bp, Homo sapiens
tgagcccatgctctttctacga

SEQ ID NO: 7007766 - DNA, 22 bp, Homo sapiens
ctggagtcactcatgtagctgc

SEQ ID NO: 7007767 - DNA, 22 bp, Homo sapiens
ttcagcaggtggtgagttctgc

SEQ ID NO: 7007768 - DNA, 20 bp, Homo sapiens
tgggtcctgtgggagaagaa

SEQ ID NO: 7007769 - DNA, 22 bp, Homo sapiens
ctgtatgtgaaaatgtcaagtg

SEQ ID NO: 7007770 - DNA, 22 bp, Homo sapiens
accagctgccaagggctacact

SEQ ID NO: 7007771 - DNA, 22 bp, Homo sapiens
ttccaaagtgctggaattacat

SEQ ID NO: 7007772 - DNA, 22 bp, Homo sapiens
tatacagaacattaagaactgt

SEQ ID NO: 7007773 - DNA, 18 bp, Homo sapiens
aagagcttcgcatataca

SEQ ID NO: 7007774 - DNA, 22 bp, Homo sapiens
actgctgagcacacaagagtgt

SEQ ID NO: 7007775 - DNA, 22 bp, Homo sapiens
gaggttcaggacatttctgggg

SEQ ID NO: 7007776 - DNA, 22 bp, Homo sapiens
cagctattggtccacaggtatg

SEQ ID NO: 7007777 - DNA, 22 bp, Homo sapiens
ctactagctactcattcaaatt

SEQ ID NO: 7007778 - DNA, 23 bp, Homo sapiens
tatccagtagggcccagagctga

SEQ ID NO: 7007779 - DNA, 22 bp, Homo sapiens
gattttatatggcatactgtgg

SEQ ID NO: 7007780 - DNA, 22 bp, Homo sapiens
ccttcagccttcatccttcctt

SEQ ID NO: 7007781 - DNA, 22 bp, Homo sapiens
agcaacaggaccatggagccca

SEQ ID NO: 7007782 - DNA, 23 bp, Homo sapiens
gggatctgtaaacctggagaacc

SEQ ID NO: 7007783 - DNA, 22 bp, Homo sapiens
ttaatttatgtccaaaccagat

SEQ ID NO: 7007784 - DNA, 21 bp, Homo sapiens
gccagccatgcttgcctaggc

SEQ ID NO: 7007785 - DNA, 22 bp, Homo sapiens
tggctggaggaaggaactgagg

SEQ ID NO: 7007786 - DNA, 19 bp, Homo sapiens
taataagcaatatggaagt

SEQ ID NO: 7007787 - DNA, 22 bp, Homo sapiens
gtcactttctgtgagatgtagt

SEQ ID NO: 7007788 - DNA, 22 bp, Homo sapiens
attgcttacagctatttctgta

SEQ ID NO: 7007789 - DNA, 22 bp, Homo sapiens
atggctcagcgcctttctgtgg

SEQ ID NO: 7007790 - DNA, 22 bp, Homo sapiens
tcaggcattcccatgcataaga

SEQ ID NO: 7007791 - DNA, 22 bp, Homo sapiens
agggccagctagagccctcgcc

SEQ ID NO: 7007792 - DNA, 22 bp, Homo sapiens
tcaggagcatatattgatgtct

SEQ ID NO: 7007793 - DNA, 22 bp, Homo sapiens
tacattccaaaggaaactggct

SEQ ID NO: 7007794 - DNA, 22 bp, Homo sapiens
cttgggaactgccttgcctttg

SEQ ID NO: 7007795 - DNA, 22 bp, Homo sapiens
ggatagtgggagaatgctatgt

SEQ ID NO: 7007796 - DNA, 22 bp, Homo sapiens
tgtttaagctgatgaggtatcg

SEQ ID NO: 7007797 - DNA, 22 bp, Homo sapiens
ggtattgcttggttgcctagca

SEQ ID NO: 7007798 - DNA, 21 bp, Homo sapiens
aggacagcaggagcatttatt

SEQ ID NO: 7007799 - DNA, 22 bp, Homo sapiens
gttcattgtggatgcttaaata

SEQ ID NO: 7007800 - DNA, 22 bp, Homo sapiens
tacacaattctggatgcatgtc

SEQ ID NO: 7007801 - DNA, 22 bp, Homo sapiens
cacacatgaagttgctgagcta

SEQ ID NO: 7007802 - DNA, 22 bp, Homo sapiens
agtctctccacattgttataaa

SEQ ID NO: 7007803 - DNA, 22 bp, Homo sapiens
atttgttcttcatgatcctgtc

SEQ ID NO: 7007804 - DNA, 22 bp, Homo sapiens
ggcttggcttgggctcagaggc

SEQ ID NO: 7007805 - DNA, 23 bp, Homo sapiens
tgaggagcatagctgactgacag

SEQ ID NO: 7007806 - DNA, 22 bp, Homo sapiens
tgctgtgggcagtacataagct

SEQ ID NO: 7007807 - DNA, 22 bp, Homo sapiens
gtccaggaatcaaaagatggaa

SEQ ID NO: 7007808 - DNA, 22 bp, Homo sapiens
attctttccagacactgattgc

SEQ ID NO: 7007809 - DNA, 22 bp, Homo sapiens
gagaaatatggctcagttccac

SEQ ID NO: 7007810 - DNA, 22 bp, Homo sapiens
acattagatgactctttctttc

SEQ ID NO: 7007811 - DNA, 22 bp, Homo sapiens
tccaggcctctagccctctctt

SEQ ID NO: 7007812 - DNA, 22 bp, Homo sapiens
tgacccttggagtaggatgtat

SEQ ID NO: 7007813 - DNA, 22 bp, Homo sapiens
atatcttttagagcaagcttgt

SEQ ID NO: 7007814 - DNA, 22 bp, Homo sapiens
aatcattctcatgccagtttcc

SEQ ID NO: 7007815 - DNA, 22 bp, Homo sapiens
tatcggtaagatggaaatcagg

SEQ ID NO: 7007816 - DNA, 22 bp, Homo sapiens
gtgagcaatgttatcaggttga

SEQ ID NO: 7007817 - DNA, 18 bp, Homo sapiens
cccaggctttgtgggtct

SEQ ID NO: 7007818 - DNA, 22 bp, Homo sapiens
tgaattctgctgtagcaagtcc

SEQ ID NO: 7007819 - DNA, 23 bp, Homo sapiens
atgtgtgggaggtcagagagcca

SEQ ID NO: 7007820 - DNA, 22 bp, Homo sapiens
tatgttcatctggtgcatcagt

SEQ ID NO: 7007821 - DNA, 22 bp, Homo sapiens
gcggtagctcaagcttgtaatc

SEQ ID NO: 7007822 - DNA, 21 bp, Homo sapiens
gctcatggtggagaaaagcag

SEQ ID NO: 7007823 - DNA, 22 bp, Homo sapiens
tggctcctgcagaccatctgga

SEQ ID NO: 7007824 - DNA, 22 bp, Homo sapiens
ttctgcctgccccagagaggcc

SEQ ID NO: 7007825 - DNA, 22 bp, Homo sapiens
cagcatggttgggttctgggga

SEQ ID NO: 7007826 - DNA, 22 bp, Homo sapiens
ctttggctggcaccccagcggg

SEQ ID NO: 7007827 - DNA, 22 bp, Homo sapiens
aaagtagcttagttgatatttc

SEQ ID NO: 7007828 - DNA, 22 bp, Homo sapiens
tattttgctttagctgactgtt

SEQ ID NO: 7007829 - DNA, 22 bp, Homo sapiens
aggagctgcttaaatggttggt

SEQ ID NO: 7007830 - DNA, 22 bp, Homo sapiens
gggccctgggattcagagcaag

SEQ ID NO: 7007831 - DNA, 22 bp, Homo sapiens
tctgaggaattctgcagtgaga

SEQ ID NO: 7007832 - DNA, 21 bp, Homo sapiens
tttcccagcagagatagctgg

SEQ ID NO: 7007833 - DNA, 22 bp, Homo sapiens
agatttagctgtgaacagcttg

SEQ ID NO: 7007834 - DNA, 22 bp, Homo sapiens
tattcttagccagcagcctggg

SEQ ID NO: 7007835 - DNA, 22 bp, Homo sapiens
ggagggccctgggtgcagctct

SEQ ID NO: 7007836 - DNA, 22 bp, Homo sapiens
atcacaaaggtctcagagcaca

SEQ ID NO: 7007837 - DNA, 22 bp, Homo sapiens
ccaggtctgcgggcggcaggca

SEQ ID NO: 7007838 - DNA, 22 bp, Homo sapiens
ttgtactggttttgaaatgagc

SEQ ID NO: 7007839 - DNA, 22 bp, Homo sapiens
gctccctggaggatgtgaactt

SEQ ID NO: 7007840 - DNA, 22 bp, Homo sapiens
ttctttggaataagtcaagctg

SEQ ID NO: 7007841 - DNA, 22 bp, Homo sapiens
aacagtgtcaggattacagata

SEQ ID NO: 7007842 - DNA, 22 bp, Homo sapiens
caatgctaggcagatcctgcgt

SEQ ID NO: 7007843 - DNA, 22 bp, Homo sapiens
ttcaaagcaatagaaagagtga

SEQ ID NO: 7007844 - DNA, 22 bp, Homo sapiens
tgcaagtgattctgttttctca

SEQ ID NO: 7007845 - DNA, 22 bp, Homo sapiens
tagttaagaggccagtgtaata

SEQ ID NO: 7007846 - DNA, 22 bp, Homo sapiens
aggctaggcatgtgctaccaca

SEQ ID NO: 7007847 - DNA, 22 bp, Homo sapiens
ctgtgaccttagcaagggaaat

SEQ ID NO: 7007848 - DNA, 22 bp, Homo sapiens
ggcaataaatgacttctgcatt

SEQ ID NO: 7007849 - DNA, 22 bp, Homo sapiens
tggtaaagcacattgcatttaa

SEQ ID NO: 7007850 - DNA, 22 bp, Homo sapiens
ttttgtgacagaaagattaagt

SEQ ID NO: 7007851 - DNA, 22 bp, Homo sapiens
tcagcatcacgtggtccgagaa

SEQ ID NO: 7007852 - DNA, 22 bp, Homo sapiens
caggaagctagattttgttgct

SEQ ID NO: 7007853 - DNA, 22 bp, Homo sapiens
cccactgagcctatacaaacag

SEQ ID NO: 7007854 - DNA, 22 bp, Homo sapiens
atggcacaggagaggagggctg

SEQ ID NO: 7007855 - DNA, 22 bp, Homo sapiens
cccaagcctttcaaaactcaga

SEQ ID NO: 7007856 - DNA, 22 bp, Homo sapiens
tccattcaattctaaagccctt

SEQ ID NO: 7007857 - DNA, 19 bp, Homo sapiens
tctgtggcacctgggaggg

SEQ ID NO: 7007858 - DNA, 22 bp, Homo sapiens
atttggaaatgcatctcttgag

SEQ ID NO: 7007859 - DNA, 22 bp, Homo sapiens
tctggcttctatgaatgtcctt

SEQ ID NO: 7007860 - DNA, 22 bp, Homo sapiens
atctgcatttgaacaagctcct

SEQ ID NO: 7007861 - DNA, 22 bp, Homo sapiens
gcagcagctcagccgggcactg

SEQ ID NO: 7007862 - DNA, 23 bp, Homo sapiens
aggcagctgggtagcatctttct

SEQ ID NO: 7007863 - DNA, 22 bp, Homo sapiens
tacttacagagcttataagtta

SEQ ID NO: 7007864 - DNA, 22 bp, Homo sapiens
tggataaccttttgggattggc

SEQ ID NO: 7007865 - DNA, 22 bp, Homo sapiens
attttactactccaattaatga

SEQ ID NO: 7007866 - DNA, 19 bp, Homo sapiens
tgaggcactagtctggtcc

SEQ ID NO: 7007867 - DNA, 22 bp, Homo sapiens
ggccccagcctcagtcccctga

SEQ ID NO: 7007868 - DNA, 21 bp, Homo sapiens
cttgttttgaaaggactggcc

SEQ ID NO: 7007869 - DNA, 22 bp, Homo sapiens
tccaggcatggtgtaattttgc

SEQ ID NO: 7007870 - DNA, 22 bp, Homo sapiens
gtgttactgacacatttttgtc

SEQ ID NO: 7007871 - DNA, 22 bp, Homo sapiens
agtgcaaagcagcctgtacacc

SEQ ID NO: 7007872 - DNA, 22 bp, Homo sapiens
tctgcctgaggactgacaccag

SEQ ID NO: 7007873 - DNA, 22 bp, Homo sapiens
atacatgatcactgtattataa

SEQ ID NO: 7007874 - DNA, 22 bp, Homo sapiens
ttaagcaacaagaatcccattg

SEQ ID NO: 7007875 - DNA, 22 bp, Homo sapiens
ttacaaagagtgccagagtgtg

SEQ ID NO: 7007876 - DNA, 22 bp, Homo sapiens
agtctgcattttaacaagatcc

SEQ ID NO: 7007877 - DNA, 22 bp, Homo sapiens
gagcacccttgagagactctcg

SEQ ID NO: 7007878 - DNA, 22 bp, Homo sapiens
gctttggtacctcctgctgatc

SEQ ID NO: 7007879 - DNA, 19 bp, Homo sapiens
tacaatgatgttacctttg

SEQ ID NO: 7007880 - DNA, 22 bp, Homo sapiens
tctgggtctattcctactgtga

SEQ ID NO: 7007881 - DNA, 22 bp, Homo sapiens
tgcatcacccttgaaccatcca

SEQ ID NO: 7007882 - DNA, 21 bp, Homo sapiens
tcttccctcaggatgtcctgc

SEQ ID NO: 7007883 - DNA, 22 bp, Homo sapiens
aagagcatatatgtatgtttgt

SEQ ID NO: 7007884 - DNA, 22 bp, Homo sapiens
tttggcaaacataagcctttct

SEQ ID NO: 7007885 - DNA, 22 bp, Homo sapiens
tggatgctgctgtcagggatgg

SEQ ID NO: 7007886 - DNA, 22 bp, Homo sapiens
atggccagctcagagcactcag

SEQ ID NO: 7007887 - DNA, 22 bp, Homo sapiens
ctgccctttatttcacaaagta

SEQ ID NO: 7007888 - DNA, 20 bp, Homo sapiens
ccagatggtccctgtgaaaa

SEQ ID NO: 7007889 - DNA, 22 bp, Homo sapiens
gctgtttcccgtgcgctgcgtc

SEQ ID NO: 7007890 - DNA, 17 bp, Homo sapiens
tctgaagccagtctgct

SEQ ID NO: 7007891 - DNA, 22 bp, Homo sapiens
cttcttctcaaggggcaggtgg

SEQ ID NO: 7007892 - DNA, 22 bp, Homo sapiens
ggtgaggggcgcctctgcccgg

SEQ ID NO: 7007893 - DNA, 17 bp, Homo sapiens
ctgaggcccagggccca

SEQ ID NO: 7007894 - DNA, 22 bp, Homo sapiens
agagtccaaatgtgcagttatg

SEQ ID NO: 7007895 - DNA, 22 bp, Homo sapiens
cccagagatgggaggtgatcgg

SEQ ID NO: 7007896 - DNA, 22 bp, Homo sapiens
acattagtttctcagatcattt

SEQ ID NO: 7007897 - DNA, 22 bp, Homo sapiens
gttcaccatatggtaatttaat

SEQ ID NO: 7007898 - DNA, 22 bp, Homo sapiens
agagcacggccaccatttacaa

SEQ ID NO: 7007899 - DNA, 22 bp, Homo sapiens
ccctcgctctaggcagccctgt

SEQ ID NO: 7007900 - DNA, 22 bp, Homo sapiens
aaagaactattaacgaggaagc

SEQ ID NO: 7007901 - DNA, 22 bp, Homo sapiens
aggttcttggtgtccagatttc

SEQ ID NO: 7007902 - DNA, 22 bp, Homo sapiens
gaggtccagagcaggttcagtg

SEQ ID NO: 7007903 - DNA, 22 bp, Homo sapiens
aaactctataaataagggctat

SEQ ID NO: 7007904 - DNA, 22 bp, Homo sapiens
tctttgtgccatgcagtgaggc

SEQ ID NO: 7007905 - DNA, 22 bp, Homo sapiens
attatggacatcaaataactct

SEQ ID NO: 7007906 - DNA, 22 bp, Homo sapiens
cacatcagggctgcttgggggt

SEQ ID NO: 7007907 - DNA, 20 bp, Homo sapiens
aagaagttggtaagcagtgc

SEQ ID NO: 7007908 - DNA, 22 bp, Homo sapiens
tttctatatcttacctattgta

SEQ ID NO: 7007909 - DNA, 22 bp, Homo sapiens
tatgagatattcccagcgtcta

SEQ ID NO: 7007910 - DNA, 22 bp, Homo sapiens
cagggtgagcctctggagccct

SEQ ID NO: 7007911 - DNA, 22 bp, Homo sapiens
catgtctctgaaatgtggtaga

SEQ ID NO: 7007912 - DNA, 22 bp, Homo sapiens
aaatgtggggctggaggcagga

SEQ ID NO: 7007913 - DNA, 22 bp, Homo sapiens
gggtccagactatgaagaactt

SEQ ID NO: 7007914 - DNA, 22 bp, Homo sapiens
aatgggttgaacatcaaggtct

SEQ ID NO: 7007915 - DNA, 22 bp, Homo sapiens
ctgaggggaaaagtcaggatga

SEQ ID NO: 7007916 - DNA, 22 bp, Homo sapiens
gggtgggcccagcccagagaag

SEQ ID NO: 7007917 - DNA, 22 bp, Homo sapiens
agaggtcagctgcatgccacat

SEQ ID NO: 7007918 - DNA, 22 bp, Homo sapiens
aaagatttgaaattaggcatca

SEQ ID NO: 7007919 - DNA, 18 bp, Homo sapiens
cgtgagtggaggctgcgg

SEQ ID NO: 7007920 - DNA, 22 bp, Homo sapiens
aggtattatgctgctgaatgct

SEQ ID NO: 7007921 - DNA, 22 bp, Homo sapiens
ggcttaaaaggaaaatgagagt

SEQ ID NO: 7007922 - DNA, 22 bp, Homo sapiens
taaatagagaatcagcttggag

SEQ ID NO: 7007923 - DNA, 22 bp, Homo sapiens
gagaaagggataatttgaagag

SEQ ID NO: 7007924 - DNA, 22 bp, Homo sapiens
tgcctgggtgctggctggtcac

SEQ ID NO: 7007925 - DNA, 22 bp, Homo sapiens
gtggagccaggggctgtaggta

SEQ ID NO: 7007926 - DNA, 22 bp, Homo sapiens
actcttcttgctgctcattaat

SEQ ID NO: 7007927 - DNA, 22 bp, Homo sapiens
gcacactggagcctggaagatt

SEQ ID NO: 7007928 - DNA, 22 bp, Homo sapiens
gtctgcagagggaaggcttcag

SEQ ID NO: 7007929 - DNA, 20 bp, Homo sapiens
taacagaagtagaagtgggt

SEQ ID NO: 7007930 - DNA, 22 bp, Homo sapiens
gttggcacttagccccagtcta

SEQ ID NO: 7007931 - DNA, 21 bp, Homo sapiens
caagacatatgagtactctgg

SEQ ID NO: 7007932 - DNA, 22 bp, Homo sapiens
aaccagaggggccctgcctggg

SEQ ID NO: 7007933 - DNA, 22 bp, Homo sapiens
ggtcgtgaattgaatcagtggc

SEQ ID NO: 7007934 - DNA, 22 bp, Homo sapiens
gtttagaagccaagatttgggt

SEQ ID NO: 7007935 - DNA, 22 bp, Homo sapiens
tccttgaatggacattacactg

SEQ ID NO: 7007936 - DNA, 22 bp, Homo sapiens
tgttacatttctctttcttgga

SEQ ID NO: 7007937 - DNA, 23 bp, Homo sapiens
taattatggaataatttgcaacg

SEQ ID NO: 7007938 - DNA, 22 bp, Homo sapiens
aaagtagctttgtaggtacagt

SEQ ID NO: 7007939 - DNA, 22 bp, Homo sapiens
tagcaggatcacagggagagcc

SEQ ID NO: 7007940 - DNA, 22 bp, Homo sapiens
tttgtttgaaagtctctacagc

SEQ ID NO: 7007941 - DNA, 22 bp, Homo sapiens
catatgaagatgtctttttgta

SEQ ID NO: 7007942 - DNA, 22 bp, Homo sapiens
tttttgtatagaaatgaactaa

SEQ ID NO: 7007943 - DNA, 22 bp, Homo sapiens
tacaagtggagttaggaagttt

SEQ ID NO: 7007944 - DNA, 22 bp, Homo sapiens
aggcagcaatgaatgaaatgga

SEQ ID NO: 7007945 - DNA, 22 bp, Homo sapiens
tggttggatggctcttgtggct

SEQ ID NO: 7007946 - DNA, 22 bp, Homo sapiens
aaaggctagtggattcattgat

SEQ ID NO: 7007947 - DNA, 22 bp, Homo sapiens
ttccttggtagggacaactctg

SEQ ID NO: 7007948 - DNA, 22 bp, Homo sapiens
ctgcccacttggccaccttcta

SEQ ID NO: 7007949 - DNA, 22 bp, Homo sapiens
ccatgccagctgctaggtcaca

SEQ ID NO: 7007950 - DNA, 22 bp, Homo sapiens
agtccaccggcagagatgctga

SEQ ID NO: 7007951 - DNA, 22 bp, Homo sapiens
tgttgtagcttgacagcagcca

SEQ ID NO: 7007952 - DNA, 21 bp, Homo sapiens
acaggctctggggatgctggg

SEQ ID NO: 7007953 - DNA, 20 bp, Homo sapiens
ttacaagtttctaataacca

SEQ ID NO: 7007954 - DNA, 22 bp, Homo sapiens
tctgttttctctgtattttgac

SEQ ID NO: 7007955 - DNA, 22 bp, Homo sapiens
ctattgaatagcccaaatcatt

SEQ ID NO: 7007956 - DNA, 22 bp, Homo sapiens
tctgggtccgggactgtggatg

SEQ ID NO: 7007957 - DNA, 22 bp, Homo sapiens
gaagttagagaaggcagccagg

SEQ ID NO: 7007958 - DNA, 22 bp, Homo sapiens
atccctgggcctcaccacctga

SEQ ID NO: 7007959 - DNA, 22 bp, Homo sapiens
ctgtggccagagcgccgttgac

SEQ ID NO: 7007960 - DNA, 22 bp, Homo sapiens
agaactgcaattacttctgcac

SEQ ID NO: 7007961 - DNA, 22 bp, Homo sapiens
tcttgaattgtactcccataag

SEQ ID NO: 7007962 - DNA, 22 bp, Homo sapiens
actcttcattcaagtatgcaaa

SEQ ID NO: 7007963 - DNA, 22 bp, Homo sapiens
tccaggctggcctcgcgtgaca

SEQ ID NO: 7007964 - DNA, 22 bp, Homo sapiens
cttccaagatgaacagcaagcg

SEQ ID NO: 7007965 - DNA, 20 bp, Homo sapiens
aacatttgtagtcaggcaca

SEQ ID NO: 7007966 - DNA, 22 bp, Homo sapiens
gtccttggcctgggtagagtgg

SEQ ID NO: 7007967 - DNA, 22 bp, Homo sapiens
gagtgtcacagggtaattgttt

SEQ ID NO: 7007968 - DNA, 22 bp, Homo sapiens
taacatcttattggcaaagata

SEQ ID NO: 7007969 - DNA, 20 bp, Homo sapiens
catcagtgcctgacaggtcc

SEQ ID NO: 7007970 - DNA, 22 bp, Homo sapiens
tttggaatcctcagtatgatca

SEQ ID NO: 7007971 - DNA, 22 bp, Homo sapiens
gaagaactgacaaactagatca

SEQ ID NO: 7007972 - DNA, 18 bp, Homo sapiens
gagctctgcctcccagtc

SEQ ID NO: 7007973 - DNA, 19 bp, Homo sapiens
agcaacaccgtttatttcc

SEQ ID NO: 7007974 - DNA, 22 bp, Homo sapiens
ttgtattaattgaaatgaatgc

SEQ ID NO: 7007975 - DNA, 22 bp, Homo sapiens
atgaaggatggctggctgccct

SEQ ID NO: 7007976 - DNA, 22 bp, Homo sapiens
caggtccaccatgcctcaagcc

SEQ ID NO: 7007977 - DNA, 22 bp, Homo sapiens
ataatcattttaattagtggtt

SEQ ID NO: 7007978 - DNA, 22 bp, Homo sapiens
tcagtgtgggtaagcatgctgt

SEQ ID NO: 7007979 - DNA, 17 bp, Homo sapiens
ccaggctataccaggct

SEQ ID NO: 7007980 - DNA, 22 bp, Homo sapiens
agtattttcgccatcacaagaa

SEQ ID NO: 7007981 - DNA, 22 bp, Homo sapiens
gcatggtgacatcatgtgaatg

SEQ ID NO: 7007982 - DNA, 22 bp, Homo sapiens
aggcttttctccagaatgtact

SEQ ID NO: 7007983 - DNA, 22 bp, Homo sapiens
atggtcaccttgggagcctgct

SEQ ID NO: 7007984 - DNA, 22 bp, Homo sapiens
caatgatggctaggcagctgct

SEQ ID NO: 7007985 - DNA, 22 bp, Homo sapiens
agaggctccaccttctctgtcc

SEQ ID NO: 7007986 - DNA, 22 bp, Homo sapiens
ctgagggagacagtgcggacta

SEQ ID NO: 7007987 - DNA, 22 bp, Homo sapiens
gattttactgtctgtgtatctc

SEQ ID NO: 7007988 - DNA, 22 bp, Homo sapiens
tcacatcacatgagtgcaagga

SEQ ID NO: 7007989 - DNA, 22 bp, Homo sapiens
ctggctggccggagcgaggcgg

SEQ ID NO: 7007990 - DNA, 22 bp, Homo sapiens
aagtccctggttcctagcaaaa

SEQ ID NO: 7007991 - DNA, 22 bp, Homo sapiens
tgagttcaagtccaagttgctg

SEQ ID NO: 7007992 - DNA, 22 bp, Homo sapiens
attctctgccattgcggtggat

SEQ ID NO: 7007993 - DNA, 22 bp, Homo sapiens
ccctgaggccctcctggggtct

SEQ ID NO: 7007994 - DNA, 18 bp, Homo sapiens
tgctgatggtccattagt

SEQ ID NO: 7007995 - DNA, 22 bp, Homo sapiens
atatcctttactgtgtcacaga

SEQ ID NO: 7007996 - DNA, 22 bp, Homo sapiens
cagagctttggctagatggttg

SEQ ID NO: 7007997 - DNA, 22 bp, Homo sapiens
caggcccagcccagcccttcga

SEQ ID NO: 7007998 - DNA, 22 bp, Homo sapiens
caggagctggatctccttgcgg

SEQ ID NO: 7007999 - DNA, 22 bp, Homo sapiens
ggtctggcactcatgcagcagg

SEQ ID NO: 7008000 - DNA, 22 bp, Homo sapiens
gacagggaaacattgaagtgtc

SEQ ID NO: 7008001 - DNA, 22 bp, Homo sapiens
cctctgtgcaggaaatacatgt

SEQ ID NO: 7008002 - DNA, 22 bp, Homo sapiens
ctctgggttcactgaggctctg

SEQ ID NO: 7008003 - DNA, 21 bp, Homo sapiens
aggctgctggctcagggtcct

SEQ ID NO: 7008004 - DNA, 22 bp, Homo sapiens
tggatctgattaggggagccag

SEQ ID NO: 7008005 - DNA, 22 bp, Homo sapiens
ggtgggtaaaactgctggcact

SEQ ID NO: 7008006 - DNA, 22 bp, Homo sapiens
aagtgctaaccacaatccacag

SEQ ID NO: 7008007 - DNA, 22 bp, Homo sapiens
agagttcatgtcttagcctatc

SEQ ID NO: 7008008 - DNA, 22 bp, Homo sapiens
gtcccatcccccttggcactca

SEQ ID NO: 7008009 - DNA, 22 bp, Homo sapiens
tctttgtactttctggctgtcc

SEQ ID NO: 7008010 - DNA, 22 bp, Homo sapiens
tgggaagggagagtgtcctgga

SEQ ID NO: 7008011 - DNA, 22 bp, Homo sapiens
aatgctttagcagtgattagtg

SEQ ID NO: 7008012 - DNA, 22 bp, Homo sapiens
cagccactcggccataaaggct

SEQ ID NO: 7008013 - DNA, 22 bp, Homo sapiens
aaactagagatggcaggtggaa

SEQ ID NO: 7008014 - DNA, 22 bp, Homo sapiens
gagctggttttaggctatgtct

SEQ ID NO: 7008015 - DNA, 22 bp, Homo sapiens
catttatcttggccctaaggcc

SEQ ID NO: 7008016 - DNA, 22 bp, Homo sapiens
ccccattctggccagcccagct

SEQ ID NO: 7008017 - DNA, 22 bp, Homo sapiens
tctgcatacccctttagcagag

SEQ ID NO: 7008018 - DNA, 22 bp, Homo sapiens
tctatgaatgacacagataata

SEQ ID NO: 7008019 - DNA, 22 bp, Homo sapiens
tacaagctcacaaatttttaag

SEQ ID NO: 7008020 - DNA, 22 bp, Homo sapiens
gagtgggcaaaagaaagtaggc

SEQ ID NO: 7008021 - DNA, 22 bp, Homo sapiens
cctgacagcgtgtccctggccc

SEQ ID NO: 7008022 - DNA, 22 bp, Homo sapiens
tgcagctgttacggaccctgtc

SEQ ID NO: 7008023 - DNA, 22 bp, Homo sapiens
aatcttcaaaaacaattgaggg

SEQ ID NO: 7008024 - DNA, 22 bp, Homo sapiens
ctcgagagatcctcttgccacc

SEQ ID NO: 7008025 - DNA, 22 bp, Homo sapiens
tcactgcaacctctgcctgcca

SEQ ID NO: 7008026 - DNA, 22 bp, Homo sapiens
caatgcttctgagggaattaca

SEQ ID NO: 7008027 - DNA, 22 bp, Homo sapiens
gcagtaaattgagagtcatgtt

SEQ ID NO: 7008028 - DNA, 22 bp, Homo sapiens
ttaatgaatatgacaggagagg

SEQ ID NO: 7008029 - DNA, 22 bp, Homo sapiens
tcctaactccactagccttggg

SEQ ID NO: 7008030 - DNA, 22 bp, Homo sapiens
cagctcagtcttgaagcactgg

SEQ ID NO: 7008031 - DNA, 20 bp, Homo sapiens
gcacctgaatgcatcttgga

SEQ ID NO: 7008032 - DNA, 22 bp, Homo sapiens
tagtacctctcagctgggatcc

SEQ ID NO: 7008033 - DNA, 22 bp, Homo sapiens
gacatgcatattcactcttctt

SEQ ID NO: 7008034 - DNA, 22 bp, Homo sapiens
agctcaccacaacctccgcctc

SEQ ID NO: 7008035 - DNA, 22 bp, Homo sapiens
actgggccggtgcagagtagtt

SEQ ID NO: 7008036 - DNA, 22 bp, Homo sapiens
tctgcatccctcattgaacggc

SEQ ID NO: 7008037 - DNA, 22 bp, Homo sapiens
tgagacctgtagcttcacagag

SEQ ID NO: 7008038 - DNA, 20 bp, Homo sapiens
gataatatttactaggtact

SEQ ID NO: 7008039 - DNA, 22 bp, Homo sapiens
gtgatgagagaaccaggacctt

SEQ ID NO: 7008040 - DNA, 22 bp, Homo sapiens
agctggagccagtgtgaggctt

SEQ ID NO: 7008041 - DNA, 22 bp, Homo sapiens
acagagtcatggtagtcaaagg

SEQ ID NO: 7008042 - DNA, 21 bp, Homo sapiens
actgcacaagttgctttgctt

SEQ ID NO: 7008043 - DNA, 22 bp, Homo sapiens
agggcagcggtgcttgtgttat

SEQ ID NO: 7008044 - DNA, 22 bp, Homo sapiens
attaattgggaacttgttgaaa

SEQ ID NO: 7008045 - DNA, 19 bp, Homo sapiens
tggcttctgttttcatgtt

SEQ ID NO: 7008046 - DNA, 22 bp, Homo sapiens
gacaggccaggggctgaggtgg

SEQ ID NO: 7008047 - DNA, 22 bp, Homo sapiens
acagacatatttggcccatagc

SEQ ID NO: 7008048 - DNA, 22 bp, Homo sapiens
tacaggaaagaaatttgaactc

SEQ ID NO: 7008049 - DNA, 22 bp, Homo sapiens
aattgcttttcaagggtacagc

SEQ ID NO: 7008050 - DNA, 22 bp, Homo sapiens
aggagaggggtaggattaattt

SEQ ID NO: 7008051 - DNA, 22 bp, Homo sapiens
gcagttatgtgaatcatgtgac

SEQ ID NO: 7008052 - DNA, 22 bp, Homo sapiens
attacaagggtctgactggagg

SEQ ID NO: 7008053 - DNA, 22 bp, Homo sapiens
tgctccatctagagctctgcag

SEQ ID NO: 7008054 - DNA, 22 bp, Homo sapiens
agggaaagtaagcatttcatta

SEQ ID NO: 7008055 - DNA, 22 bp, Homo sapiens
gtggtatttatgacagtgcccg

SEQ ID NO: 7008056 - DNA, 22 bp, Homo sapiens
ctctttggttaatcacacagat

SEQ ID NO: 7008057 - DNA, 22 bp, Homo sapiens
ccctggtcagggaaggcgcctg

SEQ ID NO: 7008058 - DNA, 22 bp, Homo sapiens
tattgctgccattttccaatgt

SEQ ID NO: 7008059 - DNA, 22 bp, Homo sapiens
tgaggtgagcatctttatcttc

SEQ ID NO: 7008060 - DNA, 22 bp, Homo sapiens
gccttcaggaaatcagtccttg

SEQ ID NO: 7008061 - DNA, 22 bp, Homo sapiens
gaatggctgaatgtcttaaatt

SEQ ID NO: 7008062 - DNA, 22 bp, Homo sapiens
atgattctcattttataaactt

SEQ ID NO: 7008063 - DNA, 22 bp, Homo sapiens
atgcccttatgccagaggcaat

SEQ ID NO: 7008064 - DNA, 22 bp, Homo sapiens
aataacttgaagatctcttcca

SEQ ID NO: 7008065 - DNA, 22 bp, Homo sapiens
ggggagcaattgcccccttaga

SEQ ID NO: 7008066 - DNA, 22 bp, Homo sapiens
gctgatagactgaatgttggga

SEQ ID NO: 7008067 - DNA, 22 bp, Homo sapiens
tttcctttgtgcaggccttggg

SEQ ID NO: 7008068 - DNA, 22 bp, Homo sapiens
tgtctgagtggtgcaaggctga

SEQ ID NO: 7008069 - DNA, 22 bp, Homo sapiens
agcagcatgatgacagagtctc

SEQ ID NO: 7008070 - DNA, 22 bp, Homo sapiens
atttcaaggggtccttgcttgg

SEQ ID NO: 7008071 - DNA, 22 bp, Homo sapiens
acctgagagctataaggtttta

SEQ ID NO: 7008072 - DNA, 22 bp, Homo sapiens
ccaggctcactgactaccacat

SEQ ID NO: 7008073 - DNA, 22 bp, Homo sapiens
aggctctttgagactacctgga

SEQ ID NO: 7008074 - DNA, 22 bp, Homo sapiens
aaaattgaagtgatcaggaact

SEQ ID NO: 7008075 - DNA, 22 bp, Homo sapiens
catttgcatatgaagaagtaag

SEQ ID NO: 7008076 - DNA, 22 bp, Homo sapiens
tcacagagcacacaagaattgc

SEQ ID NO: 7008077 - DNA, 22 bp, Homo sapiens
catttgtctctaggaagtgagg

SEQ ID NO: 7008078 - DNA, 22 bp, Homo sapiens
acatttttctaggaggcaaggt

SEQ ID NO: 7008079 - DNA, 22 bp, Homo sapiens
gaagaatcctgtcctctttagg

SEQ ID NO: 7008080 - DNA, 18 bp, Homo sapiens
gcatacagaggggaagta

SEQ ID NO: 7008081 - DNA, 22 bp, Homo sapiens
aacttagtgagccactcttgca

SEQ ID NO: 7008082 - DNA, 22 bp, Homo sapiens
tcaggaagtgctgaggctgctt

SEQ ID NO: 7008083 - DNA, 22 bp, Homo sapiens
gggtgcagcagagctcctctgt

SEQ ID NO: 7008084 - DNA, 22 bp, Homo sapiens
tgcttaaatttcagcagcttaa

SEQ ID NO: 7008085 - DNA, 22 bp, Homo sapiens
gcagtagtttatggctaaacct

SEQ ID NO: 7008086 - DNA, 22 bp, Homo sapiens
acagcagagaactttagagggt

SEQ ID NO: 7008087 - DNA, 22 bp, Homo sapiens
gcttcatgccaggaggtttaag

SEQ ID NO: 7008088 - DNA, 22 bp, Homo sapiens
ttgaagagtttgatagagttga

SEQ ID NO: 7008089 - DNA, 22 bp, Homo sapiens
tcatgacatgtgaattgaatat

SEQ ID NO: 7008090 - DNA, 22 bp, Homo sapiens
cagggcagggatgttgcggcag

SEQ ID NO: 7008091 - DNA, 22 bp, Homo sapiens
atctctggccttccttttccaa

SEQ ID NO: 7008092 - DNA, 22 bp, Homo sapiens
gtagaaattccatttactttga

SEQ ID NO: 7008093 - DNA, 22 bp, Homo sapiens
tgaagataacagtaaggtattg

SEQ ID NO: 7008094 - DNA, 22 bp, Homo sapiens
attcagatcatatttatagctt

SEQ ID NO: 7008095 - DNA, 22 bp, Homo sapiens
tatatctgggaaccaaaggggg

SEQ ID NO: 7008096 - DNA, 22 bp, Homo sapiens
tggatttgggagcctttccttc

SEQ ID NO: 7008097 - DNA, 18 bp, Homo sapiens
aagtatgcctatgttatt

SEQ ID NO: 7008098 - DNA, 22 bp, Homo sapiens
tctatctggccccttttatata

SEQ ID NO: 7008099 - DNA, 22 bp, Homo sapiens
atatattttgcggtcacgtggc

SEQ ID NO: 7008100 - DNA, 22 bp, Homo sapiens
agaggccgggtgcctgctcaga

SEQ ID NO: 7008101 - DNA, 22 bp, Homo sapiens
cttgctgtgtgccatcagggct

SEQ ID NO: 7008102 - DNA, 22 bp, Homo sapiens
atgtcaaacacaacaccagtgg

SEQ ID NO: 7008103 - DNA, 22 bp, Homo sapiens
cttccttgcggcccctgcctag

SEQ ID NO: 7008104 - DNA, 22 bp, Homo sapiens
agatgggtaattgatggcagta

SEQ ID NO: 7008105 - DNA, 19 bp, Homo sapiens
tcttgggtcgagacataga

SEQ ID NO: 7008106 - DNA, 23 bp, Homo sapiens
aggaagctaccaattttgtaggc

SEQ ID NO: 7008107 - DNA, 22 bp, Homo sapiens
tacccagcaatccctagaggtt

SEQ ID NO: 7008108 - DNA, 22 bp, Homo sapiens
aaactagatgattatgaagcat

SEQ ID NO: 7008109 - DNA, 21 bp, Homo sapiens
aaactagcagcaaccatgatc

SEQ ID NO: 7008110 - DNA, 22 bp, Homo sapiens
ggcttgtccttgggctgtgcat

SEQ ID NO: 7008111 - DNA, 22 bp, Homo sapiens
tcatccagtatgactggtgtct

SEQ ID NO: 7008112 - DNA, 22 bp, Homo sapiens
tggcagctatctttaatgagat

SEQ ID NO: 7008113 - DNA, 20 bp, Homo sapiens
aatactaaacacaaagcagt

SEQ ID NO: 7008114 - DNA, 22 bp, Homo sapiens
tactggaagttagagatctttt

SEQ ID NO: 7008115 - DNA, 22 bp, Homo sapiens
ggtttgcatgtgatgttgggca

SEQ ID NO: 7008116 - DNA, 22 bp, Homo sapiens
ttcctctttagggctggccagg

SEQ ID NO: 7008117 - DNA, 22 bp, Homo sapiens
aagcacagttcttagagttaca

SEQ ID NO: 7008118 - DNA, 22 bp, Homo sapiens
aagtacacatcgttggccccga

SEQ ID NO: 7008119 - DNA, 22 bp, Homo sapiens
ccgatcagcgaaggtcttgact

SEQ ID NO: 7008120 - DNA, 22 bp, Homo sapiens
caggaacgcctggtgttggcct

SEQ ID NO: 7008121 - DNA, 22 bp, Homo sapiens
ctgataggttattttcagtgag

SEQ ID NO: 7008122 - DNA, 22 bp, Homo sapiens
ataattacattatactgttaga

SEQ ID NO: 7008123 - DNA, 22 bp, Homo sapiens
tggctcccgcagaccctgtgct

SEQ ID NO: 7008124 - DNA, 22 bp, Homo sapiens
ctcctggcttctgaaatcgtgg

SEQ ID NO: 7008125 - DNA, 22 bp, Homo sapiens
ttgtaccaacctaatagttcat

SEQ ID NO: 7008126 - DNA, 22 bp, Homo sapiens
ggttttcgcgagtttgtggcac

SEQ ID NO: 7008127 - DNA, 22 bp, Homo sapiens
ttaacctaactcatggaaaaca

SEQ ID NO: 7008128 - DNA, 22 bp, Homo sapiens
tcagtatgatgagagggaaatt

SEQ ID NO: 7008129 - DNA, 22 bp, Homo sapiens
gtcattttatgggaacagattt

SEQ ID NO: 7008130 - DNA, 22 bp, Homo sapiens
tccacacttgctgtctgctgag

SEQ ID NO: 7008131 - DNA, 22 bp, Homo sapiens
atgggagagggtaggaattact

SEQ ID NO: 7008132 - DNA, 22 bp, Homo sapiens
atagttcttaagccatgttgct

SEQ ID NO: 7008133 - DNA, 22 bp, Homo sapiens
tcttttgggttcttatgattta

SEQ ID NO: 7008134 - DNA, 22 bp, Homo sapiens
aaatcagagaatatatttagaa

SEQ ID NO: 7008135 - DNA, 22 bp, Homo sapiens
gcagcagtaggaaataacacag

SEQ ID NO: 7008136 - DNA, 21 bp, Homo sapiens
atcattaattgctgagtgaca

SEQ ID NO: 7008137 - DNA, 22 bp, Homo sapiens
tcccatagatttttcagggtta

SEQ ID NO: 7008138 - DNA, 22 bp, Homo sapiens
ctttgtgcgtagtgagtggtca

SEQ ID NO: 7008139 - DNA, 22 bp, Homo sapiens
aagattctacagtaggtacatt

SEQ ID NO: 7008140 - DNA, 22 bp, Homo sapiens
atgttacatagtccttatttgt

SEQ ID NO: 7008141 - DNA, 22 bp, Homo sapiens
taatcacagaaatgcccattca

SEQ ID NO: 7008142 - DNA, 22 bp, Homo sapiens
gacagtaagaccttaccagcct

SEQ ID NO: 7008143 - DNA, 18 bp, Homo sapiens
gccctctggctgctgatg

SEQ ID NO: 7008144 - DNA, 22 bp, Homo sapiens
ttctttagcaacttggatttag

SEQ ID NO: 7008145 - DNA, 22 bp, Homo sapiens
agtgtctgagccagaattagaa

SEQ ID NO: 7008146 - DNA, 16 bp, Homo sapiens
accctgggtagtcctg

SEQ ID NO: 7008147 - DNA, 22 bp, Homo sapiens
ggcccagacccaagagtggtgg

SEQ ID NO: 7008148 - DNA, 22 bp, Homo sapiens
cggggaggcttcggattaaagc

SEQ ID NO: 7008149 - DNA, 22 bp, Homo sapiens
ccaggtctggaaccaccagggc

SEQ ID NO: 7008150 - DNA, 22 bp, Homo sapiens
tgaggcaatccctagggtaagg

SEQ ID NO: 7008151 - DNA, 22 bp, Homo sapiens
tgttaacatcttggactcgtga

SEQ ID NO: 7008152 - DNA, 22 bp, Homo sapiens
tttgcttttgtgctctagtggt

SEQ ID NO: 7008153 - DNA, 22 bp, Homo sapiens
gatccactgtgtttgtgttgag

SEQ ID NO: 7008154 - DNA, 22 bp, Homo sapiens
aatctgtattgctcatacttga

SEQ ID NO: 7008155 - DNA, 21 bp, Homo sapiens
tccaatttttaagactatggc

SEQ ID NO: 7008156 - DNA, 22 bp, Homo sapiens
gggcaggctgagcatgtcacct

SEQ ID NO: 7008157 - DNA, 18 bp, Homo sapiens
agtcagattccaaggtga

SEQ ID NO: 7008158 - DNA, 22 bp, Homo sapiens
atgctgacagactattaactat

SEQ ID NO: 7008159 - DNA, 23 bp, Homo sapiens
tgttccagatacgccttttcctc

SEQ ID NO: 7008160 - DNA, 22 bp, Homo sapiens
tgaggcaggtaagcaagttttg

SEQ ID NO: 7008161 - DNA, 21 bp, Homo sapiens
gcccagagttaagcccaccca

SEQ ID NO: 7008162 - DNA, 22 bp, Homo sapiens
gatcagaatgggacatatcctg

SEQ ID NO: 7008163 - DNA, 22 bp, Homo sapiens
aagagcatgttaattctaggac

SEQ ID NO: 7008164 - DNA, 22 bp, Homo sapiens
tttcacatacagtgtatagtag

SEQ ID NO: 7008165 - DNA, 22 bp, Homo sapiens
tctctgggcctcagttttctca

SEQ ID NO: 7008166 - DNA, 22 bp, Homo sapiens
cagggtgcctgtcctcagcaaa

SEQ ID NO: 7008167 - DNA, 22 bp, Homo sapiens
gggcagcataacaatcactgaa

SEQ ID NO: 7008168 - DNA, 22 bp, Homo sapiens
taaactacccatgacagtttca

SEQ ID NO: 7008169 - DNA, 22 bp, Homo sapiens
ttcagcatttctgttgttggct

SEQ ID NO: 7008170 - DNA, 22 bp, Homo sapiens
ctttggctcatggttttatcca

SEQ ID NO: 7008171 - DNA, 22 bp, Homo sapiens
ctcttgcatctgttgtattggt

SEQ ID NO: 7008172 - DNA, 22 bp, Homo sapiens
aaagacctgtggtagctctaaa

SEQ ID NO: 7008173 - DNA, 22 bp, Homo sapiens
gcacagcagacttggtggggct

SEQ ID NO: 7008174 - DNA, 22 bp, Homo sapiens
agcatccactcactgggagagg

SEQ ID NO: 7008175 - DNA, 22 bp, Homo sapiens
aagattcagttgatgtgttcca

SEQ ID NO: 7008176 - DNA, 22 bp, Homo sapiens
tgaatgatgcatttgtttccca

SEQ ID NO: 7008177 - DNA, 22 bp, Homo sapiens
gggccctgcctaaggaacacac

SEQ ID NO: 7008178 - DNA, 23 bp, Homo sapiens
tttcagttccagaaaaggggagc

SEQ ID NO: 7008179 - DNA, 22 bp, Homo sapiens
ggtagttcttcatgggtttcat

SEQ ID NO: 7008180 - DNA, 21 bp, Homo sapiens
acctttggaaagaccctggga

SEQ ID NO: 7008181 - DNA, 20 bp, Homo sapiens
aacagtaccccccttgttct

SEQ ID NO: 7008182 - DNA, 22 bp, Homo sapiens
aatatgaattattgttacaagt

SEQ ID NO: 7008183 - DNA, 22 bp, Homo sapiens
ggggctggctcactaagagact

SEQ ID NO: 7008184 - DNA, 20 bp, Homo sapiens
actcagatgctcacaacagg

SEQ ID NO: 7008185 - DNA, 22 bp, Homo sapiens
ggaatgagctcggagcagaagg

SEQ ID NO: 7008186 - DNA, 22 bp, Homo sapiens
tggataaatggtgctatcaccc

SEQ ID NO: 7008187 - DNA, 22 bp, Homo sapiens
agtctgggtgtgaatgaacttg

SEQ ID NO: 7008188 - DNA, 19 bp, Homo sapiens
tagagctgcttcctggcag

SEQ ID NO: 7008189 - DNA, 22 bp, Homo sapiens
aagcaaaggcaggagcttgtga

SEQ ID NO: 7008190 - DNA, 22 bp, Homo sapiens
atgaacaaaaacaaggcctgtt

SEQ ID NO: 7008191 - DNA, 17 bp, Homo sapiens
cttgttgagctcgttcc

SEQ ID NO: 7008192 - DNA, 22 bp, Homo sapiens
tctgagacactcttgtgatggg

SEQ ID NO: 7008193 - DNA, 22 bp, Homo sapiens
tcagactgggtttgcagccacc

SEQ ID NO: 7008194 - DNA, 22 bp, Homo sapiens
ccaccactgaggcacaggagcc

SEQ ID NO: 7008195 - DNA, 22 bp, Homo sapiens
tgtgttttgaactcatctactg

SEQ ID NO: 7008196 - DNA, 22 bp, Homo sapiens
tcaaaggagacacaaggagaaa

SEQ ID NO: 7008197 - DNA, 22 bp, Homo sapiens
tgtcctggatcatgcctctgaa

SEQ ID NO: 7008198 - DNA, 22 bp, Homo sapiens
cttcaactttgtaagtagaatt

SEQ ID NO: 7008199 - DNA, 22 bp, Homo sapiens
tcaaatgtaatttattgtttta

SEQ ID NO: 7008200 - DNA, 22 bp, Homo sapiens
agctgtggggcaggcagcgagg

SEQ ID NO: 7008201 - DNA, 22 bp, Homo sapiens
acagaattaggagatcctcttg

SEQ ID NO: 7008202 - DNA, 22 bp, Homo sapiens
ttggcaatttaaatagcaggag

SEQ ID NO: 7008203 - DNA, 22 bp, Homo sapiens
gctgtgagtggagttctgtgct

SEQ ID NO: 7008204 - DNA, 19 bp, Homo sapiens
ccattgtttgttgcccaag

SEQ ID NO: 7008205 - DNA, 22 bp, Homo sapiens
cctcagacccctgctgagcttc

SEQ ID NO: 7008206 - DNA, 22 bp, Homo sapiens
ccacccctgtagagggacagac

SEQ ID NO: 7008207 - DNA, 22 bp, Homo sapiens
tcctagggtaatcagcatacat

SEQ ID NO: 7008208 - DNA, 22 bp, Homo sapiens
tgtatgtgcaatgtttatatgt

SEQ ID NO: 7008209 - DNA, 22 bp, Homo sapiens
ccagcagagggcgcttcacacc

SEQ ID NO: 7008210 - DNA, 22 bp, Homo sapiens
gtgaggggtggctgagcagttt

SEQ ID NO: 7008211 - DNA, 19 bp, Homo sapiens
tgacaggctgttgccttga

SEQ ID NO: 7008212 - DNA, 22 bp, Homo sapiens
caagtccttagatggttctttg

SEQ ID NO: 7008213 - DNA, 22 bp, Homo sapiens
cttcaagttgtctgagggtggg

SEQ ID NO: 7008214 - DNA, 22 bp, Homo sapiens
ctctggctcttgggaaacaggt

SEQ ID NO: 7008215 - DNA, 22 bp, Homo sapiens
gtcacaggtgtggaggtgctgg

SEQ ID NO: 7008216 - DNA, 22 bp, Homo sapiens
ttctttctctgtaaaaggaaaa

SEQ ID NO: 7008217 - DNA, 22 bp, Homo sapiens
tagctatttagcccagataagt

SEQ ID NO: 7008218 - DNA, 22 bp, Homo sapiens
attggcttgcactgtattttaa

SEQ ID NO: 7008219 - DNA, 22 bp, Homo sapiens
gacagacaggagctcacaggca

SEQ ID NO: 7008220 - DNA, 22 bp, Homo sapiens
gctcagagtggcctggctaggg

SEQ ID NO: 7008221 - DNA, 22 bp, Homo sapiens
ttgaattggcaaaactgcagct

SEQ ID NO: 7008222 - DNA, 22 bp, Homo sapiens
atagctttcttaaatatataaa

SEQ ID NO: 7008223 - DNA, 22 bp, Homo sapiens
ctggagccactttttatccttt

SEQ ID NO: 7008224 - DNA, 18 bp, Homo sapiens
ggagctgggcctggttcc

SEQ ID NO: 7008225 - DNA, 22 bp, Homo sapiens
gccagctgaatttccaactgtt

SEQ ID NO: 7008226 - DNA, 22 bp, Homo sapiens
aaactctggagatgtttatgca

SEQ ID NO: 7008227 - DNA, 22 bp, Homo sapiens
ttgatgaacacagataatcagt

SEQ ID NO: 7008228 - DNA, 22 bp, Homo sapiens
agcagctttaagtcactggtta

SEQ ID NO: 7008229 - DNA, 19 bp, Homo sapiens
accactggccacacactcc

SEQ ID NO: 7008230 - DNA, 22 bp, Homo sapiens
ctctcctgggctgaccgtccga

SEQ ID NO: 7008231 - DNA, 22 bp, Homo sapiens
gaactgagaaggactagcccat

SEQ ID NO: 7008232 - DNA, 22 bp, Homo sapiens
tcatttacgcgcctccttcctt

SEQ ID NO: 7008233 - DNA, 22 bp, Homo sapiens
ctgcaaatcaagttcttataat

SEQ ID NO: 7008234 - DNA, 19 bp, Homo sapiens
tatgtgtgtgtatttacat

SEQ ID NO: 7008235 - DNA, 22 bp, Homo sapiens
ttcctctggaggctctaggaga

SEQ ID NO: 7008236 - DNA, 22 bp, Homo sapiens
gctctaaagtccagtcaactag

SEQ ID NO: 7008237 - DNA, 22 bp, Homo sapiens
tttctgtagtgtggtatgtagg

SEQ ID NO: 7008238 - DNA, 22 bp, Homo sapiens
tagaggtagcaacaggactaga

SEQ ID NO: 7008239 - DNA, 22 bp, Homo sapiens
aatctaagccaccagtagtttc

SEQ ID NO: 7008240 - DNA, 22 bp, Homo sapiens
aagagagggatttggtttattg

SEQ ID NO: 7008241 - DNA, 22 bp, Homo sapiens
tgggctggagcttgttgcttcc

SEQ ID NO: 7008242 - DNA, 22 bp, Homo sapiens
cccaccatgtgcccattggctt

SEQ ID NO: 7008243 - DNA, 22 bp, Homo sapiens
cccgacctcgcaaagcgcactc

SEQ ID NO: 7008244 - DNA, 22 bp, Homo sapiens
cccacacaaatcatggggagaa

SEQ ID NO: 7008245 - DNA, 22 bp, Homo sapiens
cccaggctggcactgctgaagt

SEQ ID NO: 7008246 - DNA, 22 bp, Homo sapiens
ggccctggtcctaggggtggaa

SEQ ID NO: 7008247 - DNA, 22 bp, Homo sapiens
attctctgctgcactgataaca

SEQ ID NO: 7008248 - DNA, 22 bp, Homo sapiens
atgagagctgatgactttacaa

SEQ ID NO: 7008249 - DNA, 21 bp, Homo sapiens
taaagctagaaccttagcttt

SEQ ID NO: 7008250 - DNA, 22 bp, Homo sapiens
gggtcttctgatataggtccag

SEQ ID NO: 7008251 - DNA, 22 bp, Homo sapiens
atttggaatggtctggcatttg

SEQ ID NO: 7008252 - DNA, 22 bp, Homo sapiens
attgagcacctactatgtgcta

SEQ ID NO: 7008253 - DNA, 22 bp, Homo sapiens
tcacattgattacattccatgt

SEQ ID NO: 7008254 - DNA, 22 bp, Homo sapiens
tatgcagtggtatcattttaaa

SEQ ID NO: 7008255 - DNA, 22 bp, Homo sapiens
gtttccagcctagagatggtga

SEQ ID NO: 7008256 - DNA, 22 bp, Homo sapiens
aagtcaaaccttgctcacagga

SEQ ID NO: 7008257 - DNA, 22 bp, Homo sapiens
gagatgaagaggcccttggagt

SEQ ID NO: 7008258 - DNA, 22 bp, Homo sapiens
cttgcctgccactacagctgaa

SEQ ID NO: 7008259 - DNA, 22 bp, Homo sapiens
gactgcagtaagcctcatgact

SEQ ID NO: 7008260 - DNA, 22 bp, Homo sapiens
tcagcatttcagaagtggcata

SEQ ID NO: 7008261 - DNA, 22 bp, Homo sapiens
aggacaaaggaccagatctgga

SEQ ID NO: 7008262 - DNA, 23 bp, Homo sapiens
atttcctactataaaagaggtaa

SEQ ID NO: 7008263 - DNA, 22 bp, Homo sapiens
agagcccctcggtggaggggtc

SEQ ID NO: 7008264 - DNA, 22 bp, Homo sapiens
tcctggtggctttccctgcctt

SEQ ID NO: 7008265 - DNA, 22 bp, Homo sapiens
atgtacatagcatcatctagga

SEQ ID NO: 7008266 - DNA, 22 bp, Homo sapiens
ggctcaggagaggggctaaaag

SEQ ID NO: 7008267 - DNA, 22 bp, Homo sapiens
tacaagaaagtccagtgggttt

SEQ ID NO: 7008268 - DNA, 22 bp, Homo sapiens
aaactgaagccttggagtgaca

SEQ ID NO: 7008269 - DNA, 22 bp, Homo sapiens
aagaggacttgtgaagatgtac

SEQ ID NO: 7008270 - DNA, 20 bp, Homo sapiens
agctgtttacatggatttct

SEQ ID NO: 7008271 - DNA, 22 bp, Homo sapiens
catttggtcattaggtctcctt

SEQ ID NO: 7008272 - DNA, 22 bp, Homo sapiens
gcctattttattatgcatgtaa

SEQ ID NO: 7008273 - DNA, 22 bp, Homo sapiens
gctaggagccgctgcactaggt

SEQ ID NO: 7008274 - DNA, 22 bp, Homo sapiens
taaagtcacagagcaggtgcaa

SEQ ID NO: 7008275 - DNA, 22 bp, Homo sapiens
ttggttcacattagatttcctt

SEQ ID NO: 7008276 - DNA, 22 bp, Homo sapiens
gtgcatctgtaagtggctttgc

SEQ ID NO: 7008277 - DNA, 22 bp, Homo sapiens
gatgatttaagtggccaaagta

SEQ ID NO: 7008278 - DNA, 22 bp, Homo sapiens
catacagagaaggataataaag

SEQ ID NO: 7008279 - DNA, 22 bp, Homo sapiens
ccagagcaattctcacagaact

SEQ ID NO: 7008280 - DNA, 22 bp, Homo sapiens
aacagcagggatggggtggcca

SEQ ID NO: 7008281 - DNA, 22 bp, Homo sapiens
aattctagcccaggcaaaacta

SEQ ID NO: 7008282 - DNA, 17 bp, Homo sapiens
agttagtgtagcagtgc

SEQ ID NO: 7008283 - DNA, 22 bp, Homo sapiens
attcaaattaagttaattcagc

SEQ ID NO: 7008284 - DNA, 22 bp, Homo sapiens
gggcctcatgatggctcaggaa

SEQ ID NO: 7008285 - DNA, 22 bp, Homo sapiens
gcagttacttctgagaagtgaa

SEQ ID NO: 7008286 - DNA, 22 bp, Homo sapiens
tatgtttatactttgatgtact

SEQ ID NO: 7008287 - DNA, 22 bp, Homo sapiens
tttagcaaaggtagggttcaga

SEQ ID NO: 7008288 - DNA, 22 bp, Homo sapiens
accccttctcctggctgttcca

SEQ ID NO: 7008289 - DNA, 22 bp, Homo sapiens
gctctggctagttacctcttac

SEQ ID NO: 7008290 - DNA, 22 bp, Homo sapiens
ttgccagtgccagcccaggcag

SEQ ID NO: 7008291 - DNA, 22 bp, Homo sapiens
gtggcactgatagtttcactct

SEQ ID NO: 7008292 - DNA, 22 bp, Homo sapiens
gcttaaagttgtaaattagaga

SEQ ID NO: 7008293 - DNA, 22 bp, Homo sapiens
aatggtttagttaagactgagt

SEQ ID NO: 7008294 - DNA, 22 bp, Homo sapiens
catgggaggttggcttggcatg

SEQ ID NO: 7008295 - DNA, 18 bp, Homo sapiens
gagctgtctgagctggtc

SEQ ID NO: 7008296 - DNA, 22 bp, Homo sapiens
aaattcagcagtgaaatgcccc

SEQ ID NO: 7008297 - DNA, 19 bp, Homo sapiens
ggttggagaagagcggccc

SEQ ID NO: 7008298 - DNA, 22 bp, Homo sapiens
tccatgtcttcatgtgtctaac

SEQ ID NO: 7008299 - DNA, 22 bp, Homo sapiens
tctggcccctggcagtcctgga

SEQ ID NO: 7008300 - DNA, 22 bp, Homo sapiens
tggtcctttaagtctttctctg

SEQ ID NO: 7008301 - DNA, 22 bp, Homo sapiens
tttcctaaggtagtgataattt

SEQ ID NO: 7008302 - DNA, 22 bp, Homo sapiens
tagtgattccctatcaaccctg

SEQ ID NO: 7008303 - DNA, 22 bp, Homo sapiens
tatctagagcctggaagtcttg

SEQ ID NO: 7008304 - DNA, 22 bp, Homo sapiens
cttgtcagccaattgtggattt

SEQ ID NO: 7008305 - DNA, 22 bp, Homo sapiens
acttctaatcagaaggtctggt

SEQ ID NO: 7008306 - DNA, 22 bp, Homo sapiens
tcatcaaagtcaaagaatgact

SEQ ID NO: 7008307 - DNA, 22 bp, Homo sapiens
atcaggaacgttcatggactgt

SEQ ID NO: 7008308 - DNA, 20 bp, Homo sapiens
gatgattatctgaagccctt

SEQ ID NO: 7008309 - DNA, 22 bp, Homo sapiens
ctggagtctcttctgtagctac

SEQ ID NO: 7008310 - DNA, 22 bp, Homo sapiens
tctgcctgaaattcacatgtaa

SEQ ID NO: 7008311 - DNA, 22 bp, Homo sapiens
cagcccagccttgtctctttat

SEQ ID NO: 7008312 - DNA, 22 bp, Homo sapiens
cgatgggggcagtgttacattg

SEQ ID NO: 7008313 - DNA, 20 bp, Homo sapiens
cggctcagcctctccctccc

SEQ ID NO: 7008314 - DNA, 22 bp, Homo sapiens
cttagtttgcatgattatggag

SEQ ID NO: 7008315 - DNA, 22 bp, Homo sapiens
cctgtgtttcaccaaaagagtc

SEQ ID NO: 7008316 - DNA, 22 bp, Homo sapiens
actgtgtctcattcatcattgt

SEQ ID NO: 7008317 - DNA, 22 bp, Homo sapiens
tagcagtgccaggattttgctg

SEQ ID NO: 7008318 - DNA, 22 bp, Homo sapiens
caaatactgtactgaacactgt

SEQ ID NO: 7008319 - DNA, 22 bp, Homo sapiens
tagaacaggaataagggaaata

SEQ ID NO: 7008320 - DNA, 22 bp, Homo sapiens
atatgtgtaaatgcatttgttt

SEQ ID NO: 7008321 - DNA, 22 bp, Homo sapiens
aaaggtgacactctgccagctg

SEQ ID NO: 7008322 - DNA, 22 bp, Homo sapiens
tctttcagccacttacctgtct

SEQ ID NO: 7008323 - DNA, 22 bp, Homo sapiens
gcccagcacagctggaagagtc

SEQ ID NO: 7008324 - DNA, 22 bp, Homo sapiens
tatctgtttgctcacaggtgtt

SEQ ID NO: 7008325 - DNA, 22 bp, Homo sapiens
attgacagcaggggctgtcact

SEQ ID NO: 7008326 - DNA, 22 bp, Homo sapiens
aaatccaagctttggtaactga

SEQ ID NO: 7008327 - DNA, 22 bp, Homo sapiens
ttcataggtacagggaatttct

SEQ ID NO: 7008328 - DNA, 22 bp, Homo sapiens
gtcaaaatgagctttgttattg

SEQ ID NO: 7008329 - DNA, 17 bp, Homo sapiens
cccatgagcccactccc

SEQ ID NO: 7008330 - DNA, 22 bp, Homo sapiens
caggccagcagggcctccgtgg

SEQ ID NO: 7008331 - DNA, 22 bp, Homo sapiens
acagtaaatattaagcctgagt

SEQ ID NO: 7008332 - DNA, 22 bp, Homo sapiens
tcataattgtatacatttatgg

SEQ ID NO: 7008333 - DNA, 22 bp, Homo sapiens
tctgtccagtgccagtgaagac

SEQ ID NO: 7008334 - DNA, 19 bp, Homo sapiens
tggtggaggccccatgttc

SEQ ID NO: 7008335 - DNA, 19 bp, Homo sapiens
tttctgtttgcttctggtt

SEQ ID NO: 7008336 - DNA, 22 bp, Homo sapiens
gtccctgggaaaggagagggca

SEQ ID NO: 7008337 - DNA, 21 bp, Homo sapiens
tcatggccagcaagtggcaga

SEQ ID NO: 7008338 - DNA, 22 bp, Homo sapiens
accaggaggctacactgtccca

SEQ ID NO: 7008339 - DNA, 22 bp, Homo sapiens
gaaaatacttcagtgttctggc

SEQ ID NO: 7008340 - DNA, 22 bp, Homo sapiens
tgagatgggtcatcaggtttgg

SEQ ID NO: 7008341 - DNA, 18 bp, Homo sapiens
gatgaagctgctggggat

SEQ ID NO: 7008342 - DNA, 22 bp, Homo sapiens
gctgcctgaagtgtctacactg

SEQ ID NO: 7008343 - DNA, 22 bp, Homo sapiens
atcccgaacctctacttctttc

SEQ ID NO: 7008344 - DNA, 22 bp, Homo sapiens
ctgtcctgagataaagatgagg

SEQ ID NO: 7008345 - DNA, 22 bp, Homo sapiens
gaagttcaactgccatgcttgg

SEQ ID NO: 7008346 - DNA, 22 bp, Homo sapiens
gagcaagaccctgggttctctc

SEQ ID NO: 7008347 - DNA, 22 bp, Homo sapiens
gaaagagaacctgggcctagat

SEQ ID NO: 7008348 - DNA, 22 bp, Homo sapiens
tcttatgataatatcactacca

SEQ ID NO: 7008349 - DNA, 22 bp, Homo sapiens
gctttgggtgtcctctgggcct

SEQ ID NO: 7008350 - DNA, 22 bp, Homo sapiens
tagacattttaagacatatacc

SEQ ID NO: 7008351 - DNA, 22 bp, Homo sapiens
ctgctgtagccactgggctcag

SEQ ID NO: 7008352 - DNA, 22 bp, Homo sapiens
ggggctgtttttggaatggctg

SEQ ID NO: 7008353 - DNA, 22 bp, Homo sapiens
atattacttcctggtataaaat

SEQ ID NO: 7008354 - DNA, 22 bp, Homo sapiens
attgtcttgtacgtttgcctgt

SEQ ID NO: 7008355 - DNA, 22 bp, Homo sapiens
tcaatttaaggtactactttgg

SEQ ID NO: 7008356 - DNA, 22 bp, Homo sapiens
cacaaaatctttctcgattatt

SEQ ID NO: 7008357 - DNA, 22 bp, Homo sapiens
tggctctgcacctcagtgtacc

SEQ ID NO: 7008358 - DNA, 22 bp, Homo sapiens
gagaggccaaaatccctgcccc

SEQ ID NO: 7008359 - DNA, 22 bp, Homo sapiens
acactctcagcttttcaactta

SEQ ID NO: 7008360 - DNA, 22 bp, Homo sapiens
ccaggcttttagctgcatggca

SEQ ID NO: 7008361 - DNA, 22 bp, Homo sapiens
tgccaggaaactgtatatcttg

SEQ ID NO: 7008362 - DNA, 22 bp, Homo sapiens
ttcctgaatataaagacactag

SEQ ID NO: 7008363 - DNA, 22 bp, Homo sapiens
aagcaaatgtgggtgcagaatt

SEQ ID NO: 7008364 - DNA, 22 bp, Homo sapiens
ttctagaaacacatgcaaacag

SEQ ID NO: 7008365 - DNA, 22 bp, Homo sapiens
cagtctcttgcttcattagttg

SEQ ID NO: 7008366 - DNA, 22 bp, Homo sapiens
tttattggatggatggatggat

SEQ ID NO: 7008367 - DNA, 22 bp, Homo sapiens
cctgagaccaagttgcagccat

SEQ ID NO: 7008368 - DNA, 22 bp, Homo sapiens
agcttcttggctcagcacttgg

SEQ ID NO: 7008369 - DNA, 22 bp, Homo sapiens
cagggagcctgaatgttccagg

SEQ ID NO: 7008370 - DNA, 22 bp, Homo sapiens
gagccagcctccgcctctctcc

SEQ ID NO: 7008371 - DNA, 22 bp, Homo sapiens
gcagagatggctgatctattcc

SEQ ID NO: 7008372 - DNA, 22 bp, Homo sapiens
agtctacagttccctcaggtcc

SEQ ID NO: 7008373 - DNA, 18 bp, Homo sapiens
cagatgagatgcaatctc

SEQ ID NO: 7008374 - DNA, 22 bp, Homo sapiens
cactgcactccagcctgcgcaa

SEQ ID NO: 7008375 - DNA, 22 bp, Homo sapiens
tctaccacagggtagaaccacg

SEQ ID NO: 7008376 - DNA, 22 bp, Homo sapiens
attcacagaatagttttaccag

SEQ ID NO: 7008377 - DNA, 22 bp, Homo sapiens
gttgaggaggttcagggtggtt

SEQ ID NO: 7008378 - DNA, 22 bp, Homo sapiens
ccaaagtccacagtttacatta

SEQ ID NO: 7008379 - DNA, 22 bp, Homo sapiens
tggagtggacttcatgaggcca

SEQ ID NO: 7008380 - DNA, 22 bp, Homo sapiens
ggacagcgtggctggtggaggg

SEQ ID NO: 7008381 - DNA, 22 bp, Homo sapiens
taggtctggcagaagaaaaatg

SEQ ID NO: 7008382 - DNA, 22 bp, Homo sapiens
gtatatgtatgcgtatacacac

SEQ ID NO: 7008383 - DNA, 22 bp, Homo sapiens
cccaggctggagtgcaatggca

SEQ ID NO: 7008384 - DNA, 22 bp, Homo sapiens
tgagagattttcatgagtgctt

SEQ ID NO: 7008385 - DNA, 22 bp, Homo sapiens
gccctctggtgggtgagccccg

SEQ ID NO: 7008386 - DNA, 22 bp, Homo sapiens
tgtatgtaaagaaggatatttt

SEQ ID NO: 7008387 - DNA, 22 bp, Homo sapiens
agtatttgatcagatgatagta

SEQ ID NO: 7008388 - DNA, 22 bp, Homo sapiens
cacgaatggaagggtcttggct

SEQ ID NO: 7008389 - DNA, 22 bp, Homo sapiens
gaggcagcatggtaccttggag

SEQ ID NO: 7008390 - DNA, 22 bp, Homo sapiens
ccctactccatagtcaattcat

SEQ ID NO: 7008391 - DNA, 22 bp, Homo sapiens
caagcatgtcttcttaagcaat

SEQ ID NO: 7008392 - DNA, 22 bp, Homo sapiens
tctggctcaaaatacgtactct

SEQ ID NO: 7008393 - DNA, 22 bp, Homo sapiens
agtctcttagatgtggacctgc

SEQ ID NO: 7008394 - DNA, 22 bp, Homo sapiens
aagggcttttaagatttatcct

SEQ ID NO: 7008395 - DNA, 22 bp, Homo sapiens
tcctattggtagacatttctgt

SEQ ID NO: 7008396 - DNA, 22 bp, Homo sapiens
tacttgaattggtttctgcaga

SEQ ID NO: 7008397 - DNA, 22 bp, Homo sapiens
cgttcacatcgtattattggga

SEQ ID NO: 7008398 - DNA, 20 bp, Homo sapiens
cagcttcaatgtcagcttga

SEQ ID NO: 7008399 - DNA, 22 bp, Homo sapiens
ccaatgaacaagtcggtcagga

SEQ ID NO: 7008400 - DNA, 22 bp, Homo sapiens
ctgaaatatatactgggaaaaa

SEQ ID NO: 7008401 - DNA, 22 bp, Homo sapiens
atttggaggcctctcctgcttg

SEQ ID NO: 7008402 - DNA, 22 bp, Homo sapiens
tgctgagtactctcctgtgtag

SEQ ID NO: 7008403 - DNA, 22 bp, Homo sapiens
tgccttaatttccctgttttgt

SEQ ID NO: 7008404 - DNA, 22 bp, Homo sapiens
tgctaggagttattctaagatt

SEQ ID NO: 7008405 - DNA, 22 bp, Homo sapiens
ggtccctggggaactaggctgt

SEQ ID NO: 7008406 - DNA, 22 bp, Homo sapiens
ccttttctaggatgctttatag

SEQ ID NO: 7008407 - DNA, 22 bp, Homo sapiens
cactgcactccagcccgggcaa

SEQ ID NO: 7008408 - DNA, 20 bp, Homo sapiens
aggctctgccattgtccctg

SEQ ID NO: 7008409 - DNA, 22 bp, Homo sapiens
tatgatggcagcgattgctgag

SEQ ID NO: 7008410 - DNA, 22 bp, Homo sapiens
agttgtaagaggcacaaggaag

SEQ ID NO: 7008411 - DNA, 22 bp, Homo sapiens
ggcagtctttcccttgagctct

SEQ ID NO: 7008412 - DNA, 22 bp, Homo sapiens
tcaggaaagcctagaagagaac

SEQ ID NO: 7008413 - DNA, 21 bp, Homo sapiens
agtatttcttcatgtccttgc

SEQ ID NO: 7008414 - DNA, 22 bp, Homo sapiens
ctgggaacatctgaatgctgag

SEQ ID NO: 7008415 - DNA, 22 bp, Homo sapiens
atggcccaggcaggctggtact

SEQ ID NO: 7008416 - DNA, 22 bp, Homo sapiens
caggcctgggctgggtatcagg

SEQ ID NO: 7008417 - DNA, 20 bp, Homo sapiens
tcagtgctcaggcaccaggt

SEQ ID NO: 7008418 - DNA, 22 bp, Homo sapiens
tcattagcagaagacagatgaa

SEQ ID NO: 7008419 - DNA, 22 bp, Homo sapiens
cctgagagagaagcgacctggt

SEQ ID NO: 7008420 - DNA, 22 bp, Homo sapiens
tccagcaggttggtcaggtgca

SEQ ID NO: 7008421 - DNA, 22 bp, Homo sapiens
ttccttcagcaagtcctgagca

SEQ ID NO: 7008422 - DNA, 22 bp, Homo sapiens
agcatctctgggagtcatccgt

SEQ ID NO: 7008423 - DNA, 22 bp, Homo sapiens
actgccttcatgcagacccctg

SEQ ID NO: 7008424 - DNA, 22 bp, Homo sapiens
tacaaagggggaagagattctg

SEQ ID NO: 7008425 - DNA, 22 bp, Homo sapiens
tcatgaagtccaaactaaagca

SEQ ID NO: 7008426 - DNA, 22 bp, Homo sapiens
agtgtctgtgctttgcagcaaa

SEQ ID NO: 7008427 - DNA, 22 bp, Homo sapiens
aaaatctgcacaggtcagtttt

SEQ ID NO: 7008428 - DNA, 19 bp, Homo sapiens
ttcctggggttccattgtg

SEQ ID NO: 7008429 - DNA, 22 bp, Homo sapiens
ttgaaattgggtgtggctgtca

SEQ ID NO: 7008430 - DNA, 22 bp, Homo sapiens
cctggctggatggagcccctgg

SEQ ID NO: 7008431 - DNA, 22 bp, Homo sapiens
tcatgacaacttgcacagtttt

SEQ ID NO: 7008432 - DNA, 22 bp, Homo sapiens
tcctgagtgtttggccaggcca

SEQ ID NO: 7008433 - DNA, 22 bp, Homo sapiens
gtcaggctgccagtctttattg

SEQ ID NO: 7008434 - DNA, 23 bp, Homo sapiens
tctcttatcacaattcattttgc

SEQ ID NO: 7008435 - DNA, 22 bp, Homo sapiens
tgttcagttaacacagacacca

SEQ ID NO: 7008436 - DNA, 17 bp, Homo sapiens
tcaccgtttggctttcc

SEQ ID NO: 7008437 - DNA, 22 bp, Homo sapiens
aatccactaatgaagaatgggc

SEQ ID NO: 7008438 - DNA, 22 bp, Homo sapiens
tcagcttgtgggtcagcctctg

SEQ ID NO: 7008439 - DNA, 22 bp, Homo sapiens
tggattagagtgaaccaaggcc

SEQ ID NO: 7008440 - DNA, 22 bp, Homo sapiens
acagctgctgtggaggttttca

SEQ ID NO: 7008441 - DNA, 22 bp, Homo sapiens
tagcacctcaattttgcaaata

SEQ ID NO: 7008442 - DNA, 22 bp, Homo sapiens
atgaagacaaactgggtagaaa

SEQ ID NO: 7008443 - DNA, 22 bp, Homo sapiens
gccccaagtccctatgtttcca

SEQ ID NO: 7008444 - DNA, 22 bp, Homo sapiens
atttcaaggctacagaaacctt

SEQ ID NO: 7008445 - DNA, 22 bp, Homo sapiens
ctcctcctaaatgattcttcct

SEQ ID NO: 7008446 - DNA, 22 bp, Homo sapiens
aagatgttattgtcttccttgc

SEQ ID NO: 7008447 - DNA, 22 bp, Homo sapiens
ggaagaagggtcattggcagcc

SEQ ID NO: 7008448 - DNA, 21 bp, Homo sapiens
aaccacatggattagtcagag

SEQ ID NO: 7008449 - DNA, 22 bp, Homo sapiens
agtgtctgcagtgatgtctctt

SEQ ID NO: 7008450 - DNA, 17 bp, Homo sapiens
gtgctggcctggggctc

SEQ ID NO: 7008451 - DNA, 22 bp, Homo sapiens
tggattccacgcctgctcctgt

SEQ ID NO: 7008452 - DNA, 22 bp, Homo sapiens
cagtgcaattagaacttattta

SEQ ID NO: 7008453 - DNA, 22 bp, Homo sapiens
tctcagaactttatatgtatca

SEQ ID NO: 7008454 - DNA, 21 bp, Homo sapiens
agagctggcctgccaggccct

SEQ ID NO: 7008455 - DNA, 22 bp, Homo sapiens
tgacaacagccatcacttttag

SEQ ID NO: 7008456 - DNA, 22 bp, Homo sapiens
gttctcagcgtgggaggcagag

SEQ ID NO: 7008457 - DNA, 22 bp, Homo sapiens
agcatcctgcttgctgtctgtg

SEQ ID NO: 7008458 - DNA, 22 bp, Homo sapiens
cctgtctggccaccagggcgat

SEQ ID NO: 7008459 - DNA, 22 bp, Homo sapiens
attttcatcatgggtttaacat

SEQ ID NO: 7008460 - DNA, 22 bp, Homo sapiens
gactctagattcatggtggagt

SEQ ID NO: 7008461 - DNA, 19 bp, Homo sapiens
tccttgtgactgtgtgaaa

SEQ ID NO: 7008462 - DNA, 22 bp, Homo sapiens
cctggctcttcagaggttccta

SEQ ID NO: 7008463 - DNA, 22 bp, Homo sapiens
cacatctgaaaagatgcacaag

SEQ ID NO: 7008464 - DNA, 22 bp, Homo sapiens
ctggcccatggtgagctctggg

SEQ ID NO: 7008465 - DNA, 22 bp, Homo sapiens
caagtgacttctttgagcccgt

SEQ ID NO: 7008466 - DNA, 22 bp, Homo sapiens
ttgggctgggcaagaatcaatg

SEQ ID NO: 7008467 - DNA, 22 bp, Homo sapiens
gcacaggtcaggagatgagatt

SEQ ID NO: 7008468 - DNA, 22 bp, Homo sapiens
gtccagcccctgactcccaggc

SEQ ID NO: 7008469 - DNA, 22 bp, Homo sapiens
gcccatggtggcgttcggtgca

SEQ ID NO: 7008470 - DNA, 22 bp, Homo sapiens
tgtccataaattcacaagtgta

SEQ ID NO: 7008471 - DNA, 22 bp, Homo sapiens
tagagcatttagaggggcagga

SEQ ID NO: 7008472 - DNA, 22 bp, Homo sapiens
cttcttgggctgccagtttcag

SEQ ID NO: 7008473 - DNA, 22 bp, Homo sapiens
tgagttgctatctagatccaga

SEQ ID NO: 7008474 - DNA, 22 bp, Homo sapiens
gtggcagtgaaggtcatagcat

SEQ ID NO: 7008475 - DNA, 22 bp, Homo sapiens
gcaaatgaaggtggtgctacag

SEQ ID NO: 7008476 - DNA, 21 bp, Homo sapiens
ggcctaggggcagatggtgct

SEQ ID NO: 7008477 - DNA, 22 bp, Homo sapiens
cagctgaggtcaaagaagcagg

SEQ ID NO: 7008478 - DNA, 22 bp, Homo sapiens
atgtccttgtgagtaaatgatg

SEQ ID NO: 7008479 - DNA, 22 bp, Homo sapiens
gaatggcattgtcagcctttat

SEQ ID NO: 7008480 - DNA, 22 bp, Homo sapiens
ggtcagaaggattctgggaaat

SEQ ID NO: 7008481 - DNA, 20 bp, Homo sapiens
gggtgaggatggagaatttg

SEQ ID NO: 7008482 - DNA, 22 bp, Homo sapiens
tctatagagccttttattaccc

SEQ ID NO: 7008483 - DNA, 22 bp, Homo sapiens
tcacatcttagtttgggactct

SEQ ID NO: 7008484 - DNA, 22 bp, Homo sapiens
tgagttgccctgccctgtgctt

SEQ ID NO: 7008485 - DNA, 22 bp, Homo sapiens
aggcctgctgtcttgaggccaa

SEQ ID NO: 7008486 - DNA, 22 bp, Homo sapiens
ctggtgtggcggcgccctgtag

SEQ ID NO: 7008487 - DNA, 22 bp, Homo sapiens
ttctcagtattacatgctaatg

SEQ ID NO: 7008488 - DNA, 22 bp, Homo sapiens
ccattacttagaaaggaactga

SEQ ID NO: 7008489 - DNA, 22 bp, Homo sapiens
ggagatggccacgtcactcagt

SEQ ID NO: 7008490 - DNA, 22 bp, Homo sapiens
atttggcatagagtatcattct

SEQ ID NO: 7008491 - DNA, 22 bp, Homo sapiens
tggagtaagaatgggcagttca

SEQ ID NO: 7008492 - DNA, 22 bp, Homo sapiens
ctgaagaatgacagtgctttga

SEQ ID NO: 7008493 - DNA, 22 bp, Homo sapiens
tcgatagaatatactagctgtg

SEQ ID NO: 7008494 - DNA, 22 bp, Homo sapiens
tcatgtcttctgtgatgtccaa

SEQ ID NO: 7008495 - DNA, 22 bp, Homo sapiens
gcagtagttcgtctgtgttccc

SEQ ID NO: 7008496 - DNA, 22 bp, Homo sapiens
ttgtttaaagaacttctgactt

SEQ ID NO: 7008497 - DNA, 22 bp, Homo sapiens
tcatggcagtataattcctcaa

SEQ ID NO: 7008498 - DNA, 22 bp, Homo sapiens
aggaatgtgaccactagactct

SEQ ID NO: 7008499 - DNA, 22 bp, Homo sapiens
cctgtgtggaaaccgcatgacg

SEQ ID NO: 7008500 - DNA, 22 bp, Homo sapiens
ggggtggattcctacaggtcca

SEQ ID NO: 7008501 - DNA, 22 bp, Homo sapiens
gtacatttctcttgttcttatt

SEQ ID NO: 7008502 - DNA, 22 bp, Homo sapiens
gtagacagaaagcggaatcata

SEQ ID NO: 7008503 - DNA, 22 bp, Homo sapiens
ttaaggaatattcatgaagttt

SEQ ID NO: 7008504 - DNA, 22 bp, Homo sapiens
agtccaagattagggtgacagc

SEQ ID NO: 7008505 - DNA, 22 bp, Homo sapiens
tttctagtatataactagatct

SEQ ID NO: 7008506 - DNA, 22 bp, Homo sapiens
ggccacgtgacctctggctcct

SEQ ID NO: 7008507 - DNA, 22 bp, Homo sapiens
cttgctgctgcatctgagcatg

SEQ ID NO: 7008508 - DNA, 22 bp, Homo sapiens
ttgaaggaggctcctttttaaa

SEQ ID NO: 7008509 - DNA, 22 bp, Homo sapiens
tcaaggtgactgaactataaac

SEQ ID NO: 7008510 - DNA, 19 bp, Homo sapiens
agctgggtgttagtggaga

SEQ ID NO: 7008511 - DNA, 22 bp, Homo sapiens
agcagccagaaagggcagtcga

SEQ ID NO: 7008512 - DNA, 22 bp, Homo sapiens
ctgcagcgagacatagaggatg

SEQ ID NO: 7008513 - DNA, 22 bp, Homo sapiens
tcattgaagcccttgacaagcc

SEQ ID NO: 7008514 - DNA, 22 bp, Homo sapiens
gctctggctactccaccctgtt

SEQ ID NO: 7008515 - DNA, 22 bp, Homo sapiens
gcttagcctggactggtgagca

SEQ ID NO: 7008516 - DNA, 22 bp, Homo sapiens
aggggctctgagtgggccagga

SEQ ID NO: 7008517 - DNA, 22 bp, Homo sapiens
tagctagaaagtttcagctgtg

SEQ ID NO: 7008518 - DNA, 22 bp, Homo sapiens
gggcatgcctgagcctgccact

SEQ ID NO: 7008519 - DNA, 22 bp, Homo sapiens
taattcagctgaacaactgtgt

SEQ ID NO: 7008520 - DNA, 22 bp, Homo sapiens
ggcaggtggccaagtgtctaag

SEQ ID NO: 7008521 - DNA, 22 bp, Homo sapiens
tgggtcaacctgataaaatgtg

SEQ ID NO: 7008522 - DNA, 23 bp, Homo sapiens
aaggtgtttgttttcagaaagca

SEQ ID NO: 7008523 - DNA, 22 bp, Homo sapiens
tcctgggtccatggcagccgaa

SEQ ID NO: 7008524 - DNA, 22 bp, Homo sapiens
gctagaaaatgaaagataattt

SEQ ID NO: 7008525 - DNA, 22 bp, Homo sapiens
tttaatgtttgagtcagtatat

SEQ ID NO: 7008526 - DNA, 22 bp, Homo sapiens
tttaggtcttcttaagagtcaa

SEQ ID NO: 7008527 - DNA, 18 bp, Homo sapiens
ctggtcagggcaatgggc

SEQ ID NO: 7008528 - DNA, 22 bp, Homo sapiens
ttgcaagacacttggaagcaca

SEQ ID NO: 7008529 - DNA, 22 bp, Homo sapiens
agctcaatgcaacctccgcctc

SEQ ID NO: 7008530 - DNA, 22 bp, Homo sapiens
agcataaactcagggacacaca

SEQ ID NO: 7008531 - DNA, 22 bp, Homo sapiens
gaggagacatatttttgaagca

SEQ ID NO: 7008532 - DNA, 22 bp, Homo sapiens
tctcatcttgttcatctaccct

SEQ ID NO: 7008533 - DNA, 23 bp, Homo sapiens
ctgtggccacccctagctggagg

SEQ ID NO: 7008534 - DNA, 22 bp, Homo sapiens
tccctccccacttctgagcttt

SEQ ID NO: 7008535 - DNA, 22 bp, Homo sapiens
cacagctgccatggctgcactt

SEQ ID NO: 7008536 - DNA, 22 bp, Homo sapiens
ctgggcctgccaccatcttagg

SEQ ID NO: 7008537 - DNA, 22 bp, Homo sapiens
cagctgttgtgtatcaggcaga

SEQ ID NO: 7008538 - DNA, 22 bp, Homo sapiens
aggctgaggatcgtactttcca

SEQ ID NO: 7008539 - DNA, 22 bp, Homo sapiens
ttcactggggagatgtggcaga

SEQ ID NO: 7008540 - DNA, 22 bp, Homo sapiens
tcagctttttggattgcccaag

SEQ ID NO: 7008541 - DNA, 22 bp, Homo sapiens
gtgagggcagcttggtcagtgt

SEQ ID NO: 7008542 - DNA, 22 bp, Homo sapiens
tatctgatgcctgttctgttca

SEQ ID NO: 7008543 - DNA, 16 bp, Homo sapiens
gggctcagatctttga

SEQ ID NO: 7008544 - DNA, 22 bp, Homo sapiens
acactgactgggacagaagacc

SEQ ID NO: 7008545 - DNA, 21 bp, Homo sapiens
ctgctgtggcccccgacatgc

SEQ ID NO: 7008546 - DNA, 22 bp, Homo sapiens
gggagagaagggcatgtacact

SEQ ID NO: 7008547 - DNA, 22 bp, Homo sapiens
ttgagaggatggattagacaaa

SEQ ID NO: 7008548 - DNA, 22 bp, Homo sapiens
ctggagctgccagacgggcaca

SEQ ID NO: 7008549 - DNA, 22 bp, Homo sapiens
ctggacagtgctgcttgagatg

SEQ ID NO: 7008550 - DNA, 22 bp, Homo sapiens
gatttctcttttgaagaggcct

SEQ ID NO: 7008551 - DNA, 22 bp, Homo sapiens
tcagtgactgggtattaaatca

SEQ ID NO: 7008552 - DNA, 21 bp, Homo sapiens
tcctcctccactaggctagcc

SEQ ID NO: 7008553 - DNA, 22 bp, Homo sapiens
tgtgaagaattaatgtgaatca

SEQ ID NO: 7008554 - DNA, 22 bp, Homo sapiens
agcagcttgagctggggctggc

SEQ ID NO: 7008555 - DNA, 22 bp, Homo sapiens
gcagagccaggagcccaggatc

SEQ ID NO: 7008556 - DNA, 22 bp, Homo sapiens
agctttgctgctggagaagggt

SEQ ID NO: 7008557 - DNA, 22 bp, Homo sapiens
ttagttaggaaacaaagttgtt

SEQ ID NO: 7008558 - DNA, 22 bp, Homo sapiens
tttcctttatgacatcaccact

SEQ ID NO: 7008559 - DNA, 22 bp, Homo sapiens
tgagcagagcaggctgcgccct

SEQ ID NO: 7008560 - DNA, 22 bp, Homo sapiens
tgttgcccaggttctctcctgc

SEQ ID NO: 7008561 - DNA, 22 bp, Homo sapiens
atgttacactgtttcacgttcc

SEQ ID NO: 7008562 - DNA, 22 bp, Homo sapiens
tcctggccaagttactctctgc

SEQ ID NO: 7008563 - DNA, 19 bp, Homo sapiens
taggttggacagtatcccc

SEQ ID NO: 7008564 - DNA, 22 bp, Homo sapiens
ttctctatcttgaatgcgtcaa

SEQ ID NO: 7008565 - DNA, 22 bp, Homo sapiens
actgtgcaatgagtaataaact

SEQ ID NO: 7008566 - DNA, 22 bp, Homo sapiens
agggacctgtcaatgacagtta

SEQ ID NO: 7008567 - DNA, 22 bp, Homo sapiens
tgaactctccaggcaaatgatc

SEQ ID NO: 7008568 - DNA, 22 bp, Homo sapiens
taagcatattccagtcatgtcc

SEQ ID NO: 7008569 - DNA, 22 bp, Homo sapiens
aaagtactaatgaatattttgc

SEQ ID NO: 7008570 - DNA, 22 bp, Homo sapiens
gaccctggagccgtctgaggca

SEQ ID NO: 7008571 - DNA, 22 bp, Homo sapiens
gctctgagagtgggtgattctg

SEQ ID NO: 7008572 - DNA, 22 bp, Homo sapiens
agtgattaattgtaaaaattct

SEQ ID NO: 7008573 - DNA, 22 bp, Homo sapiens
agctaaatcacttattctttca

SEQ ID NO: 7008574 - DNA, 20 bp, Homo sapiens
atgtcctgcttctcctcacc

SEQ ID NO: 7008575 - DNA, 22 bp, Homo sapiens
catttgtatctgggctgctgtg

SEQ ID NO: 7008576 - DNA, 22 bp, Homo sapiens
gagtcaggagttatgctccacc

SEQ ID NO: 7008577 - DNA, 22 bp, Homo sapiens
ccctgggcagtctgcacttcag

SEQ ID NO: 7008578 - DNA, 22 bp, Homo sapiens
ttgaacattttctatgttatag

SEQ ID NO: 7008579 - DNA, 22 bp, Homo sapiens
tgggcaaatgctttttagtcaa

SEQ ID NO: 7008580 - DNA, 22 bp, Homo sapiens
ctggctggacttgtgcatgtca

SEQ ID NO: 7008581 - DNA, 22 bp, Homo sapiens
gcaggacctctggatgcaatgc

SEQ ID NO: 7008582 - DNA, 22 bp, Homo sapiens
tagaaggcaggtggttggagtt

SEQ ID NO: 7008583 - DNA, 22 bp, Homo sapiens
ccagagagaaatggatttgagt

SEQ ID NO: 7008584 - DNA, 23 bp, Homo sapiens
cccaggtcaaaattcacaggcct

SEQ ID NO: 7008585 - DNA, 22 bp, Homo sapiens
tctcagagagatgaaacttcca

SEQ ID NO: 7008586 - DNA, 22 bp, Homo sapiens
ggggtcaagctcagaatcctag

SEQ ID NO: 7008587 - DNA, 22 bp, Homo sapiens
atacacaggtgctaggtcaata

SEQ ID NO: 7008588 - DNA, 16 bp, Homo sapiens
gtgcagagcaattcac

SEQ ID NO: 7008589 - DNA, 22 bp, Homo sapiens
ttttcagttgtgctctctagtt

SEQ ID NO: 7008590 - DNA, 22 bp, Homo sapiens
cttctagagtttctgatgcaac

SEQ ID NO: 7008591 - DNA, 22 bp, Homo sapiens
ttctgtatgtacatatgtgtat

SEQ ID NO: 7008592 - DNA, 22 bp, Homo sapiens
ctctgtcctccacctgctttca

SEQ ID NO: 7008593 - DNA, 22 bp, Homo sapiens
gtaaataactggtaattggggt

SEQ ID NO: 7008594 - DNA, 20 bp, Homo sapiens
tgctccatctaaagtgatta

SEQ ID NO: 7008595 - DNA, 22 bp, Homo sapiens
ggatttgaactagagccctgcc

SEQ ID NO: 7008596 - DNA, 22 bp, Homo sapiens
aggatttaatcagttggcattt

SEQ ID NO: 7008597 - DNA, 22 bp, Homo sapiens
cctggcaggctggggacagtgc

SEQ ID NO: 7008598 - DNA, 22 bp, Homo sapiens
accaggaggtgtttgctcaagt

SEQ ID NO: 7008599 - DNA, 22 bp, Homo sapiens
gctcaggaaatagtttagtgtt

SEQ ID NO: 7008600 - DNA, 22 bp, Homo sapiens
gtggctgtatagccaagtcaga

SEQ ID NO: 7008601 - DNA, 22 bp, Homo sapiens
atagtggttgtggttctggcca

SEQ ID NO: 7008602 - DNA, 22 bp, Homo sapiens
ctgctgcttttgcgggagaaca

SEQ ID NO: 7008603 - DNA, 23 bp, Homo sapiens
acacaagggtaactgccagccat

SEQ ID NO: 7008604 - DNA, 16 bp, Homo sapiens
gctcctgggccctcga

SEQ ID NO: 7008605 - DNA, 22 bp, Homo sapiens
ctagggaaataaactgagtggt

SEQ ID NO: 7008606 - DNA, 22 bp, Homo sapiens
aatgcacagcgttccatgcttg

SEQ ID NO: 7008607 - DNA, 22 bp, Homo sapiens
tctggaataggacaaaaccaaa

SEQ ID NO: 7008608 - DNA, 22 bp, Homo sapiens
tcagaattggacaatagaagca

SEQ ID NO: 7008609 - DNA, 22 bp, Homo sapiens
ctgggcctccacgggccatcac

SEQ ID NO: 7008610 - DNA, 22 bp, Homo sapiens
tcctgtgaagaatagcactcaa

SEQ ID NO: 7008611 - DNA, 22 bp, Homo sapiens
cagtggtagaagccaagtagat

SEQ ID NO: 7008612 - DNA, 22 bp, Homo sapiens
aacaatgaccacacaatgtact

SEQ ID NO: 7008613 - DNA, 21 bp, Homo sapiens
taaacctggcgctgttcaaag

SEQ ID NO: 7008614 - DNA, 22 bp, Homo sapiens
tctaggaacctgacatctctca

SEQ ID NO: 7008615 - DNA, 22 bp, Homo sapiens
gaccctgggatgcttgttttac

SEQ ID NO: 7008616 - DNA, 22 bp, Homo sapiens
tggccctgcagaactagcctgg

SEQ ID NO: 7008617 - DNA, 22 bp, Homo sapiens
aaaagtattttggatctcagat

SEQ ID NO: 7008618 - DNA, 22 bp, Homo sapiens
agatgagtgagagcatcaactt

SEQ ID NO: 7008619 - DNA, 22 bp, Homo sapiens
tgccaattagagacatccatct

SEQ ID NO: 7008620 - DNA, 22 bp, Homo sapiens
tttatatttcccaggattggcc

SEQ ID NO: 7008621 - DNA, 22 bp, Homo sapiens
ttatctggtatagtggggaaga

SEQ ID NO: 7008622 - DNA, 22 bp, Homo sapiens
ttctagattgcctgtaagtaaa

SEQ ID NO: 7008623 - DNA, 22 bp, Homo sapiens
ctggtgtctgctccctcacagc

SEQ ID NO: 7008624 - DNA, 23 bp, Homo sapiens
ccccactaccgtgatgtgcgagg

SEQ ID NO: 7008625 - DNA, 22 bp, Homo sapiens
tgatttacttctggataaatcc

SEQ ID NO: 7008626 - DNA, 22 bp, Homo sapiens
accagggctgacaatctgatgg

SEQ ID NO: 7008627 - DNA, 22 bp, Homo sapiens
gaggaacccagctggggttgcc

SEQ ID NO: 7008628 - DNA, 22 bp, Homo sapiens
gatcatagcgtcttcttgcagc

SEQ ID NO: 7008629 - DNA, 22 bp, Homo sapiens
gcttttctagctagaacatccg

SEQ ID NO: 7008630 - DNA, 20 bp, Homo sapiens
tttatctgtgggagtggaga

SEQ ID NO: 7008631 - DNA, 22 bp, Homo sapiens
cagggcagcttcctttgttagg

SEQ ID NO: 7008632 - DNA, 22 bp, Homo sapiens
tcttaggtgtatgtcattaggg

SEQ ID NO: 7008633 - DNA, 23 bp, Homo sapiens
tcagtaccacagctgcatgacct

SEQ ID NO: 7008634 - DNA, 22 bp, Homo sapiens
gtgcatggccagggtggtctgg

SEQ ID NO: 7008635 - DNA, 22 bp, Homo sapiens
gctgggtggatcggaggctctg

SEQ ID NO: 7008636 - DNA, 22 bp, Homo sapiens
ggaatttagatgtttctcaact

SEQ ID NO: 7008637 - DNA, 23 bp, Homo sapiens
ctgtatttgacttgagcggaaat

SEQ ID NO: 7008638 - DNA, 22 bp, Homo sapiens
tgcagagggagtgacggttcac

SEQ ID NO: 7008639 - DNA, 22 bp, Homo sapiens
ggctttaaggagtaaaaatgcc

SEQ ID NO: 7008640 - DNA, 22 bp, Homo sapiens
tgattccaaattcacatgcttt

SEQ ID NO: 7008641 - DNA, 22 bp, Homo sapiens
tcttccaggacctggggctcca

SEQ ID NO: 7008642 - DNA, 22 bp, Homo sapiens
tgattgaagtgttctgttccag

SEQ ID NO: 7008643 - DNA, 22 bp, Homo sapiens
ttcagctacccttggcttaata

SEQ ID NO: 7008644 - DNA, 22 bp, Homo sapiens
aagaatcatagagccactgata

SEQ ID NO: 7008645 - DNA, 22 bp, Homo sapiens
cacatcctgtgtaaacttggtg

SEQ ID NO: 7008646 - DNA, 22 bp, Homo sapiens
agctcctggacgaacagggagt

SEQ ID NO: 7008647 - DNA, 22 bp, Homo sapiens
ttgaagagtcgcttaacctgtg

SEQ ID NO: 7008648 - DNA, 22 bp, Homo sapiens
gagcagctgtggggttgaccat

SEQ ID NO: 7008649 - DNA, 22 bp, Homo sapiens
ctctgctgttcttatgtgtcct

SEQ ID NO: 7008650 - DNA, 22 bp, Homo sapiens
caccccagcttctcaggataga

SEQ ID NO: 7008651 - DNA, 22 bp, Homo sapiens
gtccctcactggaccatatgaa

SEQ ID NO: 7008652 - DNA, 22 bp, Homo sapiens
aaaaaattccattctgtgcctt

SEQ ID NO: 7008653 - DNA, 22 bp, Homo sapiens
aactttgtgtgtttaatatggc

SEQ ID NO: 7008654 - DNA, 22 bp, Homo sapiens
cagtctcatagttgtttcttat

SEQ ID NO: 7008655 - DNA, 22 bp, Homo sapiens
tggtagtcggcctcggtggctc

SEQ ID NO: 7008656 - DNA, 22 bp, Homo sapiens
gctcagagaagttgtgcctggc

SEQ ID NO: 7008657 - DNA, 22 bp, Homo sapiens
atgtgtattagttagtttaatg

SEQ ID NO: 7008658 - DNA, 22 bp, Homo sapiens
cttagcttcattattggtggcc

SEQ ID NO: 7008659 - DNA, 21 bp, Homo sapiens
accagcattccacactgtccc

SEQ ID NO: 7008660 - DNA, 22 bp, Homo sapiens
ttcctgtgcctcaggtctcagc

SEQ ID NO: 7008661 - DNA, 22 bp, Homo sapiens
gggctcggcatctgtggactct

SEQ ID NO: 7008662 - DNA, 22 bp, Homo sapiens
gagctgggagctgggatttgga

SEQ ID NO: 7008663 - DNA, 22 bp, Homo sapiens
agtgtcattttgtccatcttct

SEQ ID NO: 7008664 - DNA, 22 bp, Homo sapiens
agccacctctgtgcaggcctcg

SEQ ID NO: 7008665 - DNA, 22 bp, Homo sapiens
tgccagattgtggcatggcact

SEQ ID NO: 7008666 - DNA, 22 bp, Homo sapiens
tctacctggagtccgttgttaa

SEQ ID NO: 7008667 - DNA, 22 bp, Homo sapiens
aagcaaaacgtgctctaggagg

SEQ ID NO: 7008668 - DNA, 22 bp, Homo sapiens
ttcctgataatgagattttccc

SEQ ID NO: 7008669 - DNA, 22 bp, Homo sapiens
ggacagggatcattatctgagc

SEQ ID NO: 7008670 - DNA, 22 bp, Homo sapiens
gctgaagacaatggaattgact

SEQ ID NO: 7008671 - DNA, 22 bp, Homo sapiens
ccagaatttggatcatgatttt

SEQ ID NO: 7008672 - DNA, 22 bp, Homo sapiens
tgagtgccccctcctaccaaaa

SEQ ID NO: 7008673 - DNA, 22 bp, Homo sapiens
caaaagtctgtcctttaacttc

SEQ ID NO: 7008674 - DNA, 22 bp, Homo sapiens
gcacccacttaggccagtcaat

SEQ ID NO: 7008675 - DNA, 21 bp, Homo sapiens
tgagcacctactatgtgtcag

SEQ ID NO: 7008676 - DNA, 22 bp, Homo sapiens
tatggctgctgttttgctacaa

SEQ ID NO: 7008677 - DNA, 22 bp, Homo sapiens
ggaagagagatcccatagatgt

SEQ ID NO: 7008678 - DNA, 22 bp, Homo sapiens
ggcagcagggctgtctccctac

SEQ ID NO: 7008679 - DNA, 22 bp, Homo sapiens
tagtttatagttagcgagcacg

SEQ ID NO: 7008680 - DNA, 22 bp, Homo sapiens
ctgcctttgcccttgacactgt

SEQ ID NO: 7008681 - DNA, 22 bp, Homo sapiens
atctgtgtgttcaggaagtcct

SEQ ID NO: 7008682 - DNA, 22 bp, Homo sapiens
gagccctgtaggaatctctcaa

SEQ ID NO: 7008683 - DNA, 17 bp, Homo sapiens
tccaggagaggcaatgg

SEQ ID NO: 7008684 - DNA, 22 bp, Homo sapiens
tcttcacaaagctgttgttaaa

SEQ ID NO: 7008685 - DNA, 22 bp, Homo sapiens
attcctacgctgtcctccttct

SEQ ID NO: 7008686 - DNA, 22 bp, Homo sapiens
ggccagcatggcaagaccaact

SEQ ID NO: 7008687 - DNA, 22 bp, Homo sapiens
taagagattaaagatgtaattt

SEQ ID NO: 7008688 - DNA, 22 bp, Homo sapiens
ttctgatggtggaatgcttcag

SEQ ID NO: 7008689 - DNA, 22 bp, Homo sapiens
ggtattacttgggcccacgtta

SEQ ID NO: 7008690 - DNA, 22 bp, Homo sapiens
tgagggtgcatttagcatgtag

SEQ ID NO: 7008691 - DNA, 22 bp, Homo sapiens
aatgtctcttgagaggcgaaac

SEQ ID NO: 7008692 - DNA, 23 bp, Homo sapiens
aggattctgcttttcagaaataa

SEQ ID NO: 7008693 - DNA, 22 bp, Homo sapiens
gtatctgtggattttggtatcc

SEQ ID NO: 7008694 - DNA, 22 bp, Homo sapiens
aagtaaatatctgtagtcttta

SEQ ID NO: 7008695 - DNA, 22 bp, Homo sapiens
gtaacttatcatttcaatatag

SEQ ID NO: 7008696 - DNA, 20 bp, Homo sapiens
tatgtgcagtttggtttatc

SEQ ID NO: 7008697 - DNA, 22 bp, Homo sapiens
tctctccaacatggtggtgctg

SEQ ID NO: 7008698 - DNA, 22 bp, Homo sapiens
gcaggatggtggaaggcctgct

SEQ ID NO: 7008699 - DNA, 22 bp, Homo sapiens
gcagcctgaggccctttctggc

SEQ ID NO: 7008700 - DNA, 22 bp, Homo sapiens
gccattgagattgaagtaagca

SEQ ID NO: 7008701 - DNA, 22 bp, Homo sapiens
taaacatgtgagtgtgcatata

SEQ ID NO: 7008702 - DNA, 22 bp, Homo sapiens
atggctggaggccgggcttcct

SEQ ID NO: 7008703 - DNA, 22 bp, Homo sapiens
atcttctgatttatggagcaat

SEQ ID NO: 7008704 - DNA, 22 bp, Homo sapiens
tacaaatgagttgtatgaacca

SEQ ID NO: 7008705 - DNA, 22 bp, Homo sapiens
gcaggcttgggacgagctggag

SEQ ID NO: 7008706 - DNA, 22 bp, Homo sapiens
catgtgtaattgtaaaaggtaa

SEQ ID NO: 7008707 - DNA, 22 bp, Homo sapiens
agtgatggcatcgggtccagca

SEQ ID NO: 7008708 - DNA, 22 bp, Homo sapiens
cacagcacctaggtttgtggct

SEQ ID NO: 7008709 - DNA, 22 bp, Homo sapiens
ttgtcttattttatcataagca

SEQ ID NO: 7008710 - DNA, 22 bp, Homo sapiens
aggttaggaatttggacagaga

SEQ ID NO: 7008711 - DNA, 22 bp, Homo sapiens
gaaatacagaaagggctgaatg

SEQ ID NO: 7008712 - DNA, 22 bp, Homo sapiens
ctgcagttggctgagacccccc

SEQ ID NO: 7008713 - DNA, 22 bp, Homo sapiens
gactggagtcaatgagcagcac

SEQ ID NO: 7008714 - DNA, 22 bp, Homo sapiens
agctttagctccatttccttaa

SEQ ID NO: 7008715 - DNA, 22 bp, Homo sapiens
agatttcccactccatgtattg

SEQ ID NO: 7008716 - DNA, 22 bp, Homo sapiens
ttagtgtaaattgtgcttgaga

SEQ ID NO: 7008717 - DNA, 22 bp, Homo sapiens
ctgtgtatgactccagagggta

SEQ ID NO: 7008718 - DNA, 22 bp, Homo sapiens
gtgtcctgcacagcaccttgca

SEQ ID NO: 7008719 - DNA, 22 bp, Homo sapiens
caaaaagcttaggtaacaagcc

SEQ ID NO: 7008720 - DNA, 22 bp, Homo sapiens
caataagccaggtgtttgtgtt

SEQ ID NO: 7008721 - DNA, 22 bp, Homo sapiens
tgaaatgtctttgcaattgaaa

SEQ ID NO: 7008722 - DNA, 22 bp, Homo sapiens
aaagtacatgcaattcttctga

SEQ ID NO: 7008723 - DNA, 22 bp, Homo sapiens
attgcaggatacccaggtagag

SEQ ID NO: 7008724 - DNA, 22 bp, Homo sapiens
atggccagttagaaatcaaaaa

SEQ ID NO: 7008725 - DNA, 18 bp, Homo sapiens
tgtttattctcctgacag

SEQ ID NO: 7008726 - DNA, 22 bp, Homo sapiens
ccaggtccctggaatttatgag

SEQ ID NO: 7008727 - DNA, 22 bp, Homo sapiens
ccagtgtttacagttgaacaaa

SEQ ID NO: 7008728 - DNA, 18 bp, Homo sapiens
tgagaatatttatcccac

SEQ ID NO: 7008729 - DNA, 20 bp, Homo sapiens
cagttgaaataatttgtttg

SEQ ID NO: 7008730 - DNA, 22 bp, Homo sapiens
gtgtacacatcattcacatata

SEQ ID NO: 7008731 - DNA, 18 bp, Homo sapiens
ttctaaattctgttttta

SEQ ID NO: 7008732 - DNA, 22 bp, Homo sapiens
acctcagaacggcgttcttgaa

SEQ ID NO: 7008733 - DNA, 22 bp, Homo sapiens
tagctctttgtacaagtagatg

SEQ ID NO: 7008734 - DNA, 22 bp, Homo sapiens
agtgcaaagggctgttgagaag

SEQ ID NO: 7008735 - DNA, 22 bp, Homo sapiens
gtatataggaactctttaaaaa

SEQ ID NO: 7008736 - DNA, 23 bp, Homo sapiens
aataaggccaaactatctggtct

SEQ ID NO: 7008737 - DNA, 22 bp, Homo sapiens
tcttggctgcagagccggcaag

SEQ ID NO: 7008738 - DNA, 22 bp, Homo sapiens
tatgtgcacagagactgtagca

SEQ ID NO: 7008739 - DNA, 22 bp, Homo sapiens
acttgaaagaagtttccttaaa

SEQ ID NO: 7008740 - DNA, 22 bp, Homo sapiens
tcttgaaagcatgagatggaca

SEQ ID NO: 7008741 - DNA, 19 bp, Homo sapiens
ggcctctgcaggccgcccc

SEQ ID NO: 7008742 - DNA, 22 bp, Homo sapiens
ctacattttgtgattatgaaat

SEQ ID NO: 7008743 - DNA, 22 bp, Homo sapiens
gcccaagccggagctgggagag

SEQ ID NO: 7008744 - DNA, 22 bp, Homo sapiens
ttcctatgtgggcagagacaca

SEQ ID NO: 7008745 - DNA, 21 bp, Homo sapiens
ttcctggaggcagaaacgtga

SEQ ID NO: 7008746 - DNA, 22 bp, Homo sapiens
agtcacttccagctgtgtttca

SEQ ID NO: 7008747 - DNA, 22 bp, Homo sapiens
aggttagtatgacacggttata

SEQ ID NO: 7008748 - DNA, 22 bp, Homo sapiens
acctggcttccaatctaggagc

SEQ ID NO: 7008749 - DNA, 22 bp, Homo sapiens
ccagcacacagtgggtgcccag

SEQ ID NO: 7008750 - DNA, 21 bp, Homo sapiens
actttatgacctacccttttt

SEQ ID NO: 7008751 - DNA, 23 bp, Homo sapiens
ccagtctcacgtatacaggattt

SEQ ID NO: 7008752 - DNA, 22 bp, Homo sapiens
atgtggctagtggacacagtat

SEQ ID NO: 7008753 - DNA, 22 bp, Homo sapiens
aaaggtcttgtcttgacagagt

SEQ ID NO: 7008754 - DNA, 22 bp, Homo sapiens
ttaaagagtttattacttgtaa

SEQ ID NO: 7008755 - DNA, 22 bp, Homo sapiens
aggcaaaataagcctctcctgt

SEQ ID NO: 7008756 - DNA, 22 bp, Homo sapiens
tccaaggaagtcatttaaactg

SEQ ID NO: 7008757 - DNA, 22 bp, Homo sapiens
atgtagaattccttctactttg

SEQ ID NO: 7008758 - DNA, 22 bp, Homo sapiens
cagctagcggtgctggcggctc

SEQ ID NO: 7008759 - DNA, 22 bp, Homo sapiens
tactagtttctaccttacagaa

SEQ ID NO: 7008760 - DNA, 22 bp, Homo sapiens
gcagctgatggaagtcctattg

SEQ ID NO: 7008761 - DNA, 22 bp, Homo sapiens
ggagacttggcttggatgcttc

SEQ ID NO: 7008762 - DNA, 19 bp, Homo sapiens
ttcatgcccaatttgctac

SEQ ID NO: 7008763 - DNA, 22 bp, Homo sapiens
gagaatctctttgacaagcaga

SEQ ID NO: 7008764 - DNA, 22 bp, Homo sapiens
acaatgctccctgtagtcagga

SEQ ID NO: 7008765 - DNA, 22 bp, Homo sapiens
ccaggcaaggacatgaaactga

SEQ ID NO: 7008766 - DNA, 22 bp, Homo sapiens
tctggaagtgatgttcatagtg

SEQ ID NO: 7008767 - DNA, 22 bp, Homo sapiens
ttcatctgtacgccaagtactc

SEQ ID NO: 7008768 - DNA, 22 bp, Homo sapiens
tagcagcttaagtaattagaat

SEQ ID NO: 7008769 - DNA, 22 bp, Homo sapiens
tgcttcctgaggccgtcttctc

SEQ ID NO: 7008770 - DNA, 22 bp, Homo sapiens
tccatatacaacttaatcttta

SEQ ID NO: 7008771 - DNA, 22 bp, Homo sapiens
gcttctggggttctggcatgct

SEQ ID NO: 7008772 - DNA, 22 bp, Homo sapiens
tgacagggacagtggagatgga

SEQ ID NO: 7008773 - DNA, 22 bp, Homo sapiens
ttcccagaattgttgggaactg

SEQ ID NO: 7008774 - DNA, 22 bp, Homo sapiens
gctgtgggtaaacgctgagggt

SEQ ID NO: 7008775 - DNA, 22 bp, Homo sapiens
ggttcagtggaatgtgttgacc

SEQ ID NO: 7008776 - DNA, 22 bp, Homo sapiens
ttctttaaatgaattctctgta

SEQ ID NO: 7008777 - DNA, 22 bp, Homo sapiens
tgggagaaagaaccctgagtga

SEQ ID NO: 7008778 - DNA, 22 bp, Homo sapiens
tcaggaaactgtcaagtgggat

SEQ ID NO: 7008779 - DNA, 22 bp, Homo sapiens
agaggaaatggataaagggtga

SEQ ID NO: 7008780 - DNA, 22 bp, Homo sapiens
ccaggctaggaccgatttccct

SEQ ID NO: 7008781 - DNA, 22 bp, Homo sapiens
ggctctgcgcggtaaagtgact

SEQ ID NO: 7008782 - DNA, 22 bp, Homo sapiens
ctgatgctataagccacagtgg

SEQ ID NO: 7008783 - DNA, 22 bp, Homo sapiens
agtcaacatataacacctggca

SEQ ID NO: 7008784 - DNA, 22 bp, Homo sapiens
gagaaggcttccaaattctgtg

SEQ ID NO: 7008785 - DNA, 22 bp, Homo sapiens
tctcttgactgctaaaattaga

SEQ ID NO: 7008786 - DNA, 22 bp, Homo sapiens
attgagaaatataatctggaaa

SEQ ID NO: 7008787 - DNA, 22 bp, Homo sapiens
tctccctagggccgctggctaa

SEQ ID NO: 7008788 - DNA, 22 bp, Homo sapiens
gtgtgaaaatgtgcacaatatg

SEQ ID NO: 7008789 - DNA, 22 bp, Homo sapiens
gtcaggacaaggtggtctccag

SEQ ID NO: 7008790 - DNA, 19 bp, Homo sapiens
tctgtcatttcttctgtac

SEQ ID NO: 7008791 - DNA, 20 bp, Homo sapiens
gagggcacattgttccgtgc

SEQ ID NO: 7008792 - DNA, 22 bp, Homo sapiens
aaggcttgttgagtatctactg

SEQ ID NO: 7008793 - DNA, 22 bp, Homo sapiens
ttccttttagaatcatgaagac

SEQ ID NO: 7008794 - DNA, 22 bp, Homo sapiens
acaggtcaacgagagcaggcaa

SEQ ID NO: 7008795 - DNA, 22 bp, Homo sapiens
ctggctgggaagtagagtaggt

SEQ ID NO: 7008796 - DNA, 22 bp, Homo sapiens
ttaagatagaacccagtagtct

SEQ ID NO: 7008797 - DNA, 22 bp, Homo sapiens
aaggcttttaatgagttagaga

SEQ ID NO: 7008798 - DNA, 19 bp, Homo sapiens
ctctttggagatccttgga

SEQ ID NO: 7008799 - DNA, 22 bp, Homo sapiens
cagttaatgtcctatacaatag

SEQ ID NO: 7008800 - DNA, 22 bp, Homo sapiens
tgaagagtgcttgagattttaa

SEQ ID NO: 7008801 - DNA, 22 bp, Homo sapiens
ttctagggatggtaggtacaaa

SEQ ID NO: 7008802 - DNA, 22 bp, Homo sapiens
aggggctagaggtgccccagag

SEQ ID NO: 7008803 - DNA, 22 bp, Homo sapiens
gctgccagctttccttggctga

SEQ ID NO: 7008804 - DNA, 22 bp, Homo sapiens
caaggacactccctgctgggca

SEQ ID NO: 7008805 - DNA, 22 bp, Homo sapiens
cagtgtggctgagacagaggct

SEQ ID NO: 7008806 - DNA, 22 bp, Homo sapiens
tacacattagtcaagagtttga

SEQ ID NO: 7008807 - DNA, 22 bp, Homo sapiens
gcccctgggagcagagccacca

SEQ ID NO: 7008808 - DNA, 22 bp, Homo sapiens
aaatgcagattcatgagcccca

SEQ ID NO: 7008809 - DNA, 21 bp, Homo sapiens
taagttggcatgagtggctac

SEQ ID NO: 7008810 - DNA, 22 bp, Homo sapiens
tagcaggaataaaaatgtaccc

SEQ ID NO: 7008811 - DNA, 22 bp, Homo sapiens
tgctgctgacatttggggcttg

SEQ ID NO: 7008812 - DNA, 22 bp, Homo sapiens
gcagtgttttacagaccagcat

SEQ ID NO: 7008813 - DNA, 22 bp, Homo sapiens
tttgaaaggaagttaatacttt

SEQ ID NO: 7008814 - DNA, 22 bp, Homo sapiens
gttgggaatttattccttttct

SEQ ID NO: 7008815 - DNA, 22 bp, Homo sapiens
ctccccttccgccagctcttga

SEQ ID NO: 7008816 - DNA, 22 bp, Homo sapiens
agctggcttcacaggcagtgtg

SEQ ID NO: 7008817 - DNA, 22 bp, Homo sapiens
cagtagaattattataaaacat

SEQ ID NO: 7008818 - DNA, 22 bp, Homo sapiens
ggcttggaaatggtaatgagct

SEQ ID NO: 7008819 - DNA, 22 bp, Homo sapiens
actagaatgcaggattggtctc

SEQ ID NO: 7008820 - DNA, 22 bp, Homo sapiens
ggaggggtggaaggagtgcctg

SEQ ID NO: 7008821 - DNA, 22 bp, Homo sapiens
cctctgacttctctttattggc

SEQ ID NO: 7008822 - DNA, 22 bp, Homo sapiens
gctagggactagggaaggagca

SEQ ID NO: 7008823 - DNA, 22 bp, Homo sapiens
atgcacatgtggctttatgtat

SEQ ID NO: 7008824 - DNA, 22 bp, Homo sapiens
ggctggctccacctaggtagct

SEQ ID NO: 7008825 - DNA, 22 bp, Homo sapiens
ccaggcctgcatctgctgcgca

SEQ ID NO: 7008826 - DNA, 22 bp, Homo sapiens
tcttctctgtggcctggtggtg

SEQ ID NO: 7008827 - DNA, 22 bp, Homo sapiens
agctgggtcaataggaaatgta

SEQ ID NO: 7008828 - DNA, 22 bp, Homo sapiens
gactttggtttgagcaagtcag

SEQ ID NO: 7008829 - DNA, 22 bp, Homo sapiens
aaggtggttgtaggctggtctg

SEQ ID NO: 7008830 - DNA, 22 bp, Homo sapiens
ctctggaatgtttacatgccct

SEQ ID NO: 7008831 - DNA, 22 bp, Homo sapiens
gctgtgagggtctagtgaggtg

SEQ ID NO: 7008832 - DNA, 20 bp, Homo sapiens
ctggagtgtagcagtggctg

SEQ ID NO: 7008833 - DNA, 22 bp, Homo sapiens
ttctctatgtgtgttgtagttt

SEQ ID NO: 7008834 - DNA, 22 bp, Homo sapiens
tgatttccccagtcttgctgct

SEQ ID NO: 7008835 - DNA, 22 bp, Homo sapiens
agatgaaaatacgtgactttaa

SEQ ID NO: 7008836 - DNA, 22 bp, Homo sapiens
tcttgcagaggcactgtgtcag

SEQ ID NO: 7008837 - DNA, 22 bp, Homo sapiens
aattggttattctgtccttttt

SEQ ID NO: 7008838 - DNA, 22 bp, Homo sapiens
ctgtctgccctggccagagccc

SEQ ID NO: 7008839 - DNA, 23 bp, Homo sapiens
tagtgtatatcaacatttgtccc

SEQ ID NO: 7008840 - DNA, 22 bp, Homo sapiens
ctgcttccataaataatgtgct

SEQ ID NO: 7008841 - DNA, 22 bp, Homo sapiens
agatactgattctcaatggctc

SEQ ID NO: 7008842 - DNA, 22 bp, Homo sapiens
acaggacaactcagcagccagc

SEQ ID NO: 7008843 - DNA, 22 bp, Homo sapiens
atcctaaaattgttcaatttct

SEQ ID NO: 7008844 - DNA, 22 bp, Homo sapiens
tttcagtgcttctgtttaccgg

SEQ ID NO: 7008845 - DNA, 22 bp, Homo sapiens
agatcatttggcagaagcaacg

SEQ ID NO: 7008846 - DNA, 23 bp, Homo sapiens
ctgcatgcttgaggtcaggtgtg

SEQ ID NO: 7008847 - DNA, 22 bp, Homo sapiens
tgccctggaggggcttacagtc

SEQ ID NO: 7008848 - DNA, 21 bp, Homo sapiens
tcttggcctaagttcactgaa

SEQ ID NO: 7008849 - DNA, 22 bp, Homo sapiens
ttgcttgactttgtgtacctgt

SEQ ID NO: 7008850 - DNA, 22 bp, Homo sapiens
cctgccctgtgtttggggacta

SEQ ID NO: 7008851 - DNA, 22 bp, Homo sapiens
atgagagactgtgtgttgggag

SEQ ID NO: 7008852 - DNA, 22 bp, Homo sapiens
ccagagagtcgatgggggacac

SEQ ID NO: 7008853 - DNA, 23 bp, Homo sapiens
aaagagactgatacggaagttcc

SEQ ID NO: 7008854 - DNA, 22 bp, Homo sapiens
acatgtcttttaaagtctaata

SEQ ID NO: 7008855 - DNA, 19 bp, Homo sapiens
agtttattataggtgattc

SEQ ID NO: 7008856 - DNA, 22 bp, Homo sapiens
atcagaatcttctgaacagtgg

SEQ ID NO: 7008857 - DNA, 22 bp, Homo sapiens
attaaattagcaaactgtgaaa

SEQ ID NO: 7008858 - DNA, 22 bp, Homo sapiens
tagaaaagtatgggactgacat

SEQ ID NO: 7008859 - DNA, 22 bp, Homo sapiens
cttgagaagagatttatatttg

SEQ ID NO: 7008860 - DNA, 22 bp, Homo sapiens
ttagttaaaagataattttgga

SEQ ID NO: 7008861 - DNA, 22 bp, Homo sapiens
gtgatacaggatggtgataaat

SEQ ID NO: 7008862 - DNA, 22 bp, Homo sapiens
agctaaggagcaagtaggagtt

SEQ ID NO: 7008863 - DNA, 22 bp, Homo sapiens
cagggccttgttcaggagtgaa

SEQ ID NO: 7008864 - DNA, 22 bp, Homo sapiens
gtgctaaagggttatgaacaag

SEQ ID NO: 7008865 - DNA, 22 bp, Homo sapiens
ggacctggaagtttggtgatcc

SEQ ID NO: 7008866 - DNA, 22 bp, Homo sapiens
gtaaactgaattggatactgtg

SEQ ID NO: 7008867 - DNA, 22 bp, Homo sapiens
cagctctgtgcaggcctgggga

SEQ ID NO: 7008868 - DNA, 22 bp, Homo sapiens
tactggcatttagtgggcagaa

SEQ ID NO: 7008869 - DNA, 22 bp, Homo sapiens
atatgcataccctcaccaacta

SEQ ID NO: 7008870 - DNA, 17 bp, Homo sapiens
tttaaactactacaagg

SEQ ID NO: 7008871 - DNA, 22 bp, Homo sapiens
tttaacacccaggtagttctga

SEQ ID NO: 7008872 - DNA, 22 bp, Homo sapiens
catccgttaataaaaagacagt

SEQ ID NO: 7008873 - DNA, 22 bp, Homo sapiens
tcatttactgtaggagtgaacc

SEQ ID NO: 7008874 - DNA, 22 bp, Homo sapiens
attgtgagctcaagagtaccca

SEQ ID NO: 7008875 - DNA, 22 bp, Homo sapiens
tcctcctcacgctgttgcttgt

SEQ ID NO: 7008876 - DNA, 22 bp, Homo sapiens
ctcgtgatccgcccacctcagc

SEQ ID NO: 7008877 - DNA, 22 bp, Homo sapiens
gccccagcctcccgagtagctg

SEQ ID NO: 7008878 - DNA, 22 bp, Homo sapiens
aagccagccagtgccagtctta

SEQ ID NO: 7008879 - DNA, 18 bp, Homo sapiens
ctttgcagttacagggca

SEQ ID NO: 7008880 - DNA, 22 bp, Homo sapiens
gtttctcacttaccaacacatg

SEQ ID NO: 7008881 - DNA, 22 bp, Homo sapiens
gcaggctagagaattgagttgt

SEQ ID NO: 7008882 - DNA, 19 bp, Homo sapiens
tgcaggaggactgagcaga

SEQ ID NO: 7008883 - DNA, 22 bp, Homo sapiens
gcgggttgaagggcgcatcgaa

SEQ ID NO: 7008884 - DNA, 22 bp, Homo sapiens
gctcagctgcacctggagagcc

SEQ ID NO: 7008885 - DNA, 21 bp, Homo sapiens
accatcttccatgcattatat

SEQ ID NO: 7008886 - DNA, 22 bp, Homo sapiens
tcagaggtgagcttcttgctaa

SEQ ID NO: 7008887 - DNA, 22 bp, Homo sapiens
acgggctgggacggggaagctc

SEQ ID NO: 7008888 - DNA, 22 bp, Homo sapiens
tctgcagcttactttcacatga

SEQ ID NO: 7008889 - DNA, 22 bp, Homo sapiens
gaccaggaaagagtgtgactaa

SEQ ID NO: 7008890 - DNA, 22 bp, Homo sapiens
acacatctctctttgaggagtg

SEQ ID NO: 7008891 - DNA, 22 bp, Homo sapiens
gaaggcaggcttctgattaggt

SEQ ID NO: 7008892 - DNA, 22 bp, Homo sapiens
tcctgcctaccttgcggaggtg

SEQ ID NO: 7008893 - DNA, 22 bp, Homo sapiens
tcacccttgataatgttcttct

SEQ ID NO: 7008894 - DNA, 22 bp, Homo sapiens
attggcaatgtcccggctgctg

SEQ ID NO: 7008895 - DNA, 22 bp, Homo sapiens
aggtgccactctcatgggctac

SEQ ID NO: 7008896 - DNA, 22 bp, Homo sapiens
cctctgtacaggtcagcatcta

SEQ ID NO: 7008897 - DNA, 22 bp, Homo sapiens
acttgtctatggttacatccta

SEQ ID NO: 7008898 - DNA, 22 bp, Homo sapiens
atgtatgaagctttgtttggga

SEQ ID NO: 7008899 - DNA, 22 bp, Homo sapiens
tgcttgcttgaggcgagacatt

SEQ ID NO: 7008900 - DNA, 22 bp, Homo sapiens
cttgatttattacccactatat

SEQ ID NO: 7008901 - DNA, 22 bp, Homo sapiens
ttccgctgtttagttgaagttt

SEQ ID NO: 7008902 - DNA, 22 bp, Homo sapiens
tttacttcatttccagtgagga

SEQ ID NO: 7008903 - DNA, 22 bp, Homo sapiens
cctgggcaaatgccagagacaa

SEQ ID NO: 7008904 - DNA, 22 bp, Homo sapiens
gtctaataactttcagtcattt

SEQ ID NO: 7008905 - DNA, 22 bp, Homo sapiens
cctggcacctgtgttttctgga

SEQ ID NO: 7008906 - DNA, 22 bp, Homo sapiens
ttcagtgcagtcggaactactg

SEQ ID NO: 7008907 - DNA, 22 bp, Homo sapiens
cattttaagatgacctggtttc

SEQ ID NO: 7008908 - DNA, 22 bp, Homo sapiens
taacaggatgacagcagacatt

SEQ ID NO: 7008909 - DNA, 22 bp, Homo sapiens
cagggcctttcagggtaaaagg

SEQ ID NO: 7008910 - DNA, 22 bp, Homo sapiens
cttagtagaacgtggatgggaa

SEQ ID NO: 7008911 - DNA, 22 bp, Homo sapiens
caacatttgagtaaagaaatgg

SEQ ID NO: 7008912 - DNA, 19 bp, Homo sapiens
gggagccagaccctttgct

SEQ ID NO: 7008913 - DNA, 22 bp, Homo sapiens
gggatcttgggaacacccttac

SEQ ID NO: 7008914 - DNA, 22 bp, Homo sapiens
aagatttactagcataatagct

SEQ ID NO: 7008915 - DNA, 22 bp, Homo sapiens
gctgcatgacagacaggcctgg

SEQ ID NO: 7008916 - DNA, 22 bp, Homo sapiens
tcagctcatctgagtgtcagcg

SEQ ID NO: 7008917 - DNA, 22 bp, Homo sapiens
ttctgaaaccttcagtatgaag

SEQ ID NO: 7008918 - DNA, 22 bp, Homo sapiens
tgtccagctcgagacactatct

SEQ ID NO: 7008919 - DNA, 22 bp, Homo sapiens
ggtcgtctcagtctgactgaag

SEQ ID NO: 7008920 - DNA, 22 bp, Homo sapiens
gattaacatttctaagatgcca

SEQ ID NO: 7008921 - DNA, 22 bp, Homo sapiens
ctctggaagtgatggcaggtca

SEQ ID NO: 7008922 - DNA, 22 bp, Homo sapiens
atgtggctgtggacacctttca

SEQ ID NO: 7008923 - DNA, 23 bp, Homo sapiens
agctgggtggcctgcgtgaagct

SEQ ID NO: 7008924 - DNA, 22 bp, Homo sapiens
actgtgcatctattgccattta

SEQ ID NO: 7008925 - DNA, 22 bp, Homo sapiens
gttgccaggggctgctgtcacc

SEQ ID NO: 7008926 - DNA, 22 bp, Homo sapiens
actcccactccagagtagaagc

SEQ ID NO: 7008927 - DNA, 19 bp, Homo sapiens
actgcactccagcctgggt

SEQ ID NO: 7008928 - DNA, 22 bp, Homo sapiens
atttggaagtttttgtgggaat

SEQ ID NO: 7008929 - DNA, 22 bp, Homo sapiens
tctgcagagcattatagcaaaa

SEQ ID NO: 7008930 - DNA, 22 bp, Homo sapiens
atgggcatgcttctagttgaaa

SEQ ID NO: 7008931 - DNA, 22 bp, Homo sapiens
agatttcaatggatattgcaag

SEQ ID NO: 7008932 - DNA, 22 bp, Homo sapiens
gtattagctggataaagtaggt

SEQ ID NO: 7008933 - DNA, 22 bp, Homo sapiens
accctgggtctcaatcatccta

SEQ ID NO: 7008934 - DNA, 22 bp, Homo sapiens
ccaggggcctgtgaaggtgccc

SEQ ID NO: 7008935 - DNA, 22 bp, Homo sapiens
gtgtccatctctgtatgctgct

SEQ ID NO: 7008936 - DNA, 22 bp, Homo sapiens
ggcgccccatatagttcttaat

SEQ ID NO: 7008937 - DNA, 22 bp, Homo sapiens
tcaagaatttggataagaaatg

SEQ ID NO: 7008938 - DNA, 22 bp, Homo sapiens
acatcgatggatagagcttgct

SEQ ID NO: 7008939 - DNA, 22 bp, Homo sapiens
gtttggatagtgagagatactt

SEQ ID NO: 7008940 - DNA, 23 bp, Homo sapiens
tggccaggcataaaggtgggtgg

SEQ ID NO: 7008941 - DNA, 22 bp, Homo sapiens
aaatgcttagaggtgttcaaat

SEQ ID NO: 7008942 - DNA, 22 bp, Homo sapiens
tcatgattcttctaccacagca

SEQ ID NO: 7008943 - DNA, 22 bp, Homo sapiens
acaggggcaggcaggacccttt

SEQ ID NO: 7008944 - DNA, 19 bp, Homo sapiens
acaagtcacttacttagta

SEQ ID NO: 7008945 - DNA, 22 bp, Homo sapiens
tggtcaaaaactctcagtggac

SEQ ID NO: 7008946 - DNA, 22 bp, Homo sapiens
ctcctccctgggaggctggcat

SEQ ID NO: 7008947 - DNA, 22 bp, Homo sapiens
actcctcagttgcttcttagtt

SEQ ID NO: 7008948 - DNA, 22 bp, Homo sapiens
gtggcatttactctgactgaaa

SEQ ID NO: 7008949 - DNA, 22 bp, Homo sapiens
gacagccaactggggagggcat

SEQ ID NO: 7008950 - DNA, 22 bp, Homo sapiens
agatttagcaaatcttactagc

SEQ ID NO: 7008951 - DNA, 18 bp, Homo sapiens
gttcatctttttctaaag

SEQ ID NO: 7008952 - DNA, 22 bp, Homo sapiens
gcttcctcgctgggcagaggca

SEQ ID NO: 7008953 - DNA, 22 bp, Homo sapiens
tttcagagagatcaacatagct

SEQ ID NO: 7008954 - DNA, 22 bp, Homo sapiens
gcagatggactgtatgacctga

SEQ ID NO: 7008955 - DNA, 22 bp, Homo sapiens
gtcagcagggctccctggcagg

SEQ ID NO: 7008956 - DNA, 22 bp, Homo sapiens
acactttagaaaaaagaatggt

SEQ ID NO: 7008957 - DNA, 22 bp, Homo sapiens
cttattgtcttacagtaataga

SEQ ID NO: 7008958 - DNA, 22 bp, Homo sapiens
aagatttggtatcagaagacct

SEQ ID NO: 7008959 - DNA, 22 bp, Homo sapiens
ggcccctgcggactgcctagag

SEQ ID NO: 7008960 - DNA, 22 bp, Homo sapiens
ctaggaaatgaatacagtacac

SEQ ID NO: 7008961 - DNA, 19 bp, Homo sapiens
agctctttgctgcattcca

SEQ ID NO: 7008962 - DNA, 22 bp, Homo sapiens
ttttggtgcacctagctttttc

SEQ ID NO: 7008963 - DNA, 22 bp, Homo sapiens
agggctgtaccatcaggttcct

SEQ ID NO: 7008964 - DNA, 22 bp, Homo sapiens
actgggcattttgaacgttctt

SEQ ID NO: 7008965 - DNA, 22 bp, Homo sapiens
catttacagcagactgatgaaa

SEQ ID NO: 7008966 - DNA, 22 bp, Homo sapiens
tcaggcctgagaaaaatccttt

SEQ ID NO: 7008967 - DNA, 22 bp, Homo sapiens
tagtgtatgttcagcttatatg

SEQ ID NO: 7008968 - DNA, 22 bp, Homo sapiens
aaaatgagatacagtttgaaag

SEQ ID NO: 7008969 - DNA, 22 bp, Homo sapiens
gctggctgtatcacctggccag

SEQ ID NO: 7008970 - DNA, 22 bp, Homo sapiens
tgttacattggagttgtttaga

SEQ ID NO: 7008971 - DNA, 22 bp, Homo sapiens
tttgagtgcccatgtttcccag

SEQ ID NO: 7008972 - DNA, 22 bp, Homo sapiens
gcgcgcggggcatcagtggccg

SEQ ID NO: 7008973 - DNA, 22 bp, Homo sapiens
gccctggggaaggtgtctccaa

SEQ ID NO: 7008974 - DNA, 22 bp, Homo sapiens
aagctcctttggctcgagatct

SEQ ID NO: 7008975 - DNA, 22 bp, Homo sapiens
atccccttatcccaggctgagc

SEQ ID NO: 7008976 - DNA, 23 bp, Homo sapiens
cctctctttttaggtggtgtttg

SEQ ID NO: 7008977 - DNA, 20 bp, Homo sapiens
ttacaaggtagaggagggaa

SEQ ID NO: 7008978 - DNA, 22 bp, Homo sapiens
actctgaattaattgctctcaa

SEQ ID NO: 7008979 - DNA, 22 bp, Homo sapiens
aagataaactcttgatttctga

SEQ ID NO: 7008980 - DNA, 22 bp, Homo sapiens
aggaaagtgaatgttattttgc

SEQ ID NO: 7008981 - DNA, 22 bp, Homo sapiens
tcaggtgtgggcagagaaacca

SEQ ID NO: 7008982 - DNA, 19 bp, Homo sapiens
cttcagggaggggccaggc

SEQ ID NO: 7008983 - DNA, 22 bp, Homo sapiens
tctgctgatgtgtggtgcttca

SEQ ID NO: 7008984 - DNA, 22 bp, Homo sapiens
tttcttccttaccttactagag

SEQ ID NO: 7008985 - DNA, 22 bp, Homo sapiens
tagcagggttttgaagagggtt

SEQ ID NO: 7008986 - DNA, 20 bp, Homo sapiens
actgttcaagggcctggtgg

SEQ ID NO: 7008987 - DNA, 22 bp, Homo sapiens
agctgtctacctgcagagtcct

SEQ ID NO: 7008988 - DNA, 22 bp, Homo sapiens
agcttacagttcaatgacaaag

SEQ ID NO: 7008989 - DNA, 22 bp, Homo sapiens
ttgcttcatcagagtaaacaag

SEQ ID NO: 7008990 - DNA, 22 bp, Homo sapiens
tgtacttgaacttgactgtaga

SEQ ID NO: 7008991 - DNA, 22 bp, Homo sapiens
tcaattctgcctctaaatattt

SEQ ID NO: 7008992 - DNA, 22 bp, Homo sapiens
tgtgggcagatacacagacacg

SEQ ID NO: 7008993 - DNA, 22 bp, Homo sapiens
atccattttttcagaatgctct

SEQ ID NO: 7008994 - DNA, 18 bp, Homo sapiens
tcagagcaaacagaagcc

SEQ ID NO: 7008995 - DNA, 22 bp, Homo sapiens
tctagggaggcaatagcaatgt

SEQ ID NO: 7008996 - DNA, 22 bp, Homo sapiens
gggaatgtgaaacagtaaggga

SEQ ID NO: 7008997 - DNA, 22 bp, Homo sapiens
agcaagattgaggcttcctcag

SEQ ID NO: 7008998 - DNA, 22 bp, Homo sapiens
ttagccatgtgggaaaaacagc

SEQ ID NO: 7008999 - DNA, 22 bp, Homo sapiens
gtagggagcccagagcccagtg

SEQ ID NO: 7009000 - DNA, 22 bp, Homo sapiens
ttatgtttgagtatatgactca

SEQ ID NO: 7009001 - DNA, 22 bp, Homo sapiens
gggagaagaatgtgtcaattgt

SEQ ID NO: 7009002 - DNA, 22 bp, Homo sapiens
aggatagttgtgaagataggct

SEQ ID NO: 7009003 - DNA, 22 bp, Homo sapiens
ggggtaggcaggtgatctgatc

SEQ ID NO: 7009004 - DNA, 22 bp, Homo sapiens
atagaacataattctcagccct

SEQ ID NO: 7009005 - DNA, 23 bp, Homo sapiens
gtgttactaaagatgaacattta

SEQ ID NO: 7009006 - DNA, 22 bp, Homo sapiens
tgagtaggatagggtggggctt

SEQ ID NO: 7009007 - DNA, 22 bp, Homo sapiens
acacagggcggaaagcatgaga

SEQ ID NO: 7009008 - DNA, 22 bp, Homo sapiens
gccagcaagggtccactgtcac

SEQ ID NO: 7009009 - DNA, 20 bp, Homo sapiens
ctcagctcttcagggcaagt

SEQ ID NO: 7009010 - DNA, 22 bp, Homo sapiens
cttgtatacagtgtacacattg

SEQ ID NO: 7009011 - DNA, 22 bp, Homo sapiens
agcgggtctgcaagccttccct

SEQ ID NO: 7009012 - DNA, 17 bp, Homo sapiens
ttccaaggagcatttga

SEQ ID NO: 7009013 - DNA, 22 bp, Homo sapiens
tgaatccagagctatttcgtcc

SEQ ID NO: 7009014 - DNA, 22 bp, Homo sapiens
agcagtgattctcttggactca

SEQ ID NO: 7009015 - DNA, 22 bp, Homo sapiens
ttggtcatgcataatgtatctg

SEQ ID NO: 7009016 - DNA, 22 bp, Homo sapiens
tctatagtgtagataatttgaa

SEQ ID NO: 7009017 - DNA, 21 bp, Homo sapiens
taacaaagacttctggtcagg

SEQ ID NO: 7009018 - DNA, 22 bp, Homo sapiens
gcaagctgcttaagctcattgt

SEQ ID NO: 7009019 - DNA, 22 bp, Homo sapiens
ttggccctagatgattaagttg

SEQ ID NO: 7009020 - DNA, 20 bp, Homo sapiens
agtgttccggaagactggca

SEQ ID NO: 7009021 - DNA, 22 bp, Homo sapiens
ctgaggcactgtcagctgaggc

SEQ ID NO: 7009022 - DNA, 22 bp, Homo sapiens
tagacagaatccagcccacgcc

SEQ ID NO: 7009023 - DNA, 22 bp, Homo sapiens
tttctcccaactctggaagcca

SEQ ID NO: 7009024 - DNA, 22 bp, Homo sapiens
tcatgcccagagcagtaaatta

SEQ ID NO: 7009025 - DNA, 22 bp, Homo sapiens
ggaggcatctctgtggctgtct

SEQ ID NO: 7009026 - DNA, 22 bp, Homo sapiens
gatcctgttagaaatgtagact

SEQ ID NO: 7009027 - DNA, 19 bp, Homo sapiens
aggatggagcaggcggtga

SEQ ID NO: 7009028 - DNA, 18 bp, Homo sapiens
agctccatctgtcagcat

SEQ ID NO: 7009029 - DNA, 20 bp, Homo sapiens
acatggatcaaatgtcagtt

SEQ ID NO: 7009030 - DNA, 22 bp, Homo sapiens
gtgcacccccaaggaggtggag

SEQ ID NO: 7009031 - DNA, 22 bp, Homo sapiens
taagcaaaagtcgagtgtgagc

SEQ ID NO: 7009032 - DNA, 22 bp, Homo sapiens
gagctgagtatgaaggatgtga

SEQ ID NO: 7009033 - DNA, 22 bp, Homo sapiens
ttcctggggtactggagaaaat

SEQ ID NO: 7009034 - DNA, 22 bp, Homo sapiens
atcaacatgacaggagaagaga

SEQ ID NO: 7009035 - DNA, 22 bp, Homo sapiens
catagttcctacctaagcataa

SEQ ID NO: 7009036 - DNA, 22 bp, Homo sapiens
aacacattggaagccaagaatg

SEQ ID NO: 7009037 - DNA, 22 bp, Homo sapiens
aagagcaggctgctgtggagta

SEQ ID NO: 7009038 - DNA, 18 bp, Homo sapiens
tcagcccagagcccagtt

SEQ ID NO: 7009039 - DNA, 22 bp, Homo sapiens
aggccctgacctgggagatcta

SEQ ID NO: 7009040 - DNA, 22 bp, Homo sapiens
tccactgacaggtgaatggata

SEQ ID NO: 7009041 - DNA, 22 bp, Homo sapiens
ctgaggcttggaggggtctggt

SEQ ID NO: 7009042 - DNA, 22 bp, Homo sapiens
tgcctgctttctgggctgccat

SEQ ID NO: 7009043 - DNA, 17 bp, Homo sapiens
ggccccggagcctgaca

SEQ ID NO: 7009044 - DNA, 22 bp, Homo sapiens
caaatatctttggcaaagagaa

SEQ ID NO: 7009045 - DNA, 22 bp, Homo sapiens
gcagaattttctgttttctaga

SEQ ID NO: 7009046 - DNA, 22 bp, Homo sapiens
ctttgtgctttgaatgatagct

SEQ ID NO: 7009047 - DNA, 22 bp, Homo sapiens
tctcagggaggttccccgttct

SEQ ID NO: 7009048 - DNA, 22 bp, Homo sapiens
ttgtagcgttagcagtgtggag

SEQ ID NO: 7009049 - DNA, 22 bp, Homo sapiens
ccaatagctactgagtagtgta

SEQ ID NO: 7009050 - DNA, 23 bp, Homo sapiens
tcagtactctgctgggtatagag

SEQ ID NO: 7009051 - DNA, 22 bp, Homo sapiens
gtttgaaaaaagcagtatgtaa

SEQ ID NO: 7009052 - DNA, 22 bp, Homo sapiens
cttgggctcagcaccgtgtgga

SEQ ID NO: 7009053 - DNA, 22 bp, Homo sapiens
ggggcagtgaggtggcagcccg

SEQ ID NO: 7009054 - DNA, 22 bp, Homo sapiens
tggtcaaggcttggagatagta

SEQ ID NO: 7009055 - DNA, 22 bp, Homo sapiens
tttagcaaactttggagtttgt

SEQ ID NO: 7009056 - DNA, 22 bp, Homo sapiens
ctgtggacaggggcgcagaggt

SEQ ID NO: 7009057 - DNA, 22 bp, Homo sapiens
cggccttctccctgggcatcac

SEQ ID NO: 7009058 - DNA, 22 bp, Homo sapiens
gtctttattacaaatccttttc

SEQ ID NO: 7009059 - DNA, 22 bp, Homo sapiens
tgtgcacaatgtgcaggtttgt

SEQ ID NO: 7009060 - DNA, 22 bp, Homo sapiens
agcagtttatcctcataatgga

SEQ ID NO: 7009061 - DNA, 22 bp, Homo sapiens
agatgctttttaggtattacct

SEQ ID NO: 7009062 - DNA, 22 bp, Homo sapiens
gacaggctttgagtcccagaac

SEQ ID NO: 7009063 - DNA, 22 bp, Homo sapiens
attctactgcaaatcctgacca

SEQ ID NO: 7009064 - DNA, 17 bp, Homo sapiens
gcagtggaggggtagtt

SEQ ID NO: 7009065 - DNA, 22 bp, Homo sapiens
agggcagcagctgtccctgaga

SEQ ID NO: 7009066 - DNA, 22 bp, Homo sapiens
caggatgatgagtagagtgtga

SEQ ID NO: 7009067 - DNA, 22 bp, Homo sapiens
ttataacatcaatcagagttaa

SEQ ID NO: 7009068 - DNA, 22 bp, Homo sapiens
cagtacttggggggttctaagt

SEQ ID NO: 7009069 - DNA, 22 bp, Homo sapiens
tggctttctcacagaccacctc

SEQ ID NO: 7009070 - DNA, 22 bp, Homo sapiens
ttctgctccaccacttccagca

SEQ ID NO: 7009071 - DNA, 22 bp, Homo sapiens
gtgtgtgttcaataaatttaag

SEQ ID NO: 7009072 - DNA, 22 bp, Homo sapiens
tgcaggaagacttcccaagcca

SEQ ID NO: 7009073 - DNA, 22 bp, Homo sapiens
agtttgatggcttaatagtaga

SEQ ID NO: 7009074 - DNA, 22 bp, Homo sapiens
gcacttgataaatgttaactga

SEQ ID NO: 7009075 - DNA, 19 bp, Homo sapiens
gggcatgctggctctagag

SEQ ID NO: 7009076 - DNA, 22 bp, Homo sapiens
gtggcactgtttcccacggaag

SEQ ID NO: 7009077 - DNA, 22 bp, Homo sapiens
ggcctggcctccagatgtgggc

SEQ ID NO: 7009078 - DNA, 22 bp, Homo sapiens
gacagggcaagactctgtctaa

SEQ ID NO: 7009079 - DNA, 20 bp, Homo sapiens
tttcaggctggctatctttg

SEQ ID NO: 7009080 - DNA, 22 bp, Homo sapiens
ttggtccattacattgatgaca

SEQ ID NO: 7009081 - DNA, 23 bp, Homo sapiens
taagaacagacaagcatttacat

SEQ ID NO: 7009082 - DNA, 22 bp, Homo sapiens
tgtagtaagtgcgcaataaata

SEQ ID NO: 7009083 - DNA, 22 bp, Homo sapiens
tttcagattatctcaactttgg

SEQ ID NO: 7009084 - DNA, 22 bp, Homo sapiens
tccttagcacccaccaaggact

SEQ ID NO: 7009085 - DNA, 22 bp, Homo sapiens
caataattgctttccagagtta

SEQ ID NO: 7009086 - DNA, 22 bp, Homo sapiens
ttggctaacctgggttatcagc

SEQ ID NO: 7009087 - DNA, 22 bp, Homo sapiens
ggcaggaagcattaaaacgatt

SEQ ID NO: 7009088 - DNA, 22 bp, Homo sapiens
ggattttagagtacctaagtgt

SEQ ID NO: 7009089 - DNA, 22 bp, Homo sapiens
tcctcacagtcaacactttgag

SEQ ID NO: 7009090 - DNA, 22 bp, Homo sapiens
gagggtccctgctcagggccag

SEQ ID NO: 7009091 - DNA, 22 bp, Homo sapiens
gctgcctgtctgctgacccagg

SEQ ID NO: 7009092 - DNA, 20 bp, Homo sapiens
aggatgcagggagtctgcag

SEQ ID NO: 7009093 - DNA, 22 bp, Homo sapiens
agttagtggcaaagtggtttga

SEQ ID NO: 7009094 - DNA, 22 bp, Homo sapiens
cagtatttggaatatagctaag

SEQ ID NO: 7009095 - DNA, 22 bp, Homo sapiens
ctgtcctccagacgacagtccc

SEQ ID NO: 7009096 - DNA, 22 bp, Homo sapiens
aggtcagtgtagtggtttgggc

SEQ ID NO: 7009097 - DNA, 22 bp, Homo sapiens
agggaaactagactgcctttct

SEQ ID NO: 7009098 - DNA, 22 bp, Homo sapiens
aagtttcaagaggttctttgaa

SEQ ID NO: 7009099 - DNA, 19 bp, Homo sapiens
attgctcaccatggggctt

SEQ ID NO: 7009100 - DNA, 22 bp, Homo sapiens
caggaacacctgcagctagtgg

SEQ ID NO: 7009101 - DNA, 22 bp, Homo sapiens
gtggttttggaggccactgttt

SEQ ID NO: 7009102 - DNA, 22 bp, Homo sapiens
actttagatattcctctgtaca

SEQ ID NO: 7009103 - DNA, 22 bp, Homo sapiens
cctgggctggagtacagcagtg

SEQ ID NO: 7009104 - DNA, 22 bp, Homo sapiens
gtgttctaatggctgagggatg

SEQ ID NO: 7009105 - DNA, 22 bp, Homo sapiens
ctgctttgactgttaagaacca

SEQ ID NO: 7009106 - DNA, 22 bp, Homo sapiens
tctgcaaacttaagttgaaata

SEQ ID NO: 7009107 - DNA, 22 bp, Homo sapiens
tagaagttaggaaataggaata

SEQ ID NO: 7009108 - DNA, 22 bp, Homo sapiens
agagctgtcagcgttttggcca

SEQ ID NO: 7009109 - DNA, 22 bp, Homo sapiens
acagctgtatccccagagctca

SEQ ID NO: 7009110 - DNA, 22 bp, Homo sapiens
tctgcagaagctcactaaatcc

SEQ ID NO: 7009111 - DNA, 22 bp, Homo sapiens
aacccaggacagagctttgtgg

SEQ ID NO: 7009112 - DNA, 22 bp, Homo sapiens
ggaagaacaggtttattttcct

SEQ ID NO: 7009113 - DNA, 15 bp, Homo sapiens
gggcaggtctggggc

SEQ ID NO: 7009114 - DNA, 20 bp, Homo sapiens
ctaaccttaaccatcaccag

SEQ ID NO: 7009115 - DNA, 22 bp, Homo sapiens
agctacttccctgtaggaaaca

SEQ ID NO: 7009116 - DNA, 22 bp, Homo sapiens
aaactcagacacagtatctgtt

SEQ ID NO: 7009117 - DNA, 22 bp, Homo sapiens
agtggccagtgctgctctgggg

SEQ ID NO: 7009118 - DNA, 22 bp, Homo sapiens
atgaatgccacgatttcatcct

SEQ ID NO: 7009119 - DNA, 22 bp, Homo sapiens
gagtctgagagcctaatgacct

SEQ ID NO: 7009120 - DNA, 21 bp, Homo sapiens
cctttagatttctatgcagtt

SEQ ID NO: 7009121 - DNA, 22 bp, Homo sapiens
gtggatggtggtccagtatcat

SEQ ID NO: 7009122 - DNA, 21 bp, Homo sapiens
tacagtctcccctgttgtcca

SEQ ID NO: 7009123 - DNA, 22 bp, Homo sapiens
acagttgttttccagatatgtt

SEQ ID NO: 7009124 - DNA, 22 bp, Homo sapiens
tgggcagccatcccagcctctc

SEQ ID NO: 7009125 - DNA, 22 bp, Homo sapiens
tgcgcctctaatctcgggcgtc

SEQ ID NO: 7009126 - DNA, 22 bp, Homo sapiens
gagttctattatggttagaagt

SEQ ID NO: 7009127 - DNA, 17 bp, Homo sapiens
aaacaatgcagacaagc

SEQ ID NO: 7009128 - DNA, 22 bp, Homo sapiens
agccagactttaaaatagatga

SEQ ID NO: 7009129 - DNA, 22 bp, Homo sapiens
cattgctttgtgcatatttaaa

SEQ ID NO: 7009130 - DNA, 23 bp, Homo sapiens
ttgattctccagtatgggctgag

SEQ ID NO: 7009131 - DNA, 20 bp, Homo sapiens
aagctgggtaggagaggagc

SEQ ID NO: 7009132 - DNA, 22 bp, Homo sapiens
taataattaacagtgatgggtc

SEQ ID NO: 7009133 - DNA, 22 bp, Homo sapiens
ccttcagcgtcccctttacccg

SEQ ID NO: 7009134 - DNA, 22 bp, Homo sapiens
agtaaaggtctttcagtgccgg

SEQ ID NO: 7009135 - DNA, 22 bp, Homo sapiens
atgggtttataggtggactttt

SEQ ID NO: 7009136 - DNA, 22 bp, Homo sapiens
ttcccaatattctgcttttatg

SEQ ID NO: 7009137 - DNA, 20 bp, Homo sapiens
gattacaaaatgaaatgcat

SEQ ID NO: 7009138 - DNA, 22 bp, Homo sapiens
gtttcctgccctgtcttatcca

SEQ ID NO: 7009139 - DNA, 22 bp, Homo sapiens
ctggagaagcattcaaataatt

SEQ ID NO: 7009140 - DNA, 22 bp, Homo sapiens
aatggcagagactgttgaaata

SEQ ID NO: 7009141 - DNA, 22 bp, Homo sapiens
tgccagtgtctgctatctgaga

SEQ ID NO: 7009142 - DNA, 22 bp, Homo sapiens
attatgggtataacacagttat

SEQ ID NO: 7009143 - DNA, 22 bp, Homo sapiens
cctgcctgacagagaaggttca

SEQ ID NO: 7009144 - DNA, 22 bp, Homo sapiens
tcttgggggactttggcatgga

SEQ ID NO: 7009145 - DNA, 22 bp, Homo sapiens
gaagaagggagtgacaaatgca

SEQ ID NO: 7009146 - DNA, 22 bp, Homo sapiens
agacaggtgctcgcccaagtcc

SEQ ID NO: 7009147 - DNA, 21 bp, Homo sapiens
tggactggtgagtttaggctg

SEQ ID NO: 7009148 - DNA, 22 bp, Homo sapiens
tttggcttaacttacatgatat

SEQ ID NO: 7009149 - DNA, 22 bp, Homo sapiens
acacacaattagttttatgctt

SEQ ID NO: 7009150 - DNA, 22 bp, Homo sapiens
tagggacactgctcatgagttc

SEQ ID NO: 7009151 - DNA, 22 bp, Homo sapiens
tgtacacaacctacagtctgct

SEQ ID NO: 7009152 - DNA, 22 bp, Homo sapiens
ggccaaatctgtaaggcaagat

SEQ ID NO: 7009153 - DNA, 22 bp, Homo sapiens
atttatattttgggagctcctg

SEQ ID NO: 7009154 - DNA, 22 bp, Homo sapiens
cgcaccactgaattccagcctg

SEQ ID NO: 7009155 - DNA, 22 bp, Homo sapiens
agaagcagttattttttgcaca

SEQ ID NO: 7009156 - DNA, 22 bp, Homo sapiens
ttaaagaggcaggttaaataat

SEQ ID NO: 7009157 - DNA, 22 bp, Homo sapiens
tcagaacagctctcagatatcc

SEQ ID NO: 7009158 - DNA, 22 bp, Homo sapiens
tgtgactgagctgcagagtgtc

SEQ ID NO: 7009159 - DNA, 22 bp, Homo sapiens
ttattgtggactactgttctgg

SEQ ID NO: 7009160 - DNA, 22 bp, Homo sapiens
gaggttggggctgcagtgagct

SEQ ID NO: 7009161 - DNA, 22 bp, Homo sapiens
ttggaggaagctcatgggggat

SEQ ID NO: 7009162 - DNA, 22 bp, Homo sapiens
tccacagtggttgaactagttt

SEQ ID NO: 7009163 - DNA, 22 bp, Homo sapiens
aaagctatttgttatgagagaa

SEQ ID NO: 7009164 - DNA, 22 bp, Homo sapiens
tgtatgtttctaaatgattgct

SEQ ID NO: 7009165 - DNA, 22 bp, Homo sapiens
tgctgcctctgctgatatggcc

SEQ ID NO: 7009166 - DNA, 22 bp, Homo sapiens
taaagtgcttatgataaccaag

SEQ ID NO: 7009167 - DNA, 22 bp, Homo sapiens
tggtttttggtttaacactatg

SEQ ID NO: 7009168 - DNA, 22 bp, Homo sapiens
cctgaaatttgaagacctgaat

SEQ ID NO: 7009169 - DNA, 22 bp, Homo sapiens
gacaagcaggctcctgaagaaa

SEQ ID NO: 7009170 - DNA, 22 bp, Homo sapiens
tactcaatctaggtggcttacc

SEQ ID NO: 7009171 - DNA, 22 bp, Homo sapiens
ggctgtgacccccacaggggtg

SEQ ID NO: 7009172 - DNA, 22 bp, Homo sapiens
gaagtttagagtttggagtcct

SEQ ID NO: 7009173 - DNA, 22 bp, Homo sapiens
ttagtgataggaagccagattg

SEQ ID NO: 7009174 - DNA, 22 bp, Homo sapiens
aaggaggagcggaggcttgttg

SEQ ID NO: 7009175 - DNA, 22 bp, Homo sapiens
attagaatgaagtataggattt

SEQ ID NO: 7009176 - DNA, 22 bp, Homo sapiens
agtatgggtgtagattctgcaa

SEQ ID NO: 7009177 - DNA, 22 bp, Homo sapiens
aactttacttgaaagaacatgt

SEQ ID NO: 7009178 - DNA, 22 bp, Homo sapiens
atatggcttatttatagagcaa

SEQ ID NO: 7009179 - DNA, 22 bp, Homo sapiens
agactctgaaatctaggtgcaa

SEQ ID NO: 7009180 - DNA, 22 bp, Homo sapiens
gagctgagtgtcctaggcatgg

SEQ ID NO: 7009181 - DNA, 22 bp, Homo sapiens
gtgcagacccacgtccagggcc

SEQ ID NO: 7009182 - DNA, 22 bp, Homo sapiens
catgagtcatagtgaagcagga

SEQ ID NO: 7009183 - DNA, 22 bp, Homo sapiens
tttcaagaggccagagcgaggc

SEQ ID NO: 7009184 - DNA, 21 bp, Homo sapiens
aggctgcatttatatggtgtg

SEQ ID NO: 7009185 - DNA, 22 bp, Homo sapiens
gtcagcaatagttagtttacaa

SEQ ID NO: 7009186 - DNA, 22 bp, Homo sapiens
acagcttgcatgcagaggcact

SEQ ID NO: 7009187 - DNA, 21 bp, Homo sapiens
tcaaagcacatatttgcacat

SEQ ID NO: 7009188 - DNA, 22 bp, Homo sapiens
aagctcaggaaagagtctggtt

SEQ ID NO: 7009189 - DNA, 22 bp, Homo sapiens
aatggttttctagaacatgaaa

SEQ ID NO: 7009190 - DNA, 22 bp, Homo sapiens
ggggcacctcctcttggcaatt

SEQ ID NO: 7009191 - DNA, 22 bp, Homo sapiens
ataacagctcttaaacaccata

SEQ ID NO: 7009192 - DNA, 22 bp, Homo sapiens
aaatgctctctaatgtaataca

SEQ ID NO: 7009193 - DNA, 22 bp, Homo sapiens
caaatgctaacttctttccaaa

SEQ ID NO: 7009194 - DNA, 22 bp, Homo sapiens
agtctgtcagtcattctaacaa

SEQ ID NO: 7009195 - DNA, 22 bp, Homo sapiens
aaacagtgtttttatgatttat

SEQ ID NO: 7009196 - DNA, 22 bp, Homo sapiens
atggccagtctgactagtttcc

SEQ ID NO: 7009197 - DNA, 22 bp, Homo sapiens
aggacagggattcaaactccca

SEQ ID NO: 7009198 - DNA, 22 bp, Homo sapiens
aagacctgccagcctcatcctg

SEQ ID NO: 7009199 - DNA, 22 bp, Homo sapiens
accactggctcaggagctggga

SEQ ID NO: 7009200 - DNA, 22 bp, Homo sapiens
ggagggacccactgcggtgacc

SEQ ID NO: 7009201 - DNA, 22 bp, Homo sapiens
cctcagctgcttccctggagcc

SEQ ID NO: 7009202 - DNA, 22 bp, Homo sapiens
ggagtgatgcttgctgcctcca

SEQ ID NO: 7009203 - DNA, 22 bp, Homo sapiens
catttgtttataagttccccag

SEQ ID NO: 7009204 - DNA, 20 bp, Homo sapiens
acgcacacgcgggggcgtgc

SEQ ID NO: 7009205 - DNA, 22 bp, Homo sapiens
ctggagacctctcctgagagtg

SEQ ID NO: 7009206 - DNA, 22 bp, Homo sapiens
atcatcttgaaagtctatgttt

SEQ ID NO: 7009207 - DNA, 19 bp, Homo sapiens
actgtgtggaagtgtgatt

SEQ ID NO: 7009208 - DNA, 22 bp, Homo sapiens
tcacagaacaatgtttagttct

SEQ ID NO: 7009209 - DNA, 23 bp, Homo sapiens
agtggggaatcaacagattcttt

SEQ ID NO: 7009210 - DNA, 22 bp, Homo sapiens
tctggatctccagcacttatca

SEQ ID NO: 7009211 - DNA, 22 bp, Homo sapiens
atgacagcagaagcggacgaag

SEQ ID NO: 7009212 - DNA, 22 bp, Homo sapiens
gcagctctgacaatgcctggaa

SEQ ID NO: 7009213 - DNA, 22 bp, Homo sapiens
acagcctgatttatggagcagt

SEQ ID NO: 7009214 - DNA, 22 bp, Homo sapiens
gctgtcaggccatgtgggcctt

SEQ ID NO: 7009215 - DNA, 22 bp, Homo sapiens
gcacataactgaccacatctaa

SEQ ID NO: 7009216 - DNA, 16 bp, Homo sapiens
gtggattcccagcctg

SEQ ID NO: 7009217 - DNA, 22 bp, Homo sapiens
atgtggcccagcggtcaggctg

SEQ ID NO: 7009218 - DNA, 22 bp, Homo sapiens
tcagtccccagatgtgtgctgt

SEQ ID NO: 7009219 - DNA, 22 bp, Homo sapiens
acacatttaaaaaggaacatat

SEQ ID NO: 7009220 - DNA, 22 bp, Homo sapiens
taagcccaggaatgcacttcag

SEQ ID NO: 7009221 - DNA, 22 bp, Homo sapiens
ggacaaattccctatttgcatg

SEQ ID NO: 7009222 - DNA, 22 bp, Homo sapiens
gtccttcctgcagggatggatg

SEQ ID NO: 7009223 - DNA, 22 bp, Homo sapiens
gccagccagagaggcatggtta

SEQ ID NO: 7009224 - DNA, 22 bp, Homo sapiens
ttcttagatgattaatgatggg

SEQ ID NO: 7009225 - DNA, 22 bp, Homo sapiens
atttctgtgcagtaaatggtga

SEQ ID NO: 7009226 - DNA, 22 bp, Homo sapiens
cagtgctcctgatgtacccttg

SEQ ID NO: 7009227 - DNA, 22 bp, Homo sapiens
atttgtttatcgtcgattgtag

SEQ ID NO: 7009228 - DNA, 23 bp, Homo sapiens
ggagtgtgaagacctgatatagc

SEQ ID NO: 7009229 - DNA, 22 bp, Homo sapiens
ctgttattttcctctgaactct

SEQ ID NO: 7009230 - DNA, 22 bp, Homo sapiens
cccaggtcgtcagcagtgtggt

SEQ ID NO: 7009231 - DNA, 22 bp, Homo sapiens
ccattcatgtgagcaagaactg

SEQ ID NO: 7009232 - DNA, 16 bp, Homo sapiens
agtcattaatttggtt

SEQ ID NO: 7009233 - DNA, 22 bp, Homo sapiens
tggcccgccggaagaagatgtc

SEQ ID NO: 7009234 - DNA, 22 bp, Homo sapiens
ttagccattttatacaagtgta

SEQ ID NO: 7009235 - DNA, 22 bp, Homo sapiens
actgttcctccatgtatgtcag

SEQ ID NO: 7009236 - DNA, 22 bp, Homo sapiens
gttagggaagcgctgtgttctt

SEQ ID NO: 7009237 - DNA, 22 bp, Homo sapiens
tctaaggacaaggtcttggaga

SEQ ID NO: 7009238 - DNA, 22 bp, Homo sapiens
tggcatgagtataggcttctca

SEQ ID NO: 7009239 - DNA, 22 bp, Homo sapiens
tcagcagtgcagggtgaggcag

SEQ ID NO: 7009240 - DNA, 22 bp, Homo sapiens
aacggctgtggctggcggcagc

SEQ ID NO: 7009241 - DNA, 22 bp, Homo sapiens
attgttttgtttcccagtgact

SEQ ID NO: 7009242 - DNA, 15 bp, Homo sapiens
ggtcatgagtagaga

SEQ ID NO: 7009243 - DNA, 22 bp, Homo sapiens
gtcttaccgcacctcatgaact

SEQ ID NO: 7009244 - DNA, 22 bp, Homo sapiens
cagatttctttagcaagctaag

SEQ ID NO: 7009245 - DNA, 22 bp, Homo sapiens
gaggagctgagccacgtcctgg

SEQ ID NO: 7009246 - DNA, 22 bp, Homo sapiens
gttactcttgagaggctgaggt

SEQ ID NO: 7009247 - DNA, 22 bp, Homo sapiens
aagtcctaattttaggaggaga

SEQ ID NO: 7009248 - DNA, 22 bp, Homo sapiens
atatggctggagcctctgcctt

SEQ ID NO: 7009249 - DNA, 22 bp, Homo sapiens
tgaggggttaccttggagttga

SEQ ID NO: 7009250 - DNA, 22 bp, Homo sapiens
tttcaggaaggtgaggcacatg

SEQ ID NO: 7009251 - DNA, 18 bp, Homo sapiens
tttgggctgatgttgggc

SEQ ID NO: 7009252 - DNA, 22 bp, Homo sapiens
gttgtacattctatgggttttg

SEQ ID NO: 7009253 - DNA, 22 bp, Homo sapiens
ttataggcttagttctgtgtgt

SEQ ID NO: 7009254 - DNA, 22 bp, Homo sapiens
tgaagccactttccagaatcac

SEQ ID NO: 7009255 - DNA, 22 bp, Homo sapiens
aactaatacattaatacatgtg

SEQ ID NO: 7009256 - DNA, 19 bp, Homo sapiens
attagcatgcttgaggatg

SEQ ID NO: 7009257 - DNA, 22 bp, Homo sapiens
tgcccaagtcctccaccgaggt

SEQ ID NO: 7009258 - DNA, 22 bp, Homo sapiens
tgccctgggagttggagctgct

SEQ ID NO: 7009259 - DNA, 22 bp, Homo sapiens
actgaagagaagcattttctgc

SEQ ID NO: 7009260 - DNA, 22 bp, Homo sapiens
tctctttgcctgctgccatcca

SEQ ID NO: 7009261 - DNA, 22 bp, Homo sapiens
gcaccctggctctctggaatgg

SEQ ID NO: 7009262 - DNA, 22 bp, Homo sapiens
ttctggaaatgggtatagagca

SEQ ID NO: 7009263 - DNA, 22 bp, Homo sapiens
ctggctgcaggatgaggctgcc

SEQ ID NO: 7009264 - DNA, 22 bp, Homo sapiens
tctgagggcttgaggggaagta

SEQ ID NO: 7009265 - DNA, 22 bp, Homo sapiens
ctggcagtgacattgcaggtgc

SEQ ID NO: 7009266 - DNA, 22 bp, Homo sapiens
gcaaagatattagaatagagta

SEQ ID NO: 7009267 - DNA, 17 bp, Homo sapiens
ctcctggcagcctcagg

SEQ ID NO: 7009268 - DNA, 22 bp, Homo sapiens
atacatcatttcccatcaatcg

SEQ ID NO: 7009269 - DNA, 22 bp, Homo sapiens
tctgaaattcacagttgagtca

SEQ ID NO: 7009270 - DNA, 22 bp, Homo sapiens
gtgcaatccagttgatttttac

SEQ ID NO: 7009271 - DNA, 22 bp, Homo sapiens
gggccctctgcagctgcccagg

SEQ ID NO: 7009272 - DNA, 22 bp, Homo sapiens
tgcaggctgcacccctgccctg

SEQ ID NO: 7009273 - DNA, 22 bp, Homo sapiens
ttgattctacttaaaacatatg

SEQ ID NO: 7009274 - DNA, 22 bp, Homo sapiens
tctgtcacccctgtttctggct

SEQ ID NO: 7009275 - DNA, 22 bp, Homo sapiens
ccctgctttcaaccttctagct

SEQ ID NO: 7009276 - DNA, 22 bp, Homo sapiens
gtaactctgggtagaactcatg

SEQ ID NO: 7009277 - DNA, 22 bp, Homo sapiens
agcttacaccccccaagattct

SEQ ID NO: 7009278 - DNA, 22 bp, Homo sapiens
tgtctggaagtaccagggaagc

SEQ ID NO: 7009279 - DNA, 23 bp, Homo sapiens
agccagatttctttgcagggcag

SEQ ID NO: 7009280 - DNA, 22 bp, Homo sapiens
tggaatgccgggccaggctccg

SEQ ID NO: 7009281 - DNA, 22 bp, Homo sapiens
gtcagcagggtccccttgagtg

SEQ ID NO: 7009282 - DNA, 22 bp, Homo sapiens
actgcactccagcctgggcggc

SEQ ID NO: 7009283 - DNA, 22 bp, Homo sapiens
ctctacagctgctgcccctggt

SEQ ID NO: 7009284 - DNA, 22 bp, Homo sapiens
gggcttctgtacctacctggaa

SEQ ID NO: 7009285 - DNA, 22 bp, Homo sapiens
gcggggcccccggccgagctct

SEQ ID NO: 7009286 - DNA, 22 bp, Homo sapiens
caggctgccaaggctggggagg

SEQ ID NO: 7009287 - DNA, 22 bp, Homo sapiens
ttttattatctttgaatgggac

SEQ ID NO: 7009288 - DNA, 22 bp, Homo sapiens
tttatgacattacaatatcaag

SEQ ID NO: 7009289 - DNA, 22 bp, Homo sapiens
agagcctgcatctagcctcaga

SEQ ID NO: 7009290 - DNA, 22 bp, Homo sapiens
cacctgcctcatttgtccctgc

SEQ ID NO: 7009291 - DNA, 23 bp, Homo sapiens
gagatgtgggtttgttcagtgtc

SEQ ID NO: 7009292 - DNA, 22 bp, Homo sapiens
tgagatttggaaaatttgatat

SEQ ID NO: 7009293 - DNA, 22 bp, Homo sapiens
actactacaagtgagtacaaag

SEQ ID NO: 7009294 - DNA, 22 bp, Homo sapiens
cttcacctgtacgctggagcta

SEQ ID NO: 7009295 - DNA, 22 bp, Homo sapiens
tgtacttgcttattagaaatct

SEQ ID NO: 7009296 - DNA, 22 bp, Homo sapiens
ctggctttgaaggtctttccta

SEQ ID NO: 7009297 - DNA, 22 bp, Homo sapiens
gagctatagatgtttacatact

SEQ ID NO: 7009298 - DNA, 22 bp, Homo sapiens
tctttgtggcgggcttaaatac

SEQ ID NO: 7009299 - DNA, 22 bp, Homo sapiens
tgtctggtgggttgacaggcag

SEQ ID NO: 7009300 - DNA, 22 bp, Homo sapiens
tgcaccaagtctggcactgaat

SEQ ID NO: 7009301 - DNA, 22 bp, Homo sapiens
gtgaaggaccaatatgactcat

SEQ ID NO: 7009302 - DNA, 22 bp, Homo sapiens
agagatatggatgtcagaaact

SEQ ID NO: 7009303 - DNA, 22 bp, Homo sapiens
atctgtctgggtgcagcagtcc

SEQ ID NO: 7009304 - DNA, 22 bp, Homo sapiens
ccatgcaagaagtccaaccatc

SEQ ID NO: 7009305 - DNA, 22 bp, Homo sapiens
aagattatttaagacaggaacc

SEQ ID NO: 7009306 - DNA, 22 bp, Homo sapiens
ggagcctgttagttgagtgctc

SEQ ID NO: 7009307 - DNA, 22 bp, Homo sapiens
tttctagctgacaaaaatgttt

SEQ ID NO: 7009308 - DNA, 22 bp, Homo sapiens
gcaccactaagagcagggaccg

SEQ ID NO: 7009309 - DNA, 22 bp, Homo sapiens
gaggccacggttttccttgggg

SEQ ID NO: 7009310 - DNA, 22 bp, Homo sapiens
atggctctctccttactgctgc

SEQ ID NO: 7009311 - DNA, 22 bp, Homo sapiens
agctgttttttcctcaccactt

SEQ ID NO: 7009312 - DNA, 22 bp, Homo sapiens
cctgtctctttcaatctgagag

SEQ ID NO: 7009313 - DNA, 22 bp, Homo sapiens
ttctgatataacactctagcta

SEQ ID NO: 7009314 - DNA, 22 bp, Homo sapiens
aagaggttctaatttaactatc

SEQ ID NO: 7009315 - DNA, 22 bp, Homo sapiens
tctagttgtgagaaagcaatgt

SEQ ID NO: 7009316 - DNA, 22 bp, Homo sapiens
gaggctcagggagtatatgaat

SEQ ID NO: 7009317 - DNA, 22 bp, Homo sapiens
ccagtgctgaatgaggaggtct

SEQ ID NO: 7009318 - DNA, 22 bp, Homo sapiens
ggagagctgacatcatgatgtt

SEQ ID NO: 7009319 - DNA, 22 bp, Homo sapiens
tattgatgcttggattgggcca

SEQ ID NO: 7009320 - DNA, 22 bp, Homo sapiens
ctggctttgaggatcccctctt

SEQ ID NO: 7009321 - DNA, 22 bp, Homo sapiens
ctgtaacttaatgagaggcaga

SEQ ID NO: 7009322 - DNA, 22 bp, Homo sapiens
tgggaatacaattctgagagaa

SEQ ID NO: 7009323 - DNA, 22 bp, Homo sapiens
ttctgcttttagctaaactata

SEQ ID NO: 7009324 - DNA, 22 bp, Homo sapiens
ccacatttactgatgtatgtat

SEQ ID NO: 7009325 - DNA, 22 bp, Homo sapiens
atttggttcccaagctacgtgt

SEQ ID NO: 7009326 - DNA, 22 bp, Homo sapiens
tctgcaagatcattaaagcaga

SEQ ID NO: 7009327 - DNA, 22 bp, Homo sapiens
gttacctttgatgtgttaccct

SEQ ID NO: 7009328 - DNA, 19 bp, Homo sapiens
gctgtgtgaccttgggcaa

SEQ ID NO: 7009329 - DNA, 22 bp, Homo sapiens
acagagcacagtcgggatggga

SEQ ID NO: 7009330 - DNA, 22 bp, Homo sapiens
accacccccttgggtgtggaag

SEQ ID NO: 7009331 - DNA, 22 bp, Homo sapiens
gcagtcctcctgcctcagcctc

SEQ ID NO: 7009332 - DNA, 22 bp, Homo sapiens
aggtgcagctggtggagtctgg

SEQ ID NO: 7009333 - DNA, 22 bp, Homo sapiens
tagctcttcacctctaggcact

SEQ ID NO: 7009334 - DNA, 22 bp, Homo sapiens
caccaggctgagcctctcatct

SEQ ID NO: 7009335 - DNA, 22 bp, Homo sapiens
gagaagttgtgtggatttaaag

SEQ ID NO: 7009336 - DNA, 19 bp, Homo sapiens
ccagaggcagcttctgtaa

SEQ ID NO: 7009337 - DNA, 22 bp, Homo sapiens
aggcggtggccaaggagcggga

SEQ ID NO: 7009338 - DNA, 22 bp, Homo sapiens
tttcaacataatgcctgctagg

SEQ ID NO: 7009339 - DNA, 22 bp, Homo sapiens
ttagataacagtagaatatcaa

SEQ ID NO: 7009340 - DNA, 22 bp, Homo sapiens
ctagataaggtggcttggaatt

SEQ ID NO: 7009341 - DNA, 22 bp, Homo sapiens
gccaaggagacacggtgttgta

SEQ ID NO: 7009342 - DNA, 22 bp, Homo sapiens
ccatccatgaacgaggaagtgg

SEQ ID NO: 7009343 - DNA, 22 bp, Homo sapiens
gacagggctgtgggaggagcag

SEQ ID NO: 7009344 - DNA, 19 bp, Homo sapiens
agagttagctggctatctc

SEQ ID NO: 7009345 - DNA, 22 bp, Homo sapiens
aaattgcacaatatagacatga

SEQ ID NO: 7009346 - DNA, 21 bp, Homo sapiens
gctctgttattttctatgcag

SEQ ID NO: 7009347 - DNA, 20 bp, Homo sapiens
cagagctgttatggatgatg

SEQ ID NO: 7009348 - DNA, 22 bp, Homo sapiens
ttacaaccccagaggtgccgtt

SEQ ID NO: 7009349 - DNA, 22 bp, Homo sapiens
gagggctctgtctggaagggaa

SEQ ID NO: 7009350 - DNA, 22 bp, Homo sapiens
ttggcctggcgcggtggctcac

SEQ ID NO: 7009351 - DNA, 22 bp, Homo sapiens
gagtccagtagttaggacagag

SEQ ID NO: 7009352 - DNA, 22 bp, Homo sapiens
tcccaaagtattagcatttcaa

SEQ ID NO: 7009353 - DNA, 22 bp, Homo sapiens
accaggcagtcaccgtccagga

SEQ ID NO: 7009354 - DNA, 22 bp, Homo sapiens
tcccagagtcttctcctgtaat

SEQ ID NO: 7009355 - DNA, 22 bp, Homo sapiens
gtaaacaatagcattgcctgat

SEQ ID NO: 7009356 - DNA, 22 bp, Homo sapiens
ttctatattcgcttcccaaggc

SEQ ID NO: 7009357 - DNA, 22 bp, Homo sapiens
ttctgttatcattaagcattat

SEQ ID NO: 7009358 - DNA, 22 bp, Homo sapiens
cagctgtgctagaagccacgaa

SEQ ID NO: 7009359 - DNA, 22 bp, Homo sapiens
atgagctcaggtgtgcaaaata

SEQ ID NO: 7009360 - DNA, 22 bp, Homo sapiens
attagctttatttgaaatagga

SEQ ID NO: 7009361 - DNA, 22 bp, Homo sapiens
tcactctgatagataagctaac

SEQ ID NO: 7009362 - DNA, 22 bp, Homo sapiens
aagtgcattagatagaatgatg

SEQ ID NO: 7009363 - DNA, 22 bp, Homo sapiens
gtcaggagagacctgttctcct

SEQ ID NO: 7009364 - DNA, 22 bp, Homo sapiens
ggccaggtaagagtgcagccgc

SEQ ID NO: 7009365 - DNA, 22 bp, Homo sapiens
tgagagtacttatatgaacatt

SEQ ID NO: 7009366 - DNA, 22 bp, Homo sapiens
agaagtcaatagttgtttgatg

SEQ ID NO: 7009367 - DNA, 20 bp, Homo sapiens
ttggaaggtggagaagagga

SEQ ID NO: 7009368 - DNA, 22 bp, Homo sapiens
aagctgccttccatgtgaggaa

SEQ ID NO: 7009369 - DNA, 22 bp, Homo sapiens
taggcaattagtaacgcagaaa

SEQ ID NO: 7009370 - DNA, 22 bp, Homo sapiens
gatggaagaaaaatgcatgtct

SEQ ID NO: 7009371 - DNA, 22 bp, Homo sapiens
ttctagaacaggcaaaaccaat

SEQ ID NO: 7009372 - DNA, 22 bp, Homo sapiens
gtccctcagtagtgcacagtgg

SEQ ID NO: 7009373 - DNA, 22 bp, Homo sapiens
ttgatttgattgatgaactaag

SEQ ID NO: 7009374 - DNA, 22 bp, Homo sapiens
gtggtgaagccccatctctgct

SEQ ID NO: 7009375 - DNA, 22 bp, Homo sapiens
accaaaggtgatcaggatcacc

SEQ ID NO: 7009376 - DNA, 22 bp, Homo sapiens
cctgcacccaggccgcacctct

SEQ ID NO: 7009377 - DNA, 22 bp, Homo sapiens
attcactgtgggtcctttggat

SEQ ID NO: 7009378 - DNA, 22 bp, Homo sapiens
ctgagtaagtgtatgatgctgg

SEQ ID NO: 7009379 - DNA, 22 bp, Homo sapiens
aggcgggtttaggacaatgctt

SEQ ID NO: 7009380 - DNA, 22 bp, Homo sapiens
tttctgccaggtttctggatga

SEQ ID NO: 7009381 - DNA, 22 bp, Homo sapiens
cttcttcctgaaagctggctct

SEQ ID NO: 7009382 - DNA, 22 bp, Homo sapiens
gacagggttgagtaaactggga

SEQ ID NO: 7009383 - DNA, 22 bp, Homo sapiens
gttaactttcaggtgcatgttt

SEQ ID NO: 7009384 - DNA, 22 bp, Homo sapiens
gtgccaatcgtgcattatattg

SEQ ID NO: 7009385 - DNA, 22 bp, Homo sapiens
acagtcttcagaagggattggg

SEQ ID NO: 7009386 - DNA, 22 bp, Homo sapiens
ggtctggataattccagtacct

SEQ ID NO: 7009387 - DNA, 22 bp, Homo sapiens
ttatggctaaggcttgtcaggt

SEQ ID NO: 7009388 - DNA, 22 bp, Homo sapiens
tttatagacaaactcagaggct

SEQ ID NO: 7009389 - DNA, 22 bp, Homo sapiens
ttcctataagtcacactgttgt

SEQ ID NO: 7009390 - DNA, 22 bp, Homo sapiens
tgtatgacagaaacaccgaaat

SEQ ID NO: 7009391 - DNA, 19 bp, Homo sapiens
gacagtgcagttgtagtac

SEQ ID NO: 7009392 - DNA, 22 bp, Homo sapiens
aactggaactggtagtgttggt

SEQ ID NO: 7009393 - DNA, 20 bp, Homo sapiens
tctggctctttgctcctccc

SEQ ID NO: 7009394 - DNA, 22 bp, Homo sapiens
gtataaggattccagttgctcc

SEQ ID NO: 7009395 - DNA, 22 bp, Homo sapiens
gaggcttcccgcccatgctgga

SEQ ID NO: 7009396 - DNA, 20 bp, Homo sapiens
tctgggcttcccccagctcc

SEQ ID NO: 7009397 - DNA, 22 bp, Homo sapiens
tttattgcatacacaaatgtca

SEQ ID NO: 7009398 - DNA, 22 bp, Homo sapiens
aagcagaggccacagagtgggc

SEQ ID NO: 7009399 - DNA, 22 bp, Homo sapiens
gttcaaggttttacagagtgta

SEQ ID NO: 7009400 - DNA, 22 bp, Homo sapiens
tggctacagatttgctgacaat

SEQ ID NO: 7009401 - DNA, 22 bp, Homo sapiens
atagttcctactttgcactaat

SEQ ID NO: 7009402 - DNA, 22 bp, Homo sapiens
cagtgtttgtatagaatatgca

SEQ ID NO: 7009403 - DNA, 22 bp, Homo sapiens
ggaactagaactggctttgggt

SEQ ID NO: 7009404 - DNA, 20 bp, Homo sapiens
tcagtgcagattgtccaagt

SEQ ID NO: 7009405 - DNA, 22 bp, Homo sapiens
cggcaggacctcatttccttct

SEQ ID NO: 7009406 - DNA, 22 bp, Homo sapiens
taggccaaggacagtaaggaca

SEQ ID NO: 7009407 - DNA, 22 bp, Homo sapiens
agaagggccagctggacacctg

SEQ ID NO: 7009408 - DNA, 22 bp, Homo sapiens
tctaggaagtaaggagggacta

SEQ ID NO: 7009409 - DNA, 22 bp, Homo sapiens
aacaggaccttccaatccatca

SEQ ID NO: 7009410 - DNA, 22 bp, Homo sapiens
gggagcaggacataatagcaat

SEQ ID NO: 7009411 - DNA, 22 bp, Homo sapiens
gcattcatatggaaggaaacta

SEQ ID NO: 7009412 - DNA, 22 bp, Homo sapiens
ctccttgggttctttcggttcc

SEQ ID NO: 7009413 - DNA, 22 bp, Homo sapiens
ctggtgattacaatgatgacaa

SEQ ID NO: 7009414 - DNA, 20 bp, Homo sapiens
gctgggacgcccggtccgga

SEQ ID NO: 7009415 - DNA, 22 bp, Homo sapiens
ggacccaccaggccgggctcca

SEQ ID NO: 7009416 - DNA, 22 bp, Homo sapiens
gcccagggcgatggtcggggcc

SEQ ID NO: 7009417 - DNA, 22 bp, Homo sapiens
agaaggcatagaccggattatg

SEQ ID NO: 7009418 - DNA, 15 bp, Homo sapiens
agccccctcagagga

SEQ ID NO: 7009419 - DNA, 22 bp, Homo sapiens
acagtgtccttgtggtccctgt

SEQ ID NO: 7009420 - DNA, 22 bp, Homo sapiens
atgctgtgtttgagaacctagg

SEQ ID NO: 7009421 - DNA, 22 bp, Homo sapiens
tcctggcctagagtttgtgttc

SEQ ID NO: 7009422 - DNA, 22 bp, Homo sapiens
gggctttaggggccagtgacca

SEQ ID NO: 7009423 - DNA, 22 bp, Homo sapiens
tggaagtgtctacatgtggagt

SEQ ID NO: 7009424 - DNA, 22 bp, Homo sapiens
ttgacataggatgtatcagtca

SEQ ID NO: 7009425 - DNA, 22 bp, Homo sapiens
tgatcccagatctgagagggtt

SEQ ID NO: 7009426 - DNA, 22 bp, Homo sapiens
agacctctgagggcatcttgtc

SEQ ID NO: 7009427 - DNA, 21 bp, Homo sapiens
agaggcggggttttggaggcc

SEQ ID NO: 7009428 - DNA, 22 bp, Homo sapiens
gagagcctgccagtgagtgtat

SEQ ID NO: 7009429 - DNA, 22 bp, Homo sapiens
aagcatgcttttggaggaccat

SEQ ID NO: 7009430 - DNA, 22 bp, Homo sapiens
tgtctccatagaagagactgca

SEQ ID NO: 7009431 - DNA, 22 bp, Homo sapiens
gtctgcattggagacaagagtc

SEQ ID NO: 7009432 - DNA, 22 bp, Homo sapiens
gaccatttgctagtaaattgca

SEQ ID NO: 7009433 - DNA, 22 bp, Homo sapiens
atgttagcattgagcacttact

SEQ ID NO: 7009434 - DNA, 22 bp, Homo sapiens
gtgcttcctcagtgtttaagga

SEQ ID NO: 7009435 - DNA, 22 bp, Homo sapiens
tggcttcattcagcatgacagt

SEQ ID NO: 7009436 - DNA, 22 bp, Homo sapiens
gcagggaagggaaacagagacc

SEQ ID NO: 7009437 - DNA, 22 bp, Homo sapiens
atcaagagttatatttcatagt

SEQ ID NO: 7009438 - DNA, 22 bp, Homo sapiens
agtctttagggaggtcagagtt

SEQ ID NO: 7009439 - DNA, 22 bp, Homo sapiens
ggcttcaaatggagcaaccaga

SEQ ID NO: 7009440 - DNA, 22 bp, Homo sapiens
ctgcagaacaattcctgctgtt

SEQ ID NO: 7009441 - DNA, 22 bp, Homo sapiens
tcacagtgatgacgtgggagca

SEQ ID NO: 7009442 - DNA, 22 bp, Homo sapiens
tacaatgatgatactttactgg

SEQ ID NO: 7009443 - DNA, 22 bp, Homo sapiens
ttttggtcaacagtacatgcgg

SEQ ID NO: 7009444 - DNA, 22 bp, Homo sapiens
aaagcatagttcatctgtccat

SEQ ID NO: 7009445 - DNA, 22 bp, Homo sapiens
gcaaatattcaagacttttcca

SEQ ID NO: 7009446 - DNA, 22 bp, Homo sapiens
ctggtgctggagcctagtccct

SEQ ID NO: 7009447 - DNA, 22 bp, Homo sapiens
accacaggaattgctctgtggt

SEQ ID NO: 7009448 - DNA, 23 bp, Homo sapiens
ctctggagatcctctgcctgggt

SEQ ID NO: 7009449 - DNA, 22 bp, Homo sapiens
tggcctctgaggcacctttgcc

SEQ ID NO: 7009450 - DNA, 22 bp, Homo sapiens
ttttagactccatctgattcag

SEQ ID NO: 7009451 - DNA, 18 bp, Homo sapiens
tctccttccaaatcttca

SEQ ID NO: 7009452 - DNA, 22 bp, Homo sapiens
agattgaatatagagattcttg

SEQ ID NO: 7009453 - DNA, 22 bp, Homo sapiens
ctaggcactcacgtggctttag

SEQ ID NO: 7009454 - DNA, 22 bp, Homo sapiens
agtggtgatgtctctattattg

SEQ ID NO: 7009455 - DNA, 22 bp, Homo sapiens
taggaaatgaggccaacatgtg

SEQ ID NO: 7009456 - DNA, 22 bp, Homo sapiens
aacccagccgtgtagctgccgc

SEQ ID NO: 7009457 - DNA, 22 bp, Homo sapiens
taacatattgtgtggcactagg

SEQ ID NO: 7009458 - DNA, 22 bp, Homo sapiens
tctgaaatatattttgagtgtt

SEQ ID NO: 7009459 - DNA, 22 bp, Homo sapiens
actgcacagatgaagctgtaaa

SEQ ID NO: 7009460 - DNA, 22 bp, Homo sapiens
atgcatgtgtgaattatttgac

SEQ ID NO: 7009461 - DNA, 22 bp, Homo sapiens
ataaaagttcaagagagtacag

SEQ ID NO: 7009462 - DNA, 21 bp, Homo sapiens
tcccactggcccagggctcca

SEQ ID NO: 7009463 - DNA, 22 bp, Homo sapiens
acaaattctacaatcatatgat

SEQ ID NO: 7009464 - DNA, 22 bp, Homo sapiens
aaaatgagacacatgtgactcc

SEQ ID NO: 7009465 - DNA, 22 bp, Homo sapiens
tttgtcaaatcaaaccacattc

SEQ ID NO: 7009466 - DNA, 22 bp, Homo sapiens
agacactgtgtacagaaaaaga

SEQ ID NO: 7009467 - DNA, 22 bp, Homo sapiens
cgctggcattagggcagtggcc

SEQ ID NO: 7009468 - DNA, 22 bp, Homo sapiens
ggctgccttgaccctggctccg

SEQ ID NO: 7009469 - DNA, 22 bp, Homo sapiens
atctgaagaggtcatggctgac

SEQ ID NO: 7009470 - DNA, 22 bp, Homo sapiens
acttgaaaggaagctctaaaac

SEQ ID NO: 7009471 - DNA, 22 bp, Homo sapiens
cgggcagatcacacagggcttg

SEQ ID NO: 7009472 - DNA, 22 bp, Homo sapiens
agtaatgaggatgtttgcaaaa

SEQ ID NO: 7009473 - DNA, 22 bp, Homo sapiens
atttggaggcccatcccttaca

SEQ ID NO: 7009474 - DNA, 22 bp, Homo sapiens
atgttgttaaatgggtgtattt

SEQ ID NO: 7009475 - DNA, 22 bp, Homo sapiens
atgccagacattaacgactatg

SEQ ID NO: 7009476 - DNA, 20 bp, Homo sapiens
tccagagagtggcaaagctc

SEQ ID NO: 7009477 - DNA, 22 bp, Homo sapiens
atctatcaaaaccagagggttt

SEQ ID NO: 7009478 - DNA, 22 bp, Homo sapiens
agccctcatggaacagctccta

SEQ ID NO: 7009479 - DNA, 22 bp, Homo sapiens
gcacacattctagccttttgtg

SEQ ID NO: 7009480 - DNA, 22 bp, Homo sapiens
tcagtgtttggtttcagaattg

SEQ ID NO: 7009481 - DNA, 22 bp, Homo sapiens
taactttgaagggaattttact

SEQ ID NO: 7009482 - DNA, 22 bp, Homo sapiens
actggccaggcagcagtagctt

SEQ ID NO: 7009483 - DNA, 22 bp, Homo sapiens
aagctgtggtaaagggtagagg

SEQ ID NO: 7009484 - DNA, 22 bp, Homo sapiens
aagggccagggctctagagata

SEQ ID NO: 7009485 - DNA, 22 bp, Homo sapiens
accactataattagtttgttaa

SEQ ID NO: 7009486 - DNA, 22 bp, Homo sapiens
agctccaggataagacaggtgc

SEQ ID NO: 7009487 - DNA, 22 bp, Homo sapiens
acagctgtgagggtcacttgta

SEQ ID NO: 7009488 - DNA, 22 bp, Homo sapiens
ttgcagcatgcatagacactgc

SEQ ID NO: 7009489 - DNA, 22 bp, Homo sapiens
gttcttcacattttggggtcac

SEQ ID NO: 7009490 - DNA, 20 bp, Homo sapiens
accttgatattatatgcagt

SEQ ID NO: 7009491 - DNA, 22 bp, Homo sapiens
aacattcagctgatgggtcata

SEQ ID NO: 7009492 - DNA, 22 bp, Homo sapiens
tgcttgtccctctttatgatgg

SEQ ID NO: 7009493 - DNA, 22 bp, Homo sapiens
tattccaaaatcccaaactgcc

SEQ ID NO: 7009494 - DNA, 22 bp, Homo sapiens
cctttgtactctggtccaaact

SEQ ID NO: 7009495 - DNA, 22 bp, Homo sapiens
tgtgctatttttgcatatgtgt

SEQ ID NO: 7009496 - DNA, 22 bp, Homo sapiens
acaaaactcttgctgggatttt

SEQ ID NO: 7009497 - DNA, 23 bp, Homo sapiens
gtgtggccccagggcctcctcgc

SEQ ID NO: 7009498 - DNA, 22 bp, Homo sapiens
acacatatggttgctgcagtga

SEQ ID NO: 7009499 - DNA, 22 bp, Homo sapiens
tttctaagtaagattaacttct

SEQ ID NO: 7009500 - DNA, 22 bp, Homo sapiens
ggtaattctagtcattgcatca

SEQ ID NO: 7009501 - DNA, 22 bp, Homo sapiens
aatgtacaagggttccagtttt

SEQ ID NO: 7009502 - DNA, 22 bp, Homo sapiens
cagagctgcgctttttcctggt

SEQ ID NO: 7009503 - DNA, 22 bp, Homo sapiens
ttaagtagattcagtgttaagg

SEQ ID NO: 7009504 - DNA, 22 bp, Homo sapiens
tacaagaggatgtggacatgga

SEQ ID NO: 7009505 - DNA, 17 bp, Homo sapiens
tgttttcattcattgct

SEQ ID NO: 7009506 - DNA, 22 bp, Homo sapiens
ggaagagaaatgagtcaagact

SEQ ID NO: 7009507 - DNA, 22 bp, Homo sapiens
tgcaggctgccttcacagagcc

SEQ ID NO: 7009508 - DNA, 22 bp, Homo sapiens
acagagtcattcactgatgaag

SEQ ID NO: 7009509 - DNA, 20 bp, Homo sapiens
agtcattgggtgtccttcgg

SEQ ID NO: 7009510 - DNA, 22 bp, Homo sapiens
ggcctctggttcacagggagga

SEQ ID NO: 7009511 - DNA, 22 bp, Homo sapiens
atctgaagaatgaatggaatta

SEQ ID NO: 7009512 - DNA, 22 bp, Homo sapiens
ggcctaggattctgcatttcta

SEQ ID NO: 7009513 - DNA, 22 bp, Homo sapiens
tgctctgcaagcaggagcaaga

SEQ ID NO: 7009514 - DNA, 22 bp, Homo sapiens
agctgaagcactgggatggaag

SEQ ID NO: 7009515 - DNA, 22 bp, Homo sapiens
cttcccagaccttagagtgcag

SEQ ID NO: 7009516 - DNA, 22 bp, Homo sapiens
agaccagtaaaattagtgggag

SEQ ID NO: 7009517 - DNA, 22 bp, Homo sapiens
ccagccagatgataagctctat

SEQ ID NO: 7009518 - DNA, 22 bp, Homo sapiens
gctggagttgtgggtttactaa

SEQ ID NO: 7009519 - DNA, 20 bp, Homo sapiens
aatgagttattttgtatatg

SEQ ID NO: 7009520 - DNA, 21 bp, Homo sapiens
tgcattcttgtgtaaggtagt

SEQ ID NO: 7009521 - DNA, 22 bp, Homo sapiens
ttagacatgtttgctaaaatga

SEQ ID NO: 7009522 - DNA, 22 bp, Homo sapiens
tctagacctggcactgccctgt

SEQ ID NO: 7009523 - DNA, 22 bp, Homo sapiens
gtttatcagagagcagaggtgg

SEQ ID NO: 7009524 - DNA, 22 bp, Homo sapiens
gcttctgcagagccgtcctgag

SEQ ID NO: 7009525 - DNA, 22 bp, Homo sapiens
tttcacatcatgggatggaagc

SEQ ID NO: 7009526 - DNA, 22 bp, Homo sapiens
aagagctgattaagtcatgagg

SEQ ID NO: 7009527 - DNA, 22 bp, Homo sapiens
attctgagtagaaattattctt

SEQ ID NO: 7009528 - DNA, 22 bp, Homo sapiens
gtgctgaatccactcttaggaa

SEQ ID NO: 7009529 - DNA, 22 bp, Homo sapiens
acagctggaggggctgcagagg

SEQ ID NO: 7009530 - DNA, 22 bp, Homo sapiens
tcttcctccctacagagctcag

SEQ ID NO: 7009531 - DNA, 22 bp, Homo sapiens
ttcaatcattccaacactttaa

SEQ ID NO: 7009532 - DNA, 22 bp, Homo sapiens
aagccaggggctgcttaggaga

SEQ ID NO: 7009533 - DNA, 22 bp, Homo sapiens
ttgtatttcttccggtctcatt

SEQ ID NO: 7009534 - DNA, 22 bp, Homo sapiens
gtgataaaggggaggaagtgtg

SEQ ID NO: 7009535 - DNA, 22 bp, Homo sapiens
aggcttcagttgtaccttcttg

SEQ ID NO: 7009536 - DNA, 22 bp, Homo sapiens
ccagctggttaaaatagagaaa

SEQ ID NO: 7009537 - DNA, 22 bp, Homo sapiens
atctgcctgcttatgatgcctg

SEQ ID NO: 7009538 - DNA, 22 bp, Homo sapiens
aaggccagccctaatgatgctc

SEQ ID NO: 7009539 - DNA, 22 bp, Homo sapiens
gcactgtgatcaaggctaagca

SEQ ID NO: 7009540 - DNA, 22 bp, Homo sapiens
ctagggacctcagctcctggag

SEQ ID NO: 7009541 - DNA, 20 bp, Homo sapiens
taggagcaatgagagtagaa

SEQ ID NO: 7009542 - DNA, 22 bp, Homo sapiens
tgtctttaattctacatatctc

SEQ ID NO: 7009543 - DNA, 22 bp, Homo sapiens
gttgtgcaaccatcaccaccat

SEQ ID NO: 7009544 - DNA, 22 bp, Homo sapiens
gaggctgatgctgcctcacaga

SEQ ID NO: 7009545 - DNA, 22 bp, Homo sapiens
cactggctgggccagcactcct

SEQ ID NO: 7009546 - DNA, 22 bp, Homo sapiens
tctgtgtttaaaagatatgtcc

SEQ ID NO: 7009547 - DNA, 22 bp, Homo sapiens
tacacatgacagtggactgaga

SEQ ID NO: 7009548 - DNA, 22 bp, Homo sapiens
tctaaattctttcctgggttga

SEQ ID NO: 7009549 - DNA, 22 bp, Homo sapiens
aagtgtacatagaaagcttggt

SEQ ID NO: 7009550 - DNA, 22 bp, Homo sapiens
ggccagctttctgtcttctagg

SEQ ID NO: 7009551 - DNA, 22 bp, Homo sapiens
tggtaatggttctcttgctata

SEQ ID NO: 7009552 - DNA, 22 bp, Homo sapiens
tggcctatttcatcagttcaat

SEQ ID NO: 7009553 - DNA, 22 bp, Homo sapiens
gaatcagaatctgcatgttaag

SEQ ID NO: 7009554 - DNA, 22 bp, Homo sapiens
catcattaccttgtaaccaata

SEQ ID NO: 7009555 - DNA, 22 bp, Homo sapiens
ttcctggcttcatactttgtac

SEQ ID NO: 7009556 - DNA, 22 bp, Homo sapiens
tttcagagttggggaaaagcag

SEQ ID NO: 7009557 - DNA, 22 bp, Homo sapiens
gccaggaccctggagggcatct

SEQ ID NO: 7009558 - DNA, 22 bp, Homo sapiens
aggccctgcaggagtggggaca

SEQ ID NO: 7009559 - DNA, 22 bp, Homo sapiens
cctcctctgtgcagctgtgggt

SEQ ID NO: 7009560 - DNA, 20 bp, Homo sapiens
aagttacattgtattgtacc

SEQ ID NO: 7009561 - DNA, 22 bp, Homo sapiens
atgttacaaatcctacaggtag

SEQ ID NO: 7009562 - DNA, 22 bp, Homo sapiens
gtccttgtattccaagatacaa

SEQ ID NO: 7009563 - DNA, 22 bp, Homo sapiens
tgtaaattctatacacttaaaa

SEQ ID NO: 7009564 - DNA, 22 bp, Homo sapiens
acccaagacacgtgtcctcagc

SEQ ID NO: 7009565 - DNA, 22 bp, Homo sapiens
tagtcacaggaagtttcaatgt

SEQ ID NO: 7009566 - DNA, 22 bp, Homo sapiens
atggcctgcagtgctgccacag

SEQ ID NO: 7009567 - DNA, 21 bp, Homo sapiens
gctccagaactctatgctaac

SEQ ID NO: 7009568 - DNA, 22 bp, Homo sapiens
gtgttatttgagtgggagcgtg

SEQ ID NO: 7009569 - DNA, 22 bp, Homo sapiens
tcctgggtagagacctgatgaa

SEQ ID NO: 7009570 - DNA, 22 bp, Homo sapiens
ggagcacctactttgataacta

SEQ ID NO: 7009571 - DNA, 22 bp, Homo sapiens
taggagatagtttttacctggc

SEQ ID NO: 7009572 - DNA, 22 bp, Homo sapiens
ggcaggagaatggcgtgaactc

SEQ ID NO: 7009573 - DNA, 22 bp, Homo sapiens
cattatgtgggaaaatgttctt

SEQ ID NO: 7009574 - DNA, 22 bp, Homo sapiens
ctgcagctcctgagctcagaga

SEQ ID NO: 7009575 - DNA, 22 bp, Homo sapiens
gcttgctcaacccccgtctctc

SEQ ID NO: 7009576 - DNA, 22 bp, Homo sapiens
gaaccagcagccctgcagaagt

SEQ ID NO: 7009577 - DNA, 22 bp, Homo sapiens
aactccagggtcaccattcaca

SEQ ID NO: 7009578 - DNA, 22 bp, Homo sapiens
tgcagaaacagtcattaatgta

SEQ ID NO: 7009579 - DNA, 20 bp, Homo sapiens
attgtacttctgttgatggt

SEQ ID NO: 7009580 - DNA, 18 bp, Homo sapiens
gtgctctatgtctgttat

SEQ ID NO: 7009581 - DNA, 22 bp, Homo sapiens
ccacttgaatcaaattcttagg

SEQ ID NO: 7009582 - DNA, 22 bp, Homo sapiens
gtgtgagcaggtttgacctaag

SEQ ID NO: 7009583 - DNA, 22 bp, Homo sapiens
actgagtatcacttcttatttt

SEQ ID NO: 7009584 - DNA, 22 bp, Homo sapiens
tagctgttcaagttcctggaaa

SEQ ID NO: 7009585 - DNA, 22 bp, Homo sapiens
cctgggaggtggatgttgcggt

SEQ ID NO: 7009586 - DNA, 21 bp, Homo sapiens
agaaatgtatcattcttttcc

SEQ ID NO: 7009587 - DNA, 22 bp, Homo sapiens
acatagagatgtgtttctatac

SEQ ID NO: 7009588 - DNA, 22 bp, Homo sapiens
tggaggcaggtggaggagtgaa

SEQ ID NO: 7009589 - DNA, 22 bp, Homo sapiens
ttctagttatagaaaaagcatt

SEQ ID NO: 7009590 - DNA, 20 bp, Homo sapiens
gagctgagtgtggtcatggg

SEQ ID NO: 7009591 - DNA, 22 bp, Homo sapiens
ctttactgttcttctgtgggaa

SEQ ID NO: 7009592 - DNA, 22 bp, Homo sapiens
tggccacccccaatgtcagtag

SEQ ID NO: 7009593 - DNA, 22 bp, Homo sapiens
ggcttcacagccccattagtgc

SEQ ID NO: 7009594 - DNA, 19 bp, Homo sapiens
aagaactatgtgattacag

SEQ ID NO: 7009595 - DNA, 22 bp, Homo sapiens
ccttcccaggctagaccaacat

SEQ ID NO: 7009596 - DNA, 22 bp, Homo sapiens
acagccccagcgcggcggggtc

SEQ ID NO: 7009597 - DNA, 22 bp, Homo sapiens
gctggaggggtaataggatggg

SEQ ID NO: 7009598 - DNA, 23 bp, Homo sapiens
aaagctctgctgcatgtagaata

SEQ ID NO: 7009599 - DNA, 22 bp, Homo sapiens
atagaacctgttgtgaaattca

SEQ ID NO: 7009600 - DNA, 22 bp, Homo sapiens
ggctcaggtttccttcccagct

SEQ ID NO: 7009601 - DNA, 22 bp, Homo sapiens
agaacagtttgttggagactgt

SEQ ID NO: 7009602 - DNA, 19 bp, Homo sapiens
ttctctgctacattctcag

SEQ ID NO: 7009603 - DNA, 22 bp, Homo sapiens
atacatgaggaggctggaaaca

SEQ ID NO: 7009604 - DNA, 22 bp, Homo sapiens
attgcaggctctgacaccaggc

SEQ ID NO: 7009605 - DNA, 22 bp, Homo sapiens
atacacgtgccatgttggtgtg

SEQ ID NO: 7009606 - DNA, 22 bp, Homo sapiens
gccaagaagtatggttggggct

SEQ ID NO: 7009607 - DNA, 22 bp, Homo sapiens
cagctctgttgccaaagtgggc

SEQ ID NO: 7009608 - DNA, 22 bp, Homo sapiens
tctagggtgatgattcaggatg

SEQ ID NO: 7009609 - DNA, 22 bp, Homo sapiens
tttctagaagtggctgggcgtt

SEQ ID NO: 7009610 - DNA, 22 bp, Homo sapiens
gttcagttatttctgaagatat

SEQ ID NO: 7009611 - DNA, 22 bp, Homo sapiens
aagaaaggtgtgtttgcagatg

SEQ ID NO: 7009612 - DNA, 22 bp, Homo sapiens
gggctggaaaaacaacatacaa

SEQ ID NO: 7009613 - DNA, 22 bp, Homo sapiens
cttgttgggtcgtgaattctgt

SEQ ID NO: 7009614 - DNA, 22 bp, Homo sapiens
ggcctgctttacaggatcaact

SEQ ID NO: 7009615 - DNA, 21 bp, Homo sapiens
ggctgggcaggacccacccct

SEQ ID NO: 7009616 - DNA, 22 bp, Homo sapiens
ctgccactctgggtgggcctgg

SEQ ID NO: 7009617 - DNA, 22 bp, Homo sapiens
atttctagcagggcaggaaaga

SEQ ID NO: 7009618 - DNA, 22 bp, Homo sapiens
tctcacaggtgcacgtggctgt

SEQ ID NO: 7009619 - DNA, 22 bp, Homo sapiens
gtaaagatgagcggtaatacaa

SEQ ID NO: 7009620 - DNA, 23 bp, Homo sapiens
tgtctggtttcttttatttagca

SEQ ID NO: 7009621 - DNA, 22 bp, Homo sapiens
agctagaatattgatctgaaat

SEQ ID NO: 7009622 - DNA, 22 bp, Homo sapiens
actggctgatatggctaggaag

SEQ ID NO: 7009623 - DNA, 22 bp, Homo sapiens
agaaggctggccctgggtggcc

SEQ ID NO: 7009624 - DNA, 22 bp, Homo sapiens
atctttcaggcctagtgtttaa

SEQ ID NO: 7009625 - DNA, 22 bp, Homo sapiens
aaaattaagtgtctgggaagcc

SEQ ID NO: 7009626 - DNA, 22 bp, Homo sapiens
tgtcacacctcgtttagcattc

SEQ ID NO: 7009627 - DNA, 22 bp, Homo sapiens
tccagaaagtacatgggattca

SEQ ID NO: 7009628 - DNA, 22 bp, Homo sapiens
gttaactttttacagaaatgaa

SEQ ID NO: 7009629 - DNA, 22 bp, Homo sapiens
cacccaggctggagtgcattgg

SEQ ID NO: 7009630 - DNA, 22 bp, Homo sapiens
taacattaaaagagataattga

SEQ ID NO: 7009631 - DNA, 22 bp, Homo sapiens
gtgcagctggtggagtctgggg

SEQ ID NO: 7009632 - DNA, 22 bp, Homo sapiens
cttggagagagcctcagctgtt

SEQ ID NO: 7009633 - DNA, 22 bp, Homo sapiens
aagactttctcccaaatcctca

SEQ ID NO: 7009634 - DNA, 22 bp, Homo sapiens
cataaactctctgtaccaatat

SEQ ID NO: 7009635 - DNA, 22 bp, Homo sapiens
gtcttcaatagagcctcaattt

SEQ ID NO: 7009636 - DNA, 22 bp, Homo sapiens
caccccctccatggttgtgaca

SEQ ID NO: 7009637 - DNA, 22 bp, Homo sapiens
gagctgtgccaatctgtctggg

SEQ ID NO: 7009638 - DNA, 20 bp, Homo sapiens
tgtaccataatgactggctc

SEQ ID NO: 7009639 - DNA, 22 bp, Homo sapiens
ctaggtttaactttcacagaaa

SEQ ID NO: 7009640 - DNA, 22 bp, Homo sapiens
ccaaaggatgtccctgtgtttt

SEQ ID NO: 7009641 - DNA, 22 bp, Homo sapiens
tgctgcagaaattctgtgagga

SEQ ID NO: 7009642 - DNA, 22 bp, Homo sapiens
tcaccttgtgatccgcccacct

SEQ ID NO: 7009643 - DNA, 22 bp, Homo sapiens
aaacaaggaaatgtttggttgc

SEQ ID NO: 7009644 - DNA, 22 bp, Homo sapiens
caaagatgccaaaaggaagaca

SEQ ID NO: 7009645 - DNA, 22 bp, Homo sapiens
tgtaattaaactgaagacagaa

SEQ ID NO: 7009646 - DNA, 22 bp, Homo sapiens
tatttatgtctctgcagagaat

SEQ ID NO: 7009647 - DNA, 22 bp, Homo sapiens
ggagggacccactctagaggtg

SEQ ID NO: 7009648 - DNA, 22 bp, Homo sapiens
taacctggggcggtttcccaat

SEQ ID NO: 7009649 - DNA, 22 bp, Homo sapiens
gtgccctgagcttatgcattct

SEQ ID NO: 7009650 - DNA, 22 bp, Homo sapiens
tcccagaatctttggaagagca

SEQ ID NO: 7009651 - DNA, 19 bp, Homo sapiens
agggaaggattctgtcatt

SEQ ID NO: 7009652 - DNA, 22 bp, Homo sapiens
ctggcctggcagggagggcatg

SEQ ID NO: 7009653 - DNA, 22 bp, Homo sapiens
tagcttgactattctatgatgt

SEQ ID NO: 7009654 - DNA, 22 bp, Homo sapiens
cactttatgggaagcaaaaatt

SEQ ID NO: 7009655 - DNA, 22 bp, Homo sapiens
ccacagagactctgcaggactg

SEQ ID NO: 7009656 - DNA, 22 bp, Homo sapiens
tgatttccatgaagctgaaggc

SEQ ID NO: 7009657 - DNA, 22 bp, Homo sapiens
ctgactcccaaagaggacgcgt

SEQ ID NO: 7009658 - DNA, 22 bp, Homo sapiens
gcctggaggggccagggtggta

SEQ ID NO: 7009659 - DNA, 22 bp, Homo sapiens
attaggcaattctgggcatctc

SEQ ID NO: 7009660 - DNA, 22 bp, Homo sapiens
gagttctggtcagcagggcagc

SEQ ID NO: 7009661 - DNA, 22 bp, Homo sapiens
tgtcctggtgctccaggtggct

SEQ ID NO: 7009662 - DNA, 18 bp, Homo sapiens
ctcctccacagcccctgc

SEQ ID NO: 7009663 - DNA, 22 bp, Homo sapiens
ctctttaagctcctaacagcca

SEQ ID NO: 7009664 - DNA, 22 bp, Homo sapiens
agtgaacaagttaagaacacta

SEQ ID NO: 7009665 - DNA, 22 bp, Homo sapiens
ttcatgtaggctgcaatgcaca

SEQ ID NO: 7009666 - DNA, 22 bp, Homo sapiens
agatactggaggttcctacaac

SEQ ID NO: 7009667 - DNA, 22 bp, Homo sapiens
gtctggagccaccctaagcatt

SEQ ID NO: 7009668 - DNA, 22 bp, Homo sapiens
ctggacagtgggcagaggagac

SEQ ID NO: 7009669 - DNA, 22 bp, Homo sapiens
ttccccagtagtgacaatcaaa

SEQ ID NO: 7009670 - DNA, 22 bp, Homo sapiens
ggagggagagtgaccctaccaa

SEQ ID NO: 7009671 - DNA, 22 bp, Homo sapiens
actaaagttcacggtcagcttt

SEQ ID NO: 7009672 - DNA, 22 bp, Homo sapiens
aaactcatgccattaatccttt

SEQ ID NO: 7009673 - DNA, 22 bp, Homo sapiens
gccctgaggcaaaagaacagtc

SEQ ID NO: 7009674 - DNA, 22 bp, Homo sapiens
gagttacattcattgttacgct

SEQ ID NO: 7009675 - DNA, 22 bp, Homo sapiens
gggctgcttttaagggtctcag

SEQ ID NO: 7009676 - DNA, 22 bp, Homo sapiens
catccagggcagccatggcctg

SEQ ID NO: 7009677 - DNA, 22 bp, Homo sapiens
gcccagcaactgcacccttctt

SEQ ID NO: 7009678 - DNA, 22 bp, Homo sapiens
gacctggaatttgtgtgtgttc

SEQ ID NO: 7009679 - DNA, 22 bp, Homo sapiens
tacaggaagtaagtaatgaaat

SEQ ID NO: 7009680 - DNA, 22 bp, Homo sapiens
gtccaggcacctcccttgtgct

SEQ ID NO: 7009681 - DNA, 22 bp, Homo sapiens
atgccaaaatgttacatttctt

SEQ ID NO: 7009682 - DNA, 22 bp, Homo sapiens
gtcacacaggttgaaatgcagt

SEQ ID NO: 7009683 - DNA, 22 bp, Homo sapiens
gagctgagcctgggtggaccgc

SEQ ID NO: 7009684 - DNA, 22 bp, Homo sapiens
aattttgttcttggaaatcagg

SEQ ID NO: 7009685 - DNA, 22 bp, Homo sapiens
atgcaggacataagcatcgaca

SEQ ID NO: 7009686 - DNA, 22 bp, Homo sapiens
gtggttgtttccaggtttgaaa

SEQ ID NO: 7009687 - DNA, 22 bp, Homo sapiens
ctctggtcagtgaattcctagt

SEQ ID NO: 7009688 - DNA, 22 bp, Homo sapiens
agacattttcgttggagaggtt

SEQ ID NO: 7009689 - DNA, 22 bp, Homo sapiens
tggggggcatgaacctccacgg

SEQ ID NO: 7009690 - DNA, 22 bp, Homo sapiens
ggctgtcttgggagctcccccg

SEQ ID NO: 7009691 - DNA, 22 bp, Homo sapiens
tgtctctttggcctcccatatg

SEQ ID NO: 7009692 - DNA, 22 bp, Homo sapiens
tttctttaaaggaactctgttt

SEQ ID NO: 7009693 - DNA, 22 bp, Homo sapiens
gtccaccatagggagggcgtgg

SEQ ID NO: 7009694 - DNA, 22 bp, Homo sapiens
aatttcagttgctaataagttc

SEQ ID NO: 7009695 - DNA, 22 bp, Homo sapiens
tccatagtgaatgggtaatgca

SEQ ID NO: 7009696 - DNA, 20 bp, Homo sapiens
tgcttgtaatacctgcttca

SEQ ID NO: 7009697 - DNA, 22 bp, Homo sapiens
gaactggtgagagttcacggga

SEQ ID NO: 7009698 - DNA, 22 bp, Homo sapiens
atgtgtccacaggtgtgagaga

SEQ ID NO: 7009699 - DNA, 22 bp, Homo sapiens
ggggccactggcaggaccttgg

SEQ ID NO: 7009700 - DNA, 22 bp, Homo sapiens
ctggtgcaagattccctgcttc

SEQ ID NO: 7009701 - DNA, 19 bp, Homo sapiens
gtgtcaggatgtgcagggg

SEQ ID NO: 7009702 - DNA, 22 bp, Homo sapiens
agggccctccccgctcagggca

SEQ ID NO: 7009703 - DNA, 20 bp, Homo sapiens
ttctaactactctccctttg

SEQ ID NO: 7009704 - DNA, 22 bp, Homo sapiens
tattgggtaaagatccagtttt

SEQ ID NO: 7009705 - DNA, 22 bp, Homo sapiens
cagtatgttcttccaggacaga

SEQ ID NO: 7009706 - DNA, 22 bp, Homo sapiens
caggatgatgttaattgaagtt

SEQ ID NO: 7009707 - DNA, 22 bp, Homo sapiens
ttgggcaggatgacaccacttg

SEQ ID NO: 7009708 - DNA, 22 bp, Homo sapiens
gacattgaaaataatgtgtaga

SEQ ID NO: 7009709 - DNA, 22 bp, Homo sapiens
agctgcaagataaaagtgatgt

SEQ ID NO: 7009710 - DNA, 22 bp, Homo sapiens
aatatagttctggtattgttaa

SEQ ID NO: 7009711 - DNA, 22 bp, Homo sapiens
actctaactaattaataaagcc

SEQ ID NO: 7009712 - DNA, 22 bp, Homo sapiens
agagaggcgagttacctgtgct

SEQ ID NO: 7009713 - DNA, 22 bp, Homo sapiens
ccagcctggactgggtcttgtg

SEQ ID NO: 7009714 - DNA, 22 bp, Homo sapiens
agccagatacttggaaagaccc

SEQ ID NO: 7009715 - DNA, 22 bp, Homo sapiens
cttagctccagacccacatgac

SEQ ID NO: 7009716 - DNA, 22 bp, Homo sapiens
ttagttgacccccagtcctggc

SEQ ID NO: 7009717 - DNA, 22 bp, Homo sapiens
agagccttcagagattatttta

SEQ ID NO: 7009718 - DNA, 22 bp, Homo sapiens
taccaagtgtattatgctttgt

SEQ ID NO: 7009719 - DNA, 22 bp, Homo sapiens
ggacttcttgggcctgcaggga

SEQ ID NO: 7009720 - DNA, 22 bp, Homo sapiens
aggtactaccagggattttcag

SEQ ID NO: 7009721 - DNA, 22 bp, Homo sapiens
tttcatgcctcttgagaaagat

SEQ ID NO: 7009722 - DNA, 22 bp, Homo sapiens
ctggcccattgccttctctctc

SEQ ID NO: 7009723 - DNA, 20 bp, Homo sapiens
ctgggcacctgtctgcagtt

SEQ ID NO: 7009724 - DNA, 22 bp, Homo sapiens
cctcccttccccagtagtcaag

SEQ ID NO: 7009725 - DNA, 22 bp, Homo sapiens
gtaaacatgctgtgtactcagc

SEQ ID NO: 7009726 - DNA, 22 bp, Homo sapiens
taggcgacagcttgatggtgcg

SEQ ID NO: 7009727 - DNA, 22 bp, Homo sapiens
agacactggcactggggaagcc

SEQ ID NO: 7009728 - DNA, 22 bp, Homo sapiens
gagcagtgagtgaatgttgcct

SEQ ID NO: 7009729 - DNA, 22 bp, Homo sapiens
tctagcagagggaagaggcttt

SEQ ID NO: 7009730 - DNA, 22 bp, Homo sapiens
aagtcactgttttagttttctc

SEQ ID NO: 7009731 - DNA, 22 bp, Homo sapiens
tctctgaagatatttattatta

SEQ ID NO: 7009732 - DNA, 22 bp, Homo sapiens
caggaggacatactggctcaca

SEQ ID NO: 7009733 - DNA, 22 bp, Homo sapiens
ggccagcggcacagcctggccc

SEQ ID NO: 7009734 - DNA, 22 bp, Homo sapiens
gcttccaggtcattctcaccct

SEQ ID NO: 7009735 - DNA, 22 bp, Homo sapiens
tttgctattgtgaatagtgcca

SEQ ID NO: 7009736 - DNA, 22 bp, Homo sapiens
tgaagcccttcatgcacagtca

SEQ ID NO: 7009737 - DNA, 19 bp, Homo sapiens
aaacctgttagtagagcac

SEQ ID NO: 7009738 - DNA, 22 bp, Homo sapiens
actaattgagtgcatgatcttt

SEQ ID NO: 7009739 - DNA, 23 bp, Homo sapiens
gaactgttgatgaatagaatata

SEQ ID NO: 7009740 - DNA, 22 bp, Homo sapiens
atccaggagggctgactcctta

SEQ ID NO: 7009741 - DNA, 22 bp, Homo sapiens
gtatctttcaccagctcccagg

SEQ ID NO: 7009742 - DNA, 22 bp, Homo sapiens
tgggacagggaatctgatcccc

SEQ ID NO: 7009743 - DNA, 22 bp, Homo sapiens
tgcctggagtgtgttcaggatt

SEQ ID NO: 7009744 - DNA, 22 bp, Homo sapiens
gaggctccttgaaagggggact

SEQ ID NO: 7009745 - DNA, 22 bp, Homo sapiens
ggtcctttgaaaggggtgtgtc

SEQ ID NO: 7009746 - DNA, 22 bp, Homo sapiens
gagctcttatagttctagcagt

SEQ ID NO: 7009747 - DNA, 22 bp, Homo sapiens
tgtccagtttcggatgtaacat

SEQ ID NO: 7009748 - DNA, 22 bp, Homo sapiens
agtctggtgagaacataaatag

SEQ ID NO: 7009749 - DNA, 22 bp, Homo sapiens
caaggagagtaattgaatgaga

SEQ ID NO: 7009750 - DNA, 22 bp, Homo sapiens
tggccctttgggtgcaggggca

SEQ ID NO: 7009751 - DNA, 22 bp, Homo sapiens
agggctcagtaaacggtggatt

SEQ ID NO: 7009752 - DNA, 22 bp, Homo sapiens
agggatggagtgcggcccggac

SEQ ID NO: 7009753 - DNA, 22 bp, Homo sapiens
tgctggcttagatatcactgcc

SEQ ID NO: 7009754 - DNA, 22 bp, Homo sapiens
tgcagggcagtggaggttgagt

SEQ ID NO: 7009755 - DNA, 22 bp, Homo sapiens
agcacagaaagtattgactgaa

SEQ ID NO: 7009756 - DNA, 20 bp, Homo sapiens
agtagacaactgcaggtgtg

SEQ ID NO: 7009757 - DNA, 22 bp, Homo sapiens
taggtctgatttccattcagtc

SEQ ID NO: 7009758 - DNA, 22 bp, Homo sapiens
aacaggcttttggaaagttaca

SEQ ID NO: 7009759 - DNA, 22 bp, Homo sapiens
acgaaatactttgcacagtttt

SEQ ID NO: 7009760 - DNA, 22 bp, Homo sapiens
tcaccttgtgatctccctgcct

SEQ ID NO: 7009761 - DNA, 20 bp, Homo sapiens
aattagatgtttaatcaata

SEQ ID NO: 7009762 - DNA, 22 bp, Homo sapiens
tgtgaccactagcacagctgcc

SEQ ID NO: 7009763 - DNA, 22 bp, Homo sapiens
tctgtgtaagaccagtgctggg

SEQ ID NO: 7009764 - DNA, 22 bp, Homo sapiens
gtccgtagtggctgatgctttg

SEQ ID NO: 7009765 - DNA, 22 bp, Homo sapiens
atttgtgaattaagcatgtcaa

SEQ ID NO: 7009766 - DNA, 22 bp, Homo sapiens
cacatgggcacagagaacttgg

SEQ ID NO: 7009767 - DNA, 22 bp, Homo sapiens
ttgcaggggaaggagcagagct

SEQ ID NO: 7009768 - DNA, 18 bp, Homo sapiens
ctgctgtgtcgtctgggc

SEQ ID NO: 7009769 - DNA, 22 bp, Homo sapiens
gcagaccagcccctggagctgc

SEQ ID NO: 7009770 - DNA, 22 bp, Homo sapiens
gtgacagaaacagggctagaat

SEQ ID NO: 7009771 - DNA, 22 bp, Homo sapiens
actgcttttctaagattctgtg

SEQ ID NO: 7009772 - DNA, 22 bp, Homo sapiens
agtttgtatcaatttgctttat

SEQ ID NO: 7009773 - DNA, 22 bp, Homo sapiens
ttatttgttttctgagaagtat

SEQ ID NO: 7009774 - DNA, 22 bp, Homo sapiens
cagagtcagagcacctgggatt

SEQ ID NO: 7009775 - DNA, 22 bp, Homo sapiens
tttcccttgttccttcctctga

SEQ ID NO: 7009776 - DNA, 22 bp, Homo sapiens
ctggggtgtctcgtctgccatt

SEQ ID NO: 7009777 - DNA, 22 bp, Homo sapiens
ctgcctgtgcatgcagtcagaa

SEQ ID NO: 7009778 - DNA, 22 bp, Homo sapiens
cttctcattcaagcaaaacaga

SEQ ID NO: 7009779 - DNA, 23 bp, Homo sapiens
gagagctgactgtcaagactgtt

SEQ ID NO: 7009780 - DNA, 22 bp, Homo sapiens
atgtttttgagatacaaacaga

SEQ ID NO: 7009781 - DNA, 22 bp, Homo sapiens
ttacacgtgtgtgtatctgtat

SEQ ID NO: 7009782 - DNA, 22 bp, Homo sapiens
tgctgctgatgcatagtctgct

SEQ ID NO: 7009783 - DNA, 20 bp, Homo sapiens
ctctgggtcgagacagactt

SEQ ID NO: 7009784 - DNA, 22 bp, Homo sapiens
tatatgctctgggatcctgaaa

SEQ ID NO: 7009785 - DNA, 22 bp, Homo sapiens
atgctgattttatagaataaag

SEQ ID NO: 7009786 - DNA, 22 bp, Homo sapiens
ggccttggggaggatggtgtcc

SEQ ID NO: 7009787 - DNA, 22 bp, Homo sapiens
tgctgccttgtgctgcctttca

SEQ ID NO: 7009788 - DNA, 22 bp, Homo sapiens
tatctacaggtgtcaggtaaga

SEQ ID NO: 7009789 - DNA, 22 bp, Homo sapiens
aatgaactccgaacatttacat

SEQ ID NO: 7009790 - DNA, 22 bp, Homo sapiens
gtccatgcttaaataccttaaa

SEQ ID NO: 7009791 - DNA, 22 bp, Homo sapiens
taactgattcctttttgaaaat

SEQ ID NO: 7009792 - DNA, 22 bp, Homo sapiens
gacagaggcaagaccagaagcc

SEQ ID NO: 7009793 - DNA, 22 bp, Homo sapiens
tttccagtaagtggcaaggagc

SEQ ID NO: 7009794 - DNA, 22 bp, Homo sapiens
aagaattggtttcctctgtcat

SEQ ID NO: 7009795 - DNA, 21 bp, Homo sapiens
aaagaggttaatattgtaagt

SEQ ID NO: 7009796 - DNA, 22 bp, Homo sapiens
actctccttttgatcttcagaa

SEQ ID NO: 7009797 - DNA, 22 bp, Homo sapiens
gtgaactatttcggaaggggaa

SEQ ID NO: 7009798 - DNA, 19 bp, Homo sapiens
ctggctgcaatgccagggt

SEQ ID NO: 7009799 - DNA, 22 bp, Homo sapiens
cctgtgtgattggaagctgaga

SEQ ID NO: 7009800 - DNA, 20 bp, Homo sapiens
cttcttggagatggtgtttt

SEQ ID NO: 7009801 - DNA, 22 bp, Homo sapiens
accagctggtcagggcttttct

SEQ ID NO: 7009802 - DNA, 22 bp, Homo sapiens
agtgcagagtacatttgtggca

SEQ ID NO: 7009803 - DNA, 22 bp, Homo sapiens
aggctggccagtgctgcagtgg

SEQ ID NO: 7009804 - DNA, 22 bp, Homo sapiens
gctgagatgtcgttagatatct

SEQ ID NO: 7009805 - DNA, 22 bp, Homo sapiens
gccacagcaacaataatgcagc

SEQ ID NO: 7009806 - DNA, 22 bp, Homo sapiens
ctggctccattactcagcatct

SEQ ID NO: 7009807 - DNA, 22 bp, Homo sapiens
gcttgcatgatatggcatctgg

SEQ ID NO: 7009808 - DNA, 21 bp, Homo sapiens
tgaacactctacccatttttt

SEQ ID NO: 7009809 - DNA, 22 bp, Homo sapiens
ctgccaggtgagctccaggcct

SEQ ID NO: 7009810 - DNA, 22 bp, Homo sapiens
cactgcccaactgttttccaaa

SEQ ID NO: 7009811 - DNA, 18 bp, Homo sapiens
tcaaagtctggctccact

SEQ ID NO: 7009812 - DNA, 22 bp, Homo sapiens
gcaggcagagaaggaacattta

SEQ ID NO: 7009813 - DNA, 22 bp, Homo sapiens
gcagccttctactgaatcctct

SEQ ID NO: 7009814 - DNA, 20 bp, Homo sapiens
tgtgcatgaactgagggatt

SEQ ID NO: 7009815 - DNA, 21 bp, Homo sapiens
tcagcagaatatgaactgcac

SEQ ID NO: 7009816 - DNA, 22 bp, Homo sapiens
tgggttcttaaagggctaggtt

SEQ ID NO: 7009817 - DNA, 22 bp, Homo sapiens
tgtcaatagttttgagttctct

SEQ ID NO: 7009818 - DNA, 22 bp, Homo sapiens
atggcttctgtcttggaaattt

SEQ ID NO: 7009819 - DNA, 22 bp, Homo sapiens
gccacctgtaagccattaggcc

SEQ ID NO: 7009820 - DNA, 22 bp, Homo sapiens
ttcctcagggaggctagcagta

SEQ ID NO: 7009821 - DNA, 22 bp, Homo sapiens
aatgggttgctttccacagcct

SEQ ID NO: 7009822 - DNA, 22 bp, Homo sapiens
catgtctgccaatttggaagga

SEQ ID NO: 7009823 - DNA, 22 bp, Homo sapiens
ttgaggaggcctttcagggctt

SEQ ID NO: 7009824 - DNA, 22 bp, Homo sapiens
ttcaatagaaatgacattcttt

SEQ ID NO: 7009825 - DNA, 22 bp, Homo sapiens
atggacagcaactggaagcttc

SEQ ID NO: 7009826 - DNA, 22 bp, Homo sapiens
agatttccatctttttcatgtg

SEQ ID NO: 7009827 - DNA, 22 bp, Homo sapiens
gagctggaagtctgtggtcaga

SEQ ID NO: 7009828 - DNA, 22 bp, Homo sapiens
agtggcatcaaatcaaggtttg

SEQ ID NO: 7009829 - DNA, 22 bp, Homo sapiens
atggtacagataatacatgctg

SEQ ID NO: 7009830 - DNA, 22 bp, Homo sapiens
tttcagggtgctccagacaccc

SEQ ID NO: 7009831 - DNA, 22 bp, Homo sapiens
caggatgttgctcccatgtccc

SEQ ID NO: 7009832 - DNA, 22 bp, Homo sapiens
tatttatgtatgtggatgtgtt

SEQ ID NO: 7009833 - DNA, 22 bp, Homo sapiens
ggcatttaggcagataacagac

SEQ ID NO: 7009834 - DNA, 22 bp, Homo sapiens
caggtccaattgcgctaaaatc

SEQ ID NO: 7009835 - DNA, 22 bp, Homo sapiens
ataatggactcagtaatagtga

SEQ ID NO: 7009836 - DNA, 22 bp, Homo sapiens
tgtttacaaaaccgtggtactg

SEQ ID NO: 7009837 - DNA, 22 bp, Homo sapiens
gacaagatttagagtctgctaa

SEQ ID NO: 7009838 - DNA, 22 bp, Homo sapiens
gaagcctgctgtgcagccaaat

SEQ ID NO: 7009839 - DNA, 22 bp, Homo sapiens
tctcttcctagtgatgggcttt

SEQ ID NO: 7009840 - DNA, 22 bp, Homo sapiens
acaggtgcatgctaccatgtct

SEQ ID NO: 7009841 - DNA, 22 bp, Homo sapiens
tgtcccagttttgcaggttaga

SEQ ID NO: 7009842 - DNA, 22 bp, Homo sapiens
aagtcttatttgtcatgtatgt

SEQ ID NO: 7009843 - DNA, 22 bp, Homo sapiens
ggagtctgtgtcttgaagcagt

SEQ ID NO: 7009844 - DNA, 22 bp, Homo sapiens
ggagagtctgccgagccagccc

SEQ ID NO: 7009845 - DNA, 22 bp, Homo sapiens
cagggagaaatctccaggaggt

SEQ ID NO: 7009846 - DNA, 22 bp, Homo sapiens
tatcagataatcttttacaagc

SEQ ID NO: 7009847 - DNA, 22 bp, Homo sapiens
tgggagcaggtgtgctagggaa

SEQ ID NO: 7009848 - DNA, 22 bp, Homo sapiens
aggaagaaatgtgacttcaaac

SEQ ID NO: 7009849 - DNA, 22 bp, Homo sapiens
agcccagttgctccacgctgca

SEQ ID NO: 7009850 - DNA, 22 bp, Homo sapiens
tttaggcagctacatactaact

SEQ ID NO: 7009851 - DNA, 22 bp, Homo sapiens
ggcacttttctccccggtcatg

SEQ ID NO: 7009852 - DNA, 22 bp, Homo sapiens
caaagcaaggctcagtttgaac

SEQ ID NO: 7009853 - DNA, 22 bp, Homo sapiens
ttgcctggtcctgtgggtgctg

SEQ ID NO: 7009854 - DNA, 21 bp, Homo sapiens
acagatgggatgagcacactg

SEQ ID NO: 7009855 - DNA, 22 bp, Homo sapiens
agtccaggctcttcctgaagaa

SEQ ID NO: 7009856 - DNA, 22 bp, Homo sapiens
agtatgaacggaaggcctggga

SEQ ID NO: 7009857 - DNA, 22 bp, Homo sapiens
cagcagagaaattacatatttg

SEQ ID NO: 7009858 - DNA, 22 bp, Homo sapiens
gcacagtgatgtcagaattgga

SEQ ID NO: 7009859 - DNA, 21 bp, Homo sapiens
agtaattgcggtgattagtga

SEQ ID NO: 7009860 - DNA, 22 bp, Homo sapiens
ctgaaggaggtagagtgacata

SEQ ID NO: 7009861 - DNA, 22 bp, Homo sapiens
gcagccttatcattagagtgtt

SEQ ID NO: 7009862 - DNA, 22 bp, Homo sapiens
ggcagctgggttggccagaaac

SEQ ID NO: 7009863 - DNA, 22 bp, Homo sapiens
aggcatggggctgcagtcaggt

SEQ ID NO: 7009864 - DNA, 22 bp, Homo sapiens
gaggctcagagaggtccacata

SEQ ID NO: 7009865 - DNA, 20 bp, Homo sapiens
tcttccagagacattttccc

SEQ ID NO: 7009866 - DNA, 22 bp, Homo sapiens
tggctttacacatccactgcct

SEQ ID NO: 7009867 - DNA, 22 bp, Homo sapiens
tgtagtgtggcctatctttgcc

SEQ ID NO: 7009868 - DNA, 22 bp, Homo sapiens
ttgagaagaatgtgttgagttt

SEQ ID NO: 7009869 - DNA, 22 bp, Homo sapiens
tacatgtctacatgcatttttg

SEQ ID NO: 7009870 - DNA, 22 bp, Homo sapiens
tagctcttaccaggtggccatg

SEQ ID NO: 7009871 - DNA, 22 bp, Homo sapiens
agtatttgttgattgatatgaa

SEQ ID NO: 7009872 - DNA, 22 bp, Homo sapiens
ctggacagaagtggctgggcag

SEQ ID NO: 7009873 - DNA, 22 bp, Homo sapiens
atgtggctgatcgcagagctct

SEQ ID NO: 7009874 - DNA, 22 bp, Homo sapiens
aggtccctaatcatttcacttt

SEQ ID NO: 7009875 - DNA, 22 bp, Homo sapiens
cagaggctgacaaaatattgct

SEQ ID NO: 7009876 - DNA, 20 bp, Homo sapiens
tgaagattttgtgtttagaa

SEQ ID NO: 7009877 - DNA, 22 bp, Homo sapiens
attagcaattgtgcatctagta

SEQ ID NO: 7009878 - DNA, 22 bp, Homo sapiens
tggtaactgtttagtgttaatg

SEQ ID NO: 7009879 - DNA, 22 bp, Homo sapiens
gaggagctgggtcagggagaca

SEQ ID NO: 7009880 - DNA, 22 bp, Homo sapiens
gaaacactcaatttagtaattc

SEQ ID NO: 7009881 - DNA, 22 bp, Homo sapiens
agttagagacacatgcacatgc

SEQ ID NO: 7009882 - DNA, 22 bp, Homo sapiens
tgctgaccttgttctgtgagga

SEQ ID NO: 7009883 - DNA, 22 bp, Homo sapiens
atgtggcttggcagggaatatg

SEQ ID NO: 7009884 - DNA, 22 bp, Homo sapiens
ttcagcttgaatctggctttga

SEQ ID NO: 7009885 - DNA, 22 bp, Homo sapiens
agagccctgccaatggatgagg

SEQ ID NO: 7009886 - DNA, 22 bp, Homo sapiens
agtcacttcgtgagcactgact

SEQ ID NO: 7009887 - DNA, 22 bp, Homo sapiens
atggctattttagagatcaagg

SEQ ID NO: 7009888 - DNA, 22 bp, Homo sapiens
gctctagtaggaatgtccctct

SEQ ID NO: 7009889 - DNA, 22 bp, Homo sapiens
cactggctaaaaaagaggcaga

SEQ ID NO: 7009890 - DNA, 22 bp, Homo sapiens
ccacatttcttcacttgtccca

SEQ ID NO: 7009891 - DNA, 22 bp, Homo sapiens
aaatggatctttttataatgca

SEQ ID NO: 7009892 - DNA, 22 bp, Homo sapiens
caagcagggtttatgcatggag

SEQ ID NO: 7009893 - DNA, 22 bp, Homo sapiens
cagcccagcactaagtagattt

SEQ ID NO: 7009894 - DNA, 22 bp, Homo sapiens
gccaggcgggtctcaaactcct

SEQ ID NO: 7009895 - DNA, 22 bp, Homo sapiens
aattaaaagataacccatgagt

SEQ ID NO: 7009896 - DNA, 22 bp, Homo sapiens
tatgggcatataaagaagtatg

SEQ ID NO: 7009897 - DNA, 22 bp, Homo sapiens
ctcagaggggatgcaatcttgc

SEQ ID NO: 7009898 - DNA, 22 bp, Homo sapiens
gcttctgttaacttatgttccc

SEQ ID NO: 7009899 - DNA, 22 bp, Homo sapiens
gcaggtacccttgtccatgaca

SEQ ID NO: 7009900 - DNA, 22 bp, Homo sapiens
ttgaggtcaattctgtttcctg

SEQ ID NO: 7009901 - DNA, 22 bp, Homo sapiens
atggctgttggcaggaggcctc

SEQ ID NO: 7009902 - DNA, 21 bp, Homo sapiens
tgggtggaagcgggaggccgc

SEQ ID NO: 7009903 - DNA, 22 bp, Homo sapiens
gcagtgaagccagatctgaaat

SEQ ID NO: 7009904 - DNA, 22 bp, Homo sapiens
tgtaaactggatttgagggtgg

SEQ ID NO: 7009905 - DNA, 22 bp, Homo sapiens
cagtatattttagagaagtccc

SEQ ID NO: 7009906 - DNA, 22 bp, Homo sapiens
agggagaatgaccaaggtatat

SEQ ID NO: 7009907 - DNA, 22 bp, Homo sapiens
atgtggatgtttatatgaagaa

SEQ ID NO: 7009908 - DNA, 22 bp, Homo sapiens
aagccactgagatttcactgca

SEQ ID NO: 7009909 - DNA, 22 bp, Homo sapiens
taaaatcagccgaccatggtgg

SEQ ID NO: 7009910 - DNA, 22 bp, Homo sapiens
gccaatttggggagccgtggtg

SEQ ID NO: 7009911 - DNA, 22 bp, Homo sapiens
aaatggctccagttgacttttt

SEQ ID NO: 7009912 - DNA, 22 bp, Homo sapiens
tctgtacaccaggggccattct

SEQ ID NO: 7009913 - DNA, 22 bp, Homo sapiens
acctggcaggaaggtgggtgat

SEQ ID NO: 7009914 - DNA, 22 bp, Homo sapiens
acagtgaggacagggactgtgt

SEQ ID NO: 7009915 - DNA, 22 bp, Homo sapiens
agtttgtaagttcattatgagt

SEQ ID NO: 7009916 - DNA, 22 bp, Homo sapiens
ccccaaaacttggtgacttcca

SEQ ID NO: 7009917 - DNA, 22 bp, Homo sapiens
gggctcagcctcctcacttcga

SEQ ID NO: 7009918 - DNA, 22 bp, Homo sapiens
gaaggcctgtggtagtgagacg

SEQ ID NO: 7009919 - DNA, 22 bp, Homo sapiens
tgacatgtatgttgttggcatg

SEQ ID NO: 7009920 - DNA, 22 bp, Homo sapiens
cagctgtggagatggggtgcat

SEQ ID NO: 7009921 - DNA, 21 bp, Homo sapiens
ccaagatgaataataatgagg

SEQ ID NO: 7009922 - DNA, 22 bp, Homo sapiens
gttatgctgagttgcatgaggt

SEQ ID NO: 7009923 - DNA, 22 bp, Homo sapiens
tttttctagctcaaagattcta

SEQ ID NO: 7009924 - DNA, 23 bp, Homo sapiens
gcctgggagttgcgatctgcccg

SEQ ID NO: 7009925 - DNA, 23 bp, Homo sapiens
agaagggtccttggcagcgacag

SEQ ID NO: 7009926 - DNA, 22 bp, Homo sapiens
tctgattagctccatttgctaa

SEQ ID NO: 7009927 - DNA, 22 bp, Homo sapiens
attgtggctagacagtcacaat

SEQ ID NO: 7009928 - DNA, 22 bp, Homo sapiens
acatacttagagtaaacaagta

SEQ ID NO: 7009929 - DNA, 22 bp, Homo sapiens
cacagaggcaaccttctggggt

SEQ ID NO: 7009930 - DNA, 23 bp, Homo sapiens
agcagccatagggaagcaataca

SEQ ID NO: 7009931 - DNA, 21 bp, Homo sapiens
agtctacaactagggaagctg

SEQ ID NO: 7009932 - DNA, 22 bp, Homo sapiens
cagtctctctgaagtattaaga

SEQ ID NO: 7009933 - DNA, 22 bp, Homo sapiens
ccacattcactcatttcattgt

SEQ ID NO: 7009934 - DNA, 22 bp, Homo sapiens
ggtagctgcagcaggctggcaa

SEQ ID NO: 7009935 - DNA, 22 bp, Homo sapiens
tctcactgggtcacagcagagg

SEQ ID NO: 7009936 - DNA, 22 bp, Homo sapiens
aacagagctgaccagtgagggc

SEQ ID NO: 7009937 - DNA, 22 bp, Homo sapiens
agatggctgatataaagataag

SEQ ID NO: 7009938 - DNA, 22 bp, Homo sapiens
gccagctgccaagttgtgagat

SEQ ID NO: 7009939 - DNA, 22 bp, Homo sapiens
gttagaaatgcagaaacttgac

SEQ ID NO: 7009940 - DNA, 22 bp, Homo sapiens
gcctttggatatattcagggat

SEQ ID NO: 7009941 - DNA, 22 bp, Homo sapiens
ctgtgccctgtggctggcacct

SEQ ID NO: 7009942 - DNA, 22 bp, Homo sapiens
tccagagcaaagtttgctaaca

SEQ ID NO: 7009943 - DNA, 22 bp, Homo sapiens
tcagttcttgggctgctaggac

SEQ ID NO: 7009944 - DNA, 14 bp, Homo sapiens
ggctgcttcccttt

SEQ ID NO: 7009945 - DNA, 22 bp, Homo sapiens
ctaggcatgtgaggaattctaa

SEQ ID NO: 7009946 - DNA, 22 bp, Homo sapiens
tttcctagagtctctagaagaa

SEQ ID NO: 7009947 - DNA, 22 bp, Homo sapiens
tctgtgcttaactactcacccc

SEQ ID NO: 7009948 - DNA, 22 bp, Homo sapiens
ttcttaagtcagtaagatgcaa

SEQ ID NO: 7009949 - DNA, 22 bp, Homo sapiens
atctgcttcctccttagggaaa

SEQ ID NO: 7009950 - DNA, 22 bp, Homo sapiens
acctgccttctcaaggacatga

SEQ ID NO: 7009951 - DNA, 22 bp, Homo sapiens
acagtgattggcactgattcag

SEQ ID NO: 7009952 - DNA, 22 bp, Homo sapiens
ctgaagcaggaacagcgagatt

SEQ ID NO: 7009953 - DNA, 22 bp, Homo sapiens
ttgaggtaaagctactagttag

SEQ ID NO: 7009954 - DNA, 22 bp, Homo sapiens
cctgcagccgtcctgtttgtct

SEQ ID NO: 7009955 - DNA, 22 bp, Homo sapiens
tgggagttaacattggtctctg

SEQ ID NO: 7009956 - DNA, 22 bp, Homo sapiens
tgccttcctggagctgaaggct

SEQ ID NO: 7009957 - DNA, 22 bp, Homo sapiens
caggtctctgcagcccctctgt

SEQ ID NO: 7009958 - DNA, 22 bp, Homo sapiens
ttggccttgaacatggtttagg

SEQ ID NO: 7009959 - DNA, 22 bp, Homo sapiens
ccaggctgctcacaagctgccc

SEQ ID NO: 7009960 - DNA, 22 bp, Homo sapiens
tgagatagtatgtagcacctga

SEQ ID NO: 7009961 - DNA, 22 bp, Homo sapiens
tagaatctgaaagtggctgtga

SEQ ID NO: 7009962 - DNA, 22 bp, Homo sapiens
acagtgtgatgggcctgcctga

SEQ ID NO: 7009963 - DNA, 22 bp, Homo sapiens
gctgctgggaatgaacagtgtt

SEQ ID NO: 7009964 - DNA, 18 bp, Homo sapiens
ggctggataccttaggaa

SEQ ID NO: 7009965 - DNA, 22 bp, Homo sapiens
atggtattctcagcacctagca

SEQ ID NO: 7009966 - DNA, 22 bp, Homo sapiens
gtacatctttaaattgttcagt

SEQ ID NO: 7009967 - DNA, 22 bp, Homo sapiens
gatttctttatgaagtacagaa

SEQ ID NO: 7009968 - DNA, 22 bp, Homo sapiens
tctgcctggattttggaaagct

SEQ ID NO: 7009969 - DNA, 22 bp, Homo sapiens
gctgctcagtgggcctgagcct

SEQ ID NO: 7009970 - DNA, 22 bp, Homo sapiens
ctgtctgtgtggacacggctgc

SEQ ID NO: 7009971 - DNA, 22 bp, Homo sapiens
gcttggctcctggctcacaggt

SEQ ID NO: 7009972 - DNA, 22 bp, Homo sapiens
gcagccccaggagacgcccagg

SEQ ID NO: 7009973 - DNA, 22 bp, Homo sapiens
acctgttttcagaaaatgcaga

SEQ ID NO: 7009974 - DNA, 22 bp, Homo sapiens
taacatctgggctgcgtcctga

SEQ ID NO: 7009975 - DNA, 19 bp, Homo sapiens
gtagactttggttatgcag

SEQ ID NO: 7009976 - DNA, 22 bp, Homo sapiens
gtcaatatcgccaagtgtctct

SEQ ID NO: 7009977 - DNA, 22 bp, Homo sapiens
tgatttatgcattatactgttg

SEQ ID NO: 7009978 - DNA, 22 bp, Homo sapiens
acatgcattaaaaatacttgtg

SEQ ID NO: 7009979 - DNA, 22 bp, Homo sapiens
ttttctccaactcaaaggaaag

SEQ ID NO: 7009980 - DNA, 22 bp, Homo sapiens
ccttcctggagcccatgcagat

SEQ ID NO: 7009981 - DNA, 22 bp, Homo sapiens
taaatgaaagggtttaatttat

SEQ ID NO: 7009982 - DNA, 22 bp, Homo sapiens
aagtcggaagcattcttctgaa

SEQ ID NO: 7009983 - DNA, 22 bp, Homo sapiens
aatgtctttatttcaggtttac

SEQ ID NO: 7009984 - DNA, 22 bp, Homo sapiens
actaaatggaatgattactata

SEQ ID NO: 7009985 - DNA, 22 bp, Homo sapiens
gcttcccagcagaggaaagact

SEQ ID NO: 7009986 - DNA, 22 bp, Homo sapiens
aaacattgttatgataaattac

SEQ ID NO: 7009987 - DNA, 22 bp, Homo sapiens
tacagtacctgccacgttgttg

SEQ ID NO: 7009988 - DNA, 22 bp, Homo sapiens
gctggccattctctttgagatg

SEQ ID NO: 7009989 - DNA, 22 bp, Homo sapiens
ttcagctttgaggttgattttc

SEQ ID NO: 7009990 - DNA, 22 bp, Homo sapiens
tactgcacttgagaaagctgag

SEQ ID NO: 7009991 - DNA, 22 bp, Homo sapiens
atgcttcctaaccatggccgtg

SEQ ID NO: 7009992 - DNA, 22 bp, Homo sapiens
tctgggagccatgccttggagt

SEQ ID NO: 7009993 - DNA, 22 bp, Homo sapiens
ctgtttcagctactgttccatg

SEQ ID NO: 7009994 - DNA, 22 bp, Homo sapiens
ggaagccccagctgtgggatcc

SEQ ID NO: 7009995 - DNA, 22 bp, Homo sapiens
aggcctctgggtctcctctgac

SEQ ID NO: 7009996 - DNA, 22 bp, Homo sapiens
ggctctggagatgtccgacctg

SEQ ID NO: 7009997 - DNA, 22 bp, Homo sapiens
gctgtgatacagaaagacagag

SEQ ID NO: 7009998 - DNA, 22 bp, Homo sapiens
gttcgttgcttggtttcctcta

SEQ ID NO: 7009999 - DNA, 22 bp, Homo sapiens
cctgagctgactctcctttcag

SEQ ID NO: 7010000 - DNA, 22 bp, Homo sapiens
caggctcactttctcagtcaca

SEQ ID NO: 7010001 - DNA, 22 bp, Homo sapiens
ctcatttgttctgcagaagatc

SEQ ID NO: 7010002 - DNA, 22 bp, Homo sapiens
gtaggagctcatggggccagga

SEQ ID NO: 7010003 - DNA, 22 bp, Homo sapiens
acagactgattcattgctcagg

SEQ ID NO: 7010004 - DNA, 22 bp, Homo sapiens
ttggaaagggatatctgtactt

SEQ ID NO: 7010005 - DNA, 22 bp, Homo sapiens
ctgcaaaggtgggggaggagct

SEQ ID NO: 7010006 - DNA, 22 bp, Homo sapiens
gcacaattttgttgtcatggag

SEQ ID NO: 7010007 - DNA, 22 bp, Homo sapiens
ttaacttttatttctgctcgcc

SEQ ID NO: 7010008 - DNA, 22 bp, Homo sapiens
tagaggcattaatgaataaaca

SEQ ID NO: 7010009 - DNA, 22 bp, Homo sapiens
tggaggcctaggttgatgtgtg

SEQ ID NO: 7010010 - DNA, 17 bp, Homo sapiens
tgcttgactctcttgtt

SEQ ID NO: 7010011 - DNA, 22 bp, Homo sapiens
ccctgaggaaagggtggagggc

SEQ ID NO: 7010012 - DNA, 22 bp, Homo sapiens
agctggtctgctgcatggagtg

SEQ ID NO: 7010013 - DNA, 22 bp, Homo sapiens
gcgcctattttcattatcaagg

SEQ ID NO: 7010014 - DNA, 22 bp, Homo sapiens
gttctgcagacttggaaggtgg

SEQ ID NO: 7010015 - DNA, 22 bp, Homo sapiens
ggccttcctggcggctcagggt

SEQ ID NO: 7010016 - DNA, 22 bp, Homo sapiens
gctctgctggagggaaagagaa

SEQ ID NO: 7010017 - DNA, 22 bp, Homo sapiens
tctgcacccacgtaccttggct

SEQ ID NO: 7010018 - DNA, 23 bp, Homo sapiens
agtatgaattcattgttttagtt

SEQ ID NO: 7010019 - DNA, 22 bp, Homo sapiens
ttgaaggtaaattatattgatc

SEQ ID NO: 7010020 - DNA, 22 bp, Homo sapiens
tatcagtctcctggctgtgtca

SEQ ID NO: 7010021 - DNA, 22 bp, Homo sapiens
ttggattctcaccccacctctg

SEQ ID NO: 7010022 - DNA, 22 bp, Homo sapiens
gggaatgtggtgatagtctata

SEQ ID NO: 7010023 - DNA, 22 bp, Homo sapiens
tagctgtgtagacactcagagc

SEQ ID NO: 7010024 - DNA, 22 bp, Homo sapiens
tgtgccagcctctggctgtgtc

SEQ ID NO: 7010025 - DNA, 22 bp, Homo sapiens
cctggatcagagccagagaagc

SEQ ID NO: 7010026 - DNA, 22 bp, Homo sapiens
tcctgacctgaactggggtctt

SEQ ID NO: 7010027 - DNA, 23 bp, Homo sapiens
acatcatgatagccaacttggga

SEQ ID NO: 7010028 - DNA, 22 bp, Homo sapiens
ctgagctgttactctgtcctcg

SEQ ID NO: 7010029 - DNA, 22 bp, Homo sapiens
tgtgccctcagaagagtacatc

SEQ ID NO: 7010030 - DNA, 22 bp, Homo sapiens
actatgaatagccagatagtga

SEQ ID NO: 7010031 - DNA, 22 bp, Homo sapiens
ggccacagtgggaaatcctggg

SEQ ID NO: 7010032 - DNA, 22 bp, Homo sapiens
agctttagagactcttaggctt

SEQ ID NO: 7010033 - DNA, 17 bp, Homo sapiens
ccctggcaaagaatggc

SEQ ID NO: 7010034 - DNA, 22 bp, Homo sapiens
aaacagagagatgtatgtggag

SEQ ID NO: 7010035 - DNA, 22 bp, Homo sapiens
gaaagactaactagaaagtgca

SEQ ID NO: 7010036 - DNA, 22 bp, Homo sapiens
tgtgtatagcagtttccagtct

SEQ ID NO: 7010037 - DNA, 22 bp, Homo sapiens
atggtccttatggccgtgatat

SEQ ID NO: 7010038 - DNA, 21 bp, Homo sapiens
agattataaagaaccttctta

SEQ ID NO: 7010039 - DNA, 22 bp, Homo sapiens
gaagtctctctggagagtagaa

SEQ ID NO: 7010040 - DNA, 22 bp, Homo sapiens
acacaaagctattgagtgtcat

SEQ ID NO: 7010041 - DNA, 22 bp, Homo sapiens
agggcagaagtacagacactta

SEQ ID NO: 7010042 - DNA, 22 bp, Homo sapiens
actaaagtcctgttgtagcata

SEQ ID NO: 7010043 - DNA, 22 bp, Homo sapiens
cggggaagcggttctggcggta

SEQ ID NO: 7010044 - DNA, 22 bp, Homo sapiens
gcagagcagtactctcttgact

SEQ ID NO: 7010045 - DNA, 22 bp, Homo sapiens
ttttttatagcaatgaacccac

SEQ ID NO: 7010046 - DNA, 22 bp, Homo sapiens
tgtctctgtgagatctgacgat

SEQ ID NO: 7010047 - DNA, 22 bp, Homo sapiens
gtccacactgaggccttctcca

SEQ ID NO: 7010048 - DNA, 19 bp, Homo sapiens
agtgtatttttttctgtag

SEQ ID NO: 7010049 - DNA, 22 bp, Homo sapiens
atgaggattaactgttgtcata

SEQ ID NO: 7010050 - DNA, 22 bp, Homo sapiens
ggggtctcactatgttacccag

SEQ ID NO: 7010051 - DNA, 22 bp, Homo sapiens
ttgacctttgtttttacagagt

SEQ ID NO: 7010052 - DNA, 22 bp, Homo sapiens
aaactggtttctgagatggaac

SEQ ID NO: 7010053 - DNA, 22 bp, Homo sapiens
ctgttatttggaggatgcttgg

SEQ ID NO: 7010054 - DNA, 22 bp, Homo sapiens
aataatgttgacgatagtctta

SEQ ID NO: 7010055 - DNA, 22 bp, Homo sapiens
tctctcttttttgaacccgctc

SEQ ID NO: 7010056 - DNA, 22 bp, Homo sapiens
tatttcagacactgatcttgca

SEQ ID NO: 7010057 - DNA, 21 bp, Homo sapiens
ctggcatgaggagctttgttt

SEQ ID NO: 7010058 - DNA, 22 bp, Homo sapiens
caggatgaagggcaaaggcaag

SEQ ID NO: 7010059 - DNA, 22 bp, Homo sapiens
cagagggcttcaggttcaggat

SEQ ID NO: 7010060 - DNA, 22 bp, Homo sapiens
tttggtctctgtgcatcctcct

SEQ ID NO: 7010061 - DNA, 22 bp, Homo sapiens
aaagctctttcttctttggcat

SEQ ID NO: 7010062 - DNA, 22 bp, Homo sapiens
atattaaaactatggttttcag

SEQ ID NO: 7010063 - DNA, 22 bp, Homo sapiens
tgtctgtaaggtgtttatgtta

SEQ ID NO: 7010064 - DNA, 22 bp, Homo sapiens
tccagaatactctgaaatcatt

SEQ ID NO: 7010065 - DNA, 22 bp, Homo sapiens
gctggaccaggtgtgcacaggc

SEQ ID NO: 7010066 - DNA, 22 bp, Homo sapiens
ttatgggcgatgcaaacctgat

SEQ ID NO: 7010067 - DNA, 22 bp, Homo sapiens
atatagtaagcagtctgtaaat

SEQ ID NO: 7010068 - DNA, 22 bp, Homo sapiens
tatttgtgagactgactgaagt

SEQ ID NO: 7010069 - DNA, 22 bp, Homo sapiens
gacagacaggaggccacctgct

SEQ ID NO: 7010070 - DNA, 22 bp, Homo sapiens
tacactgtttttggaaagaaga

SEQ ID NO: 7010071 - DNA, 22 bp, Homo sapiens
cacatgactctggctacccaga

SEQ ID NO: 7010072 - DNA, 20 bp, Homo sapiens
aagaggtgataacaggtgag

SEQ ID NO: 7010073 - DNA, 22 bp, Homo sapiens
cattgagaatctgggctacagc

SEQ ID NO: 7010074 - DNA, 20 bp, Homo sapiens
tagcatcctttcctaccttc

SEQ ID NO: 7010075 - DNA, 22 bp, Homo sapiens
cctgctgagaccctgaggtggg

SEQ ID NO: 7010076 - DNA, 22 bp, Homo sapiens
cactaagatttaaagtattagt

SEQ ID NO: 7010077 - DNA, 22 bp, Homo sapiens
ccttctctctgaagaccccaaa

SEQ ID NO: 7010078 - DNA, 22 bp, Homo sapiens
cagagcagtaaatctggggcac

SEQ ID NO: 7010079 - DNA, 22 bp, Homo sapiens
ggccaatgggaatggccagtag

SEQ ID NO: 7010080 - DNA, 22 bp, Homo sapiens
ctttcctagaaatatatactta

SEQ ID NO: 7010081 - DNA, 22 bp, Homo sapiens
ttgcccactctgtttcccaaga

SEQ ID NO: 7010082 - DNA, 22 bp, Homo sapiens
ggctttggggtgtgcagagatg

SEQ ID NO: 7010083 - DNA, 22 bp, Homo sapiens
ggtcatctgtgtatcctcagtg

SEQ ID NO: 7010084 - DNA, 22 bp, Homo sapiens
ttattcagctctctagaggcac

SEQ ID NO: 7010085 - DNA, 22 bp, Homo sapiens
tgaaaccttggctagagattga

SEQ ID NO: 7010086 - DNA, 22 bp, Homo sapiens
gtattttaagtgactactaggt

SEQ ID NO: 7010087 - DNA, 22 bp, Homo sapiens
acatgtctacacattctgcaat

SEQ ID NO: 7010088 - DNA, 22 bp, Homo sapiens
ttccagtctagtacctggatgc

SEQ ID NO: 7010089 - DNA, 22 bp, Homo sapiens
ttggttacacttaatttttcca

SEQ ID NO: 7010090 - DNA, 22 bp, Homo sapiens
gtgctttactggcagtgatgta

SEQ ID NO: 7010091 - DNA, 23 bp, Homo sapiens
agagctttccagtttcttggtga

SEQ ID NO: 7010092 - DNA, 22 bp, Homo sapiens
tcttgaaacatatgagtaagtg

SEQ ID NO: 7010093 - DNA, 23 bp, Homo sapiens
ccttcagaagaagtaacaggggc

SEQ ID NO: 7010094 - DNA, 22 bp, Homo sapiens
gccagtgtcttcctgttaatcg

SEQ ID NO: 7010095 - DNA, 22 bp, Homo sapiens
ttactgtatacacaagtggtga

SEQ ID NO: 7010096 - DNA, 20 bp, Homo sapiens
tcctgaggcttcgccagtgt

SEQ ID NO: 7010097 - DNA, 22 bp, Homo sapiens
agggagctgctctgcttccgtg

SEQ ID NO: 7010098 - DNA, 22 bp, Homo sapiens
cagttattatgaggtcattagg

SEQ ID NO: 7010099 - DNA, 20 bp, Homo sapiens
aggagaaattcgggacacct

SEQ ID NO: 7010100 - DNA, 23 bp, Homo sapiens
tggtggcagaagtagcagatgac

SEQ ID NO: 7010101 - DNA, 22 bp, Homo sapiens
gggttgggactgtcatctggag

SEQ ID NO: 7010102 - DNA, 23 bp, Homo sapiens
atagttagcacacttacaactgc

SEQ ID NO: 7010103 - DNA, 19 bp, Homo sapiens
gccacatctgtaccccttt

SEQ ID NO: 7010104 - DNA, 22 bp, Homo sapiens
cagagcctgcctctggctgtgg

SEQ ID NO: 7010105 - DNA, 22 bp, Homo sapiens
agtggccactagaagctcagct

SEQ ID NO: 7010106 - DNA, 22 bp, Homo sapiens
gaagcaagtgcaaggaagaggc

SEQ ID NO: 7010107 - DNA, 22 bp, Homo sapiens
ctgtagctgacaggatcactta

SEQ ID NO: 7010108 - DNA, 22 bp, Homo sapiens
agcattaagcctggctcagagg

SEQ ID NO: 7010109 - DNA, 22 bp, Homo sapiens
tatatttaatcctagagccatt

SEQ ID NO: 7010110 - DNA, 22 bp, Homo sapiens
ctctcccagtcaggctcaggat

SEQ ID NO: 7010111 - DNA, 22 bp, Homo sapiens
gctgcctgcacagagctgcttt

SEQ ID NO: 7010112 - DNA, 22 bp, Homo sapiens
gaaatctgtctttgtttgaata

SEQ ID NO: 7010113 - DNA, 22 bp, Homo sapiens
ctctctaagctccacatttcct

SEQ ID NO: 7010114 - DNA, 22 bp, Homo sapiens
ttaaatgacgggactgggtttt

SEQ ID NO: 7010115 - DNA, 22 bp, Homo sapiens
atactcagctgctagacagaag

SEQ ID NO: 7010116 - DNA, 22 bp, Homo sapiens
aaggaactctagagccttgaac

SEQ ID NO: 7010117 - DNA, 22 bp, Homo sapiens
cacagagatggtctggcaggtg

SEQ ID NO: 7010118 - DNA, 22 bp, Homo sapiens
ggtgtcagccactttgtcggag

SEQ ID NO: 7010119 - DNA, 22 bp, Homo sapiens
ccacagtaagagatagtttatg

SEQ ID NO: 7010120 - DNA, 22 bp, Homo sapiens
ggtcccagaattggttagcaca

SEQ ID NO: 7010121 - DNA, 22 bp, Homo sapiens
agaaaggcaatattaactacac

SEQ ID NO: 7010122 - DNA, 22 bp, Homo sapiens
gcaacaatggaggtttggaggg

SEQ ID NO: 7010123 - DNA, 23 bp, Homo sapiens
cgtgcttccaggcccagctgagc

SEQ ID NO: 7010124 - DNA, 22 bp, Homo sapiens
ttctttctttgtagtcctgaac

SEQ ID NO: 7010125 - DNA, 22 bp, Homo sapiens
tctgtgtctgggcctccgcctg

SEQ ID NO: 7010126 - DNA, 22 bp, Homo sapiens
ggaggctgagaagtccaagatc

SEQ ID NO: 7010127 - DNA, 22 bp, Homo sapiens
tagggctgtgtctccaggacca

SEQ ID NO: 7010128 - DNA, 21 bp, Homo sapiens
tccaggagcacgggactagga

SEQ ID NO: 7010129 - DNA, 22 bp, Homo sapiens
gctgtgcattgagcctgagagt

SEQ ID NO: 7010130 - DNA, 22 bp, Homo sapiens
agatcactgaattgaaagtaat

SEQ ID NO: 7010131 - DNA, 22 bp, Homo sapiens
gaaggaaaaatactctgtaagg

SEQ ID NO: 7010132 - DNA, 22 bp, Homo sapiens
ttcctgtggtgtttcccagaca

SEQ ID NO: 7010133 - DNA, 22 bp, Homo sapiens
gatttcacgggaggtggctgga

SEQ ID NO: 7010134 - DNA, 22 bp, Homo sapiens
agttattgttcagtacaatgtc

SEQ ID NO: 7010135 - DNA, 22 bp, Homo sapiens
caaagcagttttaatcaagtag

SEQ ID NO: 7010136 - DNA, 22 bp, Homo sapiens
aatcatgtttcagatgagtttt

SEQ ID NO: 7010137 - DNA, 22 bp, Homo sapiens
tgggtgaagaggctatgctact

SEQ ID NO: 7010138 - DNA, 22 bp, Homo sapiens
ttctctgcctcacaggtctaag

SEQ ID NO: 7010139 - DNA, 22 bp, Homo sapiens
ttggctaacacgcgttttgttc

SEQ ID NO: 7010140 - DNA, 22 bp, Homo sapiens
gcttagtccccaagagagacca

SEQ ID NO: 7010141 - DNA, 22 bp, Homo sapiens
tcaggcctgcaggcttcctgga

SEQ ID NO: 7010142 - DNA, 22 bp, Homo sapiens
catgggaggtctgcaaggtgct

SEQ ID NO: 7010143 - DNA, 22 bp, Homo sapiens
agctggcctgttagagctgagt

SEQ ID NO: 7010144 - DNA, 22 bp, Homo sapiens
taagcactttatatgctttatc

SEQ ID NO: 7010145 - DNA, 22 bp, Homo sapiens
cctacaggaaattgtatcaaaa

SEQ ID NO: 7010146 - DNA, 22 bp, Homo sapiens
accttcaaactagatagaagtt

SEQ ID NO: 7010147 - DNA, 22 bp, Homo sapiens
gcagagtctgggcagcctccat

SEQ ID NO: 7010148 - DNA, 22 bp, Homo sapiens
tggagacctctacccatctcct

SEQ ID NO: 7010149 - DNA, 22 bp, Homo sapiens
gtccctgagcctggcatttccc

SEQ ID NO: 7010150 - DNA, 22 bp, Homo sapiens
ttcagaacaatatgaacagaac

SEQ ID NO: 7010151 - DNA, 18 bp, Homo sapiens
tggacagggtggagaaaa

SEQ ID NO: 7010152 - DNA, 22 bp, Homo sapiens
cagcagtaattagtgctgcatg

SEQ ID NO: 7010153 - DNA, 22 bp, Homo sapiens
tgtgcagagcccacaggcagct

SEQ ID NO: 7010154 - DNA, 22 bp, Homo sapiens
tctccaggttcagtcgatggaa

SEQ ID NO: 7010155 - DNA, 22 bp, Homo sapiens
atgcaacagtcagtacatccgg

SEQ ID NO: 7010156 - DNA, 22 bp, Homo sapiens
caggtcctttagtgtccagaac

SEQ ID NO: 7010157 - DNA, 22 bp, Homo sapiens
atacatcaaggatgatggtgta

SEQ ID NO: 7010158 - DNA, 21 bp, Homo sapiens
cagtattttaagcagtgagtt

SEQ ID NO: 7010159 - DNA, 19 bp, Homo sapiens
tgtgggcaagggatggcag

SEQ ID NO: 7010160 - DNA, 22 bp, Homo sapiens
gttgttttgcaggatccttaca

SEQ ID NO: 7010161 - DNA, 22 bp, Homo sapiens
aacagaactgttgttctggagg

SEQ ID NO: 7010162 - DNA, 22 bp, Homo sapiens
gcttattaggttatttcaagga

SEQ ID NO: 7010163 - DNA, 22 bp, Homo sapiens
tggagctccactggaaaaatgt

SEQ ID NO: 7010164 - DNA, 22 bp, Homo sapiens
aggtgtgtataaacatacatat

SEQ ID NO: 7010165 - DNA, 22 bp, Homo sapiens
aacccaggagatggaggttgtg

SEQ ID NO: 7010166 - DNA, 22 bp, Homo sapiens
tatgaagtgtctgttgtatctg

SEQ ID NO: 7010167 - DNA, 22 bp, Homo sapiens
agggtaagcttggggctggcag

SEQ ID NO: 7010168 - DNA, 20 bp, Homo sapiens
gggcagcaagacatttgaca

SEQ ID NO: 7010169 - DNA, 22 bp, Homo sapiens
atgtatatgaagctagtatttt

SEQ ID NO: 7010170 - DNA, 22 bp, Homo sapiens
ttcttcaaacaaaagtggcatg

SEQ ID NO: 7010171 - DNA, 22 bp, Homo sapiens
agcccaaacctgcgagcagagc

SEQ ID NO: 7010172 - DNA, 22 bp, Homo sapiens
agcacaggctttggtgtgaggg

SEQ ID NO: 7010173 - DNA, 22 bp, Homo sapiens
ttggaatagggaggctggcata

SEQ ID NO: 7010174 - DNA, 22 bp, Homo sapiens
agcaacagtgtatatcataggc

SEQ ID NO: 7010175 - DNA, 22 bp, Homo sapiens
ttgcagcttagtgatgttatct

SEQ ID NO: 7010176 - DNA, 22 bp, Homo sapiens
taactagaatggctattttgag

SEQ ID NO: 7010177 - DNA, 22 bp, Homo sapiens
gaagccactatagatattctaa

SEQ ID NO: 7010178 - DNA, 19 bp, Homo sapiens
gttgtaaatggaggtttct

SEQ ID NO: 7010179 - DNA, 22 bp, Homo sapiens
aacagaatcttgggttcttttc

SEQ ID NO: 7010180 - DNA, 22 bp, Homo sapiens
ttcttaagaggaacatttttgt

SEQ ID NO: 7010181 - DNA, 22 bp, Homo sapiens
tttcaagcatgtcaagttagtc

SEQ ID NO: 7010182 - DNA, 22 bp, Homo sapiens
agctggcatactttgctaggaa

SEQ ID NO: 7010183 - DNA, 22 bp, Homo sapiens
gagtggctgtgtacatgcccag

SEQ ID NO: 7010184 - DNA, 22 bp, Homo sapiens
tccagggacagtatagaggatc

SEQ ID NO: 7010185 - DNA, 22 bp, Homo sapiens
gaaaccagtttgtaccaagatc

SEQ ID NO: 7010186 - DNA, 22 bp, Homo sapiens
tacagatacagatctagataca

SEQ ID NO: 7010187 - DNA, 22 bp, Homo sapiens
tcagttagattgcctccttaga

SEQ ID NO: 7010188 - DNA, 22 bp, Homo sapiens
tggataaactcactgtaagttg

SEQ ID NO: 7010189 - DNA, 23 bp, Homo sapiens
atgtccccttcttgatgcctggc

SEQ ID NO: 7010190 - DNA, 22 bp, Homo sapiens
tggaggcaactgaagatgtagt

SEQ ID NO: 7010191 - DNA, 22 bp, Homo sapiens
atgcagatagtcccctactcag

SEQ ID NO: 7010192 - DNA, 22 bp, Homo sapiens
agcagagcatggtgggaagggc

SEQ ID NO: 7010193 - DNA, 22 bp, Homo sapiens
tgggcctgttgcctgagtccat

SEQ ID NO: 7010194 - DNA, 22 bp, Homo sapiens
ctctgttaagccatgtaagtac

SEQ ID NO: 7010195 - DNA, 22 bp, Homo sapiens
ttctcagggtagaggtgacact

SEQ ID NO: 7010196 - DNA, 22 bp, Homo sapiens
ttccagaatagatggagctcta

SEQ ID NO: 7010197 - DNA, 22 bp, Homo sapiens
tgtgggtgctcagagtaccccc

SEQ ID NO: 7010198 - DNA, 22 bp, Homo sapiens
ccctccctatgtagatgatgtt

SEQ ID NO: 7010199 - DNA, 22 bp, Homo sapiens
tgctcagacaagctgaacagta

SEQ ID NO: 7010200 - DNA, 22 bp, Homo sapiens
ctctgctgcccatgatggtata

SEQ ID NO: 7010201 - DNA, 22 bp, Homo sapiens
taggaggcagtcgttcttcagt

SEQ ID NO: 7010202 - DNA, 22 bp, Homo sapiens
caggttccagttgcagggactt

SEQ ID NO: 7010203 - DNA, 22 bp, Homo sapiens
ataccttatttcctggtgacat

SEQ ID NO: 7010204 - DNA, 22 bp, Homo sapiens
tgtattcaacttcttaaaaatt

SEQ ID NO: 7010205 - DNA, 22 bp, Homo sapiens
catcctgagaggtctctctacc

SEQ ID NO: 7010206 - DNA, 18 bp, Homo sapiens
ggacatcatcaggtgctt

SEQ ID NO: 7010207 - DNA, 22 bp, Homo sapiens
catgtgtaaggctcacaggcag

SEQ ID NO: 7010208 - DNA, 22 bp, Homo sapiens
acagaggaaggctgagctgccc

SEQ ID NO: 7010209 - DNA, 22 bp, Homo sapiens
cttgctaatcactcggtgtcat

SEQ ID NO: 7010210 - DNA, 22 bp, Homo sapiens
tgcaataaagtgctataaatcc

SEQ ID NO: 7010211 - DNA, 22 bp, Homo sapiens
gacacagagacttgcagttgta

SEQ ID NO: 7010212 - DNA, 22 bp, Homo sapiens
aaacaatgaaatatttttatgg

SEQ ID NO: 7010213 - DNA, 22 bp, Homo sapiens
catcagctcttcattcttgatt

SEQ ID NO: 7010214 - DNA, 22 bp, Homo sapiens
agatttaaagcagtattcgcaa

SEQ ID NO: 7010215 - DNA, 22 bp, Homo sapiens
aatcaagtattttccagtggca

SEQ ID NO: 7010216 - DNA, 22 bp, Homo sapiens
caggcagaggtaccaagattga

SEQ ID NO: 7010217 - DNA, 22 bp, Homo sapiens
gtatgtcttagggttcagtaac

SEQ ID NO: 7010218 - DNA, 22 bp, Homo sapiens
ttagtcaggaccttttggtttc

SEQ ID NO: 7010219 - DNA, 22 bp, Homo sapiens
atgttgttccctctacacaggt

SEQ ID NO: 7010220 - DNA, 22 bp, Homo sapiens
tttcctcacacagaagatcttg

SEQ ID NO: 7010221 - DNA, 22 bp, Homo sapiens
ggctggcaggggatgtcagatg

SEQ ID NO: 7010222 - DNA, 22 bp, Homo sapiens
gctctgtagtgggcatgtgatt

SEQ ID NO: 7010223 - DNA, 21 bp, Homo sapiens
agtttcaggaagttcagctgc

SEQ ID NO: 7010224 - DNA, 20 bp, Homo sapiens
aggcctcttcatgacagctg

SEQ ID NO: 7010225 - DNA, 22 bp, Homo sapiens
aaactttttattctaatgtcta

SEQ ID NO: 7010226 - DNA, 22 bp, Homo sapiens
acacatcagaaatatgaatgag

SEQ ID NO: 7010227 - DNA, 22 bp, Homo sapiens
ggtggaaggcagcagtctcagg

SEQ ID NO: 7010228 - DNA, 19 bp, Homo sapiens
cgcacagcctgccaggcgc

SEQ ID NO: 7010229 - DNA, 22 bp, Homo sapiens
atttctacattgagttttagca

SEQ ID NO: 7010230 - DNA, 22 bp, Homo sapiens
ggccatgagaatgtgcaggtcc

SEQ ID NO: 7010231 - DNA, 22 bp, Homo sapiens
ctgtgacttttgccctgtacca

SEQ ID NO: 7010232 - DNA, 22 bp, Homo sapiens
gctgtgcagatgtagggagtgg

SEQ ID NO: 7010233 - DNA, 22 bp, Homo sapiens
ccagggcagaaaaagagggaat

SEQ ID NO: 7010234 - DNA, 22 bp, Homo sapiens
gatgatgaggccatgaggcagg

SEQ ID NO: 7010235 - DNA, 23 bp, Homo sapiens
tgctcttctcagacctgtcagcc

SEQ ID NO: 7010236 - DNA, 22 bp, Homo sapiens
agtaggcatcccacagtctcct

SEQ ID NO: 7010237 - DNA, 22 bp, Homo sapiens
tatggaaaaatgtatcttgtca

SEQ ID NO: 7010238 - DNA, 22 bp, Homo sapiens
ggcatgctctttgtccacagta

SEQ ID NO: 7010239 - DNA, 22 bp, Homo sapiens
tctggctctataactcctagct

SEQ ID NO: 7010240 - DNA, 22 bp, Homo sapiens
agctgccagatgacagtgctat

SEQ ID NO: 7010241 - DNA, 22 bp, Homo sapiens
tggaagaaggcagagaggcatt

SEQ ID NO: 7010242 - DNA, 21 bp, Homo sapiens
tgatttccatcttaaaataaa

SEQ ID NO: 7010243 - DNA, 22 bp, Homo sapiens
gttaccattgtctaggtcattg

SEQ ID NO: 7010244 - DNA, 22 bp, Homo sapiens
aagctgtgaaatagattacaca

SEQ ID NO: 7010245 - DNA, 22 bp, Homo sapiens
tacagagaataataggacaggt

SEQ ID NO: 7010246 - DNA, 22 bp, Homo sapiens
gtctggtattcaattattattt

SEQ ID NO: 7010247 - DNA, 22 bp, Homo sapiens
cctgcagacacttgtccagcaa

SEQ ID NO: 7010248 - DNA, 22 bp, Homo sapiens
caatagcagcttctgaatgcaa

SEQ ID NO: 7010249 - DNA, 22 bp, Homo sapiens
actcagtaaaaacaggcagcac

SEQ ID NO: 7010250 - DNA, 22 bp, Homo sapiens
tgaacacacacctatgtacaaa

SEQ ID NO: 7010251 - DNA, 22 bp, Homo sapiens
ttgcagtttctggatgccttct

SEQ ID NO: 7010252 - DNA, 22 bp, Homo sapiens
acattggtcactgaagaatgag

SEQ ID NO: 7010253 - DNA, 22 bp, Homo sapiens
ttaagtcaatatcaatctcagc

SEQ ID NO: 7010254 - DNA, 22 bp, Homo sapiens
tcctggccaagtagatgtggcg

SEQ ID NO: 7010255 - DNA, 22 bp, Homo sapiens
aagtgctgggattacaggtgtg

SEQ ID NO: 7010256 - DNA, 22 bp, Homo sapiens
tttcccaattgagaggttctgt

SEQ ID NO: 7010257 - DNA, 22 bp, Homo sapiens
acccaagttttccatgcctgtt

SEQ ID NO: 7010258 - DNA, 22 bp, Homo sapiens
ttaacactatctgtcataatta

SEQ ID NO: 7010259 - DNA, 17 bp, Homo sapiens
aaacagtgagtgttatg

SEQ ID NO: 7010260 - DNA, 22 bp, Homo sapiens
acatattttgaaagctttctaa

SEQ ID NO: 7010261 - DNA, 19 bp, Homo sapiens
tcttgaggaaagtaaggca

SEQ ID NO: 7010262 - DNA, 22 bp, Homo sapiens
actgctaaatctccatcgatta

SEQ ID NO: 7010263 - DNA, 22 bp, Homo sapiens
aagctgtgtgactatttctgag

SEQ ID NO: 7010264 - DNA, 22 bp, Homo sapiens
gaatacatgttgtttccctgga

SEQ ID NO: 7010265 - DNA, 22 bp, Homo sapiens
ggctgggcatccatccatgaga

SEQ ID NO: 7010266 - DNA, 22 bp, Homo sapiens
gcggcctgcgctgctcccgacg

SEQ ID NO: 7010267 - DNA, 21 bp, Homo sapiens
atatgagtttcagatgttgct

SEQ ID NO: 7010268 - DNA, 22 bp, Homo sapiens
gtggcatttgaacaatcacata

SEQ ID NO: 7010269 - DNA, 22 bp, Homo sapiens
ccatcttgggtcactgcccccc

SEQ ID NO: 7010270 - DNA, 22 bp, Homo sapiens
agccaggctaaatgagccatga

SEQ ID NO: 7010271 - DNA, 23 bp, Homo sapiens
tttcaacaggcagagaagactta

SEQ ID NO: 7010272 - DNA, 22 bp, Homo sapiens
atcattgaaatgtagtttcatc

SEQ ID NO: 7010273 - DNA, 22 bp, Homo sapiens
taccatgctggctcataatcag

SEQ ID NO: 7010274 - DNA, 23 bp, Homo sapiens
ggtccaggaaaggcagcagcacc

SEQ ID NO: 7010275 - DNA, 22 bp, Homo sapiens
cataattttccatggtttgcta

SEQ ID NO: 7010276 - DNA, 22 bp, Homo sapiens
gttgcattgagagttgcattgg

SEQ ID NO: 7010277 - DNA, 21 bp, Homo sapiens
gggcagctctgttttattttc

SEQ ID NO: 7010278 - DNA, 22 bp, Homo sapiens
cttcaagtcgccaaatgctgaa

SEQ ID NO: 7010279 - DNA, 22 bp, Homo sapiens
tgcttgctcgccgcctgctgac

SEQ ID NO: 7010280 - DNA, 18 bp, Homo sapiens
tgcacagctgtgggctgg

SEQ ID NO: 7010281 - DNA, 22 bp, Homo sapiens
catgttaaaatatacattctga

SEQ ID NO: 7010282 - DNA, 20 bp, Homo sapiens
acacagtagcaattagtgca

SEQ ID NO: 7010283 - DNA, 22 bp, Homo sapiens
tgggaaggacagaacataattg

SEQ ID NO: 7010284 - DNA, 22 bp, Homo sapiens
ggcttcagtgactggtgccctc

SEQ ID NO: 7010285 - DNA, 20 bp, Homo sapiens
gatcaggaagcggcttggga

SEQ ID NO: 7010286 - DNA, 20 bp, Homo sapiens
gcaatatatgagtgcaataa

SEQ ID NO: 7010287 - DNA, 22 bp, Homo sapiens
tggaagactatcccgtgatttt

SEQ ID NO: 7010288 - DNA, 22 bp, Homo sapiens
ctgtacagacctattagcccag

SEQ ID NO: 7010289 - DNA, 22 bp, Homo sapiens
tgctgtgataattcaatgagct

SEQ ID NO: 7010290 - DNA, 22 bp, Homo sapiens
tatcagaaatcaacacacagtg

SEQ ID NO: 7010291 - DNA, 19 bp, Homo sapiens
tgcagagagaggcaaagaa

SEQ ID NO: 7010292 - DNA, 22 bp, Homo sapiens
ccctcgccgcagctgcttcccg

SEQ ID NO: 7010293 - DNA, 19 bp, Homo sapiens
ttctgccctctcttctagc

SEQ ID NO: 7010294 - DNA, 22 bp, Homo sapiens
tagattctgaccctctttttac

SEQ ID NO: 7010295 - DNA, 22 bp, Homo sapiens
ttgcatttttacaagtagccag

SEQ ID NO: 7010296 - DNA, 22 bp, Homo sapiens
tcactgcaagctccgccttccg

SEQ ID NO: 7010297 - DNA, 22 bp, Homo sapiens
agttctttgtcatctctggagt

SEQ ID NO: 7010298 - DNA, 22 bp, Homo sapiens
ggactgggccaggggttggact

SEQ ID NO: 7010299 - DNA, 22 bp, Homo sapiens
atttggtcactaggaaaatcaa

SEQ ID NO: 7010300 - DNA, 22 bp, Homo sapiens
aaacagctgcagtacacggcct

SEQ ID NO: 7010301 - DNA, 22 bp, Homo sapiens
agtggctgttcattttacacaa

SEQ ID NO: 7010302 - DNA, 22 bp, Homo sapiens
tgtgccagtgccttgggtatta

SEQ ID NO: 7010303 - DNA, 22 bp, Homo sapiens
aggagctgaaacttctcatatg

SEQ ID NO: 7010304 - DNA, 20 bp, Homo sapiens
gagagctggggatgaggctg

SEQ ID NO: 7010305 - DNA, 22 bp, Homo sapiens
gccttgccgctcagcagtgggg

SEQ ID NO: 7010306 - DNA, 22 bp, Homo sapiens
gctctgctttctggggggatcc

SEQ ID NO: 7010307 - DNA, 21 bp, Homo sapiens
caagtgtggatgtggaaggta

SEQ ID NO: 7010308 - DNA, 22 bp, Homo sapiens
agtggacattctgcacttggag

SEQ ID NO: 7010309 - DNA, 22 bp, Homo sapiens
tggaacctggcctgagctacca

SEQ ID NO: 7010310 - DNA, 22 bp, Homo sapiens
gaactccagatgactcaggaac

SEQ ID NO: 7010311 - DNA, 22 bp, Homo sapiens
gctgccttctgagaagttaaat

SEQ ID NO: 7010312 - DNA, 22 bp, Homo sapiens
gcagagcattggagggaccctg

SEQ ID NO: 7010313 - DNA, 22 bp, Homo sapiens
acctcagctatttcaaaacaga

SEQ ID NO: 7010314 - DNA, 22 bp, Homo sapiens
ttcctgtatgtcagtgaagagc

SEQ ID NO: 7010315 - DNA, 22 bp, Homo sapiens
ttcaagcaagtcctttgtgcat

SEQ ID NO: 7010316 - DNA, 22 bp, Homo sapiens
agagggctgctgcacagtgctc

SEQ ID NO: 7010317 - DNA, 22 bp, Homo sapiens
tctctgcccatcctcagtccac

SEQ ID NO: 7010318 - DNA, 22 bp, Homo sapiens
gatttattgtccctgtcctgct

SEQ ID NO: 7010319 - DNA, 22 bp, Homo sapiens
ctgtcgcctggtcctctctgga

SEQ ID NO: 7010320 - DNA, 22 bp, Homo sapiens
tggtccagttctgtgatattgc

SEQ ID NO: 7010321 - DNA, 22 bp, Homo sapiens
gcctggacaccgcccttgcaga

SEQ ID NO: 7010322 - DNA, 22 bp, Homo sapiens
tagctggtcctcagctccagcc

SEQ ID NO: 7010323 - DNA, 22 bp, Homo sapiens
gtgtcccagccccacaggcctg

SEQ ID NO: 7010324 - DNA, 22 bp, Homo sapiens
gagtgctcgggcctctgcctgc

SEQ ID NO: 7010325 - DNA, 22 bp, Homo sapiens
cctcccgtatatgtcctgggct

SEQ ID NO: 7010326 - DNA, 22 bp, Homo sapiens
tcagtcctctctgggtttctta

SEQ ID NO: 7010327 - DNA, 22 bp, Homo sapiens
tctgttaacctggtcttggctt

SEQ ID NO: 7010328 - DNA, 22 bp, Homo sapiens
tttacagaggtgtcctgcattg

SEQ ID NO: 7010329 - DNA, 22 bp, Homo sapiens
ggtggagtaattcgcagaggtt

SEQ ID NO: 7010330 - DNA, 22 bp, Homo sapiens
gccaggcaatgtgttagaagcg

SEQ ID NO: 7010331 - DNA, 22 bp, Homo sapiens
aaagtttgcaatttatgttaat

SEQ ID NO: 7010332 - DNA, 22 bp, Homo sapiens
taccactggcaggccactacta

SEQ ID NO: 7010333 - DNA, 18 bp, Homo sapiens
ctgaaggcaccagggcag

SEQ ID NO: 7010334 - DNA, 22 bp, Homo sapiens
tttggtccagcagtcccacttc

SEQ ID NO: 7010335 - DNA, 20 bp, Homo sapiens
ctctgaggctgagaagggag

SEQ ID NO: 7010336 - DNA, 22 bp, Homo sapiens
atgggaggcaggctcagaaccg

SEQ ID NO: 7010337 - DNA, 22 bp, Homo sapiens
gtgcactgtctggtcaagagca

SEQ ID NO: 7010338 - DNA, 22 bp, Homo sapiens
atctcccaaactcatttcttca

SEQ ID NO: 7010339 - DNA, 22 bp, Homo sapiens
tcacaagggccctgcagtccac

SEQ ID NO: 7010340 - DNA, 22 bp, Homo sapiens
tagatccagctgttatgttatg

SEQ ID NO: 7010341 - DNA, 22 bp, Homo sapiens
gagggctgccacgttgggcgag

SEQ ID NO: 7010342 - DNA, 22 bp, Homo sapiens
aaagctctcccactgtatgaag

SEQ ID NO: 7010343 - DNA, 22 bp, Homo sapiens
tggagcatgagagtctttagct

SEQ ID NO: 7010344 - DNA, 22 bp, Homo sapiens
cctccccatgacccggtgctgg

SEQ ID NO: 7010345 - DNA, 22 bp, Homo sapiens
tgtcctccagcagcatggtatg

SEQ ID NO: 7010346 - DNA, 22 bp, Homo sapiens
tggctgattggtaccatcttca

SEQ ID NO: 7010347 - DNA, 22 bp, Homo sapiens
agtgctttccctgaaaccttcc

SEQ ID NO: 7010348 - DNA, 22 bp, Homo sapiens
tgagtatattaatttgccagca

SEQ ID NO: 7010349 - DNA, 22 bp, Homo sapiens
cctcagctgtcttttccgaggt

SEQ ID NO: 7010350 - DNA, 22 bp, Homo sapiens
tgggagtcatcgtgtttggatc

SEQ ID NO: 7010351 - DNA, 19 bp, Homo sapiens
cctctgcatggaaacagct

SEQ ID NO: 7010352 - DNA, 21 bp, Homo sapiens
atgatatgcttgtatttccaa

SEQ ID NO: 7010353 - DNA, 22 bp, Homo sapiens
tagtctctgttgctgctttcat

SEQ ID NO: 7010354 - DNA, 22 bp, Homo sapiens
aaatatccataagcacatctat

SEQ ID NO: 7010355 - DNA, 22 bp, Homo sapiens
tctgccttagcaattgtcaagg

SEQ ID NO: 7010356 - DNA, 22 bp, Homo sapiens
tggaaggaagccaaggaaggtt

SEQ ID NO: 7010357 - DNA, 22 bp, Homo sapiens
caggaaattggctatttgggat

SEQ ID NO: 7010358 - DNA, 22 bp, Homo sapiens
ttctatgaaggtaagatgtacg

SEQ ID NO: 7010359 - DNA, 22 bp, Homo sapiens
catttagtccttgacttctctc

SEQ ID NO: 7010360 - DNA, 22 bp, Homo sapiens
tcatacattcagcagatatttg

SEQ ID NO: 7010361 - DNA, 22 bp, Homo sapiens
gtggcctggatagactccatct

SEQ ID NO: 7010362 - DNA, 22 bp, Homo sapiens
acccatgagtgtatctttaaaa

SEQ ID NO: 7010363 - DNA, 22 bp, Homo sapiens
tctgaagcctttgtacaggcct

SEQ ID NO: 7010364 - DNA, 23 bp, Homo sapiens
tgtaacttgatggaatgagctat

SEQ ID NO: 7010365 - DNA, 22 bp, Homo sapiens
ttatcagttgtgtgtatacacg

SEQ ID NO: 7010366 - DNA, 22 bp, Homo sapiens
tccttcctccatggtcttggtt

SEQ ID NO: 7010367 - DNA, 22 bp, Homo sapiens
cgcggtggcggcctccagcgcc

SEQ ID NO: 7010368 - DNA, 22 bp, Homo sapiens
gtccatcttattacagagcttt

SEQ ID NO: 7010369 - DNA, 22 bp, Homo sapiens
gtaagcattcattgtctgtata

SEQ ID NO: 7010370 - DNA, 22 bp, Homo sapiens
ccagttggtttcaatgggacag

SEQ ID NO: 7010371 - DNA, 22 bp, Homo sapiens
acaggctctggggcaggatggc

SEQ ID NO: 7010372 - DNA, 22 bp, Homo sapiens
agtctttcctgcttgactgttc

SEQ ID NO: 7010373 - DNA, 22 bp, Homo sapiens
aggcacaggaatgtcatccagt

SEQ ID NO: 7010374 - DNA, 22 bp, Homo sapiens
tcaaactagcctgactggtatt

SEQ ID NO: 7010375 - DNA, 22 bp, Homo sapiens
gccagggttcgaatccgtatgg

SEQ ID NO: 7010376 - DNA, 20 bp, Homo sapiens
tattgagtacctactgtata

SEQ ID NO: 7010377 - DNA, 21 bp, Homo sapiens
tctctgacccaggaagagggc

SEQ ID NO: 7010378 - DNA, 22 bp, Homo sapiens
gagatcatcttttttagattcc

SEQ ID NO: 7010379 - DNA, 23 bp, Homo sapiens
tggcaaagcattcttataacagt

SEQ ID NO: 7010380 - DNA, 20 bp, Homo sapiens
atatgcatgtgttttcactt

SEQ ID NO: 7010381 - DNA, 22 bp, Homo sapiens
cactgtactgtgaataaggagg

SEQ ID NO: 7010382 - DNA, 22 bp, Homo sapiens
gtagtctgaacagtaattttgt

SEQ ID NO: 7010383 - DNA, 22 bp, Homo sapiens
ttaaagcatcctgtcagtctgt

SEQ ID NO: 7010384 - DNA, 22 bp, Homo sapiens
gggtctgacctgggcacaccat

SEQ ID NO: 7010385 - DNA, 22 bp, Homo sapiens
cattgtcattctatgctattca

SEQ ID NO: 7010386 - DNA, 22 bp, Homo sapiens
gctgggcagctgaggcctctca

SEQ ID NO: 7010387 - DNA, 22 bp, Homo sapiens
taccagatgcaaagcgattgtg

SEQ ID NO: 7010388 - DNA, 22 bp, Homo sapiens
caagtcatcatagaagttcccc

SEQ ID NO: 7010389 - DNA, 22 bp, Homo sapiens
atggcagacctcctggccacaa

SEQ ID NO: 7010390 - DNA, 22 bp, Homo sapiens
gatgctgaaatccagttcgggg

SEQ ID NO: 7010391 - DNA, 21 bp, Homo sapiens
ggctggtcgcgtgcatgtctc

SEQ ID NO: 7010392 - DNA, 17 bp, Homo sapiens
ccaggctccatcactgt

SEQ ID NO: 7010393 - DNA, 22 bp, Homo sapiens
ccttgtatcatatgctgggctt

SEQ ID NO: 7010394 - DNA, 22 bp, Homo sapiens
aatttggggaggttcagactct

SEQ ID NO: 7010395 - DNA, 22 bp, Homo sapiens
agcactgtgagcaccagcacgc

SEQ ID NO: 7010396 - DNA, 22 bp, Homo sapiens
taagtatgttagaaaatcaagt

SEQ ID NO: 7010397 - DNA, 22 bp, Homo sapiens
attgaagggtgaccagccatcc

SEQ ID NO: 7010398 - DNA, 22 bp, Homo sapiens
ataaggcagtgacttcatctat

SEQ ID NO: 7010399 - DNA, 22 bp, Homo sapiens
gagaagggatatggcttcttga

SEQ ID NO: 7010400 - DNA, 22 bp, Homo sapiens
tctcaagttatgtaacagctgt

SEQ ID NO: 7010401 - DNA, 23 bp, Homo sapiens
acagagtacagtgtgcttagtgg

SEQ ID NO: 7010402 - DNA, 22 bp, Homo sapiens
gcctgagcccaggtgtgcagag

SEQ ID NO: 7010403 - DNA, 22 bp, Homo sapiens
aggccagcattctctctccagg

SEQ ID NO: 7010404 - DNA, 22 bp, Homo sapiens
ctggctggttgtctcaatccag

SEQ ID NO: 7010405 - DNA, 22 bp, Homo sapiens
tagtccttggtaaaattctatg

SEQ ID NO: 7010406 - DNA, 22 bp, Homo sapiens
gccgaggctctgcccagctgct

SEQ ID NO: 7010407 - DNA, 22 bp, Homo sapiens
tagggatgaagatggtatttct

SEQ ID NO: 7010408 - DNA, 22 bp, Homo sapiens
atatttgtggtaaaggtaagaa

SEQ ID NO: 7010409 - DNA, 18 bp, Homo sapiens
ggctcagcaggctctctc

SEQ ID NO: 7010410 - DNA, 22 bp, Homo sapiens
actttcatttgtgaagactgta

SEQ ID NO: 7010411 - DNA, 22 bp, Homo sapiens
caggaaattagtctctctgttg

SEQ ID NO: 7010412 - DNA, 22 bp, Homo sapiens
gaggttaaaccttaaagcttca

SEQ ID NO: 7010413 - DNA, 22 bp, Homo sapiens
gacaaatcattctctgtgtctg

SEQ ID NO: 7010414 - DNA, 21 bp, Homo sapiens
aataattcagacattgttgtt

SEQ ID NO: 7010415 - DNA, 22 bp, Homo sapiens
cctggcaggcaagaggaaggga

SEQ ID NO: 7010416 - DNA, 22 bp, Homo sapiens
tattaggttagtgcaaaagttt

SEQ ID NO: 7010417 - DNA, 22 bp, Homo sapiens
ttgtatgtggcaaatgggggag

SEQ ID NO: 7010418 - DNA, 22 bp, Homo sapiens
tattgcatacttaaatttccgg

SEQ ID NO: 7010419 - DNA, 22 bp, Homo sapiens
attattcttgaggtgtttattg

SEQ ID NO: 7010420 - DNA, 22 bp, Homo sapiens
ttagtgttcacagccactctat

SEQ ID NO: 7010421 - DNA, 22 bp, Homo sapiens
ttgacaaatacccattagacca

SEQ ID NO: 7010422 - DNA, 22 bp, Homo sapiens
agacctggtgatagctgtccta

SEQ ID NO: 7010423 - DNA, 22 bp, Homo sapiens
tggcatcctccctcaagctgaa

SEQ ID NO: 7010424 - DNA, 22 bp, Homo sapiens
tgctttgaaagataatactgtc

SEQ ID NO: 7010425 - DNA, 22 bp, Homo sapiens
ttgagagtggcttgttgactgc

SEQ ID NO: 7010426 - DNA, 22 bp, Homo sapiens
ggctcctgggcagctgctccct

SEQ ID NO: 7010427 - DNA, 22 bp, Homo sapiens
tcaaagattgaaactaaggaga

SEQ ID NO: 7010428 - DNA, 22 bp, Homo sapiens
agtgtttagggaatcaaggggt

SEQ ID NO: 7010429 - DNA, 22 bp, Homo sapiens
tgagtgctaagaataatctgca

SEQ ID NO: 7010430 - DNA, 22 bp, Homo sapiens
gccagtctgataggggagaagt

SEQ ID NO: 7010431 - DNA, 22 bp, Homo sapiens
cttctctatctttggcacatca

SEQ ID NO: 7010432 - DNA, 21 bp, Homo sapiens
tggagctgccacttgagctgc

SEQ ID NO: 7010433 - DNA, 22 bp, Homo sapiens
tagcccagagtcccaattccag

SEQ ID NO: 7010434 - DNA, 22 bp, Homo sapiens
aattcctgggcttcaccccaga

SEQ ID NO: 7010435 - DNA, 22 bp, Homo sapiens
ctcctctagaagctgacctgga

SEQ ID NO: 7010436 - DNA, 22 bp, Homo sapiens
gaagaagcaggagtgtgtagca

SEQ ID NO: 7010437 - DNA, 22 bp, Homo sapiens
tctgcttgcgttctgctccctc

SEQ ID NO: 7010438 - DNA, 22 bp, Homo sapiens
cacatatacctcttcttgagtt

SEQ ID NO: 7010439 - DNA, 22 bp, Homo sapiens
cccagcaggcatgttgggagga

SEQ ID NO: 7010440 - DNA, 23 bp, Homo sapiens
actcaaatttcgcttggagttca

SEQ ID NO: 7010441 - DNA, 20 bp, Homo sapiens
cttcaggacccatcctcccc

SEQ ID NO: 7010442 - DNA, 19 bp, Homo sapiens
tcagggccatgagcgccac

SEQ ID NO: 7010443 - DNA, 22 bp, Homo sapiens
cgggttcacgccattctcctgc

SEQ ID NO: 7010444 - DNA, 22 bp, Homo sapiens
caggaatgccttcttcagccat

SEQ ID NO: 7010445 - DNA, 21 bp, Homo sapiens
gttattttaagtgagctttgc

SEQ ID NO: 7010446 - DNA, 22 bp, Homo sapiens
ggtcccaggattggttgcgcag

SEQ ID NO: 7010447 - DNA, 22 bp, Homo sapiens
taacagtgtgtccagtcagttt

SEQ ID NO: 7010448 - DNA, 22 bp, Homo sapiens
gcagctgaaagggatctctaca

SEQ ID NO: 7010449 - DNA, 22 bp, Homo sapiens
cttttgatggagttcaagaagc

SEQ ID NO: 7010450 - DNA, 20 bp, Homo sapiens
cactgcaagtatttaaccca

SEQ ID NO: 7010451 - DNA, 22 bp, Homo sapiens
tcagtgtttattcaatgttatt

SEQ ID NO: 7010452 - DNA, 22 bp, Homo sapiens
cctgaatggtctccaaatagat

SEQ ID NO: 7010453 - DNA, 22 bp, Homo sapiens
acattatgagcccactggtgaa

SEQ ID NO: 7010454 - DNA, 22 bp, Homo sapiens
atttggtctgtaattacatgga

SEQ ID NO: 7010455 - DNA, 22 bp, Homo sapiens
ctgcacagaggtcggtctgcca

SEQ ID NO: 7010456 - DNA, 22 bp, Homo sapiens
tattaggtaaaggacttgcagg

SEQ ID NO: 7010457 - DNA, 22 bp, Homo sapiens
atttgtcttcagtaggttcttc

SEQ ID NO: 7010458 - DNA, 22 bp, Homo sapiens
ttctgagagtaaacatagcctg

SEQ ID NO: 7010459 - DNA, 22 bp, Homo sapiens
cccctctccctcacttatcaat

SEQ ID NO: 7010460 - DNA, 22 bp, Homo sapiens
cagcacttcagcattcagattt

SEQ ID NO: 7010461 - DNA, 22 bp, Homo sapiens
tactggagatggaatgcttttg

SEQ ID NO: 7010462 - DNA, 22 bp, Homo sapiens
cttgtaactcctatttactatg

SEQ ID NO: 7010463 - DNA, 22 bp, Homo sapiens
gggggtgagcctgccaggccca

SEQ ID NO: 7010464 - DNA, 17 bp, Homo sapiens
gctgagtgcagggagtc

SEQ ID NO: 7010465 - DNA, 22 bp, Homo sapiens
atgcatgtgtgtagcatcagca

SEQ ID NO: 7010466 - DNA, 22 bp, Homo sapiens
ttgtgctcctatgagaatctaa

SEQ ID NO: 7010467 - DNA, 17 bp, Homo sapiens
actttggaggcagctgt

SEQ ID NO: 7010468 - DNA, 22 bp, Homo sapiens
tggacactggtggatatggaat

SEQ ID NO: 7010469 - DNA, 22 bp, Homo sapiens
ggagcctggcaatgctgcgtcc

SEQ ID NO: 7010470 - DNA, 22 bp, Homo sapiens
tccaggcaaagccttgtagacg

SEQ ID NO: 7010471 - DNA, 22 bp, Homo sapiens
tacagcacaaagggcctttacc

SEQ ID NO: 7010472 - DNA, 22 bp, Homo sapiens
tgagttctgccctacacctgaa

SEQ ID NO: 7010473 - DNA, 22 bp, Homo sapiens
gcagggctgttcaggagggtgg

SEQ ID NO: 7010474 - DNA, 22 bp, Homo sapiens
ttcagcacctggaatagcacct

SEQ ID NO: 7010475 - DNA, 22 bp, Homo sapiens
agcctagctgtgtgaggccatc

SEQ ID NO: 7010476 - DNA, 22 bp, Homo sapiens
ctggtgaccttgccccaggtca

SEQ ID NO: 7010477 - DNA, 22 bp, Homo sapiens
taaatgagtaatatagctgttt

SEQ ID NO: 7010478 - DNA, 19 bp, Homo sapiens
tggtaactgcatctccaga

SEQ ID NO: 7010479 - DNA, 22 bp, Homo sapiens
gacttcctaagattcaggaatg

SEQ ID NO: 7010480 - DNA, 22 bp, Homo sapiens
atattcacactgtttagttaca

SEQ ID NO: 7010481 - DNA, 22 bp, Homo sapiens
tctgccaccaactgtcactaca

SEQ ID NO: 7010482 - DNA, 22 bp, Homo sapiens
atgtaagagtctaagattgtag

SEQ ID NO: 7010483 - DNA, 20 bp, Homo sapiens
tttgacctttatgaagataa

SEQ ID NO: 7010484 - DNA, 22 bp, Homo sapiens
gctgtccagctccagccagcca

SEQ ID NO: 7010485 - DNA, 22 bp, Homo sapiens
ctgcctggaaggagcaagggga

SEQ ID NO: 7010486 - DNA, 22 bp, Homo sapiens
tagggaaaagacttcactgttt

SEQ ID NO: 7010487 - DNA, 19 bp, Homo sapiens
atagtctttccaattatac

SEQ ID NO: 7010488 - DNA, 20 bp, Homo sapiens
ctggcccatctaccgctctg

SEQ ID NO: 7010489 - DNA, 22 bp, Homo sapiens
ctgtaacagatatcatttagca

SEQ ID NO: 7010490 - DNA, 22 bp, Homo sapiens
tactttcatgtctatacatatt

SEQ ID NO: 7010491 - DNA, 22 bp, Homo sapiens
agctgagctcaggctgatgtaa

SEQ ID NO: 7010492 - DNA, 22 bp, Homo sapiens
tgttagatattcattaatagga

SEQ ID NO: 7010493 - DNA, 23 bp, Homo sapiens
acagctgcacctggccgcctggc

SEQ ID NO: 7010494 - DNA, 22 bp, Homo sapiens
tcatgctcatcattagagtgac

SEQ ID NO: 7010495 - DNA, 22 bp, Homo sapiens
tcccatgtgttcctctagtcta

SEQ ID NO: 7010496 - DNA, 22 bp, Homo sapiens
tagcttatctatacagactttt

SEQ ID NO: 7010497 - DNA, 22 bp, Homo sapiens
agtgtcatatgccactgcatcc

SEQ ID NO: 7010498 - DNA, 22 bp, Homo sapiens
ataggcacattaggaacttttg

SEQ ID NO: 7010499 - DNA, 22 bp, Homo sapiens
aggagctgggttcctttggtgg

SEQ ID NO: 7010500 - DNA, 22 bp, Homo sapiens
tcagaggtggtaaaggacagca

SEQ ID NO: 7010501 - DNA, 21 bp, Homo sapiens
cctggttcaagtgatgcccct

SEQ ID NO: 7010502 - DNA, 18 bp, Homo sapiens
tgtggcaggggtgggaga

SEQ ID NO: 7010503 - DNA, 22 bp, Homo sapiens
ttttgtctaagaactttgcaaa

SEQ ID NO: 7010504 - DNA, 22 bp, Homo sapiens
tacaaaggcaggtttcccagga

SEQ ID NO: 7010505 - DNA, 23 bp, Homo sapiens
acatattgaatgctgagaatttt

SEQ ID NO: 7010506 - DNA, 22 bp, Homo sapiens
ttctcccctttagggcctacgg

SEQ ID NO: 7010507 - DNA, 22 bp, Homo sapiens
ctctgagaagccttgatgggga

SEQ ID NO: 7010508 - DNA, 22 bp, Homo sapiens
ccttgcatctcatttcattctt

SEQ ID NO: 7010509 - DNA, 22 bp, Homo sapiens
gctgtgctgattcattccctgc

SEQ ID NO: 7010510 - DNA, 22 bp, Homo sapiens
gcaggcaggaaggactaagtaa

SEQ ID NO: 7010511 - DNA, 22 bp, Homo sapiens
ccccttccgtctcttgagtgtc

SEQ ID NO: 7010512 - DNA, 22 bp, Homo sapiens
acaaagagaccatgagccaaac

SEQ ID NO: 7010513 - DNA, 17 bp, Homo sapiens
agacagacctctgcatc

SEQ ID NO: 7010514 - DNA, 22 bp, Homo sapiens
cttcctgaaatgtctcaccagt

SEQ ID NO: 7010515 - DNA, 22 bp, Homo sapiens
tttgacaataattgcatttata

SEQ ID NO: 7010516 - DNA, 22 bp, Homo sapiens
acccagctgtttcccgtgtcat

SEQ ID NO: 7010517 - DNA, 23 bp, Homo sapiens
agcaccaggaacagtgtggtcct

SEQ ID NO: 7010518 - DNA, 22 bp, Homo sapiens
cttcattaaccaaaatgcaata

SEQ ID NO: 7010519 - DNA, 22 bp, Homo sapiens
ggtagtagaaggtatgctttaa

SEQ ID NO: 7010520 - DNA, 22 bp, Homo sapiens
aaacggttgctcatagttacat

SEQ ID NO: 7010521 - DNA, 23 bp, Homo sapiens
tctcctgtcctaattaccacccc

SEQ ID NO: 7010522 - DNA, 22 bp, Homo sapiens
gcagggccagtgcagagaggaa

SEQ ID NO: 7010523 - DNA, 22 bp, Homo sapiens
ccagaccaccctggccatgcac

SEQ ID NO: 7010524 - DNA, 22 bp, Homo sapiens
ggctgccttcagactccagctt

SEQ ID NO: 7010525 - DNA, 22 bp, Homo sapiens
aaaggcttcggatcagaaggta

SEQ ID NO: 7010526 - DNA, 22 bp, Homo sapiens
tcatttcagtcctctgtgtgag

SEQ ID NO: 7010527 - DNA, 22 bp, Homo sapiens
tatagaggatgaacatctatta

SEQ ID NO: 7010528 - DNA, 22 bp, Homo sapiens
ctgcagctgcgggaccggagcg

SEQ ID NO: 7010529 - DNA, 22 bp, Homo sapiens
tgattaagttcaaaatatagaa

SEQ ID NO: 7010530 - DNA, 21 bp, Homo sapiens
tgggtcagagggaaagtgtat

SEQ ID NO: 7010531 - DNA, 22 bp, Homo sapiens
gagggcagagtctaatgatgca

SEQ ID NO: 7010532 - DNA, 22 bp, Homo sapiens
attctgatatgaacacacatat

SEQ ID NO: 7010533 - DNA, 22 bp, Homo sapiens
agtccaataacctctttccttc

SEQ ID NO: 7010534 - DNA, 22 bp, Homo sapiens
tcaaaggttaactctgttgttc

SEQ ID NO: 7010535 - DNA, 23 bp, Homo sapiens
cgtcttgtcctcgggcgcctggg

SEQ ID NO: 7010536 - DNA, 22 bp, Homo sapiens
tggtatgaccgtggtgcaagca

SEQ ID NO: 7010537 - DNA, 23 bp, Homo sapiens
tgacagcaggaactgattatgta

SEQ ID NO: 7010538 - DNA, 22 bp, Homo sapiens
ttcaatacaccataggaatagt

SEQ ID NO: 7010539 - DNA, 22 bp, Homo sapiens
cttaagatttgagatacctaat

SEQ ID NO: 7010540 - DNA, 21 bp, Homo sapiens
tttggcttctctgctgcagcc

SEQ ID NO: 7010541 - DNA, 22 bp, Homo sapiens
gcaatataaccagttgtcatgc

SEQ ID NO: 7010542 - DNA, 22 bp, Homo sapiens
tgcatagaggatccagtgtggt

SEQ ID NO: 7010543 - DNA, 22 bp, Homo sapiens
aatcttcagagaccatggagcc

SEQ ID NO: 7010544 - DNA, 22 bp, Homo sapiens
gtctgctgcagagcatggcttt

SEQ ID NO: 7010545 - DNA, 22 bp, Homo sapiens
tgctgcaaaagaggtactgaat

SEQ ID NO: 7010546 - DNA, 22 bp, Homo sapiens
ggcccagtgttgccagacctga

SEQ ID NO: 7010547 - DNA, 22 bp, Homo sapiens
acctcatctgagaagagcatac

SEQ ID NO: 7010548 - DNA, 22 bp, Homo sapiens
cattgacatcaggcttggccaa

SEQ ID NO: 7010549 - DNA, 22 bp, Homo sapiens
gagctccagcatctctgccaaa

SEQ ID NO: 7010550 - DNA, 22 bp, Homo sapiens
cagagccagagacctgctgtgc

SEQ ID NO: 7010551 - DNA, 22 bp, Homo sapiens
cctggccgcggagcccttccag

SEQ ID NO: 7010552 - DNA, 22 bp, Homo sapiens
ttccaggagacttccagaaata

SEQ ID NO: 7010553 - DNA, 22 bp, Homo sapiens
tgctctgggttcttgctgttac

SEQ ID NO: 7010554 - DNA, 18 bp, Homo sapiens
gaaagtgttgctggtttt

SEQ ID NO: 7010555 - DNA, 22 bp, Homo sapiens
gctgaggccccagggtgatggg

SEQ ID NO: 7010556 - DNA, 22 bp, Homo sapiens
agttgctggcacctgtgagtat

SEQ ID NO: 7010557 - DNA, 22 bp, Homo sapiens
aacctctccctttgtgtccctg

SEQ ID NO: 7010558 - DNA, 22 bp, Homo sapiens
ttccgagtctccaaggggttgt

SEQ ID NO: 7010559 - DNA, 22 bp, Homo sapiens
taaggctttgtagtgattgctt

SEQ ID NO: 7010560 - DNA, 22 bp, Homo sapiens
tgagctctcattaatattattc

SEQ ID NO: 7010561 - DNA, 22 bp, Homo sapiens
cctgagtgccatgagagcaccc

SEQ ID NO: 7010562 - DNA, 19 bp, Homo sapiens
atttccaagaattggagag

SEQ ID NO: 7010563 - DNA, 22 bp, Homo sapiens
ttgatgagagatcactaaagaa

SEQ ID NO: 7010564 - DNA, 22 bp, Homo sapiens
agccagctgtcctccctttcct

SEQ ID NO: 7010565 - DNA, 20 bp, Homo sapiens
gtctgaggagcagtgggaaa

SEQ ID NO: 7010566 - DNA, 22 bp, Homo sapiens
tcaaatgcacctctcatttgtt

SEQ ID NO: 7010567 - DNA, 22 bp, Homo sapiens
ggtgacattatcattattttaa

SEQ ID NO: 7010568 - DNA, 22 bp, Homo sapiens
gaatgctattatttctgtgtgt

SEQ ID NO: 7010569 - DNA, 22 bp, Homo sapiens
tgtggccttatttgtatggggg

SEQ ID NO: 7010570 - DNA, 22 bp, Homo sapiens
cctctgagtgctttgagggaga

SEQ ID NO: 7010571 - DNA, 18 bp, Homo sapiens
cttttgttttccctcctc

SEQ ID NO: 7010572 - DNA, 22 bp, Homo sapiens
agttctatttctaacatgttat

SEQ ID NO: 7010573 - DNA, 22 bp, Homo sapiens
ccagcagggcagtgccctggac

SEQ ID NO: 7010574 - DNA, 18 bp, Homo sapiens
tagcagggcttgtccttt

SEQ ID NO: 7010575 - DNA, 22 bp, Homo sapiens
accagctagggtagcacatctc

SEQ ID NO: 7010576 - DNA, 22 bp, Homo sapiens
ttcagacaataagagtcatctc

SEQ ID NO: 7010577 - DNA, 21 bp, Homo sapiens
tttgaaagtgggtgattcttt

SEQ ID NO: 7010578 - DNA, 20 bp, Homo sapiens
aactgcctgcccagaggtgg

SEQ ID NO: 7010579 - DNA, 23 bp, Homo sapiens
agggcctctgtcccccagcactc

SEQ ID NO: 7010580 - DNA, 22 bp, Homo sapiens
caatcttacttttgaaaagtga

SEQ ID NO: 7010581 - DNA, 22 bp, Homo sapiens
gcagccttggtgactgagtctg

SEQ ID NO: 7010582 - DNA, 22 bp, Homo sapiens
tgagataatcatgtgatttcat

SEQ ID NO: 7010583 - DNA, 22 bp, Homo sapiens
ataatatttgcattactgtgat

SEQ ID NO: 7010584 - DNA, 22 bp, Homo sapiens
catgattgatccttctaaatgc

SEQ ID NO: 7010585 - DNA, 22 bp, Homo sapiens
cattctctacactcctgccctg

SEQ ID NO: 7010586 - DNA, 19 bp, Homo sapiens
gtacaatgtgttgttggta

SEQ ID NO: 7010587 - DNA, 22 bp, Homo sapiens
cttatagaatgtttttatatgt

SEQ ID NO: 7010588 - DNA, 22 bp, Homo sapiens
tggtgctcccaagattgttcta

SEQ ID NO: 7010589 - DNA, 23 bp, Homo sapiens
gggcccagcacaggacctggcag

SEQ ID NO: 7010590 - DNA, 22 bp, Homo sapiens
tctcatgtgaagaaagaatttc

SEQ ID NO: 7010591 - DNA, 19 bp, Homo sapiens
gcatttctctttacagcca

SEQ ID NO: 7010592 - DNA, 22 bp, Homo sapiens
agggaagaagctggtagtaggt

SEQ ID NO: 7010593 - DNA, 22 bp, Homo sapiens
cacttaaagtcttagcttacag

SEQ ID NO: 7010594 - DNA, 22 bp, Homo sapiens
tgctgtctttcattgtctgcct

SEQ ID NO: 7010595 - DNA, 22 bp, Homo sapiens
gtcatccagactttgcctctgc

SEQ ID NO: 7010596 - DNA, 22 bp, Homo sapiens
ttccttgaggtattcagtttta

SEQ ID NO: 7010597 - DNA, 22 bp, Homo sapiens
tggccacatatgtgggacagct

SEQ ID NO: 7010598 - DNA, 22 bp, Homo sapiens
aagctttgttcttcacagagtg

SEQ ID NO: 7010599 - DNA, 22 bp, Homo sapiens
cattgttaccatcttttaccta

SEQ ID NO: 7010600 - DNA, 21 bp, Homo sapiens
ttgtgtccttctaaagggcca

SEQ ID NO: 7010601 - DNA, 22 bp, Homo sapiens
agggatgtaaattcttcttctt

SEQ ID NO: 7010602 - DNA, 22 bp, Homo sapiens
aaaaatgaaacggctggttggc

SEQ ID NO: 7010603 - DNA, 22 bp, Homo sapiens
gcagacagatgagggtgctggg

SEQ ID NO: 7010604 - DNA, 22 bp, Homo sapiens
agtcatgactccattggtcaag

SEQ ID NO: 7010605 - DNA, 19 bp, Homo sapiens
ccagaggtttgctgggcct

SEQ ID NO: 7010606 - DNA, 22 bp, Homo sapiens
attccaaaaggatgttagaatg

SEQ ID NO: 7010607 - DNA, 22 bp, Homo sapiens
tcacagacaattgttttggtgt

SEQ ID NO: 7010608 - DNA, 22 bp, Homo sapiens
atgcattgtaacgatgtgcaca

SEQ ID NO: 7010609 - DNA, 22 bp, Homo sapiens
agtaatgcggtggggaaaacaa

SEQ ID NO: 7010610 - DNA, 22 bp, Homo sapiens
aaggattgtctggctatttatg

SEQ ID NO: 7010611 - DNA, 22 bp, Homo sapiens
gatacagaaaggctgcattgag

SEQ ID NO: 7010612 - DNA, 22 bp, Homo sapiens
tcagtcctgatgacaggcccaa

SEQ ID NO: 7010613 - DNA, 22 bp, Homo sapiens
agagtgggcaggagcctcgact

SEQ ID NO: 7010614 - DNA, 22 bp, Homo sapiens
ttgaggtcaaagaagtgagtgg

SEQ ID NO: 7010615 - DNA, 22 bp, Homo sapiens
ttctggacttgccttgctgatg

SEQ ID NO: 7010616 - DNA, 22 bp, Homo sapiens
atctttcaatcaggaaaaatct

SEQ ID NO: 7010617 - DNA, 19 bp, Homo sapiens
ttctggacagcagaaacca

SEQ ID NO: 7010618 - DNA, 22 bp, Homo sapiens
tttgatgtcaaaatatcctgtt

SEQ ID NO: 7010619 - DNA, 23 bp, Homo sapiens
agacaaacttccttcactgcacc

SEQ ID NO: 7010620 - DNA, 22 bp, Homo sapiens
ttattaccaagttgcaggggat

SEQ ID NO: 7010621 - DNA, 22 bp, Homo sapiens
ttgagtaccttggattacaggt

SEQ ID NO: 7010622 - DNA, 21 bp, Homo sapiens
gcatgaaaacagcctgtgctc

SEQ ID NO: 7010623 - DNA, 22 bp, Homo sapiens
cttacagtgttgagggaattaa

SEQ ID NO: 7010624 - DNA, 22 bp, Homo sapiens
ggtggcagaataattgaaggtc

SEQ ID NO: 7010625 - DNA, 22 bp, Homo sapiens
accatcctgaaaccttcatgct

SEQ ID NO: 7010626 - DNA, 22 bp, Homo sapiens
gccaggaggtcagcccctcaac

SEQ ID NO: 7010627 - DNA, 22 bp, Homo sapiens
ttagggagctcagtcctcagat

SEQ ID NO: 7010628 - DNA, 22 bp, Homo sapiens
caatcatttatgcttgcggagg

SEQ ID NO: 7010629 - DNA, 22 bp, Homo sapiens
tgagaacttgtgctattgcaca

SEQ ID NO: 7010630 - DNA, 22 bp, Homo sapiens
atgttacctctattagaatatt

SEQ ID NO: 7010631 - DNA, 22 bp, Homo sapiens
ccacttcatcagtgctccattt

SEQ ID NO: 7010632 - DNA, 22 bp, Homo sapiens
tgtgtacacatgacaggcaccc

SEQ ID NO: 7010633 - DNA, 22 bp, Homo sapiens
tcagcacttttactctctttgc

SEQ ID NO: 7010634 - DNA, 22 bp, Homo sapiens
accttaaatgtgacatagtcta

SEQ ID NO: 7010635 - DNA, 22 bp, Homo sapiens
ccaggagagcaaaggtcactct

SEQ ID NO: 7010636 - DNA, 22 bp, Homo sapiens
gggaccataactaggcatgatg

SEQ ID NO: 7010637 - DNA, 22 bp, Homo sapiens
ctcctgaggggacaggactcat

SEQ ID NO: 7010638 - DNA, 22 bp, Homo sapiens
gcaatagacttggttcttctgt

SEQ ID NO: 7010639 - DNA, 22 bp, Homo sapiens
gcaaagcacaccctcagagttt

SEQ ID NO: 7010640 - DNA, 22 bp, Homo sapiens
aagtctggggagaaaaggctaa

SEQ ID NO: 7010641 - DNA, 22 bp, Homo sapiens
tggtctgcctggatcacagccc

SEQ ID NO: 7010642 - DNA, 22 bp, Homo sapiens
atctctaatcaccagctctagc

SEQ ID NO: 7010643 - DNA, 22 bp, Homo sapiens
tgtttttaaataatgatagaaa

SEQ ID NO: 7010644 - DNA, 22 bp, Homo sapiens
ggcctgttttatcagtttttaa

SEQ ID NO: 7010645 - DNA, 22 bp, Homo sapiens
gctgaggtccagcattcgccta

SEQ ID NO: 7010646 - DNA, 20 bp, Homo sapiens
atgtgaggggttgaagtggg

SEQ ID NO: 7010647 - DNA, 23 bp, Homo sapiens
gctcaggtggctcagggactgat

SEQ ID NO: 7010648 - DNA, 22 bp, Homo sapiens
ttgatgtaaagatagtttctgt

SEQ ID NO: 7010649 - DNA, 22 bp, Homo sapiens
ttggccttacgcatggtcggca

SEQ ID NO: 7010650 - DNA, 22 bp, Homo sapiens
tctgagaggttaagcaatttga

SEQ ID NO: 7010651 - DNA, 22 bp, Homo sapiens
actttgcaggccttttcttgtg

SEQ ID NO: 7010652 - DNA, 22 bp, Homo sapiens
tccagggttgtgggcttcagca

SEQ ID NO: 7010653 - DNA, 22 bp, Homo sapiens
caaattctcttactgtttgaca

SEQ ID NO: 7010654 - DNA, 22 bp, Homo sapiens
catggctttccagtcctccact

SEQ ID NO: 7010655 - DNA, 22 bp, Homo sapiens
cagactttctgactcccttgcc

SEQ ID NO: 7010656 - DNA, 22 bp, Homo sapiens
catcttaataaatctcctccct

SEQ ID NO: 7010657 - DNA, 22 bp, Homo sapiens
ttctaaacggcttcacaggaat

SEQ ID NO: 7010658 - DNA, 22 bp, Homo sapiens
ttttgctgttatatgctattat

SEQ ID NO: 7010659 - DNA, 22 bp, Homo sapiens
gcagtagagcagagattttcct

SEQ ID NO: 7010660 - DNA, 22 bp, Homo sapiens
gagactgctggtaaagatggga

SEQ ID NO: 7010661 - DNA, 21 bp, Homo sapiens
tttggcctaggtcatgttttt

SEQ ID NO: 7010662 - DNA, 22 bp, Homo sapiens
ctgccctggtcccatggctgat

SEQ ID NO: 7010663 - DNA, 22 bp, Homo sapiens
cagaggctgtgtaggcagactg

SEQ ID NO: 7010664 - DNA, 22 bp, Homo sapiens
gtcttcaactggactccaggga

SEQ ID NO: 7010665 - DNA, 22 bp, Homo sapiens
gagtcttaggcaaaaataatgg

SEQ ID NO: 7010666 - DNA, 22 bp, Homo sapiens
cacctgtccacgcagtctgcct

SEQ ID NO: 7010667 - DNA, 22 bp, Homo sapiens
tcctggttctggaatgtttaag

SEQ ID NO: 7010668 - DNA, 22 bp, Homo sapiens
ggcagtgtcaaaataggcagaa

SEQ ID NO: 7010669 - DNA, 22 bp, Homo sapiens
atttaagaggctgctagagtat

SEQ ID NO: 7010670 - DNA, 22 bp, Homo sapiens
tcttaaagcttacttcaattgt

SEQ ID NO: 7010671 - DNA, 22 bp, Homo sapiens
atgaaattcatctgagaatgct

SEQ ID NO: 7010672 - DNA, 23 bp, Homo sapiens
gacttgtccctggcaattcatcc

SEQ ID NO: 7010673 - DNA, 22 bp, Homo sapiens
acacagtgtgtgcagtcggacg

SEQ ID NO: 7010674 - DNA, 22 bp, Homo sapiens
tctgggagcctgaaagtgaatg

SEQ ID NO: 7010675 - DNA, 22 bp, Homo sapiens
aggctgctgctctacagttgct

SEQ ID NO: 7010676 - DNA, 22 bp, Homo sapiens
tctaaatgtatcacatctggat

SEQ ID NO: 7010677 - DNA, 22 bp, Homo sapiens
ggatccttctttgacctcacag

SEQ ID NO: 7010678 - DNA, 22 bp, Homo sapiens
ttgtccatggacagcaccacag

SEQ ID NO: 7010679 - DNA, 22 bp, Homo sapiens
ttgcgcatgtacccatacatct

SEQ ID NO: 7010680 - DNA, 22 bp, Homo sapiens
tgaccttatttgaaaatagaga

SEQ ID NO: 7010681 - DNA, 22 bp, Homo sapiens
catgcctgtatttctgatctat

SEQ ID NO: 7010682 - DNA, 19 bp, Homo sapiens
cagtggcctggaggtctct

SEQ ID NO: 7010683 - DNA, 22 bp, Homo sapiens
agcctgggcatgggacgggagg

SEQ ID NO: 7010684 - DNA, 22 bp, Homo sapiens
tccctgtaaggttctgagattt

SEQ ID NO: 7010685 - DNA, 22 bp, Homo sapiens
cagataggaaagggcatcccag

SEQ ID NO: 7010686 - DNA, 22 bp, Homo sapiens
ttccaaaatgccttgatatgat

SEQ ID NO: 7010687 - DNA, 22 bp, Homo sapiens
ttctaattgcaagttttagtat

SEQ ID NO: 7010688 - DNA, 22 bp, Homo sapiens
gccaggaggctgctgtgtaggc

SEQ ID NO: 7010689 - DNA, 22 bp, Homo sapiens
ttcatttgtccaaatactatgt

SEQ ID NO: 7010690 - DNA, 22 bp, Homo sapiens
cctgaggccctggctgtgctga

SEQ ID NO: 7010691 - DNA, 22 bp, Homo sapiens
ctaaatgccccttctggcacag

SEQ ID NO: 7010692 - DNA, 22 bp, Homo sapiens
ggtaatactggtgatgggattt

SEQ ID NO: 7010693 - DNA, 22 bp, Homo sapiens
catggttttaaggtcactgccg

SEQ ID NO: 7010694 - DNA, 22 bp, Homo sapiens
ttggacatttattgagtgtggt

SEQ ID NO: 7010695 - DNA, 21 bp, Homo sapiens
aggagctgtgttagctggtcg

SEQ ID NO: 7010696 - DNA, 15 bp, Homo sapiens
tggtggtgttgagac

SEQ ID NO: 7010697 - DNA, 22 bp, Homo sapiens
gaccctggctggagctggcctg

SEQ ID NO: 7010698 - DNA, 22 bp, Homo sapiens
cccagggcttgagtcatccatg

SEQ ID NO: 7010699 - DNA, 22 bp, Homo sapiens
aggaagctgctaagaaacaatg

SEQ ID NO: 7010700 - DNA, 22 bp, Homo sapiens
aaagttgactactaaggaatgt

SEQ ID NO: 7010701 - DNA, 22 bp, Homo sapiens
tccagtgtggaggtgaccaact

SEQ ID NO: 7010702 - DNA, 22 bp, Homo sapiens
ggtgtcagttgctcatcagagt

SEQ ID NO: 7010703 - DNA, 22 bp, Homo sapiens
ggttatggtgatgggaaaggat

SEQ ID NO: 7010704 - DNA, 22 bp, Homo sapiens
atcaggaatgaatacttttgga

SEQ ID NO: 7010705 - DNA, 22 bp, Homo sapiens
ggcagtttggcaggatggaggg

SEQ ID NO: 7010706 - DNA, 20 bp, Homo sapiens
agtgacagagactgtgtggc

SEQ ID NO: 7010707 - DNA, 18 bp, Homo sapiens
cagcagagacattcaaaa

SEQ ID NO: 7010708 - DNA, 23 bp, Homo sapiens
cctgtgggatggcttaatatttt

SEQ ID NO: 7010709 - DNA, 22 bp, Homo sapiens
tctgttcagttgtaccttcccc

SEQ ID NO: 7010710 - DNA, 22 bp, Homo sapiens
ttgattatagactcactaatct

SEQ ID NO: 7010711 - DNA, 22 bp, Homo sapiens
tcctgggccctccggatcaggt

SEQ ID NO: 7010712 - DNA, 22 bp, Homo sapiens
ggtgcaatggtgagggcagcca

SEQ ID NO: 7010713 - DNA, 17 bp, Homo sapiens
aggaggccctggcgttt

SEQ ID NO: 7010714 - DNA, 22 bp, Homo sapiens
ctcgtgccaggacgcgcagttt

SEQ ID NO: 7010715 - DNA, 22 bp, Homo sapiens
ttgatgtcagtattatgagttt

SEQ ID NO: 7010716 - DNA, 22 bp, Homo sapiens
gtcttgcacatcttcactgtta

SEQ ID NO: 7010717 - DNA, 22 bp, Homo sapiens
ggaagctgtgctctcaggcctc

SEQ ID NO: 7010718 - DNA, 22 bp, Homo sapiens
aggcatgggtagaagagaagcc

SEQ ID NO: 7010719 - DNA, 22 bp, Homo sapiens
tctcaggaaaaatccctagctt

SEQ ID NO: 7010720 - DNA, 22 bp, Homo sapiens
acatggcgggagtttcagatac

SEQ ID NO: 7010721 - DNA, 22 bp, Homo sapiens
tctttttcttctgtggaaggtg

SEQ ID NO: 7010722 - DNA, 22 bp, Homo sapiens
tgaggtagggacttaaaactgt

SEQ ID NO: 7010723 - DNA, 17 bp, Homo sapiens
aggcctccctccaggcc

SEQ ID NO: 7010724 - DNA, 23 bp, Homo sapiens
ctccaaatactcccaattgtttt

SEQ ID NO: 7010725 - DNA, 22 bp, Homo sapiens
ttgctctgtaataatctggggt

SEQ ID NO: 7010726 - DNA, 22 bp, Homo sapiens
tcacacagtgagcggggctcag

SEQ ID NO: 7010727 - DNA, 22 bp, Homo sapiens
ggctgcctcctcgagacaggat

SEQ ID NO: 7010728 - DNA, 22 bp, Homo sapiens
aagtgttatgtaggatttcaga

SEQ ID NO: 7010729 - DNA, 22 bp, Homo sapiens
ctctaccaggagtctccaccgt

SEQ ID NO: 7010730 - DNA, 22 bp, Homo sapiens
cgcactggagctggaacgagtc

SEQ ID NO: 7010731 - DNA, 22 bp, Homo sapiens
tgtgtaccccctgccttgtaga

SEQ ID NO: 7010732 - DNA, 22 bp, Homo sapiens
ctgggagatatgaggatctgga

SEQ ID NO: 7010733 - DNA, 22 bp, Homo sapiens
atgtatatgtgtgcacgcacag

SEQ ID NO: 7010734 - DNA, 22 bp, Homo sapiens
gggctgctgtagagaacatgtt

SEQ ID NO: 7010735 - DNA, 23 bp, Homo sapiens
ggctcagaaaaagtcctggcctc

SEQ ID NO: 7010736 - DNA, 19 bp, Homo sapiens
gtcagcaccatggacaggg

SEQ ID NO: 7010737 - DNA, 20 bp, Homo sapiens
atccctggtcagtaccaaag

SEQ ID NO: 7010738 - DNA, 22 bp, Homo sapiens
cttccagtggcaccaacatgca

SEQ ID NO: 7010739 - DNA, 22 bp, Homo sapiens
acagtctttagagtattgtcct

SEQ ID NO: 7010740 - DNA, 22 bp, Homo sapiens
taactggactcgatgctgaagg

SEQ ID NO: 7010741 - DNA, 22 bp, Homo sapiens
cagtgtctgaaataacaccgga

SEQ ID NO: 7010742 - DNA, 22 bp, Homo sapiens
ggtccctgcctgaggctggcct

SEQ ID NO: 7010743 - DNA, 22 bp, Homo sapiens
gaacacttgctgttaataagtg

SEQ ID NO: 7010744 - DNA, 22 bp, Homo sapiens
tccctgctgagagtgctctccc

SEQ ID NO: 7010745 - DNA, 22 bp, Homo sapiens
atccctcagcagacagcaaaat

SEQ ID NO: 7010746 - DNA, 22 bp, Homo sapiens
tacagatagaattagtgagtta

SEQ ID NO: 7010747 - DNA, 22 bp, Homo sapiens
gctggaattagataacattttg

SEQ ID NO: 7010748 - DNA, 22 bp, Homo sapiens
tgggggctagaacccagggatt

SEQ ID NO: 7010749 - DNA, 22 bp, Homo sapiens
gaccacagattcctaagtggca

SEQ ID NO: 7010750 - DNA, 18 bp, Homo sapiens
ggacaggagacatgggtg

SEQ ID NO: 7010751 - DNA, 22 bp, Homo sapiens
tgcactgctttgcaaagctgag

SEQ ID NO: 7010752 - DNA, 22 bp, Homo sapiens
tttgaagtgggcattagaacct

SEQ ID NO: 7010753 - DNA, 22 bp, Homo sapiens
ggctctgcagcttgctaactgt

SEQ ID NO: 7010754 - DNA, 22 bp, Homo sapiens
tactttgtggagattaaaaata

SEQ ID NO: 7010755 - DNA, 23 bp, Homo sapiens
tgagaaattttgattcagtagga

SEQ ID NO: 7010756 - DNA, 19 bp, Homo sapiens
gcccactgtctttgccaac

SEQ ID NO: 7010757 - DNA, 22 bp, Homo sapiens
tcactggcaacttgtgctccct

SEQ ID NO: 7010758 - DNA, 22 bp, Homo sapiens
tttgacaaatccttcagcaatg

SEQ ID NO: 7010759 - DNA, 21 bp, Homo sapiens
tgtaacaagttccctaggtga

SEQ ID NO: 7010760 - DNA, 21 bp, Homo sapiens
atgactgtggcacttaggagg

SEQ ID NO: 7010761 - DNA, 22 bp, Homo sapiens
aggaatctgggcccaactgtgc

SEQ ID NO: 7010762 - DNA, 22 bp, Homo sapiens
tgcagcattctggtaaaaggca

SEQ ID NO: 7010763 - DNA, 21 bp, Homo sapiens
gttattgacctccaggctggc

SEQ ID NO: 7010764 - DNA, 22 bp, Homo sapiens
gagggatctttaggcagcctca

SEQ ID NO: 7010765 - DNA, 22 bp, Homo sapiens
ggctccagaggccttacctgca

SEQ ID NO: 7010766 - DNA, 22 bp, Homo sapiens
gatacagctctggccagatgtg

SEQ ID NO: 7010767 - DNA, 22 bp, Homo sapiens
gaggcctcttctttgttaacct

SEQ ID NO: 7010768 - DNA, 20 bp, Homo sapiens
cccaaggtcacagctagcag

SEQ ID NO: 7010769 - DNA, 18 bp, Homo sapiens
aaggtctgtctggtaggt

SEQ ID NO: 7010770 - DNA, 22 bp, Homo sapiens
cgtggccagccatttcctggaa

SEQ ID NO: 7010771 - DNA, 22 bp, Homo sapiens
ttagcaaatatcttgaaacagg

SEQ ID NO: 7010772 - DNA, 22 bp, Homo sapiens
ttcctcagctgtttgggctcat

SEQ ID NO: 7010773 - DNA, 22 bp, Homo sapiens
attaggccggagaagagggaca

SEQ ID NO: 7010774 - DNA, 22 bp, Homo sapiens
aaactagatgaaacgagtaaag

SEQ ID NO: 7010775 - DNA, 22 bp, Homo sapiens
aactgtaagagaataaatgtgt

SEQ ID NO: 7010776 - DNA, 22 bp, Homo sapiens
atatgtacacttacgttacaaa

SEQ ID NO: 7010777 - DNA, 22 bp, Homo sapiens
cttcaagagaatgcagggatgt

SEQ ID NO: 7010778 - DNA, 22 bp, Homo sapiens
tacttgtgttctactagagaaa

SEQ ID NO: 7010779 - DNA, 22 bp, Homo sapiens
ccagcccttcccaactggccag

SEQ ID NO: 7010780 - DNA, 22 bp, Homo sapiens
agacatatattgcaattcactg

SEQ ID NO: 7010781 - DNA, 22 bp, Homo sapiens
attccacagctcagcctctctt

SEQ ID NO: 7010782 - DNA, 22 bp, Homo sapiens
gtatactcaacctgcctagaat

SEQ ID NO: 7010783 - DNA, 22 bp, Homo sapiens
gggcaacagagcgagggcctgt

SEQ ID NO: 7010784 - DNA, 22 bp, Homo sapiens
agacatattggcttgctttaat

SEQ ID NO: 7010785 - DNA, 20 bp, Homo sapiens
cagctctgggcaggtcgagg

SEQ ID NO: 7010786 - DNA, 22 bp, Homo sapiens
aaggttgttaagatttggtggt

SEQ ID NO: 7010787 - DNA, 22 bp, Homo sapiens
tgtagataagtaaaagcccagt

SEQ ID NO: 7010788 - DNA, 22 bp, Homo sapiens
ctatagagacacaaagtagatt

SEQ ID NO: 7010789 - DNA, 20 bp, Homo sapiens
tgacaacatgccttttgctt

SEQ ID NO: 7010790 - DNA, 22 bp, Homo sapiens
taatgaataaacttgagagtca

SEQ ID NO: 7010791 - DNA, 16 bp, Homo sapiens
tttaatctctcaggaa

SEQ ID NO: 7010792 - DNA, 22 bp, Homo sapiens
tggtggtcaaagccagtgttct

SEQ ID NO: 7010793 - DNA, 21 bp, Homo sapiens
cagttcgtcttagaaaatggc

SEQ ID NO: 7010794 - DNA, 22 bp, Homo sapiens
tgcattcaaatcctgatcctgc

SEQ ID NO: 7010795 - DNA, 23 bp, Homo sapiens
tagtgattggaaaaactagtttt

SEQ ID NO: 7010796 - DNA, 22 bp, Homo sapiens
agtgcccagttaggttggagca

SEQ ID NO: 7010797 - DNA, 22 bp, Homo sapiens
tccaggtatctttatgaaactt

SEQ ID NO: 7010798 - DNA, 22 bp, Homo sapiens
gcccagtagttcaaggttgcag

SEQ ID NO: 7010799 - DNA, 22 bp, Homo sapiens
ttgaaaggcctgtttatccagc

SEQ ID NO: 7010800 - DNA, 22 bp, Homo sapiens
ctgctttgaggggctctgtata

SEQ ID NO: 7010801 - DNA, 22 bp, Homo sapiens
gatctggaagaaagggagggca

SEQ ID NO: 7010802 - DNA, 22 bp, Homo sapiens
cctactccctttctagagtatg

SEQ ID NO: 7010803 - DNA, 22 bp, Homo sapiens
taggccacggaaagcaggttgc

SEQ ID NO: 7010804 - DNA, 22 bp, Homo sapiens
gagctgcatgcaactcgaaaat

SEQ ID NO: 7010805 - DNA, 22 bp, Homo sapiens
agactgaaatagtgcacaccaa

SEQ ID NO: 7010806 - DNA, 22 bp, Homo sapiens
tattgcacaatgagctgtgtat

SEQ ID NO: 7010807 - DNA, 22 bp, Homo sapiens
tagaaaagataacattctgtgc

SEQ ID NO: 7010808 - DNA, 22 bp, Homo sapiens
tacagctgagtttaggtacagg

SEQ ID NO: 7010809 - DNA, 22 bp, Homo sapiens
ctgggctctgtgtttcagtttc

SEQ ID NO: 7010810 - DNA, 22 bp, Homo sapiens
aggctggagtgcagttgcatga

SEQ ID NO: 7010811 - DNA, 22 bp, Homo sapiens
ctttatgttggggtgtcttagt

SEQ ID NO: 7010812 - DNA, 22 bp, Homo sapiens
cccagcagcctggatgttcttt

SEQ ID NO: 7010813 - DNA, 22 bp, Homo sapiens
aggctcctgagaggcagaggct

SEQ ID NO: 7010814 - DNA, 22 bp, Homo sapiens
tgtctaaatgaaaagagatgcc

SEQ ID NO: 7010815 - DNA, 22 bp, Homo sapiens
ctcaagatcatcaatataccaa

SEQ ID NO: 7010816 - DNA, 22 bp, Homo sapiens
ctcagaatctgccaagttcagg

SEQ ID NO: 7010817 - DNA, 21 bp, Homo sapiens
tgtgtaatatgtataagaata

SEQ ID NO: 7010818 - DNA, 22 bp, Homo sapiens
tgcacttgaggattttccacag

SEQ ID NO: 7010819 - DNA, 21 bp, Homo sapiens
atgtaggagttattggaacag

SEQ ID NO: 7010820 - DNA, 22 bp, Homo sapiens
aaagatgcataaatgccaatgg

SEQ ID NO: 7010821 - DNA, 22 bp, Homo sapiens
ccaaactgtttcgtatttatgc

SEQ ID NO: 7010822 - DNA, 22 bp, Homo sapiens
cctttaatttacaatgttaatt

SEQ ID NO: 7010823 - DNA, 19 bp, Homo sapiens
caggatgatcccatgacac

SEQ ID NO: 7010824 - DNA, 22 bp, Homo sapiens
tccgagggctggacgcaggggc

SEQ ID NO: 7010825 - DNA, 22 bp, Homo sapiens
caggcttgtgtctcagctgcag

SEQ ID NO: 7010826 - DNA, 22 bp, Homo sapiens
cagctgcctatgacctagcctc

SEQ ID NO: 7010827 - DNA, 23 bp, Homo sapiens
ggagtgcaatggcgccatctcgg

SEQ ID NO: 7010828 - DNA, 23 bp, Homo sapiens
agagtacagtggcgccatctcag

SEQ ID NO: 7010829 - DNA, 22 bp, Homo sapiens
tccagcccaggctggagtgtag

SEQ ID NO: 7010830 - DNA, 22 bp, Homo sapiens
atttcagtagtccttacttgta

SEQ ID NO: 7010831 - DNA, 22 bp, Homo sapiens
acagtttgcactgttcatcaaa

SEQ ID NO: 7010832 - DNA, 22 bp, Homo sapiens
agatacacagaggtaaagatga

SEQ ID NO: 7010833 - DNA, 22 bp, Homo sapiens
cttagaagtaatttaccttctc

SEQ ID NO: 7010834 - DNA, 22 bp, Homo sapiens
acttagcacgaacatttacttt

SEQ ID NO: 7010835 - DNA, 22 bp, Homo sapiens
ctgagaaacatatttccatcta

SEQ ID NO: 7010836 - DNA, 22 bp, Homo sapiens
tggctagatttattgctgagca

SEQ ID NO: 7010837 - DNA, 22 bp, Homo sapiens
acaagaataaggataagagatt

SEQ ID NO: 7010838 - DNA, 22 bp, Homo sapiens
tctagatcagtgcctgaaggaa

SEQ ID NO: 7010839 - DNA, 22 bp, Homo sapiens
cctggacctgcagcatcagcat

SEQ ID NO: 7010840 - DNA, 22 bp, Homo sapiens
taggaacaaaaggttttcctga

SEQ ID NO: 7010841 - DNA, 22 bp, Homo sapiens
gctgtgtgaccctagccagtag

SEQ ID NO: 7010842 - DNA, 22 bp, Homo sapiens
ctttgcatgtggtagaaggttc

SEQ ID NO: 7010843 - DNA, 20 bp, Homo sapiens
ggggggcttcagggcctgtg

SEQ ID NO: 7010844 - DNA, 22 bp, Homo sapiens
tgtggacagagcagaaggtcat

SEQ ID NO: 7010845 - DNA, 22 bp, Homo sapiens
agatggaaaatatagacagaga

SEQ ID NO: 7010846 - DNA, 22 bp, Homo sapiens
gaactaaaagctaacatcaggc

SEQ ID NO: 7010847 - DNA, 22 bp, Homo sapiens
agtgtctgatcagttgactaga

SEQ ID NO: 7010848 - DNA, 22 bp, Homo sapiens
taactgtatagcttggactaaa

SEQ ID NO: 7010849 - DNA, 22 bp, Homo sapiens
aagatactgatgatgtaggcta

SEQ ID NO: 7010850 - DNA, 22 bp, Homo sapiens
ccggaaactcctttgagagcct

SEQ ID NO: 7010851 - DNA, 22 bp, Homo sapiens
cttagaaagagttttctcccct

SEQ ID NO: 7010852 - DNA, 19 bp, Homo sapiens
taaagcacatagcaaaagt

SEQ ID NO: 7010853 - DNA, 22 bp, Homo sapiens
taagacttaggtcgagtttggc

SEQ ID NO: 7010854 - DNA, 22 bp, Homo sapiens
agcctcagcacgcagctctgtg

SEQ ID NO: 7010855 - DNA, 22 bp, Homo sapiens
tgtttattgcagtgctgggctg

SEQ ID NO: 7010856 - DNA, 21 bp, Homo sapiens
gcctggctctcactggcctgg

SEQ ID NO: 7010857 - DNA, 19 bp, Homo sapiens
acactgggagaagactgct

SEQ ID NO: 7010858 - DNA, 22 bp, Homo sapiens
ttctggaagctgggcagcaccc

SEQ ID NO: 7010859 - DNA, 22 bp, Homo sapiens
tgcattggtcatttagaaaata

SEQ ID NO: 7010860 - DNA, 22 bp, Homo sapiens
tattgatgtatttctaggtgct

SEQ ID NO: 7010861 - DNA, 22 bp, Homo sapiens
gaagcttctggcatttctcaaa

SEQ ID NO: 7010862 - DNA, 22 bp, Homo sapiens
tagcaggaatgaagttctgagg

SEQ ID NO: 7010863 - DNA, 22 bp, Homo sapiens
tctcccattcagcttgcagtca

SEQ ID NO: 7010864 - DNA, 22 bp, Homo sapiens
tacagtgctagaacctgctgta

SEQ ID NO: 7010865 - DNA, 22 bp, Homo sapiens
atcacatggaatgattttagac

SEQ ID NO: 7010866 - DNA, 22 bp, Homo sapiens
caagtctgacctctgggtgaag

SEQ ID NO: 7010867 - DNA, 22 bp, Homo sapiens
tcagtcttgtttgattcctcac

SEQ ID NO: 7010868 - DNA, 22 bp, Homo sapiens
ttacactcatattgcacttacc

SEQ ID NO: 7010869 - DNA, 22 bp, Homo sapiens
tcctgtgtgctttctttaggtt

SEQ ID NO: 7010870 - DNA, 22 bp, Homo sapiens
gtgcctgtttcttttgaattca

SEQ ID NO: 7010871 - DNA, 22 bp, Homo sapiens
tataggcagatctgagaatatt

SEQ ID NO: 7010872 - DNA, 22 bp, Homo sapiens
tcagatgcgatgcattcaggct

SEQ ID NO: 7010873 - DNA, 22 bp, Homo sapiens
gtggcattgacagcttcagtgg

SEQ ID NO: 7010874 - DNA, 22 bp, Homo sapiens
actcattttataacactgtagt

SEQ ID NO: 7010875 - DNA, 20 bp, Homo sapiens
aaagccactggcaagagact

SEQ ID NO: 7010876 - DNA, 21 bp, Homo sapiens
ttagaacatcaacagcaccta

SEQ ID NO: 7010877 - DNA, 22 bp, Homo sapiens
tgtacacatttattctctctca

SEQ ID NO: 7010878 - DNA, 22 bp, Homo sapiens
cctgccagctgggtaccttcat

SEQ ID NO: 7010879 - DNA, 22 bp, Homo sapiens
cagcagcaaatctagaagagga

SEQ ID NO: 7010880 - DNA, 22 bp, Homo sapiens
ggggtgctgaagatgtcatggt

SEQ ID NO: 7010881 - DNA, 22 bp, Homo sapiens
tgctcacaattatcagaagtat

SEQ ID NO: 7010882 - DNA, 22 bp, Homo sapiens
ccaggacaagccagagggacag

SEQ ID NO: 7010883 - DNA, 22 bp, Homo sapiens
gagttcttaggcaaacaactct

SEQ ID NO: 7010884 - DNA, 19 bp, Homo sapiens
actcatctttccagaatat

SEQ ID NO: 7010885 - DNA, 22 bp, Homo sapiens
gggcagtgaatattggtgggaa

SEQ ID NO: 7010886 - DNA, 22 bp, Homo sapiens
ttcttcttgtctgccctcacat

SEQ ID NO: 7010887 - DNA, 22 bp, Homo sapiens
gctgccttccaaagagttttat

SEQ ID NO: 7010888 - DNA, 22 bp, Homo sapiens
atagtcttacttttctctgcta

SEQ ID NO: 7010889 - DNA, 22 bp, Homo sapiens
tttcaagaacagcagcattcca

SEQ ID NO: 7010890 - DNA, 17 bp, Homo sapiens
tctgcagaggcaaacct

SEQ ID NO: 7010891 - DNA, 22 bp, Homo sapiens
ctcacagttggctcattaatga

SEQ ID NO: 7010892 - DNA, 22 bp, Homo sapiens
tgtgaagcagtcacacgctttc

SEQ ID NO: 7010893 - DNA, 22 bp, Homo sapiens
aggcctgggtctcgtgcctacc

SEQ ID NO: 7010894 - DNA, 22 bp, Homo sapiens
tcagaggtgagcatgtgaccaa

SEQ ID NO: 7010895 - DNA, 23 bp, Homo sapiens
aaactgttgcttcaatgtatcct

SEQ ID NO: 7010896 - DNA, 22 bp, Homo sapiens
aagcagagtgatataaacatgg

SEQ ID NO: 7010897 - DNA, 22 bp, Homo sapiens
aggcagaccacctgtagccatc

SEQ ID NO: 7010898 - DNA, 22 bp, Homo sapiens
tgccagtcacagttctcaaaga

SEQ ID NO: 7010899 - DNA, 22 bp, Homo sapiens
tggaaaactttggtggtgaggg

SEQ ID NO: 7010900 - DNA, 19 bp, Homo sapiens
tgcatatatctatgaaaga

SEQ ID NO: 7010901 - DNA, 22 bp, Homo sapiens
atctccagcagtgcttttgagc

SEQ ID NO: 7010902 - DNA, 22 bp, Homo sapiens
attttagttttagcatccatgc

SEQ ID NO: 7010903 - DNA, 22 bp, Homo sapiens
tatgaagtggtagagagtggtg

SEQ ID NO: 7010904 - DNA, 22 bp, Homo sapiens
taccaatgataagacagataat

SEQ ID NO: 7010905 - DNA, 22 bp, Homo sapiens
cctgttgtttactgcagtgagt

SEQ ID NO: 7010906 - DNA, 18 bp, Homo sapiens
ggctgaggttgactagaa

SEQ ID NO: 7010907 - DNA, 22 bp, Homo sapiens
cattgcactctagtctgggtga

SEQ ID NO: 7010908 - DNA, 22 bp, Homo sapiens
acaggcaggtaatttacatatt

SEQ ID NO: 7010909 - DNA, 22 bp, Homo sapiens
atgccattattaggactgaatc

SEQ ID NO: 7010910 - DNA, 22 bp, Homo sapiens
tacttcaattatatgccagtta

SEQ ID NO: 7010911 - DNA, 22 bp, Homo sapiens
ggctgcataggcagaagctgtg

SEQ ID NO: 7010912 - DNA, 22 bp, Homo sapiens
acctcgagttctttcaattcac

SEQ ID NO: 7010913 - DNA, 23 bp, Homo sapiens
taactctgtgaagggtgactggg

SEQ ID NO: 7010914 - DNA, 22 bp, Homo sapiens
acaagctcacatcagccaatga

SEQ ID NO: 7010915 - DNA, 22 bp, Homo sapiens
atggctgggatggggtagagaa

SEQ ID NO: 7010916 - DNA, 19 bp, Homo sapiens
ttctgggcattcatattta

SEQ ID NO: 7010917 - DNA, 22 bp, Homo sapiens
ggacccacagattcttcattct

SEQ ID NO: 7010918 - DNA, 22 bp, Homo sapiens
tttacatgtaatgttatacaaa

SEQ ID NO: 7010919 - DNA, 22 bp, Homo sapiens
cacagtacgcacccgatacatg

SEQ ID NO: 7010920 - DNA, 22 bp, Homo sapiens
gtgtataggtgtgtaaccaaaa

SEQ ID NO: 7010921 - DNA, 22 bp, Homo sapiens
tctgggatgcaaacagaatctg

SEQ ID NO: 7010922 - DNA, 22 bp, Homo sapiens
gctccctgctccttcaccgacc

SEQ ID NO: 7010923 - DNA, 22 bp, Homo sapiens
acttgcttagtttgcaacagag

SEQ ID NO: 7010924 - DNA, 22 bp, Homo sapiens
tcctagaataatctttgactgc

SEQ ID NO: 7010925 - DNA, 22 bp, Homo sapiens
ggacacagacctttctgttcta

SEQ ID NO: 7010926 - DNA, 23 bp, Homo sapiens
tctcatttcccttgatctatctt

SEQ ID NO: 7010927 - DNA, 21 bp, Homo sapiens
agtgcacgcctagcttctcca

SEQ ID NO: 7010928 - DNA, 22 bp, Homo sapiens
ataatgtctgcagagccacaca

SEQ ID NO: 7010929 - DNA, 22 bp, Homo sapiens
agaatatgaggaaactgtgaat

SEQ ID NO: 7010930 - DNA, 22 bp, Homo sapiens
ggtttgttggggtccaggccca

SEQ ID NO: 7010931 - DNA, 22 bp, Homo sapiens
tttctcaagctgtttgccaatt

SEQ ID NO: 7010932 - DNA, 22 bp, Homo sapiens
cgcagcagccccgtggtaggtg

SEQ ID NO: 7010933 - DNA, 22 bp, Homo sapiens
ttcaagttaactctccttgtac

SEQ ID NO: 7010934 - DNA, 22 bp, Homo sapiens
agccccagttccctggaagtct

SEQ ID NO: 7010935 - DNA, 22 bp, Homo sapiens
ggtgttggaacatggtgagatt

SEQ ID NO: 7010936 - DNA, 22 bp, Homo sapiens
ggcttcagtggccagagatgat

SEQ ID NO: 7010937 - DNA, 22 bp, Homo sapiens
ctgctttaatttagacaaggca

SEQ ID NO: 7010938 - DNA, 22 bp, Homo sapiens
ctgcttgcctggacagcgttag

SEQ ID NO: 7010939 - DNA, 22 bp, Homo sapiens
tctgatattggacaattcaggg

SEQ ID NO: 7010940 - DNA, 22 bp, Homo sapiens
cagaagttagtgtctgccagta

SEQ ID NO: 7010941 - DNA, 22 bp, Homo sapiens
ctcagaggggatgcttggagaa

SEQ ID NO: 7010942 - DNA, 22 bp, Homo sapiens
tagtttagaatgttgcaataca

SEQ ID NO: 7010943 - DNA, 22 bp, Homo sapiens
gaagccctatcctctcctggga

SEQ ID NO: 7010944 - DNA, 22 bp, Homo sapiens
cccaggtctgtgccagctctga

SEQ ID NO: 7010945 - DNA, 22 bp, Homo sapiens
tttagagcagggtgtggcacat

SEQ ID NO: 7010946 - DNA, 22 bp, Homo sapiens
tgcagcatgccaaacgaggagg

SEQ ID NO: 7010947 - DNA, 22 bp, Homo sapiens
ctctggcttgttaatgcatatt

SEQ ID NO: 7010948 - DNA, 22 bp, Homo sapiens
ggaaatgtttgggtttgtgtga

SEQ ID NO: 7010949 - DNA, 22 bp, Homo sapiens
gactgtcttgtttctaagatga

SEQ ID NO: 7010950 - DNA, 20 bp, Homo sapiens
gacattgtaattaatgatga

SEQ ID NO: 7010951 - DNA, 22 bp, Homo sapiens
ctttgacctcatatgacacatt

SEQ ID NO: 7010952 - DNA, 23 bp, Homo sapiens
tctgtgtagccaggtctggaggg

SEQ ID NO: 7010953 - DNA, 22 bp, Homo sapiens
taacattgagtccactaaacag

SEQ ID NO: 7010954 - DNA, 22 bp, Homo sapiens
tcactgggagagctgacaagga

SEQ ID NO: 7010955 - DNA, 22 bp, Homo sapiens
ggcaagaaccacaattactttt

SEQ ID NO: 7010956 - DNA, 22 bp, Homo sapiens
tttctgctgtgctttcttgcgt

SEQ ID NO: 7010957 - DNA, 22 bp, Homo sapiens
tttggcggactgagaacgcggg

SEQ ID NO: 7010958 - DNA, 17 bp, Homo sapiens
cagctcttcctccctct

SEQ ID NO: 7010959 - DNA, 22 bp, Homo sapiens
tcctacatcagctctcagtagc

SEQ ID NO: 7010960 - DNA, 22 bp, Homo sapiens
ttgaagtctaattgataaggtt

SEQ ID NO: 7010961 - DNA, 22 bp, Homo sapiens
tttccctgtgaatatttaaaga

SEQ ID NO: 7010962 - DNA, 22 bp, Homo sapiens
gtaacctgtcggaaagccttgt

SEQ ID NO: 7010963 - DNA, 22 bp, Homo sapiens
tgaaggagatttttagggaggc

SEQ ID NO: 7010964 - DNA, 22 bp, Homo sapiens
agccccttggaacacagggctg

SEQ ID NO: 7010965 - DNA, 22 bp, Homo sapiens
catttcacaaatggccacatca

SEQ ID NO: 7010966 - DNA, 22 bp, Homo sapiens
agtgatttgcagtatttactaa

SEQ ID NO: 7010967 - DNA, 22 bp, Homo sapiens
aaagggaagttgcacatgttcc

SEQ ID NO: 7010968 - DNA, 21 bp, Homo sapiens
ttagcaagtctacccatttct

SEQ ID NO: 7010969 - DNA, 22 bp, Homo sapiens
tgacccttggtcttgcttttcc

SEQ ID NO: 7010970 - DNA, 22 bp, Homo sapiens
tgcttaaaaagctccatcaata

SEQ ID NO: 7010971 - DNA, 22 bp, Homo sapiens
tcactgcaaggaggcttctcaa

SEQ ID NO: 7010972 - DNA, 21 bp, Homo sapiens
gagaggcctgggcccgtgagc

SEQ ID NO: 7010973 - DNA, 22 bp, Homo sapiens
atgattagttaccttgatttaa

SEQ ID NO: 7010974 - DNA, 22 bp, Homo sapiens
aataaacaaaggacaaggaggt

SEQ ID NO: 7010975 - DNA, 22 bp, Homo sapiens
atcaaataaaggtacctagctt

SEQ ID NO: 7010976 - DNA, 22 bp, Homo sapiens
tagaaacagagcaggtggccca

SEQ ID NO: 7010977 - DNA, 22 bp, Homo sapiens
ttagcagcaatggcatcaacta

SEQ ID NO: 7010978 - DNA, 22 bp, Homo sapiens
gcagccaagccatgaggactac

SEQ ID NO: 7010979 - DNA, 22 bp, Homo sapiens
cctgggcaaattatgttactca

SEQ ID NO: 7010980 - DNA, 22 bp, Homo sapiens
gaagcaaagagctagtgccgct

SEQ ID NO: 7010981 - DNA, 22 bp, Homo sapiens
ctgtgggctcccagcttctctc

SEQ ID NO: 7010982 - DNA, 22 bp, Homo sapiens
ctgtttctcccaacgccctagt

SEQ ID NO: 7010983 - DNA, 23 bp, Homo sapiens
agacattttaataaggacttttt

SEQ ID NO: 7010984 - DNA, 22 bp, Homo sapiens
ttcagaatgacttatgtaaggc

SEQ ID NO: 7010985 - DNA, 22 bp, Homo sapiens
cctggagattatttggtccaat

SEQ ID NO: 7010986 - DNA, 22 bp, Homo sapiens
acatgtattgacattatattct

SEQ ID NO: 7010987 - DNA, 22 bp, Homo sapiens
gagtttttccaaggtcacatga

SEQ ID NO: 7010988 - DNA, 22 bp, Homo sapiens
accagagctggcagagtatcaa

SEQ ID NO: 7010989 - DNA, 22 bp, Homo sapiens
agcttcttgaccaagcctgtaa

SEQ ID NO: 7010990 - DNA, 22 bp, Homo sapiens
gagagccagctcactccagggc

SEQ ID NO: 7010991 - DNA, 22 bp, Homo sapiens
atggcagtcagagacaggcaga

SEQ ID NO: 7010992 - DNA, 22 bp, Homo sapiens
cccatttatttaagtaggtctt

SEQ ID NO: 7010993 - DNA, 22 bp, Homo sapiens
ttcttcagtgcccctctagtag

SEQ ID NO: 7010994 - DNA, 22 bp, Homo sapiens
agagccctgcagttcttcagga

SEQ ID NO: 7010995 - DNA, 22 bp, Homo sapiens
actttgttgttccttgtctaaa

SEQ ID NO: 7010996 - DNA, 22 bp, Homo sapiens
tgttgaagataaagttctcatt

SEQ ID NO: 7010997 - DNA, 22 bp, Homo sapiens
gttatacagttttgggtctgct

SEQ ID NO: 7010998 - DNA, 22 bp, Homo sapiens
gttttataattgcttcataaga

SEQ ID NO: 7010999 - DNA, 23 bp, Homo sapiens
tgtgacagggtcattgaaaaggg

SEQ ID NO: 7011000 - DNA, 22 bp, Homo sapiens
taatacaatggagttgggcccc

SEQ ID NO: 7011001 - DNA, 22 bp, Homo sapiens
ggttttggaagtgtgtctgcag

SEQ ID NO: 7011002 - DNA, 21 bp, Homo sapiens
gcaggcactctagaggagctg

SEQ ID NO: 7011003 - DNA, 22 bp, Homo sapiens
atgtatgagagattcttttatt

SEQ ID NO: 7011004 - DNA, 22 bp, Homo sapiens
tttgttctattttagagatgaa

SEQ ID NO: 7011005 - DNA, 23 bp, Homo sapiens
gacagagtgagaccttgtcttac

SEQ ID NO: 7011006 - DNA, 22 bp, Homo sapiens
ggctctaggcggagtcccgcga

SEQ ID NO: 7011007 - DNA, 22 bp, Homo sapiens
ttttccagatgaattccacagt

SEQ ID NO: 7011008 - DNA, 22 bp, Homo sapiens
tgacatgttagggaaatgtgat

SEQ ID NO: 7011009 - DNA, 22 bp, Homo sapiens
catctaatacctcatttaatct

SEQ ID NO: 7011010 - DNA, 22 bp, Homo sapiens
acagaagcagcgcggctcttct

SEQ ID NO: 7011011 - DNA, 22 bp, Homo sapiens
agatttgtatagatgtggttga

SEQ ID NO: 7011012 - DNA, 19 bp, Homo sapiens
tggctgggcgtgcctccgt

SEQ ID NO: 7011013 - DNA, 22 bp, Homo sapiens
cttgccatcttgagttttgtta

SEQ ID NO: 7011014 - DNA, 22 bp, Homo sapiens
ctcgcctgagtttgaatgctgg

SEQ ID NO: 7011015 - DNA, 22 bp, Homo sapiens
aggacacactgttctcacgtaa

SEQ ID NO: 7011016 - DNA, 22 bp, Homo sapiens
ggatttacccaatggatagatg

SEQ ID NO: 7011017 - DNA, 22 bp, Homo sapiens
ggggaacaccgggcagaggcgc

SEQ ID NO: 7011018 - DNA, 22 bp, Homo sapiens
gagctctgcttgggttcttagg

SEQ ID NO: 7011019 - DNA, 22 bp, Homo sapiens
accatgatgggaagctcagggc

SEQ ID NO: 7011020 - DNA, 22 bp, Homo sapiens
ccatgcacaccagcaggcagac

SEQ ID NO: 7011021 - DNA, 22 bp, Homo sapiens
ccttgcctccactgttttaggt

SEQ ID NO: 7011022 - DNA, 22 bp, Homo sapiens
ccagtgcaccatttccctctgt

SEQ ID NO: 7011023 - DNA, 22 bp, Homo sapiens
tcagaagtccaattttcgcacc

SEQ ID NO: 7011024 - DNA, 22 bp, Homo sapiens
atggcagctggcttgggcacct

SEQ ID NO: 7011025 - DNA, 22 bp, Homo sapiens
cagctccatcttgcttatacca

SEQ ID NO: 7011026 - DNA, 17 bp, Homo sapiens
gtctggagtggccttca

SEQ ID NO: 7011027 - DNA, 22 bp, Homo sapiens
ttcttagaagaaacatctaaaa

SEQ ID NO: 7011028 - DNA, 22 bp, Homo sapiens
gcagcccaggagcaggcgaccc

SEQ ID NO: 7011029 - DNA, 22 bp, Homo sapiens
ccagtgcacagccaggcaggtg

SEQ ID NO: 7011030 - DNA, 22 bp, Homo sapiens
cctcacagtgttcgtgtcagat

SEQ ID NO: 7011031 - DNA, 22 bp, Homo sapiens
aagctctggggtacacatctgc

SEQ ID NO: 7011032 - DNA, 22 bp, Homo sapiens
cccagtggcccagcatgtggtg

SEQ ID NO: 7011033 - DNA, 22 bp, Homo sapiens
atgttggtgggtacagagggat

SEQ ID NO: 7011034 - DNA, 22 bp, Homo sapiens
tttcaggccatagcacagggaa

SEQ ID NO: 7011035 - DNA, 22 bp, Homo sapiens
tgccaggcccagctccagagct

SEQ ID NO: 7011036 - DNA, 22 bp, Homo sapiens
ctgaagccacgatagcttccta

SEQ ID NO: 7011037 - DNA, 22 bp, Homo sapiens
ttggctcagtgtgagggagatg

SEQ ID NO: 7011038 - DNA, 22 bp, Homo sapiens
atagtagcgagatctcagctca

SEQ ID NO: 7011039 - DNA, 22 bp, Homo sapiens
gcagccactagttttcctgttt

SEQ ID NO: 7011040 - DNA, 22 bp, Homo sapiens
ccagacaggggctgttcctgct

SEQ ID NO: 7011041 - DNA, 23 bp, Homo sapiens
ttcagaagaaatgagtacaggag

SEQ ID NO: 7011042 - DNA, 22 bp, Homo sapiens
gcacttgatcattgttacagat

SEQ ID NO: 7011043 - DNA, 22 bp, Homo sapiens
ggtctgtgtgctttgggaagtg

SEQ ID NO: 7011044 - DNA, 22 bp, Homo sapiens
tgcttctgactgggtcagttga

SEQ ID NO: 7011045 - DNA, 22 bp, Homo sapiens
taatgcacccagagtttgaact

SEQ ID NO: 7011046 - DNA, 22 bp, Homo sapiens
ttacaactctgtcagtatagct

SEQ ID NO: 7011047 - DNA, 22 bp, Homo sapiens
aacaggaaacaagttgttagga

SEQ ID NO: 7011048 - DNA, 22 bp, Homo sapiens
cattacatggtccaggatatat

SEQ ID NO: 7011049 - DNA, 22 bp, Homo sapiens
ttactttgttctcaagatatgt

SEQ ID NO: 7011050 - DNA, 22 bp, Homo sapiens
ggcgccaggcttcactttaaag

SEQ ID NO: 7011051 - DNA, 22 bp, Homo sapiens
gcctgggaagactaagtgggag

SEQ ID NO: 7011052 - DNA, 23 bp, Homo sapiens
agtcagtgcgggatggtcagggg

SEQ ID NO: 7011053 - DNA, 22 bp, Homo sapiens
tgccctgccaagactgagtggt

SEQ ID NO: 7011054 - DNA, 22 bp, Homo sapiens
ggacatgattagcagggagagc

SEQ ID NO: 7011055 - DNA, 22 bp, Homo sapiens
tccagcttggagagaagtttct

SEQ ID NO: 7011056 - DNA, 22 bp, Homo sapiens
cagtgccaaggctcttggtctg

SEQ ID NO: 7011057 - DNA, 22 bp, Homo sapiens
tactttatattgtggctggcca

SEQ ID NO: 7011058 - DNA, 18 bp, Homo sapiens
tgacctgcgcttcacggt

SEQ ID NO: 7011059 - DNA, 22 bp, Homo sapiens
ctgtgtcttgagtaattcggtg

SEQ ID NO: 7011060 - DNA, 23 bp, Homo sapiens
acgagcttctggcaggatgcaca

SEQ ID NO: 7011061 - DNA, 21 bp, Homo sapiens
tgaaggtgttcatgatgcggt

SEQ ID NO: 7011062 - DNA, 22 bp, Homo sapiens
tgaaggctttctcccctctggt

SEQ ID NO: 7011063 - DNA, 19 bp, Homo sapiens
taactggtgccttcagtca

SEQ ID NO: 7011064 - DNA, 22 bp, Homo sapiens
ataaggacacccttctctttac

SEQ ID NO: 7011065 - DNA, 22 bp, Homo sapiens
aaattgattaaagtccgtgctt

SEQ ID NO: 7011066 - DNA, 22 bp, Homo sapiens
gagaaggatgtggctcatagct

SEQ ID NO: 7011067 - DNA, 22 bp, Homo sapiens
tgtctattcccccacctccgtt

SEQ ID NO: 7011068 - DNA, 22 bp, Homo sapiens
ctgatccctccatagggcacag

SEQ ID NO: 7011069 - DNA, 22 bp, Homo sapiens
ctgggtgagtataggaaaggga

SEQ ID NO: 7011070 - DNA, 22 bp, Homo sapiens
gtgtgactagtcatgcctgaat

SEQ ID NO: 7011071 - DNA, 16 bp, Homo sapiens
ctgatcccacatcctt

SEQ ID NO: 7011072 - DNA, 22 bp, Homo sapiens
catacagtcactgtggtaccac

SEQ ID NO: 7011073 - DNA, 22 bp, Homo sapiens
ttaggaaacgctgctattgact

SEQ ID NO: 7011074 - DNA, 22 bp, Homo sapiens
tagtgtgtgggcttcagggact

SEQ ID NO: 7011075 - DNA, 18 bp, Homo sapiens
atgtttctcttggctctg

SEQ ID NO: 7011076 - DNA, 22 bp, Homo sapiens
gtgggcagtggggtcttctgcc

SEQ ID NO: 7011077 - DNA, 22 bp, Homo sapiens
aatacttgggctgagatttttg

SEQ ID NO: 7011078 - DNA, 22 bp, Homo sapiens
ttggtcctttatcctttaggca

SEQ ID NO: 7011079 - DNA, 23 bp, Homo sapiens
agtaacatgcaaataacagtctg

SEQ ID NO: 7011080 - DNA, 22 bp, Homo sapiens
tgcctgccctttccacacagcc

SEQ ID NO: 7011081 - DNA, 22 bp, Homo sapiens
gaaatcttccttcagtgaagaa

SEQ ID NO: 7011082 - DNA, 22 bp, Homo sapiens
gtttccagagtgagggcacttg

SEQ ID NO: 7011083 - DNA, 21 bp, Homo sapiens
atagtgatagataactgagtt

SEQ ID NO: 7011084 - DNA, 22 bp, Homo sapiens
tctgtggagttgaggaaggttg

SEQ ID NO: 7011085 - DNA, 22 bp, Homo sapiens
aacaggcaggagaattctgcct

SEQ ID NO: 7011086 - DNA, 23 bp, Homo sapiens
tcctgagatgagacagtgctgcc

SEQ ID NO: 7011087 - DNA, 22 bp, Homo sapiens
caagagctagactttgtcagga

SEQ ID NO: 7011088 - DNA, 22 bp, Homo sapiens
atgcttaacttcctagtctata

SEQ ID NO: 7011089 - DNA, 22 bp, Homo sapiens
tacaggtgctctacagacagga

SEQ ID NO: 7011090 - DNA, 22 bp, Homo sapiens
tcctgctgggtctaactctggt

SEQ ID NO: 7011091 - DNA, 22 bp, Homo sapiens
gtgcgtatgcatgtgaatacgt

SEQ ID NO: 7011092 - DNA, 22 bp, Homo sapiens
cagcattgatcccaggctgtgg

SEQ ID NO: 7011093 - DNA, 22 bp, Homo sapiens
cagagaacaaagctgagggttt

SEQ ID NO: 7011094 - DNA, 22 bp, Homo sapiens
ggggcccagcacccctcctcgc

SEQ ID NO: 7011095 - DNA, 17 bp, Homo sapiens
ttctgagccacttcctt

SEQ ID NO: 7011096 - DNA, 22 bp, Homo sapiens
cagcagaagcaacattcaggct

SEQ ID NO: 7011097 - DNA, 22 bp, Homo sapiens
atacaatgattggttctcaccc

SEQ ID NO: 7011098 - DNA, 22 bp, Homo sapiens
tataccttccacaaaacagctt

SEQ ID NO: 7011099 - DNA, 22 bp, Homo sapiens
gacaaccgagcagctgtgggaa

SEQ ID NO: 7011100 - DNA, 22 bp, Homo sapiens
agcattaataagaaatggctcc

SEQ ID NO: 7011101 - DNA, 22 bp, Homo sapiens
aatctagaattttaggggtata

SEQ ID NO: 7011102 - DNA, 22 bp, Homo sapiens
gcagcccaggaccctggacaga

SEQ ID NO: 7011103 - DNA, 22 bp, Homo sapiens
ctcagactttcagggtaggcca

SEQ ID NO: 7011104 - DNA, 22 bp, Homo sapiens
ggcctctctgagagcagacgtt

SEQ ID NO: 7011105 - DNA, 22 bp, Homo sapiens
tggccctgtgactgagttctag

SEQ ID NO: 7011106 - DNA, 22 bp, Homo sapiens
atagctgttagattggggtcga

SEQ ID NO: 7011107 - DNA, 22 bp, Homo sapiens
ccagtgatggtgatcagatgtt

SEQ ID NO: 7011108 - DNA, 19 bp, Homo sapiens
agcagcagctaccacttgt

SEQ ID NO: 7011109 - DNA, 22 bp, Homo sapiens
cctggagaggcgctgcagagga

SEQ ID NO: 7011110 - DNA, 22 bp, Homo sapiens
tcagtcctacacgctcagggac

SEQ ID NO: 7011111 - DNA, 22 bp, Homo sapiens
ttcatggcaggagtcagaagct

SEQ ID NO: 7011112 - DNA, 22 bp, Homo sapiens
gactgcttgagaaggaacaaat

SEQ ID NO: 7011113 - DNA, 22 bp, Homo sapiens
aagaattgatgtgaattgcagc

SEQ ID NO: 7011114 - DNA, 22 bp, Homo sapiens
cttcacaacgacatctggttag

SEQ ID NO: 7011115 - DNA, 22 bp, Homo sapiens
tgaggccatggtcttcccagtc

SEQ ID NO: 7011116 - DNA, 19 bp, Homo sapiens
gagcagtgaggaccaccag

SEQ ID NO: 7011117 - DNA, 22 bp, Homo sapiens
ttgagaagcacagggcctgtgc

SEQ ID NO: 7011118 - DNA, 22 bp, Homo sapiens
gtggtcctttagaggatgtaat

SEQ ID NO: 7011119 - DNA, 22 bp, Homo sapiens
caggctgcaagaaaggcattca

SEQ ID NO: 7011120 - DNA, 22 bp, Homo sapiens
gtctcagggcagctggaggagg

SEQ ID NO: 7011121 - DNA, 22 bp, Homo sapiens
tggctgtgtccctgtccagagt

SEQ ID NO: 7011122 - DNA, 22 bp, Homo sapiens
gtgcctgtaagggcaggtttct

SEQ ID NO: 7011123 - DNA, 22 bp, Homo sapiens
gagcaagactcactgcatcttg

SEQ ID NO: 7011124 - DNA, 22 bp, Homo sapiens
taagacaagcctcgcatttgta

SEQ ID NO: 7011125 - DNA, 22 bp, Homo sapiens
tccattttctaagtatcactta

SEQ ID NO: 7011126 - DNA, 22 bp, Homo sapiens
cttcagtggtcatttgtgataa

SEQ ID NO: 7011127 - DNA, 22 bp, Homo sapiens
tccataagcaggttcttcctga

SEQ ID NO: 7011128 - DNA, 22 bp, Homo sapiens
gcagcccaggaggcgggagccc

SEQ ID NO: 7011129 - DNA, 22 bp, Homo sapiens
gttaactaaaggctgctatttc

SEQ ID NO: 7011130 - DNA, 16 bp, Homo sapiens
actcttcatttagggt

SEQ ID NO: 7011131 - DNA, 22 bp, Homo sapiens
cagcaaggactgggcatgtgaa

SEQ ID NO: 7011132 - DNA, 22 bp, Homo sapiens
aagacagtgatctctgagagat

SEQ ID NO: 7011133 - DNA, 22 bp, Homo sapiens
cagcaagaaaattcacatgctc

SEQ ID NO: 7011134 - DNA, 18 bp, Homo sapiens
catgccttcattcttcat

SEQ ID NO: 7011135 - DNA, 22 bp, Homo sapiens
catgttggctgaggctgtattt

SEQ ID NO: 7011136 - DNA, 21 bp, Homo sapiens
ctgggctcaagcaatcctttc

SEQ ID NO: 7011137 - DNA, 22 bp, Homo sapiens
tagtgccattcaagaggtagtt

SEQ ID NO: 7011138 - DNA, 22 bp, Homo sapiens
gaaataatttagaaggtattcc

SEQ ID NO: 7011139 - DNA, 22 bp, Homo sapiens
ttgagggactttctctattatt

SEQ ID NO: 7011140 - DNA, 22 bp, Homo sapiens
cagtttctccaaacgcaggctg

SEQ ID NO: 7011141 - DNA, 22 bp, Homo sapiens
tcatagaaggaactgggagata

SEQ ID NO: 7011142 - DNA, 22 bp, Homo sapiens
ttgcacatttcctagaatttca

SEQ ID NO: 7011143 - DNA, 22 bp, Homo sapiens
aacagcgacgtcctccccaaca

SEQ ID NO: 7011144 - DNA, 22 bp, Homo sapiens
ttagagagaaccatcaggatct

SEQ ID NO: 7011145 - DNA, 22 bp, Homo sapiens
atccttgggaagagaggaatat

SEQ ID NO: 7011146 - DNA, 22 bp, Homo sapiens
agccaccttcacatggtctatc

SEQ ID NO: 7011147 - DNA, 22 bp, Homo sapiens
gtattcttatactcagtgagct

SEQ ID NO: 7011148 - DNA, 22 bp, Homo sapiens
gcctcctaccacaccctcagtc

SEQ ID NO: 7011149 - DNA, 22 bp, Homo sapiens
ggagagaagggagaatttgttc

SEQ ID NO: 7011150 - DNA, 22 bp, Homo sapiens
gcaagattgtgtggctgaagta

SEQ ID NO: 7011151 - DNA, 21 bp, Homo sapiens
tgctttgctcgttcccagagt

SEQ ID NO: 7011152 - DNA, 22 bp, Homo sapiens
tggagagtggtttgggggacat

SEQ ID NO: 7011153 - DNA, 22 bp, Homo sapiens
attaggtaagataaagcagagg

SEQ ID NO: 7011154 - DNA, 22 bp, Homo sapiens
gtgggtgtggaactgtgagacc

SEQ ID NO: 7011155 - DNA, 22 bp, Homo sapiens
agcagatgggagatggagctgc

SEQ ID NO: 7011156 - DNA, 22 bp, Homo sapiens
atttgagaaaggagggaacttt

SEQ ID NO: 7011157 - DNA, 22 bp, Homo sapiens
taatactttgaatgagagctaa

SEQ ID NO: 7011158 - DNA, 22 bp, Homo sapiens
ctcacagttgtggtacctggtt

SEQ ID NO: 7011159 - DNA, 22 bp, Homo sapiens
cagtcctgggagacttacccag

SEQ ID NO: 7011160 - DNA, 22 bp, Homo sapiens
tatctgggaaggggagaataga

SEQ ID NO: 7011161 - DNA, 22 bp, Homo sapiens
aagctaagtggaagtcttatca

SEQ ID NO: 7011162 - DNA, 22 bp, Homo sapiens
tttgtttactcattcattgatg

SEQ ID NO: 7011163 - DNA, 22 bp, Homo sapiens
tgtgccagttttgtctaagccc

SEQ ID NO: 7011164 - DNA, 19 bp, Homo sapiens
tgactgcctcaggggtgga

SEQ ID NO: 7011165 - DNA, 22 bp, Homo sapiens
tagattcctctacaataaatga

SEQ ID NO: 7011166 - DNA, 20 bp, Homo sapiens
tgtcagataactagctgtta

SEQ ID NO: 7011167 - DNA, 22 bp, Homo sapiens
cggggctgaggcaacgcggaga

SEQ ID NO: 7011168 - DNA, 19 bp, Homo sapiens
ccagagacattggcatctt

SEQ ID NO: 7011169 - DNA, 22 bp, Homo sapiens
caagaaatgggatttgactgcc

SEQ ID NO: 7011170 - DNA, 22 bp, Homo sapiens
agcagcttgaggctggattcca

SEQ ID NO: 7011171 - DNA, 22 bp, Homo sapiens
agcacagtaaagcagtgtcaca

SEQ ID NO: 7011172 - DNA, 22 bp, Homo sapiens
tcttgtctgcagatactttgaa

SEQ ID NO: 7011173 - DNA, 22 bp, Homo sapiens
gagtttagtggaatttccttct

SEQ ID NO: 7011174 - DNA, 22 bp, Homo sapiens
tcctgctgtttacctacaatgg

SEQ ID NO: 7011175 - DNA, 22 bp, Homo sapiens
ttccaatatttacaatgcatta

SEQ ID NO: 7011176 - DNA, 22 bp, Homo sapiens
tgtataagtgtgtagagtaaga

SEQ ID NO: 7011177 - DNA, 22 bp, Homo sapiens
caaacatagtgaagcaatgaca

SEQ ID NO: 7011178 - DNA, 22 bp, Homo sapiens
tccagcccgactgggcctgccg

SEQ ID NO: 7011179 - DNA, 22 bp, Homo sapiens
aaatcagaaaatatggagagga

SEQ ID NO: 7011180 - DNA, 19 bp, Homo sapiens
tgtgtgctgactgccagag

SEQ ID NO: 7011181 - DNA, 22 bp, Homo sapiens
aacaatgtctcatcctatgtgg

SEQ ID NO: 7011182 - DNA, 22 bp, Homo sapiens
tccagactctttaagttcattt

SEQ ID NO: 7011183 - DNA, 22 bp, Homo sapiens
aggagacactgagacttcacca

SEQ ID NO: 7011184 - DNA, 22 bp, Homo sapiens
aaagcaattgtggtttttgtca

SEQ ID NO: 7011185 - DNA, 22 bp, Homo sapiens
ccagtgcttctttgctagctgg

SEQ ID NO: 7011186 - DNA, 22 bp, Homo sapiens
tcagtgtgcacgatacagattg

SEQ ID NO: 7011187 - DNA, 22 bp, Homo sapiens
cgagggctgtgttgctctcctt

SEQ ID NO: 7011188 - DNA, 22 bp, Homo sapiens
aggtttactgagggtgctggtt

SEQ ID NO: 7011189 - DNA, 22 bp, Homo sapiens
ttcacaaaatggtttgttgatg

SEQ ID NO: 7011190 - DNA, 22 bp, Homo sapiens
ggtctggcctccgggcaggtgg

SEQ ID NO: 7011191 - DNA, 22 bp, Homo sapiens
tgggctctgaagtcagtctgct

SEQ ID NO: 7011192 - DNA, 22 bp, Homo sapiens
agaggggcaagtaaagagtctt

SEQ ID NO: 7011193 - DNA, 22 bp, Homo sapiens
gggctgaatttgttgcatgtaa

SEQ ID NO: 7011194 - DNA, 22 bp, Homo sapiens
tggctagaattgggttcacagg

SEQ ID NO: 7011195 - DNA, 22 bp, Homo sapiens
ctgagaggcagccagagaaaat

SEQ ID NO: 7011196 - DNA, 22 bp, Homo sapiens
atctctgggtccatagaagaga

SEQ ID NO: 7011197 - DNA, 22 bp, Homo sapiens
tgtctgtaatagtcactatgtg

SEQ ID NO: 7011198 - DNA, 22 bp, Homo sapiens
agctgctctcagcagttccagg

SEQ ID NO: 7011199 - DNA, 22 bp, Homo sapiens
ctccccaaatgggttgagttct

SEQ ID NO: 7011200 - DNA, 22 bp, Homo sapiens
ccagcccttgctgaagggtggc

SEQ ID NO: 7011201 - DNA, 22 bp, Homo sapiens
ccaagggctctgacttgcctgc

SEQ ID NO: 7011202 - DNA, 22 bp, Homo sapiens
tcaggcactggctgagtgatgg

SEQ ID NO: 7011203 - DNA, 22 bp, Homo sapiens
gctcagtgtttctggtagaaaa

SEQ ID NO: 7011204 - DNA, 22 bp, Homo sapiens
tatgtgtaatcaaacacatgct

SEQ ID NO: 7011205 - DNA, 22 bp, Homo sapiens
atattgctagcctatgagttca

SEQ ID NO: 7011206 - DNA, 22 bp, Homo sapiens
tcccaggtctttgggttcctca

SEQ ID NO: 7011207 - DNA, 22 bp, Homo sapiens
aactttctctggatggcttcct

SEQ ID NO: 7011208 - DNA, 22 bp, Homo sapiens
cacaggtagaattttagggaaa

SEQ ID NO: 7011209 - DNA, 22 bp, Homo sapiens
aggccagaaatttggagtatgt

SEQ ID NO: 7011210 - DNA, 22 bp, Homo sapiens
gacccaggctcgtgggacggct

SEQ ID NO: 7011211 - DNA, 22 bp, Homo sapiens
gggccacacagaacctcctggt

SEQ ID NO: 7011212 - DNA, 22 bp, Homo sapiens
tcctcagaatggatggcagggg

SEQ ID NO: 7011213 - DNA, 22 bp, Homo sapiens
tttgttcttagtatctgtgtgc

SEQ ID NO: 7011214 - DNA, 22 bp, Homo sapiens
cataatgtatgcattttccagc

SEQ ID NO: 7011215 - DNA, 22 bp, Homo sapiens
ctgcctagcgccatctgcctct

SEQ ID NO: 7011216 - DNA, 22 bp, Homo sapiens
tgtagtgtttctcagatatttg

SEQ ID NO: 7011217 - DNA, 22 bp, Homo sapiens
agagccaggccaggccggggca

SEQ ID NO: 7011218 - DNA, 22 bp, Homo sapiens
ttgtcacattcaagttttatat

SEQ ID NO: 7011219 - DNA, 22 bp, Homo sapiens
agcacagaaagcacatttgaaa

SEQ ID NO: 7011220 - DNA, 22 bp, Homo sapiens
tgcaaaaactgcaattgctttt

SEQ ID NO: 7011221 - DNA, 22 bp, Homo sapiens
atgtgtttgtcctgcagaaata

SEQ ID NO: 7011222 - DNA, 22 bp, Homo sapiens
tttctattctggatctgtggca

SEQ ID NO: 7011223 - DNA, 22 bp, Homo sapiens
actgggaggcaaagagcaagga

SEQ ID NO: 7011224 - DNA, 22 bp, Homo sapiens
ggcctgtgagaatcaaggaaaa

SEQ ID NO: 7011225 - DNA, 22 bp, Homo sapiens
ttattgtttaaagccatgtaaa

SEQ ID NO: 7011226 - DNA, 22 bp, Homo sapiens
catcttgctgacttgcattatt

SEQ ID NO: 7011227 - DNA, 22 bp, Homo sapiens
tgcttcaaaaagttgttagagg

SEQ ID NO: 7011228 - DNA, 22 bp, Homo sapiens
tcacatgtatatgcagcacagc

SEQ ID NO: 7011229 - DNA, 17 bp, Homo sapiens
tcatttgttgtgactag

SEQ ID NO: 7011230 - DNA, 22 bp, Homo sapiens
tatgttctctgctctaggatgt

SEQ ID NO: 7011231 - DNA, 22 bp, Homo sapiens
cacaaaatatcaagcactttta

SEQ ID NO: 7011232 - DNA, 22 bp, Homo sapiens
ttaagcagcatgcattcagtgg

SEQ ID NO: 7011233 - DNA, 22 bp, Homo sapiens
ttagagcttcccaattaaaacg

SEQ ID NO: 7011234 - DNA, 22 bp, Homo sapiens
agggctttgatggcattctcat

SEQ ID NO: 7011235 - DNA, 22 bp, Homo sapiens
aagctgaggctcccctgaggga

SEQ ID NO: 7011236 - DNA, 22 bp, Homo sapiens
tggtacaaaagtaattgcgtga

SEQ ID NO: 7011237 - DNA, 23 bp, Homo sapiens
tgcaaagaaatctgggtcattgt

SEQ ID NO: 7011238 - DNA, 22 bp, Homo sapiens
ttctgcatgggctgttggcgtc

SEQ ID NO: 7011239 - DNA, 19 bp, Homo sapiens
cccagctctcgtggtgtgc

SEQ ID NO: 7011240 - DNA, 22 bp, Homo sapiens
tctggcaggtcaatcattcttt

SEQ ID NO: 7011241 - DNA, 19 bp, Homo sapiens
taagatacccctctatttt

SEQ ID NO: 7011242 - DNA, 22 bp, Homo sapiens
tcataatgaccccagagtccgc

SEQ ID NO: 7011243 - DNA, 21 bp, Homo sapiens
caattacttttgcaccgactt

SEQ ID NO: 7011244 - DNA, 20 bp, Homo sapiens
tgacacaaattgctttctca

SEQ ID NO: 7011245 - DNA, 22 bp, Homo sapiens
ttgatttatagaatgttcaagc

SEQ ID NO: 7011246 - DNA, 22 bp, Homo sapiens
tcagtgctgccatggcagggcc

SEQ ID NO: 7011247 - DNA, 22 bp, Homo sapiens
aggcaggaaaatcgcttgaacc

SEQ ID NO: 7011248 - DNA, 22 bp, Homo sapiens
attcaaggttggctcaggaatt

SEQ ID NO: 7011249 - DNA, 19 bp, Homo sapiens
caagggtcatgacaggaac

SEQ ID NO: 7011250 - DNA, 22 bp, Homo sapiens
ttgacccgagtccttcttgggg

SEQ ID NO: 7011251 - DNA, 22 bp, Homo sapiens
cacgcctggacggcggagggtg

SEQ ID NO: 7011252 - DNA, 22 bp, Homo sapiens
aaagattaaatcaaattggtca

SEQ ID NO: 7011253 - DNA, 22 bp, Homo sapiens
gtggcctggaaaggctggtctg

SEQ ID NO: 7011254 - DNA, 22 bp, Homo sapiens
ttccagcccgcgacttgttcag

SEQ ID NO: 7011255 - DNA, 22 bp, Homo sapiens
ctacctgaaaaggttgtggtga

SEQ ID NO: 7011256 - DNA, 22 bp, Homo sapiens
ccatacacacaccaaatttgta

SEQ ID NO: 7011257 - DNA, 22 bp, Homo sapiens
agagtgtggaaatgttcagagt

SEQ ID NO: 7011258 - DNA, 22 bp, Homo sapiens
cagctagtcagaggcagggcca

SEQ ID NO: 7011259 - DNA, 22 bp, Homo sapiens
tactgtacattccgtttgttgc

SEQ ID NO: 7011260 - DNA, 22 bp, Homo sapiens
tggctggagaacttggggatct

SEQ ID NO: 7011261 - DNA, 22 bp, Homo sapiens
cactggacagagtggggttccc

SEQ ID NO: 7011262 - DNA, 22 bp, Homo sapiens
catccctgacttctaggtgaca

SEQ ID NO: 7011263 - DNA, 22 bp, Homo sapiens
tagtttgtagaaatctagaaat

SEQ ID NO: 7011264 - DNA, 22 bp, Homo sapiens
gctgtttctaagctggttccta

SEQ ID NO: 7011265 - DNA, 22 bp, Homo sapiens
cattcctaacccatgcccatca

SEQ ID NO: 7011266 - DNA, 22 bp, Homo sapiens
ctaagtcatggaaagtgtgtgt

SEQ ID NO: 7011267 - DNA, 22 bp, Homo sapiens
tcagataattaatcatgaaatt

SEQ ID NO: 7011268 - DNA, 22 bp, Homo sapiens
tctgggtgagctgcctcgggtc

SEQ ID NO: 7011269 - DNA, 22 bp, Homo sapiens
taaatcacatcgaaatctgggt

SEQ ID NO: 7011270 - DNA, 22 bp, Homo sapiens
atcattcagtgaccacttccca

SEQ ID NO: 7011271 - DNA, 22 bp, Homo sapiens
gggtccagagttttcccgccct

SEQ ID NO: 7011272 - DNA, 21 bp, Homo sapiens
aggctctgtgaatatgtttcc

SEQ ID NO: 7011273 - DNA, 22 bp, Homo sapiens
tgtggactgaaagaaccggcag

SEQ ID NO: 7011274 - DNA, 22 bp, Homo sapiens
tagaactttcagaaattccaaa

SEQ ID NO: 7011275 - DNA, 22 bp, Homo sapiens
ctgaagtccagagtaagggact

SEQ ID NO: 7011276 - DNA, 22 bp, Homo sapiens
tgaggccagactgaaaccaaca

SEQ ID NO: 7011277 - DNA, 23 bp, Homo sapiens
cacctggcttgagttggtgggtc

SEQ ID NO: 7011278 - DNA, 22 bp, Homo sapiens
caaagctcagccctccaatgaa

SEQ ID NO: 7011279 - DNA, 22 bp, Homo sapiens
tttaggtgtgtttggattgaga

SEQ ID NO: 7011280 - DNA, 22 bp, Homo sapiens
tctggactaggggaaggcctgt

SEQ ID NO: 7011281 - DNA, 22 bp, Homo sapiens
ctatgaaatgtcagattctgca

SEQ ID NO: 7011282 - DNA, 22 bp, Homo sapiens
tcctggagccacggagctttca

SEQ ID NO: 7011283 - DNA, 22 bp, Homo sapiens
atgtaatttagaaatgaacaca

SEQ ID NO: 7011284 - DNA, 22 bp, Homo sapiens
cttaggaatgcgtttcctgggt

SEQ ID NO: 7011285 - DNA, 22 bp, Homo sapiens
aggtcaggaggcctctgccatt

SEQ ID NO: 7011286 - DNA, 22 bp, Homo sapiens
ttgagctgcctggctgtggctc

SEQ ID NO: 7011287 - DNA, 22 bp, Homo sapiens
tgctcagagctctggtgcaggt

SEQ ID NO: 7011288 - DNA, 22 bp, Homo sapiens
ctctgtgggggagaggcagctg

SEQ ID NO: 7011289 - DNA, 18 bp, Homo sapiens
tttgtcctgtggcagctg

SEQ ID NO: 7011290 - DNA, 22 bp, Homo sapiens
gcggggggcagcagtcgctcag

SEQ ID NO: 7011291 - DNA, 22 bp, Homo sapiens
gtgcatttctcatacactaaat

SEQ ID NO: 7011292 - DNA, 22 bp, Homo sapiens
aactagaaaaagactttctgag

SEQ ID NO: 7011293 - DNA, 21 bp, Homo sapiens
acagctggccgcgcgggtcgg

SEQ ID NO: 7011294 - DNA, 22 bp, Homo sapiens
ttcaccattctaagacattggt

SEQ ID NO: 7011295 - DNA, 22 bp, Homo sapiens
ctgggacaagctctgtctagct

SEQ ID NO: 7011296 - DNA, 21 bp, Homo sapiens
ggggcgtggcctgccagttgc

SEQ ID NO: 7011297 - DNA, 22 bp, Homo sapiens
tagctgagaggccaattgaact

SEQ ID NO: 7011298 - DNA, 23 bp, Homo sapiens
tgacaagtctcagccaatgcaga

SEQ ID NO: 7011299 - DNA, 22 bp, Homo sapiens
tcgtggatgcgcagggcggcct

SEQ ID NO: 7011300 - DNA, 22 bp, Homo sapiens
cagagctcagagcagggcactc

SEQ ID NO: 7011301 - DNA, 22 bp, Homo sapiens
agtgtgtgctgttccccggagg

SEQ ID NO: 7011302 - DNA, 22 bp, Homo sapiens
ccatttgtaccatttctttgta

SEQ ID NO: 7011303 - DNA, 22 bp, Homo sapiens
atgaggcacatcacagccaatg

SEQ ID NO: 7011304 - DNA, 22 bp, Homo sapiens
tcccctgcagcgcctgcttcta

SEQ ID NO: 7011305 - DNA, 22 bp, Homo sapiens
gggcttaaggccagtgtgcttt

SEQ ID NO: 7011306 - DNA, 22 bp, Homo sapiens
taaggcaaaggggaagttatca

SEQ ID NO: 7011307 - DNA, 22 bp, Homo sapiens
ttatatgaactggactttagga

SEQ ID NO: 7011308 - DNA, 22 bp, Homo sapiens
cctcgtggtgtcagacctgtgc

SEQ ID NO: 7011309 - DNA, 19 bp, Homo sapiens
gggaatgatggaagacttc

SEQ ID NO: 7011310 - DNA, 22 bp, Homo sapiens
caatgcttgctgactccctgtc

SEQ ID NO: 7011311 - DNA, 22 bp, Homo sapiens
tacattgattcaggatataggc

SEQ ID NO: 7011312 - DNA, 22 bp, Homo sapiens
tcttagcatgcatgtataaata

SEQ ID NO: 7011313 - DNA, 22 bp, Homo sapiens
gagtataagtaatttcaagcaa

SEQ ID NO: 7011314 - DNA, 22 bp, Homo sapiens
gtagattcttggaattcaagtc

SEQ ID NO: 7011315 - DNA, 22 bp, Homo sapiens
gccaggcatttattgattgaat

SEQ ID NO: 7011316 - DNA, 22 bp, Homo sapiens
atgtccagagccggcctgctga

SEQ ID NO: 7011317 - DNA, 22 bp, Homo sapiens
tccctctgtgttgggcatgcct

SEQ ID NO: 7011318 - DNA, 21 bp, Homo sapiens
acaggagaccgcctggcagtc

SEQ ID NO: 7011319 - DNA, 17 bp, Homo sapiens
cgtgtgcttgtgtgcac

SEQ ID NO: 7011320 - DNA, 22 bp, Homo sapiens
tggtatctgtgaatgtgacatt

SEQ ID NO: 7011321 - DNA, 22 bp, Homo sapiens
tcaccagatctctctgtaatgg

SEQ ID NO: 7011322 - DNA, 22 bp, Homo sapiens
gaaattcaaataagatatgtag

SEQ ID NO: 7011323 - DNA, 22 bp, Homo sapiens
gcagggttggtgtcctctgcgg

SEQ ID NO: 7011324 - DNA, 21 bp, Homo sapiens
tcagcagaaggaccactaggg

SEQ ID NO: 7011325 - DNA, 20 bp, Homo sapiens
aatgttcaaaggtgatggca

SEQ ID NO: 7011326 - DNA, 22 bp, Homo sapiens
ttcctgggattattgtcaagca

SEQ ID NO: 7011327 - DNA, 22 bp, Homo sapiens
gagccaggcccgtacttgctgt

SEQ ID NO: 7011328 - DNA, 22 bp, Homo sapiens
agcccttggtattttccgatcc

SEQ ID NO: 7011329 - DNA, 22 bp, Homo sapiens
caaagtatgaaccagtttctct

SEQ ID NO: 7011330 - DNA, 22 bp, Homo sapiens
taaggctcttgagatggggaga

SEQ ID NO: 7011331 - DNA, 22 bp, Homo sapiens
catcaggaataaatgaggctgt

SEQ ID NO: 7011332 - DNA, 22 bp, Homo sapiens
gtcattctctggtgtggttgtt

SEQ ID NO: 7011333 - DNA, 22 bp, Homo sapiens
aggtgtgaagagttgacacatt

SEQ ID NO: 7011334 - DNA, 22 bp, Homo sapiens
tcagtgctctgaggtccagggt

SEQ ID NO: 7011335 - DNA, 22 bp, Homo sapiens
cttcacacccactaaaatgatg

SEQ ID NO: 7011336 - DNA, 22 bp, Homo sapiens
agtcagaagggcccttccttcc

SEQ ID NO: 7011337 - DNA, 21 bp, Homo sapiens
tcacacacgtttccaagggca

SEQ ID NO: 7011338 - DNA, 22 bp, Homo sapiens
ccactttgagaagctgatgaaa

SEQ ID NO: 7011339 - DNA, 23 bp, Homo sapiens
tttcaaagactttcccttagagt

SEQ ID NO: 7011340 - DNA, 18 bp, Homo sapiens
cagtcctgtttctacagg

SEQ ID NO: 7011341 - DNA, 22 bp, Homo sapiens
accagtgtcaccccaaccagga

SEQ ID NO: 7011342 - DNA, 22 bp, Homo sapiens
taaacagcctcccctttcactc

SEQ ID NO: 7011343 - DNA, 22 bp, Homo sapiens
tagctgggactactggccctgc

SEQ ID NO: 7011344 - DNA, 22 bp, Homo sapiens
aaagacatcagaaccagctgag

SEQ ID NO: 7011345 - DNA, 22 bp, Homo sapiens
aagtcctttccagtcctgtgat

SEQ ID NO: 7011346 - DNA, 22 bp, Homo sapiens
ttcaagtttcgcaaggacatat

SEQ ID NO: 7011347 - DNA, 22 bp, Homo sapiens
atcatgcagcaacaagcaaggc

SEQ ID NO: 7011348 - DNA, 22 bp, Homo sapiens
ttcctgcgcccttctcgcccgc

SEQ ID NO: 7011349 - DNA, 22 bp, Homo sapiens
ccatctccactgtccctgtcaa

SEQ ID NO: 7011350 - DNA, 22 bp, Homo sapiens
cagagcattgagggtctgccaa

SEQ ID NO: 7011351 - DNA, 22 bp, Homo sapiens
tgcagggaaaacccaggatgct

SEQ ID NO: 7011352 - DNA, 18 bp, Homo sapiens
cagacactctgctctgca

SEQ ID NO: 7011353 - DNA, 22 bp, Homo sapiens
tgcatgtgtgacaaggacagtt

SEQ ID NO: 7011354 - DNA, 22 bp, Homo sapiens
gcggtgggggaaaggagcggtt

SEQ ID NO: 7011355 - DNA, 22 bp, Homo sapiens
tttgggttagaagagctaagga

SEQ ID NO: 7011356 - DNA, 22 bp, Homo sapiens
aagactttccctcatcagaacg

SEQ ID NO: 7011357 - DNA, 22 bp, Homo sapiens
tcttcatggtctggttctccag

SEQ ID NO: 7011358 - DNA, 22 bp, Homo sapiens
cacagtgactggcacctagtat

SEQ ID NO: 7011359 - DNA, 23 bp, Homo sapiens
tcagtgatgttgaacctagcagt

SEQ ID NO: 7011360 - DNA, 22 bp, Homo sapiens
gggactggatagatgtgggtga

SEQ ID NO: 7011361 - DNA, 22 bp, Homo sapiens
gtcagaatttacttaatagcca

SEQ ID NO: 7011362 - DNA, 20 bp, Homo sapiens
acttgcttttgtcaggaaaa

SEQ ID NO: 7011363 - DNA, 22 bp, Homo sapiens
gctcatccagcaagccagggcc

SEQ ID NO: 7011364 - DNA, 23 bp, Homo sapiens
atgaacattagtttcagatattg

SEQ ID NO: 7011365 - DNA, 22 bp, Homo sapiens
tcagtgttattagatgaggttt

SEQ ID NO: 7011366 - DNA, 22 bp, Homo sapiens
gccaccatcttcccatgccaac

SEQ ID NO: 7011367 - DNA, 22 bp, Homo sapiens
tcagacagaaggactatttgaa

SEQ ID NO: 7011368 - DNA, 22 bp, Homo sapiens
tggcagagtgcagaagaggcat

SEQ ID NO: 7011369 - DNA, 22 bp, Homo sapiens
gtggaagcaaccctggcaggag

SEQ ID NO: 7011370 - DNA, 22 bp, Homo sapiens
cactcctataattaaagatgca

SEQ ID NO: 7011371 - DNA, 22 bp, Homo sapiens
ttaagaaggtactcaaagatct

SEQ ID NO: 7011372 - DNA, 22 bp, Homo sapiens
ttgtgcagctataaagaaatgg

SEQ ID NO: 7011373 - DNA, 22 bp, Homo sapiens
tctcttgtggttttgtagttga

SEQ ID NO: 7011374 - DNA, 22 bp, Homo sapiens
agcttctggaaggcaaggcttg

SEQ ID NO: 7011375 - DNA, 22 bp, Homo sapiens
tcatggaaacaatgcggaaaaa

SEQ ID NO: 7011376 - DNA, 22 bp, Homo sapiens
ttgaagaaccatctgtgccact

SEQ ID NO: 7011377 - DNA, 19 bp, Homo sapiens
attcatttttgccttctaa

SEQ ID NO: 7011378 - DNA, 19 bp, Homo sapiens
gccaggctcttattctgtg

SEQ ID NO: 7011379 - DNA, 22 bp, Homo sapiens
cccatttgtatagagccttata

SEQ ID NO: 7011380 - DNA, 22 bp, Homo sapiens
tgttcacaagatgtctgtggct

SEQ ID NO: 7011381 - DNA, 22 bp, Homo sapiens
cccaggaagagtgagtggcatt

SEQ ID NO: 7011382 - DNA, 21 bp, Homo sapiens
tcctgggagtctgagatcctg

SEQ ID NO: 7011383 - DNA, 22 bp, Homo sapiens
tattgtgaagggaaaaatagtg

SEQ ID NO: 7011384 - DNA, 22 bp, Homo sapiens
gagctgagatcatgtacactag

SEQ ID NO: 7011385 - DNA, 22 bp, Homo sapiens
ctcttggccagacacagaggca

SEQ ID NO: 7011386 - DNA, 22 bp, Homo sapiens
taggttcagcttccactgccta

SEQ ID NO: 7011387 - DNA, 22 bp, Homo sapiens
gctcactaaataacaggaagaa

SEQ ID NO: 7011388 - DNA, 21 bp, Homo sapiens
agtgagcatccagagaggtgg

SEQ ID NO: 7011389 - DNA, 22 bp, Homo sapiens
tttcagacagtgggtccatcca

SEQ ID NO: 7011390 - DNA, 22 bp, Homo sapiens
gccgtgtcccgggggccactct

SEQ ID NO: 7011391 - DNA, 18 bp, Homo sapiens
agctggggcctctggtcc

SEQ ID NO: 7011392 - DNA, 22 bp, Homo sapiens
tcagtgtttattgcggtgtgta

SEQ ID NO: 7011393 - DNA, 19 bp, Homo sapiens
taaggccaaaagtaagtgt

SEQ ID NO: 7011394 - DNA, 22 bp, Homo sapiens
cttttgtgattcctcagttact

SEQ ID NO: 7011395 - DNA, 22 bp, Homo sapiens
caatgaaaatttaagttgcagc

SEQ ID NO: 7011396 - DNA, 22 bp, Homo sapiens
agctgggctccaagagggatct

SEQ ID NO: 7011397 - DNA, 22 bp, Homo sapiens
ttgctgataaaataaaccaaga

SEQ ID NO: 7011398 - DNA, 22 bp, Homo sapiens
caagatggagaagcagcaaggg

SEQ ID NO: 7011399 - DNA, 22 bp, Homo sapiens
aaatacgtgcacatacatacat

SEQ ID NO: 7011400 - DNA, 22 bp, Homo sapiens
ctgctgtcaaaggaaatatttg

SEQ ID NO: 7011401 - DNA, 22 bp, Homo sapiens
gctttggatgtgtgcctgaggt

SEQ ID NO: 7011402 - DNA, 22 bp, Homo sapiens
agtgcctagatattgtttgaac

SEQ ID NO: 7011403 - DNA, 20 bp, Homo sapiens
tccagggtagatgaattctg

SEQ ID NO: 7011404 - DNA, 22 bp, Homo sapiens
ttccaggctcttccaggctgtc

SEQ ID NO: 7011405 - DNA, 22 bp, Homo sapiens
ctgggccaagaagttgtgtatg

SEQ ID NO: 7011406 - DNA, 22 bp, Homo sapiens
ctctcagacacccatttggaaa

SEQ ID NO: 7011407 - DNA, 22 bp, Homo sapiens
atacagatataagattgaggag

SEQ ID NO: 7011408 - DNA, 22 bp, Homo sapiens
ccagagacgtcggtcagggcgc

SEQ ID NO: 7011409 - DNA, 22 bp, Homo sapiens
tgacatttttaaaaccactagt

SEQ ID NO: 7011410 - DNA, 22 bp, Homo sapiens
gagagactgggcagggccggca

SEQ ID NO: 7011411 - DNA, 19 bp, Homo sapiens
tcttccctggctgtcagtc

SEQ ID NO: 7011412 - DNA, 22 bp, Homo sapiens
tttcagttttataactttggcc

SEQ ID NO: 7011413 - DNA, 22 bp, Homo sapiens
tagaactctggtcttctcatcc

SEQ ID NO: 7011414 - DNA, 22 bp, Homo sapiens
gaatccagatttttctcttatt

SEQ ID NO: 7011415 - DNA, 22 bp, Homo sapiens
gatctttcaagttttactgttt

SEQ ID NO: 7011416 - DNA, 22 bp, Homo sapiens
gagctacaagggagactttttt

SEQ ID NO: 7011417 - DNA, 22 bp, Homo sapiens
gagaacacatgcagactgggta

SEQ ID NO: 7011418 - DNA, 22 bp, Homo sapiens
taacactggttatccctgtgca

SEQ ID NO: 7011419 - DNA, 22 bp, Homo sapiens
ttcatatatatgcactacgtac

SEQ ID NO: 7011420 - DNA, 22 bp, Homo sapiens
tcagtctatccagctcagatcc

SEQ ID NO: 7011421 - DNA, 22 bp, Homo sapiens
cagcagtggctgcaggcagctg

SEQ ID NO: 7011422 - DNA, 22 bp, Homo sapiens
attcccatatatgtttgtcgct

SEQ ID NO: 7011423 - DNA, 22 bp, Homo sapiens
ttgcagggcaggaccatggaca

SEQ ID NO: 7011424 - DNA, 22 bp, Homo sapiens
ctggcagattggggtcagcagt

SEQ ID NO: 7011425 - DNA, 17 bp, Homo sapiens
tccagcctcctctgctg

SEQ ID NO: 7011426 - DNA, 22 bp, Homo sapiens
ctgcattcatatcagatagaag

SEQ ID NO: 7011427 - DNA, 22 bp, Homo sapiens
aaactctgcactgcggtaaggt

SEQ ID NO: 7011428 - DNA, 18 bp, Homo sapiens
taagtgtaattgacaatt

SEQ ID NO: 7011429 - DNA, 22 bp, Homo sapiens
gggctctgtggcttccttctta

SEQ ID NO: 7011430 - DNA, 22 bp, Homo sapiens
aaggcttctggagcttgctggc

SEQ ID NO: 7011431 - DNA, 19 bp, Homo sapiens
agctgctggcccagggacc

SEQ ID NO: 7011432 - DNA, 22 bp, Homo sapiens
tgatggaagagctaacaatatc

SEQ ID NO: 7011433 - DNA, 22 bp, Homo sapiens
aacaggggattagatagcaggc

SEQ ID NO: 7011434 - DNA, 22 bp, Homo sapiens
gcagaaccataaattcaggtaa

SEQ ID NO: 7011435 - DNA, 18 bp, Homo sapiens
ctcctgggctgcagatgc

SEQ ID NO: 7011436 - DNA, 22 bp, Homo sapiens
ctacagcagagaccagccacat

SEQ ID NO: 7011437 - DNA, 22 bp, Homo sapiens
gatgtgtgtttatacatatatt

SEQ ID NO: 7011438 - DNA, 23 bp, Homo sapiens
tggaatgtttcttgtactgaatg

SEQ ID NO: 7011439 - DNA, 22 bp, Homo sapiens
gcacacaggggagttctcagaa

SEQ ID NO: 7011440 - DNA, 22 bp, Homo sapiens
agtggagaccccacttctacat

SEQ ID NO: 7011441 - DNA, 22 bp, Homo sapiens
gaaaatagcagatagaccaatg

SEQ ID NO: 7011442 - DNA, 22 bp, Homo sapiens
tattcctactaacgtcctgtgt

SEQ ID NO: 7011443 - DNA, 22 bp, Homo sapiens
gctgaaaaatagtgtcgtgttt

SEQ ID NO: 7011444 - DNA, 22 bp, Homo sapiens
tctccaggggcagggtctggag

SEQ ID NO: 7011445 - DNA, 22 bp, Homo sapiens
agtgggagcggcagtcggggac

SEQ ID NO: 7011446 - DNA, 22 bp, Homo sapiens
actggccagccaacaacaatag

SEQ ID NO: 7011447 - DNA, 22 bp, Homo sapiens
agtcagatttagatgtagcaag

SEQ ID NO: 7011448 - DNA, 21 bp, Homo sapiens
gcccaatgaacctgggcagct

SEQ ID NO: 7011449 - DNA, 22 bp, Homo sapiens
tcatgcagataagaataagtaa

SEQ ID NO: 7011450 - DNA, 21 bp, Homo sapiens
tctccagtatccttctctgag

SEQ ID NO: 7011451 - DNA, 22 bp, Homo sapiens
agcagctacttaacccatgaca

SEQ ID NO: 7011452 - DNA, 22 bp, Homo sapiens
attctttgaacagttttcctgt

SEQ ID NO: 7011453 - DNA, 22 bp, Homo sapiens
gaacttggtattccttttaaca

SEQ ID NO: 7011454 - DNA, 22 bp, Homo sapiens
atgatgctgttattatctatac

SEQ ID NO: 7011455 - DNA, 23 bp, Homo sapiens
atggaaatagcatgtgtcattta

SEQ ID NO: 7011456 - DNA, 22 bp, Homo sapiens
atctgaaaagcctcttactcct

SEQ ID NO: 7011457 - DNA, 22 bp, Homo sapiens
catcatcaacaggtagactggt

SEQ ID NO: 7011458 - DNA, 22 bp, Homo sapiens
tccttgaagaatgattcttgga

SEQ ID NO: 7011459 - DNA, 22 bp, Homo sapiens
gagaaagcttctttcccacagg

SEQ ID NO: 7011460 - DNA, 22 bp, Homo sapiens
tttgttcaatatgtgtttgtcc

SEQ ID NO: 7011461 - DNA, 22 bp, Homo sapiens
ctcactgcaagctccacctctt

SEQ ID NO: 7011462 - DNA, 22 bp, Homo sapiens
gagtaatggccgtaggttggga

SEQ ID NO: 7011463 - DNA, 22 bp, Homo sapiens
tcattgctctaggttccttgga

SEQ ID NO: 7011464 - DNA, 17 bp, Homo sapiens
ctggagcctccaactcc

SEQ ID NO: 7011465 - DNA, 22 bp, Homo sapiens
aaagagctcacagtccactgga

SEQ ID NO: 7011466 - DNA, 22 bp, Homo sapiens
tgccagcacaagttaagagatc

SEQ ID NO: 7011467 - DNA, 22 bp, Homo sapiens
tcactctgtgtttgaactcaag

SEQ ID NO: 7011468 - DNA, 22 bp, Homo sapiens
ttgagactcgagtctctcagac

SEQ ID NO: 7011469 - DNA, 19 bp, Homo sapiens
cgcaggcttcgggtcgctc

SEQ ID NO: 7011470 - DNA, 22 bp, Homo sapiens
aagtgattaacatggagctttt

SEQ ID NO: 7011471 - DNA, 20 bp, Homo sapiens
cagtggcttctgtggaatat

SEQ ID NO: 7011472 - DNA, 22 bp, Homo sapiens
ttgggattacaggtgtaagcca

SEQ ID NO: 7011473 - DNA, 22 bp, Homo sapiens
tgaaggcaaaacatgttacacc

SEQ ID NO: 7011474 - DNA, 22 bp, Homo sapiens
taaactgcttctctcagtctgt

SEQ ID NO: 7011475 - DNA, 22 bp, Homo sapiens
agataacttttgggtattcatg

SEQ ID NO: 7011476 - DNA, 22 bp, Homo sapiens
ttcatctagtgtgctcgtaacg

SEQ ID NO: 7011477 - DNA, 22 bp, Homo sapiens
accagcaggccaggggcactgc

SEQ ID NO: 7011478 - DNA, 22 bp, Homo sapiens
tcatttcatgtctcaggcactg

SEQ ID NO: 7011479 - DNA, 22 bp, Homo sapiens
tcttcctggtttctgggccatc

SEQ ID NO: 7011480 - DNA, 22 bp, Homo sapiens
ctgttcagtaacctataaaaca

SEQ ID NO: 7011481 - DNA, 22 bp, Homo sapiens
ctctgaggctgggaattcagct

SEQ ID NO: 7011482 - DNA, 21 bp, Homo sapiens
agccaagccttgggagccagg

SEQ ID NO: 7011483 - DNA, 22 bp, Homo sapiens
cctcctggatggatttggtgga

SEQ ID NO: 7011484 - DNA, 22 bp, Homo sapiens
ggctctgtggctggccatgatg

SEQ ID NO: 7011485 - DNA, 21 bp, Homo sapiens
tgtcagttcatgtataggcca

SEQ ID NO: 7011486 - DNA, 19 bp, Homo sapiens
ccccagggtaggctagggg

SEQ ID NO: 7011487 - DNA, 22 bp, Homo sapiens
gatctgagatctaaaccagagg

SEQ ID NO: 7011488 - DNA, 22 bp, Homo sapiens
attcagttgtctactactgcct

SEQ ID NO: 7011489 - DNA, 22 bp, Homo sapiens
aagccatttcctgatacaccta

SEQ ID NO: 7011490 - DNA, 22 bp, Homo sapiens
actataacctgttagaatagat

SEQ ID NO: 7011491 - DNA, 22 bp, Homo sapiens
agatctggccctcagcttgatt

SEQ ID NO: 7011492 - DNA, 22 bp, Homo sapiens
gaggcggtacagccagtcctcc

SEQ ID NO: 7011493 - DNA, 22 bp, Homo sapiens
ggtggggctgcaagcagttcgg

SEQ ID NO: 7011494 - DNA, 22 bp, Homo sapiens
gctcagagaatcagcagacacc

SEQ ID NO: 7011495 - DNA, 21 bp, Homo sapiens
gttctggagcctggaagtcca

SEQ ID NO: 7011496 - DNA, 22 bp, Homo sapiens
cagctggggagagacatggcag

SEQ ID NO: 7011497 - DNA, 22 bp, Homo sapiens
acagtgagatccaagggcaggc

SEQ ID NO: 7011498 - DNA, 22 bp, Homo sapiens
actgtgggagcttatcatttca

SEQ ID NO: 7011499 - DNA, 22 bp, Homo sapiens
gaatcatttagctctgcatgga

SEQ ID NO: 7011500 - DNA, 22 bp, Homo sapiens
gtccttgctttggagcaggcta

SEQ ID NO: 7011501 - DNA, 22 bp, Homo sapiens
gcaggagaaatgaagattgggt

SEQ ID NO: 7011502 - DNA, 22 bp, Homo sapiens
ttgcaaaagcaattgcagtttt

SEQ ID NO: 7011503 - DNA, 22 bp, Homo sapiens
gctggctgacagagatttaaaa

SEQ ID NO: 7011504 - DNA, 22 bp, Homo sapiens
aatactctagggcagtgcttct

SEQ ID NO: 7011505 - DNA, 22 bp, Homo sapiens
taggctctagatgtggtctttg

SEQ ID NO: 7011506 - DNA, 21 bp, Homo sapiens
tctgccaggttagattgacta

SEQ ID NO: 7011507 - DNA, 22 bp, Homo sapiens
gtttggtggtagcattggctat

SEQ ID NO: 7011508 - DNA, 20 bp, Homo sapiens
ggccggggagctctccaggg

SEQ ID NO: 7011509 - DNA, 22 bp, Homo sapiens
tgtcaactttgaaccaaatgct

SEQ ID NO: 7011510 - DNA, 22 bp, Homo sapiens
agggggtgcatttgtgaatgaa

SEQ ID NO: 7011511 - DNA, 22 bp, Homo sapiens
gaggctaagcactggcatttct

SEQ ID NO: 7011512 - DNA, 22 bp, Homo sapiens
tgtgtgaggattcctggttctt

SEQ ID NO: 7011513 - DNA, 22 bp, Homo sapiens
ggagcctggagtttctgatggg

SEQ ID NO: 7011514 - DNA, 15 bp, Homo sapiens
aaagtgcacccaata

SEQ ID NO: 7011515 - DNA, 22 bp, Homo sapiens
gacatttaaggcagtcacttaa

SEQ ID NO: 7011516 - DNA, 22 bp, Homo sapiens
gtagatctcaacactggaagta

SEQ ID NO: 7011517 - DNA, 22 bp, Homo sapiens
tgtcactacatcataaatatat

SEQ ID NO: 7011518 - DNA, 22 bp, Homo sapiens
attgcaaataatgcgagccagt

SEQ ID NO: 7011519 - DNA, 22 bp, Homo sapiens
actccccagactgccatgctgg

SEQ ID NO: 7011520 - DNA, 22 bp, Homo sapiens
ctctgctggtgaccactgggcc

SEQ ID NO: 7011521 - DNA, 22 bp, Homo sapiens
tctggggaccatggcatctaaa

SEQ ID NO: 7011522 - DNA, 22 bp, Homo sapiens
acctctggcaccccctggcttg

SEQ ID NO: 7011523 - DNA, 22 bp, Homo sapiens
tctggtttcccagttcctccgt

SEQ ID NO: 7011524 - DNA, 22 bp, Homo sapiens
agggttcagtgaggtgtactcc

SEQ ID NO: 7011525 - DNA, 22 bp, Homo sapiens
atgaatgattaaagagtacagt

SEQ ID NO: 7011526 - DNA, 22 bp, Homo sapiens
tgtcccaggctgaagtacagtg

SEQ ID NO: 7011527 - DNA, 22 bp, Homo sapiens
tctgcgtgggactgaggaggct

SEQ ID NO: 7011528 - DNA, 22 bp, Homo sapiens
tcagtaattacctatgactcga

SEQ ID NO: 7011529 - DNA, 22 bp, Homo sapiens
acagatgaaaaagcttgtggat

SEQ ID NO: 7011530 - DNA, 22 bp, Homo sapiens
acaggtgttgaatgatgtcaca

SEQ ID NO: 7011531 - DNA, 22 bp, Homo sapiens
atgcagcttcaggattatgatg

SEQ ID NO: 7011532 - DNA, 22 bp, Homo sapiens
agagctgagcaccaagcatggt

SEQ ID NO: 7011533 - DNA, 22 bp, Homo sapiens
tctaccactcatgctacttact

SEQ ID NO: 7011534 - DNA, 22 bp, Homo sapiens
agatgtgaatgaattctgctgg

SEQ ID NO: 7011535 - DNA, 22 bp, Homo sapiens
ttctaagtcactcagattttgg

SEQ ID NO: 7011536 - DNA, 22 bp, Homo sapiens
gaattcaatttcttggtctttg

SEQ ID NO: 7011537 - DNA, 22 bp, Homo sapiens
acacatatatgtcgaagtcctc

SEQ ID NO: 7011538 - DNA, 22 bp, Homo sapiens
tggtacaatcacagctcactgt

SEQ ID NO: 7011539 - DNA, 16 bp, Homo sapiens
gcaggtggggcgcgca

SEQ ID NO: 7011540 - DNA, 18 bp, Homo sapiens
aaattagatggacctgtg

SEQ ID NO: 7011541 - DNA, 22 bp, Homo sapiens
acacactggaggtaaatggggt

SEQ ID NO: 7011542 - DNA, 22 bp, Homo sapiens
tgtattcttagttttaatcaga

SEQ ID NO: 7011543 - DNA, 22 bp, Homo sapiens
aagttgtagtcagatgtcagtt

SEQ ID NO: 7011544 - DNA, 22 bp, Homo sapiens
caggcccataatgcaaatattt

SEQ ID NO: 7011545 - DNA, 22 bp, Homo sapiens
cagaaatgttctaatgattcag

SEQ ID NO: 7011546 - DNA, 22 bp, Homo sapiens
ggctttattttgcatgaatgct

SEQ ID NO: 7011547 - DNA, 22 bp, Homo sapiens
tgtgtaaatggactgtgaatta

SEQ ID NO: 7011548 - DNA, 22 bp, Homo sapiens
ctttggaaggaacaggattctc

SEQ ID NO: 7011549 - DNA, 22 bp, Homo sapiens
atggctggcactggcctgggtt

SEQ ID NO: 7011550 - DNA, 22 bp, Homo sapiens
tctctgtgcttgactttcccat

SEQ ID NO: 7011551 - DNA, 22 bp, Homo sapiens
gaagcctggagaccagatgttg

SEQ ID NO: 7011552 - DNA, 22 bp, Homo sapiens
gactgagcttctgcaacactgg

SEQ ID NO: 7011553 - DNA, 22 bp, Homo sapiens
gaataactccatgatatgcttt

SEQ ID NO: 7011554 - DNA, 22 bp, Homo sapiens
atattttgaagttaataatgtg

SEQ ID NO: 7011555 - DNA, 22 bp, Homo sapiens
atggtcaagccacactcatcca

SEQ ID NO: 7011556 - DNA, 22 bp, Homo sapiens
gtctgctcatgctaccgcgggc

SEQ ID NO: 7011557 - DNA, 22 bp, Homo sapiens
gggctccagccactggctgagg

SEQ ID NO: 7011558 - DNA, 21 bp, Homo sapiens
caggccaaaaggttcaacatt

SEQ ID NO: 7011559 - DNA, 22 bp, Homo sapiens
gtggcacagggttgttggtcat

SEQ ID NO: 7011560 - DNA, 22 bp, Homo sapiens
actgtaaagaggtgtatcttta

SEQ ID NO: 7011561 - DNA, 22 bp, Homo sapiens
atttcctaatttagggatagac

SEQ ID NO: 7011562 - DNA, 22 bp, Homo sapiens
tacagtgcaatgtgatgtagat

SEQ ID NO: 7011563 - DNA, 22 bp, Homo sapiens
caaatactctggatgtgtttgt

SEQ ID NO: 7011564 - DNA, 22 bp, Homo sapiens
cacaatgtaagagtttgttcat

SEQ ID NO: 7011565 - DNA, 22 bp, Homo sapiens
tggagcaagctggagagaacat

SEQ ID NO: 7011566 - DNA, 22 bp, Homo sapiens
aatttataataaatagggcttt

SEQ ID NO: 7011567 - DNA, 22 bp, Homo sapiens
atgatccacatctggtccatag

SEQ ID NO: 7011568 - DNA, 22 bp, Homo sapiens
acacagaagatctcttaatgct

SEQ ID NO: 7011569 - DNA, 22 bp, Homo sapiens
gagagttagttgagcagtctga

SEQ ID NO: 7011570 - DNA, 22 bp, Homo sapiens
agcttagtgaggtgcaagacac

SEQ ID NO: 7011571 - DNA, 22 bp, Homo sapiens
tgagtattgaccagaaaattta

SEQ ID NO: 7011572 - DNA, 22 bp, Homo sapiens
gacagtaactacagttctgtgg

SEQ ID NO: 7011573 - DNA, 22 bp, Homo sapiens
gcctcctatggggccatcgcag

SEQ ID NO: 7011574 - DNA, 22 bp, Homo sapiens
cacctgtacagggccgggctgg

SEQ ID NO: 7011575 - DNA, 22 bp, Homo sapiens
tgtaatggagcttagagttatc

SEQ ID NO: 7011576 - DNA, 22 bp, Homo sapiens
gaggccaactttggagaacagg

SEQ ID NO: 7011577 - DNA, 22 bp, Homo sapiens
gcatgcagaaaatgaacaacga

SEQ ID NO: 7011578 - DNA, 22 bp, Homo sapiens
gggcctggggacaccaccatga

SEQ ID NO: 7011579 - DNA, 22 bp, Homo sapiens
acagagcatcagatgaaatcaa

SEQ ID NO: 7011580 - DNA, 22 bp, Homo sapiens
ccacagttattcatttgtgaca

SEQ ID NO: 7011581 - DNA, 22 bp, Homo sapiens
agtggttactcaagcaaatctc

SEQ ID NO: 7011582 - DNA, 18 bp, Homo sapiens
catgtgttctacatcagt

SEQ ID NO: 7011583 - DNA, 22 bp, Homo sapiens
agcatacagttgaaagtggctt

SEQ ID NO: 7011584 - DNA, 22 bp, Homo sapiens
taaccaaagggcctaaggaatg

SEQ ID NO: 7011585 - DNA, 22 bp, Homo sapiens
tttcctaatcccaatgacattt

SEQ ID NO: 7011586 - DNA, 22 bp, Homo sapiens
taagggctgaacatttgtgtcc

SEQ ID NO: 7011587 - DNA, 22 bp, Homo sapiens
gtggagaggaacccagctctgt

SEQ ID NO: 7011588 - DNA, 22 bp, Homo sapiens
tcttaatggcatgcaggtttca

SEQ ID NO: 7011589 - DNA, 22 bp, Homo sapiens
gagtgctcctggatggatttcc

SEQ ID NO: 7011590 - DNA, 22 bp, Homo sapiens
agtgattttggccgtgccatta

SEQ ID NO: 7011591 - DNA, 22 bp, Homo sapiens
atggcaaaaattaacagatcaa

SEQ ID NO: 7011592 - DNA, 18 bp, Homo sapiens
cctaggaaagggaggcaa

SEQ ID NO: 7011593 - DNA, 22 bp, Homo sapiens
tcaggccccttgtcagctctgt

SEQ ID NO: 7011594 - DNA, 22 bp, Homo sapiens
agcaacagcaggtttgcactcc

SEQ ID NO: 7011595 - DNA, 19 bp, Homo sapiens
ccttgtctggtgaaggact

SEQ ID NO: 7011596 - DNA, 22 bp, Homo sapiens
gaggctcagttatgtcatcagg

SEQ ID NO: 7011597 - DNA, 22 bp, Homo sapiens
cccacaggccctgctgccttga

SEQ ID NO: 7011598 - DNA, 22 bp, Homo sapiens
agcaaatgggtttatatttgac

SEQ ID NO: 7011599 - DNA, 22 bp, Homo sapiens
agcatgttcatcttctgttggt

SEQ ID NO: 7011600 - DNA, 22 bp, Homo sapiens
ctgggaggggtagccaatccta

SEQ ID NO: 7011601 - DNA, 22 bp, Homo sapiens
gcccatgtctgacagggtgggg

SEQ ID NO: 7011602 - DNA, 22 bp, Homo sapiens
ccagcttgtttgaagctcgtca

SEQ ID NO: 7011603 - DNA, 22 bp, Homo sapiens
tacaggagcatggggaagggat

SEQ ID NO: 7011604 - DNA, 22 bp, Homo sapiens
tttcttcttgatttaaacaggg

SEQ ID NO: 7011605 - DNA, 21 bp, Homo sapiens
ttctctccatatgcccagccc

SEQ ID NO: 7011606 - DNA, 22 bp, Homo sapiens
tgaaaacagaatccttgttttc

SEQ ID NO: 7011607 - DNA, 21 bp, Homo sapiens
gctgcccaaccctgcatctcc

SEQ ID NO: 7011608 - DNA, 22 bp, Homo sapiens
aggcagccattaccaagggcat

SEQ ID NO: 7011609 - DNA, 22 bp, Homo sapiens
gtagaattacctctctatgtcc

SEQ ID NO: 7011610 - DNA, 22 bp, Homo sapiens
aggtctggtgttgggcctgaaa

SEQ ID NO: 7011611 - DNA, 18 bp, Homo sapiens
tttccagggattaggtgg

SEQ ID NO: 7011612 - DNA, 22 bp, Homo sapiens
gaccctggcaggtagcctcaca

SEQ ID NO: 7011613 - DNA, 22 bp, Homo sapiens
tctagatcatgtctgtggtcaa

SEQ ID NO: 7011614 - DNA, 22 bp, Homo sapiens
tcttcattctcgcctttgtcgt

SEQ ID NO: 7011615 - DNA, 22 bp, Homo sapiens
agcttcctgtcttctgcacaaa

SEQ ID NO: 7011616 - DNA, 22 bp, Homo sapiens
ttacttgaaatggcttcttgga

SEQ ID NO: 7011617 - DNA, 22 bp, Homo sapiens
ccttctcagccccagctcccgc

SEQ ID NO: 7011618 - DNA, 19 bp, Homo sapiens
atcaggaacaaggctgatc

SEQ ID NO: 7011619 - DNA, 22 bp, Homo sapiens
cagtcccactagtgccaatacc

SEQ ID NO: 7011620 - DNA, 22 bp, Homo sapiens
cccgcaggggcagccctcatcc

SEQ ID NO: 7011621 - DNA, 22 bp, Homo sapiens
tgtgactttgtcaagttgcata

SEQ ID NO: 7011622 - DNA, 17 bp, Homo sapiens
gggcagggactcctggg

SEQ ID NO: 7011623 - DNA, 22 bp, Homo sapiens
ctgagcacctgttataggttag

SEQ ID NO: 7011624 - DNA, 22 bp, Homo sapiens
gattcctaacagcaacaggtga

SEQ ID NO: 7011625 - DNA, 22 bp, Homo sapiens
ctacagacccaccttggaagaa

SEQ ID NO: 7011626 - DNA, 22 bp, Homo sapiens
tctggctccaggaccgggcaca

SEQ ID NO: 7011627 - DNA, 22 bp, Homo sapiens
tgtgtgcagcctctgtctttgg

SEQ ID NO: 7011628 - DNA, 22 bp, Homo sapiens
cccagcttgcgggcggcaggag

SEQ ID NO: 7011629 - DNA, 22 bp, Homo sapiens
ttggccaagggatcgaggttgg

SEQ ID NO: 7011630 - DNA, 22 bp, Homo sapiens
gaagacactaaactggggcttc

SEQ ID NO: 7011631 - DNA, 22 bp, Homo sapiens
gactggatggaggcttagaagg

SEQ ID NO: 7011632 - DNA, 22 bp, Homo sapiens
agtatcaaggatctccagcacc

SEQ ID NO: 7011633 - DNA, 22 bp, Homo sapiens
ttgcaaatattcccctaggtct

SEQ ID NO: 7011634 - DNA, 22 bp, Homo sapiens
ttgggcagtctggctgcagagt

SEQ ID NO: 7011635 - DNA, 22 bp, Homo sapiens
aggccagagttaaggagaacag

SEQ ID NO: 7011636 - DNA, 22 bp, Homo sapiens
aggtcatagagatgctgtttca

SEQ ID NO: 7011637 - DNA, 22 bp, Homo sapiens
actctgagaaaacactatgctg

SEQ ID NO: 7011638 - DNA, 22 bp, Homo sapiens
aattgtcaaacacaaataagag

SEQ ID NO: 7011639 - DNA, 22 bp, Homo sapiens
agcgtagatgaaaggcacttac

SEQ ID NO: 7011640 - DNA, 22 bp, Homo sapiens
tatgctgtattctgtatgttag

SEQ ID NO: 7011641 - DNA, 22 bp, Homo sapiens
tgggagttcacgtgatattcac

SEQ ID NO: 7011642 - DNA, 22 bp, Homo sapiens
gggctgggatggcttgaagatt

SEQ ID NO: 7011643 - DNA, 19 bp, Homo sapiens
ctgtccctcccaggtatga

SEQ ID NO: 7011644 - DNA, 22 bp, Homo sapiens
agcacagttctttctctagctg

SEQ ID NO: 7011645 - DNA, 22 bp, Homo sapiens
ttagttttcccatctttatggt

SEQ ID NO: 7011646 - DNA, 22 bp, Homo sapiens
cggcagctgattgcagagcacc

SEQ ID NO: 7011647 - DNA, 18 bp, Homo sapiens
aggcacagagcatacata

SEQ ID NO: 7011648 - DNA, 19 bp, Homo sapiens
caccaagatggctctagtc

SEQ ID NO: 7011649 - DNA, 22 bp, Homo sapiens
agcttactgggcagtaaagatt

SEQ ID NO: 7011650 - DNA, 22 bp, Homo sapiens
agggcagccattgagggattct

SEQ ID NO: 7011651 - DNA, 22 bp, Homo sapiens
tgtgttttatctattgtatctt

SEQ ID NO: 7011652 - DNA, 22 bp, Homo sapiens
cctgctaataaggtagaaatat

SEQ ID NO: 7011653 - DNA, 22 bp, Homo sapiens
ctggggcttcaatgcttcggtg

SEQ ID NO: 7011654 - DNA, 19 bp, Homo sapiens
atgattcccagggaggggg

SEQ ID NO: 7011655 - DNA, 22 bp, Homo sapiens
ggcttctctaaagatcatgcgt

SEQ ID NO: 7011656 - DNA, 22 bp, Homo sapiens
gggtaatgtgcactgaagggtg

SEQ ID NO: 7011657 - DNA, 23 bp, Homo sapiens
acactcttcccagaaggttctga

SEQ ID NO: 7011658 - DNA, 22 bp, Homo sapiens
aaagatcattctctggtccaga

SEQ ID NO: 7011659 - DNA, 22 bp, Homo sapiens
ggtgcaagagctccaggccctg

SEQ ID NO: 7011660 - DNA, 22 bp, Homo sapiens
aacttcaagcttcgtcccttcg

SEQ ID NO: 7011661 - DNA, 22 bp, Homo sapiens
tagcaagatccttccctggcgt

SEQ ID NO: 7011662 - DNA, 22 bp, Homo sapiens
ttccaggaggcactgacagagg

SEQ ID NO: 7011663 - DNA, 22 bp, Homo sapiens
agacctgtgatcacatggaatg

SEQ ID NO: 7011664 - DNA, 22 bp, Homo sapiens
acacctttgccccaagtcatag

SEQ ID NO: 7011665 - DNA, 22 bp, Homo sapiens
cactggacttggagtcagaagg

SEQ ID NO: 7011666 - DNA, 22 bp, Homo sapiens
ttttagttgtagttggtgagga

SEQ ID NO: 7011667 - DNA, 22 bp, Homo sapiens
tgagatttgttttataaaatag

SEQ ID NO: 7011668 - DNA, 22 bp, Homo sapiens
gatgaaatgtgaaagttctggg

SEQ ID NO: 7011669 - DNA, 22 bp, Homo sapiens
ctaatgactaatgatgttgagt

SEQ ID NO: 7011670 - DNA, 22 bp, Homo sapiens
tggattgattataagagattca

SEQ ID NO: 7011671 - DNA, 22 bp, Homo sapiens
cctcctgcacctccaggaactc

SEQ ID NO: 7011672 - DNA, 22 bp, Homo sapiens
cctcttgaggccgggccggatc

SEQ ID NO: 7011673 - DNA, 22 bp, Homo sapiens
agcagcaagtgtaactgaatat

SEQ ID NO: 7011674 - DNA, 22 bp, Homo sapiens
tgctgccatctcaactgccctt

SEQ ID NO: 7011675 - DNA, 22 bp, Homo sapiens
ggagggctcgtcatccaccact

SEQ ID NO: 7011676 - DNA, 22 bp, Homo sapiens
tcagtatagcttctaaactaac

SEQ ID NO: 7011677 - DNA, 22 bp, Homo sapiens
tactggagtcagaaatgccttg

SEQ ID NO: 7011678 - DNA, 18 bp, Homo sapiens
ctctgctaatgggcagct

SEQ ID NO: 7011679 - DNA, 22 bp, Homo sapiens
cagctgttgtctctcacatatt

SEQ ID NO: 7011680 - DNA, 22 bp, Homo sapiens
catgcagataattatattgtgt

SEQ ID NO: 7011681 - DNA, 22 bp, Homo sapiens
taattggatgttctctggaagc

SEQ ID NO: 7011682 - DNA, 22 bp, Homo sapiens
gacgccgtgtcccggcactctt

SEQ ID NO: 7011683 - DNA, 22 bp, Homo sapiens
ctcttagtttatctttgacaaa

SEQ ID NO: 7011684 - DNA, 22 bp, Homo sapiens
ggctcttgggagctcagagttg

SEQ ID NO: 7011685 - DNA, 22 bp, Homo sapiens
atgtgctgtaatccattgaagg

SEQ ID NO: 7011686 - DNA, 22 bp, Homo sapiens
ggctctggcgtccaatggagcg

SEQ ID NO: 7011687 - DNA, 22 bp, Homo sapiens
tgggccacttgaaagtggatgt

SEQ ID NO: 7011688 - DNA, 22 bp, Homo sapiens
aagattcagccaaattgttcat

SEQ ID NO: 7011689 - DNA, 22 bp, Homo sapiens
gcagcccataacatttgaggcc

SEQ ID NO: 7011690 - DNA, 23 bp, Homo sapiens
cagtgctggttctgcctgtgggg

SEQ ID NO: 7011691 - DNA, 22 bp, Homo sapiens
ctctgctttcctcttacacact

SEQ ID NO: 7011692 - DNA, 22 bp, Homo sapiens
cagttcaagagaaatactactg

SEQ ID NO: 7011693 - DNA, 20 bp, Homo sapiens
actctggggctcattagggg

SEQ ID NO: 7011694 - DNA, 22 bp, Homo sapiens
tcctagttctctgccagtcgct

SEQ ID NO: 7011695 - DNA, 22 bp, Homo sapiens
agaagttttgggaaatactgat

SEQ ID NO: 7011696 - DNA, 22 bp, Homo sapiens
tttcagagctgagatgccacag

SEQ ID NO: 7011697 - DNA, 22 bp, Homo sapiens
ttgcctggattctaccacagaa

SEQ ID NO: 7011698 - DNA, 22 bp, Homo sapiens
ggcacaggagctagtcaaagcc

SEQ ID NO: 7011699 - DNA, 22 bp, Homo sapiens
tgaaagctgtccactaggctgt

SEQ ID NO: 7011700 - DNA, 22 bp, Homo sapiens
ggtcaacagaatttgtactcag

SEQ ID NO: 7011701 - DNA, 22 bp, Homo sapiens
caatagcaggtctacagagaga

SEQ ID NO: 7011702 - DNA, 22 bp, Homo sapiens
gagcaggctctgcctgtgtgtc

SEQ ID NO: 7011703 - DNA, 22 bp, Homo sapiens
aggcctcttcagggagcatgga

SEQ ID NO: 7011704 - DNA, 22 bp, Homo sapiens
tagactttactaaggctcattt

SEQ ID NO: 7011705 - DNA, 22 bp, Homo sapiens
gattatataatggaagctcttg

SEQ ID NO: 7011706 - DNA, 20 bp, Homo sapiens
tgtgtagcaggtgctgtgcc

SEQ ID NO: 7011707 - DNA, 22 bp, Homo sapiens
tctaagtaaaaggggatccagg

SEQ ID NO: 7011708 - DNA, 22 bp, Homo sapiens
tcttggcaaatttttgaggctc

SEQ ID NO: 7011709 - DNA, 22 bp, Homo sapiens
aaggcagcctctgccagccggg

SEQ ID NO: 7011710 - DNA, 22 bp, Homo sapiens
aagcacagaaaaggagcatgga

SEQ ID NO: 7011711 - DNA, 22 bp, Homo sapiens
atttctggctgttggaaagttc

SEQ ID NO: 7011712 - DNA, 17 bp, Homo sapiens
ggtttaatccttacctg

SEQ ID NO: 7011713 - DNA, 22 bp, Homo sapiens
ctgctgcaatctggcttccatg

SEQ ID NO: 7011714 - DNA, 22 bp, Homo sapiens
tgcagcctggtggtcactggag

SEQ ID NO: 7011715 - DNA, 22 bp, Homo sapiens
ggttcactctcaagtctgccta

SEQ ID NO: 7011716 - DNA, 22 bp, Homo sapiens
gttacagtttgggcttgattca

SEQ ID NO: 7011717 - DNA, 22 bp, Homo sapiens
tagggctgttagtaattctcag

SEQ ID NO: 7011718 - DNA, 22 bp, Homo sapiens
agtgtgaagagcagcacaaatg

SEQ ID NO: 7011719 - DNA, 22 bp, Homo sapiens
aatcacagtgggtactagattg

SEQ ID NO: 7011720 - DNA, 22 bp, Homo sapiens
ctgcctcctggctgatgggtag

SEQ ID NO: 7011721 - DNA, 22 bp, Homo sapiens
tgaaatgatatctgataacaaa

SEQ ID NO: 7011722 - DNA, 21 bp, Homo sapiens
aagatggttatgtgctaaaga

SEQ ID NO: 7011723 - DNA, 22 bp, Homo sapiens
cataatttgtggtagtggggga

SEQ ID NO: 7011724 - DNA, 22 bp, Homo sapiens
cactggtgccagagaacagaat

SEQ ID NO: 7011725 - DNA, 22 bp, Homo sapiens
cattgcctcggagcctgttatg

SEQ ID NO: 7011726 - DNA, 22 bp, Homo sapiens
tgtccttaaggagcttaatgtc

SEQ ID NO: 7011727 - DNA, 22 bp, Homo sapiens
ggcagggagagcatgctgataa

SEQ ID NO: 7011728 - DNA, 22 bp, Homo sapiens
aaactactggattagtaactta

SEQ ID NO: 7011729 - DNA, 22 bp, Homo sapiens
gggcagctggcttataggtttg

SEQ ID NO: 7011730 - DNA, 22 bp, Homo sapiens
tttcacagttagcatgaggact

SEQ ID NO: 7011731 - DNA, 22 bp, Homo sapiens
gcaaggagcctggaggtgagtg

SEQ ID NO: 7011732 - DNA, 22 bp, Homo sapiens
ggcagcaaggtggcggaaatga

SEQ ID NO: 7011733 - DNA, 22 bp, Homo sapiens
ggccaggaacttttgggatggg

SEQ ID NO: 7011734 - DNA, 22 bp, Homo sapiens
cttcccactagtatcacagagc

SEQ ID NO: 7011735 - DNA, 22 bp, Homo sapiens
cctctcagccggactgtcaggc

SEQ ID NO: 7011736 - DNA, 22 bp, Homo sapiens
gataaacactgatgatatgggg

SEQ ID NO: 7011737 - DNA, 22 bp, Homo sapiens
tcaagcaaactctgagaaataa

SEQ ID NO: 7011738 - DNA, 22 bp, Homo sapiens
aactttacactgctttacatga

SEQ ID NO: 7011739 - DNA, 22 bp, Homo sapiens
tagaatacagtttaagaactac

SEQ ID NO: 7011740 - DNA, 22 bp, Homo sapiens
cgctttggatttcgctttccaa

SEQ ID NO: 7011741 - DNA, 22 bp, Homo sapiens
gtccttcagggagtcaaacact

SEQ ID NO: 7011742 - DNA, 22 bp, Homo sapiens
ctagtcactgtaataatctgct

SEQ ID NO: 7011743 - DNA, 22 bp, Homo sapiens
cctggctgaacaaagtccctcc

SEQ ID NO: 7011744 - DNA, 22 bp, Homo sapiens
ccaattcacctcctatgcacat

SEQ ID NO: 7011745 - DNA, 22 bp, Homo sapiens
tctggcacatagcagggtctct

SEQ ID NO: 7011746 - DNA, 22 bp, Homo sapiens
atcatccagccccagaagggag

SEQ ID NO: 7011747 - DNA, 22 bp, Homo sapiens
atattggtgaaatgctagcaaa

SEQ ID NO: 7011748 - DNA, 16 bp, Homo sapiens
tccaaagcccgacttc

SEQ ID NO: 7011749 - DNA, 22 bp, Homo sapiens
gccaggtggctgagcagctgca

SEQ ID NO: 7011750 - DNA, 22 bp, Homo sapiens
tgtctgtccactcactgtggag

SEQ ID NO: 7011751 - DNA, 22 bp, Homo sapiens
cacagggctaaatgaagggttg

SEQ ID NO: 7011752 - DNA, 22 bp, Homo sapiens
aggcttagaaattcagctgagt

SEQ ID NO: 7011753 - DNA, 22 bp, Homo sapiens
agtctcttaattttttctaagt

SEQ ID NO: 7011754 - DNA, 22 bp, Homo sapiens
ttccaaggcgcgccggcgccac

SEQ ID NO: 7011755 - DNA, 22 bp, Homo sapiens
acatttttcacatttgtagggt

SEQ ID NO: 7011756 - DNA, 22 bp, Homo sapiens
gtggggggagctgcaagctgga

SEQ ID NO: 7011757 - DNA, 19 bp, Homo sapiens
gctctaaaagattttgaag

SEQ ID NO: 7011758 - DNA, 22 bp, Homo sapiens
agtgacaagagctaggcttttt

SEQ ID NO: 7011759 - DNA, 22 bp, Homo sapiens
acagtagctaatattgcattat

SEQ ID NO: 7011760 - DNA, 22 bp, Homo sapiens
ttgcagggaaacagtttaggaa

SEQ ID NO: 7011761 - DNA, 22 bp, Homo sapiens
ctttcaactacatacaggcgat

SEQ ID NO: 7011762 - DNA, 22 bp, Homo sapiens
caggccctgaggattcggcggg

SEQ ID NO: 7011763 - DNA, 22 bp, Homo sapiens
acagagttcccactccagaagc

SEQ ID NO: 7011764 - DNA, 22 bp, Homo sapiens
acccaggctgcttctcagtggc

SEQ ID NO: 7011765 - DNA, 22 bp, Homo sapiens
tatccaattcaccattgatggg

SEQ ID NO: 7011766 - DNA, 22 bp, Homo sapiens
cagtgattttggtctgccttag

SEQ ID NO: 7011767 - DNA, 22 bp, Homo sapiens
atattttccgaacttgaggtag

SEQ ID NO: 7011768 - DNA, 22 bp, Homo sapiens
tgttcctggaaagccaggtggg

SEQ ID NO: 7011769 - DNA, 22 bp, Homo sapiens
cagggagtttttgttcctctag

SEQ ID NO: 7011770 - DNA, 22 bp, Homo sapiens
gcattagatttgcctttgaagc

SEQ ID NO: 7011771 - DNA, 22 bp, Homo sapiens
aggccaagtgctgggacaggtg

SEQ ID NO: 7011772 - DNA, 22 bp, Homo sapiens
aaacgagtcccggtcccaaaag

SEQ ID NO: 7011773 - DNA, 22 bp, Homo sapiens
gccttgggaaagtgggaggaga

SEQ ID NO: 7011774 - DNA, 22 bp, Homo sapiens
ggaggaggggcgctttgtctat

SEQ ID NO: 7011775 - DNA, 22 bp, Homo sapiens
aaggaggagattagtgtttagg

SEQ ID NO: 7011776 - DNA, 22 bp, Homo sapiens
atagtgttagagccagtatgtt

SEQ ID NO: 7011777 - DNA, 19 bp, Homo sapiens
tctgtcactgggggtattc

SEQ ID NO: 7011778 - DNA, 22 bp, Homo sapiens
agagcaacgaggtgatactaga

SEQ ID NO: 7011779 - DNA, 22 bp, Homo sapiens
tttggcgtctctcaggagctca

SEQ ID NO: 7011780 - DNA, 22 bp, Homo sapiens
gaaatcaaggctacattcaggt

SEQ ID NO: 7011781 - DNA, 22 bp, Homo sapiens
gtgcttcctcagaggttcccat

SEQ ID NO: 7011782 - DNA, 22 bp, Homo sapiens
tggctggcatagccattgctcc

SEQ ID NO: 7011783 - DNA, 22 bp, Homo sapiens
taggatttctctttttgcaact

SEQ ID NO: 7011784 - DNA, 22 bp, Homo sapiens
ggcattgtgtgctttccttgcc

SEQ ID NO: 7011785 - DNA, 22 bp, Homo sapiens
gatgtcttaagcccagaagttc

SEQ ID NO: 7011786 - DNA, 22 bp, Homo sapiens
tacaagattaaaacttatacca

SEQ ID NO: 7011787 - DNA, 22 bp, Homo sapiens
caggatgccatctgctgctgct

SEQ ID NO: 7011788 - DNA, 22 bp, Homo sapiens
aaccaacataggaatgcagaga

SEQ ID NO: 7011789 - DNA, 22 bp, Homo sapiens
gtctcttagtcaatattttctg

SEQ ID NO: 7011790 - DNA, 22 bp, Homo sapiens
tagaggtgacactgagaccata

SEQ ID NO: 7011791 - DNA, 22 bp, Homo sapiens
tgggatcttttgagatactgtg

SEQ ID NO: 7011792 - DNA, 22 bp, Homo sapiens
atttcactcttaattgcttcct

SEQ ID NO: 7011793 - DNA, 22 bp, Homo sapiens
ggttccttcctgccttagccac

SEQ ID NO: 7011794 - DNA, 22 bp, Homo sapiens
tcacacagcttggagttatggt

SEQ ID NO: 7011795 - DNA, 22 bp, Homo sapiens
ggtgctctggtcatggtggagt

SEQ ID NO: 7011796 - DNA, 22 bp, Homo sapiens
cagggttgattccttctgaggg

SEQ ID NO: 7011797 - DNA, 22 bp, Homo sapiens
aacattgcagcttaattgcagg

SEQ ID NO: 7011798 - DNA, 22 bp, Homo sapiens
gggtgatttgcaaaataagtgt

SEQ ID NO: 7011799 - DNA, 20 bp, Homo sapiens
aatcctgggacagaggcagg

SEQ ID NO: 7011800 - DNA, 22 bp, Homo sapiens
tgtatgaagccagaatctgttt

SEQ ID NO: 7011801 - DNA, 22 bp, Homo sapiens
tctacatatgtgatttctaagt

SEQ ID NO: 7011802 - DNA, 22 bp, Homo sapiens
tgcagaaccagtcctcagaccc

SEQ ID NO: 7011803 - DNA, 22 bp, Homo sapiens
tgaaatgtttgggtccagaagt

SEQ ID NO: 7011804 - DNA, 23 bp, Homo sapiens
tagtcagtatgtaagtctaattg

SEQ ID NO: 7011805 - DNA, 20 bp, Homo sapiens
ggccttggaatagcacagct

SEQ ID NO: 7011806 - DNA, 22 bp, Homo sapiens
tagtccaggaaggtggggcaga

SEQ ID NO: 7011807 - DNA, 22 bp, Homo sapiens
ctggccctcggagtccagctgc

SEQ ID NO: 7011808 - DNA, 22 bp, Homo sapiens
ccaggaaggaagcaggggtttc

SEQ ID NO: 7011809 - DNA, 22 bp, Homo sapiens
attcagcacaatttggccaata

SEQ ID NO: 7011810 - DNA, 19 bp, Homo sapiens
acaggggctagcggaagca

SEQ ID NO: 7011811 - DNA, 22 bp, Homo sapiens
aaatcagacttgaattttcatc

SEQ ID NO: 7011812 - DNA, 22 bp, Homo sapiens
tactttgataaggttcttctat

SEQ ID NO: 7011813 - DNA, 22 bp, Homo sapiens
gcaggatgggagcttcactctg

SEQ ID NO: 7011814 - DNA, 22 bp, Homo sapiens
taatttcaccgttgctagaaat

SEQ ID NO: 7011815 - DNA, 22 bp, Homo sapiens
aatcctggcctagctgggctca

SEQ ID NO: 7011816 - DNA, 22 bp, Homo sapiens
tccaggtcagacttctgtgccc

SEQ ID NO: 7011817 - DNA, 17 bp, Homo sapiens
acatccagcttatgtgg

SEQ ID NO: 7011818 - DNA, 22 bp, Homo sapiens
taggacaattatcaactaggct

SEQ ID NO: 7011819 - DNA, 21 bp, Homo sapiens
agcctgggaggcggaggttgc

SEQ ID NO: 7011820 - DNA, 23 bp, Homo sapiens
ggctgtgcagcctgcggcaaaag

SEQ ID NO: 7011821 - DNA, 21 bp, Homo sapiens
actgttcatctgttcagaagc

SEQ ID NO: 7011822 - DNA, 22 bp, Homo sapiens
atgagaaatttattacaagcta

SEQ ID NO: 7011823 - DNA, 22 bp, Homo sapiens
gtggctttataggaagaggaac

SEQ ID NO: 7011824 - DNA, 22 bp, Homo sapiens
ggcaggcactgtgctaggcgct

SEQ ID NO: 7011825 - DNA, 22 bp, Homo sapiens
gagttaatagggttctttgtga

SEQ ID NO: 7011826 - DNA, 22 bp, Homo sapiens
gaggagctggcagcgtctccgc

SEQ ID NO: 7011827 - DNA, 22 bp, Homo sapiens
gcttccacttgggaacctctct

SEQ ID NO: 7011828 - DNA, 22 bp, Homo sapiens
atgacccccaagggcagcgtga

SEQ ID NO: 7011829 - DNA, 21 bp, Homo sapiens
ctgggctttctctcaaagaca

SEQ ID NO: 7011830 - DNA, 22 bp, Homo sapiens
gtctggactttatcccaaggtt

SEQ ID NO: 7011831 - DNA, 22 bp, Homo sapiens
cactcacttatttctaacagaa

SEQ ID NO: 7011832 - DNA, 17 bp, Homo sapiens
cagggctgtctgcctag

SEQ ID NO: 7011833 - DNA, 22 bp, Homo sapiens
ttggctctgatggggatcagga

SEQ ID NO: 7011834 - DNA, 22 bp, Homo sapiens
aaggctgagtaaaacagagaac

SEQ ID NO: 7011835 - DNA, 22 bp, Homo sapiens
gaggcataagtagaagagattg

SEQ ID NO: 7011836 - DNA, 22 bp, Homo sapiens
gggcatgagcgagctgctttga

SEQ ID NO: 7011837 - DNA, 22 bp, Homo sapiens
tgcatttaactagaatattaat

SEQ ID NO: 7011838 - DNA, 22 bp, Homo sapiens
ttccagaggtagcaatgacttg

SEQ ID NO: 7011839 - DNA, 23 bp, Homo sapiens
tctgtgtctccacccaaatctca

SEQ ID NO: 7011840 - DNA, 19 bp, Homo sapiens
atctttagcaactttcaaa

SEQ ID NO: 7011841 - DNA, 20 bp, Homo sapiens
tgtgtatgtgcacatgcgaa

SEQ ID NO: 7011842 - DNA, 22 bp, Homo sapiens
gttattgacatgtattaagcac

SEQ ID NO: 7011843 - DNA, 23 bp, Homo sapiens
tctgatgtctctggaagctcatg

SEQ ID NO: 7011844 - DNA, 22 bp, Homo sapiens
gctgaaggtctctggagaggtc

SEQ ID NO: 7011845 - DNA, 22 bp, Homo sapiens
ctcgcgttccagctgcgggccg

SEQ ID NO: 7011846 - DNA, 22 bp, Homo sapiens
acagaacttcagtagtattccc

SEQ ID NO: 7011847 - DNA, 22 bp, Homo sapiens
tcaagaatttttaatgtgactg

SEQ ID NO: 7011848 - DNA, 19 bp, Homo sapiens
tttcagactcatctccagc

SEQ ID NO: 7011849 - DNA, 22 bp, Homo sapiens
gtaagacatagatttctcatga

SEQ ID NO: 7011850 - DNA, 22 bp, Homo sapiens
gtgggccttcaaccctgtctgg

SEQ ID NO: 7011851 - DNA, 22 bp, Homo sapiens
ttggctcaggacccctgtgact

SEQ ID NO: 7011852 - DNA, 22 bp, Homo sapiens
gaagtcagctccccaggtcccc

SEQ ID NO: 7011853 - DNA, 22 bp, Homo sapiens
ttgtaacagtagctgtcagctc

SEQ ID NO: 7011854 - DNA, 22 bp, Homo sapiens
acagccttattctttagtttac

SEQ ID NO: 7011855 - DNA, 22 bp, Homo sapiens
ttgtcaggtgggagaacagtca

SEQ ID NO: 7011856 - DNA, 22 bp, Homo sapiens
tatttcacattagataggtctg

SEQ ID NO: 7011857 - DNA, 21 bp, Homo sapiens
aagcttccaaactgctggact

SEQ ID NO: 7011858 - DNA, 21 bp, Homo sapiens
tgtctttaggacctgttaaat

SEQ ID NO: 7011859 - DNA, 22 bp, Homo sapiens
tgtgggaaatgggagtggaaga

SEQ ID NO: 7011860 - DNA, 22 bp, Homo sapiens
tcagcaaacattgattggactt

SEQ ID NO: 7011861 - DNA, 20 bp, Homo sapiens
cattggagtggagaggaaat

SEQ ID NO: 7011862 - DNA, 22 bp, Homo sapiens
cacagccctgcgccccagtttg

SEQ ID NO: 7011863 - DNA, 22 bp, Homo sapiens
agagacgcattcagaggcaggc

SEQ ID NO: 7011864 - DNA, 22 bp, Homo sapiens
acagaactggaattggaactca

SEQ ID NO: 7011865 - DNA, 22 bp, Homo sapiens
ttatttgccagaatttctcttg

SEQ ID NO: 7011866 - DNA, 22 bp, Homo sapiens
attcagtagaagttagctatta

SEQ ID NO: 7011867 - DNA, 22 bp, Homo sapiens
aagacctctgaagtacctggtg

SEQ ID NO: 7011868 - DNA, 22 bp, Homo sapiens
ccagagcccagcacacggtgct

SEQ ID NO: 7011869 - DNA, 17 bp, Homo sapiens
acagcaggcccggaggg

SEQ ID NO: 7011870 - DNA, 22 bp, Homo sapiens
acaaatggaaggtgttctcttc

SEQ ID NO: 7011871 - DNA, 22 bp, Homo sapiens
tcctcaaatatttacttactga

SEQ ID NO: 7011872 - DNA, 22 bp, Homo sapiens
ctctggaaaattgtgtgggggt

SEQ ID NO: 7011873 - DNA, 22 bp, Homo sapiens
gttacaaactcaggtgccaaaa

SEQ ID NO: 7011874 - DNA, 22 bp, Homo sapiens
gttatgctgcctggtgagtcat

SEQ ID NO: 7011875 - DNA, 22 bp, Homo sapiens
acttttgtgcaggtctctccca

SEQ ID NO: 7011876 - DNA, 22 bp, Homo sapiens
tgccctgcagaccctgcagtgt

SEQ ID NO: 7011877 - DNA, 19 bp, Homo sapiens
atgcatacttgcatagttt

SEQ ID NO: 7011878 - DNA, 22 bp, Homo sapiens
ttaagaaggcaactggcaacta

SEQ ID NO: 7011879 - DNA, 22 bp, Homo sapiens
ttttcatttacattagggaaga

SEQ ID NO: 7011880 - DNA, 22 bp, Homo sapiens
gtgctttagctgagttggtcaa

SEQ ID NO: 7011881 - DNA, 20 bp, Homo sapiens
tcaaggaatgtcattttgtt

SEQ ID NO: 7011882 - DNA, 22 bp, Homo sapiens
agggagctttttcatgtgtcta

SEQ ID NO: 7011883 - DNA, 22 bp, Homo sapiens
ctgcctgccttggcctccagga

SEQ ID NO: 7011884 - DNA, 22 bp, Homo sapiens
agccacagtctgtagccagctt

SEQ ID NO: 7011885 - DNA, 22 bp, Homo sapiens
atctgtcttccaccacacatcc

SEQ ID NO: 7011886 - DNA, 22 bp, Homo sapiens
tattgcttcataattgttgcca

SEQ ID NO: 7011887 - DNA, 22 bp, Homo sapiens
aggaagttagtaaattatgtgc

SEQ ID NO: 7011888 - DNA, 22 bp, Homo sapiens
tggagactcagaaggggaagca

SEQ ID NO: 7011889 - DNA, 20 bp, Homo sapiens
tatgtatgcctacatgctat

SEQ ID NO: 7011890 - DNA, 19 bp, Homo sapiens
agtgcagggagcaccctca

SEQ ID NO: 7011891 - DNA, 20 bp, Homo sapiens
agctggtgaattaaagactg

SEQ ID NO: 7011892 - DNA, 22 bp, Homo sapiens
tctttggaatttgctggaaata

SEQ ID NO: 7011893 - DNA, 22 bp, Homo sapiens
ccaaagctggctttcatggttt

SEQ ID NO: 7011894 - DNA, 22 bp, Homo sapiens
ggcaccagccacctatttctag

SEQ ID NO: 7011895 - DNA, 18 bp, Homo sapiens
ggcattgtttattagtta

SEQ ID NO: 7011896 - DNA, 22 bp, Homo sapiens
tctcatggagtcaggagcagaa

SEQ ID NO: 7011897 - DNA, 22 bp, Homo sapiens
ccagtcctagttctaccttaca

SEQ ID NO: 7011898 - DNA, 22 bp, Homo sapiens
aggtcctcctcctccaggaagg

SEQ ID NO: 7011899 - DNA, 22 bp, Homo sapiens
cttcagctgcagttatgtttag

SEQ ID NO: 7011900 - DNA, 22 bp, Homo sapiens
tacaagatgtactaaaaattat

SEQ ID NO: 7011901 - DNA, 21 bp, Homo sapiens
gccactgtgcacactaaccca

SEQ ID NO: 7011902 - DNA, 21 bp, Homo sapiens
tggaagggaagtcttggttgt

SEQ ID NO: 7011903 - DNA, 22 bp, Homo sapiens
ctctgaatactttaagaattgt

SEQ ID NO: 7011904 - DNA, 22 bp, Homo sapiens
ggccttggattttaccctaaag

SEQ ID NO: 7011905 - DNA, 22 bp, Homo sapiens
acatgcatgtcatcagcccttt

SEQ ID NO: 7011906 - DNA, 22 bp, Homo sapiens
acagtaataagtgttggtgagg

SEQ ID NO: 7011907 - DNA, 22 bp, Homo sapiens
taggcattttattgaacgtaac

SEQ ID NO: 7011908 - DNA, 22 bp, Homo sapiens
tcattctttaccaagttgtcac

SEQ ID NO: 7011909 - DNA, 22 bp, Homo sapiens
ttttaaagagatgctgtgcata

SEQ ID NO: 7011910 - DNA, 22 bp, Homo sapiens
gaggctcctccttacatttacc

SEQ ID NO: 7011911 - DNA, 22 bp, Homo sapiens
atctctgaaggctccaggagag

SEQ ID NO: 7011912 - DNA, 22 bp, Homo sapiens
tgtcttaaacttgtgggacttc

SEQ ID NO: 7011913 - DNA, 22 bp, Homo sapiens
tgctgtcaatttagtttacctg

SEQ ID NO: 7011914 - DNA, 22 bp, Homo sapiens
accaggcctagcaagtacatta

SEQ ID NO: 7011915 - DNA, 22 bp, Homo sapiens
aaattgtgctttgactcctgcc

SEQ ID NO: 7011916 - DNA, 22 bp, Homo sapiens
tccttggatctttcctatgatt

SEQ ID NO: 7011917 - DNA, 20 bp, Homo sapiens
tcatcagataggttagtaca

SEQ ID NO: 7011918 - DNA, 22 bp, Homo sapiens
tcccaggatctgagggcagaga

SEQ ID NO: 7011919 - DNA, 22 bp, Homo sapiens
ggtccctgaagatgcctgagga

SEQ ID NO: 7011920 - DNA, 22 bp, Homo sapiens
atcaagtctgcctgtctggagg

SEQ ID NO: 7011921 - DNA, 22 bp, Homo sapiens
ttccttctagagcttgtttagg

SEQ ID NO: 7011922 - DNA, 22 bp, Homo sapiens
gggacaggctgagacttgagct

SEQ ID NO: 7011923 - DNA, 22 bp, Homo sapiens
atacagaaaagtggatagccag

SEQ ID NO: 7011924 - DNA, 22 bp, Homo sapiens
gtgttacatatacctgagctta

SEQ ID NO: 7011925 - DNA, 22 bp, Homo sapiens
tgtggcctctaagctcacgaag

SEQ ID NO: 7011926 - DNA, 22 bp, Homo sapiens
gaaaggttcttgggagttcaca

SEQ ID NO: 7011927 - DNA, 22 bp, Homo sapiens
cagtgcaatgttaaataggaaa

SEQ ID NO: 7011928 - DNA, 22 bp, Homo sapiens
catctaagatactctctgtcac

SEQ ID NO: 7011929 - DNA, 21 bp, Homo sapiens
cgctccaccccacccactggc

SEQ ID NO: 7011930 - DNA, 20 bp, Homo sapiens
atacaaagagattgatgtat

SEQ ID NO: 7011931 - DNA, 20 bp, Homo sapiens
atgtagcagtgtgctgggaa

SEQ ID NO: 7011932 - DNA, 22 bp, Homo sapiens
cactctgtgattgcagcattcc

SEQ ID NO: 7011933 - DNA, 22 bp, Homo sapiens
atttacactaaaggaaggagga

SEQ ID NO: 7011934 - DNA, 22 bp, Homo sapiens
agtctccacaacagccctgata

SEQ ID NO: 7011935 - DNA, 22 bp, Homo sapiens
tatgtttttcagacgtcctaca

SEQ ID NO: 7011936 - DNA, 22 bp, Homo sapiens
ggtgattctgtgaggggctgac

SEQ ID NO: 7011937 - DNA, 22 bp, Homo sapiens
tctgtaaaacaatattgtattc

SEQ ID NO: 7011938 - DNA, 22 bp, Homo sapiens
tgagaagcacagctcactcacg

SEQ ID NO: 7011939 - DNA, 22 bp, Homo sapiens
atcatttccctttagatcacaa

SEQ ID NO: 7011940 - DNA, 22 bp, Homo sapiens
ggtctcaggtagggcctaggaa

SEQ ID NO: 7011941 - DNA, 19 bp, Homo sapiens
ttgagcagtgcttagcacc

SEQ ID NO: 7011942 - DNA, 22 bp, Homo sapiens
gccactcaaatccagctttaga

SEQ ID NO: 7011943 - DNA, 22 bp, Homo sapiens
taagtgttgatctgagtgctaa

SEQ ID NO: 7011944 - DNA, 21 bp, Homo sapiens
ccatgggaagcatcctcgcgg

SEQ ID NO: 7011945 - DNA, 22 bp, Homo sapiens
agaggcactaagggaagagcag

SEQ ID NO: 7011946 - DNA, 22 bp, Homo sapiens
atctaagatgtattgagcactt

SEQ ID NO: 7011947 - DNA, 22 bp, Homo sapiens
ctgccctgctaatgagttccaa

SEQ ID NO: 7011948 - DNA, 22 bp, Homo sapiens
aatggtaatattggcacagaaa

SEQ ID NO: 7011949 - DNA, 22 bp, Homo sapiens
atggccttggctgcagagacat

SEQ ID NO: 7011950 - DNA, 22 bp, Homo sapiens
ttattgcctgtcattattgaat

SEQ ID NO: 7011951 - DNA, 22 bp, Homo sapiens
agtaaatggtggtttttatcat

SEQ ID NO: 7011952 - DNA, 22 bp, Homo sapiens
gtgctctggctggtctcccggt

SEQ ID NO: 7011953 - DNA, 22 bp, Homo sapiens
aggtgcagtggctcatgcctgt

SEQ ID NO: 7011954 - DNA, 22 bp, Homo sapiens
actgtccaagcatgcctggctt

SEQ ID NO: 7011955 - DNA, 22 bp, Homo sapiens
tctggactccatgctgcctgga

SEQ ID NO: 7011956 - DNA, 20 bp, Homo sapiens
acattgattatgtttgtaga

SEQ ID NO: 7011957 - DNA, 22 bp, Homo sapiens
aatggtcaaaaagatacgtaaa

SEQ ID NO: 7011958 - DNA, 22 bp, Homo sapiens
aggtaaagacagtgaaagaggg

SEQ ID NO: 7011959 - DNA, 22 bp, Homo sapiens
aacctgagtcttttgatttgct

SEQ ID NO: 7011960 - DNA, 22 bp, Homo sapiens
aaattatcatgggggagaaaca

SEQ ID NO: 7011961 - DNA, 21 bp, Homo sapiens
cccagagcctagggagggcac

SEQ ID NO: 7011962 - DNA, 22 bp, Homo sapiens
cactgtgtcagtttggttagac

SEQ ID NO: 7011963 - DNA, 22 bp, Homo sapiens
atttcctatacagttgtccata

SEQ ID NO: 7011964 - DNA, 22 bp, Homo sapiens
tgtcatagtgtggtagcagtgg

SEQ ID NO: 7011965 - DNA, 22 bp, Homo sapiens
tgggcctctgtttcctcatctg

SEQ ID NO: 7011966 - DNA, 22 bp, Homo sapiens
aagccttcagagttggctggtc

SEQ ID NO: 7011967 - DNA, 22 bp, Homo sapiens
aatatgcaaataggtgtaatga

SEQ ID NO: 7011968 - DNA, 22 bp, Homo sapiens
ggctctgggcatagaaggaagc

SEQ ID NO: 7011969 - DNA, 22 bp, Homo sapiens
agcagtgtttgtgactttagat

SEQ ID NO: 7011970 - DNA, 22 bp, Homo sapiens
ggacagagagtgaatatgacat

SEQ ID NO: 7011971 - DNA, 22 bp, Homo sapiens
ttaggcttccggcaggcggcgc

SEQ ID NO: 7011972 - DNA, 22 bp, Homo sapiens
acacatgacctccgcagcagca

SEQ ID NO: 7011973 - DNA, 22 bp, Homo sapiens
tgagttttggaagacaacacaa

SEQ ID NO: 7011974 - DNA, 22 bp, Homo sapiens
ccctgaggcctcaggttcattg

SEQ ID NO: 7011975 - DNA, 22 bp, Homo sapiens
atctttagagtcatctgagtgt

SEQ ID NO: 7011976 - DNA, 22 bp, Homo sapiens
gctggccacactgctgatggag

SEQ ID NO: 7011977 - DNA, 22 bp, Homo sapiens
cagttcttaataccatgtggtt

SEQ ID NO: 7011978 - DNA, 21 bp, Homo sapiens
tgacataatccatagtacaaa

SEQ ID NO: 7011979 - DNA, 18 bp, Homo sapiens
aggcaggtgctggaagtc

SEQ ID NO: 7011980 - DNA, 22 bp, Homo sapiens
atgacacaagcagaggctctaa

SEQ ID NO: 7011981 - DNA, 16 bp, Homo sapiens
aggtggagaagttcac

SEQ ID NO: 7011982 - DNA, 22 bp, Homo sapiens
cagcttcagaccctgggctgca

SEQ ID NO: 7011983 - DNA, 22 bp, Homo sapiens
acagtttgaagtttagaagtct

SEQ ID NO: 7011984 - DNA, 22 bp, Homo sapiens
gtgcatatatgcacatatgtgt

SEQ ID NO: 7011985 - DNA, 22 bp, Homo sapiens
tctgtgctcttctcagtatcac

SEQ ID NO: 7011986 - DNA, 22 bp, Homo sapiens
gcacttacatactctgcataca

SEQ ID NO: 7011987 - DNA, 22 bp, Homo sapiens
ctgctgtcgccacggtcgccgc

SEQ ID NO: 7011988 - DNA, 22 bp, Homo sapiens
ggcatccctagaatagccaggt

SEQ ID NO: 7011989 - DNA, 22 bp, Homo sapiens
ggtattcaatcagtgttcattc

SEQ ID NO: 7011990 - DNA, 22 bp, Homo sapiens
tagcccattacctttggattgg

SEQ ID NO: 7011991 - DNA, 22 bp, Homo sapiens
gtttccatatttttagtgccaa

SEQ ID NO: 7011992 - DNA, 22 bp, Homo sapiens
acccagtcatcctggtgtgaga

SEQ ID NO: 7011993 - DNA, 22 bp, Homo sapiens
accctttgtccaatagaaatga

SEQ ID NO: 7011994 - DNA, 22 bp, Homo sapiens
taatggagatgctgaagtcaca

SEQ ID NO: 7011995 - DNA, 22 bp, Homo sapiens
gaagcttaattatgaccagctg

SEQ ID NO: 7011996 - DNA, 22 bp, Homo sapiens
attgcctttggaggaagaaagc

SEQ ID NO: 7011997 - DNA, 22 bp, Homo sapiens
gtgaagtaagtactattaagat

SEQ ID NO: 7011998 - DNA, 22 bp, Homo sapiens
aaacactaataacagtggctgg

SEQ ID NO: 7011999 - DNA, 22 bp, Homo sapiens
aatagcttagtcctgattctgt

SEQ ID NO: 7012000 - DNA, 22 bp, Homo sapiens
aacagttaagcagtcctgatat

SEQ ID NO: 7012001 - DNA, 22 bp, Homo sapiens
atatttgtcaattcactgttca

SEQ ID NO: 7012002 - DNA, 22 bp, Homo sapiens
cctggaaatgtcgcgtgtagaa

SEQ ID NO: 7012003 - DNA, 22 bp, Homo sapiens
ttccaaaggaatggggagctat

SEQ ID NO: 7012004 - DNA, 21 bp, Homo sapiens
gaggcctcagcctcagctcct

SEQ ID NO: 7012005 - DNA, 22 bp, Homo sapiens
attgtcttctgtcttatagttc

SEQ ID NO: 7012006 - DNA, 22 bp, Homo sapiens
ctggacagaaagggctgctgtg

SEQ ID NO: 7012007 - DNA, 22 bp, Homo sapiens
actgtgttgccttcccccagcc

SEQ ID NO: 7012008 - DNA, 22 bp, Homo sapiens
ttctcgctcttcttgagaaact

SEQ ID NO: 7012009 - DNA, 22 bp, Homo sapiens
ccaggaaagaggaagaacgcat

SEQ ID NO: 7012010 - DNA, 22 bp, Homo sapiens
tgtgctagaagaggatggacct

SEQ ID NO: 7012011 - DNA, 22 bp, Homo sapiens
ttcctaactctggcacctagtc

SEQ ID NO: 7012012 - DNA, 19 bp, Homo sapiens
cccagcttgaccacctgct

SEQ ID NO: 7012013 - DNA, 22 bp, Homo sapiens
aagctttatgacttggagacag

SEQ ID NO: 7012014 - DNA, 22 bp, Homo sapiens
tatgaaagaatctcagagcaca

SEQ ID NO: 7012015 - DNA, 22 bp, Homo sapiens
cttgactcaggctatattctag

SEQ ID NO: 7012016 - DNA, 22 bp, Homo sapiens
tttggagagagttaaatatgtt

SEQ ID NO: 7012017 - DNA, 20 bp, Homo sapiens
aatgtctcctaaaaggtcag

SEQ ID NO: 7012018 - DNA, 22 bp, Homo sapiens
gtcaggtggctggtgattcaac

SEQ ID NO: 7012019 - DNA, 22 bp, Homo sapiens
agcaaggaaactatggagagat

SEQ ID NO: 7012020 - DNA, 22 bp, Homo sapiens
agtgtagacataggtctggtct

SEQ ID NO: 7012021 - DNA, 22 bp, Homo sapiens
ctgcttcagcaaagctatttgc

SEQ ID NO: 7012022 - DNA, 22 bp, Homo sapiens
caaagctggaaaaggaggctgg

SEQ ID NO: 7012023 - DNA, 22 bp, Homo sapiens
gctgtcagttttacccacagac

SEQ ID NO: 7012024 - DNA, 20 bp, Homo sapiens
tatgagatttgacctcaaca

SEQ ID NO: 7012025 - DNA, 22 bp, Homo sapiens
cagtgtgacttctgagctgcca

SEQ ID NO: 7012026 - DNA, 22 bp, Homo sapiens
tgcccacagatatgtgcagtct

SEQ ID NO: 7012027 - DNA, 22 bp, Homo sapiens
agctggtttggggtagaggaca

SEQ ID NO: 7012028 - DNA, 22 bp, Homo sapiens
ctgtgacagggatcagaatgca

SEQ ID NO: 7012029 - DNA, 22 bp, Homo sapiens
gtgtgcccttgttcagcagagt

SEQ ID NO: 7012030 - DNA, 22 bp, Homo sapiens
cagccctgtccctgagggacct

SEQ ID NO: 7012031 - DNA, 22 bp, Homo sapiens
cttcatgatcctaccacattga

SEQ ID NO: 7012032 - DNA, 22 bp, Homo sapiens
ctattgggatcctgacaaatct

SEQ ID NO: 7012033 - DNA, 22 bp, Homo sapiens
cagggctccccagagagcctct

SEQ ID NO: 7012034 - DNA, 21 bp, Homo sapiens
tggctcccttgaattgtctgt

SEQ ID NO: 7012035 - DNA, 22 bp, Homo sapiens
atgtcttttatgattacgggat

SEQ ID NO: 7012036 - DNA, 22 bp, Homo sapiens
tctaagccgcaagcctatctgt

SEQ ID NO: 7012037 - DNA, 22 bp, Homo sapiens
cttaagagtctttctgtgttta

SEQ ID NO: 7012038 - DNA, 22 bp, Homo sapiens
tttagtcaggtaagatgcaggg

SEQ ID NO: 7012039 - DNA, 22 bp, Homo sapiens
ctttggtgtcatgtttctgcgg

SEQ ID NO: 7012040 - DNA, 22 bp, Homo sapiens
ttcctggtaacaatctcaaagt

SEQ ID NO: 7012041 - DNA, 22 bp, Homo sapiens
gcctggaagtccagagtacatt

SEQ ID NO: 7012042 - DNA, 22 bp, Homo sapiens
ggaggggcaggtcccaagttgt

SEQ ID NO: 7012043 - DNA, 22 bp, Homo sapiens
tcgcttgaacccaggaagtgga

SEQ ID NO: 7012044 - DNA, 22 bp, Homo sapiens
cactgtctgtgtgtccttgggg

SEQ ID NO: 7012045 - DNA, 21 bp, Homo sapiens
atctttagccatccaatcaga

SEQ ID NO: 7012046 - DNA, 22 bp, Homo sapiens
ttggatttgtctaccagggaat

SEQ ID NO: 7012047 - DNA, 22 bp, Homo sapiens
gctctgggtgaacttggagcaa

SEQ ID NO: 7012048 - DNA, 22 bp, Homo sapiens
tgagtatcctatatggtgtaag

SEQ ID NO: 7012049 - DNA, 22 bp, Homo sapiens
cagggaggctgtcttatgcctg

SEQ ID NO: 7012050 - DNA, 22 bp, Homo sapiens
agacacataggaccacactgtg

SEQ ID NO: 7012051 - DNA, 22 bp, Homo sapiens
acagcccagctctttctctgca

SEQ ID NO: 7012052 - DNA, 22 bp, Homo sapiens
caggaatgtccttgtcatttca

SEQ ID NO: 7012053 - DNA, 22 bp, Homo sapiens
ttattgctgctaacattttatg

SEQ ID NO: 7012054 - DNA, 22 bp, Homo sapiens
tgtattctctcaatatttcata

SEQ ID NO: 7012055 - DNA, 22 bp, Homo sapiens
agcgacagaaaccaaggacaag

SEQ ID NO: 7012056 - DNA, 20 bp, Homo sapiens
cagcagaaatggggtgggaa

SEQ ID NO: 7012057 - DNA, 22 bp, Homo sapiens
ccagggctggtgggagatgctg

SEQ ID NO: 7012058 - DNA, 22 bp, Homo sapiens
tatgcatgtctttgcacacaaa

SEQ ID NO: 7012059 - DNA, 22 bp, Homo sapiens
gggactccaaaactgtacccaa

SEQ ID NO: 7012060 - DNA, 22 bp, Homo sapiens
agacaatgtcaaggtgatcatc

SEQ ID NO: 7012061 - DNA, 22 bp, Homo sapiens
cagcctgactatggctgcaggt

SEQ ID NO: 7012062 - DNA, 22 bp, Homo sapiens
gtgccaatccccaaaccctgct

SEQ ID NO: 7012063 - DNA, 22 bp, Homo sapiens
atatttgctgagaaggagggag

SEQ ID NO: 7012064 - DNA, 22 bp, Homo sapiens
tctcaaatttgttagataaaat

SEQ ID NO: 7012065 - DNA, 19 bp, Homo sapiens
ggacagacgcagagatctg

SEQ ID NO: 7012066 - DNA, 22 bp, Homo sapiens
tcatccgtgaagccaaagaaat

SEQ ID NO: 7012067 - DNA, 22 bp, Homo sapiens
taggctgggagcctgaggctag

SEQ ID NO: 7012068 - DNA, 22 bp, Homo sapiens
gttgcagatgtggaactcgtgc

SEQ ID NO: 7012069 - DNA, 22 bp, Homo sapiens
tgcagcaatttgcagtaattta

SEQ ID NO: 7012070 - DNA, 22 bp, Homo sapiens
agcctctgtgactcacaggtca

SEQ ID NO: 7012071 - DNA, 22 bp, Homo sapiens
gtcagatctttggggatgctgt

SEQ ID NO: 7012072 - DNA, 19 bp, Homo sapiens
agaagtgcatggtctagag

SEQ ID NO: 7012073 - DNA, 22 bp, Homo sapiens
gatatgaaaagagctgggaact

SEQ ID NO: 7012074 - DNA, 22 bp, Homo sapiens
tcaacactggctacagttatgc

SEQ ID NO: 7012075 - DNA, 23 bp, Homo sapiens
tttaaaagttgtaatgtaggctt

SEQ ID NO: 7012076 - DNA, 22 bp, Homo sapiens
tcaacaagcattggtggtaaaa

SEQ ID NO: 7012077 - DNA, 22 bp, Homo sapiens
agctgggttgacaagatggaaa

SEQ ID NO: 7012078 - DNA, 19 bp, Homo sapiens
actctacagtgtgtacaac

SEQ ID NO: 7012079 - DNA, 22 bp, Homo sapiens
taggaaattttactggtctggg

SEQ ID NO: 7012080 - DNA, 22 bp, Homo sapiens
aagctgttaatggcttgcagct

SEQ ID NO: 7012081 - DNA, 18 bp, Homo sapiens
tggatctttatgaggctg

SEQ ID NO: 7012082 - DNA, 22 bp, Homo sapiens
tgagggtagctggatcacggag

SEQ ID NO: 7012083 - DNA, 22 bp, Homo sapiens
catgaattatttttcacaagat

SEQ ID NO: 7012084 - DNA, 22 bp, Homo sapiens
gcagagctgggatatgaaccca

SEQ ID NO: 7012085 - DNA, 22 bp, Homo sapiens
ttgtctgaattcttctaggcag

SEQ ID NO: 7012086 - DNA, 22 bp, Homo sapiens
tagggactgtgtgagggacttg

SEQ ID NO: 7012087 - DNA, 22 bp, Homo sapiens
tagaggctttcagcggtaggtc

SEQ ID NO: 7012088 - DNA, 22 bp, Homo sapiens
tcactctggtccatccgagagc

SEQ ID NO: 7012089 - DNA, 22 bp, Homo sapiens
ttactctttggtgttaagttca

SEQ ID NO: 7012090 - DNA, 22 bp, Homo sapiens
aggacctttggcaaggctgctc

SEQ ID NO: 7012091 - DNA, 22 bp, Homo sapiens
tggtgtgttagagctcagggca

SEQ ID NO: 7012092 - DNA, 22 bp, Homo sapiens
tctgagctgtgagttgcttagg

SEQ ID NO: 7012093 - DNA, 21 bp, Homo sapiens
tccagctcctgccactcctta

SEQ ID NO: 7012094 - DNA, 22 bp, Homo sapiens
agtctgcaggctgtgatttttt

SEQ ID NO: 7012095 - DNA, 22 bp, Homo sapiens
taataatagcagtagctgccac

SEQ ID NO: 7012096 - DNA, 22 bp, Homo sapiens
aagccacttggggaaagatgga

SEQ ID NO: 7012097 - DNA, 22 bp, Homo sapiens
tctttgcagttctgattaaata

SEQ ID NO: 7012098 - DNA, 22 bp, Homo sapiens
agtgttagtgaaaggtgtttat

SEQ ID NO: 7012099 - DNA, 22 bp, Homo sapiens
ttccttctggaagcttcagggg

SEQ ID NO: 7012100 - DNA, 22 bp, Homo sapiens
tattgctgatgctgaagggaag

SEQ ID NO: 7012101 - DNA, 22 bp, Homo sapiens
ggaaacacacccagagaagcag

SEQ ID NO: 7012102 - DNA, 22 bp, Homo sapiens
tgaggcctcatttagggagagg

SEQ ID NO: 7012103 - DNA, 22 bp, Homo sapiens
agcctgggcaacaacacagcga

SEQ ID NO: 7012104 - DNA, 22 bp, Homo sapiens
tgccaaatgccaccacagctgc

SEQ ID NO: 7012105 - DNA, 17 bp, Homo sapiens
acagagctacatattct

SEQ ID NO: 7012106 - DNA, 22 bp, Homo sapiens
aggatctgtgagtgctgcagac

SEQ ID NO: 7012107 - DNA, 22 bp, Homo sapiens
ggtgtgcagtagcaggaggcct

SEQ ID NO: 7012108 - DNA, 22 bp, Homo sapiens
tcagtaaatggttgctgttatt

SEQ ID NO: 7012109 - DNA, 22 bp, Homo sapiens
tcctgagcaattcaaaagattt

SEQ ID NO: 7012110 - DNA, 22 bp, Homo sapiens
atgacacccaaaaccagtgcag

SEQ ID NO: 7012111 - DNA, 22 bp, Homo sapiens
cattcacaatagttgaaaggtg

SEQ ID NO: 7012112 - DNA, 19 bp, Homo sapiens
acaaagctgtgagcagctt

SEQ ID NO: 7012113 - DNA, 22 bp, Homo sapiens
tcattcattgcttaccctgtgt

SEQ ID NO: 7012114 - DNA, 22 bp, Homo sapiens
agactccaggagggaggctgct

SEQ ID NO: 7012115 - DNA, 22 bp, Homo sapiens
gtggatctaaagaaggagggtg

SEQ ID NO: 7012116 - DNA, 22 bp, Homo sapiens
tactgaaagagtggtggactct

SEQ ID NO: 7012117 - DNA, 22 bp, Homo sapiens
tggcacttgcttcagatgatgt

SEQ ID NO: 7012118 - DNA, 22 bp, Homo sapiens
tttacatctcaccagattcata

SEQ ID NO: 7012119 - DNA, 22 bp, Homo sapiens
agaataaaatagtctgaagatg

SEQ ID NO: 7012120 - DNA, 16 bp, Homo sapiens
gggggctgcaagcttc

SEQ ID NO: 7012121 - DNA, 22 bp, Homo sapiens
atgcacaagttatatgtatgga

SEQ ID NO: 7012122 - DNA, 23 bp, Homo sapiens
ctacaaagtatgagaagacccct

SEQ ID NO: 7012123 - DNA, 20 bp, Homo sapiens
taaaggctgtgaggtggccc

SEQ ID NO: 7012124 - DNA, 22 bp, Homo sapiens
ttctcctgagttcccaggtcta

SEQ ID NO: 7012125 - DNA, 22 bp, Homo sapiens
ctggaggaataatggcatcttg

SEQ ID NO: 7012126 - DNA, 22 bp, Homo sapiens
ctgggagatctgttgggactgg

SEQ ID NO: 7012127 - DNA, 22 bp, Homo sapiens
ttctgtcacagtgctggtatca

SEQ ID NO: 7012128 - DNA, 22 bp, Homo sapiens
agggtgcaaaagcaaggacagt

SEQ ID NO: 7012129 - DNA, 22 bp, Homo sapiens
caggaatggttgggactatgtt

SEQ ID NO: 7012130 - DNA, 22 bp, Homo sapiens
tctttgtttgtactgttagaat

SEQ ID NO: 7012131 - DNA, 22 bp, Homo sapiens
gccagttcctgtggagtcagag

SEQ ID NO: 7012132 - DNA, 22 bp, Homo sapiens
aggccctggcccccagagattc

SEQ ID NO: 7012133 - DNA, 22 bp, Homo sapiens
gcgactgtacagaattgcccct

SEQ ID NO: 7012134 - DNA, 22 bp, Homo sapiens
ctgagaagcaaagaactgcact

SEQ ID NO: 7012135 - DNA, 22 bp, Homo sapiens
tgtgggccctaggcaccttgtc

SEQ ID NO: 7012136 - DNA, 22 bp, Homo sapiens
actcagaggaaaccctcctagg

SEQ ID NO: 7012137 - DNA, 22 bp, Homo sapiens
ttgaaagtgccaagtcctagtg

SEQ ID NO: 7012138 - DNA, 21 bp, Homo sapiens
ttactggctctcaagtcagct

SEQ ID NO: 7012139 - DNA, 20 bp, Homo sapiens
gatgtcttggtcacagtggc

SEQ ID NO: 7012140 - DNA, 22 bp, Homo sapiens
catttaatagatgctgtttcag

SEQ ID NO: 7012141 - DNA, 22 bp, Homo sapiens
agccagtcccttgagcgtgccc

SEQ ID NO: 7012142 - DNA, 22 bp, Homo sapiens
tgggaaagactcaggacaggag

SEQ ID NO: 7012143 - DNA, 22 bp, Homo sapiens
gacatacaagctggtacctcct

SEQ ID NO: 7012144 - DNA, 22 bp, Homo sapiens
taattgtggctggatttgagaa

SEQ ID NO: 7012145 - DNA, 22 bp, Homo sapiens
gaaggctttagagagatataaa

SEQ ID NO: 7012146 - DNA, 22 bp, Homo sapiens
tggtccttctgtcttccgcacc

SEQ ID NO: 7012147 - DNA, 22 bp, Homo sapiens
gtgtttagtgtgcagacatgca

SEQ ID NO: 7012148 - DNA, 22 bp, Homo sapiens
tcagagcagactttgaaggagg

SEQ ID NO: 7012149 - DNA, 22 bp, Homo sapiens
gcaggtggatattgctacttga

SEQ ID NO: 7012150 - DNA, 22 bp, Homo sapiens
ctccagggagctgtggaggttt

SEQ ID NO: 7012151 - DNA, 21 bp, Homo sapiens
gaatggcaccattagcatata

SEQ ID NO: 7012152 - DNA, 19 bp, Homo sapiens
cggcccctcctctcgcgcc

SEQ ID NO: 7012153 - DNA, 21 bp, Homo sapiens
tgaattctggggtagttggga

SEQ ID NO: 7012154 - DNA, 22 bp, Homo sapiens
tggagctctgattaaattggaa

SEQ ID NO: 7012155 - DNA, 22 bp, Homo sapiens
ctggctcctgtttaaccagctg

SEQ ID NO: 7012156 - DNA, 22 bp, Homo sapiens
cgtgaattctttccctgtcact

SEQ ID NO: 7012157 - DNA, 22 bp, Homo sapiens
tccttgtgctgagggtgttgct

SEQ ID NO: 7012158 - DNA, 22 bp, Homo sapiens
acaggtcagataaaggctggtg

SEQ ID NO: 7012159 - DNA, 22 bp, Homo sapiens
tgagatctgctaattgactgac

SEQ ID NO: 7012160 - DNA, 22 bp, Homo sapiens
tgctgaattctaccatccattt

SEQ ID NO: 7012161 - DNA, 22 bp, Homo sapiens
aggctctgatcaggtggctgtg

SEQ ID NO: 7012162 - DNA, 22 bp, Homo sapiens
tccaactccacctttgtctccc

SEQ ID NO: 7012163 - DNA, 22 bp, Homo sapiens
gtttggaagttaagtgcagcag

SEQ ID NO: 7012164 - DNA, 22 bp, Homo sapiens
tcatctgaaattgtatatgtag

SEQ ID NO: 7012165 - DNA, 22 bp, Homo sapiens
ctggtggttcaggagaatggct

SEQ ID NO: 7012166 - DNA, 22 bp, Homo sapiens
ggctgggctgctgggtcagagc

SEQ ID NO: 7012167 - DNA, 22 bp, Homo sapiens
gcctgggactgcagatccccag

SEQ ID NO: 7012168 - DNA, 22 bp, Homo sapiens
tggcagttctaattgaccattt

SEQ ID NO: 7012169 - DNA, 22 bp, Homo sapiens
catctaccagaattgctataaa

SEQ ID NO: 7012170 - DNA, 22 bp, Homo sapiens
acttccagaattagaatttaag

SEQ ID NO: 7012171 - DNA, 22 bp, Homo sapiens
aaatatgagggtgatgcccaga

SEQ ID NO: 7012172 - DNA, 22 bp, Homo sapiens
caaagtcttggtgatcaacttt

SEQ ID NO: 7012173 - DNA, 22 bp, Homo sapiens
attccttggaacagatgcgaag

SEQ ID NO: 7012174 - DNA, 22 bp, Homo sapiens
tccaggccacgacctcctggat

SEQ ID NO: 7012175 - DNA, 22 bp, Homo sapiens
atgcttcctcccttccactcaa

SEQ ID NO: 7012176 - DNA, 22 bp, Homo sapiens
acacacttttgctaaaaattgt

SEQ ID NO: 7012177 - DNA, 22 bp, Homo sapiens
acccacagaacctgtgacaaca

SEQ ID NO: 7012178 - DNA, 22 bp, Homo sapiens
tcttcctgtcaatgagaattaa

SEQ ID NO: 7012179 - DNA, 22 bp, Homo sapiens
gtgatttagatgttgaaagtga

SEQ ID NO: 7012180 - DNA, 22 bp, Homo sapiens
gagcaggcaaagatgaaaggag

SEQ ID NO: 7012181 - DNA, 22 bp, Homo sapiens
tcctttttatagttagagaaac

SEQ ID NO: 7012182 - DNA, 22 bp, Homo sapiens
tgctttggccactagaattcag

SEQ ID NO: 7012183 - DNA, 22 bp, Homo sapiens
caatggcactgcccaaagagaa

SEQ ID NO: 7012184 - DNA, 22 bp, Homo sapiens
caggatgaccatatgttccagt

SEQ ID NO: 7012185 - DNA, 22 bp, Homo sapiens
aggtcattccttgtcttcttgc

SEQ ID NO: 7012186 - DNA, 22 bp, Homo sapiens
tttttcctagtgctttctggta

SEQ ID NO: 7012187 - DNA, 22 bp, Homo sapiens
tggccctgccgccacgacgtct

SEQ ID NO: 7012188 - DNA, 19 bp, Homo sapiens
tcatgagtctgtggggttt

SEQ ID NO: 7012189 - DNA, 22 bp, Homo sapiens
gtctctgtcttaggccaggcct

SEQ ID NO: 7012190 - DNA, 22 bp, Homo sapiens
aacctcaggctctctggacaat

SEQ ID NO: 7012191 - DNA, 22 bp, Homo sapiens
tggaaagatgaagatgtttaag

SEQ ID NO: 7012192 - DNA, 22 bp, Homo sapiens
aaggctatgatctttttcatga

SEQ ID NO: 7012193 - DNA, 22 bp, Homo sapiens
ttatgcagtaattgtaaactga

SEQ ID NO: 7012194 - DNA, 22 bp, Homo sapiens
tgattctgccccttggctctgg

SEQ ID NO: 7012195 - DNA, 22 bp, Homo sapiens
cacagataaggctttgtcccca

SEQ ID NO: 7012196 - DNA, 22 bp, Homo sapiens
ttggcattcatgggacaacaaa

SEQ ID NO: 7012197 - DNA, 22 bp, Homo sapiens
acacactggcccccagtactga

SEQ ID NO: 7012198 - DNA, 22 bp, Homo sapiens
aggccagcagcatgacggcatc

SEQ ID NO: 7012199 - DNA, 20 bp, Homo sapiens
gaacctggggaaggagtagg

SEQ ID NO: 7012200 - DNA, 22 bp, Homo sapiens
ctggacactggggatgcgcagt

SEQ ID NO: 7012201 - DNA, 22 bp, Homo sapiens
atgtcttctctgtaggtaaatt

SEQ ID NO: 7012202 - DNA, 22 bp, Homo sapiens
tctggcctgaaagtccatgctt

SEQ ID NO: 7012203 - DNA, 22 bp, Homo sapiens
gggctttatgagattgagatct

SEQ ID NO: 7012204 - DNA, 22 bp, Homo sapiens
agtcatatttagcttgtggaat

SEQ ID NO: 7012205 - DNA, 21 bp, Homo sapiens
gtatatccaactgttggagtt

SEQ ID NO: 7012206 - DNA, 22 bp, Homo sapiens
cacttgtagaggcattattcca

SEQ ID NO: 7012207 - DNA, 22 bp, Homo sapiens
gctggctcctctgtcctcacgg

SEQ ID NO: 7012208 - DNA, 22 bp, Homo sapiens
cacccagcttttgcatcctccg

SEQ ID NO: 7012209 - DNA, 23 bp, Homo sapiens
ggatttagtggatgagctgagtg

SEQ ID NO: 7012210 - DNA, 22 bp, Homo sapiens
acatgatctgacttgcttttta

SEQ ID NO: 7012211 - DNA, 22 bp, Homo sapiens
ctggagttgggatgtgcctgga

SEQ ID NO: 7012212 - DNA, 22 bp, Homo sapiens
acatgttagaaatgcagaatct

SEQ ID NO: 7012213 - DNA, 21 bp, Homo sapiens
tgctggccatgtgctgggcat

SEQ ID NO: 7012214 - DNA, 22 bp, Homo sapiens
agtctccagaaatatagcagtg

SEQ ID NO: 7012215 - DNA, 22 bp, Homo sapiens
ctgagtaagatacagaagctcc

SEQ ID NO: 7012216 - DNA, 22 bp, Homo sapiens
caactgctgacaccatcactcc

SEQ ID NO: 7012217 - DNA, 22 bp, Homo sapiens
ataaacagtaaatgtgagcagt

SEQ ID NO: 7012218 - DNA, 22 bp, Homo sapiens
tgtttactccagctgatggaac

SEQ ID NO: 7012219 - DNA, 22 bp, Homo sapiens
gaagagctgcacactggggact

SEQ ID NO: 7012220 - DNA, 22 bp, Homo sapiens
tcaggggacttaggagagaagt

SEQ ID NO: 7012221 - DNA, 22 bp, Homo sapiens
tctgttggctttttaaagttgt

SEQ ID NO: 7012222 - DNA, 22 bp, Homo sapiens
attgtctatggctgctttcact

SEQ ID NO: 7012223 - DNA, 22 bp, Homo sapiens
gacagcagatgaagcctgcaga

SEQ ID NO: 7012224 - DNA, 22 bp, Homo sapiens
tgaccacgacatcttgtgagtt

SEQ ID NO: 7012225 - DNA, 22 bp, Homo sapiens
atgtaaatcaagcagtgctggt

SEQ ID NO: 7012226 - DNA, 23 bp, Homo sapiens
ggacccacggtctttgaggctct

SEQ ID NO: 7012227 - DNA, 22 bp, Homo sapiens
atgttgttgaactctttgcatg

SEQ ID NO: 7012228 - DNA, 22 bp, Homo sapiens
gatcaatactattaagatcata

SEQ ID NO: 7012229 - DNA, 21 bp, Homo sapiens
tatagtcacttgagcattatc

SEQ ID NO: 7012230 - DNA, 22 bp, Homo sapiens
ttggggcatgattagattatga

SEQ ID NO: 7012231 - DNA, 19 bp, Homo sapiens
ttggccttgtttcatatct

SEQ ID NO: 7012232 - DNA, 22 bp, Homo sapiens
gtgtgctgttgttcaggtagaa

SEQ ID NO: 7012233 - DNA, 22 bp, Homo sapiens
tggacacatcactgcagccact

SEQ ID NO: 7012234 - DNA, 22 bp, Homo sapiens
agcagggttccttaaggccata

SEQ ID NO: 7012235 - DNA, 22 bp, Homo sapiens
atgacagaaggcctccctgaca

SEQ ID NO: 7012236 - DNA, 22 bp, Homo sapiens
acagttctgcctgtttgagaag

SEQ ID NO: 7012237 - DNA, 22 bp, Homo sapiens
cagccctgctggcaatgatgag

SEQ ID NO: 7012238 - DNA, 22 bp, Homo sapiens
cccagtggggaaatagctagct

SEQ ID NO: 7012239 - DNA, 23 bp, Homo sapiens
atttaatgctgagttgaatgtta

SEQ ID NO: 7012240 - DNA, 22 bp, Homo sapiens
aaagcgctatataaatgttaac

SEQ ID NO: 7012241 - DNA, 20 bp, Homo sapiens
ctcttcaaatattttattct

SEQ ID NO: 7012242 - DNA, 22 bp, Homo sapiens
ggcccagaagccagaagcctcc

SEQ ID NO: 7012243 - DNA, 22 bp, Homo sapiens
cttctcttgggtgtggtgtctt

SEQ ID NO: 7012244 - DNA, 22 bp, Homo sapiens
attgcactccagcctgggcaac

SEQ ID NO: 7012245 - DNA, 22 bp, Homo sapiens
taatgaacatgcatcgtgtgta

SEQ ID NO: 7012246 - DNA, 22 bp, Homo sapiens
aagagggctcgatttggcaaaa

SEQ ID NO: 7012247 - DNA, 22 bp, Homo sapiens
tcattgaatgagatgcaataga

SEQ ID NO: 7012248 - DNA, 22 bp, Homo sapiens
agattcagaaatgaggagggcc

SEQ ID NO: 7012249 - DNA, 21 bp, Homo sapiens
agacagaacaactgctctcca

SEQ ID NO: 7012250 - DNA, 21 bp, Homo sapiens
ttctgccttcccctagctggg

SEQ ID NO: 7012251 - DNA, 22 bp, Homo sapiens
tgggcactggaagcctgctgtg

SEQ ID NO: 7012252 - DNA, 19 bp, Homo sapiens
atttcaagaggtttattgg

SEQ ID NO: 7012253 - DNA, 22 bp, Homo sapiens
gctagaaactgtttaatctctt

SEQ ID NO: 7012254 - DNA, 22 bp, Homo sapiens
taaaaggcaatactagatgagt

SEQ ID NO: 7012255 - DNA, 22 bp, Homo sapiens
atgatgtcattttaatttctaa

SEQ ID NO: 7012256 - DNA, 22 bp, Homo sapiens
gaatcttatccccagtccttaa

SEQ ID NO: 7012257 - DNA, 22 bp, Homo sapiens
ggccttggtgctctgtgttgca

SEQ ID NO: 7012258 - DNA, 22 bp, Homo sapiens
gttttgcagagtgcaataaatc

SEQ ID NO: 7012259 - DNA, 22 bp, Homo sapiens
tatggctttaaacaacttaggt

SEQ ID NO: 7012260 - DNA, 22 bp, Homo sapiens
tccagtctaatgagtcagagtg

SEQ ID NO: 7012261 - DNA, 22 bp, Homo sapiens
aaatcctaataatgcactagtg

SEQ ID NO: 7012262 - DNA, 22 bp, Homo sapiens
tggaatgtgagaataccgtttt

SEQ ID NO: 7012263 - DNA, 22 bp, Homo sapiens
attcacctgttagtaaaaatct

SEQ ID NO: 7012264 - DNA, 22 bp, Homo sapiens
ttattttctcctcagaaagtgg

SEQ ID NO: 7012265 - DNA, 22 bp, Homo sapiens
aggaaaccggagctcagagagg

SEQ ID NO: 7012266 - DNA, 22 bp, Homo sapiens
caaggcctcctgggcccagaga

SEQ ID NO: 7012267 - DNA, 22 bp, Homo sapiens
tggtgtgtgagtcaagacaagt

SEQ ID NO: 7012268 - DNA, 19 bp, Homo sapiens
tctttggctaaattgggtg

SEQ ID NO: 7012269 - DNA, 22 bp, Homo sapiens
aggataaattctccaaagtgtg

SEQ ID NO: 7012270 - DNA, 23 bp, Homo sapiens
gctgtttccccatgtgctgaagg

SEQ ID NO: 7012271 - DNA, 22 bp, Homo sapiens
tgtagcacaaacacagtccagg

SEQ ID NO: 7012272 - DNA, 23 bp, Homo sapiens
tcaagcccaggaactgaaagaga

SEQ ID NO: 7012273 - DNA, 22 bp, Homo sapiens
tgtcatgcaggtttgttataga

SEQ ID NO: 7012274 - DNA, 22 bp, Homo sapiens
tgtggacactagcagatacggt

SEQ ID NO: 7012275 - DNA, 22 bp, Homo sapiens
tctacagagagtcatagactca

SEQ ID NO: 7012276 - DNA, 22 bp, Homo sapiens
gagattctaagtcgttggttag

SEQ ID NO: 7012277 - DNA, 22 bp, Homo sapiens
gtctttttattatagagtggag

SEQ ID NO: 7012278 - DNA, 22 bp, Homo sapiens
tcattcctttacagttgatcct

SEQ ID NO: 7012279 - DNA, 22 bp, Homo sapiens
tgctcctgacagagtccatatg

SEQ ID NO: 7012280 - DNA, 18 bp, Homo sapiens
gacaaaagtacagacaga

SEQ ID NO: 7012281 - DNA, 22 bp, Homo sapiens
ctgtgcctgccttgttcactga

SEQ ID NO: 7012282 - DNA, 22 bp, Homo sapiens
tgtataagcctagtgaaatttc

SEQ ID NO: 7012283 - DNA, 22 bp, Homo sapiens
aaggactctccagctagcaaat

SEQ ID NO: 7012284 - DNA, 22 bp, Homo sapiens
tagcaggcatctcagagataat

SEQ ID NO: 7012285 - DNA, 22 bp, Homo sapiens
ctgcagtagtttttgactctag

SEQ ID NO: 7012286 - DNA, 22 bp, Homo sapiens
cttctgagaggggctaggagca

SEQ ID NO: 7012287 - DNA, 22 bp, Homo sapiens
tcctggaggcaaatgaagactc

SEQ ID NO: 7012288 - DNA, 22 bp, Homo sapiens
tgagcatagcccttctagtgtt

SEQ ID NO: 7012289 - DNA, 22 bp, Homo sapiens
gtgcagagaggaccttggggag

SEQ ID NO: 7012290 - DNA, 17 bp, Homo sapiens
actgtcttttacaccct

SEQ ID NO: 7012291 - DNA, 22 bp, Homo sapiens
tgtgtcagatttaggctcaaac

SEQ ID NO: 7012292 - DNA, 22 bp, Homo sapiens
caagaaggcatccccagtccct

SEQ ID NO: 7012293 - DNA, 22 bp, Homo sapiens
gggctctgaatcccaggtctgc

SEQ ID NO: 7012294 - DNA, 22 bp, Homo sapiens
cattcctattatgtccctagtg

SEQ ID NO: 7012295 - DNA, 22 bp, Homo sapiens
gtccctgtgcccagagaggcgg

SEQ ID NO: 7012296 - DNA, 22 bp, Homo sapiens
cagatgctaagttatcagcagg

SEQ ID NO: 7012297 - DNA, 20 bp, Homo sapiens
aacattgtttgtaaaagcag

SEQ ID NO: 7012298 - DNA, 22 bp, Homo sapiens
acaaggctgtgggagaacctct

SEQ ID NO: 7012299 - DNA, 22 bp, Homo sapiens
acctgggaaaaggagtggccat

SEQ ID NO: 7012300 - DNA, 22 bp, Homo sapiens
atggtacaatgtgtgtatcttt

SEQ ID NO: 7012301 - DNA, 23 bp, Homo sapiens
tgggggtgcacgggccacatctt

SEQ ID NO: 7012302 - DNA, 22 bp, Homo sapiens
tgattacaaaagattgtttgaa

SEQ ID NO: 7012303 - DNA, 21 bp, Homo sapiens
ttcccagcacctagcacaggt

SEQ ID NO: 7012304 - DNA, 23 bp, Homo sapiens
agcagcaaaaatttatctttctg

SEQ ID NO: 7012305 - DNA, 22 bp, Homo sapiens
tcagttagcgtaatcactgggg

SEQ ID NO: 7012306 - DNA, 20 bp, Homo sapiens
tcattccaaatagttcagca

SEQ ID NO: 7012307 - DNA, 19 bp, Homo sapiens
aaatggaaaactttgggaa

SEQ ID NO: 7012308 - DNA, 22 bp, Homo sapiens
ggctccaacactaaatgtgttt

SEQ ID NO: 7012309 - DNA, 22 bp, Homo sapiens
tgggagagtctaaaaccgaggt

SEQ ID NO: 7012310 - DNA, 22 bp, Homo sapiens
gccacctctagcaaagctcagc

SEQ ID NO: 7012311 - DNA, 22 bp, Homo sapiens
tgctgcatagcagctcctgaaa

SEQ ID NO: 7012312 - DNA, 22 bp, Homo sapiens
ctgtaatgaactctttgtcagt

SEQ ID NO: 7012313 - DNA, 22 bp, Homo sapiens
cattctgggtctggctcaggga

SEQ ID NO: 7012314 - DNA, 22 bp, Homo sapiens
atatgttgttttagtctgcttg

SEQ ID NO: 7012315 - DNA, 22 bp, Homo sapiens
gtccttggtatgaccaaggttt

SEQ ID NO: 7012316 - DNA, 22 bp, Homo sapiens
ctggcccaggtggtcgttgagg

SEQ ID NO: 7012317 - DNA, 21 bp, Homo sapiens
tcctgctgggtcaaccgtttt

SEQ ID NO: 7012318 - DNA, 22 bp, Homo sapiens
gtccttcaagtaacctgggacc

SEQ ID NO: 7012319 - DNA, 22 bp, Homo sapiens
tttattcattgtttcgtcgcag

SEQ ID NO: 7012320 - DNA, 22 bp, Homo sapiens
tttgaaagttcttctgacacta

SEQ ID NO: 7012321 - DNA, 22 bp, Homo sapiens
tctttatacaaactgggaaaca

SEQ ID NO: 7012322 - DNA, 22 bp, Homo sapiens
tggagactgtgctaagggagtt

SEQ ID NO: 7012323 - DNA, 22 bp, Homo sapiens
ccagaggatcagtactggctgg

SEQ ID NO: 7012324 - DNA, 22 bp, Homo sapiens
tgaggtaggtggtgaaaaatga

SEQ ID NO: 7012325 - DNA, 22 bp, Homo sapiens
agctccaggtcagtgcacccct

SEQ ID NO: 7012326 - DNA, 22 bp, Homo sapiens
tggccagaactcagacatgtgg

SEQ ID NO: 7012327 - DNA, 22 bp, Homo sapiens
ggcagtgaaaaagtatgtttcc

SEQ ID NO: 7012328 - DNA, 22 bp, Homo sapiens
atgtttatgttgggctatattt

SEQ ID NO: 7012329 - DNA, 22 bp, Homo sapiens
tcagcctgctccaagtgctgcc

SEQ ID NO: 7012330 - DNA, 22 bp, Homo sapiens
ggagcctgagggccctcttgga

SEQ ID NO: 7012331 - DNA, 22 bp, Homo sapiens
ggccaaatgaaatctgagcaat

SEQ ID NO: 7012332 - DNA, 22 bp, Homo sapiens
atgaggagctccttgaaatgag

SEQ ID NO: 7012333 - DNA, 22 bp, Homo sapiens
ctcggagatgctggctgagatc

SEQ ID NO: 7012334 - DNA, 22 bp, Homo sapiens
aaagttagacagcatcatttct

SEQ ID NO: 7012335 - DNA, 22 bp, Homo sapiens
gtacagtacttcagaaccagcc

SEQ ID NO: 7012336 - DNA, 22 bp, Homo sapiens
gggaaggaggtggacctgcccc

SEQ ID NO: 7012337 - DNA, 22 bp, Homo sapiens
tgtgtgggcgaagacagccttt

SEQ ID NO: 7012338 - DNA, 22 bp, Homo sapiens
attgtacagatgaacctcactc

SEQ ID NO: 7012339 - DNA, 22 bp, Homo sapiens
aagccggctgggccgaggctgc

SEQ ID NO: 7012340 - DNA, 22 bp, Homo sapiens
acataagcttctgaagggatgg

SEQ ID NO: 7012341 - DNA, 22 bp, Homo sapiens
caacctgatgaattgaatttaa

SEQ ID NO: 7012342 - DNA, 22 bp, Homo sapiens
agatgacacacacgcacccgga

SEQ ID NO: 7012343 - DNA, 23 bp, Homo sapiens
ggaggagttcccagccctcctgg

SEQ ID NO: 7012344 - DNA, 22 bp, Homo sapiens
aagccagtgtgacaggaaactt

SEQ ID NO: 7012345 - DNA, 22 bp, Homo sapiens
tcttggagagccacccagtggc

SEQ ID NO: 7012346 - DNA, 22 bp, Homo sapiens
tgaaagaactagcatcttcaag

SEQ ID NO: 7012347 - DNA, 22 bp, Homo sapiens
aggtggcagttgtggaaccatc

SEQ ID NO: 7012348 - DNA, 22 bp, Homo sapiens
gaggaggtggagtcatgcagag

SEQ ID NO: 7012349 - DNA, 22 bp, Homo sapiens
actcagtgggcttgatgtcgaa

SEQ ID NO: 7012350 - DNA, 22 bp, Homo sapiens
tgtgaaatctgaactcaaagat

SEQ ID NO: 7012351 - DNA, 22 bp, Homo sapiens
tctggagtggcagtcatctgaa

SEQ ID NO: 7012352 - DNA, 22 bp, Homo sapiens
aggctcctatcgctttcagcaa

SEQ ID NO: 7012353 - DNA, 22 bp, Homo sapiens
gtgggcagcctgtccggagacc

SEQ ID NO: 7012354 - DNA, 22 bp, Homo sapiens
gcaggcattagcccccatggct

SEQ ID NO: 7012355 - DNA, 22 bp, Homo sapiens
acaatgtctgctatttggctct

SEQ ID NO: 7012356 - DNA, 22 bp, Homo sapiens
cagcatgtatctttcaggtgtg

SEQ ID NO: 7012357 - DNA, 23 bp, Homo sapiens
acattacacgcagtaattgcccc

SEQ ID NO: 7012358 - DNA, 22 bp, Homo sapiens
catgctgtcctgccagggatgg

SEQ ID NO: 7012359 - DNA, 22 bp, Homo sapiens
atgtaagagctttgcagggaaa

SEQ ID NO: 7012360 - DNA, 22 bp, Homo sapiens
ctggttcatcgcggccacttat

SEQ ID NO: 7012361 - DNA, 22 bp, Homo sapiens
tttagagtccaagttcttcact

SEQ ID NO: 7012362 - DNA, 22 bp, Homo sapiens
gtgttacatattctaaaatgct

SEQ ID NO: 7012363 - DNA, 22 bp, Homo sapiens
cagattcttcattcattctaca

SEQ ID NO: 7012364 - DNA, 22 bp, Homo sapiens
tctgcagaagaattaaggacag

SEQ ID NO: 7012365 - DNA, 20 bp, Homo sapiens
tccccagggcatcaggagca

SEQ ID NO: 7012366 - DNA, 22 bp, Homo sapiens
agcaggacacgatgcggcagga

SEQ ID NO: 7012367 - DNA, 22 bp, Homo sapiens
gcattgaaccatctagatttct

SEQ ID NO: 7012368 - DNA, 22 bp, Homo sapiens
tttatttgaatcaggggagaat

SEQ ID NO: 7012369 - DNA, 22 bp, Homo sapiens
tgcagcatctccttgtgccatg

SEQ ID NO: 7012370 - DNA, 22 bp, Homo sapiens
tgcccaaggatccattggctgg

SEQ ID NO: 7012371 - DNA, 22 bp, Homo sapiens
ccagaggttccaggctagggag

SEQ ID NO: 7012372 - DNA, 22 bp, Homo sapiens
agcaactatattgaaagccacc

SEQ ID NO: 7012373 - DNA, 22 bp, Homo sapiens
aacttcatgtaatttaaaacag

SEQ ID NO: 7012374 - DNA, 22 bp, Homo sapiens
gctttgcctgccatatggggtc

SEQ ID NO: 7012375 - DNA, 22 bp, Homo sapiens
atcacaaaggctgcttcatgat

SEQ ID NO: 7012376 - DNA, 22 bp, Homo sapiens
tgacatgtgtaatcagctccgt

SEQ ID NO: 7012377 - DNA, 22 bp, Homo sapiens
agtggcttcatttctgccagaa

SEQ ID NO: 7012378 - DNA, 22 bp, Homo sapiens
catgaaatgatatttgggtggg

SEQ ID NO: 7012379 - DNA, 23 bp, Homo sapiens
aatgcattaatttgggagagtac

SEQ ID NO: 7012380 - DNA, 22 bp, Homo sapiens
ttactttccagctctagcttca

SEQ ID NO: 7012381 - DNA, 22 bp, Homo sapiens
aggctggtgcttcctagggcag

SEQ ID NO: 7012382 - DNA, 22 bp, Homo sapiens
ttgagtctgtgccctatgctgt

SEQ ID NO: 7012383 - DNA, 22 bp, Homo sapiens
cgtccaggaagatcggccgatg

SEQ ID NO: 7012384 - DNA, 22 bp, Homo sapiens
ggcagcagttacaaatgtgcag

SEQ ID NO: 7012385 - DNA, 22 bp, Homo sapiens
aacgcccgtggttgccaaggta

SEQ ID NO: 7012386 - DNA, 19 bp, Homo sapiens
tgccagctcacaggagctc

SEQ ID NO: 7012387 - DNA, 22 bp, Homo sapiens
atgagaatgcattcatgttttg

SEQ ID NO: 7012388 - DNA, 22 bp, Homo sapiens
aatgttgccccaggacaaagga

SEQ ID NO: 7012389 - DNA, 22 bp, Homo sapiens
tttttagaattggctgagaatt

SEQ ID NO: 7012390 - DNA, 22 bp, Homo sapiens
acagaagaagttcaaggtgaag

SEQ ID NO: 7012391 - DNA, 22 bp, Homo sapiens
cctggcagctcctccccggcgg

SEQ ID NO: 7012392 - DNA, 22 bp, Homo sapiens
ttacttggtgttctgcccagga

SEQ ID NO: 7012393 - DNA, 22 bp, Homo sapiens
taggtctgtgcagaggctgagc

SEQ ID NO: 7012394 - DNA, 17 bp, Homo sapiens
ggcccctatctcccttc

SEQ ID NO: 7012395 - DNA, 22 bp, Homo sapiens
ctgtgggtattaaaaatgaatt

SEQ ID NO: 7012396 - DNA, 22 bp, Homo sapiens
gaggtagggcagaggctgaatg

SEQ ID NO: 7012397 - DNA, 22 bp, Homo sapiens
ctaaatgatattttggtttcct

SEQ ID NO: 7012398 - DNA, 18 bp, Homo sapiens
acagaactcaggggcacc

SEQ ID NO: 7012399 - DNA, 21 bp, Homo sapiens
gttttcatgatagagtctgta

SEQ ID NO: 7012400 - DNA, 22 bp, Homo sapiens
tctgagttacacaagcaagggt

SEQ ID NO: 7012401 - DNA, 16 bp, Homo sapiens
taacatttttaaaagg

SEQ ID NO: 7012402 - DNA, 22 bp, Homo sapiens
gacaaggttagggagtgcttag

SEQ ID NO: 7012403 - DNA, 22 bp, Homo sapiens
gaggagaaattatccttggtgt

SEQ ID NO: 7012404 - DNA, 23 bp, Homo sapiens
agcacatcaaagcagggaggaga

SEQ ID NO: 7012405 - DNA, 22 bp, Homo sapiens
tcggcgcgcccagtcgatgggg

SEQ ID NO: 7012406 - DNA, 22 bp, Homo sapiens
tgtcatgtagcattttatgtct

SEQ ID NO: 7012407 - DNA, 22 bp, Homo sapiens
aaaatatggggtgagcccagag

SEQ ID NO: 7012408 - DNA, 22 bp, Homo sapiens
cctgaggatgccagcatgggtg

SEQ ID NO: 7012409 - DNA, 22 bp, Homo sapiens
gacatcaggaagacatgagagg

SEQ ID NO: 7012410 - DNA, 22 bp, Homo sapiens
attacagatagactttgaagct

SEQ ID NO: 7012411 - DNA, 22 bp, Homo sapiens
tccagcatttttcaatagaatt

SEQ ID NO: 7012412 - DNA, 22 bp, Homo sapiens
ttgaaatggcagcagctgacct

SEQ ID NO: 7012413 - DNA, 22 bp, Homo sapiens
gggctcttttctgagcttcact

SEQ ID NO: 7012414 - DNA, 22 bp, Homo sapiens
agagagaggggcgagcaaacac

SEQ ID NO: 7012415 - DNA, 22 bp, Homo sapiens
gttctgagtcctcctttgaagg

SEQ ID NO: 7012416 - DNA, 22 bp, Homo sapiens
tggcaggtacccattggctgta

SEQ ID NO: 7012417 - DNA, 22 bp, Homo sapiens
aggcattttcactgatgtcatc

SEQ ID NO: 7012418 - DNA, 22 bp, Homo sapiens
tccgtggagattttgtgcaggg

SEQ ID NO: 7012419 - DNA, 22 bp, Homo sapiens
atgaagactatttgaaggtgcc

SEQ ID NO: 7012420 - DNA, 22 bp, Homo sapiens
agatcaatgtgtcagaagagat

SEQ ID NO: 7012421 - DNA, 22 bp, Homo sapiens
gtttatattcaacggagtatct

SEQ ID NO: 7012422 - DNA, 22 bp, Homo sapiens
tttttcaagacaacctgcatgt

SEQ ID NO: 7012423 - DNA, 22 bp, Homo sapiens
agtatatagtggcgctgtatgc

SEQ ID NO: 7012424 - DNA, 22 bp, Homo sapiens
acttggttgcaaatgaattatt

SEQ ID NO: 7012425 - DNA, 22 bp, Homo sapiens
ggccccagcttcaaccccgtgg

SEQ ID NO: 7012426 - DNA, 22 bp, Homo sapiens
ctttggcattagcctgtataga

SEQ ID NO: 7012427 - DNA, 22 bp, Homo sapiens
tatccattatgttggctagtct

SEQ ID NO: 7012428 - DNA, 22 bp, Homo sapiens
gcatttgttgagttgccagcta

SEQ ID NO: 7012429 - DNA, 22 bp, Homo sapiens
tgcagctggatttatcttttcc

SEQ ID NO: 7012430 - DNA, 22 bp, Homo sapiens
agctgctggtttaagggatggg

SEQ ID NO: 7012431 - DNA, 22 bp, Homo sapiens
atcaggatcagggctagcagag

SEQ ID NO: 7012432 - DNA, 22 bp, Homo sapiens
ctgatatgacctggattttata

SEQ ID NO: 7012433 - DNA, 22 bp, Homo sapiens
agtcactgtcttgcaaaggtca

SEQ ID NO: 7012434 - DNA, 22 bp, Homo sapiens
atgtatatacttacatgtgtgg

SEQ ID NO: 7012435 - DNA, 22 bp, Homo sapiens
ttgatttttttctactatgcgc

SEQ ID NO: 7012436 - DNA, 22 bp, Homo sapiens
aaatttgataagccattgttac

SEQ ID NO: 7012437 - DNA, 22 bp, Homo sapiens
ctctccagcagatgtagtctgt

SEQ ID NO: 7012438 - DNA, 22 bp, Homo sapiens
gtccaaggcaagtgtgcagagt

SEQ ID NO: 7012439 - DNA, 22 bp, Homo sapiens
gaacccaacctcacttggggta

SEQ ID NO: 7012440 - DNA, 22 bp, Homo sapiens
aagaaattaaggaatgcaacga

SEQ ID NO: 7012441 - DNA, 22 bp, Homo sapiens
ttcaatttcataatatctagct

SEQ ID NO: 7012442 - DNA, 22 bp, Homo sapiens
catggcaataaacctacacagt

SEQ ID NO: 7012443 - DNA, 22 bp, Homo sapiens
tactgcgccttcaccaagcggc

SEQ ID NO: 7012444 - DNA, 14 bp, Homo sapiens
tccacatcagcagt

SEQ ID NO: 7012445 - DNA, 21 bp, Homo sapiens
gcaatttcataagttttagtt

SEQ ID NO: 7012446 - DNA, 22 bp, Homo sapiens
tgaattctgtttgggccgctta

SEQ ID NO: 7012447 - DNA, 22 bp, Homo sapiens
aaaagcagtttatagtcagttg

SEQ ID NO: 7012448 - DNA, 22 bp, Homo sapiens
tctgagccagacaagacagcca

SEQ ID NO: 7012449 - DNA, 22 bp, Homo sapiens
gttgggttaaccaggatgtcaa

SEQ ID NO: 7012450 - DNA, 22 bp, Homo sapiens
aagctgtgaagagcaagtgagg

SEQ ID NO: 7012451 - DNA, 22 bp, Homo sapiens
aatgctaaaacacagatttttg

SEQ ID NO: 7012452 - DNA, 22 bp, Homo sapiens
gctgagagtgtaggatgtttac

SEQ ID NO: 7012453 - DNA, 23 bp, Homo sapiens
atgagcacccactatggaattgc

SEQ ID NO: 7012454 - DNA, 22 bp, Homo sapiens
ctcctgtcagaagcatcctgag

SEQ ID NO: 7012455 - DNA, 22 bp, Homo sapiens
gggcatggccaggtgaggggtc

SEQ ID NO: 7012456 - DNA, 22 bp, Homo sapiens
gtcccttcctcattccacttta

SEQ ID NO: 7012457 - DNA, 22 bp, Homo sapiens
agtgtttgagtttgcggcattg

SEQ ID NO: 7012458 - DNA, 22 bp, Homo sapiens
gtagcaggtattctggtgtgag

SEQ ID NO: 7012459 - DNA, 22 bp, Homo sapiens
aggcttggaagtggcagaactg

SEQ ID NO: 7012460 - DNA, 22 bp, Homo sapiens
aataacagaaacttgagcatca

SEQ ID NO: 7012461 - DNA, 22 bp, Homo sapiens
cagtagacagctgatgatgggc

SEQ ID NO: 7012462 - DNA, 22 bp, Homo sapiens
ccagtcattaagaacccttact

SEQ ID NO: 7012463 - DNA, 23 bp, Homo sapiens
tggctctgtgtcacatacaggat

SEQ ID NO: 7012464 - DNA, 22 bp, Homo sapiens
aaacagtgcaggaagttaagca

SEQ ID NO: 7012465 - DNA, 22 bp, Homo sapiens
agaggctgggtacgggccacct

SEQ ID NO: 7012466 - DNA, 22 bp, Homo sapiens
ccaggagagctctaaatggctg

SEQ ID NO: 7012467 - DNA, 22 bp, Homo sapiens
cattggaagacatatcatgcta

SEQ ID NO: 7012468 - DNA, 22 bp, Homo sapiens
tactttatcagcgtcaaaggta

SEQ ID NO: 7012469 - DNA, 22 bp, Homo sapiens
tggcatttggcttacttatgtt

SEQ ID NO: 7012470 - DNA, 14 bp, Homo sapiens
agctgcaagcatcc

SEQ ID NO: 7012471 - DNA, 22 bp, Homo sapiens
tcagcagggccatgctctctct

SEQ ID NO: 7012472 - DNA, 22 bp, Homo sapiens
actcatgatatgcctataagat

SEQ ID NO: 7012473 - DNA, 22 bp, Homo sapiens
ttcctgggctgcagagagcacc

SEQ ID NO: 7012474 - DNA, 22 bp, Homo sapiens
ggaaactgcttacactagaggg

SEQ ID NO: 7012475 - DNA, 22 bp, Homo sapiens
cagtactggctcattgtgctgt

SEQ ID NO: 7012476 - DNA, 22 bp, Homo sapiens
ccatttttcacaagactcactt

SEQ ID NO: 7012477 - DNA, 22 bp, Homo sapiens
taagtttagagagaatggggac

SEQ ID NO: 7012478 - DNA, 22 bp, Homo sapiens
ctgggcctggagcccacgagcc

SEQ ID NO: 7012479 - DNA, 22 bp, Homo sapiens
tgcccctcgacgcaatgaaggg

SEQ ID NO: 7012480 - DNA, 22 bp, Homo sapiens
agtgctctgatctccttgggtt

SEQ ID NO: 7012481 - DNA, 22 bp, Homo sapiens
ggcagctgagcatggctacctt

SEQ ID NO: 7012482 - DNA, 23 bp, Homo sapiens
ttacagaaagtatgcttttgttt

SEQ ID NO: 7012483 - DNA, 22 bp, Homo sapiens
gattacaaaactcatctatgac

SEQ ID NO: 7012484 - DNA, 22 bp, Homo sapiens
gtcatcttcgcagagtgatttt

SEQ ID NO: 7012485 - DNA, 22 bp, Homo sapiens
atgatttttcagcagaggatct

SEQ ID NO: 7012486 - DNA, 23 bp, Homo sapiens
acaaggcaacatagatcagggca

SEQ ID NO: 7012487 - DNA, 19 bp, Homo sapiens
gaggagctatcggagacag

SEQ ID NO: 7012488 - DNA, 22 bp, Homo sapiens
tcccttatctggtattttttag

SEQ ID NO: 7012489 - DNA, 22 bp, Homo sapiens
tcacatgccacagatgaggcaa

SEQ ID NO: 7012490 - DNA, 22 bp, Homo sapiens
tcatattagggtaatgataaga

SEQ ID NO: 7012491 - DNA, 23 bp, Homo sapiens
tctcagtaaatgttagtttaatc

SEQ ID NO: 7012492 - DNA, 22 bp, Homo sapiens
tgttcttatgaattcaagacac

SEQ ID NO: 7012493 - DNA, 21 bp, Homo sapiens
tctggccctcacagtcacacc

SEQ ID NO: 7012494 - DNA, 22 bp, Homo sapiens
gaaacctgagtgcagatcagga

SEQ ID NO: 7012495 - DNA, 22 bp, Homo sapiens
agggtgccctggagccagttcc

SEQ ID NO: 7012496 - DNA, 22 bp, Homo sapiens
gatgtcttgttgatttcattct

SEQ ID NO: 7012497 - DNA, 22 bp, Homo sapiens
taccaaagttttctgagtgata

SEQ ID NO: 7012498 - DNA, 22 bp, Homo sapiens
catcttcataaaggaactgcat

SEQ ID NO: 7012499 - DNA, 22 bp, Homo sapiens
tgtgcctgatggtcacgtggcc

SEQ ID NO: 7012500 - DNA, 22 bp, Homo sapiens
tagacatttctggttattgaca

SEQ ID NO: 7012501 - DNA, 21 bp, Homo sapiens
aaagttgatttagattggtga

SEQ ID NO: 7012502 - DNA, 22 bp, Homo sapiens
gcctgaagctggaataattgta

SEQ ID NO: 7012503 - DNA, 22 bp, Homo sapiens
tgggctcagccttcatgtggcc

SEQ ID NO: 7012504 - DNA, 22 bp, Homo sapiens
aaagaggcaatcaatgtagcaa

SEQ ID NO: 7012505 - DNA, 22 bp, Homo sapiens
agaagccactggaggttgagat

SEQ ID NO: 7012506 - DNA, 22 bp, Homo sapiens
ccaacctgaggcaggctgcagc

SEQ ID NO: 7012507 - DNA, 22 bp, Homo sapiens
aggctctggagtgtggtgctgg

SEQ ID NO: 7012508 - DNA, 22 bp, Homo sapiens
ggaggggcatagttcaccatca

SEQ ID NO: 7012509 - DNA, 22 bp, Homo sapiens
tcaggagtgataccatttgtca

SEQ ID NO: 7012510 - DNA, 22 bp, Homo sapiens
aacgttctttattggctctccc

SEQ ID NO: 7012511 - DNA, 22 bp, Homo sapiens
gctggctcagggactagagttt

SEQ ID NO: 7012512 - DNA, 22 bp, Homo sapiens
gtgtttcttgcactccccggac

SEQ ID NO: 7012513 - DNA, 22 bp, Homo sapiens
cacaagctccttatgtggagaa

SEQ ID NO: 7012514 - DNA, 21 bp, Homo sapiens
gtccacaggggtttgtcctgg

SEQ ID NO: 7012515 - DNA, 22 bp, Homo sapiens
tgtcctagagacatcagatgtt

SEQ ID NO: 7012516 - DNA, 22 bp, Homo sapiens
tctcaggagccacagcgggagt

SEQ ID NO: 7012517 - DNA, 22 bp, Homo sapiens
gaatgtcctcctggatcactcc

SEQ ID NO: 7012518 - DNA, 22 bp, Homo sapiens
cacagtgattgatttttacttt

SEQ ID NO: 7012519 - DNA, 22 bp, Homo sapiens
attagtgtacatctcacacgca

SEQ ID NO: 7012520 - DNA, 22 bp, Homo sapiens
aggcaaagagccagcaaatctg

SEQ ID NO: 7012521 - DNA, 22 bp, Homo sapiens
ttaactattattagcatctttg

SEQ ID NO: 7012522 - DNA, 20 bp, Homo sapiens
tataaattcagagctttggt

SEQ ID NO: 7012523 - DNA, 22 bp, Homo sapiens
tttggaattccatttctgcatt

SEQ ID NO: 7012524 - DNA, 22 bp, Homo sapiens
tgaacttttatttgatgacagg

SEQ ID NO: 7012525 - DNA, 22 bp, Homo sapiens
tacttctgttagctctgagagt

SEQ ID NO: 7012526 - DNA, 22 bp, Homo sapiens
tgctcccttgccagaggggaag

SEQ ID NO: 7012527 - DNA, 16 bp, Homo sapiens
gcttcgctcgcttgcc

SEQ ID NO: 7012528 - DNA, 22 bp, Homo sapiens
agctcagggcgatctgtctcgg

SEQ ID NO: 7012529 - DNA, 22 bp, Homo sapiens
ctagaaatctctgtttacatca

SEQ ID NO: 7012530 - DNA, 22 bp, Homo sapiens
acccaatacctgtgcagggctt

SEQ ID NO: 7012531 - DNA, 22 bp, Homo sapiens
ttggcttcttgtgaaatctgag

SEQ ID NO: 7012532 - DNA, 22 bp, Homo sapiens
gaaagatatttattggcaacag

SEQ ID NO: 7012533 - DNA, 22 bp, Homo sapiens
ttggcactattgacattttggg

SEQ ID NO: 7012534 - DNA, 20 bp, Homo sapiens
ggccacctgcttcagacccc

SEQ ID NO: 7012535 - DNA, 22 bp, Homo sapiens
aaactgtattccatcctcatca

SEQ ID NO: 7012536 - DNA, 22 bp, Homo sapiens
catgcatcagaatcacctagag

SEQ ID NO: 7012537 - DNA, 22 bp, Homo sapiens
cccagctcccatgttctccaat

SEQ ID NO: 7012538 - DNA, 22 bp, Homo sapiens
aaacagctttcagaatctctca

SEQ ID NO: 7012539 - DNA, 22 bp, Homo sapiens
catggcctctctcctggaatgg

SEQ ID NO: 7012540 - DNA, 22 bp, Homo sapiens
ttgtagctaggtttttgtagaa

SEQ ID NO: 7012541 - DNA, 22 bp, Homo sapiens
agccatggtctcagggccataa

SEQ ID NO: 7012542 - DNA, 22 bp, Homo sapiens
gattaggacatggatgtatgtt

SEQ ID NO: 7012543 - DNA, 22 bp, Homo sapiens
tatttggttcttcttctgtgta

SEQ ID NO: 7012544 - DNA, 22 bp, Homo sapiens
tctatgtaaatgtgagttggtg

SEQ ID NO: 7012545 - DNA, 22 bp, Homo sapiens
agctctttacacagagtccctc

SEQ ID NO: 7012546 - DNA, 22 bp, Homo sapiens
aagttcaaggtgatagtggcag

SEQ ID NO: 7012547 - DNA, 22 bp, Homo sapiens
acagctaagggcacaggtcacc

SEQ ID NO: 7012548 - DNA, 17 bp, Homo sapiens
aggaaacattttctttc

SEQ ID NO: 7012549 - DNA, 22 bp, Homo sapiens
aatagtaaaagatacagctaat

SEQ ID NO: 7012550 - DNA, 22 bp, Homo sapiens
tatgcacacatgtatgcatgtg

SEQ ID NO: 7012551 - DNA, 22 bp, Homo sapiens
tttatctattgtattgttgatg

SEQ ID NO: 7012552 - DNA, 22 bp, Homo sapiens
cccacactctgagaaatgctga

SEQ ID NO: 7012553 - DNA, 22 bp, Homo sapiens
gccttgggggtgaaagaggcta

SEQ ID NO: 7012554 - DNA, 22 bp, Homo sapiens
tgtttgtacagtgcccacttct

SEQ ID NO: 7012555 - DNA, 22 bp, Homo sapiens
ctgccagtctaaagagggcttt

SEQ ID NO: 7012556 - DNA, 23 bp, Homo sapiens
ctgactcatcccaccacctcctc

SEQ ID NO: 7012557 - DNA, 19 bp, Homo sapiens
accaggaacttccctaggc

SEQ ID NO: 7012558 - DNA, 22 bp, Homo sapiens
tactcaatgaagtagcctggtt

SEQ ID NO: 7012559 - DNA, 22 bp, Homo sapiens
aaggattcaagaaatggtgtag

SEQ ID NO: 7012560 - DNA, 22 bp, Homo sapiens
aggaaactgaagcccagagagg

SEQ ID NO: 7012561 - DNA, 22 bp, Homo sapiens
caatccagtttctgtcagctac

SEQ ID NO: 7012562 - DNA, 23 bp, Homo sapiens
aggttcagctttcttactctggg

SEQ ID NO: 7012563 - DNA, 22 bp, Homo sapiens
taaaagctcttctgttgagtta

SEQ ID NO: 7012564 - DNA, 22 bp, Homo sapiens
tgcagcctttagaagttcagat

SEQ ID NO: 7012565 - DNA, 22 bp, Homo sapiens
ttaaatgtgatcctggtatgca

SEQ ID NO: 7012566 - DNA, 21 bp, Homo sapiens
gccagagcagtacaatgaggt

SEQ ID NO: 7012567 - DNA, 22 bp, Homo sapiens
tcccaggctaggcctctgcgtt

SEQ ID NO: 7012568 - DNA, 22 bp, Homo sapiens
agggggcaggagagacctgctg

SEQ ID NO: 7012569 - DNA, 22 bp, Homo sapiens
caccttcagaatgctccaggca

SEQ ID NO: 7012570 - DNA, 22 bp, Homo sapiens
agggccctgagttgcagccctg

SEQ ID NO: 7012571 - DNA, 22 bp, Homo sapiens
agtgtcataaggagaaattaca

SEQ ID NO: 7012572 - DNA, 22 bp, Homo sapiens
ctgctcttgagggactgcggtc

SEQ ID NO: 7012573 - DNA, 22 bp, Homo sapiens
tcctagtacacactattatttg

SEQ ID NO: 7012574 - DNA, 21 bp, Homo sapiens
tagaggcaggagggactgcag

SEQ ID NO: 7012575 - DNA, 22 bp, Homo sapiens
tggctgaggtctggggcttctg

SEQ ID NO: 7012576 - DNA, 22 bp, Homo sapiens
gggatctgctccagagggaaaa

SEQ ID NO: 7012577 - DNA, 22 bp, Homo sapiens
ttctagcactgcctggaagaca

SEQ ID NO: 7012578 - DNA, 22 bp, Homo sapiens
tctttgcatcccttccatagtt

SEQ ID NO: 7012579 - DNA, 22 bp, Homo sapiens
agtctgccaagccagatcatgt

SEQ ID NO: 7012580 - DNA, 22 bp, Homo sapiens
ggagtcttggcctgctgagaaa

SEQ ID NO: 7012581 - DNA, 22 bp, Homo sapiens
gagcccagctctacctcagact

SEQ ID NO: 7012582 - DNA, 22 bp, Homo sapiens
gtaacgaataaacaagtgataa

SEQ ID NO: 7012583 - DNA, 23 bp, Homo sapiens
tctcaggcaaaccaggacaagtt

SEQ ID NO: 7012584 - DNA, 22 bp, Homo sapiens
taacagggtaggagggcatgaa

SEQ ID NO: 7012585 - DNA, 22 bp, Homo sapiens
gcaggctcaaaagctggtagga

SEQ ID NO: 7012586 - DNA, 22 bp, Homo sapiens
tctgcagaaagtggctcagtgg

SEQ ID NO: 7012587 - DNA, 22 bp, Homo sapiens
aatcaggagtgtgcactttgat

SEQ ID NO: 7012588 - DNA, 22 bp, Homo sapiens
tgtgagacacactgctgcttca

SEQ ID NO: 7012589 - DNA, 22 bp, Homo sapiens
tctaaagagaaccttttctcat

SEQ ID NO: 7012590 - DNA, 22 bp, Homo sapiens
tgtgtgagtaaggctgagagag

SEQ ID NO: 7012591 - DNA, 22 bp, Homo sapiens
cctgccttcccagcttggcttt

SEQ ID NO: 7012592 - DNA, 22 bp, Homo sapiens
aaatttcagttggaatgagctc

SEQ ID NO: 7012593 - DNA, 21 bp, Homo sapiens
gatttataagccttaagccta

SEQ ID NO: 7012594 - DNA, 22 bp, Homo sapiens
tccttggctctttgataaatac

SEQ ID NO: 7012595 - DNA, 22 bp, Homo sapiens
acagcagtcagtgaatatttaa

SEQ ID NO: 7012596 - DNA, 22 bp, Homo sapiens
cagccctgtccaatgtctgctc

SEQ ID NO: 7012597 - DNA, 22 bp, Homo sapiens
gcagctgcgctggtgtggggca

SEQ ID NO: 7012598 - DNA, 22 bp, Homo sapiens
tcaggctcaggaatgtgtttat

SEQ ID NO: 7012599 - DNA, 22 bp, Homo sapiens
tgcagctctgggcaagtgcctt

SEQ ID NO: 7012600 - DNA, 22 bp, Homo sapiens
aacagtgttctagggtgtggct

SEQ ID NO: 7012601 - DNA, 22 bp, Homo sapiens
gctctgttatcctctatatcct

SEQ ID NO: 7012602 - DNA, 22 bp, Homo sapiens
tctgcctgtctccttgaattgt

SEQ ID NO: 7012603 - DNA, 22 bp, Homo sapiens
atttgccttggtgatttgtaaa

SEQ ID NO: 7012604 - DNA, 22 bp, Homo sapiens
catttctgtcacgttcttttat

SEQ ID NO: 7012605 - DNA, 20 bp, Homo sapiens
aggctgttgacggctgcctc

SEQ ID NO: 7012606 - DNA, 22 bp, Homo sapiens
ttccaatggaatcatgtcttga

SEQ ID NO: 7012607 - DNA, 22 bp, Homo sapiens
agtttgaagcacatgaatggca

SEQ ID NO: 7012608 - DNA, 22 bp, Homo sapiens
tgctatgtcctttcctccctcc

SEQ ID NO: 7012609 - DNA, 22 bp, Homo sapiens
cctctgtgtcagggaagagact

SEQ ID NO: 7012610 - DNA, 22 bp, Homo sapiens
tacatgtgcacgtgtgactttg

SEQ ID NO: 7012611 - DNA, 22 bp, Homo sapiens
taggaatgatgtatttttctct

SEQ ID NO: 7012612 - DNA, 22 bp, Homo sapiens
tgacagtgagcttggggtactt

SEQ ID NO: 7012613 - DNA, 22 bp, Homo sapiens
ttctggagattgagaaggcatt

SEQ ID NO: 7012614 - DNA, 19 bp, Homo sapiens
tctcagactgtgcttctgt

SEQ ID NO: 7012615 - DNA, 22 bp, Homo sapiens
tttccctttgcactctacaatt

SEQ ID NO: 7012616 - DNA, 22 bp, Homo sapiens
ctggggacgtcgggcagtgttc

SEQ ID NO: 7012617 - DNA, 22 bp, Homo sapiens
tgggtccttgccatcttggagt

SEQ ID NO: 7012618 - DNA, 22 bp, Homo sapiens
ctgtcccctgtgctttcacttg

SEQ ID NO: 7012619 - DNA, 19 bp, Homo sapiens
ttcacaattatgaaattag

SEQ ID NO: 7012620 - DNA, 22 bp, Homo sapiens
atgcaactacccccaggatttt

SEQ ID NO: 7012621 - DNA, 22 bp, Homo sapiens
accagagcagactactggaggt

SEQ ID NO: 7012622 - DNA, 22 bp, Homo sapiens
ctgcccgtaagttagaaaagca

SEQ ID NO: 7012623 - DNA, 22 bp, Homo sapiens
gggtccagctacatcagggtgg

SEQ ID NO: 7012624 - DNA, 22 bp, Homo sapiens
gtcatttttttcgtaatagtgg

SEQ ID NO: 7012625 - DNA, 22 bp, Homo sapiens
ggctttgcattttgatggaggt

SEQ ID NO: 7012626 - DNA, 19 bp, Homo sapiens
ttctccagggacttaggga

SEQ ID NO: 7012627 - DNA, 22 bp, Homo sapiens
tggtggtctggctttatatcct

SEQ ID NO: 7012628 - DNA, 22 bp, Homo sapiens
ccactctgctgtgctccatgat

SEQ ID NO: 7012629 - DNA, 19 bp, Homo sapiens
aagaggcaaccctcgagcc

SEQ ID NO: 7012630 - DNA, 20 bp, Homo sapiens
tccaatgtaggataaatgtg

SEQ ID NO: 7012631 - DNA, 22 bp, Homo sapiens
gttaaatgcagattctgactca

SEQ ID NO: 7012632 - DNA, 22 bp, Homo sapiens
aatatcagtatattgtatcagt

SEQ ID NO: 7012633 - DNA, 22 bp, Homo sapiens
ttgaaaatatcacaggagcagc

SEQ ID NO: 7012634 - DNA, 22 bp, Homo sapiens
tatctataatgttttacttcct

SEQ ID NO: 7012635 - DNA, 22 bp, Homo sapiens
ttgtttgaataacagacaaatt

SEQ ID NO: 7012636 - DNA, 22 bp, Homo sapiens
gtgaagtgattgaagggtaggg

SEQ ID NO: 7012637 - DNA, 22 bp, Homo sapiens
accaccccaaatgaacctctgt

SEQ ID NO: 7012638 - DNA, 22 bp, Homo sapiens
gttatacgcctgtcaggaagct

SEQ ID NO: 7012639 - DNA, 22 bp, Homo sapiens
agttgctgcttctctctagaga

SEQ ID NO: 7012640 - DNA, 22 bp, Homo sapiens
ggccctgagcacagctcctctc

SEQ ID NO: 7012641 - DNA, 22 bp, Homo sapiens
tggcagcaatagaaatataatc

SEQ ID NO: 7012642 - DNA, 22 bp, Homo sapiens
tactttaaagaggtgtaatgag

SEQ ID NO: 7012643 - DNA, 22 bp, Homo sapiens
ttttacctgaaccacacagtat

SEQ ID NO: 7012644 - DNA, 22 bp, Homo sapiens
catgtatagacactcatacagt

SEQ ID NO: 7012645 - DNA, 22 bp, Homo sapiens
gttcacatcacttcactgaacc

SEQ ID NO: 7012646 - DNA, 22 bp, Homo sapiens
tttatctgtgggagttgtttgg

SEQ ID NO: 7012647 - DNA, 22 bp, Homo sapiens
actgtcctagaacctgcagctc

SEQ ID NO: 7012648 - DNA, 22 bp, Homo sapiens
tgtttaaccatctgcttttatg

SEQ ID NO: 7012649 - DNA, 22 bp, Homo sapiens
acaaaagtagttgcggtttttg

SEQ ID NO: 7012650 - DNA, 22 bp, Homo sapiens
gctggggtctgtgaggagggct

SEQ ID NO: 7012651 - DNA, 22 bp, Homo sapiens
gagtttctccagtgctagttgt

SEQ ID NO: 7012652 - DNA, 22 bp, Homo sapiens
tgtgtacacaagtatatataca

SEQ ID NO: 7012653 - DNA, 22 bp, Homo sapiens
tgcatgcataaatgtacacaca

SEQ ID NO: 7012654 - DNA, 22 bp, Homo sapiens
gcaaacatgtgctcattttgtg

SEQ ID NO: 7012655 - DNA, 22 bp, Homo sapiens
aggcactgacagattctgtgtc

SEQ ID NO: 7012656 - DNA, 22 bp, Homo sapiens
agaaatcattcccaaacccata

SEQ ID NO: 7012657 - DNA, 17 bp, Homo sapiens
aaactgaaaaattcact

SEQ ID NO: 7012658 - DNA, 22 bp, Homo sapiens
gcaaagcagtcttctgtgccta

SEQ ID NO: 7012659 - DNA, 22 bp, Homo sapiens
cctgctggacaggggtgttcat

SEQ ID NO: 7012660 - DNA, 22 bp, Homo sapiens
caggctgtggatcaggagcctt

SEQ ID NO: 7012661 - DNA, 22 bp, Homo sapiens
acagtcttaatggataggagct

SEQ ID NO: 7012662 - DNA, 22 bp, Homo sapiens
gcccttggcaaattctccttta

SEQ ID NO: 7012663 - DNA, 22 bp, Homo sapiens
aagattcttattaggtaatttt

SEQ ID NO: 7012664 - DNA, 21 bp, Homo sapiens
ctcagggcttggtgtcctcat

SEQ ID NO: 7012665 - DNA, 19 bp, Homo sapiens
aatgtagtgttatgtcaac

SEQ ID NO: 7012666 - DNA, 21 bp, Homo sapiens
agtccaggagtcacccaagcc

SEQ ID NO: 7012667 - DNA, 22 bp, Homo sapiens
acccaggacacagagatgaccc

SEQ ID NO: 7012668 - DNA, 22 bp, Homo sapiens
tgctcaggccagccggacagag

SEQ ID NO: 7012669 - DNA, 22 bp, Homo sapiens
ttgtcctggcccaaatgtcaac

SEQ ID NO: 7012670 - DNA, 22 bp, Homo sapiens
tatgaggtaagagggacttagc

SEQ ID NO: 7012671 - DNA, 22 bp, Homo sapiens
gtcatgtgaataagtgtggggt

SEQ ID NO: 7012672 - DNA, 22 bp, Homo sapiens
catcagtgttggcttctcagag

SEQ ID NO: 7012673 - DNA, 22 bp, Homo sapiens
acatgcatacgtgtgtttaaaa

SEQ ID NO: 7012674 - DNA, 22 bp, Homo sapiens
actgccagagacaaggatgagt

SEQ ID NO: 7012675 - DNA, 22 bp, Homo sapiens
gtgtgaaattagtcactgggaa

SEQ ID NO: 7012676 - DNA, 22 bp, Homo sapiens
gacaacaggcagacgtcagaaa

SEQ ID NO: 7012677 - DNA, 22 bp, Homo sapiens
tgaaatgttctggagtttctgt

SEQ ID NO: 7012678 - DNA, 22 bp, Homo sapiens
caggctcccgctccactgggca

SEQ ID NO: 7012679 - DNA, 22 bp, Homo sapiens
ttaccatctgtgggaagtggct

SEQ ID NO: 7012680 - DNA, 22 bp, Homo sapiens
tgtaactgtggtctagggactg

SEQ ID NO: 7012681 - DNA, 22 bp, Homo sapiens
ttagcagtttccattttggtca

SEQ ID NO: 7012682 - DNA, 23 bp, Homo sapiens
ggcttcagtgagagtccctgctg

SEQ ID NO: 7012683 - DNA, 22 bp, Homo sapiens
cctgacctccaagtggctctgg

SEQ ID NO: 7012684 - DNA, 22 bp, Homo sapiens
aaaaggctcttcaaaatggaag

SEQ ID NO: 7012685 - DNA, 22 bp, Homo sapiens
tcacctcaccacccttatggtt

SEQ ID NO: 7012686 - DNA, 22 bp, Homo sapiens
cctgaggtcagcggttcccaca

SEQ ID NO: 7012687 - DNA, 22 bp, Homo sapiens
cagctgctgaggaaggggttgg

SEQ ID NO: 7012688 - DNA, 22 bp, Homo sapiens
gagggttgtaagattgtagagc

SEQ ID NO: 7012689 - DNA, 22 bp, Homo sapiens
attagctatatgctatgtgcca

SEQ ID NO: 7012690 - DNA, 22 bp, Homo sapiens
gccgtgggtgtcatggcccata

SEQ ID NO: 7012691 - DNA, 22 bp, Homo sapiens
gagcagacgctgcagtcttggg

SEQ ID NO: 7012692 - DNA, 22 bp, Homo sapiens
agtttcagaatttatgcagaca

SEQ ID NO: 7012693 - DNA, 22 bp, Homo sapiens
tctagttaattcctttggtgtt

SEQ ID NO: 7012694 - DNA, 22 bp, Homo sapiens
ggcacagttttctacatatgct

SEQ ID NO: 7012695 - DNA, 22 bp, Homo sapiens
ttgggcctcactctagaaggca

SEQ ID NO: 7012696 - DNA, 22 bp, Homo sapiens
gtcaacagagacagagacactg

SEQ ID NO: 7012697 - DNA, 22 bp, Homo sapiens
aagatacatatttgttctagtg

SEQ ID NO: 7012698 - DNA, 22 bp, Homo sapiens
agggagaggctgaactatccta

SEQ ID NO: 7012699 - DNA, 22 bp, Homo sapiens
tctgctctgagagggccatcag

SEQ ID NO: 7012700 - DNA, 22 bp, Homo sapiens
tttagaaattcatctatggcct

SEQ ID NO: 7012701 - DNA, 22 bp, Homo sapiens
atagctactgatgacacacaca

SEQ ID NO: 7012702 - DNA, 22 bp, Homo sapiens
gcttggctctaagacacctatt

SEQ ID NO: 7012703 - DNA, 22 bp, Homo sapiens
gctgtgcttgcatgagtgtctg

SEQ ID NO: 7012704 - DNA, 15 bp, Homo sapiens
aattcctacttttaa

SEQ ID NO: 7012705 - DNA, 22 bp, Homo sapiens
ccagagaaccatctgcttgagg

SEQ ID NO: 7012706 - DNA, 22 bp, Homo sapiens
tttgtcattctgtgtatttaaa

SEQ ID NO: 7012707 - DNA, 22 bp, Homo sapiens
cagctctggcgtcagggagcga

SEQ ID NO: 7012708 - DNA, 16 bp, Homo sapiens
atctcaggagagtctt

SEQ ID NO: 7012709 - DNA, 22 bp, Homo sapiens
tgttacaagtcttgaggtactt

SEQ ID NO: 7012710 - DNA, 22 bp, Homo sapiens
tgttagaagactcttttaccta

SEQ ID NO: 7012711 - DNA, 22 bp, Homo sapiens
ccagaagcagagcctgaggcag

SEQ ID NO: 7012712 - DNA, 22 bp, Homo sapiens
agatttggcagtataaattctg

SEQ ID NO: 7012713 - DNA, 22 bp, Homo sapiens
tttaccaagagttgtcactgtt

SEQ ID NO: 7012714 - DNA, 22 bp, Homo sapiens
agtggctgtcctggctctaact

SEQ ID NO: 7012715 - DNA, 22 bp, Homo sapiens
ctagtctctggaggtcagggct

SEQ ID NO: 7012716 - DNA, 22 bp, Homo sapiens
cccagtcatcctgcaggtgaaa

SEQ ID NO: 7012717 - DNA, 22 bp, Homo sapiens
ttctcttagcactttgtgttac

SEQ ID NO: 7012718 - DNA, 22 bp, Homo sapiens
agtggcattttaatggatgtca

SEQ ID NO: 7012719 - DNA, 22 bp, Homo sapiens
tcatgtcccgttgctggctgcc

SEQ ID NO: 7012720 - DNA, 22 bp, Homo sapiens
tgaaatgaaacagaacatatca

SEQ ID NO: 7012721 - DNA, 22 bp, Homo sapiens
gctctgggctgaatcatttatc

SEQ ID NO: 7012722 - DNA, 22 bp, Homo sapiens
tagagaacaagtatggcacgga

SEQ ID NO: 7012723 - DNA, 22 bp, Homo sapiens
tagcatttcccaaatgcatttg

SEQ ID NO: 7012724 - DNA, 21 bp, Homo sapiens
tattcagtccattgatgttta

SEQ ID NO: 7012725 - DNA, 22 bp, Homo sapiens
agaatgtgaagacccggtttgt

SEQ ID NO: 7012726 - DNA, 21 bp, Homo sapiens
tagttctacttcagtctcatg

SEQ ID NO: 7012727 - DNA, 22 bp, Homo sapiens
tattccaagtcactgtgtcctg

SEQ ID NO: 7012728 - DNA, 22 bp, Homo sapiens
tctcccaaggcacagaaagagt

SEQ ID NO: 7012729 - DNA, 22 bp, Homo sapiens
gataaattatcaggggtttaaa

SEQ ID NO: 7012730 - DNA, 22 bp, Homo sapiens
cagtaggcaggttgtcttctta

SEQ ID NO: 7012731 - DNA, 22 bp, Homo sapiens
cggcttctcgggtcggattccg

SEQ ID NO: 7012732 - DNA, 22 bp, Homo sapiens
tgcttttatttaatatcttgca

SEQ ID NO: 7012733 - DNA, 22 bp, Homo sapiens
agctcttttgattctccctgtc

SEQ ID NO: 7012734 - DNA, 22 bp, Homo sapiens
ctagttcttaactgttatgatt

SEQ ID NO: 7012735 - DNA, 22 bp, Homo sapiens
tccacaggaaagcacctcccat

SEQ ID NO: 7012736 - DNA, 22 bp, Homo sapiens
ctgagctgcagtcctggctctg

SEQ ID NO: 7012737 - DNA, 22 bp, Homo sapiens
tcagtgttaatcagtggtacct

SEQ ID NO: 7012738 - DNA, 22 bp, Homo sapiens
gggggaagaaagaacatggcat

SEQ ID NO: 7012739 - DNA, 20 bp, Homo sapiens
tgagacccgctgacaagttc

SEQ ID NO: 7012740 - DNA, 22 bp, Homo sapiens
ggcacatgtatgtgggagtgtg

SEQ ID NO: 7012741 - DNA, 22 bp, Homo sapiens
tttgtcatcagttattaatatg

SEQ ID NO: 7012742 - DNA, 22 bp, Homo sapiens
gggctccgcccttggctgagct

SEQ ID NO: 7012743 - DNA, 22 bp, Homo sapiens
acagggaccttggaagctggaa

SEQ ID NO: 7012744 - DNA, 22 bp, Homo sapiens
aatttatctttagtaagcttct

SEQ ID NO: 7012745 - DNA, 18 bp, Homo sapiens
tttcacaacctccagagg

SEQ ID NO: 7012746 - DNA, 20 bp, Homo sapiens
acacactttgatcttgagcc

SEQ ID NO: 7012747 - DNA, 21 bp, Homo sapiens
atggctgatgatattgaacat

SEQ ID NO: 7012748 - DNA, 22 bp, Homo sapiens
tcctgtcagtgaggcagatgaa

SEQ ID NO: 7012749 - DNA, 23 bp, Homo sapiens
aggacagtggaatttagggattg

SEQ ID NO: 7012750 - DNA, 22 bp, Homo sapiens
gaacagcagcttcctgggaatt

SEQ ID NO: 7012751 - DNA, 22 bp, Homo sapiens
tccaggcattggagagataatg

SEQ ID NO: 7012752 - DNA, 21 bp, Homo sapiens
tccccagtgccctctctaaga

SEQ ID NO: 7012753 - DNA, 22 bp, Homo sapiens
cagggatgagaaagctctctaa

SEQ ID NO: 7012754 - DNA, 18 bp, Homo sapiens
tgtgcccggaaaatacct

SEQ ID NO: 7012755 - DNA, 22 bp, Homo sapiens
ctcactgcaacctctgcctccc

SEQ ID NO: 7012756 - DNA, 22 bp, Homo sapiens
ctggccactgcgggcctctgcc

SEQ ID NO: 7012757 - DNA, 22 bp, Homo sapiens
actctttaacagactttgatct

SEQ ID NO: 7012758 - DNA, 22 bp, Homo sapiens
aggagaaagactggacagccaa

SEQ ID NO: 7012759 - DNA, 22 bp, Homo sapiens
tcaaaggctgcttgtcttctgg

SEQ ID NO: 7012760 - DNA, 22 bp, Homo sapiens
cagaaactgcttgtggtcatct

SEQ ID NO: 7012761 - DNA, 22 bp, Homo sapiens
tctcactttgttgcccagactt

SEQ ID NO: 7012762 - DNA, 22 bp, Homo sapiens
aaagcgacctctaatctagtgc

SEQ ID NO: 7012763 - DNA, 21 bp, Homo sapiens
tgtatacacacatatatgtac

SEQ ID NO: 7012764 - DNA, 22 bp, Homo sapiens
ttctccagagtttctctcactg

SEQ ID NO: 7012765 - DNA, 22 bp, Homo sapiens
tttgtagagggtaattgacaga

SEQ ID NO: 7012766 - DNA, 22 bp, Homo sapiens
gtcaaacaaattaacatatcca

SEQ ID NO: 7012767 - DNA, 22 bp, Homo sapiens
gtgtgcctgtatcatggtaacc

SEQ ID NO: 7012768 - DNA, 22 bp, Homo sapiens
agtgatcttttaaaaagaagtg

SEQ ID NO: 7012769 - DNA, 22 bp, Homo sapiens
acatgcatgttgtgtagggggg

SEQ ID NO: 7012770 - DNA, 21 bp, Homo sapiens
ctaggaggcccagaagacctc

SEQ ID NO: 7012771 - DNA, 22 bp, Homo sapiens
gcatctgatccaatagatatat

SEQ ID NO: 7012772 - DNA, 22 bp, Homo sapiens
atacttccctgttttttcctga

SEQ ID NO: 7012773 - DNA, 22 bp, Homo sapiens
tgtaaggagtgtgagtttgagt

SEQ ID NO: 7012774 - DNA, 18 bp, Homo sapiens
tggcttcagagtaaaatg

SEQ ID NO: 7012775 - DNA, 22 bp, Homo sapiens
tcagtgttgaattttttgcaaa

SEQ ID NO: 7012776 - DNA, 22 bp, Homo sapiens
tacaagagtgagattatcatgt

SEQ ID NO: 7012777 - DNA, 22 bp, Homo sapiens
gtggccagaggtcccatgtgtc

SEQ ID NO: 7012778 - DNA, 22 bp, Homo sapiens
aagggagacagttgtgtgagga

SEQ ID NO: 7012779 - DNA, 22 bp, Homo sapiens
ggctatgggaagatggcagggg

SEQ ID NO: 7012780 - DNA, 22 bp, Homo sapiens
atgtgttcagttgacaggagca

SEQ ID NO: 7012781 - DNA, 22 bp, Homo sapiens
ggctttgaggatacagaggaaa

SEQ ID NO: 7012782 - DNA, 22 bp, Homo sapiens
catgctgggccttgggtgcact

SEQ ID NO: 7012783 - DNA, 22 bp, Homo sapiens
catatactgcatacatatgtgt

SEQ ID NO: 7012784 - DNA, 22 bp, Homo sapiens
tgaatggaagagaagtgtcctg

SEQ ID NO: 7012785 - DNA, 22 bp, Homo sapiens
atgcccaccctcagcccaggct

SEQ ID NO: 7012786 - DNA, 22 bp, Homo sapiens
tcctcattgtcactggcccgca

SEQ ID NO: 7012787 - DNA, 22 bp, Homo sapiens
ctcatccatgaccgtgtttccc

SEQ ID NO: 7012788 - DNA, 22 bp, Homo sapiens
cctgtggagttcccatctgaat

SEQ ID NO: 7012789 - DNA, 22 bp, Homo sapiens
ctcagcacatctttacatttcc

SEQ ID NO: 7012790 - DNA, 22 bp, Homo sapiens
cactttgtttattgtgcagtta

SEQ ID NO: 7012791 - DNA, 22 bp, Homo sapiens
ctgggccacagactcaaggcag

SEQ ID NO: 7012792 - DNA, 22 bp, Homo sapiens
aagcatcattcacttccttctg

SEQ ID NO: 7012793 - DNA, 22 bp, Homo sapiens
ctctggctatggcacggcgctc

SEQ ID NO: 7012794 - DNA, 22 bp, Homo sapiens
ccagtcctgccaccctgtctat

SEQ ID NO: 7012795 - DNA, 22 bp, Homo sapiens
attcttcacatggataggatct

SEQ ID NO: 7012796 - DNA, 22 bp, Homo sapiens
ctaccttcaagttcctccctct

SEQ ID NO: 7012797 - DNA, 22 bp, Homo sapiens
tccctccacacctgctggtacc

SEQ ID NO: 7012798 - DNA, 22 bp, Homo sapiens
gagactttaaaaaacattaaga

SEQ ID NO: 7012799 - DNA, 22 bp, Homo sapiens
atacttcaacatatcagtcaga

SEQ ID NO: 7012800 - DNA, 22 bp, Homo sapiens
gggacaggcaaaggtatgcttc

SEQ ID NO: 7012801 - DNA, 23 bp, Homo sapiens
cagagctggcttcatgggtgtgc

SEQ ID NO: 7012802 - DNA, 22 bp, Homo sapiens
cagccctgcggaggtgtatact

SEQ ID NO: 7012803 - DNA, 22 bp, Homo sapiens
cttattcagcacttgctctgta

SEQ ID NO: 7012804 - DNA, 22 bp, Homo sapiens
gggcactggcagtcggggacgc

SEQ ID NO: 7012805 - DNA, 22 bp, Homo sapiens
tttcaacgtgtaatcttattta

SEQ ID NO: 7012806 - DNA, 22 bp, Homo sapiens
tttctctcagcctgtagaaact

SEQ ID NO: 7012807 - DNA, 22 bp, Homo sapiens
gcctggctgggcaccaggggag

SEQ ID NO: 7012808 - DNA, 22 bp, Homo sapiens
tagggatggcagcatgtagctt

SEQ ID NO: 7012809 - DNA, 22 bp, Homo sapiens
cggcaattagacattcttcccg

SEQ ID NO: 7012810 - DNA, 22 bp, Homo sapiens
ggcttaatggttctttttctca

SEQ ID NO: 7012811 - DNA, 22 bp, Homo sapiens
gggaactgtttaacaggggttt

SEQ ID NO: 7012812 - DNA, 22 bp, Homo sapiens
atgagcaagccagttccagagt

SEQ ID NO: 7012813 - DNA, 22 bp, Homo sapiens
cctggcaccttcacagactact

SEQ ID NO: 7012814 - DNA, 22 bp, Homo sapiens
catggcctgcctcctcctggtg

SEQ ID NO: 7012815 - DNA, 22 bp, Homo sapiens
gcctgtctgcagggctgtcatt

SEQ ID NO: 7012816 - DNA, 18 bp, Homo sapiens
aggacacattcttccctc

SEQ ID NO: 7012817 - DNA, 22 bp, Homo sapiens
ggccatgcctggtctggcacca

SEQ ID NO: 7012818 - DNA, 22 bp, Homo sapiens
tcatgaacaaatgatttactaa

SEQ ID NO: 7012819 - DNA, 23 bp, Homo sapiens
aagagtttagagtcttgcagagt

SEQ ID NO: 7012820 - DNA, 22 bp, Homo sapiens
tagcacttgtgttatgccttgt

SEQ ID NO: 7012821 - DNA, 22 bp, Homo sapiens
acaggcttagggcttgggcccg

SEQ ID NO: 7012822 - DNA, 22 bp, Homo sapiens
caaaatgatgtgattttattgt

SEQ ID NO: 7012823 - DNA, 22 bp, Homo sapiens
aagatgttttaatatttcgagg

SEQ ID NO: 7012824 - DNA, 22 bp, Homo sapiens
cccacactcagttccccttggg

SEQ ID NO: 7012825 - DNA, 22 bp, Homo sapiens
ggagatgtagtgtcactggact

SEQ ID NO: 7012826 - DNA, 22 bp, Homo sapiens
gtctcctaaaccatcctggtac

SEQ ID NO: 7012827 - DNA, 22 bp, Homo sapiens
agacaccagaatctgttgagca

SEQ ID NO: 7012828 - DNA, 22 bp, Homo sapiens
gtatcctaggagcttccttagg

SEQ ID NO: 7012829 - DNA, 22 bp, Homo sapiens
ctgaggtcaggagttcaagctg

SEQ ID NO: 7012830 - DNA, 21 bp, Homo sapiens
ttcataggacgactgtctgtc

SEQ ID NO: 7012831 - DNA, 22 bp, Homo sapiens
ctctgagctcgtgcagtacttc

SEQ ID NO: 7012832 - DNA, 22 bp, Homo sapiens
ttcatgctgtgtctacaactta

SEQ ID NO: 7012833 - DNA, 22 bp, Homo sapiens
gggaagcatctgagggtccact

SEQ ID NO: 7012834 - DNA, 22 bp, Homo sapiens
atgatgtactagttaaatatta

SEQ ID NO: 7012835 - DNA, 22 bp, Homo sapiens
ttctggagtattcctggcagcc

SEQ ID NO: 7012836 - DNA, 22 bp, Homo sapiens
aagaacatgaacacaatgttta

SEQ ID NO: 7012837 - DNA, 22 bp, Homo sapiens
ccagatggaaatgatgttctca

SEQ ID NO: 7012838 - DNA, 22 bp, Homo sapiens
tcagctgctcaaatttatgtca

SEQ ID NO: 7012839 - DNA, 22 bp, Homo sapiens
gcaggcctgtcttgctcgccct

SEQ ID NO: 7012840 - DNA, 22 bp, Homo sapiens
gatgattttgttggtgattcaa

SEQ ID NO: 7012841 - DNA, 22 bp, Homo sapiens
ggtgtggatcatctgaggtcag

SEQ ID NO: 7012842 - DNA, 23 bp, Homo sapiens
tacattctgtatttttatagagt

SEQ ID NO: 7012843 - DNA, 22 bp, Homo sapiens
agtcagcatctgcactgtgctg

SEQ ID NO: 7012844 - DNA, 21 bp, Homo sapiens
gtgtctaccggatgagggaga

SEQ ID NO: 7012845 - DNA, 22 bp, Homo sapiens
ctctgcaggccttgagtgtggt

SEQ ID NO: 7012846 - DNA, 22 bp, Homo sapiens
ccatcagtgaaggagacagatt

SEQ ID NO: 7012847 - DNA, 18 bp, Homo sapiens
tccagctctgccacttac

SEQ ID NO: 7012848 - DNA, 22 bp, Homo sapiens
gagagttccagtaagtggattc

SEQ ID NO: 7012849 - DNA, 22 bp, Homo sapiens
tactatctggccctttacagaa

SEQ ID NO: 7012850 - DNA, 22 bp, Homo sapiens
ttgtttcttcatttagaagctt

SEQ ID NO: 7012851 - DNA, 22 bp, Homo sapiens
ttgtatgatcccatttagtgaa

SEQ ID NO: 7012852 - DNA, 22 bp, Homo sapiens
ccatggcttggaaagggaggtg

SEQ ID NO: 7012853 - DNA, 22 bp, Homo sapiens
tcctgcttcttcgagcttctgg

SEQ ID NO: 7012854 - DNA, 22 bp, Homo sapiens
tagaaagcaaaatcctaccaag

SEQ ID NO: 7012855 - DNA, 22 bp, Homo sapiens
tccaaagccgactgacatctga

SEQ ID NO: 7012856 - DNA, 23 bp, Homo sapiens
tgatagatgtcatggtcttgagt

SEQ ID NO: 7012857 - DNA, 22 bp, Homo sapiens
attacatgagagaatgtaaata

SEQ ID NO: 7012858 - DNA, 22 bp, Homo sapiens
tggtgtcatcatagagccttgt

SEQ ID NO: 7012859 - DNA, 21 bp, Homo sapiens
aagcttttcctgagagttgtc

SEQ ID NO: 7012860 - DNA, 22 bp, Homo sapiens
ctccagctttagctctccaggg

SEQ ID NO: 7012861 - DNA, 22 bp, Homo sapiens
tccaatgtgactatcagggagc

SEQ ID NO: 7012862 - DNA, 22 bp, Homo sapiens
ctcactgcaagttccacctacc

SEQ ID NO: 7012863 - DNA, 22 bp, Homo sapiens
aaccttcttgtgcagaactgta

SEQ ID NO: 7012864 - DNA, 22 bp, Homo sapiens
attctgaagttgcaggagaagc

SEQ ID NO: 7012865 - DNA, 22 bp, Homo sapiens
gtgaacagactgttctctacag

SEQ ID NO: 7012866 - DNA, 22 bp, Homo sapiens
ttggcactcagcaagtgttaat

SEQ ID NO: 7012867 - DNA, 22 bp, Homo sapiens
tggccagtagagctcagatagt

SEQ ID NO: 7012868 - DNA, 20 bp, Homo sapiens
agctggtcttaagtaactga

SEQ ID NO: 7012869 - DNA, 22 bp, Homo sapiens
gatggcagtggagttagtgatt

SEQ ID NO: 7012870 - DNA, 18 bp, Homo sapiens
tggaggcagagttctggc

SEQ ID NO: 7012871 - DNA, 22 bp, Homo sapiens
gtgaatggggcaggaaggatgg

SEQ ID NO: 7012872 - DNA, 22 bp, Homo sapiens
tactgagggtgaaaaataaagt

SEQ ID NO: 7012873 - DNA, 22 bp, Homo sapiens
ttcaaagggaaaagcaggctgg

SEQ ID NO: 7012874 - DNA, 22 bp, Homo sapiens
agttctaagtaaatattttata

SEQ ID NO: 7012875 - DNA, 22 bp, Homo sapiens
acatgagaaagcaggttagcaa

SEQ ID NO: 7012876 - DNA, 22 bp, Homo sapiens
aggtgtcatttctctgcaggtg

SEQ ID NO: 7012877 - DNA, 22 bp, Homo sapiens
aacatgattggaaaatgctgtc

SEQ ID NO: 7012878 - DNA, 22 bp, Homo sapiens
acatgtactgttggtgaagagg

SEQ ID NO: 7012879 - DNA, 22 bp, Homo sapiens
aatgtttggctagatagatgga

SEQ ID NO: 7012880 - DNA, 22 bp, Homo sapiens
gcttcccatagtggaattcggg

SEQ ID NO: 7012881 - DNA, 22 bp, Homo sapiens
ttgtaaatgaccttttctaatt

SEQ ID NO: 7012882 - DNA, 22 bp, Homo sapiens
tgcagccccccagatggccgta

SEQ ID NO: 7012883 - DNA, 22 bp, Homo sapiens
agaaagtgaccttgaaaactgg

SEQ ID NO: 7012884 - DNA, 22 bp, Homo sapiens
ttaaggaatgtgcagtttatat

SEQ ID NO: 7012885 - DNA, 22 bp, Homo sapiens
cacacgatgtgaattcttgccc

SEQ ID NO: 7012886 - DNA, 22 bp, Homo sapiens
agagaggtttgctggaagattc

SEQ ID NO: 7012887 - DNA, 22 bp, Homo sapiens
acagtccccataccacctgtcc

SEQ ID NO: 7012888 - DNA, 22 bp, Homo sapiens
ttcagtttctaaatgctcctct

SEQ ID NO: 7012889 - DNA, 22 bp, Homo sapiens
ggaggcagaacttcccgtcagt

SEQ ID NO: 7012890 - DNA, 22 bp, Homo sapiens
agtcctaggccctgctccagat

SEQ ID NO: 7012891 - DNA, 22 bp, Homo sapiens
gcatcatttgtcctctaggact

SEQ ID NO: 7012892 - DNA, 22 bp, Homo sapiens
aaatactgctgctattcctttt

SEQ ID NO: 7012893 - DNA, 22 bp, Homo sapiens
ttggaactctaccaacagtagt

SEQ ID NO: 7012894 - DNA, 22 bp, Homo sapiens
tatcaacaaaggccttgtgttt

SEQ ID NO: 7012895 - DNA, 22 bp, Homo sapiens
agtcttctgaataagaatcact

SEQ ID NO: 7012896 - DNA, 22 bp, Homo sapiens
ctggatagcaagcaaaaaattt

SEQ ID NO: 7012897 - DNA, 22 bp, Homo sapiens
agtgtgctagcaagaactgggg

SEQ ID NO: 7012898 - DNA, 22 bp, Homo sapiens
tgattcaactttcataacaaaa

SEQ ID NO: 7012899 - DNA, 22 bp, Homo sapiens
ggtcgctgtgtaggttcagcta

SEQ ID NO: 7012900 - DNA, 22 bp, Homo sapiens
tgaagcagcaaatgatgggaga

SEQ ID NO: 7012901 - DNA, 22 bp, Homo sapiens
ctttctctgtggtgaggagggt

SEQ ID NO: 7012902 - DNA, 22 bp, Homo sapiens
ttattaggaactcaggattttt

SEQ ID NO: 7012903 - DNA, 22 bp, Homo sapiens
tctggggcagttactggggcct

SEQ ID NO: 7012904 - DNA, 22 bp, Homo sapiens
gatacccagcaaaatgcaggag

SEQ ID NO: 7012905 - DNA, 22 bp, Homo sapiens
tcctctgactcccatggcccgc

SEQ ID NO: 7012906 - DNA, 22 bp, Homo sapiens
tcccccaggctggagtgcagtg

SEQ ID NO: 7012907 - DNA, 22 bp, Homo sapiens
agggccctctgggcactgtggc

SEQ ID NO: 7012908 - DNA, 22 bp, Homo sapiens
gctttctacaccaagtatgtgc

SEQ ID NO: 7012909 - DNA, 22 bp, Homo sapiens
tgggaccaagtcatttctttag

SEQ ID NO: 7012910 - DNA, 22 bp, Homo sapiens
cagcatggagacaaagtgggca

SEQ ID NO: 7012911 - DNA, 22 bp, Homo sapiens
ttcctggccccatccatcttca

SEQ ID NO: 7012912 - DNA, 23 bp, Homo sapiens
taaagacagccttcaggattctg

SEQ ID NO: 7012913 - DNA, 22 bp, Homo sapiens
gacaatgtaaatcaggatagca

SEQ ID NO: 7012914 - DNA, 22 bp, Homo sapiens
aggcagtcagccctgctagggt

SEQ ID NO: 7012915 - DNA, 22 bp, Homo sapiens
gtctgccctcacatgcactctt

SEQ ID NO: 7012916 - DNA, 22 bp, Homo sapiens
atacaggttgaattttctttta

SEQ ID NO: 7012917 - DNA, 22 bp, Homo sapiens
ggcatgagaggtcctggggatt

SEQ ID NO: 7012918 - DNA, 22 bp, Homo sapiens
caaaggcaggtgctgaatattc

SEQ ID NO: 7012919 - DNA, 22 bp, Homo sapiens
ctccctggaggtgagctggcac

SEQ ID NO: 7012920 - DNA, 22 bp, Homo sapiens
tcagggttgctgtgatcagtcc

SEQ ID NO: 7012921 - DNA, 22 bp, Homo sapiens
tttctgtcattactttcctccc

SEQ ID NO: 7012922 - DNA, 22 bp, Homo sapiens
aaactaagggagatgtgggctg

SEQ ID NO: 7012923 - DNA, 22 bp, Homo sapiens
gctattactgatggagatttag

SEQ ID NO: 7012924 - DNA, 23 bp, Homo sapiens
ccagagattgttacacagtaggc

SEQ ID NO: 7012925 - DNA, 22 bp, Homo sapiens
gctctagattgttacaaagttc

SEQ ID NO: 7012926 - DNA, 17 bp, Homo sapiens
ctagagagaaagagcta

SEQ ID NO: 7012927 - DNA, 22 bp, Homo sapiens
aggcactttttgcattttagaa

SEQ ID NO: 7012928 - DNA, 22 bp, Homo sapiens
attgccatgctcatagggtcga

SEQ ID NO: 7012929 - DNA, 22 bp, Homo sapiens
caatgtactacaaagattgtca

SEQ ID NO: 7012930 - DNA, 22 bp, Homo sapiens
actttgtaatagtttaaggtca

SEQ ID NO: 7012931 - DNA, 22 bp, Homo sapiens
ctcggcaggtggaggttgtagt

SEQ ID NO: 7012932 - DNA, 22 bp, Homo sapiens
gaagttagtgtaatgcagggtg

SEQ ID NO: 7012933 - DNA, 22 bp, Homo sapiens
aacaaccaaaaagatgaatgta

SEQ ID NO: 7012934 - DNA, 22 bp, Homo sapiens
aaagctctttgtatagtggaat

SEQ ID NO: 7012935 - DNA, 23 bp, Homo sapiens
actttaagagtatatgacttccc

SEQ ID NO: 7012936 - DNA, 22 bp, Homo sapiens
tgcagcaccacacctggctaat

SEQ ID NO: 7012937 - DNA, 22 bp, Homo sapiens
ggaagttcagttgctagtttca

SEQ ID NO: 7012938 - DNA, 18 bp, Homo sapiens
aagcagacagcagacagt

SEQ ID NO: 7012939 - DNA, 22 bp, Homo sapiens
tccagagtttgagtctccttcc

SEQ ID NO: 7012940 - DNA, 23 bp, Homo sapiens
gcctgtgcctatgcccagctctg

SEQ ID NO: 7012941 - DNA, 22 bp, Homo sapiens
tcctgttagtgttagacttccc

SEQ ID NO: 7012942 - DNA, 22 bp, Homo sapiens
tttttagtagaggtgggtttca

SEQ ID NO: 7012943 - DNA, 19 bp, Homo sapiens
tccagggctttatggcttt

SEQ ID NO: 7012944 - DNA, 18 bp, Homo sapiens
tccagagctactgtggtg

SEQ ID NO: 7012945 - DNA, 22 bp, Homo sapiens
tttggcaggtggcagctctggg

SEQ ID NO: 7012946 - DNA, 22 bp, Homo sapiens
atttgctttgggacagcttaaa

SEQ ID NO: 7012947 - DNA, 19 bp, Homo sapiens
aatcaggagcctaattagg

SEQ ID NO: 7012948 - DNA, 22 bp, Homo sapiens
tgccctgcccttgctatttcta

SEQ ID NO: 7012949 - DNA, 22 bp, Homo sapiens
agcagacaggctgccacagtgc

SEQ ID NO: 7012950 - DNA, 22 bp, Homo sapiens
cattacaaacatgttaagattt

SEQ ID NO: 7012951 - DNA, 19 bp, Homo sapiens
ctgggtcctgttcttttac

SEQ ID NO: 7012952 - DNA, 22 bp, Homo sapiens
atctcttcccaactccacattc

SEQ ID NO: 7012953 - DNA, 22 bp, Homo sapiens
aatgtacaccgtgggtttttta

SEQ ID NO: 7012954 - DNA, 22 bp, Homo sapiens
tgaaggagaattaataggcatt

SEQ ID NO: 7012955 - DNA, 22 bp, Homo sapiens
ccattccatgtgctacacataa

SEQ ID NO: 7012956 - DNA, 22 bp, Homo sapiens
tggcaagctcgtttgggtcaga

SEQ ID NO: 7012957 - DNA, 22 bp, Homo sapiens
tggtttcacactgcatggtgta

SEQ ID NO: 7012958 - DNA, 22 bp, Homo sapiens
ccagcagaggcatcatccttcc

SEQ ID NO: 7012959 - DNA, 22 bp, Homo sapiens
tagatgaactgcctctcagcaa

SEQ ID NO: 7012960 - DNA, 22 bp, Homo sapiens
taaattaccctttagggaattg

SEQ ID NO: 7012961 - DNA, 22 bp, Homo sapiens
ctggtcagctgaagccccacac

SEQ ID NO: 7012962 - DNA, 22 bp, Homo sapiens
tcttcagggtatgggaaaggga

SEQ ID NO: 7012963 - DNA, 22 bp, Homo sapiens
taagtactaatattagtaactc

SEQ ID NO: 7012964 - DNA, 22 bp, Homo sapiens
tcctgagaggtttataacgcag

SEQ ID NO: 7012965 - DNA, 22 bp, Homo sapiens
agctgtgcctattcgtggcaag

SEQ ID NO: 7012966 - DNA, 22 bp, Homo sapiens
ctacctatgtgccctctggcca

SEQ ID NO: 7012967 - DNA, 21 bp, Homo sapiens
tctttgattaagcttgactag

SEQ ID NO: 7012968 - DNA, 22 bp, Homo sapiens
acatcagtcttttgcatacata

SEQ ID NO: 7012969 - DNA, 22 bp, Homo sapiens
gttgggctgaagtgtgtgctta

SEQ ID NO: 7012970 - DNA, 22 bp, Homo sapiens
tcactgtgcacatatgataggt

SEQ ID NO: 7012971 - DNA, 22 bp, Homo sapiens
agtgatggtgagtgagaagctc

SEQ ID NO: 7012972 - DNA, 22 bp, Homo sapiens
cggtggtcccaagagggtggca

SEQ ID NO: 7012973 - DNA, 22 bp, Homo sapiens
tcagcaggcagtgggtcacaat

SEQ ID NO: 7012974 - DNA, 22 bp, Homo sapiens
cataggctgggctctctccaca

SEQ ID NO: 7012975 - DNA, 22 bp, Homo sapiens
tttcttctctgattaaggctca

SEQ ID NO: 7012976 - DNA, 23 bp, Homo sapiens
ctctgcaccaggtggttttcagc

SEQ ID NO: 7012977 - DNA, 22 bp, Homo sapiens
aaagaagtgttgaatttgcaag

SEQ ID NO: 7012978 - DNA, 22 bp, Homo sapiens
tgtcatatgctgtcatagccat

SEQ ID NO: 7012979 - DNA, 22 bp, Homo sapiens
ggcatttttgacaaagagcaat

SEQ ID NO: 7012980 - DNA, 22 bp, Homo sapiens
tgttattctgatgtgcaggata

SEQ ID NO: 7012981 - DNA, 22 bp, Homo sapiens
ctggagagagaaaaagccttaa

SEQ ID NO: 7012982 - DNA, 22 bp, Homo sapiens
acgaggttggagagttgtttgg

SEQ ID NO: 7012983 - DNA, 20 bp, Homo sapiens
gcagcagacagacaggggac

SEQ ID NO: 7012984 - DNA, 21 bp, Homo sapiens
tgatcatttgtgtaaaggaga

SEQ ID NO: 7012985 - DNA, 22 bp, Homo sapiens
tgcagataatactagaacttac

SEQ ID NO: 7012986 - DNA, 22 bp, Homo sapiens
ccaggtgtaagacatggtccta

SEQ ID NO: 7012987 - DNA, 20 bp, Homo sapiens
tgtgtccatcatctgggcac

SEQ ID NO: 7012988 - DNA, 22 bp, Homo sapiens
tttcatgtctgaattctttagt

SEQ ID NO: 7012989 - DNA, 18 bp, Homo sapiens
gcaagccctctccattaa

SEQ ID NO: 7012990 - DNA, 22 bp, Homo sapiens
aagtgcatacactagttaattg

SEQ ID NO: 7012991 - DNA, 22 bp, Homo sapiens
ctagaacctaggagtactaaag

SEQ ID NO: 7012992 - DNA, 22 bp, Homo sapiens
ctggctcctgaggcttggcccc

SEQ ID NO: 7012993 - DNA, 22 bp, Homo sapiens
aggcttaaatgctcatatcagt

SEQ ID NO: 7012994 - DNA, 22 bp, Homo sapiens
tcagaacatggcatgttccatc

SEQ ID NO: 7012995 - DNA, 17 bp, Homo sapiens
tctccaggacgagctca

SEQ ID NO: 7012996 - DNA, 22 bp, Homo sapiens
actgcactccatcctgggcaac

SEQ ID NO: 7012997 - DNA, 21 bp, Homo sapiens
gtgcagaggaatgtagggggc

SEQ ID NO: 7012998 - DNA, 22 bp, Homo sapiens
tgtgcagtttctatgttgtcca

SEQ ID NO: 7012999 - DNA, 22 bp, Homo sapiens
tttgtgaacactgcgcagaact

SEQ ID NO: 7013000 - DNA, 22 bp, Homo sapiens
aagagtatagctttaggattga

SEQ ID NO: 7013001 - DNA, 22 bp, Homo sapiens
gatggcaaactgggaccagagg

SEQ ID NO: 7013002 - DNA, 22 bp, Homo sapiens
ttcagtgtccctagtagaagtt

SEQ ID NO: 7013003 - DNA, 22 bp, Homo sapiens
cgccgcctgctgcagcagctgt

SEQ ID NO: 7013004 - DNA, 21 bp, Homo sapiens
gggctggaggatgggaagccc

SEQ ID NO: 7013005 - DNA, 22 bp, Homo sapiens
ttgcataaaagagtatatctta

SEQ ID NO: 7013006 - DNA, 21 bp, Homo sapiens
gcagatgggagtcatcaggct

SEQ ID NO: 7013007 - DNA, 22 bp, Homo sapiens
tattgctgctattgtcagttca

SEQ ID NO: 7013008 - DNA, 22 bp, Homo sapiens
ttcagaatgagaatggatgggt

SEQ ID NO: 7013009 - DNA, 22 bp, Homo sapiens
aggacagtggcagggtgacaga

SEQ ID NO: 7013010 - DNA, 22 bp, Homo sapiens
atgtctctttagagcaacagta

SEQ ID NO: 7013011 - DNA, 22 bp, Homo sapiens
agcctcagggctctgcgcagac

SEQ ID NO: 7013012 - DNA, 22 bp, Homo sapiens
ccttcattgcatctttaagaga

SEQ ID NO: 7013013 - DNA, 22 bp, Homo sapiens
tgtgacccccgtcacggctgct

SEQ ID NO: 7013014 - DNA, 22 bp, Homo sapiens
acatgtttaagtttgttatatg

SEQ ID NO: 7013015 - DNA, 19 bp, Homo sapiens
atgaggaactgaggctcag

SEQ ID NO: 7013016 - DNA, 22 bp, Homo sapiens
atacagagacacttgagactgg

SEQ ID NO: 7013017 - DNA, 22 bp, Homo sapiens
ctcagaagaacccagggtccca

SEQ ID NO: 7013018 - DNA, 22 bp, Homo sapiens
tcaacatatcatatctatcggt

SEQ ID NO: 7013019 - DNA, 22 bp, Homo sapiens
tcagaatctttctagagtctag

SEQ ID NO: 7013020 - DNA, 22 bp, Homo sapiens
gatggcacacagacatccccgc

SEQ ID NO: 7013021 - DNA, 22 bp, Homo sapiens
ctgactgtctcttctcccatga

SEQ ID NO: 7013022 - DNA, 22 bp, Homo sapiens
gtgtatgcagaaacatgcaaag

SEQ ID NO: 7013023 - DNA, 22 bp, Homo sapiens
aagcactgtgcctcatatctga

SEQ ID NO: 7013024 - DNA, 22 bp, Homo sapiens
taggctccagtgtgtggcgagt

SEQ ID NO: 7013025 - DNA, 22 bp, Homo sapiens
actatgtatactagatgtgtaa

SEQ ID NO: 7013026 - DNA, 22 bp, Homo sapiens
tctccataggcagttcataaca

SEQ ID NO: 7013027 - DNA, 22 bp, Homo sapiens
tgagccaggagtttgaggctgt

SEQ ID NO: 7013028 - DNA, 22 bp, Homo sapiens
tgcccctgatgcctagaacaga

SEQ ID NO: 7013029 - DNA, 22 bp, Homo sapiens
taggtacattattagatgcatg

SEQ ID NO: 7013030 - DNA, 22 bp, Homo sapiens
ttacattaggtcaagctgccaa

SEQ ID NO: 7013031 - DNA, 22 bp, Homo sapiens
ggctggctgataaagggttgag

SEQ ID NO: 7013032 - DNA, 18 bp, Homo sapiens
agccctccaggtgattct

SEQ ID NO: 7013033 - DNA, 22 bp, Homo sapiens
ttatcttgagtattgagattct

SEQ ID NO: 7013034 - DNA, 22 bp, Homo sapiens
agctcttttgctctccaagttt

SEQ ID NO: 7013035 - DNA, 22 bp, Homo sapiens
ttgattctatggctccgggagt

SEQ ID NO: 7013036 - DNA, 22 bp, Homo sapiens
tgcgctgtggcagggcaggatg

SEQ ID NO: 7013037 - DNA, 22 bp, Homo sapiens
cctcactttcctttctcctggg

SEQ ID NO: 7013038 - DNA, 22 bp, Homo sapiens
gatcaggagatggcctcagacc

SEQ ID NO: 7013039 - DNA, 22 bp, Homo sapiens
aaggatgtgactcagtcagcta

SEQ ID NO: 7013040 - DNA, 23 bp, Homo sapiens
aagctggctgggagcagaaggga

SEQ ID NO: 7013041 - DNA, 22 bp, Homo sapiens
tgtgcctgtcccgcattctggt

SEQ ID NO: 7013042 - DNA, 22 bp, Homo sapiens
tggcctgtggcacgtgctccat

SEQ ID NO: 7013043 - DNA, 18 bp, Homo sapiens
agaattattcttgtcctc

SEQ ID NO: 7013044 - DNA, 21 bp, Homo sapiens
tgaagccaggatcacgattct

SEQ ID NO: 7013045 - DNA, 22 bp, Homo sapiens
tgaatcaaagctgaagttttca

SEQ ID NO: 7013046 - DNA, 22 bp, Homo sapiens
agcagaatctgtccttggaaga

SEQ ID NO: 7013047 - DNA, 22 bp, Homo sapiens
tgttgagactgagggagtcagc

SEQ ID NO: 7013048 - DNA, 22 bp, Homo sapiens
gctttatgagtgaggcaggata

SEQ ID NO: 7013049 - DNA, 22 bp, Homo sapiens
gtgagtttatgccctgccctat

SEQ ID NO: 7013050 - DNA, 22 bp, Homo sapiens
tctcagagggaaaggccaattt

SEQ ID NO: 7013051 - DNA, 22 bp, Homo sapiens
tacacaactgacaaccattctg

SEQ ID NO: 7013052 - DNA, 23 bp, Homo sapiens
tctttttaagagatctagtgacg

SEQ ID NO: 7013053 - DNA, 22 bp, Homo sapiens
cccagcccatctcaaaggtcta

SEQ ID NO: 7013054 - DNA, 22 bp, Homo sapiens
tgtcatggtgctatttaattag

SEQ ID NO: 7013055 - DNA, 22 bp, Homo sapiens
tctagctgtggtcgagtgagga

SEQ ID NO: 7013056 - DNA, 22 bp, Homo sapiens
atgttcaagtacctttgtgtct

SEQ ID NO: 7013057 - DNA, 22 bp, Homo sapiens
ttaatgaaaggcagtttggaac

SEQ ID NO: 7013058 - DNA, 22 bp, Homo sapiens
cacaatttccaagtcatgttat

SEQ ID NO: 7013059 - DNA, 22 bp, Homo sapiens
tggacatgacctcgagcgagat

SEQ ID NO: 7013060 - DNA, 22 bp, Homo sapiens
ccaaagtattaaatcttagcaa

SEQ ID NO: 7013061 - DNA, 22 bp, Homo sapiens
ccaagaggtaatacgagatatc

SEQ ID NO: 7013062 - DNA, 22 bp, Homo sapiens
agaaaacagaaagtcattggtg

SEQ ID NO: 7013063 - DNA, 22 bp, Homo sapiens
ttgaagaaattattttatatag

SEQ ID NO: 7013064 - DNA, 20 bp, Homo sapiens
cagcttggatgagaggctga

SEQ ID NO: 7013065 - DNA, 22 bp, Homo sapiens
agtgtgtacatttggtgcagtt

SEQ ID NO: 7013066 - DNA, 22 bp, Homo sapiens
atgtatttctatgtagtgaaga

SEQ ID NO: 7013067 - DNA, 22 bp, Homo sapiens
ttcacattctcacaagaggaaa

SEQ ID NO: 7013068 - DNA, 22 bp, Homo sapiens
actgcagcctttgggctcataa

SEQ ID NO: 7013069 - DNA, 22 bp, Homo sapiens
taatacttttgccttgtattca

SEQ ID NO: 7013070 - DNA, 22 bp, Homo sapiens
tggttacacagcatgtggactt

SEQ ID NO: 7013071 - DNA, 22 bp, Homo sapiens
ttgtgcaatcccctcattttat

SEQ ID NO: 7013072 - DNA, 22 bp, Homo sapiens
acagtagagtaaaagggagcct

SEQ ID NO: 7013073 - DNA, 22 bp, Homo sapiens
tgccctgcatgcagggagctgt

SEQ ID NO: 7013074 - DNA, 23 bp, Homo sapiens
ttcatagagagatggtgagaatt

SEQ ID NO: 7013075 - DNA, 22 bp, Homo sapiens
gtgcaattcactgttatgtctg

SEQ ID NO: 7013076 - DNA, 22 bp, Homo sapiens
agagattcctttggggaaagca

SEQ ID NO: 7013077 - DNA, 22 bp, Homo sapiens
agccacacttgccaggggaagg

SEQ ID NO: 7013078 - DNA, 22 bp, Homo sapiens
caggcaccagtgagaagggcct

SEQ ID NO: 7013079 - DNA, 20 bp, Homo sapiens
taggacagggcctggcttct

SEQ ID NO: 7013080 - DNA, 22 bp, Homo sapiens
atgtatgtttcatatcttcatt

SEQ ID NO: 7013081 - DNA, 22 bp, Homo sapiens
gtggcacagtgggagagcccca

SEQ ID NO: 7013082 - DNA, 22 bp, Homo sapiens
aatgtccaccgtgatgatggaa

SEQ ID NO: 7013083 - DNA, 22 bp, Homo sapiens
agctatgtgatttaaacaaggt

SEQ ID NO: 7013084 - DNA, 22 bp, Homo sapiens
taagatgactacttaccactga

SEQ ID NO: 7013085 - DNA, 22 bp, Homo sapiens
tgagcagatgtctaacttttac

SEQ ID NO: 7013086 - DNA, 19 bp, Homo sapiens
catctctgcaaggagctgc

SEQ ID NO: 7013087 - DNA, 22 bp, Homo sapiens
cttcaaatccccctgagtttga

SEQ ID NO: 7013088 - DNA, 22 bp, Homo sapiens
gctgctttaggttgagctcagc

SEQ ID NO: 7013089 - DNA, 21 bp, Homo sapiens
ggccacaagcggaggagccgc

SEQ ID NO: 7013090 - DNA, 22 bp, Homo sapiens
ttttgaaagagtcctgctacag

SEQ ID NO: 7013091 - DNA, 22 bp, Homo sapiens
gaatcttatttttaaatcttcc

SEQ ID NO: 7013092 - DNA, 22 bp, Homo sapiens
acagagcaataacagggagagg

SEQ ID NO: 7013093 - DNA, 22 bp, Homo sapiens
tttcagatggaggtttaggaca

SEQ ID NO: 7013094 - DNA, 22 bp, Homo sapiens
ttcatctggaatttatgttata

SEQ ID NO: 7013095 - DNA, 22 bp, Homo sapiens
tgaatggatataacaacagtgt

SEQ ID NO: 7013096 - DNA, 21 bp, Homo sapiens
gcaattcgctatgatggtggc

SEQ ID NO: 7013097 - DNA, 19 bp, Homo sapiens
ttctcattcctttccactt

SEQ ID NO: 7013098 - DNA, 22 bp, Homo sapiens
agtgtttcacagcactttttct

SEQ ID NO: 7013099 - DNA, 22 bp, Homo sapiens
ccagaggtgctgggagaggtct

SEQ ID NO: 7013100 - DNA, 20 bp, Homo sapiens
atccctggccttaaggagtg

SEQ ID NO: 7013101 - DNA, 22 bp, Homo sapiens
tgcttctgttctttcacctacg

SEQ ID NO: 7013102 - DNA, 22 bp, Homo sapiens
tgcttccttgagctctccaatc

SEQ ID NO: 7013103 - DNA, 22 bp, Homo sapiens
gggatctgacttgctggtgggt

SEQ ID NO: 7013104 - DNA, 22 bp, Homo sapiens
ctgggcaggatacttcatggga

SEQ ID NO: 7013105 - DNA, 22 bp, Homo sapiens
gggcctgagactgagggtgagg

SEQ ID NO: 7013106 - DNA, 22 bp, Homo sapiens
tgcagggtatccttgtctctgc

SEQ ID NO: 7013107 - DNA, 22 bp, Homo sapiens
tggtacacatgtccaaggtcag

SEQ ID NO: 7013108 - DNA, 22 bp, Homo sapiens
ccaatcctgatctaatccaact

SEQ ID NO: 7013109 - DNA, 18 bp, Homo sapiens
tcactgagccgcctctct

SEQ ID NO: 7013110 - DNA, 22 bp, Homo sapiens
attgtatgcagcattaagcaat

SEQ ID NO: 7013111 - DNA, 22 bp, Homo sapiens
agatcattaaccacctgttctg

SEQ ID NO: 7013112 - DNA, 22 bp, Homo sapiens
cctcttgattggttggaagcgg

SEQ ID NO: 7013113 - DNA, 22 bp, Homo sapiens
caaaggcaggccccctgtgcag

SEQ ID NO: 7013114 - DNA, 22 bp, Homo sapiens
ggccaacgactgggagaacctc

SEQ ID NO: 7013115 - DNA, 22 bp, Homo sapiens
ggatgtctgtcattatgctttc

SEQ ID NO: 7013116 - DNA, 22 bp, Homo sapiens
tctgggaactgagctcccctag

SEQ ID NO: 7013117 - DNA, 16 bp, Homo sapiens
cttggaacttgttggg

SEQ ID NO: 7013118 - DNA, 22 bp, Homo sapiens
attatgctggtttacacatttt

SEQ ID NO: 7013119 - DNA, 22 bp, Homo sapiens
cacagcctccttcagagagcat

SEQ ID NO: 7013120 - DNA, 22 bp, Homo sapiens
agtgccaaatcgagggctctga

SEQ ID NO: 7013121 - DNA, 22 bp, Homo sapiens
agtagaataattggattacagt

SEQ ID NO: 7013122 - DNA, 23 bp, Homo sapiens
cttccagtactgcacactcaagg

SEQ ID NO: 7013123 - DNA, 22 bp, Homo sapiens
agggagccaggaacgcaggtcg

SEQ ID NO: 7013124 - DNA, 22 bp, Homo sapiens
ctctgggtgagacagacctggt

SEQ ID NO: 7013125 - DNA, 22 bp, Homo sapiens
aggagccaagcagaactaagga

SEQ ID NO: 7013126 - DNA, 22 bp, Homo sapiens
ccctctgctcaggtgcataggc

SEQ ID NO: 7013127 - DNA, 22 bp, Homo sapiens
ttatgtgcagaacctgggcttc

SEQ ID NO: 7013128 - DNA, 22 bp, Homo sapiens
aggcccagagcaggaaagggtt

SEQ ID NO: 7013129 - DNA, 22 bp, Homo sapiens
atggcatttgtcaagataagta

SEQ ID NO: 7013130 - DNA, 20 bp, Homo sapiens
ctgaaaggagtcgggatgtc

SEQ ID NO: 7013131 - DNA, 22 bp, Homo sapiens
gggaaagaccctgagtcttatt

SEQ ID NO: 7013132 - DNA, 22 bp, Homo sapiens
gccactgattccaagtcaattt

SEQ ID NO: 7013133 - DNA, 22 bp, Homo sapiens
caagcagacagtaggcctagaa

SEQ ID NO: 7013134 - DNA, 22 bp, Homo sapiens
tcccagggttacagccagggca

SEQ ID NO: 7013135 - DNA, 22 bp, Homo sapiens
atccttggcacagtggaattca

SEQ ID NO: 7013136 - DNA, 22 bp, Homo sapiens
ttcattgattccaggctcttct

SEQ ID NO: 7013137 - DNA, 22 bp, Homo sapiens
ctaaactagcagttctgcaaca

SEQ ID NO: 7013138 - DNA, 22 bp, Homo sapiens
tccaggcataatgcccagtggt

SEQ ID NO: 7013139 - DNA, 22 bp, Homo sapiens
tgctgagcgcatccggcggccg

SEQ ID NO: 7013140 - DNA, 22 bp, Homo sapiens
tgaggtgaagagtggagctcag

SEQ ID NO: 7013141 - DNA, 22 bp, Homo sapiens
tgtaggagtccaatcaggagac

SEQ ID NO: 7013142 - DNA, 22 bp, Homo sapiens
agatgcgtgtgtactgtaagtc

SEQ ID NO: 7013143 - DNA, 22 bp, Homo sapiens
cagagaacattcagagctgtag

SEQ ID NO: 7013144 - DNA, 17 bp, Homo sapiens
tggagctgcgtgtgttc

SEQ ID NO: 7013145 - DNA, 22 bp, Homo sapiens
ctgtgggagggaaggcgcggcc

SEQ ID NO: 7013146 - DNA, 22 bp, Homo sapiens
ggcagccttgagggaggcctgg

SEQ ID NO: 7013147 - DNA, 22 bp, Homo sapiens
ctgaatgcctgcagagccagag

SEQ ID NO: 7013148 - DNA, 22 bp, Homo sapiens
accctggactggggctgaggct

SEQ ID NO: 7013149 - DNA, 22 bp, Homo sapiens
taaagccatactgaaagccact

SEQ ID NO: 7013150 - DNA, 22 bp, Homo sapiens
gttggcatagtcttttataatt

SEQ ID NO: 7013151 - DNA, 22 bp, Homo sapiens
cagcatgcagcccctggcagct

SEQ ID NO: 7013152 - DNA, 22 bp, Homo sapiens
ttttggttctgggatacagaga

SEQ ID NO: 7013153 - DNA, 22 bp, Homo sapiens
ttagttgtaaaatggaatttgt

SEQ ID NO: 7013154 - DNA, 22 bp, Homo sapiens
cttgctgtcccttggtatgaac

SEQ ID NO: 7013155 - DNA, 22 bp, Homo sapiens
agctttgcactgagacagctca

SEQ ID NO: 7013156 - DNA, 22 bp, Homo sapiens
tggacaatcaatggaggtaagt

SEQ ID NO: 7013157 - DNA, 22 bp, Homo sapiens
aatgacatgctttttaattata

SEQ ID NO: 7013158 - DNA, 22 bp, Homo sapiens
tggctttatgtactcaagtcac

SEQ ID NO: 7013159 - DNA, 22 bp, Homo sapiens
cctcaggatacaggagccacag

SEQ ID NO: 7013160 - DNA, 22 bp, Homo sapiens
ctactttaacaattcgcaagaa

SEQ ID NO: 7013161 - DNA, 22 bp, Homo sapiens
aggcagtgttcttctaagggca

SEQ ID NO: 7013162 - DNA, 22 bp, Homo sapiens
tctccctggagccctgaagcat

SEQ ID NO: 7013163 - DNA, 22 bp, Homo sapiens
tggtgggtcggctgggagagct

SEQ ID NO: 7013164 - DNA, 22 bp, Homo sapiens
catccaggctggagtacagtgg

SEQ ID NO: 7013165 - DNA, 22 bp, Homo sapiens
cttccgtaagagagggagatga

SEQ ID NO: 7013166 - DNA, 22 bp, Homo sapiens
ccacattcatcagttgttaatg

SEQ ID NO: 7013167 - DNA, 22 bp, Homo sapiens
ctgcagctaaggaatgtggttg

SEQ ID NO: 7013168 - DNA, 22 bp, Homo sapiens
accctttgtcaagcacagaaga

SEQ ID NO: 7013169 - DNA, 22 bp, Homo sapiens
gaggtctgagtgcggaaagcct

SEQ ID NO: 7013170 - DNA, 22 bp, Homo sapiens
ggtgacttgaaggcaactgaag

SEQ ID NO: 7013171 - DNA, 21 bp, Homo sapiens
ggacagaggagaaggcaccct

SEQ ID NO: 7013172 - DNA, 22 bp, Homo sapiens
tactgaggctggcagccccttg

SEQ ID NO: 7013173 - DNA, 19 bp, Homo sapiens
tgcaagctttttcttgtta

SEQ ID NO: 7013174 - DNA, 22 bp, Homo sapiens
ccttccagatgtaagagctgat

SEQ ID NO: 7013175 - DNA, 22 bp, Homo sapiens
tagggactagtttcaaggctaa

SEQ ID NO: 7013176 - DNA, 22 bp, Homo sapiens
tgtgtacaagagtgtttactgt

SEQ ID NO: 7013177 - DNA, 22 bp, Homo sapiens
aatgataccgccaatattacca

SEQ ID NO: 7013178 - DNA, 22 bp, Homo sapiens
atgctgtggggagtgagggtag

SEQ ID NO: 7013179 - DNA, 22 bp, Homo sapiens
gctgttgcaatcaaggccatgg

SEQ ID NO: 7013180 - DNA, 17 bp, Homo sapiens
tcagtctctgtcctgga

SEQ ID NO: 7013181 - DNA, 22 bp, Homo sapiens
gatttcttggcccactctcaga

SEQ ID NO: 7013182 - DNA, 22 bp, Homo sapiens
cagtgggaaagtgaagagcatt

SEQ ID NO: 7013183 - DNA, 22 bp, Homo sapiens
gggaggtgaaaggttgctgcag

SEQ ID NO: 7013184 - DNA, 22 bp, Homo sapiens
tgggtgcttcgtcagctctgag

SEQ ID NO: 7013185 - DNA, 23 bp, Homo sapiens
atgctacaccaacacaggggaat

SEQ ID NO: 7013186 - DNA, 22 bp, Homo sapiens
gttcttcagaggggaaagaacc

SEQ ID NO: 7013187 - DNA, 22 bp, Homo sapiens
cccatggcttaggagggagtgt

SEQ ID NO: 7013188 - DNA, 22 bp, Homo sapiens
ttcattctgggctctaaggaac

SEQ ID NO: 7013189 - DNA, 17 bp, Homo sapiens
atatgctttgtatttat

SEQ ID NO: 7013190 - DNA, 22 bp, Homo sapiens
actgtgcatggtatccttgatg

SEQ ID NO: 7013191 - DNA, 22 bp, Homo sapiens
tctgatactgcaaaaatgtagg

SEQ ID NO: 7013192 - DNA, 22 bp, Homo sapiens
ctattgcccaaatctcaaccgc

SEQ ID NO: 7013193 - DNA, 22 bp, Homo sapiens
cccaggaaatgaacttctgatt

SEQ ID NO: 7013194 - DNA, 20 bp, Homo sapiens
catgcaacagattatttccc

SEQ ID NO: 7013195 - DNA, 22 bp, Homo sapiens
ggcaataatctactctgccact

SEQ ID NO: 7013196 - DNA, 22 bp, Homo sapiens
cagcatgcttgggggagggagc

SEQ ID NO: 7013197 - DNA, 16 bp, Homo sapiens
gctgtaaaaggattca

SEQ ID NO: 7013198 - DNA, 22 bp, Homo sapiens
tgctctagagctattggcttcc

SEQ ID NO: 7013199 - DNA, 22 bp, Homo sapiens
tcacatgaggttatgacaaagc

SEQ ID NO: 7013200 - DNA, 22 bp, Homo sapiens
atccatcctaatgtgagtacca

SEQ ID NO: 7013201 - DNA, 22 bp, Homo sapiens
taaagattgctcaaaactgtga

SEQ ID NO: 7013202 - DNA, 22 bp, Homo sapiens
tttgcataaaggagcatttctc

SEQ ID NO: 7013203 - DNA, 22 bp, Homo sapiens
gagcacagattgatttaaaata

SEQ ID NO: 7013204 - DNA, 21 bp, Homo sapiens
agacagactgcctgacccacg

SEQ ID NO: 7013205 - DNA, 22 bp, Homo sapiens
gcatgcattacatgggatatgc

SEQ ID NO: 7013206 - DNA, 22 bp, Homo sapiens
tgagtccgaagttgcagtgagc

SEQ ID NO: 7013207 - DNA, 22 bp, Homo sapiens
aggacaagctaaaggacttcct

SEQ ID NO: 7013208 - DNA, 22 bp, Homo sapiens
atttcctgacagggcagtggta

SEQ ID NO: 7013209 - DNA, 22 bp, Homo sapiens
agtgaagccccgatgcgttttg

SEQ ID NO: 7013210 - DNA, 22 bp, Homo sapiens
gctcggtggccagcctgaggcc

SEQ ID NO: 7013211 - DNA, 22 bp, Homo sapiens
aattggctttgagaagtttgag

SEQ ID NO: 7013212 - DNA, 20 bp, Homo sapiens
ccacaggagtccagtcgacc

SEQ ID NO: 7013213 - DNA, 22 bp, Homo sapiens
aagcagtgttcccagctggccc

SEQ ID NO: 7013214 - DNA, 22 bp, Homo sapiens
ttggaaatgtagaaaagcagat

SEQ ID NO: 7013215 - DNA, 22 bp, Homo sapiens
agtctcacttcttgagctatgc

SEQ ID NO: 7013216 - DNA, 20 bp, Homo sapiens
agttagtgagtaattgagct

SEQ ID NO: 7013217 - DNA, 22 bp, Homo sapiens
gcagtgtgacgctgttctccgt

SEQ ID NO: 7013218 - DNA, 22 bp, Homo sapiens
agaagttaattcctgaaattct

SEQ ID NO: 7013219 - DNA, 22 bp, Homo sapiens
ggcaaggccaggcctccaagac

SEQ ID NO: 7013220 - DNA, 18 bp, Homo sapiens
tgcccaccagaagaggga

SEQ ID NO: 7013221 - DNA, 22 bp, Homo sapiens
accattaagaatctggtttcct

SEQ ID NO: 7013222 - DNA, 22 bp, Homo sapiens
aggtgggttcccgactctggct

SEQ ID NO: 7013223 - DNA, 21 bp, Homo sapiens
ggccttggcgggggccgaatt

SEQ ID NO: 7013224 - DNA, 22 bp, Homo sapiens
ttcctggctcacagcagtgggg

SEQ ID NO: 7013225 - DNA, 22 bp, Homo sapiens
agctgggactcaactgtctggg

SEQ ID NO: 7013226 - DNA, 22 bp, Homo sapiens
ccctgtcctgctaggccctggt

SEQ ID NO: 7013227 - DNA, 18 bp, Homo sapiens
agcagctttgtgcttgat

SEQ ID NO: 7013228 - DNA, 22 bp, Homo sapiens
ctttccaggctgagtttgcttg

SEQ ID NO: 7013229 - DNA, 22 bp, Homo sapiens
ataatctttcttttccagatag

SEQ ID NO: 7013230 - DNA, 18 bp, Homo sapiens
gtaggtcagtaccaagca

SEQ ID NO: 7013231 - DNA, 22 bp, Homo sapiens
agccttgtttgtagttaatagt

SEQ ID NO: 7013232 - DNA, 21 bp, Homo sapiens
tcaggaagagcttctcccact

SEQ ID NO: 7013233 - DNA, 22 bp, Homo sapiens
gtatggatgtgtgaactggtta

SEQ ID NO: 7013234 - DNA, 22 bp, Homo sapiens
cagcagctccaaagaatagcca

SEQ ID NO: 7013235 - DNA, 22 bp, Homo sapiens
tgggtcagacagccagtgggcc

SEQ ID NO: 7013236 - DNA, 22 bp, Homo sapiens
tttgttcattagcattggcctt

SEQ ID NO: 7013237 - DNA, 22 bp, Homo sapiens
tgcagaattctcagtcagactc

SEQ ID NO: 7013238 - DNA, 22 bp, Homo sapiens
cctgtgggccaaggacctgcca

SEQ ID NO: 7013239 - DNA, 22 bp, Homo sapiens
caacaagcgctcagagcaaagc

SEQ ID NO: 7013240 - DNA, 22 bp, Homo sapiens
agatgaaagatttttatagaga

SEQ ID NO: 7013241 - DNA, 22 bp, Homo sapiens
ggttgacagaagaaggatgaca

SEQ ID NO: 7013242 - DNA, 22 bp, Homo sapiens
ggttctctaactttgactggag

SEQ ID NO: 7013243 - DNA, 22 bp, Homo sapiens
acaggctgaaagttaagttctg

SEQ ID NO: 7013244 - DNA, 22 bp, Homo sapiens
ttaagacttttcaaaggcaaac

SEQ ID NO: 7013245 - DNA, 22 bp, Homo sapiens
cccagggacagctaggtggggc

SEQ ID NO: 7013246 - DNA, 22 bp, Homo sapiens
ctgttgtgaatttagttaccaa

SEQ ID NO: 7013247 - DNA, 20 bp, Homo sapiens
ttgtatcagtgtctcccaaa

SEQ ID NO: 7013248 - DNA, 22 bp, Homo sapiens
ttactgaaataatgaaacacat

SEQ ID NO: 7013249 - DNA, 22 bp, Homo sapiens
tgggagttagttatactgtgac

SEQ ID NO: 7013250 - DNA, 22 bp, Homo sapiens
accaggcctggctgggcagcca

SEQ ID NO: 7013251 - DNA, 22 bp, Homo sapiens
tgcattggtaaaatacatacac

SEQ ID NO: 7013252 - DNA, 21 bp, Homo sapiens
ctgtggacaggctggggcatg

SEQ ID NO: 7013253 - DNA, 22 bp, Homo sapiens
acagagtagcagcactgtgctt

SEQ ID NO: 7013254 - DNA, 22 bp, Homo sapiens
ggcctggcagagcgcgcggctg

SEQ ID NO: 7013255 - DNA, 22 bp, Homo sapiens
tgggctctgtgccaggttggtg

SEQ ID NO: 7013256 - DNA, 23 bp, Homo sapiens
ctgttaaattccttaagagcagg

SEQ ID NO: 7013257 - DNA, 22 bp, Homo sapiens
actgtggctcatcaggctggtg

SEQ ID NO: 7013258 - DNA, 22 bp, Homo sapiens
tctttcccctacatttggttaa

SEQ ID NO: 7013259 - DNA, 22 bp, Homo sapiens
tcattgtcgctctgcggtgttc

SEQ ID NO: 7013260 - DNA, 20 bp, Homo sapiens
acttagtttttctcacagga

SEQ ID NO: 7013261 - DNA, 22 bp, Homo sapiens
atagacacagctatgatttgag

SEQ ID NO: 7013262 - DNA, 22 bp, Homo sapiens
gtctgaggaagatgcaggggga

SEQ ID NO: 7013263 - DNA, 21 bp, Homo sapiens
tgagtctctcagcttcaggta

SEQ ID NO: 7013264 - DNA, 22 bp, Homo sapiens
tggggtctggagttgcccatga

SEQ ID NO: 7013265 - DNA, 22 bp, Homo sapiens
tggaaactgggagttaaatgta

SEQ ID NO: 7013266 - DNA, 22 bp, Homo sapiens
cggtccagagctagttcattgc

SEQ ID NO: 7013267 - DNA, 22 bp, Homo sapiens
ttccctgaagacctcatgtgac

SEQ ID NO: 7013268 - DNA, 22 bp, Homo sapiens
tttaggcaatagatggcagtgt

SEQ ID NO: 7013269 - DNA, 22 bp, Homo sapiens
tgccctgcttctcttgggacag

SEQ ID NO: 7013270 - DNA, 22 bp, Homo sapiens
gccttggcccacagtgctcctg

SEQ ID NO: 7013271 - DNA, 22 bp, Homo sapiens
ctttgggtattctcccttgggg

SEQ ID NO: 7013272 - DNA, 22 bp, Homo sapiens
agtatatgccagagagatagct

SEQ ID NO: 7013273 - DNA, 22 bp, Homo sapiens
taggaatgattggaattccagg

SEQ ID NO: 7013274 - DNA, 22 bp, Homo sapiens
ctgggggcaatggtcagagtgt

SEQ ID NO: 7013275 - DNA, 19 bp, Homo sapiens
gggctccttgggcctctct

SEQ ID NO: 7013276 - DNA, 22 bp, Homo sapiens
ccagaagcacctccttttgtgc

SEQ ID NO: 7013277 - DNA, 22 bp, Homo sapiens
tgggccacagagtgagaaatgt

SEQ ID NO: 7013278 - DNA, 22 bp, Homo sapiens
aggaatttaagggctcagagag

SEQ ID NO: 7013279 - DNA, 22 bp, Homo sapiens
tctaccgaaccccctgtggcct

SEQ ID NO: 7013280 - DNA, 22 bp, Homo sapiens
ttccaggtcgccataggtttga

SEQ ID NO: 7013281 - DNA, 22 bp, Homo sapiens
taataattttaaagaaggctag

SEQ ID NO: 7013282 - DNA, 22 bp, Homo sapiens
taaaagctgagatatcctgtac

SEQ ID NO: 7013283 - DNA, 22 bp, Homo sapiens
acagatgttacagtatgatctc

SEQ ID NO: 7013284 - DNA, 22 bp, Homo sapiens
tagtgataatgtttatgctttt

SEQ ID NO: 7013285 - DNA, 22 bp, Homo sapiens
tctactatgtttcttaaataga

SEQ ID NO: 7013286 - DNA, 22 bp, Homo sapiens
aaactgaggaatgacagcatta

SEQ ID NO: 7013287 - DNA, 22 bp, Homo sapiens
agtgtcagctaattattcatga

SEQ ID NO: 7013288 - DNA, 22 bp, Homo sapiens
ataactctgtttttttcatgca

SEQ ID NO: 7013289 - DNA, 22 bp, Homo sapiens
ggaggaagtgcagttctactac

SEQ ID NO: 7013290 - DNA, 22 bp, Homo sapiens
aagaatgtgggtggatatgatg

SEQ ID NO: 7013291 - DNA, 22 bp, Homo sapiens
tttacaggattaccctggctgc

SEQ ID NO: 7013292 - DNA, 22 bp, Homo sapiens
tgggcacaaacatctgcctgtt

SEQ ID NO: 7013293 - DNA, 22 bp, Homo sapiens
gtctgccccagaccctgaccca

SEQ ID NO: 7013294 - DNA, 22 bp, Homo sapiens
tccaggagtgataaggccactg

SEQ ID NO: 7013295 - DNA, 22 bp, Homo sapiens
ctgcatggtagggataagatgg

SEQ ID NO: 7013296 - DNA, 23 bp, Homo sapiens
tgccattttccatctcatgcaga

SEQ ID NO: 7013297 - DNA, 22 bp, Homo sapiens
tgcagctgcttgattcatcttg

SEQ ID NO: 7013298 - DNA, 22 bp, Homo sapiens
tgtttactcactgtatccacaa

SEQ ID NO: 7013299 - DNA, 20 bp, Homo sapiens
ctaccatctcccaaaccgtc

SEQ ID NO: 7013300 - DNA, 22 bp, Homo sapiens
tactgtctggagttgccaaagg

SEQ ID NO: 7013301 - DNA, 22 bp, Homo sapiens
ctaaggaaatatgtcacttgct

SEQ ID NO: 7013302 - DNA, 20 bp, Homo sapiens
ttctgggcagccatgtactt

SEQ ID NO: 7013303 - DNA, 23 bp, Homo sapiens
tggcaagtcatttctagtaacct

SEQ ID NO: 7013304 - DNA, 22 bp, Homo sapiens
gcaggcctgcaggtatggccgg

SEQ ID NO: 7013305 - DNA, 22 bp, Homo sapiens
aagactgtcttttctgagtgac

SEQ ID NO: 7013306 - DNA, 22 bp, Homo sapiens
atatattttttgagacagagtc

SEQ ID NO: 7013307 - DNA, 22 bp, Homo sapiens
ttacatgtttacggatacactt

SEQ ID NO: 7013308 - DNA, 22 bp, Homo sapiens
aaagacagacggaaacctgagg

SEQ ID NO: 7013309 - DNA, 22 bp, Homo sapiens
atctgatttgtaattttagaaa

SEQ ID NO: 7013310 - DNA, 22 bp, Homo sapiens
cctggaggcggaggttgcagtg

SEQ ID NO: 7013311 - DNA, 23 bp, Homo sapiens
tgctgggcagagctggtgctgag

SEQ ID NO: 7013312 - DNA, 22 bp, Homo sapiens
gcagggctgtaatttgagcctg

SEQ ID NO: 7013313 - DNA, 22 bp, Homo sapiens
tgttacagtcattgttttctga

SEQ ID NO: 7013314 - DNA, 22 bp, Homo sapiens
ggctggcagcttcatcccagat

SEQ ID NO: 7013315 - DNA, 22 bp, Homo sapiens
gtgaggcagggaaagaggataa

SEQ ID NO: 7013316 - DNA, 22 bp, Homo sapiens
tattgtgcatgttgaataacta

SEQ ID NO: 7013317 - DNA, 22 bp, Homo sapiens
taaaatgacttcctccaacatc

SEQ ID NO: 7013318 - DNA, 22 bp, Homo sapiens
ctagaaatgctcaagagaaagt

SEQ ID NO: 7013319 - DNA, 22 bp, Homo sapiens
tgtactaatgcatttaactaac

SEQ ID NO: 7013320 - DNA, 22 bp, Homo sapiens
tgtgacagccagtaaagtaagc

SEQ ID NO: 7013321 - DNA, 18 bp, Homo sapiens
tccaggctggattgatga

SEQ ID NO: 7013322 - DNA, 22 bp, Homo sapiens
cagcaggcgttgggagaaagac

SEQ ID NO: 7013323 - DNA, 22 bp, Homo sapiens
aagaagagaaatgtgctgctgg

SEQ ID NO: 7013324 - DNA, 22 bp, Homo sapiens
taaagtcaaaatatgggtaggc

SEQ ID NO: 7013325 - DNA, 22 bp, Homo sapiens
tacagaaattgccaccagctct

SEQ ID NO: 7013326 - DNA, 22 bp, Homo sapiens
gttccttgtatttcagacatga

SEQ ID NO: 7013327 - DNA, 22 bp, Homo sapiens
tagacattttctcaacatctct

SEQ ID NO: 7013328 - DNA, 22 bp, Homo sapiens
ccctggctgcgtgatggatgaa

SEQ ID NO: 7013329 - DNA, 22 bp, Homo sapiens
ttgaagcaaggcgaatcttgtg

SEQ ID NO: 7013330 - DNA, 23 bp, Homo sapiens
tagactgcaggctccttgagggc

SEQ ID NO: 7013331 - DNA, 22 bp, Homo sapiens
gcactgagtctgtcatgctgca

SEQ ID NO: 7013332 - DNA, 22 bp, Homo sapiens
ctgtgtcttcctctgcccaggc

SEQ ID NO: 7013333 - DNA, 22 bp, Homo sapiens
tggagccagggtagaagcagag

SEQ ID NO: 7013334 - DNA, 22 bp, Homo sapiens
ttggcagccctgacccaatggg

SEQ ID NO: 7013335 - DNA, 22 bp, Homo sapiens
taaaggcagttggagttgagga

SEQ ID NO: 7013336 - DNA, 22 bp, Homo sapiens
aggctgggtacctgtcatatgc

SEQ ID NO: 7013337 - DNA, 18 bp, Homo sapiens
cttgcagtgtgtggagaa

SEQ ID NO: 7013338 - DNA, 22 bp, Homo sapiens
ctctaaggaactcccccaaact

SEQ ID NO: 7013339 - DNA, 22 bp, Homo sapiens
acttcctgacttctgggttgga

SEQ ID NO: 7013340 - DNA, 22 bp, Homo sapiens
aggaatgtggcctagggaggag

SEQ ID NO: 7013341 - DNA, 22 bp, Homo sapiens
tacaaagttttcttggattgag

SEQ ID NO: 7013342 - DNA, 22 bp, Homo sapiens
aatgtttgcatctattcacatg

SEQ ID NO: 7013343 - DNA, 22 bp, Homo sapiens
aggtctggtgttgatgaattcc

SEQ ID NO: 7013344 - DNA, 22 bp, Homo sapiens
aaggcctgctcagctgtctgtg

SEQ ID NO: 7013345 - DNA, 22 bp, Homo sapiens
tgtcactcgctcagtccctgtg

SEQ ID NO: 7013346 - DNA, 22 bp, Homo sapiens
tcggaagttagagtgtgttatt

SEQ ID NO: 7013347 - DNA, 22 bp, Homo sapiens
ggcttttgaattccaaggcatt

SEQ ID NO: 7013348 - DNA, 22 bp, Homo sapiens
agtgacttgacacttgtgaggg

SEQ ID NO: 7013349 - DNA, 22 bp, Homo sapiens
tctagcagggaaagcagagaat

SEQ ID NO: 7013350 - DNA, 22 bp, Homo sapiens
tacaccaggttaccaatcactg

SEQ ID NO: 7013351 - DNA, 22 bp, Homo sapiens
aaattttcagagcactagagaa

SEQ ID NO: 7013352 - DNA, 22 bp, Homo sapiens
tgtggacatagaagcatgtgga

SEQ ID NO: 7013353 - DNA, 22 bp, Homo sapiens
cttctgaaatgtgagcaaaatc

SEQ ID NO: 7013354 - DNA, 22 bp, Homo sapiens
taatgccttatgtcaaatgtaa

SEQ ID NO: 7013355 - DNA, 22 bp, Homo sapiens
tccatattaactaaaactagaa

SEQ ID NO: 7013356 - DNA, 22 bp, Homo sapiens
tttttgttgcagagaggccact

SEQ ID NO: 7013357 - DNA, 22 bp, Homo sapiens
gaggacacctcacagcctcaca

SEQ ID NO: 7013358 - DNA, 22 bp, Homo sapiens
taagagtaagtgattaagaaga

SEQ ID NO: 7013359 - DNA, 22 bp, Homo sapiens
tagggggctttgctgcttgaca

SEQ ID NO: 7013360 - DNA, 22 bp, Homo sapiens
attttcatcgctaggttggcct

SEQ ID NO: 7013361 - DNA, 22 bp, Homo sapiens
ttcaacatcttggagctggaac

SEQ ID NO: 7013362 - DNA, 22 bp, Homo sapiens
caggcctcagagagtggcgggg

SEQ ID NO: 7013363 - DNA, 22 bp, Homo sapiens
gttccagtatgattccacccat

SEQ ID NO: 7013364 - DNA, 22 bp, Homo sapiens
tcaaaaattttctgaggatgag

SEQ ID NO: 7013365 - DNA, 22 bp, Homo sapiens
tcaaggaatttagtttagtaaa

SEQ ID NO: 7013366 - DNA, 22 bp, Homo sapiens
ggcacacatggtggttggtgaa

SEQ ID NO: 7013367 - DNA, 18 bp, Homo sapiens
tctttgtttccttcttgc

SEQ ID NO: 7013368 - DNA, 22 bp, Homo sapiens
tagggtgcgggggtgtcacccg

SEQ ID NO: 7013369 - DNA, 22 bp, Homo sapiens
ttaaacagtgtttcatgtgggg

SEQ ID NO: 7013370 - DNA, 17 bp, Homo sapiens
agcatttgtgttaacag

SEQ ID NO: 7013371 - DNA, 22 bp, Homo sapiens
agtgcagcttataaagcatcaa

SEQ ID NO: 7013372 - DNA, 22 bp, Homo sapiens
ctgaacaaagttcttttgagct

SEQ ID NO: 7013373 - DNA, 22 bp, Homo sapiens
ggctccacaattacacactgga

SEQ ID NO: 7013374 - DNA, 22 bp, Homo sapiens
gaattctttaggtgaatttcta

SEQ ID NO: 7013375 - DNA, 22 bp, Homo sapiens
cctttttcaatatagaattgca

SEQ ID NO: 7013376 - DNA, 22 bp, Homo sapiens
cagtctaatctgttactcatta

SEQ ID NO: 7013377 - DNA, 21 bp, Homo sapiens
aggcttctccgtgcaggaaga

SEQ ID NO: 7013378 - DNA, 22 bp, Homo sapiens
tggtaatttattttgagagatt

SEQ ID NO: 7013379 - DNA, 20 bp, Homo sapiens
ccagctgagccaaggggaga

SEQ ID NO: 7013380 - DNA, 22 bp, Homo sapiens
gcctgtttgttatgtcatggta

SEQ ID NO: 7013381 - DNA, 22 bp, Homo sapiens
agacacagtacttgccctcatg

SEQ ID NO: 7013382 - DNA, 22 bp, Homo sapiens
ggagaggtgcaggtcagtggca

SEQ ID NO: 7013383 - DNA, 22 bp, Homo sapiens
ggtggcattgatccctcccagc

SEQ ID NO: 7013384 - DNA, 22 bp, Homo sapiens
ccagaggaaaaatatctcccta

SEQ ID NO: 7013385 - DNA, 22 bp, Homo sapiens
ttaacagttaaacaattggcta

SEQ ID NO: 7013386 - DNA, 22 bp, Homo sapiens
tccagaatcaatagcagttatc

SEQ ID NO: 7013387 - DNA, 22 bp, Homo sapiens
cgcagacactgagggtccgggg

SEQ ID NO: 7013388 - DNA, 22 bp, Homo sapiens
ttttttggataataaacgatct

SEQ ID NO: 7013389 - DNA, 22 bp, Homo sapiens
catatatctacctgcaattgca

SEQ ID NO: 7013390 - DNA, 22 bp, Homo sapiens
caaatgttgctgtaatgtttgt

SEQ ID NO: 7013391 - DNA, 22 bp, Homo sapiens
aatttcaagtggcatctttgat

SEQ ID NO: 7013392 - DNA, 22 bp, Homo sapiens
caagatcttggctgaagtacag

SEQ ID NO: 7013393 - DNA, 22 bp, Homo sapiens
tctgggaacagcttagctccag

SEQ ID NO: 7013394 - DNA, 22 bp, Homo sapiens
gagttggctactctctgaggct

SEQ ID NO: 7013395 - DNA, 19 bp, Homo sapiens
tctagttttgagagacttc

SEQ ID NO: 7013396 - DNA, 22 bp, Homo sapiens
aaggctttgtgggctgcaggca

SEQ ID NO: 7013397 - DNA, 22 bp, Homo sapiens
gccagagctgagacacgagtcc

SEQ ID NO: 7013398 - DNA, 22 bp, Homo sapiens
aggagctcacatctttatttct

SEQ ID NO: 7013399 - DNA, 18 bp, Homo sapiens
gaaatctcaagagacaga

SEQ ID NO: 7013400 - DNA, 22 bp, Homo sapiens
aatgggcatttggggttgagaa

SEQ ID NO: 7013401 - DNA, 22 bp, Homo sapiens
gatgtctttgctgttatccact

SEQ ID NO: 7013402 - DNA, 22 bp, Homo sapiens
tcttgctgctgtccacacagta

SEQ ID NO: 7013403 - DNA, 22 bp, Homo sapiens
aggtgggttccgcggcggcccg

SEQ ID NO: 7013404 - DNA, 21 bp, Homo sapiens
agtgggccatgtgtaatattt

SEQ ID NO: 7013405 - DNA, 22 bp, Homo sapiens
gctctgggccgggcaccagcct

SEQ ID NO: 7013406 - DNA, 23 bp, Homo sapiens
atcattaacagtgcaggggtagg

SEQ ID NO: 7013407 - DNA, 22 bp, Homo sapiens
tgtcatttaatagatatgatgg

SEQ ID NO: 7013408 - DNA, 22 bp, Homo sapiens
actctgggattgtttctggtat

SEQ ID NO: 7013409 - DNA, 22 bp, Homo sapiens
aatttcagggtgaatggactga

SEQ ID NO: 7013410 - DNA, 22 bp, Homo sapiens
ccagaagatggctcaaaccatg

SEQ ID NO: 7013411 - DNA, 20 bp, Homo sapiens
tgagtccagattttgcttta

SEQ ID NO: 7013412 - DNA, 18 bp, Homo sapiens
tttggccatgacctggct

SEQ ID NO: 7013413 - DNA, 22 bp, Homo sapiens
ggtgcagagtccacagaaagct

SEQ ID NO: 7013414 - DNA, 22 bp, Homo sapiens
aatttgccttaccttcttccaa

SEQ ID NO: 7013415 - DNA, 22 bp, Homo sapiens
tgtgtgaattctgagcagttta

SEQ ID NO: 7013416 - DNA, 22 bp, Homo sapiens
gatgtaaaaactcctttcgaaa

SEQ ID NO: 7013417 - DNA, 22 bp, Homo sapiens
tttctacagaagatacactgct

SEQ ID NO: 7013418 - DNA, 22 bp, Homo sapiens
taaacaggccccagggaggttg

SEQ ID NO: 7013419 - DNA, 22 bp, Homo sapiens
atttccaactacccctccattt

SEQ ID NO: 7013420 - DNA, 22 bp, Homo sapiens
gtgaagatgcctcaggtgaccc

SEQ ID NO: 7013421 - DNA, 19 bp, Homo sapiens
gaggaactggcttggttcc

SEQ ID NO: 7013422 - DNA, 22 bp, Homo sapiens
ctgaggcctggccccaccacag

SEQ ID NO: 7013423 - DNA, 22 bp, Homo sapiens
cctggaaaacatgggaatcaca

SEQ ID NO: 7013424 - DNA, 22 bp, Homo sapiens
ttcattgaagcacaagtgatct

SEQ ID NO: 7013425 - DNA, 22 bp, Homo sapiens
cagtataagagtgaggaagggc

SEQ ID NO: 7013426 - DNA, 22 bp, Homo sapiens
tatctatgctgcttcagttaag

SEQ ID NO: 7013427 - DNA, 22 bp, Homo sapiens
ctaaggctaatcaggcttaaaa

SEQ ID NO: 7013428 - DNA, 22 bp, Homo sapiens
ctgagaggtgctggtggctgca

SEQ ID NO: 7013429 - DNA, 22 bp, Homo sapiens
aatggagactgacacaaagata

SEQ ID NO: 7013430 - DNA, 22 bp, Homo sapiens
gtaaaactgtctaatggtatat

SEQ ID NO: 7013431 - DNA, 22 bp, Homo sapiens
tgggttttgtcctgatccatca

SEQ ID NO: 7013432 - DNA, 22 bp, Homo sapiens
ggatgacccgagtctggggaac

SEQ ID NO: 7013433 - DNA, 22 bp, Homo sapiens
ctgggtcttcagcagcaggcgg

SEQ ID NO: 7013434 - DNA, 22 bp, Homo sapiens
gcctgggtgcccaatgatgaga

SEQ ID NO: 7013435 - DNA, 23 bp, Homo sapiens
gctgtacaggaaccagtttggag

SEQ ID NO: 7013436 - DNA, 22 bp, Homo sapiens
attagcttcaaagccatcaacc

SEQ ID NO: 7013437 - DNA, 22 bp, Homo sapiens
caggaacagagtggcattgtct

SEQ ID NO: 7013438 - DNA, 22 bp, Homo sapiens
ccctggaaggttctctggctca

SEQ ID NO: 7013439 - DNA, 22 bp, Homo sapiens
gcacatctggagctctgtggaa

SEQ ID NO: 7013440 - DNA, 22 bp, Homo sapiens
tggtggagggaactatttccag

SEQ ID NO: 7013441 - DNA, 22 bp, Homo sapiens
ttagcttcttacatttcatcct

SEQ ID NO: 7013442 - DNA, 22 bp, Homo sapiens
tttattctctagttggtcagat

SEQ ID NO: 7013443 - DNA, 22 bp, Homo sapiens
gttctccactgcagagtctctc

SEQ ID NO: 7013444 - DNA, 22 bp, Homo sapiens
ctttatatccagatgtttggtg

SEQ ID NO: 7013445 - DNA, 22 bp, Homo sapiens
agcagcatcttctgttctccgc

SEQ ID NO: 7013446 - DNA, 23 bp, Homo sapiens
tgctgtagtctctacagctggtc

SEQ ID NO: 7013447 - DNA, 22 bp, Homo sapiens
gatgtgaggtggtaaacaggga

SEQ ID NO: 7013448 - DNA, 22 bp, Homo sapiens
tcctccaggtctagggtggctt

SEQ ID NO: 7013449 - DNA, 21 bp, Homo sapiens
gctgccaggattttgcaggaa

SEQ ID NO: 7013450 - DNA, 22 bp, Homo sapiens
ccagcagggttggtttcttctg

SEQ ID NO: 7013451 - DNA, 22 bp, Homo sapiens
ttacagaaaggttgtgggatag

SEQ ID NO: 7013452 - DNA, 22 bp, Homo sapiens
gctctgtgaccttaggcaagtt

SEQ ID NO: 7013453 - DNA, 22 bp, Homo sapiens
ggccactgacctacatctgggg

SEQ ID NO: 7013454 - DNA, 22 bp, Homo sapiens
tgagaggctagatcagctctgt

SEQ ID NO: 7013455 - DNA, 22 bp, Homo sapiens
ccctgcccaccacatgctggga

SEQ ID NO: 7013456 - DNA, 22 bp, Homo sapiens
gtctcttctttgccggtcctgc

SEQ ID NO: 7013457 - DNA, 22 bp, Homo sapiens
gacaatgtgacagaccaatgat

SEQ ID NO: 7013458 - DNA, 22 bp, Homo sapiens
atgcctgtaatcccagcacttt

SEQ ID NO: 7013459 - DNA, 22 bp, Homo sapiens
agtgcagctattacaacagtgt

SEQ ID NO: 7013460 - DNA, 22 bp, Homo sapiens
cttgtattaggaagaatgcttt

SEQ ID NO: 7013461 - DNA, 22 bp, Homo sapiens
tctaagaagggttttaaatatt

SEQ ID NO: 7013462 - DNA, 22 bp, Homo sapiens
ggaggtggcagagggacattct

SEQ ID NO: 7013463 - DNA, 22 bp, Homo sapiens
cagcaggggtgtcattgtagtt

SEQ ID NO: 7013464 - DNA, 22 bp, Homo sapiens
tgattacactatttgggaatag

SEQ ID NO: 7013465 - DNA, 23 bp, Homo sapiens
ctggctctgtaggtggcatcctt

SEQ ID NO: 7013466 - DNA, 22 bp, Homo sapiens
gataagcagcagccgttatagg

SEQ ID NO: 7013467 - DNA, 20 bp, Homo sapiens
tgcaatgtccatgttccagg

SEQ ID NO: 7013468 - DNA, 22 bp, Homo sapiens
tggcagcacttgaacttgagcc

SEQ ID NO: 7013469 - DNA, 22 bp, Homo sapiens
tgacatcacgtcctttcagaga

SEQ ID NO: 7013470 - DNA, 22 bp, Homo sapiens
tctgtctgctcatttacctcag

SEQ ID NO: 7013471 - DNA, 22 bp, Homo sapiens
atgaggcccaggaatctgtatt

SEQ ID NO: 7013472 - DNA, 22 bp, Homo sapiens
cccaggaccatccttctgtgcc

SEQ ID NO: 7013473 - DNA, 22 bp, Homo sapiens
gagcagtggtctgatcttctaa

SEQ ID NO: 7013474 - DNA, 23 bp, Homo sapiens
cagtacttagtgtagcgttaatt

SEQ ID NO: 7013475 - DNA, 22 bp, Homo sapiens
gggacatgcccctcagtgggtg

SEQ ID NO: 7013476 - DNA, 22 bp, Homo sapiens
ctgtgatgatggaaactttctt

SEQ ID NO: 7013477 - DNA, 22 bp, Homo sapiens
ggacatttctattgagctaaga

SEQ ID NO: 7013478 - DNA, 22 bp, Homo sapiens
aactttctgtctgagctgcaga

SEQ ID NO: 7013479 - DNA, 22 bp, Homo sapiens
taagatgcattataccacagag

SEQ ID NO: 7013480 - DNA, 22 bp, Homo sapiens
ctctccactgtcctttgctggt

SEQ ID NO: 7013481 - DNA, 22 bp, Homo sapiens
tgtcacatcaggggtgttgaca

SEQ ID NO: 7013482 - DNA, 22 bp, Homo sapiens
gcaggatgaactaacacctgca

SEQ ID NO: 7013483 - DNA, 22 bp, Homo sapiens
tgtttaattcaccatcatgttc

SEQ ID NO: 7013484 - DNA, 22 bp, Homo sapiens
tttcattgtcatctatcttaga

SEQ ID NO: 7013485 - DNA, 21 bp, Homo sapiens
tagcaaagccagatgtatatt

SEQ ID NO: 7013486 - DNA, 18 bp, Homo sapiens
cagagcagaggtggagcg

SEQ ID NO: 7013487 - DNA, 22 bp, Homo sapiens
cctgttttattctgttgtatct

SEQ ID NO: 7013488 - DNA, 22 bp, Homo sapiens
aatatttctccttcgttatagc

SEQ ID NO: 7013489 - DNA, 22 bp, Homo sapiens
ccacaagtgaagtacacctgcc

SEQ ID NO: 7013490 - DNA, 22 bp, Homo sapiens
aggccaggcaacattctgaagt

SEQ ID NO: 7013491 - DNA, 22 bp, Homo sapiens
accttgtctgtgcacctgggct

SEQ ID NO: 7013492 - DNA, 22 bp, Homo sapiens
ttggcgcccaggacgccgccgc

SEQ ID NO: 7013493 - DNA, 22 bp, Homo sapiens
agccaaggaaagccctttgctg

SEQ ID NO: 7013494 - DNA, 22 bp, Homo sapiens
tctactgccacttaagacattt

SEQ ID NO: 7013495 - DNA, 22 bp, Homo sapiens
ctgcatcacagcaggaggcaca

SEQ ID NO: 7013496 - DNA, 22 bp, Homo sapiens
tgaaatagaaaaacaggcttct

SEQ ID NO: 7013497 - DNA, 22 bp, Homo sapiens
tgttctaagctgccaaaatgct

SEQ ID NO: 7013498 - DNA, 22 bp, Homo sapiens
aatgtctagacatgttaatgca

SEQ ID NO: 7013499 - DNA, 22 bp, Homo sapiens
ccaggaagatttattttggctt

SEQ ID NO: 7013500 - DNA, 22 bp, Homo sapiens
cagctcagtttcaataccaggt

SEQ ID NO: 7013501 - DNA, 22 bp, Homo sapiens
tgggtcctctggagcagcagca

SEQ ID NO: 7013502 - DNA, 22 bp, Homo sapiens
tgaagtgattagaaccacttga

SEQ ID NO: 7013503 - DNA, 22 bp, Homo sapiens
atttagaagttggagggcaaga

SEQ ID NO: 7013504 - DNA, 22 bp, Homo sapiens
taattttgtccccctgcacata

SEQ ID NO: 7013505 - DNA, 21 bp, Homo sapiens
aaactgaggagatgaggacta

SEQ ID NO: 7013506 - DNA, 19 bp, Homo sapiens
atctttgggtcctgaaggg

SEQ ID NO: 7013507 - DNA, 22 bp, Homo sapiens
atgccaagtatgattcacatgt

SEQ ID NO: 7013508 - DNA, 22 bp, Homo sapiens
taatctatcaagcaacaaagtg

SEQ ID NO: 7013509 - DNA, 22 bp, Homo sapiens
agctctgtgcaggcagaggcat

SEQ ID NO: 7013510 - DNA, 22 bp, Homo sapiens
ggcatggctgttggggatagag

SEQ ID NO: 7013511 - DNA, 22 bp, Homo sapiens
tttcctcagaagtgtctactat

SEQ ID NO: 7013512 - DNA, 22 bp, Homo sapiens
tgaatgcttggagtcataaaat

SEQ ID NO: 7013513 - DNA, 22 bp, Homo sapiens
gaagttacttctttgtgcctca

SEQ ID NO: 7013514 - DNA, 22 bp, Homo sapiens
ttctgctcttggctttgctggt

SEQ ID NO: 7013515 - DNA, 22 bp, Homo sapiens
agtctttactaaacagaccacc

SEQ ID NO: 7013516 - DNA, 22 bp, Homo sapiens
tcccacaggagcctgagtccca

SEQ ID NO: 7013517 - DNA, 22 bp, Homo sapiens
acataatacctaggacagtttg

SEQ ID NO: 7013518 - DNA, 22 bp, Homo sapiens
ctatatcatcattacctgcacc

SEQ ID NO: 7013519 - DNA, 22 bp, Homo sapiens
gtgttttagtgctgctgagctg

SEQ ID NO: 7013520 - DNA, 22 bp, Homo sapiens
actgggccacatagacctgctg

SEQ ID NO: 7013521 - DNA, 22 bp, Homo sapiens
agtaaatcagacctcattatgt

SEQ ID NO: 7013522 - DNA, 22 bp, Homo sapiens
ggaactattgctctagcaatag

SEQ ID NO: 7013523 - DNA, 22 bp, Homo sapiens
ctgttgcttcaggaaacagtaa

SEQ ID NO: 7013524 - DNA, 22 bp, Homo sapiens
atttggaaatacgcgcttttgg

SEQ ID NO: 7013525 - DNA, 22 bp, Homo sapiens
tctgtagtatggtacttattta

SEQ ID NO: 7013526 - DNA, 22 bp, Homo sapiens
tggcttctggggtggcctgcat

SEQ ID NO: 7013527 - DNA, 22 bp, Homo sapiens
atcacctgggaggaaccatcta

SEQ ID NO: 7013528 - DNA, 22 bp, Homo sapiens
agatccgtggattataatttag

SEQ ID NO: 7013529 - DNA, 22 bp, Homo sapiens
atttaaattttctgatggagag

SEQ ID NO: 7013530 - DNA, 20 bp, Homo sapiens
tctgaacacaatatatcccc

SEQ ID NO: 7013531 - DNA, 22 bp, Homo sapiens
gtgtatgaggggagaatgtttt

SEQ ID NO: 7013532 - DNA, 22 bp, Homo sapiens
aagaaatgctgatgttggatgg

SEQ ID NO: 7013533 - DNA, 22 bp, Homo sapiens
tgaattccattgccaaagtttt

SEQ ID NO: 7013534 - DNA, 22 bp, Homo sapiens
gctgcagcctttgggaaggaca

SEQ ID NO: 7013535 - DNA, 22 bp, Homo sapiens
ccagggcttcagaggttttggc

SEQ ID NO: 7013536 - DNA, 22 bp, Homo sapiens
tcctgagacatctctgctggtc

SEQ ID NO: 7013537 - DNA, 19 bp, Homo sapiens
atggctgtgttccagtaaa

SEQ ID NO: 7013538 - DNA, 22 bp, Homo sapiens
atcttggattggagaaagaagt

SEQ ID NO: 7013539 - DNA, 22 bp, Homo sapiens
ggagtgccgaggtgttcaagga

SEQ ID NO: 7013540 - DNA, 22 bp, Homo sapiens
ccttcaaagagtatttcctgag

SEQ ID NO: 7013541 - DNA, 22 bp, Homo sapiens
tcttgggcaatttctctagagg

SEQ ID NO: 7013542 - DNA, 22 bp, Homo sapiens
tcctttccctttccatcctggc

SEQ ID NO: 7013543 - DNA, 22 bp, Homo sapiens
ggcagccatggacactggctag

SEQ ID NO: 7013544 - DNA, 22 bp, Homo sapiens
tactgcctgggggagacagctg

SEQ ID NO: 7013545 - DNA, 22 bp, Homo sapiens
ctgtggcaccaatacatttttc

SEQ ID NO: 7013546 - DNA, 22 bp, Homo sapiens
tttcacagctagtgagcttcta

SEQ ID NO: 7013547 - DNA, 22 bp, Homo sapiens
ttgccctgtcagtagaagtgca

SEQ ID NO: 7013548 - DNA, 22 bp, Homo sapiens
caaagaaggaactataatccca

SEQ ID NO: 7013549 - DNA, 22 bp, Homo sapiens
gttgagaagcctcaaagaagga

SEQ ID NO: 7013550 - DNA, 22 bp, Homo sapiens
tctacaaagaagaattaatgtc

SEQ ID NO: 7013551 - DNA, 22 bp, Homo sapiens
cagggcttgaatcaaggaagtc

SEQ ID NO: 7013552 - DNA, 22 bp, Homo sapiens
gatgtggcatagaatgatggtt

SEQ ID NO: 7013553 - DNA, 22 bp, Homo sapiens
actgaagtagtcattgtcatta

SEQ ID NO: 7013554 - DNA, 22 bp, Homo sapiens
tgctttgtgtttgaatagataa

SEQ ID NO: 7013555 - DNA, 22 bp, Homo sapiens
gattgctgggattggtactgat

SEQ ID NO: 7013556 - DNA, 22 bp, Homo sapiens
tttcatcttatttgtctacatc

SEQ ID NO: 7013557 - DNA, 22 bp, Homo sapiens
tgaggtaggtggtaagagatac

SEQ ID NO: 7013558 - DNA, 22 bp, Homo sapiens
gaaggcttagaaacaagggagc

SEQ ID NO: 7013559 - DNA, 22 bp, Homo sapiens
acagggcttagaaatctgttgc

SEQ ID NO: 7013560 - DNA, 22 bp, Homo sapiens
tactacaaggccgaagctctca

SEQ ID NO: 7013561 - DNA, 22 bp, Homo sapiens
tgtgggctttggagtcaggaag

SEQ ID NO: 7013562 - DNA, 22 bp, Homo sapiens
tacagcattttgtagagtacta

SEQ ID NO: 7013563 - DNA, 22 bp, Homo sapiens
tacttcatacctgctagaatgg

SEQ ID NO: 7013564 - DNA, 22 bp, Homo sapiens
tacatagtgaacatttacagag

SEQ ID NO: 7013565 - DNA, 22 bp, Homo sapiens
gaggctgccccttcctcagctg

SEQ ID NO: 7013566 - DNA, 22 bp, Homo sapiens
gatcctggagctccatcactat

SEQ ID NO: 7013567 - DNA, 19 bp, Homo sapiens
aggctgtgaggggaaggaa

SEQ ID NO: 7013568 - DNA, 22 bp, Homo sapiens
tccctactgttagggactcagc

SEQ ID NO: 7013569 - DNA, 22 bp, Homo sapiens
ttctggggccccagtgtcctcg

SEQ ID NO: 7013570 - DNA, 22 bp, Homo sapiens
ttggcagcccagcttactagca

SEQ ID NO: 7013571 - DNA, 22 bp, Homo sapiens
atccttctaagagggacgtatg

SEQ ID NO: 7013572 - DNA, 22 bp, Homo sapiens
tctggctctcatactcgccagt

SEQ ID NO: 7013573 - DNA, 22 bp, Homo sapiens
gtagttatgtttacatgccatc

SEQ ID NO: 7013574 - DNA, 22 bp, Homo sapiens
gttccaggtggtcacagagctc

SEQ ID NO: 7013575 - DNA, 22 bp, Homo sapiens
ccagtgtggtaggtccacaggt

SEQ ID NO: 7013576 - DNA, 18 bp, Homo sapiens
gtgcaatgaatagcagag

SEQ ID NO: 7013577 - DNA, 22 bp, Homo sapiens
ttggccaaaggaaagactactg

SEQ ID NO: 7013578 - DNA, 17 bp, Homo sapiens
ggagccaggagcccacc

SEQ ID NO: 7013579 - DNA, 22 bp, Homo sapiens
aaggacacaaaacagcagcagt

SEQ ID NO: 7013580 - DNA, 22 bp, Homo sapiens
gtgctgaggtacacaaattcta

SEQ ID NO: 7013581 - DNA, 22 bp, Homo sapiens
ttctggaaagaaggctaaggtc

SEQ ID NO: 7013582 - DNA, 22 bp, Homo sapiens
gacaagcaagagtttgctgggc

SEQ ID NO: 7013583 - DNA, 22 bp, Homo sapiens
tctcagtaagtggcactctgtc

SEQ ID NO: 7013584 - DNA, 22 bp, Homo sapiens
ggcacagggtgatgttgcagtt

SEQ ID NO: 7013585 - DNA, 20 bp, Homo sapiens
ttactaatctcaatgacctg

SEQ ID NO: 7013586 - DNA, 22 bp, Homo sapiens
tgcctagtagggttgttgtagg

SEQ ID NO: 7013587 - DNA, 22 bp, Homo sapiens
acattctgtcaacagtgagcag

SEQ ID NO: 7013588 - DNA, 22 bp, Homo sapiens
cctgagtggggagctaagtgag

SEQ ID NO: 7013589 - DNA, 22 bp, Homo sapiens
cagccaaatgagtcataaatgt

SEQ ID NO: 7013590 - DNA, 22 bp, Homo sapiens
tatgaggcttacaggcaggcca

SEQ ID NO: 7013591 - DNA, 22 bp, Homo sapiens
cacacccttgctaacacttgtt

SEQ ID NO: 7013592 - DNA, 22 bp, Homo sapiens
agtttacaaagtttcactgttc

SEQ ID NO: 7013593 - DNA, 18 bp, Homo sapiens
cagtgctgttaacagtga

SEQ ID NO: 7013594 - DNA, 22 bp, Homo sapiens
cagggtccatctttcatcactg

SEQ ID NO: 7013595 - DNA, 22 bp, Homo sapiens
cagaaacctccctgaatatttt

SEQ ID NO: 7013596 - DNA, 22 bp, Homo sapiens
attagtgttgtaagaagctgcc

SEQ ID NO: 7013597 - DNA, 22 bp, Homo sapiens
tcttctccagtgcttctgcaca

SEQ ID NO: 7013598 - DNA, 22 bp, Homo sapiens
gccctctggtggccgcctcggc

SEQ ID NO: 7013599 - DNA, 22 bp, Homo sapiens
atgtgtgcatattctgccacct

SEQ ID NO: 7013600 - DNA, 22 bp, Homo sapiens
agtgtcattccagggaccctcg

SEQ ID NO: 7013601 - DNA, 22 bp, Homo sapiens
tgcaatgatattgtcaaagcat

SEQ ID NO: 7013602 - DNA, 21 bp, Homo sapiens
ctgaggcatgcaggcctgggc

SEQ ID NO: 7013603 - DNA, 22 bp, Homo sapiens
atttcttccttctcctagaaga

SEQ ID NO: 7013604 - DNA, 22 bp, Homo sapiens
tacctcatgctgtacagcacgt

SEQ ID NO: 7013605 - DNA, 22 bp, Homo sapiens
tcaggcctgcaaatgaatggta

SEQ ID NO: 7013606 - DNA, 22 bp, Homo sapiens
agctactagggtgccagacatg

SEQ ID NO: 7013607 - DNA, 22 bp, Homo sapiens
tcaatgtctctttctaaaatgt

SEQ ID NO: 7013608 - DNA, 22 bp, Homo sapiens
gctggcctcgcaggcaggatgt

SEQ ID NO: 7013609 - DNA, 22 bp, Homo sapiens
agggctcagagtagttcggttt

SEQ ID NO: 7013610 - DNA, 22 bp, Homo sapiens
ttattatgtggatgaaagatgt

SEQ ID NO: 7013611 - DNA, 22 bp, Homo sapiens
cctgggcctatcctagaaccaa

SEQ ID NO: 7013612 - DNA, 22 bp, Homo sapiens
cttcaggggtgttagttttgtg

SEQ ID NO: 7013613 - DNA, 22 bp, Homo sapiens
tgacacttgagagggacacgga

SEQ ID NO: 7013614 - DNA, 22 bp, Homo sapiens
caaaggaggtgataggccctct

SEQ ID NO: 7013615 - DNA, 22 bp, Homo sapiens
ggagtgagagagtttaaggtca

SEQ ID NO: 7013616 - DNA, 22 bp, Homo sapiens
tgcaaaggcatctgggaaggtt

SEQ ID NO: 7013617 - DNA, 22 bp, Homo sapiens
ctctgggcaggacgccaggcct

SEQ ID NO: 7013618 - DNA, 22 bp, Homo sapiens
ttgaggtcttcagctgacacct

SEQ ID NO: 7013619 - DNA, 22 bp, Homo sapiens
tacttagactctatctagagat

SEQ ID NO: 7013620 - DNA, 22 bp, Homo sapiens
ttcaacaaaatatatttttcca

SEQ ID NO: 7013621 - DNA, 22 bp, Homo sapiens
agaaaagtttaaatcttggcac

SEQ ID NO: 7013622 - DNA, 22 bp, Homo sapiens
ggagcaaatgccaagtgggagg

SEQ ID NO: 7013623 - DNA, 22 bp, Homo sapiens
ggtccccccatggtgagcactg

SEQ ID NO: 7013624 - DNA, 20 bp, Homo sapiens
aaacgagccatcattctggt

SEQ ID NO: 7013625 - DNA, 22 bp, Homo sapiens
tgtggacagctctttgagtgct

SEQ ID NO: 7013626 - DNA, 22 bp, Homo sapiens
tcagggcatactcttcaaggtc

SEQ ID NO: 7013627 - DNA, 22 bp, Homo sapiens
atacaggtaatttgaataatag

SEQ ID NO: 7013628 - DNA, 22 bp, Homo sapiens
ctttttgtctctgtcctgatga

SEQ ID NO: 7013629 - DNA, 23 bp, Homo sapiens
atcaaaggatgtagagaagaagc

SEQ ID NO: 7013630 - DNA, 22 bp, Homo sapiens
tcagcaggcagaaatctgcaga

SEQ ID NO: 7013631 - DNA, 22 bp, Homo sapiens
agaagggttcaggaatatgtta

SEQ ID NO: 7013632 - DNA, 22 bp, Homo sapiens
acagttctccagtgcctttgag

SEQ ID NO: 7013633 - DNA, 22 bp, Homo sapiens
tcccatcatctgttctggctac

SEQ ID NO: 7013634 - DNA, 22 bp, Homo sapiens
gagtgcctggggcatctcctgc

SEQ ID NO: 7013635 - DNA, 22 bp, Homo sapiens
tctgaagaaatacagctggggt

SEQ ID NO: 7013636 - DNA, 22 bp, Homo sapiens
tctgtgaaaggaaagaactgac

SEQ ID NO: 7013637 - DNA, 22 bp, Homo sapiens
ggagcctggtcaggttggctcc

SEQ ID NO: 7013638 - DNA, 22 bp, Homo sapiens
ttctgggctcccacatatttca

SEQ ID NO: 7013639 - DNA, 22 bp, Homo sapiens
gcccccgaggaggtgatgtcgc

SEQ ID NO: 7013640 - DNA, 22 bp, Homo sapiens
gctatctccctctaactttgac

SEQ ID NO: 7013641 - DNA, 22 bp, Homo sapiens
aaggcctttcttatcagtagat

SEQ ID NO: 7013642 - DNA, 22 bp, Homo sapiens
tgaaggtaaaggaaggaggctt

SEQ ID NO: 7013643 - DNA, 22 bp, Homo sapiens
ggcctgaaatagctctgaggtt

SEQ ID NO: 7013644 - DNA, 22 bp, Homo sapiens
tataccaaaaaaattcttgtct

SEQ ID NO: 7013645 - DNA, 22 bp, Homo sapiens
agggtctttcctgggagccagc

SEQ ID NO: 7013646 - DNA, 22 bp, Homo sapiens
ttagtagtgatgttatttcaag

SEQ ID NO: 7013647 - DNA, 22 bp, Homo sapiens
gacagctacagggagagcattg

SEQ ID NO: 7013648 - DNA, 22 bp, Homo sapiens
agcagccatccttagagaaaga

SEQ ID NO: 7013649 - DNA, 22 bp, Homo sapiens
aaattcacttgcctgcttagct

SEQ ID NO: 7013650 - DNA, 22 bp, Homo sapiens
aagaagcatgagaagattttat

SEQ ID NO: 7013651 - DNA, 22 bp, Homo sapiens
acagtcaggccgagatgggcct

SEQ ID NO: 7013652 - DNA, 22 bp, Homo sapiens
cgggagcctctgggtcacactg

SEQ ID NO: 7013653 - DNA, 22 bp, Homo sapiens
tcaaacatccccaccagggact

SEQ ID NO: 7013654 - DNA, 22 bp, Homo sapiens
agcaggaaggtctgttagtcca

SEQ ID NO: 7013655 - DNA, 22 bp, Homo sapiens
ccacagagtccgcatttgaggc

SEQ ID NO: 7013656 - DNA, 22 bp, Homo sapiens
aaattattgggtcccaccccag

SEQ ID NO: 7013657 - DNA, 22 bp, Homo sapiens
gatcatttcagtccagtaaata

SEQ ID NO: 7013658 - DNA, 22 bp, Homo sapiens
ttctggaggtgtgaccattagc

SEQ ID NO: 7013659 - DNA, 22 bp, Homo sapiens
taagcagagccctctttattag

SEQ ID NO: 7013660 - DNA, 22 bp, Homo sapiens
ccccagccagcaggacctctga

SEQ ID NO: 7013661 - DNA, 21 bp, Homo sapiens
attcaactagatgattatttc

SEQ ID NO: 7013662 - DNA, 22 bp, Homo sapiens
cactttactatctataaaataa

SEQ ID NO: 7013663 - DNA, 22 bp, Homo sapiens
atagactcagtttggcatttta

SEQ ID NO: 7013664 - DNA, 17 bp, Homo sapiens
ctcctggccacccctct

SEQ ID NO: 7013665 - DNA, 22 bp, Homo sapiens
gtccattttattcagagacttt

SEQ ID NO: 7013666 - DNA, 22 bp, Homo sapiens
acatttgattccatcctctact

SEQ ID NO: 7013667 - DNA, 22 bp, Homo sapiens
ttttgttggcttaagaaataca

SEQ ID NO: 7013668 - DNA, 22 bp, Homo sapiens
ggcctaagtggttaaatggctt

SEQ ID NO: 7013669 - DNA, 22 bp, Homo sapiens
gtgtgagccatgatgtgtccag

SEQ ID NO: 7013670 - DNA, 22 bp, Homo sapiens
gaagactctaagagaaatatga

SEQ ID NO: 7013671 - DNA, 22 bp, Homo sapiens
atgaatcagaatctgcatttta

SEQ ID NO: 7013672 - DNA, 22 bp, Homo sapiens
agagcttagggggctttgcatc

SEQ ID NO: 7013673 - DNA, 22 bp, Homo sapiens
aggctggagtgtagcagtgcag

SEQ ID NO: 7013674 - DNA, 22 bp, Homo sapiens
taggcactggatgaccgaagag

SEQ ID NO: 7013675 - DNA, 22 bp, Homo sapiens
catcagtggtaactgaatggtt

SEQ ID NO: 7013676 - DNA, 22 bp, Homo sapiens
ggctcagcttatctgggcaggc

SEQ ID NO: 7013677 - DNA, 22 bp, Homo sapiens
tggggagagttacaaggaatct

SEQ ID NO: 7013678 - DNA, 22 bp, Homo sapiens
attaatgagcttctgcactcat

SEQ ID NO: 7013679 - DNA, 18 bp, Homo sapiens
agagggaaagcaggctga

SEQ ID NO: 7013680 - DNA, 22 bp, Homo sapiens
tgagcaggctcccacttcagtg

SEQ ID NO: 7013681 - DNA, 22 bp, Homo sapiens
agctgccctggtaagattgatg

SEQ ID NO: 7013682 - DNA, 22 bp, Homo sapiens
tgaagtatccatcttgttctag

SEQ ID NO: 7013683 - DNA, 22 bp, Homo sapiens
tattcagtggaaaatgtgttga

SEQ ID NO: 7013684 - DNA, 21 bp, Homo sapiens
ttttattgatgaatggccact

SEQ ID NO: 7013685 - DNA, 22 bp, Homo sapiens
agaaatagaggaaaggtttgac

SEQ ID NO: 7013686 - DNA, 22 bp, Homo sapiens
gagtccagtgtttaccaggggt

SEQ ID NO: 7013687 - DNA, 22 bp, Homo sapiens
cccttcccttctgggagatcca

SEQ ID NO: 7013688 - DNA, 22 bp, Homo sapiens
gaggccctcttgccacaatgaa

SEQ ID NO: 7013689 - DNA, 22 bp, Homo sapiens
ggcaggaaatgggataagggct

SEQ ID NO: 7013690 - DNA, 22 bp, Homo sapiens
gctccctcccaccagcctgcag

SEQ ID NO: 7013691 - DNA, 22 bp, Homo sapiens
ctatattggtaatatttgctca

SEQ ID NO: 7013692 - DNA, 22 bp, Homo sapiens
tacactttcgtttgtggattag

SEQ ID NO: 7013693 - DNA, 22 bp, Homo sapiens
ttgaggagtcaggggcacggaa

SEQ ID NO: 7013694 - DNA, 22 bp, Homo sapiens
aggagctgaagtctctgcactc

SEQ ID NO: 7013695 - DNA, 22 bp, Homo sapiens
tgtttgtgctgcctggtgggca

SEQ ID NO: 7013696 - DNA, 19 bp, Homo sapiens
ctgtctgtgcagagatgtg

SEQ ID NO: 7013697 - DNA, 22 bp, Homo sapiens
actggaggggaaaatggtagta

SEQ ID NO: 7013698 - DNA, 22 bp, Homo sapiens
agaaatacttaatctttgcagg

SEQ ID NO: 7013699 - DNA, 22 bp, Homo sapiens
gtagaaccttctttactagagt

SEQ ID NO: 7013700 - DNA, 22 bp, Homo sapiens
tacaacatgtggtcctttatga

SEQ ID NO: 7013701 - DNA, 22 bp, Homo sapiens
gcagccaggggctgtgacctgt

SEQ ID NO: 7013702 - DNA, 22 bp, Homo sapiens
ttctctgggttaggggaactat

SEQ ID NO: 7013703 - DNA, 22 bp, Homo sapiens
aaatggtatgaaaagagatttc

SEQ ID NO: 7013704 - DNA, 22 bp, Homo sapiens
tctgaaattgttagtaaaaatg

SEQ ID NO: 7013705 - DNA, 22 bp, Homo sapiens
tagaaacatgagagaaactctt

SEQ ID NO: 7013706 - DNA, 22 bp, Homo sapiens
gctgtgtgactgagagcctggc

SEQ ID NO: 7013707 - DNA, 22 bp, Homo sapiens
cctgggaacagtgggttggctc

SEQ ID NO: 7013708 - DNA, 23 bp, Homo sapiens
tctggatgccaccacatactaac

SEQ ID NO: 7013709 - DNA, 22 bp, Homo sapiens
tggtccagaagatattcaacca

SEQ ID NO: 7013710 - DNA, 22 bp, Homo sapiens
agttgacaataaatttaattgg

SEQ ID NO: 7013711 - DNA, 22 bp, Homo sapiens
ctggtagtttgcaaaatggtgt

SEQ ID NO: 7013712 - DNA, 22 bp, Homo sapiens
gggaagagaggaggtggtttcg

SEQ ID NO: 7013713 - DNA, 22 bp, Homo sapiens
tttcaagagggaactgaacaca

SEQ ID NO: 7013714 - DNA, 22 bp, Homo sapiens
gtctgggtggctgctttcagct

SEQ ID NO: 7013715 - DNA, 22 bp, Homo sapiens
tcactgtagcctcaactcttgg

SEQ ID NO: 7013716 - DNA, 22 bp, Homo sapiens
tccccaggactaagttgcaatc

SEQ ID NO: 7013717 - DNA, 22 bp, Homo sapiens
cccactgagggttaatgcctgc

SEQ ID NO: 7013718 - DNA, 23 bp, Homo sapiens
tgtgtctgaggatatatgtgcat

SEQ ID NO: 7013719 - DNA, 18 bp, Homo sapiens
caggaatggatgggattt

SEQ ID NO: 7013720 - DNA, 22 bp, Homo sapiens
acatattgaggctttgatttaa

SEQ ID NO: 7013721 - DNA, 22 bp, Homo sapiens
aggagacatggaatagtgaggc

SEQ ID NO: 7013722 - DNA, 21 bp, Homo sapiens
agagtaattcctgctggaaag

SEQ ID NO: 7013723 - DNA, 22 bp, Homo sapiens
gcttggctgtgttcaagggcgg

SEQ ID NO: 7013724 - DNA, 22 bp, Homo sapiens
ctcagctgtctcatgggtctgt

SEQ ID NO: 7013725 - DNA, 22 bp, Homo sapiens
agtaaacattttcatattttct

SEQ ID NO: 7013726 - DNA, 22 bp, Homo sapiens
atttggtcttgtatcctggagg

SEQ ID NO: 7013727 - DNA, 22 bp, Homo sapiens
tggaagcatacccccttagcac

SEQ ID NO: 7013728 - DNA, 22 bp, Homo sapiens
cactgcccagcgtcttaggcac

SEQ ID NO: 7013729 - DNA, 22 bp, Homo sapiens
tagtgggtcttataattttagg

SEQ ID NO: 7013730 - DNA, 22 bp, Homo sapiens
tcactgaactctcatagagaaa

SEQ ID NO: 7013731 - DNA, 22 bp, Homo sapiens
tctagggtgttacatacctgct

SEQ ID NO: 7013732 - DNA, 21 bp, Homo sapiens
agcagacagcccaagaaaatc

SEQ ID NO: 7013733 - DNA, 22 bp, Homo sapiens
ctgccaatctgaagagcttctt

SEQ ID NO: 7013734 - DNA, 22 bp, Homo sapiens
tcccagagctctgacaccagct

SEQ ID NO: 7013735 - DNA, 22 bp, Homo sapiens
caagtgagcctcctctttttaa

SEQ ID NO: 7013736 - DNA, 22 bp, Homo sapiens
cccagatgcaggttcaagagta

SEQ ID NO: 7013737 - DNA, 22 bp, Homo sapiens
ggcctgctccgggggctgagct

SEQ ID NO: 7013738 - DNA, 21 bp, Homo sapiens
agagggcgaaggcggggtccg

SEQ ID NO: 7013739 - DNA, 22 bp, Homo sapiens
ttttctcttgttaatgtactga

SEQ ID NO: 7013740 - DNA, 22 bp, Homo sapiens
ccagtcctgctccctgaccacc

SEQ ID NO: 7013741 - DNA, 22 bp, Homo sapiens
gcctctgagtttggagaagagc

SEQ ID NO: 7013742 - DNA, 22 bp, Homo sapiens
tgactttcttaactagctgttc

SEQ ID NO: 7013743 - DNA, 22 bp, Homo sapiens
atttcagatgaccaaatggaaa

SEQ ID NO: 7013744 - DNA, 22 bp, Homo sapiens
acagagcttcccagcctgagca

SEQ ID NO: 7013745 - DNA, 22 bp, Homo sapiens
acatggctcagtctcatgacag

SEQ ID NO: 7013746 - DNA, 22 bp, Homo sapiens
tgatgaggagactgtggcttgg

SEQ ID NO: 7013747 - DNA, 22 bp, Homo sapiens
agaggccagcactgcagggaag

SEQ ID NO: 7013748 - DNA, 22 bp, Homo sapiens
atgatggaggggtggctttaga

SEQ ID NO: 7013749 - DNA, 22 bp, Homo sapiens
atcctgtttgtcactagaaaat

SEQ ID NO: 7013750 - DNA, 22 bp, Homo sapiens
aggcttcttttagaggggatgg

SEQ ID NO: 7013751 - DNA, 22 bp, Homo sapiens
tagatacacacacagtcatgtg

SEQ ID NO: 7013752 - DNA, 22 bp, Homo sapiens
tcttcagctccctgttcagtac

SEQ ID NO: 7013753 - DNA, 22 bp, Homo sapiens
actgtcctgaatactgcatgac

SEQ ID NO: 7013754 - DNA, 22 bp, Homo sapiens
catgttctaatattgtgacata

SEQ ID NO: 7013755 - DNA, 19 bp, Homo sapiens
gcatttcaggcatgtttgc

SEQ ID NO: 7013756 - DNA, 22 bp, Homo sapiens
caggcttttatgaatttcagtg

SEQ ID NO: 7013757 - DNA, 22 bp, Homo sapiens
agacataagtggcattttccaa

SEQ ID NO: 7013758 - DNA, 22 bp, Homo sapiens
gtctgctggcacgtcacagata

SEQ ID NO: 7013759 - DNA, 22 bp, Homo sapiens
tgcaattagcattgtattctta

SEQ ID NO: 7013760 - DNA, 22 bp, Homo sapiens
agcacttcattagtaggtagtc

SEQ ID NO: 7013761 - DNA, 22 bp, Homo sapiens
gggtagcagcagggttcctatg

SEQ ID NO: 7013762 - DNA, 22 bp, Homo sapiens
aggctgagcggggtcccagagc

SEQ ID NO: 7013763 - DNA, 22 bp, Homo sapiens
tcattagataactccaccattt

SEQ ID NO: 7013764 - DNA, 22 bp, Homo sapiens
atctgaaaaatctcctttgtca

SEQ ID NO: 7013765 - DNA, 22 bp, Homo sapiens
agttaaactctagtagatacaa

SEQ ID NO: 7013766 - DNA, 22 bp, Homo sapiens
ggctgagcttttcatgatggtt

SEQ ID NO: 7013767 - DNA, 22 bp, Homo sapiens
ttggcaaaggactcaaagcagg

SEQ ID NO: 7013768 - DNA, 22 bp, Homo sapiens
taggtccctctttagctggttc

SEQ ID NO: 7013769 - DNA, 22 bp, Homo sapiens
tatttccacctattattttctg

SEQ ID NO: 7013770 - DNA, 22 bp, Homo sapiens
ctgcatgtttacatttttgaga

SEQ ID NO: 7013771 - DNA, 22 bp, Homo sapiens
atgatggtaaattcagtatccg

SEQ ID NO: 7013772 - DNA, 22 bp, Homo sapiens
gggcagctgcccctctctgggc

SEQ ID NO: 7013773 - DNA, 22 bp, Homo sapiens
ctctgtggtggagtgggtcacc

SEQ ID NO: 7013774 - DNA, 22 bp, Homo sapiens
gcgtggcttagagtggggtacc

SEQ ID NO: 7013775 - DNA, 22 bp, Homo sapiens
gctgggagtttgatttgactgg

SEQ ID NO: 7013776 - DNA, 22 bp, Homo sapiens
acccacgaagatgagcggcatg

SEQ ID NO: 7013777 - DNA, 22 bp, Homo sapiens
tggctgagaaaatggttttagg

SEQ ID NO: 7013778 - DNA, 18 bp, Homo sapiens
atgctttgcttacgttat

SEQ ID NO: 7013779 - DNA, 18 bp, Homo sapiens
gtccacagattcttcact

SEQ ID NO: 7013780 - DNA, 20 bp, Homo sapiens
ctctgcagcaaggcctgggt

SEQ ID NO: 7013781 - DNA, 22 bp, Homo sapiens
acagcagcagaccagcatatgt

SEQ ID NO: 7013782 - DNA, 22 bp, Homo sapiens
tccaggagtttgacctgtgggc

SEQ ID NO: 7013783 - DNA, 22 bp, Homo sapiens
aaggtccagtttgaattactgt

SEQ ID NO: 7013784 - DNA, 22 bp, Homo sapiens
tagtttgtaatgaggagaagta

SEQ ID NO: 7013785 - DNA, 22 bp, Homo sapiens
acattctatagcaagctgatct

SEQ ID NO: 7013786 - DNA, 18 bp, Homo sapiens
gtctttggagtggaggta

SEQ ID NO: 7013787 - DNA, 22 bp, Homo sapiens
ggctgcttgtcagcagctggcc

SEQ ID NO: 7013788 - DNA, 22 bp, Homo sapiens
tgggtcagagcagacctctgga

SEQ ID NO: 7013789 - DNA, 20 bp, Homo sapiens
cttggcctacttagctttgt

SEQ ID NO: 7013790 - DNA, 22 bp, Homo sapiens
agtgccttcagatttgccccag

SEQ ID NO: 7013791 - DNA, 22 bp, Homo sapiens
ttacacttctaaaaaaagcagg

SEQ ID NO: 7013792 - DNA, 22 bp, Homo sapiens
atctttttgacatggtgatggt

SEQ ID NO: 7013793 - DNA, 22 bp, Homo sapiens
acaatgtgacctgacagtgtta

SEQ ID NO: 7013794 - DNA, 23 bp, Homo sapiens
tctggaggggacactgcagatgc

SEQ ID NO: 7013795 - DNA, 22 bp, Homo sapiens
aggcttctgtctttaggagttg

SEQ ID NO: 7013796 - DNA, 22 bp, Homo sapiens
ctttctccctgtcccaaactgg

SEQ ID NO: 7013797 - DNA, 22 bp, Homo sapiens
cgttctctcatgatcttcccga

SEQ ID NO: 7013798 - DNA, 22 bp, Homo sapiens
ggctctgtcacctatgagctga

SEQ ID NO: 7013799 - DNA, 22 bp, Homo sapiens
agcagcaaagaataggccctct

SEQ ID NO: 7013800 - DNA, 22 bp, Homo sapiens
tgctaagtcactcaagacctct

SEQ ID NO: 7013801 - DNA, 22 bp, Homo sapiens
atcaaattatgtgctacaagaa

SEQ ID NO: 7013802 - DNA, 22 bp, Homo sapiens
aaccaagagggttttccttgaa

SEQ ID NO: 7013803 - DNA, 22 bp, Homo sapiens
tgaattccaaatcctggaatta

SEQ ID NO: 7013804 - DNA, 22 bp, Homo sapiens
tgctatgctttcccccaatgtt

SEQ ID NO: 7013805 - DNA, 22 bp, Homo sapiens
aggtttatgagtttggaagggg

SEQ ID NO: 7013806 - DNA, 22 bp, Homo sapiens
gttgttgatgaagatctgactg

SEQ ID NO: 7013807 - DNA, 22 bp, Homo sapiens
agaggccaagccagactgtgca

SEQ ID NO: 7013808 - DNA, 22 bp, Homo sapiens
tcacaagagctggactgtcttt

SEQ ID NO: 7013809 - DNA, 22 bp, Homo sapiens
accctggagcaataatccctgg

SEQ ID NO: 7013810 - DNA, 22 bp, Homo sapiens
aaacattccatatataccttgt

SEQ ID NO: 7013811 - DNA, 22 bp, Homo sapiens
tcagccctagaaagtctaagca

SEQ ID NO: 7013812 - DNA, 22 bp, Homo sapiens
cagaagcagtgagagatgtgca

SEQ ID NO: 7013813 - DNA, 22 bp, Homo sapiens
tgtcctcacacgtagggagtaa

SEQ ID NO: 7013814 - DNA, 22 bp, Homo sapiens
atctgaggtatatgactggcta

SEQ ID NO: 7013815 - DNA, 18 bp, Homo sapiens
gctgccttcccagtcaag

SEQ ID NO: 7013816 - DNA, 22 bp, Homo sapiens
tccacaatggcagagaaatgtc

SEQ ID NO: 7013817 - DNA, 22 bp, Homo sapiens
cagtaaatcctagagccctcat

SEQ ID NO: 7013818 - DNA, 20 bp, Homo sapiens
ctcagctaaacaacactgac

SEQ ID NO: 7013819 - DNA, 22 bp, Homo sapiens
tgtatgcttgagtgtgtatact

SEQ ID NO: 7013820 - DNA, 22 bp, Homo sapiens
gtgggctttgctggatccttcc

SEQ ID NO: 7013821 - DNA, 22 bp, Homo sapiens
gtcctgttggtgaatggctctt

SEQ ID NO: 7013822 - DNA, 22 bp, Homo sapiens
gtggcatggagaaggaggcagt

SEQ ID NO: 7013823 - DNA, 22 bp, Homo sapiens
gtctggggtgaggcccgggatt

SEQ ID NO: 7013824 - DNA, 22 bp, Homo sapiens
gcagatgctgtggtgatagaag

SEQ ID NO: 7013825 - DNA, 22 bp, Homo sapiens
gccaggcagagccccgtgcagc

SEQ ID NO: 7013826 - DNA, 18 bp, Homo sapiens
cacaatttacagatgaca

SEQ ID NO: 7013827 - DNA, 22 bp, Homo sapiens
aggctgtgtttaagtggtaatg

SEQ ID NO: 7013828 - DNA, 21 bp, Homo sapiens
tttgaaagctacatctatagc

SEQ ID NO: 7013829 - DNA, 21 bp, Homo sapiens
tgttacagtccaaatgtttgt

SEQ ID NO: 7013830 - DNA, 22 bp, Homo sapiens
tgctcagctgctctgtattctt

SEQ ID NO: 7013831 - DNA, 22 bp, Homo sapiens
tacatgtattgatttctcttct

SEQ ID NO: 7013832 - DNA, 22 bp, Homo sapiens
tttatctgggattttgcagtct

SEQ ID NO: 7013833 - DNA, 22 bp, Homo sapiens
agttttctgggatcactggaat

SEQ ID NO: 7013834 - DNA, 22 bp, Homo sapiens
tattttactttaaagcgagaga

SEQ ID NO: 7013835 - DNA, 22 bp, Homo sapiens
agctggtcctaattgagccatt

SEQ ID NO: 7013836 - DNA, 22 bp, Homo sapiens
tgaatctatgttgccccataat

SEQ ID NO: 7013837 - DNA, 22 bp, Homo sapiens
attttgctgtggtacattagga

SEQ ID NO: 7013838 - DNA, 22 bp, Homo sapiens
tcctgagggcgattcagcaggt

SEQ ID NO: 7013839 - DNA, 20 bp, Homo sapiens
gacatgtctttctcacacaa

SEQ ID NO: 7013840 - DNA, 17 bp, Homo sapiens
agcactaaggataatac

SEQ ID NO: 7013841 - DNA, 22 bp, Homo sapiens
ggcaggtgtggagtgttatttt

SEQ ID NO: 7013842 - DNA, 18 bp, Homo sapiens
aggcatggtggtgcgcac

SEQ ID NO: 7013843 - DNA, 22 bp, Homo sapiens
ttctggaactatactgttggtg

SEQ ID NO: 7013844 - DNA, 22 bp, Homo sapiens
ttcctcacctaattgggagggg

SEQ ID NO: 7013845 - DNA, 17 bp, Homo sapiens
gtttgcatggtgttaac

SEQ ID NO: 7013846 - DNA, 22 bp, Homo sapiens
cttcttgaaagtggtgaccctc

SEQ ID NO: 7013847 - DNA, 22 bp, Homo sapiens
agtcacatcgattataaaattt

SEQ ID NO: 7013848 - DNA, 22 bp, Homo sapiens
ctcctcaggaagtagcatgtgt

SEQ ID NO: 7013849 - DNA, 21 bp, Homo sapiens
catgatctcattcaactaggg

SEQ ID NO: 7013850 - DNA, 22 bp, Homo sapiens
aaggtgctgtggacttgggagc

SEQ ID NO: 7013851 - DNA, 22 bp, Homo sapiens
gaactttaattagcttttgtct

SEQ ID NO: 7013852 - DNA, 22 bp, Homo sapiens
ccttccaagtgctgctttttcc

SEQ ID NO: 7013853 - DNA, 22 bp, Homo sapiens
atggcagtatttctgaaaggct

SEQ ID NO: 7013854 - DNA, 19 bp, Homo sapiens
tgaattctgttagaggcag

SEQ ID NO: 7013855 - DNA, 15 bp, Homo sapiens
ggcaggtggatcact

SEQ ID NO: 7013856 - DNA, 22 bp, Homo sapiens
gatgaatgatggcttgtttctg

SEQ ID NO: 7013857 - DNA, 22 bp, Homo sapiens
agacagactgtgtttgaatcct

SEQ ID NO: 7013858 - DNA, 22 bp, Homo sapiens
ggctgctcacgcagccctccct

SEQ ID NO: 7013859 - DNA, 22 bp, Homo sapiens
caggagaggctgtacgtttctc

SEQ ID NO: 7013860 - DNA, 22 bp, Homo sapiens
acaatgttctacatatacataa

SEQ ID NO: 7013861 - DNA, 22 bp, Homo sapiens
catttctgattacagaatacta

SEQ ID NO: 7013862 - DNA, 22 bp, Homo sapiens
ccaaggccatcaggtaggtcct

SEQ ID NO: 7013863 - DNA, 22 bp, Homo sapiens
actggactctggaggtttcgta

SEQ ID NO: 7013864 - DNA, 21 bp, Homo sapiens
gcagtttatgtaatatgcact

SEQ ID NO: 7013865 - DNA, 22 bp, Homo sapiens
gctcactgcctgggcaacaaga

SEQ ID NO: 7013866 - DNA, 20 bp, Homo sapiens
gcttggcataggccacttga

SEQ ID NO: 7013867 - DNA, 22 bp, Homo sapiens
ccctcagctcaagcccctgtgc

SEQ ID NO: 7013868 - DNA, 19 bp, Homo sapiens
gtccatgcttagaggggcc

SEQ ID NO: 7013869 - DNA, 22 bp, Homo sapiens
cactgggctgataccaggcttc

SEQ ID NO: 7013870 - DNA, 23 bp, Homo sapiens
ttcctggcaggtacaacttttac

SEQ ID NO: 7013871 - DNA, 22 bp, Homo sapiens
agggaccagcgtgagtctgagg

SEQ ID NO: 7013872 - DNA, 22 bp, Homo sapiens
catccctgtctgccactctgaa

SEQ ID NO: 7013873 - DNA, 22 bp, Homo sapiens
gccctcctttgcttctcctagt

SEQ ID NO: 7013874 - DNA, 22 bp, Homo sapiens
aagggaatgttgtggttggttt

SEQ ID NO: 7013875 - DNA, 22 bp, Homo sapiens
tctctaagataggaatacagtt

SEQ ID NO: 7013876 - DNA, 22 bp, Homo sapiens
aatactagttattaaagctttt

SEQ ID NO: 7013877 - DNA, 23 bp, Homo sapiens
agtggccttccaggttgtgtttc

SEQ ID NO: 7013878 - DNA, 22 bp, Homo sapiens
cagtagtctttttcctcctaga

SEQ ID NO: 7013879 - DNA, 22 bp, Homo sapiens
ttctgagctgcaacactaacat

SEQ ID NO: 7013880 - DNA, 22 bp, Homo sapiens
gtgtacttctgctgagccatgg

SEQ ID NO: 7013881 - DNA, 18 bp, Homo sapiens
gtgtcctggctgcggcgc

SEQ ID NO: 7013882 - DNA, 22 bp, Homo sapiens
tgtctcaggcccaagccagtaa

SEQ ID NO: 7013883 - DNA, 22 bp, Homo sapiens
tattaagagatgtatgaagaga

SEQ ID NO: 7013884 - DNA, 22 bp, Homo sapiens
tgcttatttgaatttattctca

SEQ ID NO: 7013885 - DNA, 22 bp, Homo sapiens
attgcacaaagagggaaactga

SEQ ID NO: 7013886 - DNA, 22 bp, Homo sapiens
gtgcagcaaactagtgcgaggg

SEQ ID NO: 7013887 - DNA, 22 bp, Homo sapiens
ttctttccacagaggggatgat

SEQ ID NO: 7013888 - DNA, 22 bp, Homo sapiens
acattagcccatctggtatttg

SEQ ID NO: 7013889 - DNA, 22 bp, Homo sapiens
tggcaggagagcgtcagatcag

SEQ ID NO: 7013890 - DNA, 22 bp, Homo sapiens
gctgtctgtcttcacatctcgc

SEQ ID NO: 7013891 - DNA, 22 bp, Homo sapiens
gcagaaggtctggcacttcagg

SEQ ID NO: 7013892 - DNA, 22 bp, Homo sapiens
ttctggaaatgttgctgaggcc

SEQ ID NO: 7013893 - DNA, 22 bp, Homo sapiens
ttgggagattcattgagccaag

SEQ ID NO: 7013894 - DNA, 22 bp, Homo sapiens
ttgctcatatttgcatgtgttt

SEQ ID NO: 7013895 - DNA, 22 bp, Homo sapiens
ccatgtggtgggaaggagaatg

SEQ ID NO: 7013896 - DNA, 22 bp, Homo sapiens
agctcccctcgtttctctccat

SEQ ID NO: 7013897 - DNA, 23 bp, Homo sapiens
gcattctgatggttctctgtgat

SEQ ID NO: 7013898 - DNA, 22 bp, Homo sapiens
agtggcagagccagggttggga

SEQ ID NO: 7013899 - DNA, 22 bp, Homo sapiens
cagagcagatttctaagtattg

SEQ ID NO: 7013900 - DNA, 22 bp, Homo sapiens
tgcatcctgttctaggtttggg

SEQ ID NO: 7013901 - DNA, 22 bp, Homo sapiens
agtctctgccagcttgtcctct

SEQ ID NO: 7013902 - DNA, 22 bp, Homo sapiens
gttataaatgactgcaaaagtt

SEQ ID NO: 7013903 - DNA, 22 bp, Homo sapiens
ttcaagtatgagaaaggggact

SEQ ID NO: 7013904 - DNA, 23 bp, Homo sapiens
catttctgggagatttataaaat

SEQ ID NO: 7013905 - DNA, 22 bp, Homo sapiens
cattgcttatttcagctaaagt

SEQ ID NO: 7013906 - DNA, 22 bp, Homo sapiens
ttcagtgttactcaaggggcag

SEQ ID NO: 7013907 - DNA, 22 bp, Homo sapiens
gctttcttggttctgcaggggc

SEQ ID NO: 7013908 - DNA, 22 bp, Homo sapiens
gagtaattagagcaatgacttt

SEQ ID NO: 7013909 - DNA, 22 bp, Homo sapiens
cagggttagagaaaatccttaa

SEQ ID NO: 7013910 - DNA, 23 bp, Homo sapiens
gcagtgtttgcttcatcttatcc

SEQ ID NO: 7013911 - DNA, 22 bp, Homo sapiens
ctgctctctttcagagacaggt

SEQ ID NO: 7013912 - DNA, 22 bp, Homo sapiens
tttagcaagttctctgagagaa

SEQ ID NO: 7013913 - DNA, 18 bp, Homo sapiens
tttctcagactctctttc

SEQ ID NO: 7013914 - DNA, 22 bp, Homo sapiens
aggctcaggtgcctcattcaca

SEQ ID NO: 7013915 - DNA, 22 bp, Homo sapiens
aagcttcagttctggggcaatg

SEQ ID NO: 7013916 - DNA, 22 bp, Homo sapiens
tcaacagttgcactggagaggt

SEQ ID NO: 7013917 - DNA, 22 bp, Homo sapiens
ggagttgctggatgtggtttaa

SEQ ID NO: 7013918 - DNA, 22 bp, Homo sapiens
actcttatggaaattttaacta

SEQ ID NO: 7013919 - DNA, 22 bp, Homo sapiens
atagtgcagggaaggccaatct

SEQ ID NO: 7013920 - DNA, 22 bp, Homo sapiens
atctgcttgttgcatgtctgtt

SEQ ID NO: 7013921 - DNA, 22 bp, Homo sapiens
gcatggctctggcctcagtgtg

SEQ ID NO: 7013922 - DNA, 22 bp, Homo sapiens
ctgcaatctccatgcttgattt

SEQ ID NO: 7013923 - DNA, 22 bp, Homo sapiens
gacccaggaagctacttctggt

SEQ ID NO: 7013924 - DNA, 22 bp, Homo sapiens
ttctgcaggctgtacaagaagc

SEQ ID NO: 7013925 - DNA, 22 bp, Homo sapiens
ccaccacatttgcctagacttt

SEQ ID NO: 7013926 - DNA, 22 bp, Homo sapiens
agagatgcggttccatggttat

SEQ ID NO: 7013927 - DNA, 22 bp, Homo sapiens
atgatggtgggtaatgtgtaaa

SEQ ID NO: 7013928 - DNA, 22 bp, Homo sapiens
gaggcctggtttccagcatcct

SEQ ID NO: 7013929 - DNA, 22 bp, Homo sapiens
tgagtcacacatttcttcatac

SEQ ID NO: 7013930 - DNA, 22 bp, Homo sapiens
gttatgtattgggaaatccaag

SEQ ID NO: 7013931 - DNA, 22 bp, Homo sapiens
gaaagcccattgacaaagaagt

SEQ ID NO: 7013932 - DNA, 22 bp, Homo sapiens
ggtcacttctttcatcgaaact

SEQ ID NO: 7013933 - DNA, 21 bp, Homo sapiens
tgagcaccttcttatattttg

SEQ ID NO: 7013934 - DNA, 22 bp, Homo sapiens
tgcctggcactcctggagctca

SEQ ID NO: 7013935 - DNA, 22 bp, Homo sapiens
ttgggcactgtgggttgtctgt

SEQ ID NO: 7013936 - DNA, 22 bp, Homo sapiens
ttcaccattacatacaaagatg

SEQ ID NO: 7013937 - DNA, 22 bp, Homo sapiens
agagcccagtgacatcagcaca

SEQ ID NO: 7013938 - DNA, 22 bp, Homo sapiens
agctgtttaaatgacttacttt

SEQ ID NO: 7013939 - DNA, 22 bp, Homo sapiens
tgttcagtttgctatcataatc

SEQ ID NO: 7013940 - DNA, 22 bp, Homo sapiens
tcctgggaagttgcatcaccgt

SEQ ID NO: 7013941 - DNA, 19 bp, Homo sapiens
ttggttcatggatgcccaa

SEQ ID NO: 7013942 - DNA, 22 bp, Homo sapiens
tgtgagcaagattcagagattc

SEQ ID NO: 7013943 - DNA, 22 bp, Homo sapiens
aatccataggtttttccaagag

SEQ ID NO: 7013944 - DNA, 22 bp, Homo sapiens
gatttcttgagcaagttgctta

SEQ ID NO: 7013945 - DNA, 22 bp, Homo sapiens
ctgcaaggctgaattcagctga

SEQ ID NO: 7013946 - DNA, 19 bp, Homo sapiens
cctttagttgctcagagaa

SEQ ID NO: 7013947 - DNA, 22 bp, Homo sapiens
gcttacaagatcgtgctccagt

SEQ ID NO: 7013948 - DNA, 22 bp, Homo sapiens
ggcatcctctagaagctggaaa

SEQ ID NO: 7013949 - DNA, 22 bp, Homo sapiens
agcccaggtccagttcactgca

SEQ ID NO: 7013950 - DNA, 22 bp, Homo sapiens
cagctggtcaactgaatgaaca

SEQ ID NO: 7013951 - DNA, 22 bp, Homo sapiens
ctatgcttacctctatggatac

SEQ ID NO: 7013952 - DNA, 22 bp, Homo sapiens
cgagagtggacagggcgcagct

SEQ ID NO: 7013953 - DNA, 22 bp, Homo sapiens
agtctgcactcaggtggaggtc

SEQ ID NO: 7013954 - DNA, 22 bp, Homo sapiens
tactgtatgaattatgttattt

SEQ ID NO: 7013955 - DNA, 22 bp, Homo sapiens
ttagacagagctccttgagggc

SEQ ID NO: 7013956 - DNA, 22 bp, Homo sapiens
cctggaaactgttgtcaaatct

SEQ ID NO: 7013957 - DNA, 22 bp, Homo sapiens
tgccactggggctaggactgtt

SEQ ID NO: 7013958 - DNA, 22 bp, Homo sapiens
aagggtgctgctatcaggaagc

SEQ ID NO: 7013959 - DNA, 22 bp, Homo sapiens
ttcatgtccagaggaagttgag

SEQ ID NO: 7013960 - DNA, 22 bp, Homo sapiens
atccctgccctcatggagctta

SEQ ID NO: 7013961 - DNA, 22 bp, Homo sapiens
aggttaggaatgggaggtaatg

SEQ ID NO: 7013962 - DNA, 22 bp, Homo sapiens
catttagtcaaggacacgtggc

SEQ ID NO: 7013963 - DNA, 16 bp, Homo sapiens
ccaagcagcagcagct

SEQ ID NO: 7013964 - DNA, 22 bp, Homo sapiens
agaaggcttaaaacatggaata

SEQ ID NO: 7013965 - DNA, 22 bp, Homo sapiens
gcagggacaaggcaggtgttct

SEQ ID NO: 7013966 - DNA, 22 bp, Homo sapiens
tccctgagtgggctggtagtat

SEQ ID NO: 7013967 - DNA, 22 bp, Homo sapiens
agttgtattagagaacacaaac

SEQ ID NO: 7013968 - DNA, 22 bp, Homo sapiens
taaggtttgaagaagactgagc

SEQ ID NO: 7013969 - DNA, 21 bp, Homo sapiens
agattaaaatctgtgagaagg

SEQ ID NO: 7013970 - DNA, 22 bp, Homo sapiens
aagtacagccttcattctcatg

SEQ ID NO: 7013971 - DNA, 22 bp, Homo sapiens
ggagagtgggagcaactgttgc

SEQ ID NO: 7013972 - DNA, 22 bp, Homo sapiens
actcagaatgtcactgagggac

SEQ ID NO: 7013973 - DNA, 22 bp, Homo sapiens
cctggccgacatggtgaaacgc

SEQ ID NO: 7013974 - DNA, 23 bp, Homo sapiens
ggataaatctcagcttcttccat

SEQ ID NO: 7013975 - DNA, 22 bp, Homo sapiens
ttattgcaaccttttctggtgt

SEQ ID NO: 7013976 - DNA, 22 bp, Homo sapiens
gcccagtttcagctctgccttt

SEQ ID NO: 7013977 - DNA, 22 bp, Homo sapiens
cttctgagcagacctcctgggg

SEQ ID NO: 7013978 - DNA, 22 bp, Homo sapiens
gtctttcttcagagcttggact

SEQ ID NO: 7013979 - DNA, 22 bp, Homo sapiens
tacttcctgtttccatgtctgt

SEQ ID NO: 7013980 - DNA, 22 bp, Homo sapiens
ctaatcatctttctcttaaagc

SEQ ID NO: 7013981 - DNA, 22 bp, Homo sapiens
gaaatgccctcccactgaatgt

SEQ ID NO: 7013982 - DNA, 22 bp, Homo sapiens
tggtggcagctgggacagaggt

SEQ ID NO: 7013983 - DNA, 22 bp, Homo sapiens
ttacagttgctacaaaggataa

SEQ ID NO: 7013984 - DNA, 22 bp, Homo sapiens
gctgcacagacttgctcattta

SEQ ID NO: 7013985 - DNA, 22 bp, Homo sapiens
aagacaatgtttctgatagata

SEQ ID NO: 7013986 - DNA, 22 bp, Homo sapiens
gtgaacattttcttgcaaattg

SEQ ID NO: 7013987 - DNA, 22 bp, Homo sapiens
actgttcacagattagtcgatg

SEQ ID NO: 7013988 - DNA, 22 bp, Homo sapiens
ggagaagggccaattccatgta

SEQ ID NO: 7013989 - DNA, 22 bp, Homo sapiens
atgaagtctgccaaggaaaggc

SEQ ID NO: 7013990 - DNA, 22 bp, Homo sapiens
atatccagcagcaggtgagtat

SEQ ID NO: 7013991 - DNA, 22 bp, Homo sapiens
ttcatgtagcttagcagagagg

SEQ ID NO: 7013992 - DNA, 22 bp, Homo sapiens
taggcattacctaacattacct

SEQ ID NO: 7013993 - DNA, 18 bp, Homo sapiens
gccatgttctatgcttac

SEQ ID NO: 7013994 - DNA, 22 bp, Homo sapiens
agcaggagtttgatgcttttat

SEQ ID NO: 7013995 - DNA, 22 bp, Homo sapiens
caccccagtctaaaaccagcct

SEQ ID NO: 7013996 - DNA, 22 bp, Homo sapiens
caggaaagccgagtgccatagg

SEQ ID NO: 7013997 - DNA, 22 bp, Homo sapiens
acaagagattatctacagatga

SEQ ID NO: 7013998 - DNA, 22 bp, Homo sapiens
tcacagctccagactgcaactc

SEQ ID NO: 7013999 - DNA, 22 bp, Homo sapiens
tgattccactctgaggatcgta

SEQ ID NO: 7014000 - DNA, 20 bp, Homo sapiens
tcacatgcatattcgtttct

SEQ ID NO: 7014001 - DNA, 21 bp, Homo sapiens
attcagtttgacatctagcag

SEQ ID NO: 7014002 - DNA, 22 bp, Homo sapiens
acagccttgcttatttgtctct

SEQ ID NO: 7014003 - DNA, 22 bp, Homo sapiens
gtgcttaatacatgtcaataac

SEQ ID NO: 7014004 - DNA, 22 bp, Homo sapiens
gcaaggatgtactgcaatagga

SEQ ID NO: 7014005 - DNA, 22 bp, Homo sapiens
ttccatccatgtcccgtttctg

SEQ ID NO: 7014006 - DNA, 22 bp, Homo sapiens
tgttggtaggatttgcttcagc

SEQ ID NO: 7014007 - DNA, 22 bp, Homo sapiens
tctctagagcatgtgctgggca

SEQ ID NO: 7014008 - DNA, 22 bp, Homo sapiens
gcctctagggctgttgggaatt

SEQ ID NO: 7014009 - DNA, 22 bp, Homo sapiens
agaaagtgaacgtgttcagttt

SEQ ID NO: 7014010 - DNA, 22 bp, Homo sapiens
agaggggctcatatcctgtcat

SEQ ID NO: 7014011 - DNA, 22 bp, Homo sapiens
tgtaacatatagcatgttcttg

SEQ ID NO: 7014012 - DNA, 22 bp, Homo sapiens
tcaatacatacaatgtatagtg

SEQ ID NO: 7014013 - DNA, 22 bp, Homo sapiens
aagaacatgagttatgatgatt

SEQ ID NO: 7014014 - DNA, 22 bp, Homo sapiens
agttaaggagagttggaatcag

SEQ ID NO: 7014015 - DNA, 20 bp, Homo sapiens
aagctggcaggtcatagctt

SEQ ID NO: 7014016 - DNA, 22 bp, Homo sapiens
attagctttaaaccacagcagt

SEQ ID NO: 7014017 - DNA, 22 bp, Homo sapiens
gggaacctgccccaggcctctg

SEQ ID NO: 7014018 - DNA, 22 bp, Homo sapiens
tgggagcaaatgactgggagat

SEQ ID NO: 7014019 - DNA, 22 bp, Homo sapiens
ggctttgacatgctgaattaaa

SEQ ID NO: 7014020 - DNA, 22 bp, Homo sapiens
gatattcataggcaggtattta

SEQ ID NO: 7014021 - DNA, 17 bp, Homo sapiens
ggcttccaggtggctct

SEQ ID NO: 7014022 - DNA, 22 bp, Homo sapiens
acttcatgttgctcttggctat

SEQ ID NO: 7014023 - DNA, 19 bp, Homo sapiens
tggcaggtagtgagcagtc

SEQ ID NO: 7014024 - DNA, 22 bp, Homo sapiens
ttgagatgtcttttggcattat

SEQ ID NO: 7014025 - DNA, 22 bp, Homo sapiens
actgggcttcacttggcacatc

SEQ ID NO: 7014026 - DNA, 22 bp, Homo sapiens
cagaaatgtgatgtacacacac

SEQ ID NO: 7014027 - DNA, 22 bp, Homo sapiens
tgcacacagtggacaagtcttg

SEQ ID NO: 7014028 - DNA, 22 bp, Homo sapiens
catggctgcattggaatgggtt

SEQ ID NO: 7014029 - DNA, 22 bp, Homo sapiens
tcagagtgaggcgtcaacatga

SEQ ID NO: 7014030 - DNA, 22 bp, Homo sapiens
tgcaggctatatcttatttgac

SEQ ID NO: 7014031 - DNA, 22 bp, Homo sapiens
tgggccagtccagccccaggga

SEQ ID NO: 7014032 - DNA, 22 bp, Homo sapiens
gacatttagaagttagattcaa

SEQ ID NO: 7014033 - DNA, 22 bp, Homo sapiens
tctaaactcctttacccagacc

SEQ ID NO: 7014034 - DNA, 22 bp, Homo sapiens
ggtgcagaaggaagggagctgg

SEQ ID NO: 7014035 - DNA, 22 bp, Homo sapiens
catttgtttagaagtctttata

SEQ ID NO: 7014036 - DNA, 22 bp, Homo sapiens
taggtctgaggctgcatcttgg

SEQ ID NO: 7014037 - DNA, 22 bp, Homo sapiens
gtgactctcaaaagtgcagtct

SEQ ID NO: 7014038 - DNA, 22 bp, Homo sapiens
ttggcaaaatttaaagaagtga

SEQ ID NO: 7014039 - DNA, 22 bp, Homo sapiens
ggcaaacaccaggcgagggagc

SEQ ID NO: 7014040 - DNA, 22 bp, Homo sapiens
tacacacagaggccatgggatt

SEQ ID NO: 7014041 - DNA, 22 bp, Homo sapiens
ttctcacaaatccatccaggag

SEQ ID NO: 7014042 - DNA, 22 bp, Homo sapiens
gcattcttagggcctggggtgt

SEQ ID NO: 7014043 - DNA, 22 bp, Homo sapiens
tgctttattcagggtttacccc

SEQ ID NO: 7014044 - DNA, 22 bp, Homo sapiens
tgctggagtgagtggtttctta

SEQ ID NO: 7014045 - DNA, 22 bp, Homo sapiens
gaacaaggattcccaaagaaga

SEQ ID NO: 7014046 - DNA, 22 bp, Homo sapiens
gcattggttaagagctttgggg

SEQ ID NO: 7014047 - DNA, 22 bp, Homo sapiens
atacttttaattccttctgagt

SEQ ID NO: 7014048 - DNA, 21 bp, Homo sapiens
gcctagggagatgggactgcc

SEQ ID NO: 7014049 - DNA, 22 bp, Homo sapiens
ttgaagcatggtacttgttcaa

SEQ ID NO: 7014050 - DNA, 22 bp, Homo sapiens
gctccccttggtcctcctggga

SEQ ID NO: 7014051 - DNA, 22 bp, Homo sapiens
aggcagagctaggaagaattgt

SEQ ID NO: 7014052 - DNA, 22 bp, Homo sapiens
catgctaaaatatctgaagatt

SEQ ID NO: 7014053 - DNA, 22 bp, Homo sapiens
ttttccttcacctcttgagcct

SEQ ID NO: 7014054 - DNA, 22 bp, Homo sapiens
tgggagttgggcagaacaagtg

SEQ ID NO: 7014055 - DNA, 22 bp, Homo sapiens
ggcaggttggatgctgtagtga

SEQ ID NO: 7014056 - DNA, 22 bp, Homo sapiens
gaactgaaacttggtttaaagc

SEQ ID NO: 7014057 - DNA, 22 bp, Homo sapiens
tccctgtggcacacccaagccc

SEQ ID NO: 7014058 - DNA, 22 bp, Homo sapiens
ctggatgtaaagggtgaagaaa

SEQ ID NO: 7014059 - DNA, 20 bp, Homo sapiens
tctacatgcctcttcccatc

SEQ ID NO: 7014060 - DNA, 22 bp, Homo sapiens
tggcagagtctgggcttgggca

SEQ ID NO: 7014061 - DNA, 22 bp, Homo sapiens
gtacatttatttttgcagcata

SEQ ID NO: 7014062 - DNA, 20 bp, Homo sapiens
caaggcagaccagagtgagt

SEQ ID NO: 7014063 - DNA, 22 bp, Homo sapiens
tcacttagatggggatcatcac

SEQ ID NO: 7014064 - DNA, 17 bp, Homo sapiens
caggtgttctgtttttc

SEQ ID NO: 7014065 - DNA, 22 bp, Homo sapiens
gctgtttctccaggtcaggaag

SEQ ID NO: 7014066 - DNA, 22 bp, Homo sapiens
gagaggccatggggtgggatgc

SEQ ID NO: 7014067 - DNA, 22 bp, Homo sapiens
agcagtgctatggccaggctaa

SEQ ID NO: 7014068 - DNA, 22 bp, Homo sapiens
gcagctttgaagacttatttgc

SEQ ID NO: 7014069 - DNA, 22 bp, Homo sapiens
tacagaagttggttttagttta

SEQ ID NO: 7014070 - DNA, 18 bp, Homo sapiens
gagcagaggagggttttt

SEQ ID NO: 7014071 - DNA, 22 bp, Homo sapiens
tacagaggagaccaaggctcag

SEQ ID NO: 7014072 - DNA, 22 bp, Homo sapiens
agtcacatagaagtgggtttaa

SEQ ID NO: 7014073 - DNA, 22 bp, Homo sapiens
tggaaagagaaactcttgctaa

SEQ ID NO: 7014074 - DNA, 22 bp, Homo sapiens
atcaaagtttcccagaagttgt

SEQ ID NO: 7014075 - DNA, 22 bp, Homo sapiens
tttatccaagcacaatttctaa

SEQ ID NO: 7014076 - DNA, 22 bp, Homo sapiens
acagtgtcatgtcgtgttcccc

SEQ ID NO: 7014077 - DNA, 22 bp, Homo sapiens
gcattcttggtatgaaggacag

SEQ ID NO: 7014078 - DNA, 22 bp, Homo sapiens
gagggctgtgaaggagcgggtt

SEQ ID NO: 7014079 - DNA, 22 bp, Homo sapiens
ggggtgagtgctcagccccgga

SEQ ID NO: 7014080 - DNA, 22 bp, Homo sapiens
tacttcccactggggtctacca

SEQ ID NO: 7014081 - DNA, 22 bp, Homo sapiens
gcactccagcctgggtaacagc

SEQ ID NO: 7014082 - DNA, 22 bp, Homo sapiens
ggcattaactctgtttcaattt

SEQ ID NO: 7014083 - DNA, 22 bp, Homo sapiens
taagtcatggagctgggattga

SEQ ID NO: 7014084 - DNA, 22 bp, Homo sapiens
agggagagacatttccttcttg

SEQ ID NO: 7014085 - DNA, 22 bp, Homo sapiens
aaggagaggttgtccgtgttgt

SEQ ID NO: 7014086 - DNA, 21 bp, Homo sapiens
tctatgcaagaccctagtcct

SEQ ID NO: 7014087 - DNA, 19 bp, Homo sapiens
gggttgtgtggaaggtatc

SEQ ID NO: 7014088 - DNA, 22 bp, Homo sapiens
caagccagctcctgccacagag

SEQ ID NO: 7014089 - DNA, 22 bp, Homo sapiens
aggcactgaatatccagtaaaa

SEQ ID NO: 7014090 - DNA, 22 bp, Homo sapiens
tgctaggagaggcagcacagcg

SEQ ID NO: 7014091 - DNA, 22 bp, Homo sapiens
ggtgtccttcgtccgctggcat

SEQ ID NO: 7014092 - DNA, 22 bp, Homo sapiens
tagattttaggagattttactg

SEQ ID NO: 7014093 - DNA, 22 bp, Homo sapiens
gtgcagaagtaacaattaaaga

SEQ ID NO: 7014094 - DNA, 22 bp, Homo sapiens
tctcctttaagatttcctcagg

SEQ ID NO: 7014095 - DNA, 22 bp, Homo sapiens
atttaatttatagatgtggata

SEQ ID NO: 7014096 - DNA, 22 bp, Homo sapiens
aacatgcaatgtctgaaaatcc

SEQ ID NO: 7014097 - DNA, 22 bp, Homo sapiens
tgtttgcattgttaattcagtc

SEQ ID NO: 7014098 - DNA, 22 bp, Homo sapiens
tactgtctggcaattaagaatc

SEQ ID NO: 7014099 - DNA, 22 bp, Homo sapiens
gggagggaaggtacctgtgtga

SEQ ID NO: 7014100 - DNA, 22 bp, Homo sapiens
cccaggagttagaggttgtggt

SEQ ID NO: 7014101 - DNA, 22 bp, Homo sapiens
tagctgcacaggaagtaagatt

SEQ ID NO: 7014102 - DNA, 22 bp, Homo sapiens
gcagctcctggcacagtttttt

SEQ ID NO: 7014103 - DNA, 22 bp, Homo sapiens
tcctcagatacctggcagatca

SEQ ID NO: 7014104 - DNA, 22 bp, Homo sapiens
atgctgtgtctagcaggaacac

SEQ ID NO: 7014105 - DNA, 22 bp, Homo sapiens
gcagaggttggattggtgactt

SEQ ID NO: 7014106 - DNA, 21 bp, Homo sapiens
ggcctcccggaccgcagcgcc

SEQ ID NO: 7014107 - DNA, 22 bp, Homo sapiens
tcaaattttaacatgcattaga

SEQ ID NO: 7014108 - DNA, 22 bp, Homo sapiens
ctgtcgtgttcactgtggccta

SEQ ID NO: 7014109 - DNA, 22 bp, Homo sapiens
tttctgcatttacaaaatgagg

SEQ ID NO: 7014110 - DNA, 22 bp, Homo sapiens
tggaaattaaaattcctcttaa

SEQ ID NO: 7014111 - DNA, 22 bp, Homo sapiens
gagagctgtttatcttcttcaa

SEQ ID NO: 7014112 - DNA, 22 bp, Homo sapiens
ggcaaggggtcaggctgagaca

SEQ ID NO: 7014113 - DNA, 22 bp, Homo sapiens
ggcatatatctctatttagcca

SEQ ID NO: 7014114 - DNA, 22 bp, Homo sapiens
gctgagctgctgttcatcctgc

SEQ ID NO: 7014115 - DNA, 22 bp, Homo sapiens
gcttatcttgaaatccaccagc

SEQ ID NO: 7014116 - DNA, 22 bp, Homo sapiens
tcagatttctagcgtttggcca

SEQ ID NO: 7014117 - DNA, 22 bp, Homo sapiens
gtttctgaagggattacttggt

SEQ ID NO: 7014118 - DNA, 22 bp, Homo sapiens
tgctggaattgacctagaagga

SEQ ID NO: 7014119 - DNA, 22 bp, Homo sapiens
tcctgcagacctcagtcaggtc

SEQ ID NO: 7014120 - DNA, 22 bp, Homo sapiens
acagaattaacatttgatgaat

SEQ ID NO: 7014121 - DNA, 22 bp, Homo sapiens
tgtctgctcggggttcccacct

SEQ ID NO: 7014122 - DNA, 22 bp, Homo sapiens
tgtagttaggctgggaattggc

SEQ ID NO: 7014123 - DNA, 22 bp, Homo sapiens
ccagatggtccagagtctagcc

SEQ ID NO: 7014124 - DNA, 22 bp, Homo sapiens
attagttgaacaagttaagtaa

SEQ ID NO: 7014125 - DNA, 22 bp, Homo sapiens
tcccagccttatctcccctggc

SEQ ID NO: 7014126 - DNA, 22 bp, Homo sapiens
ctgaaggcttgttgttttctta

SEQ ID NO: 7014127 - DNA, 22 bp, Homo sapiens
tctgctgctgaccaacactgtg

SEQ ID NO: 7014128 - DNA, 22 bp, Homo sapiens
accaacatgtcctcacacagcc

SEQ ID NO: 7014129 - DNA, 22 bp, Homo sapiens
gagagttctacctctgaaggcg

SEQ ID NO: 7014130 - DNA, 19 bp, Homo sapiens
gggagctttccatctgtcc

SEQ ID NO: 7014131 - DNA, 22 bp, Homo sapiens
tagctacacatctaaacagcaa

SEQ ID NO: 7014132 - DNA, 22 bp, Homo sapiens
atcatgcagagtctgggcttca

SEQ ID NO: 7014133 - DNA, 22 bp, Homo sapiens
tgccagttgggaaaacagacat

SEQ ID NO: 7014134 - DNA, 22 bp, Homo sapiens
ggatgtgtcactctcaggaggt

SEQ ID NO: 7014135 - DNA, 22 bp, Homo sapiens
cggcttcatctttacttcaaga

SEQ ID NO: 7014136 - DNA, 22 bp, Homo sapiens
gacaggttgaagtatcaaaggt

SEQ ID NO: 7014137 - DNA, 22 bp, Homo sapiens
caaacattgggggcttcaacac

SEQ ID NO: 7014138 - DNA, 22 bp, Homo sapiens
agcataggttttccggtgtgcc

SEQ ID NO: 7014139 - DNA, 22 bp, Homo sapiens
tataagtctggcatatgtatgc

SEQ ID NO: 7014140 - DNA, 23 bp, Homo sapiens
gattcaggattagttgtccagag

SEQ ID NO: 7014141 - DNA, 22 bp, Homo sapiens
tataaagaagtgtaaacaggaa

SEQ ID NO: 7014142 - DNA, 22 bp, Homo sapiens
tgtcaggtctaaaatgggtctc

SEQ ID NO: 7014143 - DNA, 22 bp, Homo sapiens
cagagccactgtctgccaggca

SEQ ID NO: 7014144 - DNA, 22 bp, Homo sapiens
gctgctttgtgaaaatcattca

SEQ ID NO: 7014145 - DNA, 19 bp, Homo sapiens
taagtagtcaaatagtaac

SEQ ID NO: 7014146 - DNA, 22 bp, Homo sapiens
tctattagattattctcaagga

SEQ ID NO: 7014147 - DNA, 22 bp, Homo sapiens
tggctaatcttaaggcttttgc

SEQ ID NO: 7014148 - DNA, 22 bp, Homo sapiens
cagtgcagaggtgcaagcatgt

SEQ ID NO: 7014149 - DNA, 22 bp, Homo sapiens
ctgaagggatgtgatttctaca

SEQ ID NO: 7014150 - DNA, 20 bp, Homo sapiens
aaaatgatgggcagggcagg

SEQ ID NO: 7014151 - DNA, 22 bp, Homo sapiens
tagcaaaaactgcagttacttt

SEQ ID NO: 7014152 - DNA, 22 bp, Homo sapiens
tggcaagaactgcaattgcttt

SEQ ID NO: 7014153 - DNA, 22 bp, Homo sapiens
tcattgagttgcacttttacta

SEQ ID NO: 7014154 - DNA, 22 bp, Homo sapiens
tgatgaaaaccagaactctcat

SEQ ID NO: 7014155 - DNA, 22 bp, Homo sapiens
gcatctaaggtggataacttct

SEQ ID NO: 7014156 - DNA, 22 bp, Homo sapiens
cctgtctggccttccacggggg

SEQ ID NO: 7014157 - DNA, 22 bp, Homo sapiens
cagtcactccagcctgcctcag

SEQ ID NO: 7014158 - DNA, 22 bp, Homo sapiens
cagaaggcatagatgaaggcct

SEQ ID NO: 7014159 - DNA, 20 bp, Homo sapiens
tgagccagtcaagctacatt

SEQ ID NO: 7014160 - DNA, 22 bp, Homo sapiens
caagagcatccctgcatccagc

SEQ ID NO: 7014161 - DNA, 22 bp, Homo sapiens
caaacttttcctggaaaagatt

SEQ ID NO: 7014162 - DNA, 22 bp, Homo sapiens
cacagtgtagactaataataga

SEQ ID NO: 7014163 - DNA, 22 bp, Homo sapiens
aatgctgagtcctgtgagtctt

SEQ ID NO: 7014164 - DNA, 22 bp, Homo sapiens
ccaccgctgaaggcactggcat

SEQ ID NO: 7014165 - DNA, 22 bp, Homo sapiens
agttatatgtgaaaacacgtat

SEQ ID NO: 7014166 - DNA, 22 bp, Homo sapiens
agaggcagccgtatttcaaagg

SEQ ID NO: 7014167 - DNA, 22 bp, Homo sapiens
ccacaggaagttatgagtacta

SEQ ID NO: 7014168 - DNA, 22 bp, Homo sapiens
agagctcctaaatgtagccaac

SEQ ID NO: 7014169 - DNA, 22 bp, Homo sapiens
cacagggcagagacctgggtgc

SEQ ID NO: 7014170 - DNA, 22 bp, Homo sapiens
gcatgctgagcccacgcctggg

SEQ ID NO: 7014171 - DNA, 22 bp, Homo sapiens
tgccctccctgtactgtcagga

SEQ ID NO: 7014172 - DNA, 23 bp, Homo sapiens
atgaaatgatactttattcactg

SEQ ID NO: 7014173 - DNA, 22 bp, Homo sapiens
tcataacactggtgattaagaa

SEQ ID NO: 7014174 - DNA, 22 bp, Homo sapiens
aggtggcatttacaccatggga

SEQ ID NO: 7014175 - DNA, 22 bp, Homo sapiens
gcacccagggacttggctggcc

SEQ ID NO: 7014176 - DNA, 21 bp, Homo sapiens
tcatatattccagctgcagct

SEQ ID NO: 7014177 - DNA, 19 bp, Homo sapiens
tggcatctgggccctccag

SEQ ID NO: 7014178 - DNA, 19 bp, Homo sapiens
ctgtggactctagatcatg

SEQ ID NO: 7014179 - DNA, 22 bp, Homo sapiens
gcctggctctgagggagctcct

SEQ ID NO: 7014180 - DNA, 22 bp, Homo sapiens
ttccaggtgttgctgtcttcct

SEQ ID NO: 7014181 - DNA, 22 bp, Homo sapiens
gagtggctccctgggtttggca

SEQ ID NO: 7014182 - DNA, 22 bp, Homo sapiens
ttaaggctggtcccctctgcgt

SEQ ID NO: 7014183 - DNA, 22 bp, Homo sapiens
acaaagaaggaattggtcttta

SEQ ID NO: 7014184 - DNA, 22 bp, Homo sapiens
cggaagagggacagcgccagcc

SEQ ID NO: 7014185 - DNA, 18 bp, Homo sapiens
gctcaggccctagtcagt

SEQ ID NO: 7014186 - DNA, 22 bp, Homo sapiens
tggttagaggcttcttgcttgg

SEQ ID NO: 7014187 - DNA, 22 bp, Homo sapiens
ctggatgttttgctaaggactc

SEQ ID NO: 7014188 - DNA, 22 bp, Homo sapiens
cagggccagggctccatttcct

SEQ ID NO: 7014189 - DNA, 22 bp, Homo sapiens
ttctaggggggatcttggtcca

SEQ ID NO: 7014190 - DNA, 22 bp, Homo sapiens
tctgatagataccatgaggcaa

SEQ ID NO: 7014191 - DNA, 22 bp, Homo sapiens
caagattcattttgtccttgtc

SEQ ID NO: 7014192 - DNA, 22 bp, Homo sapiens
actgccctggcaccacacatgc

SEQ ID NO: 7014193 - DNA, 22 bp, Homo sapiens
tatctagaaatttcttttgttg

SEQ ID NO: 7014194 - DNA, 22 bp, Homo sapiens
tcagtttagatgcatttgtcgt

SEQ ID NO: 7014195 - DNA, 22 bp, Homo sapiens
ttctctgcattgtaaagagcca

SEQ ID NO: 7014196 - DNA, 22 bp, Homo sapiens
gctttgcattgtttaatcagga

SEQ ID NO: 7014197 - DNA, 22 bp, Homo sapiens
atgcttctcagctcaaggcaaa

SEQ ID NO: 7014198 - DNA, 18 bp, Homo sapiens
cctttcctcccctcagct

SEQ ID NO: 7014199 - DNA, 22 bp, Homo sapiens
aaagcttagaggccagtggagg

SEQ ID NO: 7014200 - DNA, 22 bp, Homo sapiens
tggctaagctggggaggcctgg

SEQ ID NO: 7014201 - DNA, 22 bp, Homo sapiens
tcagcaggcccatcctccaggc

SEQ ID NO: 7014202 - DNA, 22 bp, Homo sapiens
accagccaccaccaggagatcg

SEQ ID NO: 7014203 - DNA, 22 bp, Homo sapiens
catgtgtgggacccttaggttg

SEQ ID NO: 7014204 - DNA, 22 bp, Homo sapiens
acatacacaagcgtacatgaac

SEQ ID NO: 7014205 - DNA, 22 bp, Homo sapiens
tcagatgccctttgttttagac

SEQ ID NO: 7014206 - DNA, 22 bp, Homo sapiens
ttacaggaggaaattggctaca

SEQ ID NO: 7014207 - DNA, 22 bp, Homo sapiens
ttttattggtaatgataaaagt

SEQ ID NO: 7014208 - DNA, 22 bp, Homo sapiens
ttacacagatggttagtagagg

SEQ ID NO: 7014209 - DNA, 22 bp, Homo sapiens
tcccagggggatgaacactgcc

SEQ ID NO: 7014210 - DNA, 20 bp, Homo sapiens
cccaggagtgagcagcttta

SEQ ID NO: 7014211 - DNA, 22 bp, Homo sapiens
ggggtagtaccttcgtatgctg

SEQ ID NO: 7014212 - DNA, 22 bp, Homo sapiens
tgtggtgccgagagtctggacg

SEQ ID NO: 7014213 - DNA, 22 bp, Homo sapiens
tttacaaggcagaactgattaa

SEQ ID NO: 7014214 - DNA, 22 bp, Homo sapiens
tgtggcctgattttgcatctct

SEQ ID NO: 7014215 - DNA, 22 bp, Homo sapiens
ctcctctgtctaccacgagggt

SEQ ID NO: 7014216 - DNA, 22 bp, Homo sapiens
ggacaaaggggagcctgccccg

SEQ ID NO: 7014217 - DNA, 22 bp, Homo sapiens
tgcataaagtgccatagtatta

SEQ ID NO: 7014218 - DNA, 22 bp, Homo sapiens
gtgcaaatgtaattgcagtttt

SEQ ID NO: 7014219 - DNA, 22 bp, Homo sapiens
tacaagtctctgtgccttccct

SEQ ID NO: 7014220 - DNA, 22 bp, Homo sapiens
ggtgccagatgaggcccgcgat

SEQ ID NO: 7014221 - DNA, 22 bp, Homo sapiens
atgccatttcaaaataagattt

SEQ ID NO: 7014222 - DNA, 22 bp, Homo sapiens
gcttcgttgattttattataaa

SEQ ID NO: 7014223 - DNA, 22 bp, Homo sapiens
cctgtgccagccccttctgctg

SEQ ID NO: 7014224 - DNA, 22 bp, Homo sapiens
atggaacaagaactcagattta

SEQ ID NO: 7014225 - DNA, 22 bp, Homo sapiens
caggagacaagttagcagctga

SEQ ID NO: 7014226 - DNA, 22 bp, Homo sapiens
ggagctggccgcctatgtgcag

SEQ ID NO: 7014227 - DNA, 22 bp, Homo sapiens
tggaaaggaggcttgtggaata

SEQ ID NO: 7014228 - DNA, 22 bp, Homo sapiens
tgtcttaagaaattgcatttgt

SEQ ID NO: 7014229 - DNA, 15 bp, Homo sapiens
ggtgagagtaggatt

SEQ ID NO: 7014230 - DNA, 22 bp, Homo sapiens
gagagaagaacaatgtcattca

SEQ ID NO: 7014231 - DNA, 22 bp, Homo sapiens
cgtgggccccagccactccctc

SEQ ID NO: 7014232 - DNA, 22 bp, Homo sapiens
acctctgggaaaagtatggaaa

SEQ ID NO: 7014233 - DNA, 22 bp, Homo sapiens
ccagctctggcttcttgctggg

SEQ ID NO: 7014234 - DNA, 22 bp, Homo sapiens
aaataggaatgtggtcctggga

SEQ ID NO: 7014235 - DNA, 22 bp, Homo sapiens
agtgtctgttgttcagaactct

SEQ ID NO: 7014236 - DNA, 22 bp, Homo sapiens
tagattcttcttttgagtctct

SEQ ID NO: 7014237 - DNA, 22 bp, Homo sapiens
ctgagaaaagtatgagctctgg

SEQ ID NO: 7014238 - DNA, 22 bp, Homo sapiens
aggccacagtcagtgggtgctg

SEQ ID NO: 7014239 - DNA, 22 bp, Homo sapiens
ggactgctgtttacctggcttt

SEQ ID NO: 7014240 - DNA, 22 bp, Homo sapiens
agcactctggagtaggagtggg

SEQ ID NO: 7014241 - DNA, 23 bp, Homo sapiens
tttggctccatgggtggctcatt

SEQ ID NO: 7014242 - DNA, 18 bp, Homo sapiens
gactttaaaacactgctc

SEQ ID NO: 7014243 - DNA, 22 bp, Homo sapiens
tgctgaggtcaccttgctgcta

SEQ ID NO: 7014244 - DNA, 22 bp, Homo sapiens
atgcatgcacacactgcattgc

SEQ ID NO: 7014245 - DNA, 22 bp, Homo sapiens
cagggtggaaaagctagttgga

SEQ ID NO: 7014246 - DNA, 22 bp, Homo sapiens
ttgacaattgggagatataaag

SEQ ID NO: 7014247 - DNA, 22 bp, Homo sapiens
agccaaatctaaagtgaatatt

SEQ ID NO: 7014248 - DNA, 22 bp, Homo sapiens
tgacataaaccagtgagcaaaa

SEQ ID NO: 7014249 - DNA, 22 bp, Homo sapiens
tagcacaggtcttgttgccatt

SEQ ID NO: 7014250 - DNA, 22 bp, Homo sapiens
cctttatgtcactctggagagc

SEQ ID NO: 7014251 - DNA, 22 bp, Homo sapiens
cagtgctgtgtttgctgcctgg

SEQ ID NO: 7014252 - DNA, 22 bp, Homo sapiens
atccttcaaaaggaatagcagg

SEQ ID NO: 7014253 - DNA, 22 bp, Homo sapiens
caggagtccatctggcctggtg

SEQ ID NO: 7014254 - DNA, 22 bp, Homo sapiens
atttccatgtccaaaaattagt

SEQ ID NO: 7014255 - DNA, 22 bp, Homo sapiens
tactgggtatacaaagatgaat

SEQ ID NO: 7014256 - DNA, 22 bp, Homo sapiens
aaggttgcagcagtgttgatga

SEQ ID NO: 7014257 - DNA, 23 bp, Homo sapiens
atcaccagcggaagctgcagacc

SEQ ID NO: 7014258 - DNA, 22 bp, Homo sapiens
taatttcaatagcttgcataat

SEQ ID NO: 7014259 - DNA, 22 bp, Homo sapiens
gggttgaggcggatgtcggcgg

SEQ ID NO: 7014260 - DNA, 18 bp, Homo sapiens
ggcactggtgatgcagag

SEQ ID NO: 7014261 - DNA, 22 bp, Homo sapiens
tctgttcttaaagcattcttgc

SEQ ID NO: 7014262 - DNA, 22 bp, Homo sapiens
atgtagtttggggctagattta

SEQ ID NO: 7014263 - DNA, 23 bp, Homo sapiens
ttgcttagagacctcctcatcag

SEQ ID NO: 7014264 - DNA, 22 bp, Homo sapiens
gtgtgcatgtgcttgcacagat

SEQ ID NO: 7014265 - DNA, 22 bp, Homo sapiens
atttggaattcgagtaattcca

SEQ ID NO: 7014266 - DNA, 19 bp, Homo sapiens
gatattgcttgagtaactg

SEQ ID NO: 7014267 - DNA, 22 bp, Homo sapiens
aggggcagttccaagttttgtg

SEQ ID NO: 7014268 - DNA, 22 bp, Homo sapiens
ttacaatgacaggtgtatcatt

SEQ ID NO: 7014269 - DNA, 22 bp, Homo sapiens
ttggcagagagtatgctgaaga

SEQ ID NO: 7014270 - DNA, 22 bp, Homo sapiens
gaacctgatccaatatttactc

SEQ ID NO: 7014271 - DNA, 22 bp, Homo sapiens
ccaggaggatggttgttaggtg

SEQ ID NO: 7014272 - DNA, 22 bp, Homo sapiens
ctcagtgttggagaccttcagg

SEQ ID NO: 7014273 - DNA, 22 bp, Homo sapiens
tagctctgctggaaggagtcag

SEQ ID NO: 7014274 - DNA, 22 bp, Homo sapiens
tagtgtaaacttatgctgagcc

SEQ ID NO: 7014275 - DNA, 22 bp, Homo sapiens
tgggcaattttctttcctcatt

SEQ ID NO: 7014276 - DNA, 22 bp, Homo sapiens
gcttcatgcttgctccaaagct

SEQ ID NO: 7014277 - DNA, 22 bp, Homo sapiens
atcttgctgctacaaagtgccc

SEQ ID NO: 7014278 - DNA, 22 bp, Homo sapiens
ggctgcagatagccagccacca

SEQ ID NO: 7014279 - DNA, 22 bp, Homo sapiens
ttgcaaaagccgaggcactcca

SEQ ID NO: 7014280 - DNA, 22 bp, Homo sapiens
ataagtgttaggtaaacatctt

SEQ ID NO: 7014281 - DNA, 22 bp, Homo sapiens
cttggcccagttgccaaggaaa

SEQ ID NO: 7014282 - DNA, 22 bp, Homo sapiens
ccagtgatctgacaccaaatca

SEQ ID NO: 7014283 - DNA, 22 bp, Homo sapiens
tagtagaaaaatgttaatccct

SEQ ID NO: 7014284 - DNA, 22 bp, Homo sapiens
gtgctgcatgacttgctcctga

SEQ ID NO: 7014285 - DNA, 23 bp, Homo sapiens
gtgctctgcggtctgctagtctg

SEQ ID NO: 7014286 - DNA, 22 bp, Homo sapiens
aatgtgtatactggcaattaag

SEQ ID NO: 7014287 - DNA, 22 bp, Homo sapiens
tacagttatatgtgataagtaa

SEQ ID NO: 7014288 - DNA, 22 bp, Homo sapiens
ttgaatcattacaatagataag

SEQ ID NO: 7014289 - DNA, 22 bp, Homo sapiens
ccagggcctgccacttagcaag

SEQ ID NO: 7014290 - DNA, 22 bp, Homo sapiens
cagtacaagaggccacctgccc

SEQ ID NO: 7014291 - DNA, 23 bp, Homo sapiens
ggctcacacggagtgcctccacc

SEQ ID NO: 7014292 - DNA, 22 bp, Homo sapiens
ggcgccgcactcggtgcagccg

SEQ ID NO: 7014293 - DNA, 22 bp, Homo sapiens
gaggcctcctctgagacatctg

SEQ ID NO: 7014294 - DNA, 18 bp, Homo sapiens
tgaacagatgagttgaag

SEQ ID NO: 7014295 - DNA, 22 bp, Homo sapiens
attagaaaaactcaagggctct

SEQ ID NO: 7014296 - DNA, 22 bp, Homo sapiens
ctagagaagaggttaagcatga

SEQ ID NO: 7014297 - DNA, 22 bp, Homo sapiens
gaagtgggctttgtggtcagct

SEQ ID NO: 7014298 - DNA, 22 bp, Homo sapiens
gtgccagagtttgaggacaatt

SEQ ID NO: 7014299 - DNA, 22 bp, Homo sapiens
gtggccaagagataaaattgtg

SEQ ID NO: 7014300 - DNA, 22 bp, Homo sapiens
ctccggccgcggtgcccagcgc

SEQ ID NO: 7014301 - DNA, 22 bp, Homo sapiens
aaagtaattgcagtttctgcca

SEQ ID NO: 7014302 - DNA, 23 bp, Homo sapiens
tcacagagcatactgcattttgc

SEQ ID NO: 7014303 - DNA, 22 bp, Homo sapiens
ggtaacagtatgtagagtaaga

SEQ ID NO: 7014304 - DNA, 22 bp, Homo sapiens
aactcctctctggtggttcgtc

SEQ ID NO: 7014305 - DNA, 22 bp, Homo sapiens
cagatggcaacagctctgtgac

SEQ ID NO: 7014306 - DNA, 22 bp, Homo sapiens
cttcttcagttgcatgtattgg

SEQ ID NO: 7014307 - DNA, 22 bp, Homo sapiens
agccaggggagtcagctgctgg

SEQ ID NO: 7014308 - DNA, 23 bp, Homo sapiens
catatgaaagtagacactttcca

SEQ ID NO: 7014309 - DNA, 22 bp, Homo sapiens
tccaggccactgcagaggctct

SEQ ID NO: 7014310 - DNA, 22 bp, Homo sapiens
tgctgggctggagctgccaggg

SEQ ID NO: 7014311 - DNA, 22 bp, Homo sapiens
tcttccagtctgtaggactagg

SEQ ID NO: 7014312 - DNA, 22 bp, Homo sapiens
tccatgcagaggagctggtggc

SEQ ID NO: 7014313 - DNA, 22 bp, Homo sapiens
tgctagtgcagggttttcagtt

SEQ ID NO: 7014314 - DNA, 22 bp, Homo sapiens
agggtggcaccacatatcatag

SEQ ID NO: 7014315 - DNA, 22 bp, Homo sapiens
cctagatggattatgtaagatt

SEQ ID NO: 7014316 - DNA, 22 bp, Homo sapiens
tgcaggtgctgatacctactcc

SEQ ID NO: 7014317 - DNA, 22 bp, Homo sapiens
gtgagagctgctagactgttat

SEQ ID NO: 7014318 - DNA, 22 bp, Homo sapiens
atgctaatgtttgtggaagata

SEQ ID NO: 7014319 - DNA, 22 bp, Homo sapiens
aatgcaaggcctgtatctgatt

SEQ ID NO: 7014320 - DNA, 22 bp, Homo sapiens
ttgattttaaaatagtgacact

SEQ ID NO: 7014321 - DNA, 22 bp, Homo sapiens
tcttgaagtcttatggtttaaa

SEQ ID NO: 7014322 - DNA, 22 bp, Homo sapiens
aaatgcatttcactaatgtttc

SEQ ID NO: 7014323 - DNA, 22 bp, Homo sapiens
gttgaaagtagatgctatttgg

SEQ ID NO: 7014324 - DNA, 23 bp, Homo sapiens
ctgtggctgagtcctgttggagt

SEQ ID NO: 7014325 - DNA, 22 bp, Homo sapiens
ctaaacttcttggcaattttat

SEQ ID NO: 7014326 - DNA, 22 bp, Homo sapiens
gatttggcttggatgattaaac

SEQ ID NO: 7014327 - DNA, 22 bp, Homo sapiens
gagggcatagttaaataggagg

SEQ ID NO: 7014328 - DNA, 22 bp, Homo sapiens
gggaggaggaatgttttgtgta

SEQ ID NO: 7014329 - DNA, 22 bp, Homo sapiens
ggcagtgtccagcttcctggag

SEQ ID NO: 7014330 - DNA, 22 bp, Homo sapiens
gaagcaatttagaatcagaagc

SEQ ID NO: 7014331 - DNA, 22 bp, Homo sapiens
ctaaaaatccacactaggtgaa

SEQ ID NO: 7014332 - DNA, 22 bp, Homo sapiens
tccagagatccaaagaatatga

SEQ ID NO: 7014333 - DNA, 22 bp, Homo sapiens
aggggtcttgggagtcctggct

SEQ ID NO: 7014334 - DNA, 23 bp, Homo sapiens
tcacaggggccagcgctctgtgg

SEQ ID NO: 7014335 - DNA, 21 bp, Homo sapiens
aagccagcccacagtggtttg

SEQ ID NO: 7014336 - DNA, 22 bp, Homo sapiens
tgtctattaattccacataaaa

SEQ ID NO: 7014337 - DNA, 22 bp, Homo sapiens
gcactaaccagcaagttcactg

SEQ ID NO: 7014338 - DNA, 22 bp, Homo sapiens
gaaggaggtctgcattctacag

SEQ ID NO: 7014339 - DNA, 22 bp, Homo sapiens
tctgggaatgaggcttgggcaa

SEQ ID NO: 7014340 - DNA, 19 bp, Homo sapiens
tgcttgaggtgtgctagag

SEQ ID NO: 7014341 - DNA, 22 bp, Homo sapiens
ctttggaaaagcataccaagga

SEQ ID NO: 7014342 - DNA, 22 bp, Homo sapiens
aatcttcaacagaatggtagga

SEQ ID NO: 7014343 - DNA, 22 bp, Homo sapiens
aagccaggcatgcttggacagt

SEQ ID NO: 7014344 - DNA, 21 bp, Homo sapiens
tcaggaaacacctcttaagga

SEQ ID NO: 7014345 - DNA, 22 bp, Homo sapiens
aacactgtcagcctttgatgga

SEQ ID NO: 7014346 - DNA, 22 bp, Homo sapiens
gtccttggagtcaggcaaggct

SEQ ID NO: 7014347 - DNA, 22 bp, Homo sapiens
atttctttctggccacggtttt

SEQ ID NO: 7014348 - DNA, 22 bp, Homo sapiens
ctcacagatgtcctggcacttc

SEQ ID NO: 7014349 - DNA, 21 bp, Homo sapiens
cactggaattttctgtgacat

SEQ ID NO: 7014350 - DNA, 22 bp, Homo sapiens
agacaattagcacatcacgggg

SEQ ID NO: 7014351 - DNA, 22 bp, Homo sapiens
aagaaatctgatatttgtttca

SEQ ID NO: 7014352 - DNA, 22 bp, Homo sapiens
aggaattgtgttgtagtggaga

SEQ ID NO: 7014353 - DNA, 22 bp, Homo sapiens
cagctgccccgctggctgacca

SEQ ID NO: 7014354 - DNA, 19 bp, Homo sapiens
aatccaggataagcccctt

SEQ ID NO: 7014355 - DNA, 22 bp, Homo sapiens
acaggcaagtcacacaacttgt

SEQ ID NO: 7014356 - DNA, 22 bp, Homo sapiens
ttcacattgaaggtgctttctt

SEQ ID NO: 7014357 - DNA, 22 bp, Homo sapiens
agaggtattagatttgcatagg

SEQ ID NO: 7014358 - DNA, 22 bp, Homo sapiens
agtgcttaatagatgtccagca

SEQ ID NO: 7014359 - DNA, 22 bp, Homo sapiens
tgtaactcagaaagtcttcatt

SEQ ID NO: 7014360 - DNA, 22 bp, Homo sapiens
tgatctttttggtcatttgggt

SEQ ID NO: 7014361 - DNA, 22 bp, Homo sapiens
tacaagtgctagcagatattgt

SEQ ID NO: 7014362 - DNA, 22 bp, Homo sapiens
ctctgggttttgtcagctgagg

SEQ ID NO: 7014363 - DNA, 22 bp, Homo sapiens
tccttgcatatctgaaaatgtt

SEQ ID NO: 7014364 - DNA, 22 bp, Homo sapiens
gagttacacaaaatttctattt

SEQ ID NO: 7014365 - DNA, 22 bp, Homo sapiens
atcagaatggagcccacatggt

SEQ ID NO: 7014366 - DNA, 22 bp, Homo sapiens
aaatcccagatagtaatgtatt

SEQ ID NO: 7014367 - DNA, 20 bp, Homo sapiens
cttgtacatgataaagattt

SEQ ID NO: 7014368 - DNA, 23 bp, Homo sapiens
agggtgagcaagctatggagacc

SEQ ID NO: 7014369 - DNA, 22 bp, Homo sapiens
ataggatgataaaattagaaac

SEQ ID NO: 7014370 - DNA, 22 bp, Homo sapiens
ctgtctgtcccgtcaccgcccc

SEQ ID NO: 7014371 - DNA, 22 bp, Homo sapiens
aagagcctggctgctaggctca

SEQ ID NO: 7014372 - DNA, 22 bp, Homo sapiens
aggaaattgggacacagagaaa

SEQ ID NO: 7014373 - DNA, 22 bp, Homo sapiens
gataatacttattaagcactta

SEQ ID NO: 7014374 - DNA, 22 bp, Homo sapiens
tatatgtgtggattcttgtaga

SEQ ID NO: 7014375 - DNA, 22 bp, Homo sapiens
agtgtttagtcaagtaagacgc

SEQ ID NO: 7014376 - DNA, 19 bp, Homo sapiens
cccttggtagacagctgca

SEQ ID NO: 7014377 - DNA, 22 bp, Homo sapiens
tgagtgcctttgattgggcatg

SEQ ID NO: 7014378 - DNA, 22 bp, Homo sapiens
agcaacaggcataatgtgttga

SEQ ID NO: 7014379 - DNA, 22 bp, Homo sapiens
aatcacatgtgctcaattttaa

SEQ ID NO: 7014380 - DNA, 22 bp, Homo sapiens
agctgtctccagatacaggatt

SEQ ID NO: 7014381 - DNA, 22 bp, Homo sapiens
tatgtatagagtcttttaaatt

SEQ ID NO: 7014382 - DNA, 18 bp, Homo sapiens
ccacccatctctgccttt

SEQ ID NO: 7014383 - DNA, 22 bp, Homo sapiens
gtccaatggtaaatccaaataa

SEQ ID NO: 7014384 - DNA, 22 bp, Homo sapiens
tttgaactacctctccttagca

SEQ ID NO: 7014385 - DNA, 19 bp, Homo sapiens
tgctgaagttgtcagtctg

SEQ ID NO: 7014386 - DNA, 19 bp, Homo sapiens
aggctggatgcccatctta

SEQ ID NO: 7014387 - DNA, 22 bp, Homo sapiens
tggtgacaccccatctctaaag

SEQ ID NO: 7014388 - DNA, 22 bp, Homo sapiens
gtgctgcgatgattttacagag

SEQ ID NO: 7014389 - DNA, 22 bp, Homo sapiens
tttcattagtatgacagcacgc

SEQ ID NO: 7014390 - DNA, 22 bp, Homo sapiens
gctgggcagcctggccgctgcc

SEQ ID NO: 7014391 - DNA, 22 bp, Homo sapiens
ttaaagcaaccatcaatttgga

SEQ ID NO: 7014392 - DNA, 22 bp, Homo sapiens
ttggccatctaagcccagccac

SEQ ID NO: 7014393 - DNA, 22 bp, Homo sapiens
ctgtttatactcaaaagataca

SEQ ID NO: 7014394 - DNA, 22 bp, Homo sapiens
ctctctgctgtatccttaggct

SEQ ID NO: 7014395 - DNA, 22 bp, Homo sapiens
tctgctgtcctttatatagatt

SEQ ID NO: 7014396 - DNA, 22 bp, Homo sapiens
agttgtaataacaataccaaaa

SEQ ID NO: 7014397 - DNA, 22 bp, Homo sapiens
ttcttaaaattcaagctaggtt

SEQ ID NO: 7014398 - DNA, 19 bp, Homo sapiens
tgggtgtgaccatctctgc

SEQ ID NO: 7014399 - DNA, 22 bp, Homo sapiens
ggaagtagaagtaatgaaatca

SEQ ID NO: 7014400 - DNA, 22 bp, Homo sapiens
atggattggatttttatggacc

SEQ ID NO: 7014401 - DNA, 21 bp, Homo sapiens
ttaagaagcactgctctaaga

SEQ ID NO: 7014402 - DNA, 23 bp, Homo sapiens
acagccagttcacctctccttgg

SEQ ID NO: 7014403 - DNA, 22 bp, Homo sapiens
agagggggcagcggaccagtga

SEQ ID NO: 7014404 - DNA, 22 bp, Homo sapiens
tagtaactggttgaacaactgt

SEQ ID NO: 7014405 - DNA, 22 bp, Homo sapiens
tctcttgaagattgaagacaaa

SEQ ID NO: 7014406 - DNA, 22 bp, Homo sapiens
caggctacatttgctctgagaa

SEQ ID NO: 7014407 - DNA, 22 bp, Homo sapiens
tggagcagagttcagcggggag

SEQ ID NO: 7014408 - DNA, 22 bp, Homo sapiens
gctctgtgagccacttgatgta

SEQ ID NO: 7014409 - DNA, 22 bp, Homo sapiens
tctgtgaacatcacattgacag

SEQ ID NO: 7014410 - DNA, 22 bp, Homo sapiens
ggcaagggacggccgtgagaca

SEQ ID NO: 7014411 - DNA, 22 bp, Homo sapiens
gagctattgattactgaatcaa

SEQ ID NO: 7014412 - DNA, 22 bp, Homo sapiens
tctcttctgacctagccttgga

SEQ ID NO: 7014413 - DNA, 20 bp, Homo sapiens
acctagtacaatctgtttct

SEQ ID NO: 7014414 - DNA, 22 bp, Homo sapiens
cctggcacatagcaacccctcc

SEQ ID NO: 7014415 - DNA, 22 bp, Homo sapiens
acagttcccgtcttgcacagct

SEQ ID NO: 7014416 - DNA, 22 bp, Homo sapiens
tgtcgcagctgaaaatctcaat

SEQ ID NO: 7014417 - DNA, 22 bp, Homo sapiens
ttcacttaaaggttttagcatc

SEQ ID NO: 7014418 - DNA, 22 bp, Homo sapiens
gcagtctataaatcagctttgc

SEQ ID NO: 7014419 - DNA, 22 bp, Homo sapiens
actttgcaatacttaatacaaa

SEQ ID NO: 7014420 - DNA, 22 bp, Homo sapiens
aagtcttggtagagaaggactt

SEQ ID NO: 7014421 - DNA, 22 bp, Homo sapiens
acacttcagcagtatgcttggg

SEQ ID NO: 7014422 - DNA, 22 bp, Homo sapiens
atttggtgttcatcttttagtg

SEQ ID NO: 7014423 - DNA, 22 bp, Homo sapiens
cagccagatcaaactcagatgt

SEQ ID NO: 7014424 - DNA, 22 bp, Homo sapiens
ctgggccctatggaagaaaggg

SEQ ID NO: 7014425 - DNA, 22 bp, Homo sapiens
tggcagccatcagagcaggggt

SEQ ID NO: 7014426 - DNA, 22 bp, Homo sapiens
ctgccttggtttctagcagggc

SEQ ID NO: 7014427 - DNA, 22 bp, Homo sapiens
agtattccaaaaataaggacaa

SEQ ID NO: 7014428 - DNA, 22 bp, Homo sapiens
agtttccttggattcaatttgg

SEQ ID NO: 7014429 - DNA, 22 bp, Homo sapiens
tacagaggaggggattttaata

SEQ ID NO: 7014430 - DNA, 22 bp, Homo sapiens
tcatcatgtttgatttccacag

SEQ ID NO: 7014431 - DNA, 22 bp, Homo sapiens
aaggtcatttaacaatttatga

SEQ ID NO: 7014432 - DNA, 22 bp, Homo sapiens
atattcctgtttttaacacttt

SEQ ID NO: 7014433 - DNA, 22 bp, Homo sapiens
ggatcagggctggggatattct

SEQ ID NO: 7014434 - DNA, 22 bp, Homo sapiens
cgacgggctcggtccgcttcct

SEQ ID NO: 7014435 - DNA, 22 bp, Homo sapiens
ggtcagtcaattagttctagca

SEQ ID NO: 7014436 - DNA, 22 bp, Homo sapiens
gagcagcatctccggcttaaag

SEQ ID NO: 7014437 - DNA, 22 bp, Homo sapiens
tgcctggcagcttgaaagaaat

SEQ ID NO: 7014438 - DNA, 22 bp, Homo sapiens
attgctggtagtcagtgtccct

SEQ ID NO: 7014439 - DNA, 22 bp, Homo sapiens
tggcactgtcaccaatgctgtc

SEQ ID NO: 7014440 - DNA, 22 bp, Homo sapiens
ttgtacaaataggaacctctga

SEQ ID NO: 7014441 - DNA, 22 bp, Homo sapiens
gaggctgcccaactggagtgga

SEQ ID NO: 7014442 - DNA, 22 bp, Homo sapiens
tcatatattttggcagtgatca

SEQ ID NO: 7014443 - DNA, 20 bp, Homo sapiens
ctgggtggcaagcaaggggg

SEQ ID NO: 7014444 - DNA, 22 bp, Homo sapiens
aggcccttggactcatgctcga

SEQ ID NO: 7014445 - DNA, 22 bp, Homo sapiens
tggttataaaagtcctctcatt

SEQ ID NO: 7014446 - DNA, 21 bp, Homo sapiens
tggctcagttgctgggcacag

SEQ ID NO: 7014447 - DNA, 22 bp, Homo sapiens
tccacctgggcaacagtgcctc

SEQ ID NO: 7014448 - DNA, 23 bp, Homo sapiens
cttgtggacagtagcttcagcct

SEQ ID NO: 7014449 - DNA, 22 bp, Homo sapiens
tcatacacattcttattacttt

SEQ ID NO: 7014450 - DNA, 23 bp, Homo sapiens
cagctcagagtgtgtcctgtttc

SEQ ID NO: 7014451 - DNA, 21 bp, Homo sapiens
ctacttaagtaggggattagg

SEQ ID NO: 7014452 - DNA, 22 bp, Homo sapiens
ctgtgcctaagatgcatgtctc

SEQ ID NO: 7014453 - DNA, 22 bp, Homo sapiens
attgctgttgttatggcactgt

SEQ ID NO: 7014454 - DNA, 22 bp, Homo sapiens
tttcacagtgctctgtaagtat

SEQ ID NO: 7014455 - DNA, 22 bp, Homo sapiens
ttgctgaaaacagtgggtattg

SEQ ID NO: 7014456 - DNA, 22 bp, Homo sapiens
tacagctcagaacctcactgtc

SEQ ID NO: 7014457 - DNA, 22 bp, Homo sapiens
tcagtgtcatatcaagaagatg

SEQ ID NO: 7014458 - DNA, 22 bp, Homo sapiens
agcatctggatggaaagcaagg

SEQ ID NO: 7014459 - DNA, 22 bp, Homo sapiens
tgtgtctgcactgagtcctcac

SEQ ID NO: 7014460 - DNA, 22 bp, Homo sapiens
agaaaactctacatctgtatgt

SEQ ID NO: 7014461 - DNA, 22 bp, Homo sapiens
acctgcaaaatattatgttctt

SEQ ID NO: 7014462 - DNA, 22 bp, Homo sapiens
attcttgcagtatacaactact

SEQ ID NO: 7014463 - DNA, 22 bp, Homo sapiens
tttctaaggtgatcctttctta

SEQ ID NO: 7014464 - DNA, 18 bp, Homo sapiens
tgactcaccctgtcagtg

SEQ ID NO: 7014465 - DNA, 22 bp, Homo sapiens
agtttgatgattacagagaaaa

SEQ ID NO: 7014466 - DNA, 19 bp, Homo sapiens
tggctctgtcgaaggcaca

SEQ ID NO: 7014467 - DNA, 22 bp, Homo sapiens
tgggagcggcccgggccacacg

SEQ ID NO: 7014468 - DNA, 22 bp, Homo sapiens
aggtgtggctatgctgtgttcc

SEQ ID NO: 7014469 - DNA, 22 bp, Homo sapiens
aaatgttttgctcccatgtggt

SEQ ID NO: 7014470 - DNA, 22 bp, Homo sapiens
ggtctagggtcattatggtaca

SEQ ID NO: 7014471 - DNA, 22 bp, Homo sapiens
agctggtgctgaagctcttgag

SEQ ID NO: 7014472 - DNA, 22 bp, Homo sapiens
agggctgcctgactccagagcc

SEQ ID NO: 7014473 - DNA, 22 bp, Homo sapiens
ccagagggacgttaccagttca

SEQ ID NO: 7014474 - DNA, 22 bp, Homo sapiens
gcttctagggaaggcagtcaca

SEQ ID NO: 7014475 - DNA, 22 bp, Homo sapiens
gctgccagcgtcagacctgggg

SEQ ID NO: 7014476 - DNA, 22 bp, Homo sapiens
ttcatgtattgcattgtgtcct

SEQ ID NO: 7014477 - DNA, 22 bp, Homo sapiens
ttgggcctctcaaagtgctggg

SEQ ID NO: 7014478 - DNA, 22 bp, Homo sapiens
ctgccttgtcttgttttcaggg

SEQ ID NO: 7014479 - DNA, 22 bp, Homo sapiens
ttgaggtctgagactgtgcagg

SEQ ID NO: 7014480 - DNA, 22 bp, Homo sapiens
ataatattgaagagccttggcc

SEQ ID NO: 7014481 - DNA, 22 bp, Homo sapiens
tgtctacaaacgtgtacacatt

SEQ ID NO: 7014482 - DNA, 22 bp, Homo sapiens
ccctcttgctgactcttaaagg

SEQ ID NO: 7014483 - DNA, 22 bp, Homo sapiens
agtgagagtattaatgtgaact

SEQ ID NO: 7014484 - DNA, 22 bp, Homo sapiens
tagaaatgagccatggtagagc

SEQ ID NO: 7014485 - DNA, 22 bp, Homo sapiens
atgatgtagtgacttggcagag

SEQ ID NO: 7014486 - DNA, 22 bp, Homo sapiens
aagggtgcaaagcactctagct

SEQ ID NO: 7014487 - DNA, 22 bp, Homo sapiens
acagctgtgacttagagaagtt

SEQ ID NO: 7014488 - DNA, 22 bp, Homo sapiens
gacagctgcatcctcagacaca

SEQ ID NO: 7014489 - DNA, 22 bp, Homo sapiens
agctttggcatctgactagccg

SEQ ID NO: 7014490 - DNA, 22 bp, Homo sapiens
atgaatgcaatattttatgaca

SEQ ID NO: 7014491 - DNA, 22 bp, Homo sapiens
aagatccttggttctgctttcc

SEQ ID NO: 7014492 - DNA, 22 bp, Homo sapiens
gctgtgggtgctggctccaccc

SEQ ID NO: 7014493 - DNA, 22 bp, Homo sapiens
ttacaacatatttagcttgatt

SEQ ID NO: 7014494 - DNA, 22 bp, Homo sapiens
ccagggttgacaaattattggg

SEQ ID NO: 7014495 - DNA, 22 bp, Homo sapiens
ccagaattcagaaagggcataa

SEQ ID NO: 7014496 - DNA, 22 bp, Homo sapiens
tggcctgtcttgttgtgctaga

SEQ ID NO: 7014497 - DNA, 22 bp, Homo sapiens
tggaagcagtcacttcctagtt

SEQ ID NO: 7014498 - DNA, 22 bp, Homo sapiens
agatggctttgcttttagaagc

SEQ ID NO: 7014499 - DNA, 22 bp, Homo sapiens
agagcacagccaccatttacaa

SEQ ID NO: 7014500 - DNA, 22 bp, Homo sapiens
tccatacagaatgcagtaaggg

SEQ ID NO: 7014501 - DNA, 22 bp, Homo sapiens
ttacacaaagttagctcttgca

SEQ ID NO: 7014502 - DNA, 22 bp, Homo sapiens
gagaggctctgaggactggggt

SEQ ID NO: 7014503 - DNA, 22 bp, Homo sapiens
tctgtcttagcatctttgctca

SEQ ID NO: 7014504 - DNA, 18 bp, Homo sapiens
atattcaagaagacagag

SEQ ID NO: 7014505 - DNA, 23 bp, Homo sapiens
aaatgatgtgtgttgtcccattc

SEQ ID NO: 7014506 - DNA, 22 bp, Homo sapiens
ggcacagagctccagccttggc

SEQ ID NO: 7014507 - DNA, 22 bp, Homo sapiens
tttgggctcccacaggcttgtg

SEQ ID NO: 7014508 - DNA, 22 bp, Homo sapiens
ttgagaaaacacagagtttatt

SEQ ID NO: 7014509 - DNA, 22 bp, Homo sapiens
tgtctatagaatcatgcagttt

SEQ ID NO: 7014510 - DNA, 22 bp, Homo sapiens
cttagcatgcagtgttctgccc

SEQ ID NO: 7014511 - DNA, 22 bp, Homo sapiens
gtcccattttctactatggaat

SEQ ID NO: 7014512 - DNA, 22 bp, Homo sapiens
tacattcctgggctccacccta

SEQ ID NO: 7014513 - DNA, 22 bp, Homo sapiens
gttaaccatgatgttttaaaag

SEQ ID NO: 7014514 - DNA, 20 bp, Homo sapiens
ttactcataggaccacaagc

SEQ ID NO: 7014515 - DNA, 22 bp, Homo sapiens
tgacaaaactgcaattactttt

SEQ ID NO: 7014516 - DNA, 22 bp, Homo sapiens
agaccctctgccagatgcttta

SEQ ID NO: 7014517 - DNA, 22 bp, Homo sapiens
tgtcaacatttatcaagttatt

SEQ ID NO: 7014518 - DNA, 22 bp, Homo sapiens
cggtggtcataagtggctggcg

SEQ ID NO: 7014519 - DNA, 17 bp, Homo sapiens
ctgttggttggaaaatt

SEQ ID NO: 7014520 - DNA, 22 bp, Homo sapiens
ttttctaatttagttaccctcc

SEQ ID NO: 7014521 - DNA, 22 bp, Homo sapiens
tgggtccatggaacagaggtgc

SEQ ID NO: 7014522 - DNA, 22 bp, Homo sapiens
tgaaagagtgcaagtcaaggag

SEQ ID NO: 7014523 - DNA, 22 bp, Homo sapiens
tggtataaacagttactggaga

SEQ ID NO: 7014524 - DNA, 23 bp, Homo sapiens
agaggggagcatctgctggctga

SEQ ID NO: 7014525 - DNA, 22 bp, Homo sapiens
cctgggcagcctgctcaaggac

SEQ ID NO: 7014526 - DNA, 22 bp, Homo sapiens
gctggctgctgttgagacttgt

SEQ ID NO: 7014527 - DNA, 22 bp, Homo sapiens
gtcaggaagcaaggttgggcat

SEQ ID NO: 7014528 - DNA, 22 bp, Homo sapiens
cagctgtccttcctggtgggcg

SEQ ID NO: 7014529 - DNA, 22 bp, Homo sapiens
gatattttcattcggatgctca

SEQ ID NO: 7014530 - DNA, 17 bp, Homo sapiens
gtcattctcagaaaatg

SEQ ID NO: 7014531 - DNA, 22 bp, Homo sapiens
ctgctacacgattctgattcca

SEQ ID NO: 7014532 - DNA, 22 bp, Homo sapiens
tatcattgtgttatttcttcca

SEQ ID NO: 7014533 - DNA, 22 bp, Homo sapiens
tctgggaaccaaagggtgctta

SEQ ID NO: 7014534 - DNA, 19 bp, Homo sapiens
tgcttcctcaccatctccc

SEQ ID NO: 7014535 - DNA, 22 bp, Homo sapiens
tttggggatgacaggttaggaa

SEQ ID NO: 7014536 - DNA, 22 bp, Homo sapiens
accctgtcttccctgggcatca

SEQ ID NO: 7014537 - DNA, 22 bp, Homo sapiens
tcaggaacagaattttctaaaa

SEQ ID NO: 7014538 - DNA, 22 bp, Homo sapiens
tgctaagttctgcaaaagataa

SEQ ID NO: 7014539 - DNA, 22 bp, Homo sapiens
atacaattattctgcagatatt

SEQ ID NO: 7014540 - DNA, 22 bp, Homo sapiens
cagcatgggggcaattcaggtg

SEQ ID NO: 7014541 - DNA, 20 bp, Homo sapiens
cacctggctgactgtctcca

SEQ ID NO: 7014542 - DNA, 22 bp, Homo sapiens
ccagggaatgatatttttgcct

SEQ ID NO: 7014543 - DNA, 22 bp, Homo sapiens
acagaggccgcctctctcacgg

SEQ ID NO: 7014544 - DNA, 22 bp, Homo sapiens
tgggtctcctgtgcctgggagg

SEQ ID NO: 7014545 - DNA, 17 bp, Homo sapiens
tgttaattccaatgata

SEQ ID NO: 7014546 - DNA, 22 bp, Homo sapiens
ctcacaatttttcagtgactat

SEQ ID NO: 7014547 - DNA, 22 bp, Homo sapiens
aggccaaagcacagagctggaa

SEQ ID NO: 7014548 - DNA, 22 bp, Homo sapiens
tctgaaagcataatttgtccca

SEQ ID NO: 7014549 - DNA, 22 bp, Homo sapiens
gtgcctctgagctctgctacag

SEQ ID NO: 7014550 - DNA, 22 bp, Homo sapiens
acaaggatctgtgtaggcaggc

SEQ ID NO: 7014551 - DNA, 22 bp, Homo sapiens
agtggctgattacaaactgagt

SEQ ID NO: 7014552 - DNA, 22 bp, Homo sapiens
aaaagtattttgagcactttat

SEQ ID NO: 7014553 - DNA, 22 bp, Homo sapiens
ctaaaattacctaccagtttag

SEQ ID NO: 7014554 - DNA, 21 bp, Homo sapiens
agccctctccaattccctttt

SEQ ID NO: 7014555 - DNA, 22 bp, Homo sapiens
tgagtggacacctgcttcttta

SEQ ID NO: 7014556 - DNA, 22 bp, Homo sapiens
tgaggcttggagaggtcaggga

SEQ ID NO: 7014557 - DNA, 20 bp, Homo sapiens
ggctgtgcccttccgtggcc

SEQ ID NO: 7014558 - DNA, 22 bp, Homo sapiens
cgtgtccttttagcttcaggtc

SEQ ID NO: 7014559 - DNA, 22 bp, Homo sapiens
gctcacagaacttctcttccca

SEQ ID NO: 7014560 - DNA, 22 bp, Homo sapiens
atgaacacatgtacacatttct

SEQ ID NO: 7014561 - DNA, 18 bp, Homo sapiens
gcacttcacagggatagt

SEQ ID NO: 7014562 - DNA, 22 bp, Homo sapiens
acttattctgagattatgatca

SEQ ID NO: 7014563 - DNA, 22 bp, Homo sapiens
ggcagttgctgtggatgaggtt

SEQ ID NO: 7014564 - DNA, 22 bp, Homo sapiens
aagtatctttctagcaactaaa

SEQ ID NO: 7014565 - DNA, 22 bp, Homo sapiens
tgtccctttgtgttctgaaact

SEQ ID NO: 7014566 - DNA, 22 bp, Homo sapiens
cggggcttggaccagccacccc

SEQ ID NO: 7014567 - DNA, 22 bp, Homo sapiens
gagatgatgagatttggaactt

SEQ ID NO: 7014568 - DNA, 22 bp, Homo sapiens
atatatgcgcaggcacccagct

SEQ ID NO: 7014569 - DNA, 22 bp, Homo sapiens
cagctgcagtgggggaccacaa

SEQ ID NO: 7014570 - DNA, 22 bp, Homo sapiens
cagggccagcccgacgtggtgc

SEQ ID NO: 7014571 - DNA, 22 bp, Homo sapiens
gcccaagctccgcctcctgtcg

SEQ ID NO: 7014572 - DNA, 22 bp, Homo sapiens
attctcaaaacataacttcact

SEQ ID NO: 7014573 - DNA, 22 bp, Homo sapiens
agctaatgatacatgctccaca

SEQ ID NO: 7014574 - DNA, 19 bp, Homo sapiens
tcagaatgactactcatgt

SEQ ID NO: 7014575 - DNA, 22 bp, Homo sapiens
tgctcctgaggttggagatcca

SEQ ID NO: 7014576 - DNA, 22 bp, Homo sapiens
gtggaggacaaaagaagccttt

SEQ ID NO: 7014577 - DNA, 22 bp, Homo sapiens
cacagctgcttgttagaatagc

SEQ ID NO: 7014578 - DNA, 22 bp, Homo sapiens
aagattctttgaggattttact

SEQ ID NO: 7014579 - DNA, 22 bp, Homo sapiens
aatcaggcaaggaaaggagtta

SEQ ID NO: 7014580 - DNA, 21 bp, Homo sapiens
tcctggcccactctatcccca

SEQ ID NO: 7014581 - DNA, 22 bp, Homo sapiens
tttgaccagaggtccctggaaa

SEQ ID NO: 7014582 - DNA, 22 bp, Homo sapiens
agaaggaaaacctgtcttatgt

SEQ ID NO: 7014583 - DNA, 22 bp, Homo sapiens
gcccaggaggtcaagtagctat

SEQ ID NO: 7014584 - DNA, 22 bp, Homo sapiens
taggcactgaggggagcaaggt

SEQ ID NO: 7014585 - DNA, 22 bp, Homo sapiens
tctcttcagcccattataaggg

SEQ ID NO: 7014586 - DNA, 22 bp, Homo sapiens
ctagacacagtttttgctccca

SEQ ID NO: 7014587 - DNA, 22 bp, Homo sapiens
actgaattagggaacactgaac

SEQ ID NO: 7014588 - DNA, 22 bp, Homo sapiens
ttcatttggcctctgcttaaaa

SEQ ID NO: 7014589 - DNA, 22 bp, Homo sapiens
ttataaagattgttatgtatct

SEQ ID NO: 7014590 - DNA, 22 bp, Homo sapiens
gagagcacatgaacatggagga

SEQ ID NO: 7014591 - DNA, 22 bp, Homo sapiens
ctgcctgctcaccagggctctg

SEQ ID NO: 7014592 - DNA, 19 bp, Homo sapiens
tgaattagaattatcctct

SEQ ID NO: 7014593 - DNA, 22 bp, Homo sapiens
aggcctcacattgggcttcaag

SEQ ID NO: 7014594 - DNA, 22 bp, Homo sapiens
gccttcctgcagctctgagcgt

SEQ ID NO: 7014595 - DNA, 17 bp, Homo sapiens
ctctggaattggtgaag

SEQ ID NO: 7014596 - DNA, 22 bp, Homo sapiens
ctgcagtgcctgccactgagcc

SEQ ID NO: 7014597 - DNA, 22 bp, Homo sapiens
tcagagctgggtgcttcttcct

SEQ ID NO: 7014598 - DNA, 22 bp, Homo sapiens
tagggctgcctatggctagata

SEQ ID NO: 7014599 - DNA, 22 bp, Homo sapiens
gctgacacttagaagtgccctg

SEQ ID NO: 7014600 - DNA, 22 bp, Homo sapiens
ctagccaacaccttattttctg

SEQ ID NO: 7014601 - DNA, 20 bp, Homo sapiens
tccacttactagctctgtga

SEQ ID NO: 7014602 - DNA, 22 bp, Homo sapiens
gcagggcaggatttgaacccag

SEQ ID NO: 7014603 - DNA, 22 bp, Homo sapiens
ggcaagtgcttccccaaccaca

SEQ ID NO: 7014604 - DNA, 22 bp, Homo sapiens
tttggctcggctgctgatggtg

SEQ ID NO: 7014605 - DNA, 22 bp, Homo sapiens
gaatggccccagagcaccactg

SEQ ID NO: 7014606 - DNA, 19 bp, Homo sapiens
cctcttcctctgacactat

SEQ ID NO: 7014607 - DNA, 22 bp, Homo sapiens
ccagctgtcagtgtgaaaataa

SEQ ID NO: 7014608 - DNA, 22 bp, Homo sapiens
tttgtacagtgatgttgtatgc

SEQ ID NO: 7014609 - DNA, 19 bp, Homo sapiens
catctgtaaggacagaaac

SEQ ID NO: 7014610 - DNA, 22 bp, Homo sapiens
atcacactggacattggatact

SEQ ID NO: 7014611 - DNA, 23 bp, Homo sapiens
tcatttcacagtgagcttcctag

SEQ ID NO: 7014612 - DNA, 22 bp, Homo sapiens
tatgctctgagacctttgtgca

SEQ ID NO: 7014613 - DNA, 22 bp, Homo sapiens
cataggaagccatctcagtcac

SEQ ID NO: 7014614 - DNA, 22 bp, Homo sapiens
cagccctggctagggcgagggc

SEQ ID NO: 7014615 - DNA, 22 bp, Homo sapiens
ttgctttactttgccattcgtt

SEQ ID NO: 7014616 - DNA, 22 bp, Homo sapiens
acatctttgtttcttagtgtat

SEQ ID NO: 7014617 - DNA, 22 bp, Homo sapiens
tgtcctttatgaaatggtgttt

SEQ ID NO: 7014618 - DNA, 22 bp, Homo sapiens
ggaaatgtatgattctcatcag

SEQ ID NO: 7014619 - DNA, 23 bp, Homo sapiens
ggtggcaggagtggatgctgagc

SEQ ID NO: 7014620 - DNA, 22 bp, Homo sapiens
gaaggtgtctggcccagagtct

SEQ ID NO: 7014621 - DNA, 21 bp, Homo sapiens
agggacacacaggatggggct

SEQ ID NO: 7014622 - DNA, 22 bp, Homo sapiens
tgtcaaggacgtgcatgaaccc

SEQ ID NO: 7014623 - DNA, 22 bp, Homo sapiens
tctttttcttattcccacactg

SEQ ID NO: 7014624 - DNA, 22 bp, Homo sapiens
ctagtaaagtactcaaatagcc

SEQ ID NO: 7014625 - DNA, 22 bp, Homo sapiens
aaacagtattatcaatatattt

SEQ ID NO: 7014626 - DNA, 22 bp, Homo sapiens
tgaagcccctaagtcccaggca

SEQ ID NO: 7014627 - DNA, 22 bp, Homo sapiens
gaccacacttttcccctgctag

SEQ ID NO: 7014628 - DNA, 22 bp, Homo sapiens
tccaggcatgtctgagtccttc

SEQ ID NO: 7014629 - DNA, 22 bp, Homo sapiens
agtgaggtcatactggagaggg

SEQ ID NO: 7014630 - DNA, 22 bp, Homo sapiens
acctgggaggcagaggttgcag

SEQ ID NO: 7014631 - DNA, 17 bp, Homo sapiens
gaggccaaggcaggcgg

SEQ ID NO: 7014632 - DNA, 21 bp, Homo sapiens
cacagagatattggtgagcct

SEQ ID NO: 7014633 - DNA, 22 bp, Homo sapiens
ttgcagttgtctttcctaattt

SEQ ID NO: 7014634 - DNA, 20 bp, Homo sapiens
tccattcagcattgtggaaa

SEQ ID NO: 7014635 - DNA, 15 bp, Homo sapiens
taccagctgatccgt

SEQ ID NO: 7014636 - DNA, 22 bp, Homo sapiens
agagtctgttacttgtccccta

SEQ ID NO: 7014637 - DNA, 22 bp, Homo sapiens
ttgggatctcaaatccagctat

SEQ ID NO: 7014638 - DNA, 19 bp, Homo sapiens
tctcaattctccccactgc

SEQ ID NO: 7014639 - DNA, 22 bp, Homo sapiens
tccagccaccaccttgattgcc

SEQ ID NO: 7014640 - DNA, 22 bp, Homo sapiens
tagagggaagactgctagattt

SEQ ID NO: 7014641 - DNA, 22 bp, Homo sapiens
ttgacaggaaatatggtggcag

SEQ ID NO: 7014642 - DNA, 22 bp, Homo sapiens
ctctaaaggcttgttattgcat

SEQ ID NO: 7014643 - DNA, 22 bp, Homo sapiens
ggaggggtgagaatggctgcct

SEQ ID NO: 7014644 - DNA, 22 bp, Homo sapiens
ctttgtattcatccgtaataat

SEQ ID NO: 7014645 - DNA, 22 bp, Homo sapiens
tagaagaacatgtcaaactata

SEQ ID NO: 7014646 - DNA, 22 bp, Homo sapiens
tgctggagtggcactgtgtggc

SEQ ID NO: 7014647 - DNA, 22 bp, Homo sapiens
agaggaaacataggtttttaaa

SEQ ID NO: 7014648 - DNA, 22 bp, Homo sapiens
agcagccagtgggagtgataca

SEQ ID NO: 7014649 - DNA, 22 bp, Homo sapiens
gctcagagagaggctcaccatt

SEQ ID NO: 7014650 - DNA, 22 bp, Homo sapiens
ccaggcagtggaagctaaaatt

SEQ ID NO: 7014651 - DNA, 23 bp, Homo sapiens
cgtgtctgtgggcgatccggcct

SEQ ID NO: 7014652 - DNA, 22 bp, Homo sapiens
agcagcagctcattcttcctgt

SEQ ID NO: 7014653 - DNA, 21 bp, Homo sapiens
cagttacacaagtgttaccag

SEQ ID NO: 7014654 - DNA, 22 bp, Homo sapiens
gccccagaaagttcaaggcaca

SEQ ID NO: 7014655 - DNA, 22 bp, Homo sapiens
ataaccttggctagtattgtgc

SEQ ID NO: 7014656 - DNA, 22 bp, Homo sapiens
caacagctggaggcttggcccg

SEQ ID NO: 7014657 - DNA, 22 bp, Homo sapiens
ggctggcaagtgtctgctcatg

SEQ ID NO: 7014658 - DNA, 22 bp, Homo sapiens
ccctgggatggattggcaggaa

SEQ ID NO: 7014659 - DNA, 22 bp, Homo sapiens
ggagccctgccctaggcagctc

SEQ ID NO: 7014660 - DNA, 22 bp, Homo sapiens
agagatgaaaagggtactgagg

SEQ ID NO: 7014661 - DNA, 22 bp, Homo sapiens
tctaagaggcatcaagacaagc

SEQ ID NO: 7014662 - DNA, 22 bp, Homo sapiens
ggtgaccagggtcagtagcttt

SEQ ID NO: 7014663 - DNA, 22 bp, Homo sapiens
tctgcctgttgagcctaaggcc

SEQ ID NO: 7014664 - DNA, 22 bp, Homo sapiens
acagatgtaatctattcacatt

SEQ ID NO: 7014665 - DNA, 21 bp, Homo sapiens
actgtattgttttcaaggatc

SEQ ID NO: 7014666 - DNA, 22 bp, Homo sapiens
tcatcgtgctgctctgtccata

SEQ ID NO: 7014667 - DNA, 22 bp, Homo sapiens
ccaggcacaggtgggcctcaga

SEQ ID NO: 7014668 - DNA, 22 bp, Homo sapiens
gtctctctgctaggcctccagt

SEQ ID NO: 7014669 - DNA, 22 bp, Homo sapiens
tcattactttttttgtgtctac

SEQ ID NO: 7014670 - DNA, 22 bp, Homo sapiens
agcagtaagcaactgagcttgc

SEQ ID NO: 7014671 - DNA, 22 bp, Homo sapiens
ctgctttaaaaccctcagctgg

SEQ ID NO: 7014672 - DNA, 22 bp, Homo sapiens
tcccctcccttccaacagagct

SEQ ID NO: 7014673 - DNA, 21 bp, Homo sapiens
gctgagacgcaacctcagtga

SEQ ID NO: 7014674 - DNA, 22 bp, Homo sapiens
tgtcagtgacagatttatgatc

SEQ ID NO: 7014675 - DNA, 22 bp, Homo sapiens
ggggtcttgggtagcatataga

SEQ ID NO: 7014676 - DNA, 20 bp, Homo sapiens
gaggaaccactgggaggaga

SEQ ID NO: 7014677 - DNA, 22 bp, Homo sapiens
taaggcaccataatatatttaa

SEQ ID NO: 7014678 - DNA, 22 bp, Homo sapiens
gctatgtataaccaaagtacaa

SEQ ID NO: 7014679 - DNA, 22 bp, Homo sapiens
ttgttggaaatgagaggctagg

SEQ ID NO: 7014680 - DNA, 21 bp, Homo sapiens
actgaatgtgtccaagctgag

SEQ ID NO: 7014681 - DNA, 22 bp, Homo sapiens
aatggctgggtttcattttgta

SEQ ID NO: 7014682 - DNA, 21 bp, Homo sapiens
tgcattcctccatccaacagg

SEQ ID NO: 7014683 - DNA, 22 bp, Homo sapiens
ggttcacagtaaggtttgtgct

SEQ ID NO: 7014684 - DNA, 22 bp, Homo sapiens
aaactctataggcagaagcaat

SEQ ID NO: 7014685 - DNA, 21 bp, Homo sapiens
aagtctggttgattcctttgc

SEQ ID NO: 7014686 - DNA, 22 bp, Homo sapiens
cctgctgggcctgagcaatgag

SEQ ID NO: 7014687 - DNA, 22 bp, Homo sapiens
gctcaggatcagccacctcttt

SEQ ID NO: 7014688 - DNA, 22 bp, Homo sapiens
cagaggtagccgagtgcaatcg

SEQ ID NO: 7014689 - DNA, 22 bp, Homo sapiens
actgtctgagtcaggagtcaca

SEQ ID NO: 7014690 - DNA, 18 bp, Homo sapiens
ggcagcaagaagggaggg

SEQ ID NO: 7014691 - DNA, 22 bp, Homo sapiens
agaatctaaatatgcaatttga

SEQ ID NO: 7014692 - DNA, 22 bp, Homo sapiens
ttaggaatatagactaagtaga

SEQ ID NO: 7014693 - DNA, 22 bp, Homo sapiens
tcttcctgaaaccctgttccag

SEQ ID NO: 7014694 - DNA, 22 bp, Homo sapiens
agcctaggtctgggtctagcag

SEQ ID NO: 7014695 - DNA, 22 bp, Homo sapiens
tacaacataacgggcattcagt

SEQ ID NO: 7014696 - DNA, 22 bp, Homo sapiens
gtatgaaggcgagagcccacta

SEQ ID NO: 7014697 - DNA, 22 bp, Homo sapiens
tacataccttgacggtagatgg

SEQ ID NO: 7014698 - DNA, 22 bp, Homo sapiens
gaggcgagaagctggagatggt

SEQ ID NO: 7014699 - DNA, 22 bp, Homo sapiens
ctggatttaggactagtccaag

SEQ ID NO: 7014700 - DNA, 22 bp, Homo sapiens
ctgagcatgctcctcttttcca

SEQ ID NO: 7014701 - DNA, 22 bp, Homo sapiens
tgggccaggatttcaagaccct

SEQ ID NO: 7014702 - DNA, 18 bp, Homo sapiens
gggcactggggactggag

SEQ ID NO: 7014703 - DNA, 22 bp, Homo sapiens
aggggctcaagcagtgtggtct

SEQ ID NO: 7014704 - DNA, 22 bp, Homo sapiens
ttggttcaacttttctaagtag

SEQ ID NO: 7014705 - DNA, 22 bp, Homo sapiens
cactgcactccagcttgggcaa

SEQ ID NO: 7014706 - DNA, 22 bp, Homo sapiens
ctcagcaacccacacacggtct

SEQ ID NO: 7014707 - DNA, 22 bp, Homo sapiens
tgaagcaggaaccagcagcatt

SEQ ID NO: 7014708 - DNA, 22 bp, Homo sapiens
gaggcacaatacatgtctcaag

SEQ ID NO: 7014709 - DNA, 19 bp, Homo sapiens
tctctacactacatttcta

SEQ ID NO: 7014710 - DNA, 23 bp, Homo sapiens
gcctgggtctagagataagagcc

SEQ ID NO: 7014711 - DNA, 22 bp, Homo sapiens
agagctaaatcagactttcttt

SEQ ID NO: 7014712 - DNA, 19 bp, Homo sapiens
agtgggcaaggaagatgac

SEQ ID NO: 7014713 - DNA, 22 bp, Homo sapiens
taccaggaatggggtcaccgtc

SEQ ID NO: 7014714 - DNA, 22 bp, Homo sapiens
taataccttgatctctcttgtc

SEQ ID NO: 7014715 - DNA, 22 bp, Homo sapiens
tcccttaatgtattgaatttca

SEQ ID NO: 7014716 - DNA, 22 bp, Homo sapiens
aagttctagaggttgatttggt

SEQ ID NO: 7014717 - DNA, 22 bp, Homo sapiens
catttcagtgttattctaattt

SEQ ID NO: 7014718 - DNA, 22 bp, Homo sapiens
actaggaagtggcaaaactgga

SEQ ID NO: 7014719 - DNA, 22 bp, Homo sapiens
tctgagtgacgtcctgacagga

SEQ ID NO: 7014720 - DNA, 22 bp, Homo sapiens
cattaggtatttaagcacacag

SEQ ID NO: 7014721 - DNA, 18 bp, Homo sapiens
ggctgcctgttcctgaag

SEQ ID NO: 7014722 - DNA, 18 bp, Homo sapiens
tcctctctttccccaggg

SEQ ID NO: 7014723 - DNA, 22 bp, Homo sapiens
gcttctgtcttagctacctccc

SEQ ID NO: 7014724 - DNA, 22 bp, Homo sapiens
tctgcgttgctcacgctgggag

SEQ ID NO: 7014725 - DNA, 22 bp, Homo sapiens
atgattttctgataaagaactg

SEQ ID NO: 7014726 - DNA, 21 bp, Homo sapiens
agaagcctgggtggaggtggg

SEQ ID NO: 7014727 - DNA, 22 bp, Homo sapiens
tttcatagccttctaatgagtt

SEQ ID NO: 7014728 - DNA, 22 bp, Homo sapiens
aaacagttttcctagctgtctg

SEQ ID NO: 7014729 - DNA, 22 bp, Homo sapiens
taagtacaaatgtatacataag

SEQ ID NO: 7014730 - DNA, 22 bp, Homo sapiens
cggcttccagcaggtgctgcgc

SEQ ID NO: 7014731 - DNA, 22 bp, Homo sapiens
ccctccctttgtctttatgaac

SEQ ID NO: 7014732 - DNA, 22 bp, Homo sapiens
tgctttcacttctctgcagcca

SEQ ID NO: 7014733 - DNA, 22 bp, Homo sapiens
acattaaaaaatgttgcatgaa

SEQ ID NO: 7014734 - DNA, 22 bp, Homo sapiens
ccatccagaaacttccatcccc

SEQ ID NO: 7014735 - DNA, 22 bp, Homo sapiens
aaactttgtagagaatgctggc

SEQ ID NO: 7014736 - DNA, 22 bp, Homo sapiens
atagacagcgcattaaaaatgt

SEQ ID NO: 7014737 - DNA, 20 bp, Homo sapiens
aggatggcaagcaagtgcat

SEQ ID NO: 7014738 - DNA, 22 bp, Homo sapiens
tgcctattcaatatatgcattt

SEQ ID NO: 7014739 - DNA, 22 bp, Homo sapiens
ctgattctctgactcttggctt

SEQ ID NO: 7014740 - DNA, 22 bp, Homo sapiens
tatagcaagctctttgtaacca

SEQ ID NO: 7014741 - DNA, 17 bp, Homo sapiens
aaatggtcctagggatt

SEQ ID NO: 7014742 - DNA, 19 bp, Homo sapiens
agccagtccaagttctgtc

SEQ ID NO: 7014743 - DNA, 19 bp, Homo sapiens
ctctgccatttgctgcctg

SEQ ID NO: 7014744 - DNA, 22 bp, Homo sapiens
gctgggaaatggagtttggctt

SEQ ID NO: 7014745 - DNA, 20 bp, Homo sapiens
cagagaccaggccaggtgtc

SEQ ID NO: 7014746 - DNA, 22 bp, Homo sapiens
atctgggtcacagtggcatcta

SEQ ID NO: 7014747 - DNA, 22 bp, Homo sapiens
ggttttatagcagtactatcag

SEQ ID NO: 7014748 - DNA, 22 bp, Homo sapiens
aatgaacacatgtggtcagttt

SEQ ID NO: 7014749 - DNA, 19 bp, Homo sapiens
aagcagccctggcaagagc

SEQ ID NO: 7014750 - DNA, 22 bp, Homo sapiens
tagatgtgtagggctccagcta

SEQ ID NO: 7014751 - DNA, 22 bp, Homo sapiens
aaactctatttctgttggctta

SEQ ID NO: 7014752 - DNA, 22 bp, Homo sapiens
ttctggggacataacagtaagc

SEQ ID NO: 7014753 - DNA, 22 bp, Homo sapiens
aggcttaacctgatcacatgag

SEQ ID NO: 7014754 - DNA, 22 bp, Homo sapiens
atatgaagtcagacaaactggg

SEQ ID NO: 7014755 - DNA, 22 bp, Homo sapiens
caaactctcccactcactctga

SEQ ID NO: 7014756 - DNA, 22 bp, Homo sapiens
tattcatgggggtccaggtacc

SEQ ID NO: 7014757 - DNA, 22 bp, Homo sapiens
actctggcttgaggaccaggtc

SEQ ID NO: 7014758 - DNA, 21 bp, Homo sapiens
cttattgctgcacaatgattt

SEQ ID NO: 7014759 - DNA, 22 bp, Homo sapiens
ccctctcctggctgcatggagc

SEQ ID NO: 7014760 - DNA, 22 bp, Homo sapiens
ctggctgggcagacagaatgct

SEQ ID NO: 7014761 - DNA, 22 bp, Homo sapiens
cagctgagtctgaggttctttg

SEQ ID NO: 7014762 - DNA, 22 bp, Homo sapiens
atactgtttctcttctacatga

SEQ ID NO: 7014763 - DNA, 22 bp, Homo sapiens
acatgcaacaaagtacctgcaa

SEQ ID NO: 7014764 - DNA, 22 bp, Homo sapiens
gatctttaaggcttaccctgga

SEQ ID NO: 7014765 - DNA, 22 bp, Homo sapiens
agtttgaaatgttggcaatatt

SEQ ID NO: 7014766 - DNA, 22 bp, Homo sapiens
caccctttgctgctcttcctcc

SEQ ID NO: 7014767 - DNA, 22 bp, Homo sapiens
tggaggcagatacactgtaaaa

SEQ ID NO: 7014768 - DNA, 22 bp, Homo sapiens
aggcttgcattttattttcagt

SEQ ID NO: 7014769 - DNA, 22 bp, Homo sapiens
cagacaggcaggtgctgctttg

SEQ ID NO: 7014770 - DNA, 22 bp, Homo sapiens
atgaagatttcccagagacatg

SEQ ID NO: 7014771 - DNA, 22 bp, Homo sapiens
gctgatgtcccactgacagcca

SEQ ID NO: 7014772 - DNA, 22 bp, Homo sapiens
tgtctattcaatatccatttct

SEQ ID NO: 7014773 - DNA, 22 bp, Homo sapiens
aaggccagtggataaaacctct

SEQ ID NO: 7014774 - DNA, 22 bp, Homo sapiens
gagcctggggaccctcctgagt

SEQ ID NO: 7014775 - DNA, 22 bp, Homo sapiens
cagccacttgtgatgctgggga

SEQ ID NO: 7014776 - DNA, 23 bp, Homo sapiens
aaacttgttaatgaggcaacagg

SEQ ID NO: 7014777 - DNA, 23 bp, Homo sapiens
cccatgctgggcgcagtgaatgg

SEQ ID NO: 7014778 - DNA, 21 bp, Homo sapiens
tcttccaagggctgctgagac

SEQ ID NO: 7014779 - DNA, 22 bp, Homo sapiens
tcaacatacatacatggtcagg

SEQ ID NO: 7014780 - DNA, 22 bp, Homo sapiens
gaacacaagcgtatgtctttgt

SEQ ID NO: 7014781 - DNA, 22 bp, Homo sapiens
ggacactagatggagaagggaa

SEQ ID NO: 7014782 - DNA, 22 bp, Homo sapiens
tgagccctcttcccattttatt

SEQ ID NO: 7014783 - DNA, 16 bp, Homo sapiens
gcaagccatcaggcaa

SEQ ID NO: 7014784 - DNA, 22 bp, Homo sapiens
agtcttgcattttctgaagatg

SEQ ID NO: 7014785 - DNA, 22 bp, Homo sapiens
tgggctgagtgtggaactagtt

SEQ ID NO: 7014786 - DNA, 22 bp, Homo sapiens
agagctggatggtcaagatggc

SEQ ID NO: 7014787 - DNA, 19 bp, Homo sapiens
aaggcagcagtagcatcca

SEQ ID NO: 7014788 - DNA, 19 bp, Homo sapiens
attgtacattgagtttggc

SEQ ID NO: 7014789 - DNA, 20 bp, Homo sapiens
tctggactctaaggtatatt

SEQ ID NO: 7014790 - DNA, 21 bp, Homo sapiens
aggtggagtgcttagcatcca

SEQ ID NO: 7014791 - DNA, 22 bp, Homo sapiens
ctctgctttgtaagttgtgagg

SEQ ID NO: 7014792 - DNA, 22 bp, Homo sapiens
ggtcactggtctctgcttccat

SEQ ID NO: 7014793 - DNA, 22 bp, Homo sapiens
tacaagtgtttgagaggtggac

SEQ ID NO: 7014794 - DNA, 23 bp, Homo sapiens
tttcatatggtgtggatgaagaa

SEQ ID NO: 7014795 - DNA, 22 bp, Homo sapiens
ctttaattctcaggtgcacata

SEQ ID NO: 7014796 - DNA, 22 bp, Homo sapiens
atatcattctgatgtatatctt

SEQ ID NO: 7014797 - DNA, 22 bp, Homo sapiens
atattctctgctgcttttgtgt

SEQ ID NO: 7014798 - DNA, 22 bp, Homo sapiens
agttaacacaagtaagattcca

SEQ ID NO: 7014799 - DNA, 19 bp, Homo sapiens
ctgtcctggtttggtccct

SEQ ID NO: 7014800 - DNA, 22 bp, Homo sapiens
tcacatgagtcactatcttaat

SEQ ID NO: 7014801 - DNA, 22 bp, Homo sapiens
ttaactgtatcatactgtttca

SEQ ID NO: 7014802 - DNA, 22 bp, Homo sapiens
tggcccctggcacacggaggat

SEQ ID NO: 7014803 - DNA, 20 bp, Homo sapiens
tagcatgggtgagggtagag

SEQ ID NO: 7014804 - DNA, 22 bp, Homo sapiens
attcttttcccaactgctttaa

SEQ ID NO: 7014805 - DNA, 22 bp, Homo sapiens
cctggtttcaggaacataatct

SEQ ID NO: 7014806 - DNA, 22 bp, Homo sapiens
ctgttgtattattcaatattat

SEQ ID NO: 7014807 - DNA, 22 bp, Homo sapiens
ggaaggaagtaaatgatgctat

SEQ ID NO: 7014808 - DNA, 22 bp, Homo sapiens
aaaattttgccctatccttcat

SEQ ID NO: 7014809 - DNA, 22 bp, Homo sapiens
ttttctgtattattgtgcttca

SEQ ID NO: 7014810 - DNA, 22 bp, Homo sapiens
atgaggccacagttatagattt

SEQ ID NO: 7014811 - DNA, 22 bp, Homo sapiens
agccagagttgaatgtgagtct

SEQ ID NO: 7014812 - DNA, 22 bp, Homo sapiens
aactctttgtggacattaaatt

SEQ ID NO: 7014813 - DNA, 22 bp, Homo sapiens
gagagaaaagggggaattgatt

SEQ ID NO: 7014814 - DNA, 22 bp, Homo sapiens
tccaagaagtcatctaaactgt

SEQ ID NO: 7014815 - DNA, 22 bp, Homo sapiens
cctggactaaaatcttttctta

SEQ ID NO: 7014816 - DNA, 22 bp, Homo sapiens
tggagtcaggatcttataaata

SEQ ID NO: 7014817 - DNA, 22 bp, Homo sapiens
ctccacggcccattgggcagga

SEQ ID NO: 7014818 - DNA, 23 bp, Homo sapiens
gcagcttgtggtttagtagaggg

SEQ ID NO: 7014819 - DNA, 22 bp, Homo sapiens
tcactgctatattggatactga

SEQ ID NO: 7014820 - DNA, 22 bp, Homo sapiens
gttcccacagtatatttttgca

SEQ ID NO: 7014821 - DNA, 22 bp, Homo sapiens
tctgtcacttttatttactgaa

SEQ ID NO: 7014822 - DNA, 22 bp, Homo sapiens
acttgttagttttatctgcatg

SEQ ID NO: 7014823 - DNA, 22 bp, Homo sapiens
cgtttaaccagcacgcttggcc

SEQ ID NO: 7014824 - DNA, 22 bp, Homo sapiens
gtagagttgagtagtggtaaca

SEQ ID NO: 7014825 - DNA, 22 bp, Homo sapiens
tctgagaacatgctttgatcat

SEQ ID NO: 7014826 - DNA, 22 bp, Homo sapiens
tatcttcaactaggattcattt

SEQ ID NO: 7014827 - DNA, 22 bp, Homo sapiens
tctcattttgagtcagacacta

SEQ ID NO: 7014828 - DNA, 20 bp, Homo sapiens
tggattctggagctgccctc

SEQ ID NO: 7014829 - DNA, 22 bp, Homo sapiens
tgagaactgaggatttgaattc

SEQ ID NO: 7014830 - DNA, 22 bp, Homo sapiens
aatcaggccaagtgaagtggga

SEQ ID NO: 7014831 - DNA, 23 bp, Homo sapiens
gcttccattctagtttgctgtgc

SEQ ID NO: 7014832 - DNA, 22 bp, Homo sapiens
cctcagagcgcgtggcattatt

SEQ ID NO: 7014833 - DNA, 22 bp, Homo sapiens
tttgcaaagtgcttgcagagta

SEQ ID NO: 7014834 - DNA, 22 bp, Homo sapiens
tgagggaggcctccatctgcca

SEQ ID NO: 7014835 - DNA, 22 bp, Homo sapiens
gcacataccccaggaatggtag

SEQ ID NO: 7014836 - DNA, 22 bp, Homo sapiens
ctgaatcatgccattttgctta

SEQ ID NO: 7014837 - DNA, 22 bp, Homo sapiens
tcctggggagggttctggctcc

SEQ ID NO: 7014838 - DNA, 22 bp, Homo sapiens
tctatgaaaagtctattcattc

SEQ ID NO: 7014839 - DNA, 22 bp, Homo sapiens
gtctgggccaggcgagccgagg

SEQ ID NO: 7014840 - DNA, 22 bp, Homo sapiens
cccacccagcctggctgagggg

SEQ ID NO: 7014841 - DNA, 22 bp, Homo sapiens
tgcagctgatgatacccccatg

SEQ ID NO: 7014842 - DNA, 22 bp, Homo sapiens
gccctcagagttccccacagtg

SEQ ID NO: 7014843 - DNA, 22 bp, Homo sapiens
ctggcaggcggcagagcccagg

SEQ ID NO: 7014844 - DNA, 22 bp, Homo sapiens
ggtgtgggggcagctctgatat

SEQ ID NO: 7014845 - DNA, 22 bp, Homo sapiens
gcctgtggccgactgagagcct

SEQ ID NO: 7014846 - DNA, 22 bp, Homo sapiens
cagagcctccctcctctgccat

SEQ ID NO: 7014847 - DNA, 18 bp, Homo sapiens
tgcaaatggctgtttgat

SEQ ID NO: 7014848 - DNA, 22 bp, Homo sapiens
agagaacatgacgtaatagtgg

SEQ ID NO: 7014849 - DNA, 22 bp, Homo sapiens
atgaagtctgcacatgcatgtg

SEQ ID NO: 7014850 - DNA, 22 bp, Homo sapiens
aagtacacctttggagtccacg

SEQ ID NO: 7014851 - DNA, 22 bp, Homo sapiens
agtggggtcctcagtatggttc

SEQ ID NO: 7014852 - DNA, 22 bp, Homo sapiens
cagcctgtagaatacagtaaat

SEQ ID NO: 7014853 - DNA, 23 bp, Homo sapiens
tgggaatactgaaacaaccttat

SEQ ID NO: 7014854 - DNA, 22 bp, Homo sapiens
tgaaaattctcaggctcacccc

SEQ ID NO: 7014855 - DNA, 22 bp, Homo sapiens
ggtgcaaggccaccatctagtg

SEQ ID NO: 7014856 - DNA, 22 bp, Homo sapiens
ggcagccagtagggccagcctg

SEQ ID NO: 7014857 - DNA, 22 bp, Homo sapiens
attcttaattccaaagactgag

SEQ ID NO: 7014858 - DNA, 22 bp, Homo sapiens
ttctgtggctgggagcctggct

SEQ ID NO: 7014859 - DNA, 22 bp, Homo sapiens
accaatgtcccgcccacgctgc

SEQ ID NO: 7014860 - DNA, 22 bp, Homo sapiens
agctgcctctgctggtttagaa

SEQ ID NO: 7014861 - DNA, 22 bp, Homo sapiens
tggccaccaccaatacttgcct

SEQ ID NO: 7014862 - DNA, 22 bp, Homo sapiens
ctacagaagccgtggtcaggaa

SEQ ID NO: 7014863 - DNA, 18 bp, Homo sapiens
gaggaacattcacctcct

SEQ ID NO: 7014864 - DNA, 22 bp, Homo sapiens
tttcagtgtgctcctgagggct

SEQ ID NO: 7014865 - DNA, 22 bp, Homo sapiens
acttctgattacacatgggcct

SEQ ID NO: 7014866 - DNA, 22 bp, Homo sapiens
aagagcccttgttcataattat

SEQ ID NO: 7014867 - DNA, 22 bp, Homo sapiens
atggagagagaaggcttgctgt

SEQ ID NO: 7014868 - DNA, 22 bp, Homo sapiens
ttgcaccccttgattgagcctt

SEQ ID NO: 7014869 - DNA, 22 bp, Homo sapiens
gcacacacatgtgagtacatgc

SEQ ID NO: 7014870 - DNA, 22 bp, Homo sapiens
tgaggggagacagagtggactc

SEQ ID NO: 7014871 - DNA, 22 bp, Homo sapiens
cagagggcacatggtttcctca

SEQ ID NO: 7014872 - DNA, 22 bp, Homo sapiens
gttcacacttttgatatgtgaa

SEQ ID NO: 7014873 - DNA, 22 bp, Homo sapiens
gcttagtttaggacaattttct

SEQ ID NO: 7014874 - DNA, 22 bp, Homo sapiens
tgaagaatgtgaattggtagct

SEQ ID NO: 7014875 - DNA, 22 bp, Homo sapiens
tacacaggggagcatggttgac

SEQ ID NO: 7014876 - DNA, 22 bp, Homo sapiens
gagcccagctaaatttatataa

SEQ ID NO: 7014877 - DNA, 22 bp, Homo sapiens
tctcatgtttctggtactcctt

SEQ ID NO: 7014878 - DNA, 20 bp, Homo sapiens
ccaaatgtggagaaaaagta

SEQ ID NO: 7014879 - DNA, 22 bp, Homo sapiens
ccagagctgcatccagcaggtt

SEQ ID NO: 7014880 - DNA, 22 bp, Homo sapiens
actgctttaaaaaagcaagctt

SEQ ID NO: 7014881 - DNA, 22 bp, Homo sapiens
taccactgctccctgcctgtga

SEQ ID NO: 7014882 - DNA, 22 bp, Homo sapiens
attattcttatgtcatcatggc

SEQ ID NO: 7014883 - DNA, 22 bp, Homo sapiens
cctcaaaggcctggcaccagaa

SEQ ID NO: 7014884 - DNA, 22 bp, Homo sapiens
tgagcacctactgtattccagg

SEQ ID NO: 7014885 - DNA, 22 bp, Homo sapiens
ctgtttttgtgctgtgtctccc

SEQ ID NO: 7014886 - DNA, 22 bp, Homo sapiens
atatatcttcattaggtcgaga

SEQ ID NO: 7014887 - DNA, 22 bp, Homo sapiens
tccctctggtcctcggtggaga

SEQ ID NO: 7014888 - DNA, 22 bp, Homo sapiens
cacatgtcccctctaggggctt

SEQ ID NO: 7014889 - DNA, 22 bp, Homo sapiens
ctgggcctcatcctcagagttt

SEQ ID NO: 7014890 - DNA, 22 bp, Homo sapiens
actgaagagcgtgctatgctca

SEQ ID NO: 7014891 - DNA, 21 bp, Homo sapiens
tgtataacttctctccctcag

SEQ ID NO: 7014892 - DNA, 22 bp, Homo sapiens
caaatcctcacctcatcatgaa

SEQ ID NO: 7014893 - DNA, 22 bp, Homo sapiens
gcagggaccagggccagatcca

SEQ ID NO: 7014894 - DNA, 22 bp, Homo sapiens
tttgcacagcctttctggctgc

SEQ ID NO: 7014895 - DNA, 22 bp, Homo sapiens
tgcctacattccttgcttatgg

SEQ ID NO: 7014896 - DNA, 22 bp, Homo sapiens
catctgcaggggaagccagttt

SEQ ID NO: 7014897 - DNA, 22 bp, Homo sapiens
ttgcagatttcttcttacctgt

SEQ ID NO: 7014898 - DNA, 22 bp, Homo sapiens
ggcatcttgttgctcaaatcta

SEQ ID NO: 7014899 - DNA, 22 bp, Homo sapiens
cactcaatacaatggttggcac

SEQ ID NO: 7014900 - DNA, 22 bp, Homo sapiens
tctttctggtctcgccttattc

SEQ ID NO: 7014901 - DNA, 22 bp, Homo sapiens
tttacacggcattatcttcatg

SEQ ID NO: 7014902 - DNA, 22 bp, Homo sapiens
gcactagtgttcttcagtaata

SEQ ID NO: 7014903 - DNA, 22 bp, Homo sapiens
gtcttgggacccgcactgtggg

SEQ ID NO: 7014904 - DNA, 22 bp, Homo sapiens
gatcagaatttacttataattg

SEQ ID NO: 7014905 - DNA, 22 bp, Homo sapiens
tgaggatttcctgcagctttct

SEQ ID NO: 7014906 - DNA, 22 bp, Homo sapiens
agatggctatagatagcctttc

SEQ ID NO: 7014907 - DNA, 16 bp, Homo sapiens
gcaggcagatcacatg

SEQ ID NO: 7014908 - DNA, 21 bp, Homo sapiens
cctgtgctatcagcttgggtt

SEQ ID NO: 7014909 - DNA, 22 bp, Homo sapiens
gcttggggtcatgaggctgctg

SEQ ID NO: 7014910 - DNA, 22 bp, Homo sapiens
aggtccctggtaattgacacac

SEQ ID NO: 7014911 - DNA, 22 bp, Homo sapiens
tatgtgtttcctgtggctgcca

SEQ ID NO: 7014912 - DNA, 22 bp, Homo sapiens
tggtagcaacatctcagtggct

SEQ ID NO: 7014913 - DNA, 21 bp, Homo sapiens
ttgattttaggaagtttgtca

SEQ ID NO: 7014914 - DNA, 22 bp, Homo sapiens
tacaggacagatgtttacagga

SEQ ID NO: 7014915 - DNA, 22 bp, Homo sapiens
atcagttttgttcactactata

SEQ ID NO: 7014916 - DNA, 22 bp, Homo sapiens
ccgaggaatttttataagatct

SEQ ID NO: 7014917 - DNA, 22 bp, Homo sapiens
acttgtaattcctggcccaggt

SEQ ID NO: 7014918 - DNA, 22 bp, Homo sapiens
cacctacttccaagagtttcca

SEQ ID NO: 7014919 - DNA, 22 bp, Homo sapiens
accagctgtgtgacctgaggca

SEQ ID NO: 7014920 - DNA, 22 bp, Homo sapiens
tgttaaggcagcaacggatgaa

SEQ ID NO: 7014921 - DNA, 22 bp, Homo sapiens
tctggaaatttcagttttagag

SEQ ID NO: 7014922 - DNA, 22 bp, Homo sapiens
cccaggccccagggcttgtcag

SEQ ID NO: 7014923 - DNA, 22 bp, Homo sapiens
ttccaaggttactggtggttta

SEQ ID NO: 7014924 - DNA, 22 bp, Homo sapiens
gggcttgggtattgtgagaggt

SEQ ID NO: 7014925 - DNA, 22 bp, Homo sapiens
tactgtttctactacttaggga

SEQ ID NO: 7014926 - DNA, 22 bp, Homo sapiens
gcggtccaggagcgcaggtcct

SEQ ID NO: 7014927 - DNA, 22 bp, Homo sapiens
gtggccaagggactctaaggca

SEQ ID NO: 7014928 - DNA, 22 bp, Homo sapiens
caggatgccatgccccaataca

SEQ ID NO: 7014929 - DNA, 22 bp, Homo sapiens
gacaggggtccctctgggctgt

SEQ ID NO: 7014930 - DNA, 22 bp, Homo sapiens
aaatgcttgtaaattttccatg

SEQ ID NO: 7014931 - DNA, 22 bp, Homo sapiens
ccctgagttagtacagttgagt

SEQ ID NO: 7014932 - DNA, 23 bp, Homo sapiens
acaatgtctgttcataaaatacc

SEQ ID NO: 7014933 - DNA, 22 bp, Homo sapiens
atgtacaggatggtgctcatct

SEQ ID NO: 7014934 - DNA, 22 bp, Homo sapiens
acgagagacagtacatagtctg

SEQ ID NO: 7014935 - DNA, 19 bp, Homo sapiens
aggcttcatcctgggcagc

SEQ ID NO: 7014936 - DNA, 22 bp, Homo sapiens
cctttttccctggagggacagc

SEQ ID NO: 7014937 - DNA, 22 bp, Homo sapiens
tacaacttacttgaatggcttt

SEQ ID NO: 7014938 - DNA, 22 bp, Homo sapiens
attctcagggagtattttctat

SEQ ID NO: 7014939 - DNA, 22 bp, Homo sapiens
agcttcaggtggtcttgtttct

SEQ ID NO: 7014940 - DNA, 22 bp, Homo sapiens
catgccattaacattagctagc

SEQ ID NO: 7014941 - DNA, 22 bp, Homo sapiens
ccagggctgctcattggctggt

SEQ ID NO: 7014942 - DNA, 19 bp, Homo sapiens
ctggccaggccaggggccc

SEQ ID NO: 7014943 - DNA, 20 bp, Homo sapiens
aggagatgatccagagtcag

SEQ ID NO: 7014944 - DNA, 22 bp, Homo sapiens
cctgagtctgtgttttcctaag

SEQ ID NO: 7014945 - DNA, 22 bp, Homo sapiens
aagaacatgggtgtgggcattc

SEQ ID NO: 7014946 - DNA, 22 bp, Homo sapiens
tgcccttgggatttaggtaagg

SEQ ID NO: 7014947 - DNA, 16 bp, Homo sapiens
atttcatgggcagtga

SEQ ID NO: 7014948 - DNA, 22 bp, Homo sapiens
ggaacagttgagatgatgtacc

SEQ ID NO: 7014949 - DNA, 22 bp, Homo sapiens
gccctgttctggacaggcacaa

SEQ ID NO: 7014950 - DNA, 22 bp, Homo sapiens
gtttggctttctctctatcctg

SEQ ID NO: 7014951 - DNA, 22 bp, Homo sapiens
tatgtcgagaataattagaatt

SEQ ID NO: 7014952 - DNA, 22 bp, Homo sapiens
tgagcaactgtgctctgctaaa

SEQ ID NO: 7014953 - DNA, 22 bp, Homo sapiens
caactccctgtggggtactggg

SEQ ID NO: 7014954 - DNA, 22 bp, Homo sapiens
gtttcctggaggttatttttga

SEQ ID NO: 7014955 - DNA, 22 bp, Homo sapiens
aaatgacagagctgggactagt

SEQ ID NO: 7014956 - DNA, 19 bp, Homo sapiens
ccaggtggaactgaggtag

SEQ ID NO: 7014957 - DNA, 22 bp, Homo sapiens
taactgaatgtattacaacaga

SEQ ID NO: 7014958 - DNA, 21 bp, Homo sapiens
ttcctcttgcttccgccttgc

SEQ ID NO: 7014959 - DNA, 22 bp, Homo sapiens
actgtgtttggcaatagggcct

SEQ ID NO: 7014960 - DNA, 22 bp, Homo sapiens
ggcaggtgctaagagaggtaaa

SEQ ID NO: 7014961 - DNA, 22 bp, Homo sapiens
cagatgaactgtgactgaaaat

SEQ ID NO: 7014962 - DNA, 20 bp, Homo sapiens
ttcttaaagacctcactttg

SEQ ID NO: 7014963 - DNA, 22 bp, Homo sapiens
tgcataatggatgatttcacaa

SEQ ID NO: 7014964 - DNA, 22 bp, Homo sapiens
ggcatccagttctgatcaacaa

SEQ ID NO: 7014965 - DNA, 22 bp, Homo sapiens
aaaccactcctgattcacttca

SEQ ID NO: 7014966 - DNA, 22 bp, Homo sapiens
tggtcttgtactatgttgcatt

SEQ ID NO: 7014967 - DNA, 22 bp, Homo sapiens
caaagctgtgaattcctacaaa

SEQ ID NO: 7014968 - DNA, 22 bp, Homo sapiens
ctgtggacctgctcttagagac

SEQ ID NO: 7014969 - DNA, 18 bp, Homo sapiens
ttggctttgagaactggt

SEQ ID NO: 7014970 - DNA, 22 bp, Homo sapiens
atggacaggtactgcagtgggt

SEQ ID NO: 7014971 - DNA, 22 bp, Homo sapiens
ttacgatcatttctaaaataaa

SEQ ID NO: 7014972 - DNA, 22 bp, Homo sapiens
caagtgtgtaattactgggagc

SEQ ID NO: 7014973 - DNA, 22 bp, Homo sapiens
gctgggaggatctctccctgtc

SEQ ID NO: 7014974 - DNA, 22 bp, Homo sapiens
ttacatttggctatgtcctcta

SEQ ID NO: 7014975 - DNA, 22 bp, Homo sapiens
cagagtgaaaactgagctcaaa

SEQ ID NO: 7014976 - DNA, 22 bp, Homo sapiens
cccagcgagtttgccggtgaac

SEQ ID NO: 7014977 - DNA, 22 bp, Homo sapiens
agaaatgaatatgtagtggtta

SEQ ID NO: 7014978 - DNA, 22 bp, Homo sapiens
ttatggttcaggtgagggtgta

SEQ ID NO: 7014979 - DNA, 22 bp, Homo sapiens
gaaggcaccctccatcactcac

SEQ ID NO: 7014980 - DNA, 22 bp, Homo sapiens
ttgccagtattaatagcacttt

SEQ ID NO: 7014981 - DNA, 22 bp, Homo sapiens
ggagggaagtgagttctcagct

SEQ ID NO: 7014982 - DNA, 22 bp, Homo sapiens
cttgatgagcctagtgcttaga

SEQ ID NO: 7014983 - DNA, 22 bp, Homo sapiens
tttgagaaactgattattatgg

SEQ ID NO: 7014984 - DNA, 22 bp, Homo sapiens
tgaaacttttgaggttcttcca

SEQ ID NO: 7014985 - DNA, 22 bp, Homo sapiens
tcatgccaaactgaacacagtt

SEQ ID NO: 7014986 - DNA, 22 bp, Homo sapiens
ctttgaaattcttcagctgaag

SEQ ID NO: 7014987 - DNA, 22 bp, Homo sapiens
attgcaaatgagtcttaatata

SEQ ID NO: 7014988 - DNA, 22 bp, Homo sapiens
atctagacatctgaaacattta

SEQ ID NO: 7014989 - DNA, 23 bp, Homo sapiens
ttgattctttcagggacctagat

SEQ ID NO: 7014990 - DNA, 23 bp, Homo sapiens
aagtgaacaggagctagatggtc

SEQ ID NO: 7014991 - DNA, 22 bp, Homo sapiens
cccagagccgctcccctacttc

SEQ ID NO: 7014992 - DNA, 22 bp, Homo sapiens
tgagggagagggcgaaaatgaa

SEQ ID NO: 7014993 - DNA, 22 bp, Homo sapiens
cgcaatcatctctctttgtgcc

SEQ ID NO: 7014994 - DNA, 22 bp, Homo sapiens
tagacattatttctacccacaa

SEQ ID NO: 7014995 - DNA, 22 bp, Homo sapiens
tgtaattttctcaagtttctac

SEQ ID NO: 7014996 - DNA, 22 bp, Homo sapiens
gatccgttccaccagtctttat

SEQ ID NO: 7014997 - DNA, 22 bp, Homo sapiens
cagggcagtgaagaacacacgt

SEQ ID NO: 7014998 - DNA, 22 bp, Homo sapiens
aaggccctagaatctatattgc

SEQ ID NO: 7014999 - DNA, 22 bp, Homo sapiens
tgaaaatttccatcagttatat

SEQ ID NO: 7015000 - DNA, 22 bp, Homo sapiens
agtgaatgagaggtgagtattg

SEQ ID NO: 7015001 - DNA, 22 bp, Homo sapiens
tctttagctaactggatgccaa

SEQ ID NO: 7015002 - DNA, 22 bp, Homo sapiens
ctgtggctaataattagtattt

SEQ ID NO: 7015003 - DNA, 22 bp, Homo sapiens
aatctagagacaatttgaatat

SEQ ID NO: 7015004 - DNA, 22 bp, Homo sapiens
caagacaatgggtaagtgtaac

SEQ ID NO: 7015005 - DNA, 22 bp, Homo sapiens
attttgcacactatgcagcttt

SEQ ID NO: 7015006 - DNA, 22 bp, Homo sapiens
gattcccatgtctgaggaggtg

SEQ ID NO: 7015007 - DNA, 22 bp, Homo sapiens
tagggtgccttttattgctgtg

SEQ ID NO: 7015008 - DNA, 22 bp, Homo sapiens
cggggagggcagaggctccctc

SEQ ID NO: 7015009 - DNA, 22 bp, Homo sapiens
gacaaagcgcctgctcgcgggc

SEQ ID NO: 7015010 - DNA, 22 bp, Homo sapiens
aagttatttttcaagatccttt

SEQ ID NO: 7015011 - DNA, 21 bp, Homo sapiens
aagagctgtcaggaaggctgc

SEQ ID NO: 7015012 - DNA, 22 bp, Homo sapiens
atgccatctcttcattttatag

SEQ ID NO: 7015013 - DNA, 22 bp, Homo sapiens
ctccacagttgctgcttttaat

SEQ ID NO: 7015014 - DNA, 22 bp, Homo sapiens
ttacccagagcacttgagcttt

SEQ ID NO: 7015015 - DNA, 22 bp, Homo sapiens
gaatttacagggtgagcttcag

SEQ ID NO: 7015016 - DNA, 22 bp, Homo sapiens
acatatatgcgtgggctcatgg

SEQ ID NO: 7015017 - DNA, 22 bp, Homo sapiens
gcagtcatcagtcctttaatta

SEQ ID NO: 7015018 - DNA, 21 bp, Homo sapiens
tcttgggataaacttcaagaa

SEQ ID NO: 7015019 - DNA, 22 bp, Homo sapiens
cagacagtttatcctaaataac

SEQ ID NO: 7015020 - DNA, 22 bp, Homo sapiens
attattgtcatcttaatcttaa

SEQ ID NO: 7015021 - DNA, 22 bp, Homo sapiens
tgggcatctctgctgccggcct

SEQ ID NO: 7015022 - DNA, 22 bp, Homo sapiens
ggcccagctgtgcttccagccc

SEQ ID NO: 7015023 - DNA, 22 bp, Homo sapiens
ctgtgaagggacggatgctgct

SEQ ID NO: 7015024 - DNA, 22 bp, Homo sapiens
gtgtggctgaaatcaaggcagg

SEQ ID NO: 7015025 - DNA, 22 bp, Homo sapiens
ttccatttggcacttcactgag

SEQ ID NO: 7015026 - DNA, 22 bp, Homo sapiens
atggtcttgattttccataggt

SEQ ID NO: 7015027 - DNA, 22 bp, Homo sapiens
cagtccagagcccaccagagga

SEQ ID NO: 7015028 - DNA, 22 bp, Homo sapiens
tttagaggttggggactttgca

SEQ ID NO: 7015029 - DNA, 22 bp, Homo sapiens
ttggatcaaatttcatgctgtc

SEQ ID NO: 7015030 - DNA, 22 bp, Homo sapiens
gttctgtcctcctaccaggcat

SEQ ID NO: 7015031 - DNA, 22 bp, Homo sapiens
aacatttcattggaagctatgt

SEQ ID NO: 7015032 - DNA, 22 bp, Homo sapiens
tagaagctcaggaataggcata

SEQ ID NO: 7015033 - DNA, 22 bp, Homo sapiens
ttgcctttcccctctggaagca

SEQ ID NO: 7015034 - DNA, 22 bp, Homo sapiens
aagtgtctgacacaaaatatgt

SEQ ID NO: 7015035 - DNA, 22 bp, Homo sapiens
tactgcttgttagctgtatttg

SEQ ID NO: 7015036 - DNA, 22 bp, Homo sapiens
cgtttagttgtcccttcttaaa

SEQ ID NO: 7015037 - DNA, 22 bp, Homo sapiens
aataacttcagttcttacatta

SEQ ID NO: 7015038 - DNA, 22 bp, Homo sapiens
ttttgtgttgccatgttaagca

SEQ ID NO: 7015039 - DNA, 22 bp, Homo sapiens
ttgctttatattcaagagagga

SEQ ID NO: 7015040 - DNA, 22 bp, Homo sapiens
accccagaatctatgctttaca

SEQ ID NO: 7015041 - DNA, 19 bp, Homo sapiens
tgtgttcattcatcagagg

SEQ ID NO: 7015042 - DNA, 22 bp, Homo sapiens
aaacaggcatcactcagcaaag

SEQ ID NO: 7015043 - DNA, 22 bp, Homo sapiens
agtatttcagttactttaaaat

SEQ ID NO: 7015044 - DNA, 22 bp, Homo sapiens
agagaaggcatagaacttgagt

SEQ ID NO: 7015045 - DNA, 22 bp, Homo sapiens
gacagtccttgcccagtatcta

SEQ ID NO: 7015046 - DNA, 22 bp, Homo sapiens
cagtgctgggcagaggagagcg

SEQ ID NO: 7015047 - DNA, 22 bp, Homo sapiens
ctgagcagctccctgagtggtc

SEQ ID NO: 7015048 - DNA, 22 bp, Homo sapiens
gtctatatattgcttgaataat

SEQ ID NO: 7015049 - DNA, 22 bp, Homo sapiens
ttgcaatagccttatttccaaa

SEQ ID NO: 7015050 - DNA, 23 bp, Homo sapiens
caaaatggtttaaaagtggcata

SEQ ID NO: 7015051 - DNA, 22 bp, Homo sapiens
gtggcaggagtgggccttgaag

SEQ ID NO: 7015052 - DNA, 18 bp, Homo sapiens
gcctggctgccaacccag

SEQ ID NO: 7015053 - DNA, 22 bp, Homo sapiens
gcaggcaggcttccttgaactg

SEQ ID NO: 7015054 - DNA, 22 bp, Homo sapiens
ggaagcccagctgtctcctgtc

SEQ ID NO: 7015055 - DNA, 22 bp, Homo sapiens
tgtccaatgccctttccacatg

SEQ ID NO: 7015056 - DNA, 22 bp, Homo sapiens
gagtctggtgatggtcattgtc

SEQ ID NO: 7015057 - DNA, 22 bp, Homo sapiens
cagcacagggacaatagcagat

SEQ ID NO: 7015058 - DNA, 22 bp, Homo sapiens
gagaagtttcttcctaggtttg

SEQ ID NO: 7015059 - DNA, 22 bp, Homo sapiens
gtgtaaatttgtacttgtaaat

SEQ ID NO: 7015060 - DNA, 22 bp, Homo sapiens
agttattttggaaaatgagtca

SEQ ID NO: 7015061 - DNA, 22 bp, Homo sapiens
agggaactccatgaggccagag

SEQ ID NO: 7015062 - DNA, 22 bp, Homo sapiens
tggccctgctggacacgcctgc

SEQ ID NO: 7015063 - DNA, 22 bp, Homo sapiens
tttgggcacagatattaagtat

SEQ ID NO: 7015064 - DNA, 22 bp, Homo sapiens
ggccagctgccaccagccctat

SEQ ID NO: 7015065 - DNA, 22 bp, Homo sapiens
cctgtgccaaaatctaggcagt

SEQ ID NO: 7015066 - DNA, 22 bp, Homo sapiens
tgctctatcctgctgagtgatt

SEQ ID NO: 7015067 - DNA, 22 bp, Homo sapiens
cagacaggggtaaccttcctca

SEQ ID NO: 7015068 - DNA, 22 bp, Homo sapiens
aagttctatagtctttctacta

SEQ ID NO: 7015069 - DNA, 22 bp, Homo sapiens
cttcacttcacagatgccaaga

SEQ ID NO: 7015070 - DNA, 22 bp, Homo sapiens
tatctaaatggaatattccaga

SEQ ID NO: 7015071 - DNA, 22 bp, Homo sapiens
attcctaaagtaatacactaga

SEQ ID NO: 7015072 - DNA, 22 bp, Homo sapiens
aatatcagattatgacgtttca

SEQ ID NO: 7015073 - DNA, 22 bp, Homo sapiens
atgtggcaatggttagcactgt

SEQ ID NO: 7015074 - DNA, 22 bp, Homo sapiens
ctgagacccagacacctgagga

SEQ ID NO: 7015075 - DNA, 18 bp, Homo sapiens
tgctcaaaagggattgct

SEQ ID NO: 7015076 - DNA, 22 bp, Homo sapiens
gagtctgtatgtcttccatgca

SEQ ID NO: 7015077 - DNA, 22 bp, Homo sapiens
tgattcaataggaattgagtag

SEQ ID NO: 7015078 - DNA, 22 bp, Homo sapiens
tgcctctgcctccattgttagt

SEQ ID NO: 7015079 - DNA, 22 bp, Homo sapiens
atttctgttgcttataaattac

SEQ ID NO: 7015080 - DNA, 22 bp, Homo sapiens
cccgggaggtggagactgcagt

SEQ ID NO: 7015081 - DNA, 22 bp, Homo sapiens
cacagctaactttcactgagca

SEQ ID NO: 7015082 - DNA, 22 bp, Homo sapiens
tagctcttaggtgcgtggctct

SEQ ID NO: 7015083 - DNA, 18 bp, Homo sapiens
agtttcagggcaggaaac

SEQ ID NO: 7015084 - DNA, 22 bp, Homo sapiens
cttaggagttcacttgaatagt

SEQ ID NO: 7015085 - DNA, 22 bp, Homo sapiens
gaacactcatggaagagttttt

SEQ ID NO: 7015086 - DNA, 20 bp, Homo sapiens
tcccaggctccaccctagac

SEQ ID NO: 7015087 - DNA, 22 bp, Homo sapiens
atatttgtatttcgtgtgtgta

SEQ ID NO: 7015088 - DNA, 22 bp, Homo sapiens
tcaatgtgaattaagaatactt

SEQ ID NO: 7015089 - DNA, 22 bp, Homo sapiens
cttctttagggatctcttgctg

SEQ ID NO: 7015090 - DNA, 22 bp, Homo sapiens
tcgttagcctcgagatctttgt

SEQ ID NO: 7015091 - DNA, 22 bp, Homo sapiens
aataaacaaatccttccttccc

SEQ ID NO: 7015092 - DNA, 20 bp, Homo sapiens
taagtgagaacatgtggtat

SEQ ID NO: 7015093 - DNA, 22 bp, Homo sapiens
ggtggcaggccctgagcatccc

SEQ ID NO: 7015094 - DNA, 22 bp, Homo sapiens
tgccgcactcggccaccagctg

SEQ ID NO: 7015095 - DNA, 22 bp, Homo sapiens
atgtcagatcctcagaaagtct

SEQ ID NO: 7015096 - DNA, 22 bp, Homo sapiens
atggagggtgtcagagagcgaa

SEQ ID NO: 7015097 - DNA, 22 bp, Homo sapiens
atacagtaattgccctgcaatg

SEQ ID NO: 7015098 - DNA, 22 bp, Homo sapiens
tacaaactgttattattattgt

SEQ ID NO: 7015099 - DNA, 20 bp, Homo sapiens
agaattcccaagcatgacca

SEQ ID NO: 7015100 - DNA, 22 bp, Homo sapiens
acatctgtttgagaaaaagaag

SEQ ID NO: 7015101 - DNA, 23 bp, Homo sapiens
ttggacaaggccagagccagcac

SEQ ID NO: 7015102 - DNA, 22 bp, Homo sapiens
gtgtgcagtgagcaaaagatct

SEQ ID NO: 7015103 - DNA, 22 bp, Homo sapiens
attcttcaaagagtgtcaaagt

SEQ ID NO: 7015104 - DNA, 22 bp, Homo sapiens
gagacgtggcctttgcctgagc

SEQ ID NO: 7015105 - DNA, 22 bp, Homo sapiens
ttaataaacaggtgcagctgaa

SEQ ID NO: 7015106 - DNA, 22 bp, Homo sapiens
ggaccaggactggtggtatctc

SEQ ID NO: 7015107 - DNA, 22 bp, Homo sapiens
gcaatagattatgatctacagt

SEQ ID NO: 7015108 - DNA, 22 bp, Homo sapiens
tagttacttttgctcttcatta

SEQ ID NO: 7015109 - DNA, 22 bp, Homo sapiens
ttctggggctaatacagaggtc

SEQ ID NO: 7015110 - DNA, 22 bp, Homo sapiens
catggagataaactgaaatatt

SEQ ID NO: 7015111 - DNA, 22 bp, Homo sapiens
atgcttaatgagggtatatatg

SEQ ID NO: 7015112 - DNA, 20 bp, Homo sapiens
gagtccaggggcctgtagca

SEQ ID NO: 7015113 - DNA, 22 bp, Homo sapiens
aagcttctttacaggagagatt

SEQ ID NO: 7015114 - DNA, 22 bp, Homo sapiens
ttgcttcatggagatggacgaa

SEQ ID NO: 7015115 - DNA, 22 bp, Homo sapiens
cactgttttcagtcagttctat

SEQ ID NO: 7015116 - DNA, 22 bp, Homo sapiens
agcatgcatgaagattcagcaa

SEQ ID NO: 7015117 - DNA, 22 bp, Homo sapiens
ggtgctgaggccttggcaggga

SEQ ID NO: 7015118 - DNA, 22 bp, Homo sapiens
cctcttgatttggctgtgaagt

SEQ ID NO: 7015119 - DNA, 22 bp, Homo sapiens
actggccaggttcaaaatacag

SEQ ID NO: 7015120 - DNA, 22 bp, Homo sapiens
ttcagaaggtgcagcctgggcc

SEQ ID NO: 7015121 - DNA, 22 bp, Homo sapiens
agggttttcatttctgagcatt

SEQ ID NO: 7015122 - DNA, 22 bp, Homo sapiens
tggctgccgactggctcttggc

SEQ ID NO: 7015123 - DNA, 22 bp, Homo sapiens
aaagtgctgggattccaggcgt

SEQ ID NO: 7015124 - DNA, 22 bp, Homo sapiens
tatcagctcggaatctgttgaa

SEQ ID NO: 7015125 - DNA, 22 bp, Homo sapiens
ctttgcagtgattgttcttgga

SEQ ID NO: 7015126 - DNA, 22 bp, Homo sapiens
ctccaggccagggaagtggaca

SEQ ID NO: 7015127 - DNA, 22 bp, Homo sapiens
aacctgctttctcagagaaggg

SEQ ID NO: 7015128 - DNA, 22 bp, Homo sapiens
agagcgcactgtctgcaggcaa

SEQ ID NO: 7015129 - DNA, 22 bp, Homo sapiens
cagctctggttcctgggcccag

SEQ ID NO: 7015130 - DNA, 22 bp, Homo sapiens
agggctggccacatgatttggt

SEQ ID NO: 7015131 - DNA, 22 bp, Homo sapiens
tgtctaaacttgttttatctca

SEQ ID NO: 7015132 - DNA, 22 bp, Homo sapiens
aagtgtgtttccgtgattgagg

SEQ ID NO: 7015133 - DNA, 23 bp, Homo sapiens
gtcctctggagagaaaggcagta

SEQ ID NO: 7015134 - DNA, 22 bp, Homo sapiens
cttgtggagtgcctgctgcagt

SEQ ID NO: 7015135 - DNA, 21 bp, Homo sapiens
agctcacagttctgtcctgtc

SEQ ID NO: 7015136 - DNA, 22 bp, Homo sapiens
gactctttcaaacagaaagcca

SEQ ID NO: 7015137 - DNA, 22 bp, Homo sapiens
acacggtggccagcagtaggtg

SEQ ID NO: 7015138 - DNA, 23 bp, Homo sapiens
ggtcccagtggagaggcctcacc

SEQ ID NO: 7015139 - DNA, 22 bp, Homo sapiens
ctggaagctggaacaggtgtgg

SEQ ID NO: 7015140 - DNA, 22 bp, Homo sapiens
caaatgtttcttatctattgtt

SEQ ID NO: 7015141 - DNA, 22 bp, Homo sapiens
tgtgacagttagtttggtgtta

SEQ ID NO: 7015142 - DNA, 21 bp, Homo sapiens
gatctctggaaggagaaagct

SEQ ID NO: 7015143 - DNA, 22 bp, Homo sapiens
agactcagccacacaagactac

SEQ ID NO: 7015144 - DNA, 22 bp, Homo sapiens
ccaggtctttggccttggcact

SEQ ID NO: 7015145 - DNA, 17 bp, Homo sapiens
ttattttttgggctgag

SEQ ID NO: 7015146 - DNA, 19 bp, Homo sapiens
cctgggacttaggctgggt

SEQ ID NO: 7015147 - DNA, 22 bp, Homo sapiens
tatagcaactccaaagagactt

SEQ ID NO: 7015148 - DNA, 22 bp, Homo sapiens
tctgggtgtggtatcttagcca

SEQ ID NO: 7015149 - DNA, 22 bp, Homo sapiens
ctgggacttgcagagcaggagg

SEQ ID NO: 7015150 - DNA, 22 bp, Homo sapiens
ctctccagaattattactatta

SEQ ID NO: 7015151 - DNA, 22 bp, Homo sapiens
tccagggcagggtgcgcatggg

SEQ ID NO: 7015152 - DNA, 22 bp, Homo sapiens
gcctagggtgctcagggacgag

SEQ ID NO: 7015153 - DNA, 22 bp, Homo sapiens
ctcagagggtacaggtgaaccc

SEQ ID NO: 7015154 - DNA, 22 bp, Homo sapiens
tttctgtagggatttcacagtt

SEQ ID NO: 7015155 - DNA, 22 bp, Homo sapiens
caccagctccaccagggcaggt

SEQ ID NO: 7015156 - DNA, 22 bp, Homo sapiens
tatttataatctgccaaagaga

SEQ ID NO: 7015157 - DNA, 22 bp, Homo sapiens
gtgtgtccctcctctcctgagt

SEQ ID NO: 7015158 - DNA, 22 bp, Homo sapiens
tgttttctattacctgagattg

SEQ ID NO: 7015159 - DNA, 22 bp, Homo sapiens
ggctgagtggctgggtctagtt

SEQ ID NO: 7015160 - DNA, 19 bp, Homo sapiens
agaagttagacattgcaat

SEQ ID NO: 7015161 - DNA, 22 bp, Homo sapiens
gatttgtgctcattttccatta

SEQ ID NO: 7015162 - DNA, 22 bp, Homo sapiens
atcagtgatcttgtttgccaga

SEQ ID NO: 7015163 - DNA, 23 bp, Homo sapiens
aaggcattggcttctctcatttc

SEQ ID NO: 7015164 - DNA, 22 bp, Homo sapiens
tgtgtacttgaaagggcaggtc

SEQ ID NO: 7015165 - DNA, 22 bp, Homo sapiens
ttgctgaggcttctgtccctgc

SEQ ID NO: 7015166 - DNA, 22 bp, Homo sapiens
tcatgttttagtaaagtgaagg

SEQ ID NO: 7015167 - DNA, 22 bp, Homo sapiens
gggcctgattagcaggctagct

SEQ ID NO: 7015168 - DNA, 22 bp, Homo sapiens
ctgatagacaatcaccatggga

SEQ ID NO: 7015169 - DNA, 22 bp, Homo sapiens
aaggacacctgcagagggacca

SEQ ID NO: 7015170 - DNA, 22 bp, Homo sapiens
cctgggtccctgagagatgatt

SEQ ID NO: 7015171 - DNA, 22 bp, Homo sapiens
tggaaggtgtggcaggtctagt

SEQ ID NO: 7015172 - DNA, 23 bp, Homo sapiens
cacacctgttaagaagagtgcct

SEQ ID NO: 7015173 - DNA, 22 bp, Homo sapiens
gtgtttctggggcattcatagt

SEQ ID NO: 7015174 - DNA, 22 bp, Homo sapiens
tcccagcaagaaagggggtggc

SEQ ID NO: 7015175 - DNA, 22 bp, Homo sapiens
tacaagtatggaatgattctca

SEQ ID NO: 7015176 - DNA, 22 bp, Homo sapiens
ctacagtatgaaacctttactc

SEQ ID NO: 7015177 - DNA, 22 bp, Homo sapiens
agggactgagctaggatctagt

SEQ ID NO: 7015178 - DNA, 22 bp, Homo sapiens
atttcttatctgaggtctacat

SEQ ID NO: 7015179 - DNA, 22 bp, Homo sapiens
tcacatgcagtagcagggattg

SEQ ID NO: 7015180 - DNA, 22 bp, Homo sapiens
agtctggagtttgctactggac

SEQ ID NO: 7015181 - DNA, 22 bp, Homo sapiens
aattgcttcccaagggaggtct

SEQ ID NO: 7015182 - DNA, 22 bp, Homo sapiens
aagggctggaatatctcttaga

SEQ ID NO: 7015183 - DNA, 22 bp, Homo sapiens
ctgggctgcttgctgaaggggt

SEQ ID NO: 7015184 - DNA, 17 bp, Homo sapiens
aagtgattcagccctca

SEQ ID NO: 7015185 - DNA, 22 bp, Homo sapiens
ttgctatgtgagatggctcaag

SEQ ID NO: 7015186 - DNA, 22 bp, Homo sapiens
ctgtgagctaggaggtaattta

SEQ ID NO: 7015187 - DNA, 22 bp, Homo sapiens
ttcaggagaattccaagaagta

SEQ ID NO: 7015188 - DNA, 21 bp, Homo sapiens
gtggttattttcattagcatc

SEQ ID NO: 7015189 - DNA, 22 bp, Homo sapiens
acagtctaggcctaggtcaaaa

SEQ ID NO: 7015190 - DNA, 22 bp, Homo sapiens
aggaagatgggagagctctgga

SEQ ID NO: 7015191 - DNA, 22 bp, Homo sapiens
tctggatttctgcctctacctc

SEQ ID NO: 7015192 - DNA, 22 bp, Homo sapiens
ctgaggtaattttccagataat

SEQ ID NO: 7015193 - DNA, 22 bp, Homo sapiens
attagttgtgtggttctcaatt

SEQ ID NO: 7015194 - DNA, 22 bp, Homo sapiens
ctggtacatttgatgataatag

SEQ ID NO: 7015195 - DNA, 21 bp, Homo sapiens
tctccagagtgggaggaaatc

SEQ ID NO: 7015196 - DNA, 20 bp, Homo sapiens
gctccccttctctgggcctc

SEQ ID NO: 7015197 - DNA, 22 bp, Homo sapiens
aaggtcactgatcagttgagta

SEQ ID NO: 7015198 - DNA, 22 bp, Homo sapiens
gaggcaatgggctatagcattg

SEQ ID NO: 7015199 - DNA, 22 bp, Homo sapiens
tattcccatttcataggcaaag

SEQ ID NO: 7015200 - DNA, 22 bp, Homo sapiens
tcctgagaaggcacagcttgca

SEQ ID NO: 7015201 - DNA, 22 bp, Homo sapiens
aacagctgttcgcagatgtagg

SEQ ID NO: 7015202 - DNA, 22 bp, Homo sapiens
tgacatgtgctcatcttggcta

SEQ ID NO: 7015203 - DNA, 22 bp, Homo sapiens
taaatgctccatacatacacca

SEQ ID NO: 7015204 - DNA, 19 bp, Homo sapiens
tgtacaaggattatgcagg

SEQ ID NO: 7015205 - DNA, 22 bp, Homo sapiens
aagcagagagcagaattaagtt

SEQ ID NO: 7015206 - DNA, 22 bp, Homo sapiens
tataatgttttccatggactga

SEQ ID NO: 7015207 - DNA, 22 bp, Homo sapiens
gagtccttgtcataattcagtg

SEQ ID NO: 7015208 - DNA, 22 bp, Homo sapiens
tagcatcatgatcagaactgtt

SEQ ID NO: 7015209 - DNA, 20 bp, Homo sapiens
agggtgtgggccttagccat

SEQ ID NO: 7015210 - DNA, 22 bp, Homo sapiens
aaggccatgaccacttgctgtg

SEQ ID NO: 7015211 - DNA, 22 bp, Homo sapiens
ttagtaaataaagtctactttc

SEQ ID NO: 7015212 - DNA, 22 bp, Homo sapiens
tcagctgccccatgtgttcact

SEQ ID NO: 7015213 - DNA, 19 bp, Homo sapiens
cctggaggtgaaggttctc

SEQ ID NO: 7015214 - DNA, 22 bp, Homo sapiens
agctgccactgagggtgcacag

SEQ ID NO: 7015215 - DNA, 22 bp, Homo sapiens
ccttaatctgatatggctggtg

SEQ ID NO: 7015216 - DNA, 22 bp, Homo sapiens
ctgagaggcacaaggcatttcg

SEQ ID NO: 7015217 - DNA, 22 bp, Homo sapiens
aagtccaaggtcaccattcaca

SEQ ID NO: 7015218 - DNA, 22 bp, Homo sapiens
tgatgcacaaagtcagcatcct

SEQ ID NO: 7015219 - DNA, 22 bp, Homo sapiens
atgaaaactttagcctcattag

SEQ ID NO: 7015220 - DNA, 21 bp, Homo sapiens
tcacagagccacagaattggt

SEQ ID NO: 7015221 - DNA, 22 bp, Homo sapiens
taggctcctctcacattctatt

SEQ ID NO: 7015222 - DNA, 22 bp, Homo sapiens
aagcagagtccccttcccatgg

SEQ ID NO: 7015223 - DNA, 22 bp, Homo sapiens
agcaggctaatcttgctgaaca

SEQ ID NO: 7015224 - DNA, 17 bp, Homo sapiens
ggtggctcgggcgcggc

SEQ ID NO: 7015225 - DNA, 22 bp, Homo sapiens
tcaaagtatctcatggagagca

SEQ ID NO: 7015226 - DNA, 22 bp, Homo sapiens
gcacttcatgactttgtcaaat

SEQ ID NO: 7015227 - DNA, 22 bp, Homo sapiens
gctgggccccttgaaaggcgtc

SEQ ID NO: 7015228 - DNA, 22 bp, Homo sapiens
cctcagaacggaaatggttttg

SEQ ID NO: 7015229 - DNA, 22 bp, Homo sapiens
agaatctgcattttaacaagat

SEQ ID NO: 7015230 - DNA, 22 bp, Homo sapiens
ttgtgtcttaaagattaaatgg

SEQ ID NO: 7015231 - DNA, 22 bp, Homo sapiens
tgccagctagtcacatattaga

SEQ ID NO: 7015232 - DNA, 22 bp, Homo sapiens
ctactgtcaatgtgagccttgg

SEQ ID NO: 7015233 - DNA, 22 bp, Homo sapiens
gagccagctgagctgcactgtc

SEQ ID NO: 7015234 - DNA, 22 bp, Homo sapiens
cagaatctgttggggttgcaga

SEQ ID NO: 7015235 - DNA, 22 bp, Homo sapiens
tctgtcaaatgggcataaggat

SEQ ID NO: 7015236 - DNA, 22 bp, Homo sapiens
ttcaatagcatacttttgctct

SEQ ID NO: 7015237 - DNA, 22 bp, Homo sapiens
tgggcttcctggagcctgtgct

SEQ ID NO: 7015238 - DNA, 22 bp, Homo sapiens
tctgttcatctcatgggagaat

SEQ ID NO: 7015239 - DNA, 22 bp, Homo sapiens
agatgtgggagatgcttctgca

SEQ ID NO: 7015240 - DNA, 22 bp, Homo sapiens
cagactggctgaaggccgagtg

SEQ ID NO: 7015241 - DNA, 22 bp, Homo sapiens
tgtgcctagttctgtatttaca

SEQ ID NO: 7015242 - DNA, 22 bp, Homo sapiens
tctctggcttaggttgagtgca

SEQ ID NO: 7015243 - DNA, 22 bp, Homo sapiens
gataaactggaaccattgcctc

SEQ ID NO: 7015244 - DNA, 22 bp, Homo sapiens
tccaaatatattcacgtcctag

SEQ ID NO: 7015245 - DNA, 22 bp, Homo sapiens
ctgtccattggtatattagggt

SEQ ID NO: 7015246 - DNA, 22 bp, Homo sapiens
taggatgtagctatgtcatcat

SEQ ID NO: 7015247 - DNA, 22 bp, Homo sapiens
gctgtggcctccagcactcccc

SEQ ID NO: 7015248 - DNA, 22 bp, Homo sapiens
atgtggcttagttaggtgcccc

SEQ ID NO: 7015249 - DNA, 22 bp, Homo sapiens
tgcaggttctgaccagccaact

SEQ ID NO: 7015250 - DNA, 22 bp, Homo sapiens
ccaggtaggagagtcaacatgt

SEQ ID NO: 7015251 - DNA, 22 bp, Homo sapiens
tacagtcaacattgatgatgat

SEQ ID NO: 7015252 - DNA, 22 bp, Homo sapiens
tttctcctgagttccacgctac

SEQ ID NO: 7015253 - DNA, 22 bp, Homo sapiens
aatcaatgttagtcatgaattt

SEQ ID NO: 7015254 - DNA, 22 bp, Homo sapiens
gaccaaagaagccacccgtcct

SEQ ID NO: 7015255 - DNA, 22 bp, Homo sapiens
agagggaacggatcccagcgcg

SEQ ID NO: 7015256 - DNA, 22 bp, Homo sapiens
tctgcatcatttttcagagccg

SEQ ID NO: 7015257 - DNA, 22 bp, Homo sapiens
aaggcacttgcccagagctgca

SEQ ID NO: 7015258 - DNA, 22 bp, Homo sapiens
agggcactgcaagggttgaagg

SEQ ID NO: 7015259 - DNA, 22 bp, Homo sapiens
tctccttgacaggcaggcagac

SEQ ID NO: 7015260 - DNA, 22 bp, Homo sapiens
aatcttttaggggatcctgagg

SEQ ID NO: 7015261 - DNA, 22 bp, Homo sapiens
agagaaagtaaagattctacct

SEQ ID NO: 7015262 - DNA, 22 bp, Homo sapiens
tagcaccggcagtggtaggtgc

SEQ ID NO: 7015263 - DNA, 22 bp, Homo sapiens
gcaagattccgctctagagcct

SEQ ID NO: 7015264 - DNA, 17 bp, Homo sapiens
ggcttatctgttgggtg

SEQ ID NO: 7015265 - DNA, 22 bp, Homo sapiens
tcctccacgtgagggcatacag

SEQ ID NO: 7015266 - DNA, 22 bp, Homo sapiens
tgtgctggagatcagcttattt

SEQ ID NO: 7015267 - DNA, 22 bp, Homo sapiens
ggaggtgcagagtagggttggt

SEQ ID NO: 7015268 - DNA, 22 bp, Homo sapiens
atgtccttttatttaaagcagg

SEQ ID NO: 7015269 - DNA, 23 bp, Homo sapiens
aatttggaaatgaggctaccaag

SEQ ID NO: 7015270 - DNA, 22 bp, Homo sapiens
agtctgtgactcattggatctc

SEQ ID NO: 7015271 - DNA, 20 bp, Homo sapiens
aggttcctttgtggagaatt

SEQ ID NO: 7015272 - DNA, 22 bp, Homo sapiens
cccgagggtagatggcattgaa

SEQ ID NO: 7015273 - DNA, 22 bp, Homo sapiens
aacatcttgtcaaatgtccaca

SEQ ID NO: 7015274 - DNA, 19 bp, Homo sapiens
acattggacatggatcttg

SEQ ID NO: 7015275 - DNA, 22 bp, Homo sapiens
attctgcttcttatttcacgtg

SEQ ID NO: 7015276 - DNA, 22 bp, Homo sapiens
ttcctgaaaatacagggagacc

SEQ ID NO: 7015277 - DNA, 22 bp, Homo sapiens
ggcagcctggagactttgtgaa

SEQ ID NO: 7015278 - DNA, 22 bp, Homo sapiens
agctaaggactggagggtttct

SEQ ID NO: 7015279 - DNA, 22 bp, Homo sapiens
acttgataaacaattactgtta

SEQ ID NO: 7015280 - DNA, 22 bp, Homo sapiens
tttacagtctatgttgaattaa

SEQ ID NO: 7015281 - DNA, 22 bp, Homo sapiens
tatattctattgtacctctcct

SEQ ID NO: 7015282 - DNA, 22 bp, Homo sapiens
ttgaaactgagtgtgtttgggg

SEQ ID NO: 7015283 - DNA, 22 bp, Homo sapiens
aaggtgccacttccctcagact

SEQ ID NO: 7015284 - DNA, 22 bp, Homo sapiens
ctctttgtggaacggcagtgtc

SEQ ID NO: 7015285 - DNA, 22 bp, Homo sapiens
ttcatgtatttatcatgtaaat

SEQ ID NO: 7015286 - DNA, 22 bp, Homo sapiens
tggatgagttcaatgaggcaga

SEQ ID NO: 7015287 - DNA, 22 bp, Homo sapiens
tgtaagatttgctatgtgttgt

SEQ ID NO: 7015288 - DNA, 22 bp, Homo sapiens
agccttgaacactgactgaagg

SEQ ID NO: 7015289 - DNA, 22 bp, Homo sapiens
gacttcagatattttttaagtt

SEQ ID NO: 7015290 - DNA, 22 bp, Homo sapiens
gtggaattagctgcctaggaaa

SEQ ID NO: 7015291 - DNA, 22 bp, Homo sapiens
ggcagctgtggacgtcgtcatt

SEQ ID NO: 7015292 - DNA, 22 bp, Homo sapiens
ttacagttaatgtgactaacca

SEQ ID NO: 7015293 - DNA, 22 bp, Homo sapiens
ggctcacaaaatgttgcttaat

SEQ ID NO: 7015294 - DNA, 22 bp, Homo sapiens
cttgaggttttgactcagcttt

SEQ ID NO: 7015295 - DNA, 22 bp, Homo sapiens
tggtaattaatttgataggttc

SEQ ID NO: 7015296 - DNA, 22 bp, Homo sapiens
agtggccaggaaaggtccagcc

SEQ ID NO: 7015297 - DNA, 22 bp, Homo sapiens
ttaccaagctctgcatgttaag

SEQ ID NO: 7015298 - DNA, 22 bp, Homo sapiens
aaagagaaaatgatctgtacat

SEQ ID NO: 7015299 - DNA, 22 bp, Homo sapiens
ttcaaggcaagtactttaattt

SEQ ID NO: 7015300 - DNA, 22 bp, Homo sapiens
tgcacaggtgagactcaggaag

SEQ ID NO: 7015301 - DNA, 22 bp, Homo sapiens
tttaggcatgcagttctattta

SEQ ID NO: 7015302 - DNA, 22 bp, Homo sapiens
acaggcagagtcaggttgggtt

SEQ ID NO: 7015303 - DNA, 23 bp, Homo sapiens
ttgggcaggagagtaatgtgatc

SEQ ID NO: 7015304 - DNA, 22 bp, Homo sapiens
gataaagcaggtaggagaagat

SEQ ID NO: 7015305 - DNA, 22 bp, Homo sapiens
tgtgcatgttgcttgaactcct

SEQ ID NO: 7015306 - DNA, 22 bp, Homo sapiens
ggctcctgccgtcttttctgag

SEQ ID NO: 7015307 - DNA, 22 bp, Homo sapiens
actcctggggctgccatcacag

SEQ ID NO: 7015308 - DNA, 23 bp, Homo sapiens
agggcactgttgggtgttgagga

SEQ ID NO: 7015309 - DNA, 22 bp, Homo sapiens
gtccctctgcctgtggttctct

SEQ ID NO: 7015310 - DNA, 22 bp, Homo sapiens
ccacaggcggagtggcgggcag

SEQ ID NO: 7015311 - DNA, 22 bp, Homo sapiens
agatctggaaaatcacaggtgc

SEQ ID NO: 7015312 - DNA, 22 bp, Homo sapiens
gtataagcccattctcagagac

SEQ ID NO: 7015313 - DNA, 19 bp, Homo sapiens
aatggacaggcaatagtct

SEQ ID NO: 7015314 - DNA, 22 bp, Homo sapiens
acctacagagatctgcattttt

SEQ ID NO: 7015315 - DNA, 22 bp, Homo sapiens
tcccacagatgctgtccagagt

SEQ ID NO: 7015316 - DNA, 22 bp, Homo sapiens
ctgggccttatgagtacctgga

SEQ ID NO: 7015317 - DNA, 22 bp, Homo sapiens
aagttggtgtatgagacagaag

SEQ ID NO: 7015318 - DNA, 22 bp, Homo sapiens
atagtacagcatttttcctgag

SEQ ID NO: 7015319 - DNA, 22 bp, Homo sapiens
tccctgagggcagctcaagtcc

SEQ ID NO: 7015320 - DNA, 22 bp, Homo sapiens
aacactgagaggggagtggcac

SEQ ID NO: 7015321 - DNA, 22 bp, Homo sapiens
agggagaaggtttagctgtgag

SEQ ID NO: 7015322 - DNA, 22 bp, Homo sapiens
ggctgcttttcttgtatctact

SEQ ID NO: 7015323 - DNA, 22 bp, Homo sapiens
atcaaagggattgggggctgct

SEQ ID NO: 7015324 - DNA, 21 bp, Homo sapiens
gtcagagatgcccaactgcct

SEQ ID NO: 7015325 - DNA, 20 bp, Homo sapiens
tcacctaaaccagcagtttc

SEQ ID NO: 7015326 - DNA, 22 bp, Homo sapiens
gtcagagaactggattttccaa

SEQ ID NO: 7015327 - DNA, 22 bp, Homo sapiens
agaagctgcgtttatttaaatc

SEQ ID NO: 7015328 - DNA, 22 bp, Homo sapiens
ggggctcttagagagcctagtg

SEQ ID NO: 7015329 - DNA, 22 bp, Homo sapiens
attaaattaagtggctaattta

SEQ ID NO: 7015330 - DNA, 22 bp, Homo sapiens
taagaccaaagttctgtaggga

SEQ ID NO: 7015331 - DNA, 22 bp, Homo sapiens
aagactgtgtctatggctactc

SEQ ID NO: 7015332 - DNA, 22 bp, Homo sapiens
tctgataggcagaaggcataag

SEQ ID NO: 7015333 - DNA, 17 bp, Homo sapiens
cccagctggcagtgccg

SEQ ID NO: 7015334 - DNA, 22 bp, Homo sapiens
ttccaggaaaacagttggaagt

SEQ ID NO: 7015335 - DNA, 22 bp, Homo sapiens
tctcaattgtgggtgaggagca

SEQ ID NO: 7015336 - DNA, 22 bp, Homo sapiens
tagtttagcactaagaaaaaca

SEQ ID NO: 7015337 - DNA, 22 bp, Homo sapiens
tctttcttattagccattgttc

SEQ ID NO: 7015338 - DNA, 22 bp, Homo sapiens
gcagcagattgttttttcacct

SEQ ID NO: 7015339 - DNA, 22 bp, Homo sapiens
gctctgtgtaaatgtagggtcc

SEQ ID NO: 7015340 - DNA, 22 bp, Homo sapiens
gcggcccgggtccccagcagca

SEQ ID NO: 7015341 - DNA, 22 bp, Homo sapiens
atcagtttaaatgggctgttgg

SEQ ID NO: 7015342 - DNA, 22 bp, Homo sapiens
tagacactgtatgagctgggtg

SEQ ID NO: 7015343 - DNA, 22 bp, Homo sapiens
gtgagactcgcctttgtgtagc

SEQ ID NO: 7015344 - DNA, 22 bp, Homo sapiens
accattgcctagaaaaattcct

SEQ ID NO: 7015345 - DNA, 22 bp, Homo sapiens
tgacactgccgaaactgtagag

SEQ ID NO: 7015346 - DNA, 22 bp, Homo sapiens
tagtccatgttgatatcctcat

SEQ ID NO: 7015347 - DNA, 22 bp, Homo sapiens
tggagataggctgaggcagggc

SEQ ID NO: 7015348 - DNA, 22 bp, Homo sapiens
aacagtatctacgggaactatt

SEQ ID NO: 7015349 - DNA, 22 bp, Homo sapiens
ggcctcagggttgggcccatta

SEQ ID NO: 7015350 - DNA, 22 bp, Homo sapiens
accaggagggaccctggtggcc

SEQ ID NO: 7015351 - DNA, 20 bp, Homo sapiens
tcacatcctctcccaacatg

SEQ ID NO: 7015352 - DNA, 22 bp, Homo sapiens
tcagggccctggcaggaaacag

SEQ ID NO: 7015353 - DNA, 22 bp, Homo sapiens
tcttgaataagtttcatgagct

SEQ ID NO: 7015354 - DNA, 22 bp, Homo sapiens
agccagtgttaagtgactggtt

SEQ ID NO: 7015355 - DNA, 18 bp, Homo sapiens
tgaacacagtacaattcc

SEQ ID NO: 7015356 - DNA, 22 bp, Homo sapiens
ttcagcaattttttaagctaat

SEQ ID NO: 7015357 - DNA, 22 bp, Homo sapiens
ggtcatgttttaaaaatattgt

SEQ ID NO: 7015358 - DNA, 22 bp, Homo sapiens
tttaagggatattttgatagct

SEQ ID NO: 7015359 - DNA, 23 bp, Homo sapiens
tcaagcaattctcctgcctcggc

SEQ ID NO: 7015360 - DNA, 21 bp, Homo sapiens
aggctttacctctgggtaggt

SEQ ID NO: 7015361 - DNA, 22 bp, Homo sapiens
ctggttatcctgcctattttgt

SEQ ID NO: 7015362 - DNA, 22 bp, Homo sapiens
agaggcagcagtcatactacag

SEQ ID NO: 7015363 - DNA, 22 bp, Homo sapiens
gtggcagaggctgtgaggatgc

SEQ ID NO: 7015364 - DNA, 22 bp, Homo sapiens
aaactagagcatgtgagtggga

SEQ ID NO: 7015365 - DNA, 22 bp, Homo sapiens
gacattgaagtatttttgtcga

SEQ ID NO: 7015366 - DNA, 22 bp, Homo sapiens
ccagtttaagacttatctcaat

SEQ ID NO: 7015367 - DNA, 22 bp, Homo sapiens
tagtcagtgcacagacacttgt

SEQ ID NO: 7015368 - DNA, 22 bp, Homo sapiens
gggcttaattcatcccataaat

SEQ ID NO: 7015369 - DNA, 22 bp, Homo sapiens
aggtctgagcaggggagaacag

SEQ ID NO: 7015370 - DNA, 22 bp, Homo sapiens
atgggttacagccttggatttc

SEQ ID NO: 7015371 - DNA, 21 bp, Homo sapiens
cctggctgcacagttgctggt

SEQ ID NO: 7015372 - DNA, 23 bp, Homo sapiens
tacctattttcttaacacatcta

SEQ ID NO: 7015373 - DNA, 23 bp, Homo sapiens
tcactgtcctgctcctggaacgc

SEQ ID NO: 7015374 - DNA, 22 bp, Homo sapiens
cagctgctgttactgcttatta

SEQ ID NO: 7015375 - DNA, 22 bp, Homo sapiens
ctctggaattgacctgggaggg

SEQ ID NO: 7015376 - DNA, 22 bp, Homo sapiens
tgctgacaaaggaacaatactc

SEQ ID NO: 7015377 - DNA, 22 bp, Homo sapiens
gataatttgatacctcaatcag

SEQ ID NO: 7015378 - DNA, 22 bp, Homo sapiens
caatgcaatgcaatgcaatgca

SEQ ID NO: 7015379 - DNA, 20 bp, Homo sapiens
ggccagctgatgcacgatgc

SEQ ID NO: 7015380 - DNA, 22 bp, Homo sapiens
catgttgtatcattctgttcct

SEQ ID NO: 7015381 - DNA, 22 bp, Homo sapiens
gcaccagggtgctgtgttctgg

SEQ ID NO: 7015382 - DNA, 17 bp, Homo sapiens
ttctgctgtttcccctt

SEQ ID NO: 7015383 - DNA, 22 bp, Homo sapiens
acatgcatggtgttgggttgga

SEQ ID NO: 7015384 - DNA, 22 bp, Homo sapiens
tctgtgcatttcaggacctgaa

SEQ ID NO: 7015385 - DNA, 22 bp, Homo sapiens
cttggagaatcctggttattca

SEQ ID NO: 7015386 - DNA, 22 bp, Homo sapiens
taacagttggtgtaatttcttg

SEQ ID NO: 7015387 - DNA, 22 bp, Homo sapiens
ggtgggagtggaacgtggaaga

SEQ ID NO: 7015388 - DNA, 22 bp, Homo sapiens
ggctctagagctgtgcacacat

SEQ ID NO: 7015389 - DNA, 22 bp, Homo sapiens
tctttgcagaacgatgaagatg

SEQ ID NO: 7015390 - DNA, 22 bp, Homo sapiens
gctctgtcttcagcacacagta

SEQ ID NO: 7015391 - DNA, 22 bp, Homo sapiens
cagcccatggtttgtggccagt

SEQ ID NO: 7015392 - DNA, 22 bp, Homo sapiens
agtaatagtgaatcgactatga

SEQ ID NO: 7015393 - DNA, 22 bp, Homo sapiens
cctgcctgtccctcagtccaca

SEQ ID NO: 7015394 - DNA, 22 bp, Homo sapiens
tattattttagcactgaggatt

SEQ ID NO: 7015395 - DNA, 22 bp, Homo sapiens
ttcactgctgggtgattgggtt

SEQ ID NO: 7015396 - DNA, 18 bp, Homo sapiens
tttcattgagtgtgatat

SEQ ID NO: 7015397 - DNA, 22 bp, Homo sapiens
tggacagtatctcttattcctc

SEQ ID NO: 7015398 - DNA, 22 bp, Homo sapiens
tctaaggaaggacaccctggct

SEQ ID NO: 7015399 - DNA, 21 bp, Homo sapiens
tatgaacatgaccaatagtcc

SEQ ID NO: 7015400 - DNA, 22 bp, Homo sapiens
tcctcttctgtggattccctga

SEQ ID NO: 7015401 - DNA, 23 bp, Homo sapiens
gacagggctgacttggcagctgc

SEQ ID NO: 7015402 - DNA, 20 bp, Homo sapiens
gctgtgccatgaccctcgag

SEQ ID NO: 7015403 - DNA, 22 bp, Homo sapiens
caaggcatgcacaagaaggggg

SEQ ID NO: 7015404 - DNA, 22 bp, Homo sapiens
agatcatatgcagtaatgaact

SEQ ID NO: 7015405 - DNA, 22 bp, Homo sapiens
acagttaataagtagtaagtca

SEQ ID NO: 7015406 - DNA, 22 bp, Homo sapiens
gacaaaactgagatcacactgt

SEQ ID NO: 7015407 - DNA, 22 bp, Homo sapiens
attttaaccctcttatatatac

SEQ ID NO: 7015408 - DNA, 22 bp, Homo sapiens
atgcagggttatttcaaaaata

SEQ ID NO: 7015409 - DNA, 22 bp, Homo sapiens
gattggcctagtccctattata

SEQ ID NO: 7015410 - DNA, 22 bp, Homo sapiens
tacactgtcttagaaaggggca

SEQ ID NO: 7015411 - DNA, 22 bp, Homo sapiens
ttcagagcccaaatggagatta

SEQ ID NO: 7015412 - DNA, 22 bp, Homo sapiens
tttcattggcagagcctgtttt

SEQ ID NO: 7015413 - DNA, 22 bp, Homo sapiens
gtaagaggatcaaggcggtgca

SEQ ID NO: 7015414 - DNA, 22 bp, Homo sapiens
ctcctgagtctccacgccccgt

SEQ ID NO: 7015415 - DNA, 22 bp, Homo sapiens
ccagggttggtctctctgaggt

SEQ ID NO: 7015416 - DNA, 22 bp, Homo sapiens
tcagttttcaatttcatcagag

SEQ ID NO: 7015417 - DNA, 22 bp, Homo sapiens
tgagttttgtcttgctagaagt

SEQ ID NO: 7015418 - DNA, 22 bp, Homo sapiens
ctgtttatagcagagcaagcct

SEQ ID NO: 7015419 - DNA, 22 bp, Homo sapiens
ccttcaaaacactagtttttga

SEQ ID NO: 7015420 - DNA, 22 bp, Homo sapiens
agtccaaggttcatggcacaga

SEQ ID NO: 7015421 - DNA, 22 bp, Homo sapiens
ttctgtaaacatcaagtgcctg

SEQ ID NO: 7015422 - DNA, 22 bp, Homo sapiens
tgctaataaactccaggctgag

SEQ ID NO: 7015423 - DNA, 22 bp, Homo sapiens
agatccatgtgatttggagttc

SEQ ID NO: 7015424 - DNA, 22 bp, Homo sapiens
tgtggttgaaggttattactta

SEQ ID NO: 7015425 - DNA, 22 bp, Homo sapiens
gctcccagatttcagccttgtg

SEQ ID NO: 7015426 - DNA, 22 bp, Homo sapiens
cttcagtcgccttggcaggggc

SEQ ID NO: 7015427 - DNA, 22 bp, Homo sapiens
ctctgcttgtgtcaggcatgct

SEQ ID NO: 7015428 - DNA, 21 bp, Homo sapiens
cagaggtcatcctgaggacaa

SEQ ID NO: 7015429 - DNA, 22 bp, Homo sapiens
gcagagctccccaagacaccaa

SEQ ID NO: 7015430 - DNA, 22 bp, Homo sapiens
gggtaccaagctgcttgggggc

SEQ ID NO: 7015431 - DNA, 19 bp, Homo sapiens
cagatggccacctacttgc

SEQ ID NO: 7015432 - DNA, 22 bp, Homo sapiens
cctgtatttgcttccttctgca

SEQ ID NO: 7015433 - DNA, 22 bp, Homo sapiens
tcagagtcctcaccctgaggat

SEQ ID NO: 7015434 - DNA, 22 bp, Homo sapiens
tgccaggctaagtggaggactt

SEQ ID NO: 7015435 - DNA, 19 bp, Homo sapiens
gctgttctgaccatcaccc

SEQ ID NO: 7015436 - DNA, 22 bp, Homo sapiens
gggtgtccagggcgtgtctgga

SEQ ID NO: 7015437 - DNA, 22 bp, Homo sapiens
tttctgcaagtgtagataccca

SEQ ID NO: 7015438 - DNA, 22 bp, Homo sapiens
aaggagacatttgcagagcacc

SEQ ID NO: 7015439 - DNA, 22 bp, Homo sapiens
gcagtcctgtagcgactttttt

SEQ ID NO: 7015440 - DNA, 22 bp, Homo sapiens
cagaggcaggataagaactgcg

SEQ ID NO: 7015441 - DNA, 22 bp, Homo sapiens
gaggaaccaaatcagcttgcac

SEQ ID NO: 7015442 - DNA, 22 bp, Homo sapiens
accctggacatcttgtcatagc

SEQ ID NO: 7015443 - DNA, 22 bp, Homo sapiens
gtcacttgagcatttcttcttt

SEQ ID NO: 7015444 - DNA, 22 bp, Homo sapiens
ttagttagtggggctgtcagtc

SEQ ID NO: 7015445 - DNA, 22 bp, Homo sapiens
agtcaacagtttttgatgtaaa

SEQ ID NO: 7015446 - DNA, 22 bp, Homo sapiens
aagtatgcaaatcgtcttagaa

SEQ ID NO: 7015447 - DNA, 22 bp, Homo sapiens
tacacatcaacctggctttggc

SEQ ID NO: 7015448 - DNA, 23 bp, Homo sapiens
acatccatgaatcatctgctttc

SEQ ID NO: 7015449 - DNA, 23 bp, Homo sapiens
tcaaacatattgtgagacacagg

SEQ ID NO: 7015450 - DNA, 22 bp, Homo sapiens
gtttacatattttaattggtga

SEQ ID NO: 7015451 - DNA, 22 bp, Homo sapiens
gtctcctggctgcagctaagac

SEQ ID NO: 7015452 - DNA, 22 bp, Homo sapiens
ctgtatatcatggttttgcagt

SEQ ID NO: 7015453 - DNA, 22 bp, Homo sapiens
tttagctcagttctagccccat

SEQ ID NO: 7015454 - DNA, 22 bp, Homo sapiens
gggttaggtccctcccttctgg

SEQ ID NO: 7015455 - DNA, 22 bp, Homo sapiens
gggagagagagctcatgttgaa

SEQ ID NO: 7015456 - DNA, 22 bp, Homo sapiens
tggtcaggtacctctggctgtc

SEQ ID NO: 7015457 - DNA, 22 bp, Homo sapiens
tagtatatgtctatggttgtag

SEQ ID NO: 7015458 - DNA, 20 bp, Homo sapiens
tgggtcctgcacattctcca

SEQ ID NO: 7015459 - DNA, 22 bp, Homo sapiens
tgcatacttgtatgtgttacat

SEQ ID NO: 7015460 - DNA, 22 bp, Homo sapiens
gcttcgctgctagctagttggt

SEQ ID NO: 7015461 - DNA, 22 bp, Homo sapiens
acctggagggaagttctgactt

SEQ ID NO: 7015462 - DNA, 22 bp, Homo sapiens
atattccttttaaagagttaca

SEQ ID NO: 7015463 - DNA, 22 bp, Homo sapiens
attagtgttgtggcttcatggc

SEQ ID NO: 7015464 - DNA, 22 bp, Homo sapiens
tgcagggtgtccggaggatcac

SEQ ID NO: 7015465 - DNA, 22 bp, Homo sapiens
caagatcaatcaatactcctta

SEQ ID NO: 7015466 - DNA, 22 bp, Homo sapiens
tttcaataacaaagctcatttt

SEQ ID NO: 7015467 - DNA, 22 bp, Homo sapiens
gagcacagtgtgttgtgatttc

SEQ ID NO: 7015468 - DNA, 22 bp, Homo sapiens
gaaggaaaacagatctgcctga

SEQ ID NO: 7015469 - DNA, 22 bp, Homo sapiens
gatgaacatttaaagcctcttg

SEQ ID NO: 7015470 - DNA, 22 bp, Homo sapiens
gcagccagtgggatgagaaaga

SEQ ID NO: 7015471 - DNA, 22 bp, Homo sapiens
ggctctgccatttcctagctgc

SEQ ID NO: 7015472 - DNA, 22 bp, Homo sapiens
tgtgctctgaagagtgcatgtc

SEQ ID NO: 7015473 - DNA, 22 bp, Homo sapiens
tgacttctctggcctggtgcag

SEQ ID NO: 7015474 - DNA, 22 bp, Homo sapiens
acctgagaatgggggcatgtgt

SEQ ID NO: 7015475 - DNA, 22 bp, Homo sapiens
tgcagacaagccaggctatggc

SEQ ID NO: 7015476 - DNA, 22 bp, Homo sapiens
tggtgtttaatgggctgtttat

SEQ ID NO: 7015477 - DNA, 22 bp, Homo sapiens
ggaggtgggagacataggcggc

SEQ ID NO: 7015478 - DNA, 22 bp, Homo sapiens
tagcatttctggcctctactca

SEQ ID NO: 7015479 - DNA, 22 bp, Homo sapiens
taataagcgtagaaggtatatc

SEQ ID NO: 7015480 - DNA, 22 bp, Homo sapiens
aacacagggggttacaaattgt

SEQ ID NO: 7015481 - DNA, 21 bp, Homo sapiens
gcatttggttttgtcaatgct

SEQ ID NO: 7015482 - DNA, 19 bp, Homo sapiens
ctttggagaatggtttgct

SEQ ID NO: 7015483 - DNA, 22 bp, Homo sapiens
acaaagagggaccagtgacttg

SEQ ID NO: 7015484 - DNA, 22 bp, Homo sapiens
tcctggcattgtgcagggtgtg

SEQ ID NO: 7015485 - DNA, 22 bp, Homo sapiens
cacaatttccattgagcagcag

SEQ ID NO: 7015486 - DNA, 22 bp, Homo sapiens
aacaatgccaacagcatgctgg

SEQ ID NO: 7015487 - DNA, 22 bp, Homo sapiens
tagtgaaagtattaaacagctg

SEQ ID NO: 7015488 - DNA, 22 bp, Homo sapiens
tttagcaaaacattatgtctgt

SEQ ID NO: 7015489 - DNA, 22 bp, Homo sapiens
ggtatgaattcactacttccaa

SEQ ID NO: 7015490 - DNA, 20 bp, Homo sapiens
tactggagtgagcctgtagc

SEQ ID NO: 7015491 - DNA, 17 bp, Homo sapiens
ctgtcacaatacctcgc

SEQ ID NO: 7015492 - DNA, 22 bp, Homo sapiens
gcgtggagacaactctggggtg

SEQ ID NO: 7015493 - DNA, 22 bp, Homo sapiens
agtagtttccatttctgagttt

SEQ ID NO: 7015494 - DNA, 22 bp, Homo sapiens
tggtggagctgtggccacgacc

SEQ ID NO: 7015495 - DNA, 17 bp, Homo sapiens
ctaggcttggcagctcg

SEQ ID NO: 7015496 - DNA, 22 bp, Homo sapiens
gatttccaggtcattaataaag

SEQ ID NO: 7015497 - DNA, 22 bp, Homo sapiens
gaggccaggaagcccaagatca

SEQ ID NO: 7015498 - DNA, 20 bp, Homo sapiens
agaaatacatgcatgcatga

SEQ ID NO: 7015499 - DNA, 22 bp, Homo sapiens
tgccacagaggtgaagcccact

SEQ ID NO: 7015500 - DNA, 22 bp, Homo sapiens
aagagctggaagtgaagataac

SEQ ID NO: 7015501 - DNA, 18 bp, Homo sapiens
tagtgcatgaaaggttca

SEQ ID NO: 7015502 - DNA, 22 bp, Homo sapiens
acaggcttactgtttcataggg

SEQ ID NO: 7015503 - DNA, 22 bp, Homo sapiens
ctgggtctccggcagcctcggg

SEQ ID NO: 7015504 - DNA, 22 bp, Homo sapiens
ctctccaggctgggacaggacc

SEQ ID NO: 7015505 - DNA, 22 bp, Homo sapiens
aactaagttgcccagtccctgg

SEQ ID NO: 7015506 - DNA, 22 bp, Homo sapiens
aaatacattagacggagagtta

SEQ ID NO: 7015507 - DNA, 22 bp, Homo sapiens
tgtcaaaaccagcaattttgtt

SEQ ID NO: 7015508 - DNA, 22 bp, Homo sapiens
actaattgctttcttgtgctga

SEQ ID NO: 7015509 - DNA, 22 bp, Homo sapiens
agtcagttttctccagggggct

SEQ ID NO: 7015510 - DNA, 22 bp, Homo sapiens
agttttctttcgcaaaggtaca

SEQ ID NO: 7015511 - DNA, 22 bp, Homo sapiens
tttccagtgcatggcaaatgct

SEQ ID NO: 7015512 - DNA, 22 bp, Homo sapiens
tcacctaattgaagtcaggagt

SEQ ID NO: 7015513 - DNA, 22 bp, Homo sapiens
aggattctagaaatttgatact

SEQ ID NO: 7015514 - DNA, 22 bp, Homo sapiens
ctgtcattcttacataatgtga

SEQ ID NO: 7015515 - DNA, 22 bp, Homo sapiens
tcaatacatgtgtgtggatggt

SEQ ID NO: 7015516 - DNA, 22 bp, Homo sapiens
tcactgtggtatatatgtatca

SEQ ID NO: 7015517 - DNA, 22 bp, Homo sapiens
attagaagaggctgacgaatgt

SEQ ID NO: 7015518 - DNA, 22 bp, Homo sapiens
tgggctctggaattgagtggcc

SEQ ID NO: 7015519 - DNA, 22 bp, Homo sapiens
taattggctttacttaaagtcc

SEQ ID NO: 7015520 - DNA, 22 bp, Homo sapiens
gggtgggatgccgctgtctcca

SEQ ID NO: 7015521 - DNA, 22 bp, Homo sapiens
actgtaaaggtgattagaagtt

SEQ ID NO: 7015522 - DNA, 22 bp, Homo sapiens
tgaattcttatgaaagtgcttg

SEQ ID NO: 7015523 - DNA, 22 bp, Homo sapiens
ttgatgtagcctaagacagaac

SEQ ID NO: 7015524 - DNA, 22 bp, Homo sapiens
ccctaaggcagcccagtctgtg

SEQ ID NO: 7015525 - DNA, 22 bp, Homo sapiens
ctccatgggggctggcctgtgt

SEQ ID NO: 7015526 - DNA, 22 bp, Homo sapiens
ccacatggagcaggaggtgggg

SEQ ID NO: 7015527 - DNA, 22 bp, Homo sapiens
tcaataactttgtttagcattg

SEQ ID NO: 7015528 - DNA, 22 bp, Homo sapiens
ccttcaaatttagaacaagtga

SEQ ID NO: 7015529 - DNA, 22 bp, Homo sapiens
ctgatgcaggtggtttaaaaac

SEQ ID NO: 7015530 - DNA, 22 bp, Homo sapiens
tctggctgacatcctgtatgag

SEQ ID NO: 7015531 - DNA, 22 bp, Homo sapiens
aacatctgtgaactccgaaaat

SEQ ID NO: 7015532 - DNA, 18 bp, Homo sapiens
ggtcactgagatgctact

SEQ ID NO: 7015533 - DNA, 22 bp, Homo sapiens
tagaacttcttacagctaagtt

SEQ ID NO: 7015534 - DNA, 22 bp, Homo sapiens
accctgagtgcaacggtgagga

SEQ ID NO: 7015535 - DNA, 22 bp, Homo sapiens
atgctggtaagttgcaaatgtt

SEQ ID NO: 7015536 - DNA, 22 bp, Homo sapiens
tacaggcatgaatgaaatctgt

SEQ ID NO: 7015537 - DNA, 22 bp, Homo sapiens
cccttggggctctttgccaggc

SEQ ID NO: 7015538 - DNA, 22 bp, Homo sapiens
aggcaaatagatagtccataca

SEQ ID NO: 7015539 - DNA, 20 bp, Homo sapiens
actcaaatcacctgcctcaa

SEQ ID NO: 7015540 - DNA, 22 bp, Homo sapiens
agagcaagtgacagaaacaggg

SEQ ID NO: 7015541 - DNA, 22 bp, Homo sapiens
aggtattcagatgaagtgctga

SEQ ID NO: 7015542 - DNA, 22 bp, Homo sapiens
tggagagcgcgacgggaggaag

SEQ ID NO: 7015543 - DNA, 22 bp, Homo sapiens
tccattgtctttggtcctagcc

SEQ ID NO: 7015544 - DNA, 22 bp, Homo sapiens
acaatatagtccatgagcatgc

SEQ ID NO: 7015545 - DNA, 19 bp, Homo sapiens
gtggagctaagaaaaggaa

SEQ ID NO: 7015546 - DNA, 22 bp, Homo sapiens
cagagacatccatgttagttgg

SEQ ID NO: 7015547 - DNA, 22 bp, Homo sapiens
attgaagagaagctaaatagag

SEQ ID NO: 7015548 - DNA, 22 bp, Homo sapiens
ggctttgcagcctcattgctct

SEQ ID NO: 7015549 - DNA, 22 bp, Homo sapiens
acagatgaggaagagtcagcca

SEQ ID NO: 7015550 - DNA, 22 bp, Homo sapiens
tctgagtcttggggtccctatt

SEQ ID NO: 7015551 - DNA, 22 bp, Homo sapiens
tatggatgtttatctacaggct

SEQ ID NO: 7015552 - DNA, 22 bp, Homo sapiens
atgtagaatggtgattggcagg

SEQ ID NO: 7015553 - DNA, 22 bp, Homo sapiens
gcgggttttgtgaatgtaggtt

SEQ ID NO: 7015554 - DNA, 23 bp, Homo sapiens
acgaggtagggcagggtgtgtct

SEQ ID NO: 7015555 - DNA, 19 bp, Homo sapiens
tgcttcatttcttttatgt

SEQ ID NO: 7015556 - DNA, 22 bp, Homo sapiens
agcacagtgaatggtttactca

SEQ ID NO: 7015557 - DNA, 22 bp, Homo sapiens
attgcaaggtgtagttatggtt

SEQ ID NO: 7015558 - DNA, 22 bp, Homo sapiens
tagagaggtttgaattggctgc

SEQ ID NO: 7015559 - DNA, 22 bp, Homo sapiens
cactgcaacctccacctcctgg

SEQ ID NO: 7015560 - DNA, 22 bp, Homo sapiens
tctctgtagttgggcagctgct

SEQ ID NO: 7015561 - DNA, 22 bp, Homo sapiens
gtgtgactttatttggaaatag

SEQ ID NO: 7015562 - DNA, 22 bp, Homo sapiens
tcgaactcatagtcgtagctgt

SEQ ID NO: 7015563 - DNA, 22 bp, Homo sapiens
aggcagctggacataactaacc

SEQ ID NO: 7015564 - DNA, 22 bp, Homo sapiens
tggtctggaactcctggcttca

SEQ ID NO: 7015565 - DNA, 22 bp, Homo sapiens
tccaagggctttggcgtgaagt

SEQ ID NO: 7015566 - DNA, 22 bp, Homo sapiens
cacagagattagaattagacta

SEQ ID NO: 7015567 - DNA, 21 bp, Homo sapiens
agacctcttcccttcatgcac

SEQ ID NO: 7015568 - DNA, 22 bp, Homo sapiens
ttcacagatgagaaaattgagg

SEQ ID NO: 7015569 - DNA, 22 bp, Homo sapiens
cagcctgctagggcaatgcctt

SEQ ID NO: 7015570 - DNA, 22 bp, Homo sapiens
actggcagaggttggacaccat

SEQ ID NO: 7015571 - DNA, 17 bp, Homo sapiens
ttattgcagtgctgaag

SEQ ID NO: 7015572 - DNA, 19 bp, Homo sapiens
gccctcatgatattcagat

SEQ ID NO: 7015573 - DNA, 22 bp, Homo sapiens
agaagtgtctcatcaggcaata

SEQ ID NO: 7015574 - DNA, 21 bp, Homo sapiens
gtcagctgtgtgtgaggaccc

SEQ ID NO: 7015575 - DNA, 17 bp, Homo sapiens
ctggagcagacaaaagg

SEQ ID NO: 7015576 - DNA, 22 bp, Homo sapiens
tctatgtagtgccagctagtat

SEQ ID NO: 7015577 - DNA, 22 bp, Homo sapiens
aatttcagaactatctgggagt

SEQ ID NO: 7015578 - DNA, 22 bp, Homo sapiens
ggccaggctggtctcagacttc

SEQ ID NO: 7015579 - DNA, 22 bp, Homo sapiens
aggaagcttgtgtgtattggtc

SEQ ID NO: 7015580 - DNA, 22 bp, Homo sapiens
ttaagtgcttcaagggaagctc

SEQ ID NO: 7015581 - DNA, 18 bp, Homo sapiens
ctgcactcccgcctgggc

SEQ ID NO: 7015582 - DNA, 22 bp, Homo sapiens
acagcagaataatgagtaatag

SEQ ID NO: 7015583 - DNA, 22 bp, Homo sapiens
gctctggtttcctgttcactca

SEQ ID NO: 7015584 - DNA, 22 bp, Homo sapiens
ttcatgtgtttgttgtcaaggg

SEQ ID NO: 7015585 - DNA, 23 bp, Homo sapiens
cagaagcacctgttgactgctgc

SEQ ID NO: 7015586 - DNA, 21 bp, Homo sapiens
agggagctgcgtcttgaaaga

SEQ ID NO: 7015587 - DNA, 22 bp, Homo sapiens
tccctgtaaacctcaagttgat

SEQ ID NO: 7015588 - DNA, 22 bp, Homo sapiens
ccagagcagggcagcagggctc

SEQ ID NO: 7015589 - DNA, 22 bp, Homo sapiens
aagcaaggccggaaggaaactc

SEQ ID NO: 7015590 - DNA, 22 bp, Homo sapiens
tttgtacacaggtcattcaggg

SEQ ID NO: 7015591 - DNA, 22 bp, Homo sapiens
aaacttgttctcttgtgcctat

SEQ ID NO: 7015592 - DNA, 22 bp, Homo sapiens
ccctgcttccgctgttttctca

SEQ ID NO: 7015593 - DNA, 22 bp, Homo sapiens
tgggactcactcttttggccag

SEQ ID NO: 7015594 - DNA, 22 bp, Homo sapiens
cctcacatgaatgtaagctcca

SEQ ID NO: 7015595 - DNA, 22 bp, Homo sapiens
ttatacaggagattccttactt

SEQ ID NO: 7015596 - DNA, 22 bp, Homo sapiens
tctctggctggcaccccaggga

SEQ ID NO: 7015597 - DNA, 22 bp, Homo sapiens
gtgattctcactctagtgcttg

SEQ ID NO: 7015598 - DNA, 22 bp, Homo sapiens
ttcacactataaagggcgtgaa

SEQ ID NO: 7015599 - DNA, 22 bp, Homo sapiens
agaccatggccatcctaggaaa

SEQ ID NO: 7015600 - DNA, 20 bp, Homo sapiens
caagtgttattgtgcattta

SEQ ID NO: 7015601 - DNA, 22 bp, Homo sapiens
acagagtcattcattgtccagt

SEQ ID NO: 7015602 - DNA, 22 bp, Homo sapiens
aggcttggctgcacgcctcgct

SEQ ID NO: 7015603 - DNA, 22 bp, Homo sapiens
tggctagcaactcaactgttaa

SEQ ID NO: 7015604 - DNA, 21 bp, Homo sapiens
ccagagagagggaagtgggtt

SEQ ID NO: 7015605 - DNA, 22 bp, Homo sapiens
agttgaataattagacatatct

SEQ ID NO: 7015606 - DNA, 20 bp, Homo sapiens
gaacatggcaggtggagggg

SEQ ID NO: 7015607 - DNA, 22 bp, Homo sapiens
atagcaaagcctggcacaatga

SEQ ID NO: 7015608 - DNA, 22 bp, Homo sapiens
tacacataaaatgctcatggta

SEQ ID NO: 7015609 - DNA, 22 bp, Homo sapiens
agctcctgggccaagcccatgc

SEQ ID NO: 7015610 - DNA, 22 bp, Homo sapiens
cagtaaatgtgatttttcttgt

SEQ ID NO: 7015611 - DNA, 22 bp, Homo sapiens
gaaggagggtgcggatctgagc

SEQ ID NO: 7015612 - DNA, 22 bp, Homo sapiens
cagctgctgttcagttttgttt

SEQ ID NO: 7015613 - DNA, 22 bp, Homo sapiens
ccacacagtcagtttccaagaa

SEQ ID NO: 7015614 - DNA, 22 bp, Homo sapiens
tcatccctaaggacagctctgc

SEQ ID NO: 7015615 - DNA, 17 bp, Homo sapiens
aatacttccaactagtg

SEQ ID NO: 7015616 - DNA, 21 bp, Homo sapiens
ctgtgccagcagaagaaagct

SEQ ID NO: 7015617 - DNA, 22 bp, Homo sapiens
acattgttctacttctagttag

SEQ ID NO: 7015618 - DNA, 22 bp, Homo sapiens
tatatgtctgctactgtataaa

SEQ ID NO: 7015619 - DNA, 22 bp, Homo sapiens
agctggccagcacctccaggtc

SEQ ID NO: 7015620 - DNA, 22 bp, Homo sapiens
actgcccacatctctttccgct

SEQ ID NO: 7015621 - DNA, 22 bp, Homo sapiens
ttctggctgtatgatatttaat

SEQ ID NO: 7015622 - DNA, 22 bp, Homo sapiens
caatcagtttctgttgtataat

SEQ ID NO: 7015623 - DNA, 22 bp, Homo sapiens
gctatttctatattataaagaa

SEQ ID NO: 7015624 - DNA, 22 bp, Homo sapiens
tggtgtcatgttggggtttatt

SEQ ID NO: 7015625 - DNA, 22 bp, Homo sapiens
tttagcattaagcttttcaaat

SEQ ID NO: 7015626 - DNA, 22 bp, Homo sapiens
ggagtgggaacaatgacatggt

SEQ ID NO: 7015627 - DNA, 22 bp, Homo sapiens
gctgcctgatttacatagtgaa

SEQ ID NO: 7015628 - DNA, 22 bp, Homo sapiens
ttgtctgtccaggcaccccaag

SEQ ID NO: 7015629 - DNA, 22 bp, Homo sapiens
attctgggtttgctgtacaaag

SEQ ID NO: 7015630 - DNA, 22 bp, Homo sapiens
tttacagtatagtaggactcat

SEQ ID NO: 7015631 - DNA, 22 bp, Homo sapiens
gataccagagcccaaagcagca

SEQ ID NO: 7015632 - DNA, 22 bp, Homo sapiens
gtgcttttctgcagggtcctat

SEQ ID NO: 7015633 - DNA, 22 bp, Homo sapiens
tgaagccagctttggaagacac

SEQ ID NO: 7015634 - DNA, 22 bp, Homo sapiens
cttcaaatcctgtgtagggcta

SEQ ID NO: 7015635 - DNA, 21 bp, Homo sapiens
cctgggccaaattccctggac

SEQ ID NO: 7015636 - DNA, 22 bp, Homo sapiens
ttcaacactgatcgtttacaca

SEQ ID NO: 7015637 - DNA, 18 bp, Homo sapiens
gatgtctcgaggagacta

SEQ ID NO: 7015638 - DNA, 22 bp, Homo sapiens
tgcaggaggccccatggaaccg

SEQ ID NO: 7015639 - DNA, 22 bp, Homo sapiens
gttggccaggctggtctcaatc

SEQ ID NO: 7015640 - DNA, 21 bp, Homo sapiens
cactgcagccttgacctgggc

SEQ ID NO: 7015641 - DNA, 22 bp, Homo sapiens
ttctagaagctgaaaaggggga

SEQ ID NO: 7015642 - DNA, 22 bp, Homo sapiens
tgcttaatacgtatttgctgga

SEQ ID NO: 7015643 - DNA, 22 bp, Homo sapiens
aaggctttgattccattgccct

SEQ ID NO: 7015644 - DNA, 22 bp, Homo sapiens
tccattcttttgctgtcttcct

SEQ ID NO: 7015645 - DNA, 22 bp, Homo sapiens
gagtgtgttattaaagatggaa

SEQ ID NO: 7015646 - DNA, 22 bp, Homo sapiens
atcaggattacacggggatgct

SEQ ID NO: 7015647 - DNA, 22 bp, Homo sapiens
cctcactgctatgtgtttgctc

SEQ ID NO: 7015648 - DNA, 22 bp, Homo sapiens
ctggcctgagcacagcggctgc

SEQ ID NO: 7015649 - DNA, 22 bp, Homo sapiens
tactttggttaatgaaatgtga

SEQ ID NO: 7015650 - DNA, 21 bp, Homo sapiens
ccactctgagtgttgaacaga

SEQ ID NO: 7015651 - DNA, 22 bp, Homo sapiens
gcacccctcagcttgtttacta

SEQ ID NO: 7015652 - DNA, 17 bp, Homo sapiens
tcagcaggggccaagct

SEQ ID NO: 7015653 - DNA, 22 bp, Homo sapiens
ggagcagccgcgtctcagggca

SEQ ID NO: 7015654 - DNA, 22 bp, Homo sapiens
agcccaagctatgaggtgacct

SEQ ID NO: 7015655 - DNA, 22 bp, Homo sapiens
gtagctgatattagcaatgagt

SEQ ID NO: 7015656 - DNA, 22 bp, Homo sapiens
taatgctgtggtctaatgggga

SEQ ID NO: 7015657 - DNA, 22 bp, Homo sapiens
aacaaggcaagtctgtgagcat

SEQ ID NO: 7015658 - DNA, 22 bp, Homo sapiens
cagtcattggctaaagctccct

SEQ ID NO: 7015659 - DNA, 22 bp, Homo sapiens
acctttatggagaacttgggat

SEQ ID NO: 7015660 - DNA, 21 bp, Homo sapiens
gttttaagggagaaaacctag

SEQ ID NO: 7015661 - DNA, 22 bp, Homo sapiens
tcagaattaagctcttggtcag

SEQ ID NO: 7015662 - DNA, 22 bp, Homo sapiens
atgcctttgccacagattagga

SEQ ID NO: 7015663 - DNA, 22 bp, Homo sapiens
acagtgctatcaatagctagaa

SEQ ID NO: 7015664 - DNA, 22 bp, Homo sapiens
tgacaggagggttgtggcaggg

SEQ ID NO: 7015665 - DNA, 22 bp, Homo sapiens
gggttaggttctagaggcacaa

SEQ ID NO: 7015666 - DNA, 22 bp, Homo sapiens
tggaatgtcataccataaaaga

SEQ ID NO: 7015667 - DNA, 22 bp, Homo sapiens
aggagtttggggattagtcagg

SEQ ID NO: 7015668 - DNA, 22 bp, Homo sapiens
tgctggaaagttaaattttgga

SEQ ID NO: 7015669 - DNA, 16 bp, Homo sapiens
cacagtgctgctgctc

SEQ ID NO: 7015670 - DNA, 22 bp, Homo sapiens
agggcagaaatcgattacacct

SEQ ID NO: 7015671 - DNA, 22 bp, Homo sapiens
tgctgagtctgaaacagctcag

SEQ ID NO: 7015672 - DNA, 22 bp, Homo sapiens
actgggagtcatgaggaaggag

SEQ ID NO: 7015673 - DNA, 22 bp, Homo sapiens
gagggaagagggtttgaattca

SEQ ID NO: 7015674 - DNA, 22 bp, Homo sapiens
gcagctgcgaagaagtctatct

SEQ ID NO: 7015675 - DNA, 22 bp, Homo sapiens
tgatggaaggtttctcggtgat

SEQ ID NO: 7015676 - DNA, 22 bp, Homo sapiens
actaattgtatagttgatgtaa

SEQ ID NO: 7015677 - DNA, 22 bp, Homo sapiens
cactgggaatctgggaaagaga

SEQ ID NO: 7015678 - DNA, 22 bp, Homo sapiens
atattcttcttgttcagactat

SEQ ID NO: 7015679 - DNA, 22 bp, Homo sapiens
actggaattggaatctggagct

SEQ ID NO: 7015680 - DNA, 22 bp, Homo sapiens
ttaggcaatatcattggagttg

SEQ ID NO: 7015681 - DNA, 22 bp, Homo sapiens
aaaccaaacatttgcggtggtg

SEQ ID NO: 7015682 - DNA, 22 bp, Homo sapiens
tccagtcctgggagcctttctg

SEQ ID NO: 7015683 - DNA, 22 bp, Homo sapiens
tctagagccaaagtcttggggg

SEQ ID NO: 7015684 - DNA, 22 bp, Homo sapiens
ttgaatgaataaaagagtaagg

SEQ ID NO: 7015685 - DNA, 22 bp, Homo sapiens
aagactgtacattttccagtct

SEQ ID NO: 7015686 - DNA, 22 bp, Homo sapiens
acatgtctaagtactcaacaaa

SEQ ID NO: 7015687 - DNA, 22 bp, Homo sapiens
actcctgtgggcatggcacccc

SEQ ID NO: 7015688 - DNA, 22 bp, Homo sapiens
atataaagtgtttagaaagctg

SEQ ID NO: 7015689 - DNA, 22 bp, Homo sapiens
tagatgcttgtcagtttctgtc

SEQ ID NO: 7015690 - DNA, 22 bp, Homo sapiens
gagctcttcctttcaggaggcc

SEQ ID NO: 7015691 - DNA, 22 bp, Homo sapiens
ctgtgcattgtcttgtctgtag

SEQ ID NO: 7015692 - DNA, 22 bp, Homo sapiens
gatggcaccttgaacgctgcgt

SEQ ID NO: 7015693 - DNA, 22 bp, Homo sapiens
gaaacccaaactaagacagtag

SEQ ID NO: 7015694 - DNA, 22 bp, Homo sapiens
agttctcttccacagcctcctc

SEQ ID NO: 7015695 - DNA, 20 bp, Homo sapiens
acaatatgtagatgaatagc

SEQ ID NO: 7015696 - DNA, 22 bp, Homo sapiens
gtaaagctctcatttaatatca

SEQ ID NO: 7015697 - DNA, 18 bp, Homo sapiens
atgcagttggtactctca

SEQ ID NO: 7015698 - DNA, 22 bp, Homo sapiens
gttttctggcagttattcctta

SEQ ID NO: 7015699 - DNA, 22 bp, Homo sapiens
tctaaacagtttcactcttaat

SEQ ID NO: 7015700 - DNA, 22 bp, Homo sapiens
catatcaaagagaaggatagga

SEQ ID NO: 7015701 - DNA, 22 bp, Homo sapiens
actgtgcaagtcaaagatgggc

SEQ ID NO: 7015702 - DNA, 22 bp, Homo sapiens
aaggaggcagaactcacatgga

SEQ ID NO: 7015703 - DNA, 22 bp, Homo sapiens
tgccatccaacagttccatctt

SEQ ID NO: 7015704 - DNA, 22 bp, Homo sapiens
catggccacatctagctgcaag

SEQ ID NO: 7015705 - DNA, 22 bp, Homo sapiens
tttaggttcttggaatcagtct

SEQ ID NO: 7015706 - DNA, 22 bp, Homo sapiens
aatcacattacagcatatctgt

SEQ ID NO: 7015707 - DNA, 22 bp, Homo sapiens
gatgtgtttgtttctggaggag

SEQ ID NO: 7015708 - DNA, 22 bp, Homo sapiens
cggcttgctcacacccacctcc

SEQ ID NO: 7015709 - DNA, 22 bp, Homo sapiens
ccagccagtatattccaaagcc

SEQ ID NO: 7015710 - DNA, 17 bp, Homo sapiens
agacaggttatagttga

SEQ ID NO: 7015711 - DNA, 22 bp, Homo sapiens
gagttaatgtgtacacaaaggg

SEQ ID NO: 7015712 - DNA, 22 bp, Homo sapiens
cacagtgaatttcaagtgttgt

SEQ ID NO: 7015713 - DNA, 22 bp, Homo sapiens
ggtgagtttcatggttgtttac

SEQ ID NO: 7015714 - DNA, 22 bp, Homo sapiens
tgcatcaacctaatatcagctc

SEQ ID NO: 7015715 - DNA, 22 bp, Homo sapiens
tcaggcaatctgacagctggag

SEQ ID NO: 7015716 - DNA, 22 bp, Homo sapiens
ttgcagggcttggggattacag

SEQ ID NO: 7015717 - DNA, 22 bp, Homo sapiens
aaagtggtttttcagactttga

SEQ ID NO: 7015718 - DNA, 22 bp, Homo sapiens
ctgcctgtgatttttctctagt

SEQ ID NO: 7015719 - DNA, 22 bp, Homo sapiens
gccctgctggggcacagcaaga

SEQ ID NO: 7015720 - DNA, 22 bp, Homo sapiens
atagaagctgataaactacttc

SEQ ID NO: 7015721 - DNA, 22 bp, Homo sapiens
tccccaggagttttactttgca

SEQ ID NO: 7015722 - DNA, 22 bp, Homo sapiens
tatcagcaagatggcagtatag

SEQ ID NO: 7015723 - DNA, 22 bp, Homo sapiens
tggaggaagtggctggccagaa

SEQ ID NO: 7015724 - DNA, 19 bp, Homo sapiens
cttgctgggtggtttctgc

SEQ ID NO: 7015725 - DNA, 22 bp, Homo sapiens
ggtgggtcttgtggggcagctt

SEQ ID NO: 7015726 - DNA, 22 bp, Homo sapiens
gcatggcctctgtgcttgttgc

SEQ ID NO: 7015727 - DNA, 22 bp, Homo sapiens
tgtgttcttaaaagcagtgata

SEQ ID NO: 7015728 - DNA, 22 bp, Homo sapiens
agggcatgctggaggagagaca

SEQ ID NO: 7015729 - DNA, 22 bp, Homo sapiens
atttaccagctgtgcactgata

SEQ ID NO: 7015730 - DNA, 22 bp, Homo sapiens
tcagtaacctttagcacagttg

SEQ ID NO: 7015731 - DNA, 22 bp, Homo sapiens
tttatgagcctcaaatctgagt

SEQ ID NO: 7015732 - DNA, 22 bp, Homo sapiens
tctttgaatcctttacatctga

SEQ ID NO: 7015733 - DNA, 22 bp, Homo sapiens
gttctcctcttgtcccaggctg

SEQ ID NO: 7015734 - DNA, 22 bp, Homo sapiens
gggaaactggggactgaatctg

SEQ ID NO: 7015735 - DNA, 22 bp, Homo sapiens
aggtttctgcaatgtgtgtaca

SEQ ID NO: 7015736 - DNA, 22 bp, Homo sapiens
ccaaatcaggggccacaagcat

SEQ ID NO: 7015737 - DNA, 22 bp, Homo sapiens
tggctgggccgggccttgtgcc

SEQ ID NO: 7015738 - DNA, 22 bp, Homo sapiens
atttgcaggtgtcgattagtct

SEQ ID NO: 7015739 - DNA, 22 bp, Homo sapiens
cagggatgggatggagtcagtt

SEQ ID NO: 7015740 - DNA, 22 bp, Homo sapiens
tgggggctttatgtaatgcaca

SEQ ID NO: 7015741 - DNA, 22 bp, Homo sapiens
cccaagagatcgcatgtagttg

SEQ ID NO: 7015742 - DNA, 23 bp, Homo sapiens
ttcaacaaatatggccaccagaa

SEQ ID NO: 7015743 - DNA, 18 bp, Homo sapiens
agctcctgaactctgtgg

SEQ ID NO: 7015744 - DNA, 22 bp, Homo sapiens
tatttggatacaatcatttgct

SEQ ID NO: 7015745 - DNA, 22 bp, Homo sapiens
agcccagtgggccgaggcgggg

SEQ ID NO: 7015746 - DNA, 22 bp, Homo sapiens
gcatgcaggataggttgagctc

SEQ ID NO: 7015747 - DNA, 22 bp, Homo sapiens
tgcagcctctctgcttcaggaa

SEQ ID NO: 7015748 - DNA, 22 bp, Homo sapiens
tccctgtgtcctgggggcacct

SEQ ID NO: 7015749 - DNA, 22 bp, Homo sapiens
gtgtgtcaggtactgtgctagg

SEQ ID NO: 7015750 - DNA, 22 bp, Homo sapiens
tccagggagagccgctgctcca

SEQ ID NO: 7015751 - DNA, 22 bp, Homo sapiens
cgggcactttgaaaatccattt

SEQ ID NO: 7015752 - DNA, 22 bp, Homo sapiens
accatttaaaattgatgccttc

SEQ ID NO: 7015753 - DNA, 22 bp, Homo sapiens
tgagctgccccctggcctgctc

SEQ ID NO: 7015754 - DNA, 22 bp, Homo sapiens
agctttgggattcaggcaggaa

SEQ ID NO: 7015755 - DNA, 22 bp, Homo sapiens
tcttagaagtttatggcacgga

SEQ ID NO: 7015756 - DNA, 22 bp, Homo sapiens
gaaaacactttgatctgaaagt

SEQ ID NO: 7015757 - DNA, 22 bp, Homo sapiens
gttcagttatgtgacctcaaaa

SEQ ID NO: 7015758 - DNA, 22 bp, Homo sapiens
tcagagaagtaggctaatggtg

SEQ ID NO: 7015759 - DNA, 22 bp, Homo sapiens
cctttaaagactgcataacttc

SEQ ID NO: 7015760 - DNA, 22 bp, Homo sapiens
agctgaacgtgcttctgcagca

SEQ ID NO: 7015761 - DNA, 22 bp, Homo sapiens
tgtgcctgctagatggttgtcg

SEQ ID NO: 7015762 - DNA, 22 bp, Homo sapiens
tgagaacatacaaacagagaaa

SEQ ID NO: 7015763 - DNA, 22 bp, Homo sapiens
tttcagttcatgtattccgagt

SEQ ID NO: 7015764 - DNA, 19 bp, Homo sapiens
ttagaacatcctctaggga

SEQ ID NO: 7015765 - DNA, 19 bp, Homo sapiens
atgcaaatagatttggaat

SEQ ID NO: 7015766 - DNA, 22 bp, Homo sapiens
tgtttggagaaaggctgtgaac

SEQ ID NO: 7015767 - DNA, 19 bp, Homo sapiens
gtccagtgttttccagtca

SEQ ID NO: 7015768 - DNA, 22 bp, Homo sapiens
cagcttctccggcctggtgcgg

SEQ ID NO: 7015769 - DNA, 22 bp, Homo sapiens
tcaaaggataactgagggcagt

SEQ ID NO: 7015770 - DNA, 22 bp, Homo sapiens
gctcagagagaggatatgttat

SEQ ID NO: 7015771 - DNA, 22 bp, Homo sapiens
tccaggagattcattaggtcat

SEQ ID NO: 7015772 - DNA, 22 bp, Homo sapiens
acactgtgacaagaaagagctg

SEQ ID NO: 7015773 - DNA, 23 bp, Homo sapiens
atgatagaaactcttgtagtctc

SEQ ID NO: 7015774 - DNA, 22 bp, Homo sapiens
tacttgagtatagtcgcttcac

SEQ ID NO: 7015775 - DNA, 22 bp, Homo sapiens
ccatttgtgcttcttcaaagca

SEQ ID NO: 7015776 - DNA, 22 bp, Homo sapiens
acctgtgtctcctctgtgttct

SEQ ID NO: 7015777 - DNA, 22 bp, Homo sapiens
aggctccagtctcctctggcag

SEQ ID NO: 7015778 - DNA, 23 bp, Homo sapiens
cataaaatattagtatggtagca

SEQ ID NO: 7015779 - DNA, 22 bp, Homo sapiens
tgacagttaaggtatacattca

SEQ ID NO: 7015780 - DNA, 19 bp, Homo sapiens
cccagggtttcctctctcc

SEQ ID NO: 7015781 - DNA, 22 bp, Homo sapiens
gattctggagttaaggatgcct

SEQ ID NO: 7015782 - DNA, 22 bp, Homo sapiens
gtttcaggtttaggcacctgga

SEQ ID NO: 7015783 - DNA, 22 bp, Homo sapiens
cacattgcaggttgagaaggtg

SEQ ID NO: 7015784 - DNA, 16 bp, Homo sapiens
gtgttaagagctgttc

SEQ ID NO: 7015785 - DNA, 22 bp, Homo sapiens
taattagagtttggtaaacaat

SEQ ID NO: 7015786 - DNA, 22 bp, Homo sapiens
tggtccagacatttctgaggta

SEQ ID NO: 7015787 - DNA, 22 bp, Homo sapiens
ttcattaattcattcagtgact

SEQ ID NO: 7015788 - DNA, 22 bp, Homo sapiens
agcctttaagctgccacagctg

SEQ ID NO: 7015789 - DNA, 22 bp, Homo sapiens
tttccctgaggcctggacatta

SEQ ID NO: 7015790 - DNA, 22 bp, Homo sapiens
atgcactgtaagactagccatg

SEQ ID NO: 7015791 - DNA, 22 bp, Homo sapiens
ttggacgctcctaagaccaagc

SEQ ID NO: 7015792 - DNA, 22 bp, Homo sapiens
ggtgacggggcccaggtttcct

SEQ ID NO: 7015793 - DNA, 22 bp, Homo sapiens
gactggttgctaagcacagctt

SEQ ID NO: 7015794 - DNA, 22 bp, Homo sapiens
aggggcaaatgtgagcctggaa

SEQ ID NO: 7015795 - DNA, 22 bp, Homo sapiens
acactggttaaacacctctaaa

SEQ ID NO: 7015796 - DNA, 22 bp, Homo sapiens
aagattttctcaactgtatttg

SEQ ID NO: 7015797 - DNA, 22 bp, Homo sapiens
gattagtaagagtttacctatt

SEQ ID NO: 7015798 - DNA, 21 bp, Homo sapiens
ttgcacagaaaaccatagaga

SEQ ID NO: 7015799 - DNA, 22 bp, Homo sapiens
cttggtcacaggcttgtgtgct

SEQ ID NO: 7015800 - DNA, 22 bp, Homo sapiens
tcatgattggaatggaatatgt

SEQ ID NO: 7015801 - DNA, 22 bp, Homo sapiens
ctttcacagccttcgttctgaa

SEQ ID NO: 7015802 - DNA, 19 bp, Homo sapiens
aggtccttggctggaagtt

SEQ ID NO: 7015803 - DNA, 22 bp, Homo sapiens
gtttccagccctgcaggtttaa

SEQ ID NO: 7015804 - DNA, 22 bp, Homo sapiens
aagattgttttggatgctaact

SEQ ID NO: 7015805 - DNA, 22 bp, Homo sapiens
gggtgggagaaatgagtatcta

SEQ ID NO: 7015806 - DNA, 22 bp, Homo sapiens
tggatgagtctgagattgggca

SEQ ID NO: 7015807 - DNA, 22 bp, Homo sapiens
agctgccacctctgcctttggg

SEQ ID NO: 7015808 - DNA, 22 bp, Homo sapiens
ctagagaggtggtgttgggtgg

SEQ ID NO: 7015809 - DNA, 22 bp, Homo sapiens
taacaatacccattctaattac

SEQ ID NO: 7015810 - DNA, 22 bp, Homo sapiens
cctgggcttccacgagcagagg

SEQ ID NO: 7015811 - DNA, 22 bp, Homo sapiens
tgttatgaacttctagaaaaca

SEQ ID NO: 7015812 - DNA, 22 bp, Homo sapiens
tgtgtcaacctgtggccgggtg

SEQ ID NO: 7015813 - DNA, 22 bp, Homo sapiens
caggacagtgcaggtccatcct

SEQ ID NO: 7015814 - DNA, 22 bp, Homo sapiens
cttcttcaagagaatgggagac

SEQ ID NO: 7015815 - DNA, 22 bp, Homo sapiens
tttcagttgccaagctaattct

SEQ ID NO: 7015816 - DNA, 22 bp, Homo sapiens
agttaggatttctccggggagg

SEQ ID NO: 7015817 - DNA, 22 bp, Homo sapiens
caagggaattgtgtgtgagagg

SEQ ID NO: 7015818 - DNA, 18 bp, Homo sapiens
ctgataggggtggcagct

SEQ ID NO: 7015819 - DNA, 22 bp, Homo sapiens
agcaagctggaggggctcatga

SEQ ID NO: 7015820 - DNA, 21 bp, Homo sapiens
cacttgaatggtgttttacaa

SEQ ID NO: 7015821 - DNA, 22 bp, Homo sapiens
gagctgcttccagagttgagtg

SEQ ID NO: 7015822 - DNA, 22 bp, Homo sapiens
cgctttgcataacctaacactt

SEQ ID NO: 7015823 - DNA, 22 bp, Homo sapiens
atgctgtgtggccacctccatg

SEQ ID NO: 7015824 - DNA, 22 bp, Homo sapiens
agggaggaaggatgttccaaag

SEQ ID NO: 7015825 - DNA, 22 bp, Homo sapiens
attagtgtcatgttgaggactt

SEQ ID NO: 7015826 - DNA, 22 bp, Homo sapiens
atctgtccctcctcacagcctc

SEQ ID NO: 7015827 - DNA, 22 bp, Homo sapiens
acagatgaggcccatcagtctg

SEQ ID NO: 7015828 - DNA, 22 bp, Homo sapiens
atggtaatgatttatgtaaatt

SEQ ID NO: 7015829 - DNA, 22 bp, Homo sapiens
agaagccattccctgtaggctc

SEQ ID NO: 7015830 - DNA, 22 bp, Homo sapiens
tctcagagggaaacatgagtga

SEQ ID NO: 7015831 - DNA, 22 bp, Homo sapiens
aggctgtgctcagccaatggga

SEQ ID NO: 7015832 - DNA, 22 bp, Homo sapiens
ccatttgttttcgctaccatgg

SEQ ID NO: 7015833 - DNA, 22 bp, Homo sapiens
agaggctgtgcagagggagtgc

SEQ ID NO: 7015834 - DNA, 22 bp, Homo sapiens
cttcagcctcgttactcctgcg

SEQ ID NO: 7015835 - DNA, 16 bp, Homo sapiens
ggctttaatttatccc

SEQ ID NO: 7015836 - DNA, 22 bp, Homo sapiens
agccctgcataaatcagttggt

SEQ ID NO: 7015837 - DNA, 22 bp, Homo sapiens
ttatatgtttctgtttggaggc

SEQ ID NO: 7015838 - DNA, 22 bp, Homo sapiens
tgtgtacaggaactgatcagat

SEQ ID NO: 7015839 - DNA, 22 bp, Homo sapiens
cagtgccagtggatgaactgtt

SEQ ID NO: 7015840 - DNA, 22 bp, Homo sapiens
ggaatagggagagaatcgtttg

SEQ ID NO: 7015841 - DNA, 22 bp, Homo sapiens
aaagtgctgggattataggcat

SEQ ID NO: 7015842 - DNA, 22 bp, Homo sapiens
ctggaagttggaactgatatga

SEQ ID NO: 7015843 - DNA, 22 bp, Homo sapiens
tggaaagaggtagaggatctgg

SEQ ID NO: 7015844 - DNA, 16 bp, Homo sapiens
ctctctgaatgcaatt

SEQ ID NO: 7015845 - DNA, 22 bp, Homo sapiens
gagggcctctgctgctccacat

SEQ ID NO: 7015846 - DNA, 22 bp, Homo sapiens
ttattttgtagctctgatcttt

SEQ ID NO: 7015847 - DNA, 22 bp, Homo sapiens
taactctgcttgttctctgagt

SEQ ID NO: 7015848 - DNA, 22 bp, Homo sapiens
tctaaacttgtaaacaagcata

SEQ ID NO: 7015849 - DNA, 20 bp, Homo sapiens
tcaggtgacacacgtggcac

SEQ ID NO: 7015850 - DNA, 22 bp, Homo sapiens
ttggcttctttagtcagtttgg

SEQ ID NO: 7015851 - DNA, 22 bp, Homo sapiens
agtatatttgttaagattattc

SEQ ID NO: 7015852 - DNA, 22 bp, Homo sapiens
acagcttctctgaaattcatgt

SEQ ID NO: 7015853 - DNA, 22 bp, Homo sapiens
aaggccaggggctggcgcctcc

SEQ ID NO: 7015854 - DNA, 22 bp, Homo sapiens
agcagtgagtaacacagaccag

SEQ ID NO: 7015855 - DNA, 22 bp, Homo sapiens
gggctgaccaatgccttgcttt

SEQ ID NO: 7015856 - DNA, 22 bp, Homo sapiens
cctgcccacagagagggtgcat

SEQ ID NO: 7015857 - DNA, 22 bp, Homo sapiens
tggtacataaatggatgttttc

SEQ ID NO: 7015858 - DNA, 22 bp, Homo sapiens
ggctgagcttatatatgtgctg

SEQ ID NO: 7015859 - DNA, 19 bp, Homo sapiens
cagctgccttttctttgca

SEQ ID NO: 7015860 - DNA, 22 bp, Homo sapiens
ggaaagcatccaggtgccccca

SEQ ID NO: 7015861 - DNA, 22 bp, Homo sapiens
ctccttcacgcaggctgccatg

SEQ ID NO: 7015862 - DNA, 22 bp, Homo sapiens
acattttacagttgtctggcta

SEQ ID NO: 7015863 - DNA, 19 bp, Homo sapiens
agtttttggaaatcctgct

SEQ ID NO: 7015864 - DNA, 22 bp, Homo sapiens
ctactagatcagtatgcctcaa

SEQ ID NO: 7015865 - DNA, 22 bp, Homo sapiens
ggttgtagttggaggttgtata

SEQ ID NO: 7015866 - DNA, 22 bp, Homo sapiens
tgctcaggagcttagagcacag

SEQ ID NO: 7015867 - DNA, 22 bp, Homo sapiens
cttggggcagtgcttggcacat

SEQ ID NO: 7015868 - DNA, 22 bp, Homo sapiens
cccaggaggtgtgcccaactcg

SEQ ID NO: 7015869 - DNA, 22 bp, Homo sapiens
ttccttaatatcccttttggaa

SEQ ID NO: 7015870 - DNA, 22 bp, Homo sapiens
tagcaccggatggcaagcaaca

SEQ ID NO: 7015871 - DNA, 22 bp, Homo sapiens
caaatggctggcatccttctac

SEQ ID NO: 7015872 - DNA, 22 bp, Homo sapiens
gagtaaacacaccttaccagag

SEQ ID NO: 7015873 - DNA, 22 bp, Homo sapiens
cggctcaggccacaggacggca

SEQ ID NO: 7015874 - DNA, 22 bp, Homo sapiens
ctcacactgacttccaggaaca

SEQ ID NO: 7015875 - DNA, 22 bp, Homo sapiens
tttgacatggaataactcattt

SEQ ID NO: 7015876 - DNA, 20 bp, Homo sapiens
gggctctgtaaggttgaaag

SEQ ID NO: 7015877 - DNA, 16 bp, Homo sapiens
tccaagaagtgcccct

SEQ ID NO: 7015878 - DNA, 22 bp, Homo sapiens
ttagttatagtgaagaaatact

SEQ ID NO: 7015879 - DNA, 22 bp, Homo sapiens
agtgatgttgactagctataag

SEQ ID NO: 7015880 - DNA, 22 bp, Homo sapiens
tggcttcatgtagtttgagttg

SEQ ID NO: 7015881 - DNA, 22 bp, Homo sapiens
actgagatgagttgcatagatt

SEQ ID NO: 7015882 - DNA, 22 bp, Homo sapiens
tgcatattttctgattcagaag

SEQ ID NO: 7015883 - DNA, 22 bp, Homo sapiens
aggctggagtgctggagtgctg

SEQ ID NO: 7015884 - DNA, 22 bp, Homo sapiens
aatcagttagggtgttaatgag

SEQ ID NO: 7015885 - DNA, 22 bp, Homo sapiens
tgaggggagctagcatgccttg

SEQ ID NO: 7015886 - DNA, 22 bp, Homo sapiens
aattgtcatgtttggtagataa

SEQ ID NO: 7015887 - DNA, 22 bp, Homo sapiens
ttctcctctgttaccttgcaaa

SEQ ID NO: 7015888 - DNA, 22 bp, Homo sapiens
ttcatagaaagtgcttagattg

SEQ ID NO: 7015889 - DNA, 22 bp, Homo sapiens
agaatttctggaagattgcaag

SEQ ID NO: 7015890 - DNA, 22 bp, Homo sapiens
tggtgccaccctccttcagctg

SEQ ID NO: 7015891 - DNA, 22 bp, Homo sapiens
tgattttgtcatgtttctgata

SEQ ID NO: 7015892 - DNA, 22 bp, Homo sapiens
agctgcagccgcagctgtggcc

SEQ ID NO: 7015893 - DNA, 22 bp, Homo sapiens
tcacccttgacttggaaaaacc

SEQ ID NO: 7015894 - DNA, 22 bp, Homo sapiens
tattcccagcctctttctatct

SEQ ID NO: 7015895 - DNA, 22 bp, Homo sapiens
ctcagtttgaatgctgacactg

SEQ ID NO: 7015896 - DNA, 22 bp, Homo sapiens
ccctgctttgcacccaggctgg

SEQ ID NO: 7015897 - DNA, 22 bp, Homo sapiens
caggtcaaaggttagttatgtt

SEQ ID NO: 7015898 - DNA, 22 bp, Homo sapiens
atgttagtttgtagagtagatg

SEQ ID NO: 7015899 - DNA, 22 bp, Homo sapiens
tcagaggtggagatagttggga

SEQ ID NO: 7015900 - DNA, 22 bp, Homo sapiens
ttacacatgctttgtgtgtatg

SEQ ID NO: 7015901 - DNA, 22 bp, Homo sapiens
tcatgagtttaaggtttaggct

SEQ ID NO: 7015902 - DNA, 22 bp, Homo sapiens
ccaccctgtgcaggcgtgggta

SEQ ID NO: 7015903 - DNA, 22 bp, Homo sapiens
ctgactccttaccatatgcttt

SEQ ID NO: 7015904 - DNA, 22 bp, Homo sapiens
tgtctttagacctctctggcct

SEQ ID NO: 7015905 - DNA, 20 bp, Homo sapiens
gctgaggtttcttcctatat

SEQ ID NO: 7015906 - DNA, 22 bp, Homo sapiens
aacaaagcaccactgagtcagt

SEQ ID NO: 7015907 - DNA, 21 bp, Homo sapiens
agctctatgacttggccaggt

SEQ ID NO: 7015908 - DNA, 22 bp, Homo sapiens
agtagaatcccttgcaatgtcc

SEQ ID NO: 7015909 - DNA, 22 bp, Homo sapiens
caggcttgtgactattccaaag

SEQ ID NO: 7015910 - DNA, 22 bp, Homo sapiens
tatatgatgccaaataacctgt

SEQ ID NO: 7015911 - DNA, 22 bp, Homo sapiens
tcagacaggctggacagcttgc

SEQ ID NO: 7015912 - DNA, 19 bp, Homo sapiens
agcagcttaattttgtagc

SEQ ID NO: 7015913 - DNA, 22 bp, Homo sapiens
tccagctctggcttggctagct

SEQ ID NO: 7015914 - DNA, 22 bp, Homo sapiens
ccaggagcagatatggacataa

SEQ ID NO: 7015915 - DNA, 22 bp, Homo sapiens
gcatgtgtatggtaggaatatt

SEQ ID NO: 7015916 - DNA, 22 bp, Homo sapiens
ctgggcactgcagcaggcatca

SEQ ID NO: 7015917 - DNA, 22 bp, Homo sapiens
tccatctggagacttcctggtc

SEQ ID NO: 7015918 - DNA, 22 bp, Homo sapiens
gtttttacagcagcaaaatact

SEQ ID NO: 7015919 - DNA, 22 bp, Homo sapiens
gtttcatgccatttccagattg

SEQ ID NO: 7015920 - DNA, 20 bp, Homo sapiens
tgtgcccagcagaggctgcc

SEQ ID NO: 7015921 - DNA, 22 bp, Homo sapiens
ccagttgttccctgtcagagat

SEQ ID NO: 7015922 - DNA, 22 bp, Homo sapiens
tggatctgaacgcttgggtgca

SEQ ID NO: 7015923 - DNA, 22 bp, Homo sapiens
tccagggccagtccttgtctgt

SEQ ID NO: 7015924 - DNA, 22 bp, Homo sapiens
ctggctgaagctgggctctcct

SEQ ID NO: 7015925 - DNA, 22 bp, Homo sapiens
ggtctagacgaattcctatcag

SEQ ID NO: 7015926 - DNA, 22 bp, Homo sapiens
cagctcctctggccagccctgc

SEQ ID NO: 7015927 - DNA, 22 bp, Homo sapiens
gttgagtgggttaggatgctga

SEQ ID NO: 7015928 - DNA, 22 bp, Homo sapiens
agacataggattccacatagca

SEQ ID NO: 7015929 - DNA, 19 bp, Homo sapiens
ctcttacagaatagacaca

SEQ ID NO: 7015930 - DNA, 22 bp, Homo sapiens
gaactttataactgtaaatgtc

SEQ ID NO: 7015931 - DNA, 22 bp, Homo sapiens
tgcagtgtgctagatttggact

SEQ ID NO: 7015932 - DNA, 22 bp, Homo sapiens
caggctttttctgctgtcctct

SEQ ID NO: 7015933 - DNA, 22 bp, Homo sapiens
ccagtgtgggctggtggaggac

SEQ ID NO: 7015934 - DNA, 22 bp, Homo sapiens
agaatatgccttagcaagccca

SEQ ID NO: 7015935 - DNA, 22 bp, Homo sapiens
aatgttagattcctccacctag

SEQ ID NO: 7015936 - DNA, 22 bp, Homo sapiens
tgaaatgcctatgaagtcagga

SEQ ID NO: 7015937 - DNA, 22 bp, Homo sapiens
agggtcaggttaagggagtcat

SEQ ID NO: 7015938 - DNA, 22 bp, Homo sapiens
atgtgctttctttccaaggggc

SEQ ID NO: 7015939 - DNA, 22 bp, Homo sapiens
acactgggcttgttacgttgca

SEQ ID NO: 7015940 - DNA, 22 bp, Homo sapiens
gtggcagcaaaatcctgcattc

SEQ ID NO: 7015941 - DNA, 23 bp, Homo sapiens
aatatatgtgtttttctgcttca

SEQ ID NO: 7015942 - DNA, 22 bp, Homo sapiens
tcagttagggcctcagaagaca

SEQ ID NO: 7015943 - DNA, 22 bp, Homo sapiens
ttagcattctcatttgcataaa

SEQ ID NO: 7015944 - DNA, 21 bp, Homo sapiens
agcaggtctacaggttcatag

SEQ ID NO: 7015945 - DNA, 22 bp, Homo sapiens
aatactgtaaatggagcagcca

SEQ ID NO: 7015946 - DNA, 22 bp, Homo sapiens
cttacaagcaaaacaactgtag

SEQ ID NO: 7015947 - DNA, 22 bp, Homo sapiens
tgtgcagcaaaatagaatcttt

SEQ ID NO: 7015948 - DNA, 22 bp, Homo sapiens
aaaaccatgtatctatttcctt

SEQ ID NO: 7015949 - DNA, 21 bp, Homo sapiens
atgtctatgacatatttcctt

SEQ ID NO: 7015950 - DNA, 21 bp, Homo sapiens
atttatgtttggggtggaatg

SEQ ID NO: 7015951 - DNA, 21 bp, Homo sapiens
agagttatgtggcttgcctga

SEQ ID NO: 7015952 - DNA, 22 bp, Homo sapiens
atgctaaggcactaccttctca

SEQ ID NO: 7015953 - DNA, 22 bp, Homo sapiens
atcaagaacttattttggaaat

SEQ ID NO: 7015954 - DNA, 22 bp, Homo sapiens
gcaatagactgtttttattgtt

SEQ ID NO: 7015955 - DNA, 22 bp, Homo sapiens
agggctccaggggctgggtgac

SEQ ID NO: 7015956 - DNA, 22 bp, Homo sapiens
acctgagggcccaaacttggta

SEQ ID NO: 7015957 - DNA, 22 bp, Homo sapiens
aggctaggaacagcccggccct

SEQ ID NO: 7015958 - DNA, 22 bp, Homo sapiens
gctggttaggtgagggtgcgcc

SEQ ID NO: 7015959 - DNA, 22 bp, Homo sapiens
agcagatggagaatggagtcag

SEQ ID NO: 7015960 - DNA, 22 bp, Homo sapiens
ctttgttcatgacatctgcttc

SEQ ID NO: 7015961 - DNA, 22 bp, Homo sapiens
gtgttcctggacagcaagtgag

SEQ ID NO: 7015962 - DNA, 22 bp, Homo sapiens
cttcctgttgtcacagtctgcg

SEQ ID NO: 7015963 - DNA, 22 bp, Homo sapiens
cttttctagagccgcagcccta

SEQ ID NO: 7015964 - DNA, 22 bp, Homo sapiens
cctcagaagaagtggaattgat

SEQ ID NO: 7015965 - DNA, 22 bp, Homo sapiens
ctcatctgctcttattatctta

SEQ ID NO: 7015966 - DNA, 22 bp, Homo sapiens
tcctggtaggctatgtcatgtc

SEQ ID NO: 7015967 - DNA, 15 bp, Homo sapiens
gccccaggaatcaaa

SEQ ID NO: 7015968 - DNA, 22 bp, Homo sapiens
tctgataatggacttctcatct

SEQ ID NO: 7015969 - DNA, 18 bp, Homo sapiens
caattttacccagtccct

SEQ ID NO: 7015970 - DNA, 22 bp, Homo sapiens
ccaagggctgagatacatctag

SEQ ID NO: 7015971 - DNA, 22 bp, Homo sapiens
taacacatggttagtacacaat

SEQ ID NO: 7015972 - DNA, 22 bp, Homo sapiens
ttaacgaattgtgcataattcc

SEQ ID NO: 7015973 - DNA, 22 bp, Homo sapiens
cctgtcccctcacaatgccact

SEQ ID NO: 7015974 - DNA, 22 bp, Homo sapiens
atctgacaaggccacatattct

SEQ ID NO: 7015975 - DNA, 22 bp, Homo sapiens
atgaaatgattgaaatctttac

SEQ ID NO: 7015976 - DNA, 22 bp, Homo sapiens
aatcattcttatttcacagcaa

SEQ ID NO: 7015977 - DNA, 18 bp, Homo sapiens
taatttgcacagttgcaa

SEQ ID NO: 7015978 - DNA, 22 bp, Homo sapiens
gaggggagtaaagtcatgttac

SEQ ID NO: 7015979 - DNA, 22 bp, Homo sapiens
tgacactaaatagctgtgtgcc

SEQ ID NO: 7015980 - DNA, 22 bp, Homo sapiens
gcatgcagggagggtctggctg

SEQ ID NO: 7015981 - DNA, 22 bp, Homo sapiens
tgcatatatcttatttttctgt

SEQ ID NO: 7015982 - DNA, 18 bp, Homo sapiens
ccacccagggggagagga

SEQ ID NO: 7015983 - DNA, 22 bp, Homo sapiens
agctctgtgttcacagcactaa

SEQ ID NO: 7015984 - DNA, 22 bp, Homo sapiens
tccttcagccatgggctctcca

SEQ ID NO: 7015985 - DNA, 22 bp, Homo sapiens
gggaggctctgctcagcccccg

SEQ ID NO: 7015986 - DNA, 22 bp, Homo sapiens
caatcactgggatattggtgtg

SEQ ID NO: 7015987 - DNA, 22 bp, Homo sapiens
gtggggcggcagatgctccctg

SEQ ID NO: 7015988 - DNA, 22 bp, Homo sapiens
tgactttgtccctttcaaatcc

SEQ ID NO: 7015989 - DNA, 22 bp, Homo sapiens
gcactggagggtgtagttgctg

SEQ ID NO: 7015990 - DNA, 22 bp, Homo sapiens
gtttcaaataggtttcagcaaa

SEQ ID NO: 7015991 - DNA, 22 bp, Homo sapiens
cttaggcaaccaggtcaatgct

SEQ ID NO: 7015992 - DNA, 22 bp, Homo sapiens
gtggagccaggatctccgcaca

SEQ ID NO: 7015993 - DNA, 22 bp, Homo sapiens
ctattcagttgtgggcaacaat

SEQ ID NO: 7015994 - DNA, 22 bp, Homo sapiens
taacaggtggtagtttgtgctc

SEQ ID NO: 7015995 - DNA, 22 bp, Homo sapiens
cagcttccatctccactgccct

SEQ ID NO: 7015996 - DNA, 22 bp, Homo sapiens
ttctgctctaatgtacaccagc

SEQ ID NO: 7015997 - DNA, 22 bp, Homo sapiens
tttgaaagcaccatttgagtag

SEQ ID NO: 7015998 - DNA, 22 bp, Homo sapiens
actgatacatctgtggaagtgg

SEQ ID NO: 7015999 - DNA, 22 bp, Homo sapiens
cctgtatttaaaaatattctaa

SEQ ID NO: 7016000 - DNA, 22 bp, Homo sapiens
agctctcccatagggcaagatc

SEQ ID NO: 7016001 - DNA, 22 bp, Homo sapiens
agagtcaccttttcctcaggat

SEQ ID NO: 7016002 - DNA, 22 bp, Homo sapiens
acagggcatgtgcaagagacat

SEQ ID NO: 7016003 - DNA, 18 bp, Homo sapiens
gcctgcctagagcttgcc

SEQ ID NO: 7016004 - DNA, 22 bp, Homo sapiens
tgtctttttactatgttcaatc

SEQ ID NO: 7016005 - DNA, 22 bp, Homo sapiens
tgagccctaatttacaacatct

SEQ ID NO: 7016006 - DNA, 22 bp, Homo sapiens
ttgggaagaaacatgtccatca

SEQ ID NO: 7016007 - DNA, 23 bp, Homo sapiens
gctgcctctgttggtcttcagtt

SEQ ID NO: 7016008 - DNA, 22 bp, Homo sapiens
ttttaattcaaagtgaatagtg

SEQ ID NO: 7016009 - DNA, 22 bp, Homo sapiens
ggggtgtggacggctgtgccag

SEQ ID NO: 7016010 - DNA, 22 bp, Homo sapiens
caggaacaatacctcttgccag

SEQ ID NO: 7016011 - DNA, 22 bp, Homo sapiens
agagcttttacttacattctat

SEQ ID NO: 7016012 - DNA, 22 bp, Homo sapiens
aggcagacttcctgcttggatc

SEQ ID NO: 7016013 - DNA, 22 bp, Homo sapiens
agaccagtgttttagttagaag

SEQ ID NO: 7016014 - DNA, 22 bp, Homo sapiens
gtttactgttttctgataagtg

SEQ ID NO: 7016015 - DNA, 22 bp, Homo sapiens
agtttgaattttaatctcggtg

SEQ ID NO: 7016016 - DNA, 22 bp, Homo sapiens
caaagtatcaactcccacactg

SEQ ID NO: 7016017 - DNA, 22 bp, Homo sapiens
agttggaagacaccctgaaatc

SEQ ID NO: 7016018 - DNA, 21 bp, Homo sapiens
acacaacaggcagtcattttc

SEQ ID NO: 7016019 - DNA, 22 bp, Homo sapiens
aaaggccactgcaagggaaggt

SEQ ID NO: 7016020 - DNA, 22 bp, Homo sapiens
tcatgccatccacatctgtttc

SEQ ID NO: 7016021 - DNA, 22 bp, Homo sapiens
tgttttcttctgtaccgtgcca

SEQ ID NO: 7016022 - DNA, 22 bp, Homo sapiens
tgctggcaaggtaggtttcatt

SEQ ID NO: 7016023 - DNA, 22 bp, Homo sapiens
ataattctccaatttttgttgt

SEQ ID NO: 7016024 - DNA, 22 bp, Homo sapiens
atcagacactagtggactagaa

SEQ ID NO: 7016025 - DNA, 22 bp, Homo sapiens
cagctcccctctgtggggcagt

SEQ ID NO: 7016026 - DNA, 22 bp, Homo sapiens
gctggcaggagaaacggggtgc

SEQ ID NO: 7016027 - DNA, 22 bp, Homo sapiens
acacaagcagcttttgagcgga

SEQ ID NO: 7016028 - DNA, 22 bp, Homo sapiens
ggtgcaggaatctgcaattgaa

SEQ ID NO: 7016029 - DNA, 22 bp, Homo sapiens
gagggcatctagagcctaatcc

SEQ ID NO: 7016030 - DNA, 22 bp, Homo sapiens
tgatgaataaccttgagcatat

SEQ ID NO: 7016031 - DNA, 22 bp, Homo sapiens
aaggtcatggcaaattactttt

SEQ ID NO: 7016032 - DNA, 19 bp, Homo sapiens
ctggtcctgactgaggggt

SEQ ID NO: 7016033 - DNA, 22 bp, Homo sapiens
ccagtcactggaaaatgggaat

SEQ ID NO: 7016034 - DNA, 22 bp, Homo sapiens
gatctgggagcctcatggagac

SEQ ID NO: 7016035 - DNA, 22 bp, Homo sapiens
tgatatgtaactactccttata

SEQ ID NO: 7016036 - DNA, 22 bp, Homo sapiens
gagggctcaactactactaggc

SEQ ID NO: 7016037 - DNA, 22 bp, Homo sapiens
tctagttttagcttgagttgca

SEQ ID NO: 7016038 - DNA, 22 bp, Homo sapiens
tcagagttttattttattccgg

SEQ ID NO: 7016039 - DNA, 17 bp, Homo sapiens
atgtgtctgagtgtcct

SEQ ID NO: 7016040 - DNA, 22 bp, Homo sapiens
attgctgggaggatgtgtgttc

SEQ ID NO: 7016041 - DNA, 22 bp, Homo sapiens
accagtggatactgcttgcttt

SEQ ID NO: 7016042 - DNA, 22 bp, Homo sapiens
gcagggaaacaggtgctaagga

SEQ ID NO: 7016043 - DNA, 22 bp, Homo sapiens
atgctctataaatatgacatgt

SEQ ID NO: 7016044 - DNA, 22 bp, Homo sapiens
tatccgttagaatcatgctggg

SEQ ID NO: 7016045 - DNA, 22 bp, Homo sapiens
tatgctattttaatgaagatgt

SEQ ID NO: 7016046 - DNA, 22 bp, Homo sapiens
tgaattccttgcatttttacct

SEQ ID NO: 7016047 - DNA, 22 bp, Homo sapiens
agtcaggtaccacattacattg

SEQ ID NO: 7016048 - DNA, 22 bp, Homo sapiens
gtcctgtgccctgggtggcgct

SEQ ID NO: 7016049 - DNA, 22 bp, Homo sapiens
tttggggaggttatcggtgtgc

SEQ ID NO: 7016050 - DNA, 22 bp, Homo sapiens
gatgtatacagggttgactcat

SEQ ID NO: 7016051 - DNA, 23 bp, Homo sapiens
taggccttagcgatcactgtcag

SEQ ID NO: 7016052 - DNA, 22 bp, Homo sapiens
tcagcagaggggaaggcatctg

SEQ ID NO: 7016053 - DNA, 22 bp, Homo sapiens
tctgttcctttgtgcagtgatg

SEQ ID NO: 7016054 - DNA, 22 bp, Homo sapiens
gatctgagaaatccttggccag

SEQ ID NO: 7016055 - DNA, 22 bp, Homo sapiens
cccacatcccttccccgctgtg

SEQ ID NO: 7016056 - DNA, 22 bp, Homo sapiens
cacattgggcttgcatgcacgg

SEQ ID NO: 7016057 - DNA, 22 bp, Homo sapiens
agaaatgtacacgacacccaga

SEQ ID NO: 7016058 - DNA, 22 bp, Homo sapiens
tttctccctttataagactgta

SEQ ID NO: 7016059 - DNA, 22 bp, Homo sapiens
cggggtccgggcagtaggctgc

SEQ ID NO: 7016060 - DNA, 22 bp, Homo sapiens
ttgtacctttgcagccccaggt

SEQ ID NO: 7016061 - DNA, 22 bp, Homo sapiens
cagtatgtccttcctcgttggc

SEQ ID NO: 7016062 - DNA, 22 bp, Homo sapiens
ctgaggggataaaggtttgggt

SEQ ID NO: 7016063 - DNA, 22 bp, Homo sapiens
ctggcaggcaaattggtgggag

SEQ ID NO: 7016064 - DNA, 22 bp, Homo sapiens
gacctctgggtgatgcccaggc

SEQ ID NO: 7016065 - DNA, 22 bp, Homo sapiens
agatacacagagcatcttcaga

SEQ ID NO: 7016066 - DNA, 22 bp, Homo sapiens
tttgacatgcaaagcactttag

SEQ ID NO: 7016067 - DNA, 22 bp, Homo sapiens
agttcactgcttaagcctttga

SEQ ID NO: 7016068 - DNA, 22 bp, Homo sapiens
gagctatttttagcggtgcgtg

SEQ ID NO: 7016069 - DNA, 22 bp, Homo sapiens
tttggaacccagcccatcggaa

SEQ ID NO: 7016070 - DNA, 22 bp, Homo sapiens
acttgacacttatattactcac

SEQ ID NO: 7016071 - DNA, 22 bp, Homo sapiens
ggtggctcatttgatcttcata

SEQ ID NO: 7016072 - DNA, 22 bp, Homo sapiens
tcttttggaaatgatgtgcagg

SEQ ID NO: 7016073 - DNA, 22 bp, Homo sapiens
agggcactttacccatagcttg

SEQ ID NO: 7016074 - DNA, 22 bp, Homo sapiens
ttctggaagaggtgtaagtata

SEQ ID NO: 7016075 - DNA, 22 bp, Homo sapiens
agacattttgatacccctaccg

SEQ ID NO: 7016076 - DNA, 22 bp, Homo sapiens
tcttgggccaatattctgggta

SEQ ID NO: 7016077 - DNA, 22 bp, Homo sapiens
acaaatgaacctgaaatctcag

SEQ ID NO: 7016078 - DNA, 22 bp, Homo sapiens
cacagccttactgagatccact

SEQ ID NO: 7016079 - DNA, 22 bp, Homo sapiens
aatgatatagcagacatagcct

SEQ ID NO: 7016080 - DNA, 22 bp, Homo sapiens
tggaatgtaatcagaatatgaa

SEQ ID NO: 7016081 - DNA, 16 bp, Homo sapiens
ggctcctggttccttc

SEQ ID NO: 7016082 - DNA, 22 bp, Homo sapiens
agagttaaataagcattaactt

SEQ ID NO: 7016083 - DNA, 19 bp, Homo sapiens
gaaggagagctgagttagg

SEQ ID NO: 7016084 - DNA, 22 bp, Homo sapiens
atgttggagtcgtaaggcatgg

SEQ ID NO: 7016085 - DNA, 22 bp, Homo sapiens
gtgggagaagatttggtcatct

SEQ ID NO: 7016086 - DNA, 22 bp, Homo sapiens
gaaatcatctgagtaataatct

SEQ ID NO: 7016087 - DNA, 22 bp, Homo sapiens
gctgtgctggaaggggacctgc

SEQ ID NO: 7016088 - DNA, 22 bp, Homo sapiens
ctgagcagtctgactcaagcta

SEQ ID NO: 7016089 - DNA, 22 bp, Homo sapiens
acatttaccctggaacattgga

SEQ ID NO: 7016090 - DNA, 22 bp, Homo sapiens
ttggaagttaaataaggttcaa

SEQ ID NO: 7016091 - DNA, 22 bp, Homo sapiens
ttcccttcctcactctacttgt

SEQ ID NO: 7016092 - DNA, 22 bp, Homo sapiens
ctttcatgcagttgacaaggtg

SEQ ID NO: 7016093 - DNA, 18 bp, Homo sapiens
acaagcaggggcaaacac

SEQ ID NO: 7016094 - DNA, 22 bp, Homo sapiens
tggaatggaaacaaactgagga

SEQ ID NO: 7016095 - DNA, 22 bp, Homo sapiens
acacatgtgtctgcatgcagtg

SEQ ID NO: 7016096 - DNA, 20 bp, Homo sapiens
tccagcagtatgctatactt

SEQ ID NO: 7016097 - DNA, 22 bp, Homo sapiens
gagctttgtcccttgggggctc

SEQ ID NO: 7016098 - DNA, 22 bp, Homo sapiens
tgagtccaataggggcctggaa

SEQ ID NO: 7016099 - DNA, 22 bp, Homo sapiens
catgtttactaccaggagaatg

SEQ ID NO: 7016100 - DNA, 22 bp, Homo sapiens
gaggtgtccctgaccctttgca

SEQ ID NO: 7016101 - DNA, 22 bp, Homo sapiens
ggagctgagtgggtttattgat

SEQ ID NO: 7016102 - DNA, 22 bp, Homo sapiens
aatgtcatttttaaatgtgaga

SEQ ID NO: 7016103 - DNA, 22 bp, Homo sapiens
ccttctcctgccttgggttcat

SEQ ID NO: 7016104 - DNA, 22 bp, Homo sapiens
agcagttcataaacattttgag

SEQ ID NO: 7016105 - DNA, 22 bp, Homo sapiens
ttccagagagttattcccctgg

SEQ ID NO: 7016106 - DNA, 22 bp, Homo sapiens
acttgcagcagcagctattggc

SEQ ID NO: 7016107 - DNA, 22 bp, Homo sapiens
aaagctcttgggagggttaatt

SEQ ID NO: 7016108 - DNA, 22 bp, Homo sapiens
tcacagtattgggggtggagga

SEQ ID NO: 7016109 - DNA, 22 bp, Homo sapiens
atcttctggtcaaatttttgca

SEQ ID NO: 7016110 - DNA, 22 bp, Homo sapiens
gggatgacaattcaagggctgg

SEQ ID NO: 7016111 - DNA, 22 bp, Homo sapiens
acactgaatgtttaagaacttg

SEQ ID NO: 7016112 - DNA, 22 bp, Homo sapiens
gcccacatttttggcttagagg

SEQ ID NO: 7016113 - DNA, 22 bp, Homo sapiens
gtgattatttgtgattaaggag

SEQ ID NO: 7016114 - DNA, 22 bp, Homo sapiens
aggccttggcatgctgccctgc

SEQ ID NO: 7016115 - DNA, 22 bp, Homo sapiens
tcactgtagagtctgtttccac

SEQ ID NO: 7016116 - DNA, 22 bp, Homo sapiens
ttggaaggatttagagatgtct

SEQ ID NO: 7016117 - DNA, 22 bp, Homo sapiens
gcacagccctggtcggggcccc

SEQ ID NO: 7016118 - DNA, 22 bp, Homo sapiens
gctcagggaactttttgcaggc

SEQ ID NO: 7016119 - DNA, 22 bp, Homo sapiens
ggtcagaaggcagttaaacaaa

SEQ ID NO: 7016120 - DNA, 22 bp, Homo sapiens
tcaggtgtgtggctctggacca

SEQ ID NO: 7016121 - DNA, 18 bp, Homo sapiens
aggtacacatacttctca

SEQ ID NO: 7016122 - DNA, 22 bp, Homo sapiens
ttgccaagtttaatgaatgact

SEQ ID NO: 7016123 - DNA, 22 bp, Homo sapiens
ctgtccattttgaattttcagt

SEQ ID NO: 7016124 - DNA, 19 bp, Homo sapiens
agggtggcaaaggagggtg

SEQ ID NO: 7016125 - DNA, 22 bp, Homo sapiens
ggtggcaggctggcattggcaa

SEQ ID NO: 7016126 - DNA, 22 bp, Homo sapiens
caggaaaccgcatcccagtggg

SEQ ID NO: 7016127 - DNA, 22 bp, Homo sapiens
tagcaacaagtgactatctata

SEQ ID NO: 7016128 - DNA, 22 bp, Homo sapiens
tctgtactgagcatggtgctta

SEQ ID NO: 7016129 - DNA, 22 bp, Homo sapiens
gcatctgtgtttctagctagga

SEQ ID NO: 7016130 - DNA, 22 bp, Homo sapiens
tgggctccggcggcctcaggct

SEQ ID NO: 7016131 - DNA, 22 bp, Homo sapiens
tcagacctctgaccttgccaaa

SEQ ID NO: 7016132 - DNA, 22 bp, Homo sapiens
ccctgaggggcttactttgccc

SEQ ID NO: 7016133 - DNA, 22 bp, Homo sapiens
tttgtacacctacctaatacag

SEQ ID NO: 7016134 - DNA, 22 bp, Homo sapiens
ggggaaaggccatggcaagaac

SEQ ID NO: 7016135 - DNA, 22 bp, Homo sapiens
gcaagaactgcaattacttttg

SEQ ID NO: 7016136 - DNA, 22 bp, Homo sapiens
atgtatgtgcacgcatgtacat

SEQ ID NO: 7016137 - DNA, 22 bp, Homo sapiens
aagtatgctaattaactagcac

SEQ ID NO: 7016138 - DNA, 22 bp, Homo sapiens
accacagtgggccacaagaagt

SEQ ID NO: 7016139 - DNA, 19 bp, Homo sapiens
gtcaggaagtactttccgg

SEQ ID NO: 7016140 - DNA, 22 bp, Homo sapiens
atggctggcgtcattgtgtggg

SEQ ID NO: 7016141 - DNA, 22 bp, Homo sapiens
ttctgtgattgacatgtggctt

SEQ ID NO: 7016142 - DNA, 22 bp, Homo sapiens
ttagagaaaagcttgcttgctt

SEQ ID NO: 7016143 - DNA, 22 bp, Homo sapiens
caggtcagaggtagatgagatg

SEQ ID NO: 7016144 - DNA, 22 bp, Homo sapiens
tgaaatcattgccaagtattga

SEQ ID NO: 7016145 - DNA, 22 bp, Homo sapiens
gggacacgggctgagcagagcc

SEQ ID NO: 7016146 - DNA, 22 bp, Homo sapiens
tcctctccagcaaactggctat

SEQ ID NO: 7016147 - DNA, 22 bp, Homo sapiens
tggcccttgttcaaatatgtca

SEQ ID NO: 7016148 - DNA, 22 bp, Homo sapiens
cttctgagttaacagtagattt

SEQ ID NO: 7016149 - DNA, 22 bp, Homo sapiens
aactgaattttaaatacaggcc

SEQ ID NO: 7016150 - DNA, 22 bp, Homo sapiens
cagtggcatacttggctgatat

SEQ ID NO: 7016151 - DNA, 22 bp, Homo sapiens
aacattgcagatggcacagaag

SEQ ID NO: 7016152 - DNA, 22 bp, Homo sapiens
aactatcacaaacagagtgtct

SEQ ID NO: 7016153 - DNA, 22 bp, Homo sapiens
tttggtcctctctctgtgtgtg

SEQ ID NO: 7016154 - DNA, 22 bp, Homo sapiens
ccttttatactctgtcctctgg

SEQ ID NO: 7016155 - DNA, 22 bp, Homo sapiens
gcctgtgtgtgaggactggctg

SEQ ID NO: 7016156 - DNA, 22 bp, Homo sapiens
gctgtgctcaacgtgccttcct

SEQ ID NO: 7016157 - DNA, 22 bp, Homo sapiens
ttaagctaattagttccagcat

SEQ ID NO: 7016158 - DNA, 22 bp, Homo sapiens
gagtcactgaggagggtactca

SEQ ID NO: 7016159 - DNA, 22 bp, Homo sapiens
gagggaagtcataatgttctag

SEQ ID NO: 7016160 - DNA, 22 bp, Homo sapiens
ttagcttcctacaactgctgca

SEQ ID NO: 7016161 - DNA, 22 bp, Homo sapiens
aaatggcgatatattcaggcaa

SEQ ID NO: 7016162 - DNA, 22 bp, Homo sapiens
tcactgcagcctctgcctcccg

SEQ ID NO: 7016163 - DNA, 22 bp, Homo sapiens
actgtcagggatcatgaaagct

SEQ ID NO: 7016164 - DNA, 22 bp, Homo sapiens
tcacagacttgtctccagggat

SEQ ID NO: 7016165 - DNA, 22 bp, Homo sapiens
atcttctatagatattctgaag

SEQ ID NO: 7016166 - DNA, 22 bp, Homo sapiens
tatagccaataatagtgtgtga

SEQ ID NO: 7016167 - DNA, 22 bp, Homo sapiens
gtttccaaccccaccaaagtgc

SEQ ID NO: 7016168 - DNA, 22 bp, Homo sapiens
tttgtgttggaagaaatgctac

SEQ ID NO: 7016169 - DNA, 22 bp, Homo sapiens
gatcaacaaatgtcctttgtga

SEQ ID NO: 7016170 - DNA, 22 bp, Homo sapiens
tattggtatctgagacagagtt

SEQ ID NO: 7016171 - DNA, 22 bp, Homo sapiens
ctgtgtctgaataactctgtgt

SEQ ID NO: 7016172 - DNA, 22 bp, Homo sapiens
gaggcctggctctgccctcctg

SEQ ID NO: 7016173 - DNA, 22 bp, Homo sapiens
tttgtgcagataggagacaatc

SEQ ID NO: 7016174 - DNA, 22 bp, Homo sapiens
agtctgcattcacagcaattat

SEQ ID NO: 7016175 - DNA, 22 bp, Homo sapiens
tggagctggggtttgaatctgg

SEQ ID NO: 7016176 - DNA, 22 bp, Homo sapiens
ttatccaagcagaagctgcaca

SEQ ID NO: 7016177 - DNA, 22 bp, Homo sapiens
tctctcctgcactgaattatgt

SEQ ID NO: 7016178 - DNA, 22 bp, Homo sapiens
gacataaaccttgagatattaa

SEQ ID NO: 7016179 - DNA, 22 bp, Homo sapiens
tggtttgagagtgtgagctttt

SEQ ID NO: 7016180 - DNA, 22 bp, Homo sapiens
agaggcctttgggcaacatccc

SEQ ID NO: 7016181 - DNA, 22 bp, Homo sapiens
caggcatatctacattatccaa

SEQ ID NO: 7016182 - DNA, 22 bp, Homo sapiens
tctgaagcactgcaatgcttta

SEQ ID NO: 7016183 - DNA, 22 bp, Homo sapiens
tttctgctaatcttttactgag

SEQ ID NO: 7016184 - DNA, 22 bp, Homo sapiens
ggatacagcggcttctgcgcga

SEQ ID NO: 7016185 - DNA, 22 bp, Homo sapiens
ttaaagaggtagttaggtttaa

SEQ ID NO: 7016186 - DNA, 22 bp, Homo sapiens
aagtacctcatagggttatttt

SEQ ID NO: 7016187 - DNA, 22 bp, Homo sapiens
ctgtccacctactgactagttg

SEQ ID NO: 7016188 - DNA, 22 bp, Homo sapiens
gagcactgatttatttttgtct

SEQ ID NO: 7016189 - DNA, 22 bp, Homo sapiens
taggcctatgcagaaggtggtt

SEQ ID NO: 7016190 - DNA, 22 bp, Homo sapiens
tccacaaggcagctcctccagg

SEQ ID NO: 7016191 - DNA, 22 bp, Homo sapiens
acaatcagtatttagacccagg

SEQ ID NO: 7016192 - DNA, 22 bp, Homo sapiens
cagttaaaaggtatgctaccaa

SEQ ID NO: 7016193 - DNA, 22 bp, Homo sapiens
agcaccattgcaaatatggcag

SEQ ID NO: 7016194 - DNA, 22 bp, Homo sapiens
ttctgcttattcaaatgatctt

SEQ ID NO: 7016195 - DNA, 22 bp, Homo sapiens
aaccctggggctgctctgcctg

SEQ ID NO: 7016196 - DNA, 22 bp, Homo sapiens
tacaagtttatccatcattgtt

SEQ ID NO: 7016197 - DNA, 18 bp, Homo sapiens
tgggcacaatgaacagca

SEQ ID NO: 7016198 - DNA, 22 bp, Homo sapiens
aaccaagcccattactttactt

SEQ ID NO: 7016199 - DNA, 22 bp, Homo sapiens
atgtggctcagcaggctcccgt

SEQ ID NO: 7016200 - DNA, 17 bp, Homo sapiens
tcccccagggctctctc

SEQ ID NO: 7016201 - DNA, 22 bp, Homo sapiens
ctggccaacttgcttgttggca

SEQ ID NO: 7016202 - DNA, 22 bp, Homo sapiens
tggttgtgtcacttagattaga

SEQ ID NO: 7016203 - DNA, 22 bp, Homo sapiens
ttaagattttcttcagtattat

SEQ ID NO: 7016204 - DNA, 22 bp, Homo sapiens
agtaacactattttcatatgta

SEQ ID NO: 7016205 - DNA, 22 bp, Homo sapiens
aaggatatttggctacagaagc

SEQ ID NO: 7016206 - DNA, 22 bp, Homo sapiens
cagtgtctcaaaacaagttgct

SEQ ID NO: 7016207 - DNA, 22 bp, Homo sapiens
ctctggattgctgtgagatgct

SEQ ID NO: 7016208 - DNA, 22 bp, Homo sapiens
aatgctgtggagccgtggacag

SEQ ID NO: 7016209 - DNA, 22 bp, Homo sapiens
agataatgttctgatccatttc

SEQ ID NO: 7016210 - DNA, 22 bp, Homo sapiens
cttgaaatccagatttcagagg

SEQ ID NO: 7016211 - DNA, 22 bp, Homo sapiens
gctgccttcccggaatgtcatc

SEQ ID NO: 7016212 - DNA, 22 bp, Homo sapiens
tggccagcacttagcccttacc

SEQ ID NO: 7016213 - DNA, 22 bp, Homo sapiens
agcaggtggtgggccagatttg

SEQ ID NO: 7016214 - DNA, 22 bp, Homo sapiens
tgtcctcaggacctggcacagt

SEQ ID NO: 7016215 - DNA, 22 bp, Homo sapiens
aaggcagccctggctcagcctg

SEQ ID NO: 7016216 - DNA, 22 bp, Homo sapiens
gccacagctccagtcaggtgac

SEQ ID NO: 7016217 - DNA, 22 bp, Homo sapiens
gaatctcaggaagatctctgca

SEQ ID NO: 7016218 - DNA, 22 bp, Homo sapiens
cctggtgttatcataggtcatg

SEQ ID NO: 7016219 - DNA, 22 bp, Homo sapiens
cggggcaggagtccctgtagag

SEQ ID NO: 7016220 - DNA, 22 bp, Homo sapiens
tggcaggtagtcagaggcgaca

SEQ ID NO: 7016221 - DNA, 23 bp, Homo sapiens
ctgggcatggagcttcagaggct

SEQ ID NO: 7016222 - DNA, 22 bp, Homo sapiens
gcctggagacagcagaggcggc

SEQ ID NO: 7016223 - DNA, 22 bp, Homo sapiens
aggctgggaaggtaaagttgta

SEQ ID NO: 7016224 - DNA, 22 bp, Homo sapiens
atgacccctaaaatttactgtc

SEQ ID NO: 7016225 - DNA, 22 bp, Homo sapiens
ttgcagacttacttcgagaaat

SEQ ID NO: 7016226 - DNA, 22 bp, Homo sapiens
gtgccagctgtccatgttcctc

SEQ ID NO: 7016227 - DNA, 22 bp, Homo sapiens
gaggtccagccaagcggcaagg

SEQ ID NO: 7016228 - DNA, 22 bp, Homo sapiens
atgggcagctgcagcagtggtg

SEQ ID NO: 7016229 - DNA, 22 bp, Homo sapiens
ctggaaagtagatgtactaagg

SEQ ID NO: 7016230 - DNA, 22 bp, Homo sapiens
gctctctggttccagtcaggaa

SEQ ID NO: 7016231 - DNA, 22 bp, Homo sapiens
gccttgggccagctgctctgga

SEQ ID NO: 7016232 - DNA, 22 bp, Homo sapiens
ccagggaagattagaagccact

SEQ ID NO: 7016233 - DNA, 22 bp, Homo sapiens
tggacctgaagaataggaagta

SEQ ID NO: 7016234 - DNA, 22 bp, Homo sapiens
aagtgctagaaccccagcaaca

SEQ ID NO: 7016235 - DNA, 22 bp, Homo sapiens
ctctgttaagtatcctttgctg

SEQ ID NO: 7016236 - DNA, 23 bp, Homo sapiens
ggcagctgggcagcactcatggg

SEQ ID NO: 7016237 - DNA, 22 bp, Homo sapiens
caaagttctcggctcaagtcct

SEQ ID NO: 7016238 - DNA, 22 bp, Homo sapiens
gggctgagtcatctggggcctc

SEQ ID NO: 7016239 - DNA, 22 bp, Homo sapiens
acagtctgcatatgacctgtag

SEQ ID NO: 7016240 - DNA, 22 bp, Homo sapiens
tccttaggtatttagcatgaat

SEQ ID NO: 7016241 - DNA, 22 bp, Homo sapiens
tagatacaggcaagattatgaa

SEQ ID NO: 7016242 - DNA, 22 bp, Homo sapiens
ttctaaagcctgtcctatcaga

SEQ ID NO: 7016243 - DNA, 22 bp, Homo sapiens
cagtggcagagccgttgccatc

SEQ ID NO: 7016244 - DNA, 21 bp, Homo sapiens
tggcctgaagctccctctccc

SEQ ID NO: 7016245 - DNA, 22 bp, Homo sapiens
agtgggccaaatggaggcaagt

SEQ ID NO: 7016246 - DNA, 22 bp, Homo sapiens
atatgattccactattgtatgg

SEQ ID NO: 7016247 - DNA, 17 bp, Homo sapiens
cctcagcttctttcctc

SEQ ID NO: 7016248 - DNA, 22 bp, Homo sapiens
agctcctgcacccagccttgag

SEQ ID NO: 7016249 - DNA, 22 bp, Homo sapiens
tctcagaagggtggtgctggag

SEQ ID NO: 7016250 - DNA, 22 bp, Homo sapiens
ttctaaggggttcacaggcata

SEQ ID NO: 7016251 - DNA, 22 bp, Homo sapiens
acagtgctggctacaaccctgg

SEQ ID NO: 7016252 - DNA, 22 bp, Homo sapiens
gctgggcagcccctacagagag

SEQ ID NO: 7016253 - DNA, 22 bp, Homo sapiens
atcagcaaggcaatcactgcag

SEQ ID NO: 7016254 - DNA, 20 bp, Homo sapiens
ctgggaggtcttccaaatca

SEQ ID NO: 7016255 - DNA, 22 bp, Homo sapiens
agaagcgtgagtggatttaggt

SEQ ID NO: 7016256 - DNA, 22 bp, Homo sapiens
gcattctatagtctacattaca

SEQ ID NO: 7016257 - DNA, 22 bp, Homo sapiens
cccagacccagagggaggcagg

SEQ ID NO: 7016258 - DNA, 22 bp, Homo sapiens
gaatcagataataagcaagcat

SEQ ID NO: 7016259 - DNA, 22 bp, Homo sapiens
cttggggattttaaagacctct

SEQ ID NO: 7016260 - DNA, 22 bp, Homo sapiens
gcagcccaaaaaagaggtagat

SEQ ID NO: 7016261 - DNA, 22 bp, Homo sapiens
ggagcccaggttgtttgtgcag

SEQ ID NO: 7016262 - DNA, 21 bp, Homo sapiens
cagctctgagatttctactag

SEQ ID NO: 7016263 - DNA, 19 bp, Homo sapiens
ttgaatatgcaaactgaag

SEQ ID NO: 7016264 - DNA, 22 bp, Homo sapiens
ccagaccctccattcaagctcc

SEQ ID NO: 7016265 - DNA, 22 bp, Homo sapiens
gtatttctagaaccaaaagcca

SEQ ID NO: 7016266 - DNA, 22 bp, Homo sapiens
agggatgatcagggtagaggct

SEQ ID NO: 7016267 - DNA, 22 bp, Homo sapiens
tcaggtgtggaccgaggtcaga

SEQ ID NO: 7016268 - DNA, 22 bp, Homo sapiens
gctgacctttgccaggaaggca

SEQ ID NO: 7016269 - DNA, 22 bp, Homo sapiens
tggtgacacgaagtttgctatc

SEQ ID NO: 7016270 - DNA, 22 bp, Homo sapiens
agagtttgtgggcttttcctcc

SEQ ID NO: 7016271 - DNA, 22 bp, Homo sapiens
ccttcaaagtacacatctttat

SEQ ID NO: 7016272 - DNA, 22 bp, Homo sapiens
atgaactgcatgttttctactg

SEQ ID NO: 7016273 - DNA, 17 bp, Homo sapiens
tgtctgtcatcagttcc

SEQ ID NO: 7016274 - DNA, 22 bp, Homo sapiens
ttggaaagcccattatttggac

SEQ ID NO: 7016275 - DNA, 22 bp, Homo sapiens
aacattctttggaggattattc

SEQ ID NO: 7016276 - DNA, 22 bp, Homo sapiens
ttacaggtcagtttgactgaat

SEQ ID NO: 7016277 - DNA, 22 bp, Homo sapiens
atgtcttctgtggagacaggta

SEQ ID NO: 7016278 - DNA, 20 bp, Homo sapiens
ggcagaatgtgagcagctgc

SEQ ID NO: 7016279 - DNA, 22 bp, Homo sapiens
acatacatggttctcagccctt

SEQ ID NO: 7016280 - DNA, 22 bp, Homo sapiens
ctccagagatacacggtcttgc

SEQ ID NO: 7016281 - DNA, 22 bp, Homo sapiens
atgagcttggtccagcaggctt

SEQ ID NO: 7016282 - DNA, 22 bp, Homo sapiens
gttattctattaatgtgattgt

SEQ ID NO: 7016283 - DNA, 22 bp, Homo sapiens
aaaggcaatttcttcttcctga

SEQ ID NO: 7016284 - DNA, 19 bp, Homo sapiens
tgacagagagcagggtggt

SEQ ID NO: 7016285 - DNA, 22 bp, Homo sapiens
gactgtcattctagtgcccatg

SEQ ID NO: 7016286 - DNA, 22 bp, Homo sapiens
cagggaaattaagtgacgatga

SEQ ID NO: 7016287 - DNA, 22 bp, Homo sapiens
aggctcagctggtggtgatcgc

SEQ ID NO: 7016288 - DNA, 20 bp, Homo sapiens
ttacagaaatgatgttattt

SEQ ID NO: 7016289 - DNA, 22 bp, Homo sapiens
gaacagtatcagtagtgccagt

SEQ ID NO: 7016290 - DNA, 22 bp, Homo sapiens
cctgacagtggtagccttggca

SEQ ID NO: 7016291 - DNA, 22 bp, Homo sapiens
gcccaatagtggggatatacct

SEQ ID NO: 7016292 - DNA, 22 bp, Homo sapiens
gaactgtagagaatacatttct

SEQ ID NO: 7016293 - DNA, 22 bp, Homo sapiens
gttaaatgcactattgaaagct

SEQ ID NO: 7016294 - DNA, 22 bp, Homo sapiens
ctttggcaagggttttaattgt

SEQ ID NO: 7016295 - DNA, 22 bp, Homo sapiens
tccgattagctctttataaaac

SEQ ID NO: 7016296 - DNA, 22 bp, Homo sapiens
ttggcttctgttttggctctgt

SEQ ID NO: 7016297 - DNA, 22 bp, Homo sapiens
aagttcttgtatttgcctttct

SEQ ID NO: 7016298 - DNA, 21 bp, Homo sapiens
gcaggatgcatcttggtgtct

SEQ ID NO: 7016299 - DNA, 22 bp, Homo sapiens
atttgcaatgatttcagtgctt

SEQ ID NO: 7016300 - DNA, 22 bp, Homo sapiens
gtttctggcgccggggcaggcc

SEQ ID NO: 7016301 - DNA, 22 bp, Homo sapiens
actgtcctgcaaaaatactctt

SEQ ID NO: 7016302 - DNA, 22 bp, Homo sapiens
atgtgcttccctggatgggtgt

SEQ ID NO: 7016303 - DNA, 22 bp, Homo sapiens
tctactgtggaggcaaatcctt

SEQ ID NO: 7016304 - DNA, 22 bp, Homo sapiens
tccctgcaggtgtgcaagctga

SEQ ID NO: 7016305 - DNA, 22 bp, Homo sapiens
gctgctccagctgtgctgcaga

SEQ ID NO: 7016306 - DNA, 22 bp, Homo sapiens
tgactgaagaagccacattgga

SEQ ID NO: 7016307 - DNA, 22 bp, Homo sapiens
tgctgcctaataagtcgagggt

SEQ ID NO: 7016308 - DNA, 22 bp, Homo sapiens
tggcttctgcatatttttagag

SEQ ID NO: 7016309 - DNA, 23 bp, Homo sapiens
aggagcactttcagtttgtaaag

SEQ ID NO: 7016310 - DNA, 17 bp, Homo sapiens
tttctggaatgggcaaa

SEQ ID NO: 7016311 - DNA, 22 bp, Homo sapiens
gtggtccagcgtccacacattc

SEQ ID NO: 7016312 - DNA, 22 bp, Homo sapiens
caaattgctaactgtcagacta

SEQ ID NO: 7016313 - DNA, 22 bp, Homo sapiens
cagccctgctgacactgtctga

SEQ ID NO: 7016314 - DNA, 22 bp, Homo sapiens
ccactgactccaggagctgagg

SEQ ID NO: 7016315 - DNA, 22 bp, Homo sapiens
gaactgagatttttgtctggct

SEQ ID NO: 7016316 - DNA, 22 bp, Homo sapiens
atgtgaccatcagtgtgaagga

SEQ ID NO: 7016317 - DNA, 22 bp, Homo sapiens
tggaaactcagggccagaagga

SEQ ID NO: 7016318 - DNA, 22 bp, Homo sapiens
agtcttcacatcagtctaaaga

SEQ ID NO: 7016319 - DNA, 22 bp, Homo sapiens
gcttcattaactcagagttttg

SEQ ID NO: 7016320 - DNA, 22 bp, Homo sapiens
cacttgaatggcattgttcctt

SEQ ID NO: 7016321 - DNA, 20 bp, Homo sapiens
tcctcagaagacatttgggg

SEQ ID NO: 7016322 - DNA, 19 bp, Homo sapiens
gagcagcttcctatctggt

SEQ ID NO: 7016323 - DNA, 16 bp, Homo sapiens
tggtaaggttaccaga

SEQ ID NO: 7016324 - DNA, 22 bp, Homo sapiens
aatcatctccgaaaaaagagta

SEQ ID NO: 7016325 - DNA, 22 bp, Homo sapiens
actgtgggacatccctccctat

SEQ ID NO: 7016326 - DNA, 22 bp, Homo sapiens
cgtctcctgtgttcgagccatt

SEQ ID NO: 7016327 - DNA, 22 bp, Homo sapiens
gtggcttcacatggcatttggc

SEQ ID NO: 7016328 - DNA, 22 bp, Homo sapiens
ggtcttctctatgagctggtct

SEQ ID NO: 7016329 - DNA, 22 bp, Homo sapiens
gatgagctgctcaatctgtggt

SEQ ID NO: 7016330 - DNA, 22 bp, Homo sapiens
tttttccaccgtacttcctgag

SEQ ID NO: 7016331 - DNA, 22 bp, Homo sapiens
atgtgtacaaccaagcactaaa

SEQ ID NO: 7016332 - DNA, 22 bp, Homo sapiens
agtgattgcttgcttaaggaca

SEQ ID NO: 7016333 - DNA, 23 bp, Homo sapiens
cctgggcattggctgcagcttct

SEQ ID NO: 7016334 - DNA, 22 bp, Homo sapiens
aggcctcattgcccacctgtgg

SEQ ID NO: 7016335 - DNA, 22 bp, Homo sapiens
atcaccaggcaaaatgtcagag

SEQ ID NO: 7016336 - DNA, 22 bp, Homo sapiens
gctctttgcacagctctgccct

SEQ ID NO: 7016337 - DNA, 18 bp, Homo sapiens
ggggtagagtgtcctatt

SEQ ID NO: 7016338 - DNA, 22 bp, Homo sapiens
ttaacagagaacatagaagtag

SEQ ID NO: 7016339 - DNA, 22 bp, Homo sapiens
accattctgagatgctgctggt

SEQ ID NO: 7016340 - DNA, 22 bp, Homo sapiens
tttcagtgttatgactttcatt

SEQ ID NO: 7016341 - DNA, 22 bp, Homo sapiens
gctcaggtagatggggttgtcc

SEQ ID NO: 7016342 - DNA, 21 bp, Homo sapiens
ggcttgtcaccatagctactg

SEQ ID NO: 7016343 - DNA, 20 bp, Homo sapiens
gtgggcagatgtgtgcatgg

SEQ ID NO: 7016344 - DNA, 22 bp, Homo sapiens
ctcctcgaagcaacctgcaggc

SEQ ID NO: 7016345 - DNA, 22 bp, Homo sapiens
gtgcattcaggggttgacagga

SEQ ID NO: 7016346 - DNA, 22 bp, Homo sapiens
gtgacatttacgaatcttatcc

SEQ ID NO: 7016347 - DNA, 22 bp, Homo sapiens
agatatgatctatgattttgac

SEQ ID NO: 7016348 - DNA, 22 bp, Homo sapiens
tctctgctcaggcaccagccct

SEQ ID NO: 7016349 - DNA, 22 bp, Homo sapiens
gaatcaaatcaagttcttttga

SEQ ID NO: 7016350 - DNA, 22 bp, Homo sapiens
ccaccgccttggcgtgttcccc

SEQ ID NO: 7016351 - DNA, 22 bp, Homo sapiens
attgaacattgttctaggaggc

SEQ ID NO: 7016352 - DNA, 22 bp, Homo sapiens
atgtactgactgtacttttaaa

SEQ ID NO: 7016353 - DNA, 22 bp, Homo sapiens
ccagggtgctctgtggcgtcgc

SEQ ID NO: 7016354 - DNA, 22 bp, Homo sapiens
ttacatgactcaatagaagggc

SEQ ID NO: 7016355 - DNA, 22 bp, Homo sapiens
atccacagagaggaagaatagt

SEQ ID NO: 7016356 - DNA, 22 bp, Homo sapiens
gcagccagcaggaagcgggaga

SEQ ID NO: 7016357 - DNA, 22 bp, Homo sapiens
tcagaagctggtgtcctttgaa

SEQ ID NO: 7016358 - DNA, 22 bp, Homo sapiens
tgggcccaagtgcaatgcagtg

SEQ ID NO: 7016359 - DNA, 22 bp, Homo sapiens
atgtagctggggaggttgagtc

SEQ ID NO: 7016360 - DNA, 22 bp, Homo sapiens
ttttggctccagtggtttgtgc

SEQ ID NO: 7016361 - DNA, 22 bp, Homo sapiens
atgtcatttaaatgtttgtata

SEQ ID NO: 7016362 - DNA, 22 bp, Homo sapiens
tggccagccagaaagaagcctt

SEQ ID NO: 7016363 - DNA, 22 bp, Homo sapiens
tttgtctgccttgctggactgt

SEQ ID NO: 7016364 - DNA, 22 bp, Homo sapiens
tcaattactaaccaaataatgt

SEQ ID NO: 7016365 - DNA, 22 bp, Homo sapiens
caggctcctcactcatgctccc

SEQ ID NO: 7016366 - DNA, 22 bp, Homo sapiens
gcacagaacttctcttagtagg

SEQ ID NO: 7016367 - DNA, 22 bp, Homo sapiens
gtgcatgttaatggtgtacaaa

SEQ ID NO: 7016368 - DNA, 22 bp, Homo sapiens
tgcattcctttctaggatagct

SEQ ID NO: 7016369 - DNA, 22 bp, Homo sapiens
tactgtggtaacattttaaatt

SEQ ID NO: 7016370 - DNA, 22 bp, Homo sapiens
tagattcttagtttcatagaat

SEQ ID NO: 7016371 - DNA, 22 bp, Homo sapiens
tttctcaaattgcatgagtagc

SEQ ID NO: 7016372 - DNA, 22 bp, Homo sapiens
gcgggcgctcaggctgcagctg

SEQ ID NO: 7016373 - DNA, 22 bp, Homo sapiens
ttcagctatgcgctttgggcaa

SEQ ID NO: 7016374 - DNA, 22 bp, Homo sapiens
gtgtcagctaatttgggagctc

SEQ ID NO: 7016375 - DNA, 22 bp, Homo sapiens
agaaactattatggtaaacaaa

SEQ ID NO: 7016376 - DNA, 22 bp, Homo sapiens
aaatgtgtcagtttcattctct

SEQ ID NO: 7016377 - DNA, 22 bp, Homo sapiens
tcagaggacgcactagggttgt

SEQ ID NO: 7016378 - DNA, 22 bp, Homo sapiens
gattcctatttggctcctgttc

SEQ ID NO: 7016379 - DNA, 21 bp, Homo sapiens
ttacttttgcagcaacctaat

SEQ ID NO: 7016380 - DNA, 22 bp, Homo sapiens
gcttgtcatagttgttacaaat

SEQ ID NO: 7016381 - DNA, 22 bp, Homo sapiens
gtttcaaagcacagctcacatt

SEQ ID NO: 7016382 - DNA, 22 bp, Homo sapiens
gtttcctgtggccacagaataa

SEQ ID NO: 7016383 - DNA, 22 bp, Homo sapiens
taaggcaggctttcatccagag

SEQ ID NO: 7016384 - DNA, 22 bp, Homo sapiens
caagttggtctcctgtagcaac

SEQ ID NO: 7016385 - DNA, 22 bp, Homo sapiens
tttgcaatggtagttgttgctc

SEQ ID NO: 7016386 - DNA, 22 bp, Homo sapiens
ctcctggctatgactacatttc

SEQ ID NO: 7016387 - DNA, 22 bp, Homo sapiens
tcaccttgaatgcagcagcgtg

SEQ ID NO: 7016388 - DNA, 22 bp, Homo sapiens
atccagaatgtcttgctggaga

SEQ ID NO: 7016389 - DNA, 22 bp, Homo sapiens
tcaattcaattgaacagttact

SEQ ID NO: 7016390 - DNA, 22 bp, Homo sapiens
tgaatagtgttctataatatgg

SEQ ID NO: 7016391 - DNA, 22 bp, Homo sapiens
agaggtctatgctaggggaact

SEQ ID NO: 7016392 - DNA, 22 bp, Homo sapiens
gtgtgtcttgaccaggatcgga

SEQ ID NO: 7016393 - DNA, 22 bp, Homo sapiens
agaaaatgtgaacttgtgaatt

SEQ ID NO: 7016394 - DNA, 22 bp, Homo sapiens
gactggatattgagtactgcaa

SEQ ID NO: 7016395 - DNA, 22 bp, Homo sapiens
tcggggatgggagagagctcca

SEQ ID NO: 7016396 - DNA, 22 bp, Homo sapiens
gttcagtttggggtatttgaag

SEQ ID NO: 7016397 - DNA, 22 bp, Homo sapiens
ataaatttataattgtttcctg

SEQ ID NO: 7016398 - DNA, 22 bp, Homo sapiens
cctgggtctatagacttcaaga

SEQ ID NO: 7016399 - DNA, 22 bp, Homo sapiens
ctgagcagccccaccagccatt

SEQ ID NO: 7016400 - DNA, 22 bp, Homo sapiens
gcacaaaggtggaaggaggaag

SEQ ID NO: 7016401 - DNA, 22 bp, Homo sapiens
acctccaggaagctcttggtac

SEQ ID NO: 7016402 - DNA, 22 bp, Homo sapiens
gctctgacaaaggccacttaca

SEQ ID NO: 7016403 - DNA, 22 bp, Homo sapiens
ttacatggatgtaaaaaagtta

SEQ ID NO: 7016404 - DNA, 22 bp, Homo sapiens
ctaagaacagtctaccctcctt

SEQ ID NO: 7016405 - DNA, 22 bp, Homo sapiens
aaggctgggtaacctgtccact

SEQ ID NO: 7016406 - DNA, 18 bp, Homo sapiens
actctgagtccacttaag

SEQ ID NO: 7016407 - DNA, 22 bp, Homo sapiens
aggccaagtagctagcattgaa

SEQ ID NO: 7016408 - DNA, 22 bp, Homo sapiens
agctgttgtctgcaggagaagc

SEQ ID NO: 7016409 - DNA, 22 bp, Homo sapiens
tgggagtactatgtgataggat

SEQ ID NO: 7016410 - DNA, 22 bp, Homo sapiens
cttattgtgtgtattttctagt

SEQ ID NO: 7016411 - DNA, 22 bp, Homo sapiens
gctgacaaacaaggtggtgtca

SEQ ID NO: 7016412 - DNA, 22 bp, Homo sapiens
aacatgcatgttatttatcagt

SEQ ID NO: 7016413 - DNA, 22 bp, Homo sapiens
gctgttctttggtcaaaggtat

SEQ ID NO: 7016414 - DNA, 22 bp, Homo sapiens
aactcagacatgtataaagact

SEQ ID NO: 7016415 - DNA, 22 bp, Homo sapiens
ctctcccttgggtgggctttgg

SEQ ID NO: 7016416 - DNA, 22 bp, Homo sapiens
ttcagcattggtatgaaaaccc

SEQ ID NO: 7016417 - DNA, 18 bp, Homo sapiens
gctctaattttagaaagg

SEQ ID NO: 7016418 - DNA, 22 bp, Homo sapiens
gtattttgttagggtgtggtat

SEQ ID NO: 7016419 - DNA, 22 bp, Homo sapiens
aggctggggaattgaatttgct

SEQ ID NO: 7016420 - DNA, 21 bp, Homo sapiens
ggccatcctgggaagggctgc

SEQ ID NO: 7016421 - DNA, 22 bp, Homo sapiens
gaggttcacttcctggatcctt

SEQ ID NO: 7016422 - DNA, 22 bp, Homo sapiens
tggaagacaggctgtattttaa

SEQ ID NO: 7016423 - DNA, 22 bp, Homo sapiens
tttgaatgaaattgacatttgg

SEQ ID NO: 7016424 - DNA, 22 bp, Homo sapiens
ctgcacagtggacagtgaagat

SEQ ID NO: 7016425 - DNA, 22 bp, Homo sapiens
tggctccttccgcagcatgcct

SEQ ID NO: 7016426 - DNA, 22 bp, Homo sapiens
actgagggtcaaccatttgctc

SEQ ID NO: 7016427 - DNA, 22 bp, Homo sapiens
cccatgctgtgcctagagagca

SEQ ID NO: 7016428 - DNA, 22 bp, Homo sapiens
tggggtgctttcttgcctgtac

SEQ ID NO: 7016429 - DNA, 22 bp, Homo sapiens
tttagaccctgggagattgact

SEQ ID NO: 7016430 - DNA, 22 bp, Homo sapiens
cacagcttctgtctgacccatg

SEQ ID NO: 7016431 - DNA, 22 bp, Homo sapiens
tggcttcctccagagcaggagg

SEQ ID NO: 7016432 - DNA, 22 bp, Homo sapiens
tcccaggacaggccacatggaa

SEQ ID NO: 7016433 - DNA, 22 bp, Homo sapiens
atcagacagggagttctgtgtc

SEQ ID NO: 7016434 - DNA, 22 bp, Homo sapiens
acagagaccagttacagcgtcc

SEQ ID NO: 7016435 - DNA, 22 bp, Homo sapiens
gttccacaaaaggtctagttta

SEQ ID NO: 7016436 - DNA, 22 bp, Homo sapiens
agacattttagacataaaagat

SEQ ID NO: 7016437 - DNA, 22 bp, Homo sapiens
tgcctgctaggccctgctgggt

SEQ ID NO: 7016438 - DNA, 22 bp, Homo sapiens
ttgctgaaaacaggtcatcagg

SEQ ID NO: 7016439 - DNA, 22 bp, Homo sapiens
tggtccttgtggcttttcagta

SEQ ID NO: 7016440 - DNA, 22 bp, Homo sapiens
gctgatccttttatgtctagct

SEQ ID NO: 7016441 - DNA, 22 bp, Homo sapiens
tctgatcagaagtacttggttc

SEQ ID NO: 7016442 - DNA, 22 bp, Homo sapiens
tgctgcaggccaggtcgttgtc

SEQ ID NO: 7016443 - DNA, 22 bp, Homo sapiens
aagtgggttcatgtggcattat

SEQ ID NO: 7016444 - DNA, 22 bp, Homo sapiens
gcctgtttaagtattctgacat

SEQ ID NO: 7016445 - DNA, 22 bp, Homo sapiens
ccagactgtggagttcctggtg

SEQ ID NO: 7016446 - DNA, 22 bp, Homo sapiens
ggctgcaacattttcttaggta

SEQ ID NO: 7016447 - DNA, 22 bp, Homo sapiens
tgccagtctcaccctgggtcct

SEQ ID NO: 7016448 - DNA, 22 bp, Homo sapiens
tcagttctctcatgcctgccct

SEQ ID NO: 7016449 - DNA, 22 bp, Homo sapiens
tccatacccagctttctcacac

SEQ ID NO: 7016450 - DNA, 22 bp, Homo sapiens
gagaggctccatgaccccggca

SEQ ID NO: 7016451 - DNA, 22 bp, Homo sapiens
tggggcctcaggccttttccta

SEQ ID NO: 7016452 - DNA, 22 bp, Homo sapiens
caaacatttgttggaacccctg

SEQ ID NO: 7016453 - DNA, 22 bp, Homo sapiens
gccttctgcgctcgtgtctccg

SEQ ID NO: 7016454 - DNA, 22 bp, Homo sapiens
aaatcctaatgacaagtttagt

SEQ ID NO: 7016455 - DNA, 22 bp, Homo sapiens
tggccaggtgtgggttctcaga

SEQ ID NO: 7016456 - DNA, 23 bp, Homo sapiens
tattgcacacatagaaacataga

SEQ ID NO: 7016457 - DNA, 22 bp, Homo sapiens
agtctagatccccagtgctgtc

SEQ ID NO: 7016458 - DNA, 22 bp, Homo sapiens
tttgaatggactgagaatcttg

SEQ ID NO: 7016459 - DNA, 22 bp, Homo sapiens
atagacactgaaatccctgcca

SEQ ID NO: 7016460 - DNA, 22 bp, Homo sapiens
atacatgacactgggctacagg

SEQ ID NO: 7016461 - DNA, 22 bp, Homo sapiens
tctaaagatttggattcatttg

SEQ ID NO: 7016462 - DNA, 22 bp, Homo sapiens
tctaggaaattgttactatatt

SEQ ID NO: 7016463 - DNA, 22 bp, Homo sapiens
ctgaaagggttacatagtaagt

SEQ ID NO: 7016464 - DNA, 22 bp, Homo sapiens
tctgttcagaattgtaacactc

SEQ ID NO: 7016465 - DNA, 23 bp, Homo sapiens
tgcatttgcaattgcagtaaggt

SEQ ID NO: 7016466 - DNA, 22 bp, Homo sapiens
agctcctgggcacctctttcac

SEQ ID NO: 7016467 - DNA, 22 bp, Homo sapiens
gtccatccacctctcgtctacc

SEQ ID NO: 7016468 - DNA, 22 bp, Homo sapiens
caggaacagctgacctgacaat

SEQ ID NO: 7016469 - DNA, 22 bp, Homo sapiens
caggaggcaggtgcattttgag

SEQ ID NO: 7016470 - DNA, 18 bp, Homo sapiens
tacatgcataaatgaagc

SEQ ID NO: 7016471 - DNA, 22 bp, Homo sapiens
ttgctttaatgagattttgcca

SEQ ID NO: 7016472 - DNA, 22 bp, Homo sapiens
tgtctggactgctcacagtacc

SEQ ID NO: 7016473 - DNA, 22 bp, Homo sapiens
agtgataaaggtgtgatatgaa

SEQ ID NO: 7016474 - DNA, 22 bp, Homo sapiens
acaggcagagagtggcggactc

SEQ ID NO: 7016475 - DNA, 23 bp, Homo sapiens
actgcagtcttgatctcctgggc

SEQ ID NO: 7016476 - DNA, 22 bp, Homo sapiens
ccagtgcctgtgggcatggtgc

SEQ ID NO: 7016477 - DNA, 22 bp, Homo sapiens
agagcagatggagctggaagag

SEQ ID NO: 7016478 - DNA, 22 bp, Homo sapiens
cagtctctgtcatctcatggga

SEQ ID NO: 7016479 - DNA, 22 bp, Homo sapiens
tgtctgccaccccatcaagctc

SEQ ID NO: 7016480 - DNA, 22 bp, Homo sapiens
atcacactaagggttggggcat

SEQ ID NO: 7016481 - DNA, 22 bp, Homo sapiens
catttgttaaccagtgtggatt

SEQ ID NO: 7016482 - DNA, 22 bp, Homo sapiens
ctcagagtccatagtttacagt

SEQ ID NO: 7016483 - DNA, 22 bp, Homo sapiens
aagtacatttttaacttacagc

SEQ ID NO: 7016484 - DNA, 22 bp, Homo sapiens
ttgcataacagccattaaagta

SEQ ID NO: 7016485 - DNA, 22 bp, Homo sapiens
cctttctgtgttgccctatttg

SEQ ID NO: 7016486 - DNA, 22 bp, Homo sapiens
gtaaactgtgttaaaggttgac

SEQ ID NO: 7016487 - DNA, 22 bp, Homo sapiens
aggctcaggaggagctgccgga

SEQ ID NO: 7016488 - DNA, 22 bp, Homo sapiens
ggcaaaaaccgcaataacttct

SEQ ID NO: 7016489 - DNA, 22 bp, Homo sapiens
tggaggcattttaggttgtcac

SEQ ID NO: 7016490 - DNA, 22 bp, Homo sapiens
cactaggctggagtgcagtggc

SEQ ID NO: 7016491 - DNA, 22 bp, Homo sapiens
cattgggcttctcctggaccca

SEQ ID NO: 7016492 - DNA, 22 bp, Homo sapiens
ctcctggaggctccaagggaga

SEQ ID NO: 7016493 - DNA, 22 bp, Homo sapiens
tgcttctggcttatctcgtgcc

SEQ ID NO: 7016494 - DNA, 22 bp, Homo sapiens
tttctgtaagtggcaaataatg

SEQ ID NO: 7016495 - DNA, 22 bp, Homo sapiens
tagtgggtgatttgatgaggaa

SEQ ID NO: 7016496 - DNA, 22 bp, Homo sapiens
tgtgctcttgtctgtgactaac

SEQ ID NO: 7016497 - DNA, 22 bp, Homo sapiens
tacagccatggttaatttacct

SEQ ID NO: 7016498 - DNA, 22 bp, Homo sapiens
gaactgtagttaatactacaca

SEQ ID NO: 7016499 - DNA, 22 bp, Homo sapiens
ggtacaattctggggtatgctc

SEQ ID NO: 7016500 - DNA, 22 bp, Homo sapiens
ttctaaatgtaaatagtatgat

SEQ ID NO: 7016501 - DNA, 19 bp, Homo sapiens
tcacccaggctgctggctc

SEQ ID NO: 7016502 - DNA, 22 bp, Homo sapiens
tcacagagaaaagctatcacaa

SEQ ID NO: 7016503 - DNA, 22 bp, Homo sapiens
gtattcttggttatcaaaatac

SEQ ID NO: 7016504 - DNA, 22 bp, Homo sapiens
tgatttaaaagaaacattgtct

SEQ ID NO: 7016505 - DNA, 22 bp, Homo sapiens
ttgttacaggtcctagtggctg

SEQ ID NO: 7016506 - DNA, 22 bp, Homo sapiens
aaggcattcaagatggaagttg

SEQ ID NO: 7016507 - DNA, 22 bp, Homo sapiens
aaatgtgctaaagtattaacat

SEQ ID NO: 7016508 - DNA, 22 bp, Homo sapiens
ttcttttcccaatattttgctg

SEQ ID NO: 7016509 - DNA, 22 bp, Homo sapiens
agacatcatgttacagattaag

SEQ ID NO: 7016510 - DNA, 20 bp, Homo sapiens
tcaattttctacaacatttg

SEQ ID NO: 7016511 - DNA, 22 bp, Homo sapiens
actcagaagatgtgggtagata

SEQ ID NO: 7016512 - DNA, 22 bp, Homo sapiens
gggtccagatggtgagagttaa

SEQ ID NO: 7016513 - DNA, 22 bp, Homo sapiens
gcccaggtgccctctgccttac

SEQ ID NO: 7016514 - DNA, 22 bp, Homo sapiens
tgcctggctaatttttgtatcc

SEQ ID NO: 7016515 - DNA, 22 bp, Homo sapiens
tacaagctgaccctgaagatga

SEQ ID NO: 7016516 - DNA, 22 bp, Homo sapiens
taagcgtttgggagttatgaac

SEQ ID NO: 7016517 - DNA, 21 bp, Homo sapiens
cccttcttgggtcaaagtata

SEQ ID NO: 7016518 - DNA, 22 bp, Homo sapiens
actttctcaggaattcacagac

SEQ ID NO: 7016519 - DNA, 22 bp, Homo sapiens
taatgaggtgatgactaaggtc

SEQ ID NO: 7016520 - DNA, 22 bp, Homo sapiens
aagcaagcccaggctcagtcaa

SEQ ID NO: 7016521 - DNA, 22 bp, Homo sapiens
agccactgtgagaggaccaggg

SEQ ID NO: 7016522 - DNA, 22 bp, Homo sapiens
acaagagtgagattatcatgta

SEQ ID NO: 7016523 - DNA, 22 bp, Homo sapiens
tctgaaggattttgtactcaaa

SEQ ID NO: 7016524 - DNA, 22 bp, Homo sapiens
acaaagttaacagttggatagt

SEQ ID NO: 7016525 - DNA, 18 bp, Homo sapiens
gcagctgacactggagtt

SEQ ID NO: 7016526 - DNA, 22 bp, Homo sapiens
ggctgctggagttgggtctctc

SEQ ID NO: 7016527 - DNA, 20 bp, Homo sapiens
tgactattcccacatgagag

SEQ ID NO: 7016528 - DNA, 22 bp, Homo sapiens
ctgttttatgaagggaatgaga

SEQ ID NO: 7016529 - DNA, 19 bp, Homo sapiens
tcagtgctcctatgtcctt

SEQ ID NO: 7016530 - DNA, 22 bp, Homo sapiens
tggccctgggtggaatgtccca

SEQ ID NO: 7016531 - DNA, 22 bp, Homo sapiens
tgagctgtgtgacattgagcca

SEQ ID NO: 7016532 - DNA, 22 bp, Homo sapiens
agggatggagcccagctgttct

SEQ ID NO: 7016533 - DNA, 23 bp, Homo sapiens
agttcctaagggctttgaactta

SEQ ID NO: 7016534 - DNA, 22 bp, Homo sapiens
ctagatcagctaactttccagt

SEQ ID NO: 7016535 - DNA, 22 bp, Homo sapiens
tcctagaaggatcattctagtg

SEQ ID NO: 7016536 - DNA, 22 bp, Homo sapiens
agctgaagatccagggttgggg

SEQ ID NO: 7016537 - DNA, 22 bp, Homo sapiens
cggcagtgggcgccaggtctcc

SEQ ID NO: 7016538 - DNA, 22 bp, Homo sapiens
ctgccatcctcaccagagcagc

SEQ ID NO: 7016539 - DNA, 22 bp, Homo sapiens
gcctggcagcccctagacattt

SEQ ID NO: 7016540 - DNA, 22 bp, Homo sapiens
tctcatgctgaagtattttctc

SEQ ID NO: 7016541 - DNA, 22 bp, Homo sapiens
agtcaaagttgtccccagcacc

SEQ ID NO: 7016542 - DNA, 22 bp, Homo sapiens
agaggtcttcacatggcaatga

SEQ ID NO: 7016543 - DNA, 22 bp, Homo sapiens
gtggggagcagccttagcccct

SEQ ID NO: 7016544 - DNA, 22 bp, Homo sapiens
tctgaaggtgctagagaaagct

SEQ ID NO: 7016545 - DNA, 22 bp, Homo sapiens
aagatgtgctgtcttgccactc

SEQ ID NO: 7016546 - DNA, 16 bp, Homo sapiens
tctggaagtggagggg

SEQ ID NO: 7016547 - DNA, 22 bp, Homo sapiens
gcctggctaattttggtatttt

SEQ ID NO: 7016548 - DNA, 22 bp, Homo sapiens
gtgcatgtgcatccatgtgtac

SEQ ID NO: 7016549 - DNA, 22 bp, Homo sapiens
ctgtgggcctgatgttcttctc

SEQ ID NO: 7016550 - DNA, 22 bp, Homo sapiens
caagccagtgatgtttgctgcc

SEQ ID NO: 7016551 - DNA, 22 bp, Homo sapiens
tggcaaccacaactacttttgc

SEQ ID NO: 7016552 - DNA, 22 bp, Homo sapiens
agtccaagaccaaggtgtcacc

SEQ ID NO: 7016553 - DNA, 22 bp, Homo sapiens
aataatgaacatttaaaacctg

SEQ ID NO: 7016554 - DNA, 19 bp, Homo sapiens
acaggggcctttccagggt

SEQ ID NO: 7016555 - DNA, 22 bp, Homo sapiens
tgtttattgctgcaattgtgcc

SEQ ID NO: 7016556 - DNA, 22 bp, Homo sapiens
cactctgacacatgaacttgat

SEQ ID NO: 7016557 - DNA, 22 bp, Homo sapiens
ggtgcaggcggtggggcaagta

SEQ ID NO: 7016558 - DNA, 22 bp, Homo sapiens
tttgaaactcatgatcatcact

SEQ ID NO: 7016559 - DNA, 18 bp, Homo sapiens
tctggctttgttccttgt

SEQ ID NO: 7016560 - DNA, 22 bp, Homo sapiens
ctgggaaggggaaggtcctctc

SEQ ID NO: 7016561 - DNA, 22 bp, Homo sapiens
aagcaggagatgcaggaatgta

SEQ ID NO: 7016562 - DNA, 22 bp, Homo sapiens
ctaacgaaatacctcagacttt

SEQ ID NO: 7016563 - DNA, 22 bp, Homo sapiens
acatacacacatactttctcct

SEQ ID NO: 7016564 - DNA, 22 bp, Homo sapiens
tggaaaacaaagctctcattat

SEQ ID NO: 7016565 - DNA, 23 bp, Homo sapiens
ctgtgcccggggctccacctgat

SEQ ID NO: 7016566 - DNA, 20 bp, Homo sapiens
attggccaggcataaaacac

SEQ ID NO: 7016567 - DNA, 22 bp, Homo sapiens
aatcacattagtgaaacactga

SEQ ID NO: 7016568 - DNA, 22 bp, Homo sapiens
tagagctgtatcaaagagcctt

SEQ ID NO: 7016569 - DNA, 22 bp, Homo sapiens
agctttatataaaagagtacat

SEQ ID NO: 7016570 - DNA, 22 bp, Homo sapiens
cgtggggacccacgtgcagcac

SEQ ID NO: 7016571 - DNA, 22 bp, Homo sapiens
cagtgcatagagagctcctgac

SEQ ID NO: 7016572 - DNA, 22 bp, Homo sapiens
agccatatcaagcattcttcac

SEQ ID NO: 7016573 - DNA, 22 bp, Homo sapiens
attctacacaacatgatgatgg

SEQ ID NO: 7016574 - DNA, 22 bp, Homo sapiens
ttttggtgattttactgaaggt

SEQ ID NO: 7016575 - DNA, 22 bp, Homo sapiens
accacagtctcgaagcactgca

SEQ ID NO: 7016576 - DNA, 22 bp, Homo sapiens
ctgataatttgctgactttcag

SEQ ID NO: 7016577 - DNA, 22 bp, Homo sapiens
actctctgtctaaatgcagttt

SEQ ID NO: 7016578 - DNA, 22 bp, Homo sapiens
caggaggagggcagccgcctcc

SEQ ID NO: 7016579 - DNA, 22 bp, Homo sapiens
agtcctgtgcaaatgcatctga

SEQ ID NO: 7016580 - DNA, 22 bp, Homo sapiens
gatgaattgttatggctacgag

SEQ ID NO: 7016581 - DNA, 22 bp, Homo sapiens
gagaccaggaagtacagcagcc

SEQ ID NO: 7016582 - DNA, 21 bp, Homo sapiens
ataatgtacaaaaactgtctt

SEQ ID NO: 7016583 - DNA, 22 bp, Homo sapiens
tatggctttaaacttttcattt

SEQ ID NO: 7016584 - DNA, 22 bp, Homo sapiens
cctgtgtgcacacgaggccatg

SEQ ID NO: 7016585 - DNA, 22 bp, Homo sapiens
tacccagagggagagcaactat

SEQ ID NO: 7016586 - DNA, 22 bp, Homo sapiens
tagcatctaacatcttaggact

SEQ ID NO: 7016587 - DNA, 22 bp, Homo sapiens
agggcctctaccatccaaggtt

SEQ ID NO: 7016588 - DNA, 22 bp, Homo sapiens
agatcagactttgtgactagga

SEQ ID NO: 7016589 - DNA, 22 bp, Homo sapiens
agagtctgtgctttcatcagga

SEQ ID NO: 7016590 - DNA, 22 bp, Homo sapiens
tacttcaatttgtatatgtgaa

SEQ ID NO: 7016591 - DNA, 22 bp, Homo sapiens
tttcagggaagtgttgaaaagg

SEQ ID NO: 7016592 - DNA, 22 bp, Homo sapiens
cagggtggcactcagcgcatct

SEQ ID NO: 7016593 - DNA, 22 bp, Homo sapiens
acattaagatgtgctgtaggat

SEQ ID NO: 7016594 - DNA, 22 bp, Homo sapiens
tctcagtgggttaaaagagaag

SEQ ID NO: 7016595 - DNA, 22 bp, Homo sapiens
ttgtccttgtgcaagacccagc

SEQ ID NO: 7016596 - DNA, 22 bp, Homo sapiens
gtggcagtcgctgacagataca

SEQ ID NO: 7016597 - DNA, 22 bp, Homo sapiens
aggataataataatctcgttta

SEQ ID NO: 7016598 - DNA, 22 bp, Homo sapiens
catgtgatatgaaaacatcttt

SEQ ID NO: 7016599 - DNA, 22 bp, Homo sapiens
agagaaatgattcctgggcaga

SEQ ID NO: 7016600 - DNA, 22 bp, Homo sapiens
cagttttacccaagcttatttt

SEQ ID NO: 7016601 - DNA, 22 bp, Homo sapiens
gaaagactgtaggattttgaat

SEQ ID NO: 7016602 - DNA, 22 bp, Homo sapiens
gccaggactgagaatgggagca

SEQ ID NO: 7016603 - DNA, 22 bp, Homo sapiens
gctggccatagaagccaaagag

SEQ ID NO: 7016604 - DNA, 21 bp, Homo sapiens
ctcctcaggaccagccacagg

SEQ ID NO: 7016605 - DNA, 18 bp, Homo sapiens
atatattgacaagaggga

SEQ ID NO: 7016606 - DNA, 22 bp, Homo sapiens
cagggagccccaattccatgcc

SEQ ID NO: 7016607 - DNA, 20 bp, Homo sapiens
cagaatgctgtaatcaagaa

SEQ ID NO: 7016608 - DNA, 21 bp, Homo sapiens
agcagccatttcacagagact

SEQ ID NO: 7016609 - DNA, 20 bp, Homo sapiens
tacttaggcttgttttggcc

SEQ ID NO: 7016610 - DNA, 22 bp, Homo sapiens
tcacaaacaatgctttggaatt

SEQ ID NO: 7016611 - DNA, 22 bp, Homo sapiens
caggaagaggtatcaccgagca

SEQ ID NO: 7016612 - DNA, 22 bp, Homo sapiens
aacacatgaaagttggtgagta

SEQ ID NO: 7016613 - DNA, 22 bp, Homo sapiens
ttgccacagtagcaaaaggttc

SEQ ID NO: 7016614 - DNA, 22 bp, Homo sapiens
agttccttttatctgagtctaa

SEQ ID NO: 7016615 - DNA, 22 bp, Homo sapiens
cagtttaacctatccattatgt

SEQ ID NO: 7016616 - DNA, 22 bp, Homo sapiens
agcttgttaaacagcctccact

SEQ ID NO: 7016617 - DNA, 22 bp, Homo sapiens
tggcagggagccaccggtcatg

SEQ ID NO: 7016618 - DNA, 22 bp, Homo sapiens
ttacatgcatatatgtgtgtgt

SEQ ID NO: 7016619 - DNA, 22 bp, Homo sapiens
tttgaaatatgaggcattatga

SEQ ID NO: 7016620 - DNA, 22 bp, Homo sapiens
attgtgacagtacctgccatgg

SEQ ID NO: 7016621 - DNA, 21 bp, Homo sapiens
ggccaacatggtctcatctct

SEQ ID NO: 7016622 - DNA, 22 bp, Homo sapiens
atgaactatcatcagttccacc

SEQ ID NO: 7016623 - DNA, 22 bp, Homo sapiens
tctgctttcaaattcacttagt

SEQ ID NO: 7016624 - DNA, 22 bp, Homo sapiens
aactttccatcatttgaagccc

SEQ ID NO: 7016625 - DNA, 22 bp, Homo sapiens
tgaaggccagggatttgcagcc

SEQ ID NO: 7016626 - DNA, 22 bp, Homo sapiens
ttccaaggagagctcgacctca

SEQ ID NO: 7016627 - DNA, 22 bp, Homo sapiens
tatgtgtatttagttctataca

SEQ ID NO: 7016628 - DNA, 22 bp, Homo sapiens
ctccagaggttctcatctggga

SEQ ID NO: 7016629 - DNA, 22 bp, Homo sapiens
acaaggcgtgacggagagagga

SEQ ID NO: 7016630 - DNA, 20 bp, Homo sapiens
actgtgtaaacatgattcat

SEQ ID NO: 7016631 - DNA, 22 bp, Homo sapiens
aggtaattttgtgttaatgatt

SEQ ID NO: 7016632 - DNA, 22 bp, Homo sapiens
tttctacaacacttctgaatct

SEQ ID NO: 7016633 - DNA, 22 bp, Homo sapiens
ctcttaatgttttatagattga

SEQ ID NO: 7016634 - DNA, 22 bp, Homo sapiens
tctgggagtgaagcaacagatg

SEQ ID NO: 7016635 - DNA, 22 bp, Homo sapiens
acagagtattggaaaggcagtg

SEQ ID NO: 7016636 - DNA, 21 bp, Homo sapiens
ccaggtacatggagaatgtgg

SEQ ID NO: 7016637 - DNA, 22 bp, Homo sapiens
aaagcaatagagggtaagactg

SEQ ID NO: 7016638 - DNA, 22 bp, Homo sapiens
gcgttaaggtttcaaggggtgg

SEQ ID NO: 7016639 - DNA, 22 bp, Homo sapiens
actttcttcttatgcattaagg

SEQ ID NO: 7016640 - DNA, 22 bp, Homo sapiens
ccacatctccctattgctcttt

SEQ ID NO: 7016641 - DNA, 22 bp, Homo sapiens
gtggccaagaaaatagatgcat

SEQ ID NO: 7016642 - DNA, 22 bp, Homo sapiens
atggaatgaaaaacacatgcaa

SEQ ID NO: 7016643 - DNA, 22 bp, Homo sapiens
aaggcccagccaatgggggcag

SEQ ID NO: 7016644 - DNA, 22 bp, Homo sapiens
aaagttagaatgatatcaacga

SEQ ID NO: 7016645 - DNA, 22 bp, Homo sapiens
tcagctttctcagaggcctaac

SEQ ID NO: 7016646 - DNA, 22 bp, Homo sapiens
gcagctggccctgacacgcaga

SEQ ID NO: 7016647 - DNA, 22 bp, Homo sapiens
aaaagaacctagctcctcagtc

SEQ ID NO: 7016648 - DNA, 22 bp, Homo sapiens
gcccaagagttaagtctctgct

SEQ ID NO: 7016649 - DNA, 22 bp, Homo sapiens
aggccagcagacgtgggactga

SEQ ID NO: 7016650 - DNA, 22 bp, Homo sapiens
tcatgacaggtgagtttttagg

SEQ ID NO: 7016651 - DNA, 22 bp, Homo sapiens
ctgctaccctagagctcactct

SEQ ID NO: 7016652 - DNA, 22 bp, Homo sapiens
aggctggagagtgcagtggcgt

SEQ ID NO: 7016653 - DNA, 22 bp, Homo sapiens
catttcaatacagtttgtaaat

SEQ ID NO: 7016654 - DNA, 22 bp, Homo sapiens
tgacatctgccagtttggtcgt

SEQ ID NO: 7016655 - DNA, 22 bp, Homo sapiens
acacatttatggatcgcagaaa

SEQ ID NO: 7016656 - DNA, 22 bp, Homo sapiens
tatgtactctaatttgtctcat

SEQ ID NO: 7016657 - DNA, 21 bp, Homo sapiens
tcttggggaggagggctgcac

SEQ ID NO: 7016658 - DNA, 22 bp, Homo sapiens
ttgtacttttgtcaggtggaca

SEQ ID NO: 7016659 - DNA, 22 bp, Homo sapiens
tctcagaattgtgtccactggg

SEQ ID NO: 7016660 - DNA, 22 bp, Homo sapiens
gtggccagaaccaggagaatga

SEQ ID NO: 7016661 - DNA, 22 bp, Homo sapiens
gggctggagacaagtgagccgc

SEQ ID NO: 7016662 - DNA, 19 bp, Homo sapiens
aaatccaagctcaggcctc

SEQ ID NO: 7016663 - DNA, 22 bp, Homo sapiens
agctttaaaaatccaatatcca

SEQ ID NO: 7016664 - DNA, 22 bp, Homo sapiens
agtcaaagaagatggttccaaa

SEQ ID NO: 7016665 - DNA, 22 bp, Homo sapiens
ggacaaaccaatagacactggc

SEQ ID NO: 7016666 - DNA, 22 bp, Homo sapiens
cttaacagatacatctgtggtt

SEQ ID NO: 7016667 - DNA, 18 bp, Homo sapiens
tcaggagacacagacgca

SEQ ID NO: 7016668 - DNA, 22 bp, Homo sapiens
caggcagcagaggagtgtggga

SEQ ID NO: 7016669 - DNA, 22 bp, Homo sapiens
tgcaggctgcagtctcaggtgg

SEQ ID NO: 7016670 - DNA, 22 bp, Homo sapiens
aggtttcttcttaggaatatgt

SEQ ID NO: 7016671 - DNA, 18 bp, Homo sapiens
cattagcaccacgtagag

SEQ ID NO: 7016672 - DNA, 21 bp, Homo sapiens
ctgtcatgcaaccattctcca

SEQ ID NO: 7016673 - DNA, 22 bp, Homo sapiens
atttgcttgtcctggtgactgt

SEQ ID NO: 7016674 - DNA, 22 bp, Homo sapiens
cagtctacctttcagacattga

SEQ ID NO: 7016675 - DNA, 22 bp, Homo sapiens
cagggtggtaccagcatctagt

SEQ ID NO: 7016676 - DNA, 22 bp, Homo sapiens
ggccatgtttggcagaaggatt

SEQ ID NO: 7016677 - DNA, 22 bp, Homo sapiens
accagctggcccatgagcacgt

SEQ ID NO: 7016678 - DNA, 22 bp, Homo sapiens
ttatggcttctgtgaagaattt

SEQ ID NO: 7016679 - DNA, 22 bp, Homo sapiens
agcagtgatgcatgacagccta

SEQ ID NO: 7016680 - DNA, 22 bp, Homo sapiens
gagaaggaagttgagccagcat

SEQ ID NO: 7016681 - DNA, 22 bp, Homo sapiens
tttagctagcctgtgtgtactt

SEQ ID NO: 7016682 - DNA, 22 bp, Homo sapiens
atatccatattacaagcagaaa

SEQ ID NO: 7016683 - DNA, 21 bp, Homo sapiens
actcatctttttggagaccag

SEQ ID NO: 7016684 - DNA, 22 bp, Homo sapiens
acatggcaaaaccccgtttcta

SEQ ID NO: 7016685 - DNA, 22 bp, Homo sapiens
gggccccttgtatctctggctc

SEQ ID NO: 7016686 - DNA, 22 bp, Homo sapiens
tgtacacgcttatggagtgaac

SEQ ID NO: 7016687 - DNA, 22 bp, Homo sapiens
cagaggtccctatttctttgtt

SEQ ID NO: 7016688 - DNA, 19 bp, Homo sapiens
acactggttgttcaagggc

SEQ ID NO: 7016689 - DNA, 22 bp, Homo sapiens
caggttctgccatttacttgta

SEQ ID NO: 7016690 - DNA, 22 bp, Homo sapiens
aagagacttctagatttgttga

SEQ ID NO: 7016691 - DNA, 22 bp, Homo sapiens
tagtgaaacagttatcaatctg

SEQ ID NO: 7016692 - DNA, 22 bp, Homo sapiens
aggcagtgatgagtcatgaata

SEQ ID NO: 7016693 - DNA, 22 bp, Homo sapiens
ggcccatgaccctagccaactg

SEQ ID NO: 7016694 - DNA, 22 bp, Homo sapiens
tctcttttctttctggataaaa

SEQ ID NO: 7016695 - DNA, 22 bp, Homo sapiens
ctggctctattccctaaggatg

SEQ ID NO: 7016696 - DNA, 22 bp, Homo sapiens
acatctcacttctttgaaggct

SEQ ID NO: 7016697 - DNA, 22 bp, Homo sapiens
gtcttgttggagttcttgcagc

SEQ ID NO: 7016698 - DNA, 22 bp, Homo sapiens
tagcaggaatatgaggttaata

SEQ ID NO: 7016699 - DNA, 22 bp, Homo sapiens
ccttagcaactgtcatagagca

SEQ ID NO: 7016700 - DNA, 22 bp, Homo sapiens
agtgtttagaggaggaaagatg

SEQ ID NO: 7016701 - DNA, 22 bp, Homo sapiens
gagaaagattgtccttcagggg

SEQ ID NO: 7016702 - DNA, 22 bp, Homo sapiens
tcttattttgttagatgctgta

SEQ ID NO: 7016703 - DNA, 22 bp, Homo sapiens
tagcattccttgtggcttctga

SEQ ID NO: 7016704 - DNA, 22 bp, Homo sapiens
gataaacacaaggtgatttcat

SEQ ID NO: 7016705 - DNA, 22 bp, Homo sapiens
ctggaagtatttaacccagaga

SEQ ID NO: 7016706 - DNA, 22 bp, Homo sapiens
agtttcaaattactgcccatgg

SEQ ID NO: 7016707 - DNA, 22 bp, Homo sapiens
cggcatgggcgtccccctcact

SEQ ID NO: 7016708 - DNA, 22 bp, Homo sapiens
tgtcaattaaagtttgtaggtg

SEQ ID NO: 7016709 - DNA, 22 bp, Homo sapiens
cagggcttcttggcatttgctg

SEQ ID NO: 7016710 - DNA, 22 bp, Homo sapiens
taatacctggccttgatacagt

SEQ ID NO: 7016711 - DNA, 22 bp, Homo sapiens
ttttcccagagctgtcctcaag

SEQ ID NO: 7016712 - DNA, 22 bp, Homo sapiens
ttcaccatgggatgacaacagt

SEQ ID NO: 7016713 - DNA, 22 bp, Homo sapiens
tagacatttgaatgtgaaatga

SEQ ID NO: 7016714 - DNA, 22 bp, Homo sapiens
agtgcatttggggtagtggaag

SEQ ID NO: 7016715 - DNA, 21 bp, Homo sapiens
gaatgtctgccttcacaatga

SEQ ID NO: 7016716 - DNA, 22 bp, Homo sapiens
tcacatctctcattgcctctgc

SEQ ID NO: 7016717 - DNA, 22 bp, Homo sapiens
cacaggtggcttctttcatctt

SEQ ID NO: 7016718 - DNA, 19 bp, Homo sapiens
tcgagtcaagacactaggc

SEQ ID NO: 7016719 - DNA, 22 bp, Homo sapiens
actaaagctcacagagttgaac

SEQ ID NO: 7016720 - DNA, 15 bp, Homo sapiens
cagtgcatacagtga

SEQ ID NO: 7016721 - DNA, 22 bp, Homo sapiens
taggaaacaaacctgcctcttc

SEQ ID NO: 7016722 - DNA, 22 bp, Homo sapiens
ctgccatctgagccaaaagtgc

SEQ ID NO: 7016723 - DNA, 22 bp, Homo sapiens
tacagaagctgagacactgaga

SEQ ID NO: 7016724 - DNA, 22 bp, Homo sapiens
tggtccctagcacagctgtcct

SEQ ID NO: 7016725 - DNA, 22 bp, Homo sapiens
tttcaaactatgtgtcaggcag

SEQ ID NO: 7016726 - DNA, 22 bp, Homo sapiens
tgtgaatacattggtagaagca

SEQ ID NO: 7016727 - DNA, 22 bp, Homo sapiens
tcccaaaatacttttctctcct

SEQ ID NO: 7016728 - DNA, 22 bp, Homo sapiens
gcagcatctgtacatagacgct

SEQ ID NO: 7016729 - DNA, 22 bp, Homo sapiens
tagatttgtttccttctctcca

SEQ ID NO: 7016730 - DNA, 22 bp, Homo sapiens
gttaggaatttgttactgtgta

SEQ ID NO: 7016731 - DNA, 23 bp, Homo sapiens
ggccttgcagtaaaccaaatgac

SEQ ID NO: 7016732 - DNA, 22 bp, Homo sapiens
caccaggctgaaccagagggga

SEQ ID NO: 7016733 - DNA, 18 bp, Homo sapiens
agactctgtgtgaaagta

SEQ ID NO: 7016734 - DNA, 22 bp, Homo sapiens
acacatgtgattctaagacagc

SEQ ID NO: 7016735 - DNA, 22 bp, Homo sapiens
agacataattaattagttctac

SEQ ID NO: 7016736 - DNA, 22 bp, Homo sapiens
aagtgttatgagtcaaggagct

SEQ ID NO: 7016737 - DNA, 22 bp, Homo sapiens
ttggcttcattgatctcacttt

SEQ ID NO: 7016738 - DNA, 22 bp, Homo sapiens
gggtggccttcatagctcaggg

SEQ ID NO: 7016739 - DNA, 22 bp, Homo sapiens
ggcttggcttgaaattaaggtt

SEQ ID NO: 7016740 - DNA, 22 bp, Homo sapiens
tgctcaggccctgggccatcct

SEQ ID NO: 7016741 - DNA, 22 bp, Homo sapiens
ttacagagctgggtggagagag

SEQ ID NO: 7016742 - DNA, 22 bp, Homo sapiens
accagcagctgccagagtggag

SEQ ID NO: 7016743 - DNA, 22 bp, Homo sapiens
agtggggaggtccaggccaccc

SEQ ID NO: 7016744 - DNA, 22 bp, Homo sapiens
atctgttaggtcaggtatggaa

SEQ ID NO: 7016745 - DNA, 22 bp, Homo sapiens
cactatttatacttcctgatcc

SEQ ID NO: 7016746 - DNA, 22 bp, Homo sapiens
atggctttgactgtaagtggta

SEQ ID NO: 7016747 - DNA, 22 bp, Homo sapiens
tctgccaggagccatgagcaag

SEQ ID NO: 7016748 - DNA, 22 bp, Homo sapiens
acttgcattatatttatcacaa

SEQ ID NO: 7016749 - DNA, 17 bp, Homo sapiens
agactgaggacacagga

SEQ ID NO: 7016750 - DNA, 22 bp, Homo sapiens
aagtgcttaaaagggtggtcta

SEQ ID NO: 7016751 - DNA, 20 bp, Homo sapiens
ctgggctcaagtgagcctcc

SEQ ID NO: 7016752 - DNA, 22 bp, Homo sapiens
gtaaacacctgttaaattcaga

SEQ ID NO: 7016753 - DNA, 22 bp, Homo sapiens
tggaaactataaaagcaccttc

SEQ ID NO: 7016754 - DNA, 22 bp, Homo sapiens
tggtccatgctccaggcacatt

SEQ ID NO: 7016755 - DNA, 22 bp, Homo sapiens
atactcaatttgttggaaagca

SEQ ID NO: 7016756 - DNA, 22 bp, Homo sapiens
gaggttggtgaggggacacggt

SEQ ID NO: 7016757 - DNA, 19 bp, Homo sapiens
ccttccagaactaaattaa

SEQ ID NO: 7016758 - DNA, 22 bp, Homo sapiens
gatgcagggctggcaggagctt

SEQ ID NO: 7016759 - DNA, 20 bp, Homo sapiens
ggtggccgtagcgggcggcg

SEQ ID NO: 7016760 - DNA, 22 bp, Homo sapiens
cccagagaaccttctgtgccac

SEQ ID NO: 7016761 - DNA, 22 bp, Homo sapiens
gtgccagagattcctaaacttt

SEQ ID NO: 7016762 - DNA, 22 bp, Homo sapiens
atgggacaaacctttgatttga

SEQ ID NO: 7016763 - DNA, 22 bp, Homo sapiens
caatttcagtgctgtggagagg

SEQ ID NO: 7016764 - DNA, 22 bp, Homo sapiens
agagaccttcctgactccagag

SEQ ID NO: 7016765 - DNA, 22 bp, Homo sapiens
gtgtgtcagagctcagagaagt

SEQ ID NO: 7016766 - DNA, 22 bp, Homo sapiens
cacatctgacttccagtgcagg

SEQ ID NO: 7016767 - DNA, 23 bp, Homo sapiens
gtgggcgcccaggagcgggacgg

SEQ ID NO: 7016768 - DNA, 22 bp, Homo sapiens
ctccagggcagcatggcagtgg

SEQ ID NO: 7016769 - DNA, 22 bp, Homo sapiens
ctcctggttcagagagctgaga

SEQ ID NO: 7016770 - DNA, 22 bp, Homo sapiens
aagcaaagtgctttgcctccag

SEQ ID NO: 7016771 - DNA, 22 bp, Homo sapiens
ctgccttttcatctgagctgga

SEQ ID NO: 7016772 - DNA, 22 bp, Homo sapiens
catagccatctttagcttccag

SEQ ID NO: 7016773 - DNA, 22 bp, Homo sapiens
agaagtttggtcctataaactc

SEQ ID NO: 7016774 - DNA, 22 bp, Homo sapiens
ttgctgtttaatgatgtcttat

SEQ ID NO: 7016775 - DNA, 22 bp, Homo sapiens
ccttggtccaaccctgcacagc

SEQ ID NO: 7016776 - DNA, 22 bp, Homo sapiens
ccaagggctgctgaggtgtcca

SEQ ID NO: 7016777 - DNA, 22 bp, Homo sapiens
tcaccgtcgggggtcgctgtct

SEQ ID NO: 7016778 - DNA, 22 bp, Homo sapiens
ttttcttggagtggctgtcctt

SEQ ID NO: 7016779 - DNA, 23 bp, Homo sapiens
tagcaggctttcttttctctcac

SEQ ID NO: 7016780 - DNA, 22 bp, Homo sapiens
aaggtggtgatcatcttgaagg

SEQ ID NO: 7016781 - DNA, 22 bp, Homo sapiens
ggccacagaacagctacaggac

SEQ ID NO: 7016782 - DNA, 22 bp, Homo sapiens
tagggctgctttgtattctgct

SEQ ID NO: 7016783 - DNA, 22 bp, Homo sapiens
agtctcttccttcaaggctggt

SEQ ID NO: 7016784 - DNA, 22 bp, Homo sapiens
cctgaagaagttgttatggtct

SEQ ID NO: 7016785 - DNA, 22 bp, Homo sapiens
gaaaaaggataaatacagtgtt

SEQ ID NO: 7016786 - DNA, 22 bp, Homo sapiens
tcccacaggcccagggcggaaa

SEQ ID NO: 7016787 - DNA, 22 bp, Homo sapiens
ttaagcaacacacattaattat

SEQ ID NO: 7016788 - DNA, 22 bp, Homo sapiens
cagacgggctcatggcagtccc

SEQ ID NO: 7016789 - DNA, 22 bp, Homo sapiens
tctcctaaggctgaatatctct

SEQ ID NO: 7016790 - DNA, 22 bp, Homo sapiens
tctgcgtgaatttgcattgtgg

SEQ ID NO: 7016791 - DNA, 22 bp, Homo sapiens
atctgctgttcttcacagcttg

SEQ ID NO: 7016792 - DNA, 22 bp, Homo sapiens
gacagcttctagaggaattggt

SEQ ID NO: 7016793 - DNA, 22 bp, Homo sapiens
agaatttggtagttatttttgg

SEQ ID NO: 7016794 - DNA, 16 bp, Homo sapiens
aggaatgtggcggaac

SEQ ID NO: 7016795 - DNA, 22 bp, Homo sapiens
gtacaacttctgtagctacttt

SEQ ID NO: 7016796 - DNA, 22 bp, Homo sapiens
tttctaggtttacaatactgca

SEQ ID NO: 7016797 - DNA, 22 bp, Homo sapiens
tcgatttgtttgggggagaagt

SEQ ID NO: 7016798 - DNA, 22 bp, Homo sapiens
gagattctgtagtcaggcatct

SEQ ID NO: 7016799 - DNA, 22 bp, Homo sapiens
gcaggcaccgcggcggcaggtt

SEQ ID NO: 7016800 - DNA, 21 bp, Homo sapiens
agagatagactagaattgatg

SEQ ID NO: 7016801 - DNA, 22 bp, Homo sapiens
gtgacattcaggatatcaatgg

SEQ ID NO: 7016802 - DNA, 22 bp, Homo sapiens
tgctatacggagcatcttcagg

SEQ ID NO: 7016803 - DNA, 22 bp, Homo sapiens
tctgctgttcattcttttagct

SEQ ID NO: 7016804 - DNA, 22 bp, Homo sapiens
caggcctggttgagccctgaga

SEQ ID NO: 7016805 - DNA, 23 bp, Homo sapiens
gggatctgtaagttgaagacaaa

SEQ ID NO: 7016806 - DNA, 22 bp, Homo sapiens
caggtgcttctgtaagaaagac

SEQ ID NO: 7016807 - DNA, 17 bp, Homo sapiens
taagtgattatctcata

SEQ ID NO: 7016808 - DNA, 22 bp, Homo sapiens
aagatacacggtcaactctcaa

SEQ ID NO: 7016809 - DNA, 22 bp, Homo sapiens
gtgctctgcctggggtcatggc

SEQ ID NO: 7016810 - DNA, 22 bp, Homo sapiens
ttgctctatgtttgtaaacaga

SEQ ID NO: 7016811 - DNA, 22 bp, Homo sapiens
tctatgaaaaactgttaagctc

SEQ ID NO: 7016812 - DNA, 22 bp, Homo sapiens
ctgctctgagaggctcttccta

SEQ ID NO: 7016813 - DNA, 22 bp, Homo sapiens
aattacctgtcatacatcaagc

SEQ ID NO: 7016814 - DNA, 22 bp, Homo sapiens
gttctctagggctgtagactgg

SEQ ID NO: 7016815 - DNA, 22 bp, Homo sapiens
tatagcaattcagaatacatgt

SEQ ID NO: 7016816 - DNA, 22 bp, Homo sapiens
tggtggacattctggatgtgct

SEQ ID NO: 7016817 - DNA, 22 bp, Homo sapiens
ggaagaggctgagccaggtccc

SEQ ID NO: 7016818 - DNA, 22 bp, Homo sapiens
agggcacttgaggctgggcctg

SEQ ID NO: 7016819 - DNA, 22 bp, Homo sapiens
actcaggaaatgaagactggtt

SEQ ID NO: 7016820 - DNA, 22 bp, Homo sapiens
caggcaataaagggttggttgg

SEQ ID NO: 7016821 - DNA, 22 bp, Homo sapiens
ttggcaatatttactgaagttg

SEQ ID NO: 7016822 - DNA, 22 bp, Homo sapiens
catctactttaaggattctggg

SEQ ID NO: 7016823 - DNA, 22 bp, Homo sapiens
ctggagcaggtttaggagtccc

SEQ ID NO: 7016824 - DNA, 22 bp, Homo sapiens
agaaggaaggataactgcatta

SEQ ID NO: 7016825 - DNA, 22 bp, Homo sapiens
attcaactatgtatagtcttct

SEQ ID NO: 7016826 - DNA, 23 bp, Homo sapiens
atatgttgtgaaattttagtagc

SEQ ID NO: 7016827 - DNA, 20 bp, Homo sapiens
agagtttggggtcattttgg

SEQ ID NO: 7016828 - DNA, 22 bp, Homo sapiens
ttgtacttacattttaaagcta

SEQ ID NO: 7016829 - DNA, 18 bp, Homo sapiens
ggaaatgtttggtactag

SEQ ID NO: 7016830 - DNA, 22 bp, Homo sapiens
tgcagttttatcacatatatag

SEQ ID NO: 7016831 - DNA, 22 bp, Homo sapiens
tgtaggaattccagtgacttca

SEQ ID NO: 7016832 - DNA, 22 bp, Homo sapiens
ctgcaggacagggccggaggcc

SEQ ID NO: 7016833 - DNA, 22 bp, Homo sapiens
cccacttcatgggcaggaagga

SEQ ID NO: 7016834 - DNA, 22 bp, Homo sapiens
cagagggctgccctgagttcgt

SEQ ID NO: 7016835 - DNA, 22 bp, Homo sapiens
agtcctgggtgtgcaaggcaga

SEQ ID NO: 7016836 - DNA, 22 bp, Homo sapiens
atgcatgcagggaagacagtag

SEQ ID NO: 7016837 - DNA, 22 bp, Homo sapiens
acattctttcgatgtctgattt

SEQ ID NO: 7016838 - DNA, 22 bp, Homo sapiens
tagtcctttatcaaacatttat

SEQ ID NO: 7016839 - DNA, 22 bp, Homo sapiens
tttgcagtcaaatttgctaaat

SEQ ID NO: 7016840 - DNA, 22 bp, Homo sapiens
gagcagcaaagggagggtaaat

SEQ ID NO: 7016841 - DNA, 22 bp, Homo sapiens
tctctggccgagagtccctggg

SEQ ID NO: 7016842 - DNA, 23 bp, Homo sapiens
agtgatgtcacccacagacaagg

SEQ ID NO: 7016843 - DNA, 22 bp, Homo sapiens
tttggaatctgagggcttagtt

SEQ ID NO: 7016844 - DNA, 22 bp, Homo sapiens
aggctggctttggtagcatggt

SEQ ID NO: 7016845 - DNA, 22 bp, Homo sapiens
caaaggctcagtaaatctttgt

SEQ ID NO: 7016846 - DNA, 22 bp, Homo sapiens
taagttctcagaagattttgta

SEQ ID NO: 7016847 - DNA, 22 bp, Homo sapiens
gcccactccagcttctcccaca

SEQ ID NO: 7016848 - DNA, 22 bp, Homo sapiens
tcccactgagcccctgctggtg

SEQ ID NO: 7016849 - DNA, 22 bp, Homo sapiens
ccagaaatcctctctttcttgc

SEQ ID NO: 7016850 - DNA, 22 bp, Homo sapiens
taagcaggtgccttctgtgacc

SEQ ID NO: 7016851 - DNA, 22 bp, Homo sapiens
tcacaccttttagaattactat

SEQ ID NO: 7016852 - DNA, 22 bp, Homo sapiens
aaagacacacagtgcttcagtt

SEQ ID NO: 7016853 - DNA, 22 bp, Homo sapiens
gcagaaagctccttgcgatctg

SEQ ID NO: 7016854 - DNA, 22 bp, Homo sapiens
actgtgctggcaatgactcagg

SEQ ID NO: 7016855 - DNA, 22 bp, Homo sapiens
agtgctcctgccagctttctgg

SEQ ID NO: 7016856 - DNA, 22 bp, Homo sapiens
ttacaattacttgatctcagct

SEQ ID NO: 7016857 - DNA, 22 bp, Homo sapiens
tccccagtaagcctgcactgtg

SEQ ID NO: 7016858 - DNA, 19 bp, Homo sapiens
atggaaaattgtactcaat

SEQ ID NO: 7016859 - DNA, 22 bp, Homo sapiens
agcctggctgggaagagcctct

SEQ ID NO: 7016860 - DNA, 22 bp, Homo sapiens
aagtgttaaaagattaaatgct

SEQ ID NO: 7016861 - DNA, 22 bp, Homo sapiens
cagttaatgtgggccaagttct

SEQ ID NO: 7016862 - DNA, 22 bp, Homo sapiens
taaaggcaaatgtgtgtttgtg

SEQ ID NO: 7016863 - DNA, 22 bp, Homo sapiens
tggcctgcaagctaaaaatcta

SEQ ID NO: 7016864 - DNA, 22 bp, Homo sapiens
tgtcacatgtgtggcatttttc

SEQ ID NO: 7016865 - DNA, 22 bp, Homo sapiens
agccctgtctctcactccaggt

SEQ ID NO: 7016866 - DNA, 17 bp, Homo sapiens
cattctgtaatctttct

SEQ ID NO: 7016867 - DNA, 22 bp, Homo sapiens
tttgagcaccctatgtgtttac

SEQ ID NO: 7016868 - DNA, 22 bp, Homo sapiens
tggttacatcatcccattctga

SEQ ID NO: 7016869 - DNA, 22 bp, Homo sapiens
cagagccgggagccagtcacag

SEQ ID NO: 7016870 - DNA, 22 bp, Homo sapiens
tgtgtggtgaagcagagatgct

SEQ ID NO: 7016871 - DNA, 22 bp, Homo sapiens
tttgtcctataatcctcttaca

SEQ ID NO: 7016872 - DNA, 22 bp, Homo sapiens
gagtttcttaacaggtggaagc

SEQ ID NO: 7016873 - DNA, 22 bp, Homo sapiens
atgtacaaaatgttttgaaatg

SEQ ID NO: 7016874 - DNA, 22 bp, Homo sapiens
acatcagtaattaagtctcaag

SEQ ID NO: 7016875 - DNA, 22 bp, Homo sapiens
acaaagttattctttcagagga

SEQ ID NO: 7016876 - DNA, 23 bp, Homo sapiens
agttttcaagttggtggctggca

SEQ ID NO: 7016877 - DNA, 22 bp, Homo sapiens
taacacttcagatgattttgtt

SEQ ID NO: 7016878 - DNA, 22 bp, Homo sapiens
ttccacatgttagctggttaaa

SEQ ID NO: 7016879 - DNA, 22 bp, Homo sapiens
ggaccaaatgctttttaattga

SEQ ID NO: 7016880 - DNA, 22 bp, Homo sapiens
agctttgaagtatttggtctcc

SEQ ID NO: 7016881 - DNA, 22 bp, Homo sapiens
ccccacagtccgtgaggagcca

SEQ ID NO: 7016882 - DNA, 22 bp, Homo sapiens
gcaccctgtcaaaatggaccaa

SEQ ID NO: 7016883 - DNA, 20 bp, Homo sapiens
cacagaacaaattgcaggac

SEQ ID NO: 7016884 - DNA, 22 bp, Homo sapiens
ttatttatgttaacagtcgaga

SEQ ID NO: 7016885 - DNA, 22 bp, Homo sapiens
cttttcaggctacattatggga

SEQ ID NO: 7016886 - DNA, 22 bp, Homo sapiens
tgggcactgtagctggtgctgg

SEQ ID NO: 7016887 - DNA, 22 bp, Homo sapiens
gctggaggtggtgagaaaaggt

SEQ ID NO: 7016888 - DNA, 22 bp, Homo sapiens
tcagggccggggctgtggcgag

SEQ ID NO: 7016889 - DNA, 22 bp, Homo sapiens
attaggaaactgaatgtcagaa

SEQ ID NO: 7016890 - DNA, 22 bp, Homo sapiens
aaagtttatcatagccggggac

SEQ ID NO: 7016891 - DNA, 22 bp, Homo sapiens
agcaaattaggtcaaggagatg

SEQ ID NO: 7016892 - DNA, 22 bp, Homo sapiens
caaacatctgcaccttgaccgg

SEQ ID NO: 7016893 - DNA, 22 bp, Homo sapiens
atttcatgttgatctttcgagg

SEQ ID NO: 7016894 - DNA, 22 bp, Homo sapiens
ctttggaggaaaattgaggtca

SEQ ID NO: 7016895 - DNA, 22 bp, Homo sapiens
taaatgaagaaatggagattgt

SEQ ID NO: 7016896 - DNA, 22 bp, Homo sapiens
tgacaatttggcagagtctggc

SEQ ID NO: 7016897 - DNA, 22 bp, Homo sapiens
gttcccacttggtgcactatga

SEQ ID NO: 7016898 - DNA, 22 bp, Homo sapiens
tgtttatgtgtgtgcatatata

SEQ ID NO: 7016899 - DNA, 22 bp, Homo sapiens
gaacagcctcaataacatcctt

SEQ ID NO: 7016900 - DNA, 22 bp, Homo sapiens
ttacatggtgccccgatggtac

SEQ ID NO: 7016901 - DNA, 19 bp, Homo sapiens
agggatatttaaaaagctc

SEQ ID NO: 7016902 - DNA, 22 bp, Homo sapiens
ttgtctgaatatgtatgtatcc

SEQ ID NO: 7016903 - DNA, 22 bp, Homo sapiens
cacgtgagaccttgcagaggtg

SEQ ID NO: 7016904 - DNA, 22 bp, Homo sapiens
gcagcgataagagaactgggac

SEQ ID NO: 7016905 - DNA, 22 bp, Homo sapiens
accaggaaactgtgcccacgac

SEQ ID NO: 7016906 - DNA, 22 bp, Homo sapiens
tctgatatgaatgtctagctct

SEQ ID NO: 7016907 - DNA, 19 bp, Homo sapiens
tgagctgccgtcttccctg

SEQ ID NO: 7016908 - DNA, 22 bp, Homo sapiens
acaagtgtgtgcagtttgtaaa

SEQ ID NO: 7016909 - DNA, 22 bp, Homo sapiens
caccagagtgggtgagggtgat

SEQ ID NO: 7016910 - DNA, 22 bp, Homo sapiens
ttcagcagtcgtccaggaaaag

SEQ ID NO: 7016911 - DNA, 22 bp, Homo sapiens
gagggccagaaagttattgaga

SEQ ID NO: 7016912 - DNA, 23 bp, Homo sapiens
tgtcacatttagttggcattgtt

SEQ ID NO: 7016913 - DNA, 23 bp, Homo sapiens
agcagccagagatcctcggccct

SEQ ID NO: 7016914 - DNA, 22 bp, Homo sapiens
ttggctctgacattaaaacaat

SEQ ID NO: 7016915 - DNA, 22 bp, Homo sapiens
acaatgctgttgagacattctt

SEQ ID NO: 7016916 - DNA, 22 bp, Homo sapiens
ttctgacagcaaaactcagcct

SEQ ID NO: 7016917 - DNA, 22 bp, Homo sapiens
caagccaggaaggatccagcac

SEQ ID NO: 7016918 - DNA, 22 bp, Homo sapiens
gacagtagtaaagctaggacca

SEQ ID NO: 7016919 - DNA, 22 bp, Homo sapiens
atttactaatgtcatatcgcgt

SEQ ID NO: 7016920 - DNA, 22 bp, Homo sapiens
tgagccctcggctggggcagag

SEQ ID NO: 7016921 - DNA, 22 bp, Homo sapiens
tccttcaagatgccacagcttt

SEQ ID NO: 7016922 - DNA, 22 bp, Homo sapiens
tgcttccagccttcccaatgct

SEQ ID NO: 7016923 - DNA, 23 bp, Homo sapiens
gcactgagctcactagtcccctg

SEQ ID NO: 7016924 - DNA, 22 bp, Homo sapiens
ttccatctttcagctttgttgg

SEQ ID NO: 7016925 - DNA, 22 bp, Homo sapiens
tgctctggctgggatgagtgca

SEQ ID NO: 7016926 - DNA, 23 bp, Homo sapiens
gtgcagcagtgtctgcagtcatg

SEQ ID NO: 7016927 - DNA, 22 bp, Homo sapiens
tttgagaaaaagtgatgatgat

SEQ ID NO: 7016928 - DNA, 22 bp, Homo sapiens
tcctgggagtaaaagctgccct

SEQ ID NO: 7016929 - DNA, 20 bp, Homo sapiens
cctgctgtgctttccatgga

SEQ ID NO: 7016930 - DNA, 22 bp, Homo sapiens
ttcagctccttatttctgagca

SEQ ID NO: 7016931 - DNA, 22 bp, Homo sapiens
tgcccagctattcctttcttag

SEQ ID NO: 7016932 - DNA, 22 bp, Homo sapiens
atctggagcttaagcttatata

SEQ ID NO: 7016933 - DNA, 22 bp, Homo sapiens
cattctgaccctatgatttaag

SEQ ID NO: 7016934 - DNA, 22 bp, Homo sapiens
cacaggccaataccctctctct

SEQ ID NO: 7016935 - DNA, 22 bp, Homo sapiens
agagtggtacttctttttcttc

SEQ ID NO: 7016936 - DNA, 22 bp, Homo sapiens
atcatagaacacctacctacct

SEQ ID NO: 7016937 - DNA, 22 bp, Homo sapiens
tcagaccccagaatgaagccag

SEQ ID NO: 7016938 - DNA, 22 bp, Homo sapiens
tgctggttcttaagatgcctcc

SEQ ID NO: 7016939 - DNA, 22 bp, Homo sapiens
caatgtcagtcaagcagcaaat

SEQ ID NO: 7016940 - DNA, 22 bp, Homo sapiens
catgctccatatggatattctt

SEQ ID NO: 7016941 - DNA, 22 bp, Homo sapiens
ggcccagctgtatattacagtt

SEQ ID NO: 7016942 - DNA, 22 bp, Homo sapiens
tcttatgtgctgtgagattttt

SEQ ID NO: 7016943 - DNA, 21 bp, Homo sapiens
gctttagatttagtgagccag

SEQ ID NO: 7016944 - DNA, 22 bp, Homo sapiens
ctgagccccatctgaggtgccc

SEQ ID NO: 7016945 - DNA, 17 bp, Homo sapiens
tccagggtttatgaaat

SEQ ID NO: 7016946 - DNA, 22 bp, Homo sapiens
ttcattgctattcactgtactg

SEQ ID NO: 7016947 - DNA, 22 bp, Homo sapiens
aggacacaacatcatttctgtg

SEQ ID NO: 7016948 - DNA, 22 bp, Homo sapiens
aggcacacccagtgacctcccg

SEQ ID NO: 7016949 - DNA, 22 bp, Homo sapiens
gactgaggtgcccagaggtgac

SEQ ID NO: 7016950 - DNA, 22 bp, Homo sapiens
cccaggaacctaccagctcgag

SEQ ID NO: 7016951 - DNA, 22 bp, Homo sapiens
cggagaggtgggggcagcatct

SEQ ID NO: 7016952 - DNA, 22 bp, Homo sapiens
gattggactaaaggcaacagct

SEQ ID NO: 7016953 - DNA, 22 bp, Homo sapiens
aaggcacaacacaagagggtga

SEQ ID NO: 7016954 - DNA, 22 bp, Homo sapiens
taagtcccccacttgccacagg

SEQ ID NO: 7016955 - DNA, 22 bp, Homo sapiens
gcaaagcattctgtggagtcta

SEQ ID NO: 7016956 - DNA, 22 bp, Homo sapiens
tttgcactagcatttgtccatg

SEQ ID NO: 7016957 - DNA, 19 bp, Homo sapiens
acctagctcagtggagtag

SEQ ID NO: 7016958 - DNA, 22 bp, Homo sapiens
aatatgcattatacagactgat

SEQ ID NO: 7016959 - DNA, 22 bp, Homo sapiens
tttagcactaatcagctgtggc

SEQ ID NO: 7016960 - DNA, 22 bp, Homo sapiens
agttgatttttctggctcagcc

SEQ ID NO: 7016961 - DNA, 22 bp, Homo sapiens
ggaattcttaaaatggtgtgta

SEQ ID NO: 7016962 - DNA, 22 bp, Homo sapiens
cctgaataggctctgctcaaaa

SEQ ID NO: 7016963 - DNA, 22 bp, Homo sapiens
gctgggtattttaagaaaggaa

SEQ ID NO: 7016964 - DNA, 22 bp, Homo sapiens
acacatttagcaccaggtttat

SEQ ID NO: 7016965 - DNA, 16 bp, Homo sapiens
acttccaggggagccc

SEQ ID NO: 7016966 - DNA, 23 bp, Homo sapiens
aggccagtttttcctgcttgctg

SEQ ID NO: 7016967 - DNA, 22 bp, Homo sapiens
gcagtaagaaagtcaagcagtt

SEQ ID NO: 7016968 - DNA, 22 bp, Homo sapiens
gcctctgccaagggggctgcgg

SEQ ID NO: 7016969 - DNA, 21 bp, Homo sapiens
atcactgaatgccttcaagga

SEQ ID NO: 7016970 - DNA, 22 bp, Homo sapiens
gcaaagaatgcagatttgcctc

SEQ ID NO: 7016971 - DNA, 22 bp, Homo sapiens
catggctggtgcacctctggga

SEQ ID NO: 7016972 - DNA, 22 bp, Homo sapiens
caaaggaagctccttgatggcg

SEQ ID NO: 7016973 - DNA, 22 bp, Homo sapiens
ctgcccatctggccacacacag

SEQ ID NO: 7016974 - DNA, 22 bp, Homo sapiens
ctgaagtgccaaatcataatca

SEQ ID NO: 7016975 - DNA, 22 bp, Homo sapiens
gggctggaagacaggaaatgct

SEQ ID NO: 7016976 - DNA, 22 bp, Homo sapiens
gagtctccaatccatgcctgtc

SEQ ID NO: 7016977 - DNA, 22 bp, Homo sapiens
acaggggtgcatggtgcatggt

SEQ ID NO: 7016978 - DNA, 22 bp, Homo sapiens
aagaaatcagaaaagcattcgt

SEQ ID NO: 7016979 - DNA, 22 bp, Homo sapiens
tctgggtgccactgtctgtaca

SEQ ID NO: 7016980 - DNA, 22 bp, Homo sapiens
gcatttcatgtagattgagaac

SEQ ID NO: 7016981 - DNA, 22 bp, Homo sapiens
agcctggaggccaggagacagt

SEQ ID NO: 7016982 - DNA, 22 bp, Homo sapiens
tcaggctcaaagggccggatga

SEQ ID NO: 7016983 - DNA, 22 bp, Homo sapiens
cccagctctaggagtggtggca

SEQ ID NO: 7016984 - DNA, 22 bp, Homo sapiens
ggaaggctctgttccttgactt

SEQ ID NO: 7016985 - DNA, 22 bp, Homo sapiens
agtgttttatttcagcactttg

SEQ ID NO: 7016986 - DNA, 22 bp, Homo sapiens
aatgtatgagcgtgaaagcact

SEQ ID NO: 7016987 - DNA, 22 bp, Homo sapiens
tgaatagagggcaggctttgta

SEQ ID NO: 7016988 - DNA, 22 bp, Homo sapiens
ggcgcacgccattggccgtgcg

SEQ ID NO: 7016989 - DNA, 22 bp, Homo sapiens
ttgagaaaatagttcgaatgtt

SEQ ID NO: 7016990 - DNA, 23 bp, Homo sapiens
cctctaataaacttgaccttgtg

SEQ ID NO: 7016991 - DNA, 22 bp, Homo sapiens
ccactgtagttatgatgaagtt

SEQ ID NO: 7016992 - DNA, 22 bp, Homo sapiens
catctgaataaagacttgcaga

SEQ ID NO: 7016993 - DNA, 22 bp, Homo sapiens
ccagaaccaaaagcatggagta

SEQ ID NO: 7016994 - DNA, 22 bp, Homo sapiens
agcagaattgaatatcgggttc

SEQ ID NO: 7016995 - DNA, 21 bp, Homo sapiens
accaccctgtttatccagagg

SEQ ID NO: 7016996 - DNA, 22 bp, Homo sapiens
ggggctgcttcacctttttacg

SEQ ID NO: 7016997 - DNA, 22 bp, Homo sapiens
tcagtttttgtttgccagatag

SEQ ID NO: 7016998 - DNA, 22 bp, Homo sapiens
acagcaatcaatatggcattct

SEQ ID NO: 7016999 - DNA, 22 bp, Homo sapiens
ttgcagggcaaatggtcagata

SEQ ID NO: 7017000 - DNA, 22 bp, Homo sapiens
ttgcaagggcatgtgtgcgtgt

SEQ ID NO: 7017001 - DNA, 23 bp, Homo sapiens
gcttgcctggtgtgtggctgacc

SEQ ID NO: 7017002 - DNA, 21 bp, Homo sapiens
aagcccgtagagccaggactc

SEQ ID NO: 7017003 - DNA, 21 bp, Homo sapiens
ttcccatcttttctgagtctg

SEQ ID NO: 7017004 - DNA, 22 bp, Homo sapiens
gaccagaaggaaatgtgagcag

SEQ ID NO: 7017005 - DNA, 22 bp, Homo sapiens
agtgtttatggaatcttagtta

SEQ ID NO: 7017006 - DNA, 18 bp, Homo sapiens
tttgaccctcagtgccat

SEQ ID NO: 7017007 - DNA, 22 bp, Homo sapiens
ctgtgaagtgaatgctcctagt

SEQ ID NO: 7017008 - DNA, 22 bp, Homo sapiens
taagcaaaggattttgatcttt

SEQ ID NO: 7017009 - DNA, 22 bp, Homo sapiens
tcattaaatgtttgttgtgcca

SEQ ID NO: 7017010 - DNA, 22 bp, Homo sapiens
gcagggacatcttcagatcact

SEQ ID NO: 7017011 - DNA, 22 bp, Homo sapiens
agcatggggcaatgcatgtgct

SEQ ID NO: 7017012 - DNA, 22 bp, Homo sapiens
tcttcaggtagtgagtggggtg

SEQ ID NO: 7017013 - DNA, 22 bp, Homo sapiens
aggaatatagttggaatgtagg

SEQ ID NO: 7017014 - DNA, 22 bp, Homo sapiens
gagcagctcgagaaggaagcag

SEQ ID NO: 7017015 - DNA, 22 bp, Homo sapiens
tccttcagttatcacagtactg

SEQ ID NO: 7017016 - DNA, 21 bp, Homo sapiens
aaattagcttcaagttctgca

SEQ ID NO: 7017017 - DNA, 22 bp, Homo sapiens
aaaaccttcaggtttggagttt

SEQ ID NO: 7017018 - DNA, 22 bp, Homo sapiens
gagccgtgccagccctgtctcg

SEQ ID NO: 7017019 - DNA, 22 bp, Homo sapiens
ccagagcccagggtcatgcagg

SEQ ID NO: 7017020 - DNA, 22 bp, Homo sapiens
tgttttgcttctctgtttccca

SEQ ID NO: 7017021 - DNA, 22 bp, Homo sapiens
tttctattgatctaataaacat

SEQ ID NO: 7017022 - DNA, 22 bp, Homo sapiens
cacatttaaaggttgaagctga

SEQ ID NO: 7017023 - DNA, 19 bp, Homo sapiens
atgagctggcatttcaggt

SEQ ID NO: 7017024 - DNA, 22 bp, Homo sapiens
agccttagaggaaaacattagt

SEQ ID NO: 7017025 - DNA, 22 bp, Homo sapiens
atgcacttaaataacataactt

SEQ ID NO: 7017026 - DNA, 22 bp, Homo sapiens
aggctggtgattagaagcagcc

SEQ ID NO: 7017027 - DNA, 22 bp, Homo sapiens
gatttgtctatattcaaatatg

SEQ ID NO: 7017028 - DNA, 22 bp, Homo sapiens
gctctgttagtcattttcatct

SEQ ID NO: 7017029 - DNA, 22 bp, Homo sapiens
tcacctcagagattattttgaa

SEQ ID NO: 7017030 - DNA, 22 bp, Homo sapiens
ctctgggtgtgacagcacctgg

SEQ ID NO: 7017031 - DNA, 22 bp, Homo sapiens
gtgttttctctccagcaggcag

SEQ ID NO: 7017032 - DNA, 21 bp, Homo sapiens
tcagaatctgtgagctatctc

SEQ ID NO: 7017033 - DNA, 22 bp, Homo sapiens
tgaggtaggtggtggcagccat

SEQ ID NO: 7017034 - DNA, 22 bp, Homo sapiens
aaagttagcattctctcttgct

SEQ ID NO: 7017035 - DNA, 22 bp, Homo sapiens
gtcatctgtgcttttggtagga

SEQ ID NO: 7017036 - DNA, 22 bp, Homo sapiens
tgaggaggtcagagtctggctg

SEQ ID NO: 7017037 - DNA, 22 bp, Homo sapiens
atttccttgcaagtttctgtaa

SEQ ID NO: 7017038 - DNA, 22 bp, Homo sapiens
accaggctccccttggatcctg

SEQ ID NO: 7017039 - DNA, 22 bp, Homo sapiens
ctttttcttctaggtgtgcctg

SEQ ID NO: 7017040 - DNA, 22 bp, Homo sapiens
gggtaatggaggaggcagcccc

SEQ ID NO: 7017041 - DNA, 22 bp, Homo sapiens
caggcactggccagtcagcaca

SEQ ID NO: 7017042 - DNA, 23 bp, Homo sapiens
tgaaacatttagggtagaatttc

SEQ ID NO: 7017043 - DNA, 20 bp, Homo sapiens
acatttgtatctcccagtgg

SEQ ID NO: 7017044 - DNA, 22 bp, Homo sapiens
tgtatttattcaggatgtaact

SEQ ID NO: 7017045 - DNA, 20 bp, Homo sapiens
accctccactgttcactgtg

SEQ ID NO: 7017046 - DNA, 19 bp, Homo sapiens
aatttagttcttgtttaga

SEQ ID NO: 7017047 - DNA, 22 bp, Homo sapiens
aggaatagctgttaaagtcaat

SEQ ID NO: 7017048 - DNA, 22 bp, Homo sapiens
tgcagttttgccaggcaatgga

SEQ ID NO: 7017049 - DNA, 22 bp, Homo sapiens
atgtaaacactcactgtgcccc

SEQ ID NO: 7017050 - DNA, 22 bp, Homo sapiens
ggcagcctccagggcactggtg

SEQ ID NO: 7017051 - DNA, 22 bp, Homo sapiens
tgaaccatctggctccagaaga

SEQ ID NO: 7017052 - DNA, 22 bp, Homo sapiens
tgaacctggggctgttgctggt

SEQ ID NO: 7017053 - DNA, 22 bp, Homo sapiens
cagtgggtggctaagtggctga

SEQ ID NO: 7017054 - DNA, 22 bp, Homo sapiens
cagtaggaggttctgaggttct

SEQ ID NO: 7017055 - DNA, 22 bp, Homo sapiens
agcaggctaggaacctcactgc

SEQ ID NO: 7017056 - DNA, 22 bp, Homo sapiens
ctcagtgtcttatttgagttct

SEQ ID NO: 7017057 - DNA, 22 bp, Homo sapiens
tgtcatgtctgtaaatacacca

SEQ ID NO: 7017058 - DNA, 22 bp, Homo sapiens
ttttggtaatgaacttaggaag

SEQ ID NO: 7017059 - DNA, 22 bp, Homo sapiens
aagacaataatttttgggcagg

SEQ ID NO: 7017060 - DNA, 22 bp, Homo sapiens
taacagaagatgaaacttcttt

SEQ ID NO: 7017061 - DNA, 22 bp, Homo sapiens
ttggcagtgactgcgggccccg

SEQ ID NO: 7017062 - DNA, 22 bp, Homo sapiens
gtgtaagaaccttctagagccc

SEQ ID NO: 7017063 - DNA, 22 bp, Homo sapiens
actgatcacagatatgtatatt

SEQ ID NO: 7017064 - DNA, 22 bp, Homo sapiens
agggctctgtccccagaggccc

SEQ ID NO: 7017065 - DNA, 22 bp, Homo sapiens
gtcagttattttgagcaattgg

SEQ ID NO: 7017066 - DNA, 22 bp, Homo sapiens
gcagcactgatcctaaacttag

SEQ ID NO: 7017067 - DNA, 22 bp, Homo sapiens
gtgaggagctgacactggggtg

SEQ ID NO: 7017068 - DNA, 22 bp, Homo sapiens
tggtccagtgacagataggcac

SEQ ID NO: 7017069 - DNA, 22 bp, Homo sapiens
ccaggctgggctacaagttgag

SEQ ID NO: 7017070 - DNA, 22 bp, Homo sapiens
cagttttaaattgttagataat

SEQ ID NO: 7017071 - DNA, 22 bp, Homo sapiens
ggtagaaagcccaagtccccct

SEQ ID NO: 7017072 - DNA, 22 bp, Homo sapiens
agcacattctgccttgctttgc

SEQ ID NO: 7017073 - DNA, 22 bp, Homo sapiens
agtgtagtggcattgacttcgt

SEQ ID NO: 7017074 - DNA, 22 bp, Homo sapiens
gttcacaagatgtggtggggag

SEQ ID NO: 7017075 - DNA, 22 bp, Homo sapiens
aagtcatcactcctctgaactt

SEQ ID NO: 7017076 - DNA, 22 bp, Homo sapiens
ttacccactgagcttcagccct

SEQ ID NO: 7017077 - DNA, 22 bp, Homo sapiens
gagccagcagccggcaccacca

SEQ ID NO: 7017078 - DNA, 16 bp, Homo sapiens
ctcagctaaggagagg

SEQ ID NO: 7017079 - DNA, 22 bp, Homo sapiens
caagtcaactcaaattgttatc

SEQ ID NO: 7017080 - DNA, 22 bp, Homo sapiens
tcctggccgccgcgtggggccg

SEQ ID NO: 7017081 - DNA, 22 bp, Homo sapiens
attacgagaatgaagtatcagg

SEQ ID NO: 7017082 - DNA, 22 bp, Homo sapiens
taggaacacatcctcctctagc

SEQ ID NO: 7017083 - DNA, 22 bp, Homo sapiens
ttgaatgctgttcttggagcta

SEQ ID NO: 7017084 - DNA, 19 bp, Homo sapiens
ttacaggttgacatcaatt

SEQ ID NO: 7017085 - DNA, 22 bp, Homo sapiens
gtgttaaatgcaatcacatgca

SEQ ID NO: 7017086 - DNA, 22 bp, Homo sapiens
ggccttgcggaacgctcaggcg

SEQ ID NO: 7017087 - DNA, 22 bp, Homo sapiens
aggcctggtgaatgaagtatct

SEQ ID NO: 7017088 - DNA, 22 bp, Homo sapiens
aggagccatccccatgagaggt

SEQ ID NO: 7017089 - DNA, 17 bp, Homo sapiens
tcaaagaatgcatgcag

SEQ ID NO: 7017090 - DNA, 23 bp, Homo sapiens
tgacagtgtatttgactatatgg

SEQ ID NO: 7017091 - DNA, 22 bp, Homo sapiens
tctggcagagatatccatccca

SEQ ID NO: 7017092 - DNA, 22 bp, Homo sapiens
tcaggctgtggcttcagttctt

SEQ ID NO: 7017093 - DNA, 22 bp, Homo sapiens
tcacatgcttgaggaaagaaaa

SEQ ID NO: 7017094 - DNA, 22 bp, Homo sapiens
gtttgtcttaattaggcatcga

SEQ ID NO: 7017095 - DNA, 22 bp, Homo sapiens
attctctgtgcagatttaagac

SEQ ID NO: 7017096 - DNA, 22 bp, Homo sapiens
ggctagcaaggtagcagaatgc

SEQ ID NO: 7017097 - DNA, 22 bp, Homo sapiens
cctttattcaattagtcctaat

SEQ ID NO: 7017098 - DNA, 18 bp, Homo sapiens
actgttatctgataaggc

SEQ ID NO: 7017099 - DNA, 22 bp, Homo sapiens
cccattctaagctttgctcttc

SEQ ID NO: 7017100 - DNA, 22 bp, Homo sapiens
gtctagaaatgttctcaggggt

SEQ ID NO: 7017101 - DNA, 22 bp, Homo sapiens
attgtgctttgcatcttgttcc

SEQ ID NO: 7017102 - DNA, 22 bp, Homo sapiens
gccaggactagagggaggtgag

SEQ ID NO: 7017103 - DNA, 22 bp, Homo sapiens
aaatgtgcttcttactctcaat

SEQ ID NO: 7017104 - DNA, 22 bp, Homo sapiens
tatgacagcaaatatccatgag

SEQ ID NO: 7017105 - DNA, 22 bp, Homo sapiens
gctgtctggatatcttggaatt

SEQ ID NO: 7017106 - DNA, 22 bp, Homo sapiens
gagttgctttcctgttaatatc

SEQ ID NO: 7017107 - DNA, 22 bp, Homo sapiens
ggcaattaaagtactgtgaatg

SEQ ID NO: 7017108 - DNA, 22 bp, Homo sapiens
tcaaatcccagctcagcctctc

SEQ ID NO: 7017109 - DNA, 22 bp, Homo sapiens
aaagtcaaggtttagactagag

SEQ ID NO: 7017110 - DNA, 20 bp, Homo sapiens
cagcaggaaaagtgcctcag

SEQ ID NO: 7017111 - DNA, 22 bp, Homo sapiens
tagcttttaagtcataacctca

SEQ ID NO: 7017112 - DNA, 22 bp, Homo sapiens
aattggcagaactttatatatt

SEQ ID NO: 7017113 - DNA, 22 bp, Homo sapiens
gactgggctccaagagggagag

SEQ ID NO: 7017114 - DNA, 22 bp, Homo sapiens
tacggtgacatttaatttatgg

SEQ ID NO: 7017115 - DNA, 22 bp, Homo sapiens
tactgaaaaagaatccagacct

SEQ ID NO: 7017116 - DNA, 22 bp, Homo sapiens
aaattctcaagtgatcctgttg

SEQ ID NO: 7017117 - DNA, 22 bp, Homo sapiens
gggctgctgccaccaggtggat

SEQ ID NO: 7017118 - DNA, 22 bp, Homo sapiens
tccagctgaggtggcctctgtg

SEQ ID NO: 7017119 - DNA, 20 bp, Homo sapiens
gcctgcagagaaggtcagag

SEQ ID NO: 7017120 - DNA, 22 bp, Homo sapiens
aggatgactggaacccaagtga

SEQ ID NO: 7017121 - DNA, 22 bp, Homo sapiens
ccttccaggtgcaggcaagcct

SEQ ID NO: 7017122 - DNA, 22 bp, Homo sapiens
tcttggcttttcccctatggtc

SEQ ID NO: 7017123 - DNA, 22 bp, Homo sapiens
cctgctggcgcttgtctgggag

SEQ ID NO: 7017124 - DNA, 22 bp, Homo sapiens
ggcgagcagcgctgtgtcaggt

SEQ ID NO: 7017125 - DNA, 22 bp, Homo sapiens
acttacaatcaaccaccttgga

SEQ ID NO: 7017126 - DNA, 22 bp, Homo sapiens
tggggtgggcatgcgctgtcct

SEQ ID NO: 7017127 - DNA, 22 bp, Homo sapiens
tcaggtagtggttaagttctgt

SEQ ID NO: 7017128 - DNA, 22 bp, Homo sapiens
tgcatagtcgctctgtgcttca

SEQ ID NO: 7017129 - DNA, 22 bp, Homo sapiens
cagcttcattgcctgatgtctt

SEQ ID NO: 7017130 - DNA, 22 bp, Homo sapiens
cctgctcctatctgggctcatt

SEQ ID NO: 7017131 - DNA, 22 bp, Homo sapiens
atcttgggacatgtgctctggg

SEQ ID NO: 7017132 - DNA, 22 bp, Homo sapiens
tggagggcatgctgtccatggg

SEQ ID NO: 7017133 - DNA, 23 bp, Homo sapiens
ttctgggttgctgtgcttggaat

SEQ ID NO: 7017134 - DNA, 22 bp, Homo sapiens
gcaagggcatggctctgatcaa

SEQ ID NO: 7017135 - DNA, 22 bp, Homo sapiens
aggaggtagtcttataaatgtt

SEQ ID NO: 7017136 - DNA, 22 bp, Homo sapiens
gatggcagtgggcctcgagtcc

SEQ ID NO: 7017137 - DNA, 21 bp, Homo sapiens
tcagaggctgggggaatgccc

SEQ ID NO: 7017138 - DNA, 22 bp, Homo sapiens
aagtgcttggctaatggttatg

SEQ ID NO: 7017139 - DNA, 22 bp, Homo sapiens
ggtactacatggttggctgggg

SEQ ID NO: 7017140 - DNA, 23 bp, Homo sapiens
tcaccagaaggggtcaataaaga

SEQ ID NO: 7017141 - DNA, 22 bp, Homo sapiens
tctatctgggagttccccatta

SEQ ID NO: 7017142 - DNA, 22 bp, Homo sapiens
atgccccagtgtgtgcttcctt

SEQ ID NO: 7017143 - DNA, 22 bp, Homo sapiens
tccagtctggagccttctggtt

SEQ ID NO: 7017144 - DNA, 22 bp, Homo sapiens
aatgtgactgaatatttactct

SEQ ID NO: 7017145 - DNA, 18 bp, Homo sapiens
ggtggctcagtcatgggg

SEQ ID NO: 7017146 - DNA, 22 bp, Homo sapiens
taagacaaatactatttcaaga

SEQ ID NO: 7017147 - DNA, 22 bp, Homo sapiens
gagggggcgtgcaaggctccgc

SEQ ID NO: 7017148 - DNA, 22 bp, Homo sapiens
tacagcttcagtgtgccccagt

SEQ ID NO: 7017149 - DNA, 22 bp, Homo sapiens
tggttactctaggtggctgtaa

SEQ ID NO: 7017150 - DNA, 22 bp, Homo sapiens
ggcagtcacttttgcttgtgcc

SEQ ID NO: 7017151 - DNA, 22 bp, Homo sapiens
aagtaacatgggaacatctgaa

SEQ ID NO: 7017152 - DNA, 22 bp, Homo sapiens
tggccttcctggtgactcatga

SEQ ID NO: 7017153 - DNA, 22 bp, Homo sapiens
agatttcaatgtgagcattagt

SEQ ID NO: 7017154 - DNA, 22 bp, Homo sapiens
agtcacttaacatttgctgcag

SEQ ID NO: 7017155 - DNA, 22 bp, Homo sapiens
atgttggccaggctggtcttga

SEQ ID NO: 7017156 - DNA, 22 bp, Homo sapiens
ggtgtgcaggctatcacagaca

SEQ ID NO: 7017157 - DNA, 22 bp, Homo sapiens
gcattccttgagttccctgtgc

SEQ ID NO: 7017158 - DNA, 22 bp, Homo sapiens
tcaggagaaaatatcaggaagt

SEQ ID NO: 7017159 - DNA, 20 bp, Homo sapiens
tcaagacagacatggagttt

SEQ ID NO: 7017160 - DNA, 22 bp, Homo sapiens
gagatgtacaatgtgtattaat

SEQ ID NO: 7017161 - DNA, 22 bp, Homo sapiens
ctgagaaaagacatttctagat

SEQ ID NO: 7017162 - DNA, 22 bp, Homo sapiens
tgtgtgtcactgaaagaaatct

SEQ ID NO: 7017163 - DNA, 22 bp, Homo sapiens
agcacctgtgtgagctagatgt

SEQ ID NO: 7017164 - DNA, 22 bp, Homo sapiens
aggaagctcattttgacatatc

SEQ ID NO: 7017165 - DNA, 22 bp, Homo sapiens
ctgtacaagtccttcatcaggg

SEQ ID NO: 7017166 - DNA, 22 bp, Homo sapiens
caggggggcaggagtcattgat

SEQ ID NO: 7017167 - DNA, 22 bp, Homo sapiens
gaggggtggcgttggcatttag

SEQ ID NO: 7017168 - DNA, 22 bp, Homo sapiens
aggatggcgattcgagcacctc

SEQ ID NO: 7017169 - DNA, 22 bp, Homo sapiens
ctgaccttcccaggggctggaa

SEQ ID NO: 7017170 - DNA, 22 bp, Homo sapiens
ggatttccagcttcattgtcta

SEQ ID NO: 7017171 - DNA, 22 bp, Homo sapiens
ggtaactgcagaatgtgcctca

SEQ ID NO: 7017172 - DNA, 22 bp, Homo sapiens
attgggctctactgaagggagg

SEQ ID NO: 7017173 - DNA, 22 bp, Homo sapiens
taatagcattatcatcaaaact

SEQ ID NO: 7017174 - DNA, 22 bp, Homo sapiens
gtggcattgccttctgcaggaa

SEQ ID NO: 7017175 - DNA, 18 bp, Homo sapiens
gccagtgggtccaggtgc

SEQ ID NO: 7017176 - DNA, 22 bp, Homo sapiens
tggcaaagctagacattccctc

SEQ ID NO: 7017177 - DNA, 22 bp, Homo sapiens
atacagtgccccttttcacatg

SEQ ID NO: 7017178 - DNA, 22 bp, Homo sapiens
ccagaggtgggagtgatctggt

SEQ ID NO: 7017179 - DNA, 22 bp, Homo sapiens
gctttatgtaagtccaaaggca

SEQ ID NO: 7017180 - DNA, 20 bp, Homo sapiens
agggcccaggaagagagtta

SEQ ID NO: 7017181 - DNA, 23 bp, Homo sapiens
gatgaggacctacaggtggccag

SEQ ID NO: 7017182 - DNA, 22 bp, Homo sapiens
ctgcagagctttctgaatgaag

SEQ ID NO: 7017183 - DNA, 22 bp, Homo sapiens
gcctggcccagggctcttgttg

SEQ ID NO: 7017184 - DNA, 22 bp, Homo sapiens
cacagaagaatcatgctgtgtt

SEQ ID NO: 7017185 - DNA, 22 bp, Homo sapiens
gacaatgtgaggcgagtttgtt

SEQ ID NO: 7017186 - DNA, 22 bp, Homo sapiens
agctgaggcctgatttcgccgt

SEQ ID NO: 7017187 - DNA, 22 bp, Homo sapiens
ttacacttacctgtccattgaa

SEQ ID NO: 7017188 - DNA, 22 bp, Homo sapiens
atgacactcgaaaaattgatgc

SEQ ID NO: 7017189 - DNA, 22 bp, Homo sapiens
tcattgttactgtttagttgcc

SEQ ID NO: 7017190 - DNA, 22 bp, Homo sapiens
aagagagagtgcgctcacagaa

SEQ ID NO: 7017191 - DNA, 22 bp, Homo sapiens
aagacacagcgaaatgttcctg

SEQ ID NO: 7017192 - DNA, 22 bp, Homo sapiens
tcagcccaggaggttgagacta

SEQ ID NO: 7017193 - DNA, 22 bp, Homo sapiens
taggaaataaatacttatggtt

SEQ ID NO: 7017194 - DNA, 20 bp, Homo sapiens
tcagctcttagaggtcgctt

SEQ ID NO: 7017195 - DNA, 18 bp, Homo sapiens
gggtgcaggcactgactg

SEQ ID NO: 7017196 - DNA, 22 bp, Homo sapiens
ctctgcttgtatcacatttgct

SEQ ID NO: 7017197 - DNA, 22 bp, Homo sapiens
cacattcatcagtgttgtactg

SEQ ID NO: 7017198 - DNA, 22 bp, Homo sapiens
cctgggctttcggcggcttcct

SEQ ID NO: 7017199 - DNA, 22 bp, Homo sapiens
ctgcacacatcgcactgcccgt

SEQ ID NO: 7017200 - DNA, 22 bp, Homo sapiens
ttcggcttgggtatttctcagg

SEQ ID NO: 7017201 - DNA, 22 bp, Homo sapiens
aagtttggggagaatttcattt

SEQ ID NO: 7017202 - DNA, 22 bp, Homo sapiens
ggaactcctgctccaagcagct

SEQ ID NO: 7017203 - DNA, 22 bp, Homo sapiens
catataattacctaccagctgg

SEQ ID NO: 7017204 - DNA, 22 bp, Homo sapiens
tcctggctgccgtcgtcctgcg

SEQ ID NO: 7017205 - DNA, 22 bp, Homo sapiens
ctcagtgtctggggccccaggg

SEQ ID NO: 7017206 - DNA, 22 bp, Homo sapiens
tggtcgaccagttggaaagtaa

SEQ ID NO: 7017207 - DNA, 22 bp, Homo sapiens
tcctccagctgtatcctgcctg

SEQ ID NO: 7017208 - DNA, 22 bp, Homo sapiens
ggtggagctgtgagtagaatct

SEQ ID NO: 7017209 - DNA, 20 bp, Homo sapiens
gaaatgtctatgataatgat

SEQ ID NO: 7017210 - DNA, 22 bp, Homo sapiens
caaagctataaattcagacaga

SEQ ID NO: 7017211 - DNA, 22 bp, Homo sapiens
ggatgtttggcgtttgaattgc

SEQ ID NO: 7017212 - DNA, 22 bp, Homo sapiens
ttgtcctgtcaggctgggggct

SEQ ID NO: 7017213 - DNA, 22 bp, Homo sapiens
gaatcagaatctctggggttgg

SEQ ID NO: 7017214 - DNA, 22 bp, Homo sapiens
ctgggagcctggcagttgctga

SEQ ID NO: 7017215 - DNA, 22 bp, Homo sapiens
acatgtttaagtttaatgaaaa

SEQ ID NO: 7017216 - DNA, 22 bp, Homo sapiens
tagatttgaatgatgtaaagag

SEQ ID NO: 7017217 - DNA, 22 bp, Homo sapiens
tcaggctaacggcatattgcct

SEQ ID NO: 7017218 - DNA, 22 bp, Homo sapiens
acctgtgggcagaacctagtgc

SEQ ID NO: 7017219 - DNA, 22 bp, Homo sapiens
tccagggcatggggagagagtg

SEQ ID NO: 7017220 - DNA, 22 bp, Homo sapiens
gtatttcctcgcttgtgggatt

SEQ ID NO: 7017221 - DNA, 22 bp, Homo sapiens
taggcagagtttaatggttaag

SEQ ID NO: 7017222 - DNA, 22 bp, Homo sapiens
aactctttgaacagtgaggcta

SEQ ID NO: 7017223 - DNA, 22 bp, Homo sapiens
tttagtagaaatatttgggcct

SEQ ID NO: 7017224 - DNA, 22 bp, Homo sapiens
tctacttttccctatacagttt

SEQ ID NO: 7017225 - DNA, 15 bp, Homo sapiens
atacacatgagggag

SEQ ID NO: 7017226 - DNA, 22 bp, Homo sapiens
tgcagtctcaccagacctattt

SEQ ID NO: 7017227 - DNA, 22 bp, Homo sapiens
actgccttgaaagattgttgag

SEQ ID NO: 7017228 - DNA, 22 bp, Homo sapiens
actcttgactccatggtgttag

SEQ ID NO: 7017229 - DNA, 22 bp, Homo sapiens
tacagttagcctgtctactccc

SEQ ID NO: 7017230 - DNA, 22 bp, Homo sapiens
tattgtttctggctgtggcagc

SEQ ID NO: 7017231 - DNA, 22 bp, Homo sapiens
cagtattttccttgttaactta

SEQ ID NO: 7017232 - DNA, 22 bp, Homo sapiens
cagtgtgtagaaggccgattta

SEQ ID NO: 7017233 - DNA, 22 bp, Homo sapiens
tcagggggaggagactgccagt

SEQ ID NO: 7017234 - DNA, 22 bp, Homo sapiens
tagcagtggttcctacgtgttg

SEQ ID NO: 7017235 - DNA, 22 bp, Homo sapiens
tgcataaagaaagcctggagag

SEQ ID NO: 7017236 - DNA, 22 bp, Homo sapiens
ggggaccttcccagagcagttg

SEQ ID NO: 7017237 - DNA, 22 bp, Homo sapiens
caactgcacaccaagcttgtgt

SEQ ID NO: 7017238 - DNA, 22 bp, Homo sapiens
cccaggaggtgtagctgcgtgg

SEQ ID NO: 7017239 - DNA, 22 bp, Homo sapiens
gagacagcagggccagggcctg

SEQ ID NO: 7017240 - DNA, 22 bp, Homo sapiens
gggctatggccacctggaccca

SEQ ID NO: 7017241 - DNA, 22 bp, Homo sapiens
caaagagctgttcagtgtcgct

SEQ ID NO: 7017242 - DNA, 22 bp, Homo sapiens
ttctcaggtgaggctgaggctg

SEQ ID NO: 7017243 - DNA, 22 bp, Homo sapiens
agccaataaatttacaactaga

SEQ ID NO: 7017244 - DNA, 22 bp, Homo sapiens
actgaacttggtgaatgccaca

SEQ ID NO: 7017245 - DNA, 21 bp, Homo sapiens
gcctgaccttactactggggt

SEQ ID NO: 7017246 - DNA, 22 bp, Homo sapiens
ttattctgttgcttttacagta

SEQ ID NO: 7017247 - DNA, 22 bp, Homo sapiens
tccttggagaatcttgttttac

SEQ ID NO: 7017248 - DNA, 22 bp, Homo sapiens
gccctttgtggtcagaggcctg

SEQ ID NO: 7017249 - DNA, 22 bp, Homo sapiens
tgaggattaaatgagctaataa

SEQ ID NO: 7017250 - DNA, 17 bp, Homo sapiens
agagcatgtgtaggagc

SEQ ID NO: 7017251 - DNA, 22 bp, Homo sapiens
aggggccatgtaagtgtatcac

SEQ ID NO: 7017252 - DNA, 22 bp, Homo sapiens
tgctgccacccctcaccagagc

SEQ ID NO: 7017253 - DNA, 22 bp, Homo sapiens
aaagtcatcatttcttttcaaa

SEQ ID NO: 7017254 - DNA, 22 bp, Homo sapiens
acttccagacctgtgcttgctc

SEQ ID NO: 7017255 - DNA, 22 bp, Homo sapiens
tcgctcaggcttgagtgtagtg

SEQ ID NO: 7017256 - DNA, 22 bp, Homo sapiens
ctctttagtctgtgtggagaag

SEQ ID NO: 7017257 - DNA, 22 bp, Homo sapiens
aacacaatcttccagtttgctg

SEQ ID NO: 7017258 - DNA, 19 bp, Homo sapiens
ggataaggttggagtgatc

SEQ ID NO: 7017259 - DNA, 21 bp, Homo sapiens
ctcaaaattctttctgttgga

SEQ ID NO: 7017260 - DNA, 21 bp, Homo sapiens
aggaaaggaagtccccagggt

SEQ ID NO: 7017261 - DNA, 22 bp, Homo sapiens
ttgcagtaggtggagtgaattt

SEQ ID NO: 7017262 - DNA, 22 bp, Homo sapiens
gttttgttgctgcagagctcaa

SEQ ID NO: 7017263 - DNA, 22 bp, Homo sapiens
tcttcagcagagaattatgatg

SEQ ID NO: 7017264 - DNA, 22 bp, Homo sapiens
taaagacatgcaaagtctaatt

SEQ ID NO: 7017265 - DNA, 22 bp, Homo sapiens
agagtttggattttaggacatc

SEQ ID NO: 7017266 - DNA, 22 bp, Homo sapiens
aagacctgcacagtttaccatt

SEQ ID NO: 7017267 - DNA, 22 bp, Homo sapiens
ataatgtaggtatgtgtattta

SEQ ID NO: 7017268 - DNA, 21 bp, Homo sapiens
tttcaatgtgttctttgtagt

SEQ ID NO: 7017269 - DNA, 22 bp, Homo sapiens
gactgcttctccttggtaggtt

SEQ ID NO: 7017270 - DNA, 22 bp, Homo sapiens
aatatgagtttgcctttcctgc

SEQ ID NO: 7017271 - DNA, 22 bp, Homo sapiens
atctacactataacagaatgct

SEQ ID NO: 7017272 - DNA, 22 bp, Homo sapiens
tggccttgtgtttaagcaagaa

SEQ ID NO: 7017273 - DNA, 22 bp, Homo sapiens
tgtacctggagagctcttggcc

SEQ ID NO: 7017274 - DNA, 22 bp, Homo sapiens
ctgccctgggtgctggggatcc

SEQ ID NO: 7017275 - DNA, 20 bp, Homo sapiens
ttctaaggttttggtgcaca

SEQ ID NO: 7017276 - DNA, 22 bp, Homo sapiens
cagtttcagaatcaaaacatca

SEQ ID NO: 7017277 - DNA, 22 bp, Homo sapiens
tggggactgacagccaggcctc

SEQ ID NO: 7017278 - DNA, 19 bp, Homo sapiens
ctggagatagggcctttaa

SEQ ID NO: 7017279 - DNA, 22 bp, Homo sapiens
ctggggaggcagggctgcccct

SEQ ID NO: 7017280 - DNA, 22 bp, Homo sapiens
ctccaaggtggttatttgagat

SEQ ID NO: 7017281 - DNA, 22 bp, Homo sapiens
gaaaaatgagctgatgtcaggg

SEQ ID NO: 7017282 - DNA, 22 bp, Homo sapiens
ctcctgctgaatggccaggagc

SEQ ID NO: 7017283 - DNA, 22 bp, Homo sapiens
aagggagatagttcgccatggg

SEQ ID NO: 7017284 - DNA, 22 bp, Homo sapiens
ttgctctgaacccagggcacca

SEQ ID NO: 7017285 - DNA, 22 bp, Homo sapiens
tgacaaagacaaagatatgtcc

SEQ ID NO: 7017286 - DNA, 22 bp, Homo sapiens
accaaaggctatgggacctgcc

SEQ ID NO: 7017287 - DNA, 21 bp, Homo sapiens
gcagagccggggcgagaaggc

SEQ ID NO: 7017288 - DNA, 20 bp, Homo sapiens
atggctctgtttggcagtga

SEQ ID NO: 7017289 - DNA, 22 bp, Homo sapiens
tgtgacatgcaggaggtgctca

SEQ ID NO: 7017290 - DNA, 22 bp, Homo sapiens
actgtgtcctcatgtggcagaa

SEQ ID NO: 7017291 - DNA, 20 bp, Homo sapiens
ggcccagtgaaccaggacgg

SEQ ID NO: 7017292 - DNA, 22 bp, Homo sapiens
ttgctgtgtcatttgtttaatc

SEQ ID NO: 7017293 - DNA, 22 bp, Homo sapiens
cggagcagaaggcgccgccggc

SEQ ID NO: 7017294 - DNA, 22 bp, Homo sapiens
gccctgcctgtctgctgggagg

SEQ ID NO: 7017295 - DNA, 22 bp, Homo sapiens
aaggaacctggagtagagggag

SEQ ID NO: 7017296 - DNA, 22 bp, Homo sapiens
actcatgtcatgtgttctttac

SEQ ID NO: 7017297 - DNA, 22 bp, Homo sapiens
tacatgtaattttcatagtaag

SEQ ID NO: 7017298 - DNA, 22 bp, Homo sapiens
tgattcctaggcactcttctcc

SEQ ID NO: 7017299 - DNA, 22 bp, Homo sapiens
aactgcttcacttggcatttgg

SEQ ID NO: 7017300 - DNA, 22 bp, Homo sapiens
ggcctgtgggaggacagctggg

SEQ ID NO: 7017301 - DNA, 22 bp, Homo sapiens
tttcagtttgaaggaaaggcca

SEQ ID NO: 7017302 - DNA, 22 bp, Homo sapiens
gaagttctggtgtatgtgataa

SEQ ID NO: 7017303 - DNA, 22 bp, Homo sapiens
ccagggtcacaaataactgcag

SEQ ID NO: 7017304 - DNA, 21 bp, Homo sapiens
tcttcccattatgttccaatt

SEQ ID NO: 7017305 - DNA, 22 bp, Homo sapiens
ctggttcccagcaggagtgtag

SEQ ID NO: 7017306 - DNA, 22 bp, Homo sapiens
aacagctttgagcagttctgta

SEQ ID NO: 7017307 - DNA, 22 bp, Homo sapiens
gccagcagctcttgggcgggca

SEQ ID NO: 7017308 - DNA, 22 bp, Homo sapiens
gcctgggagaatgacctccaac

SEQ ID NO: 7017309 - DNA, 22 bp, Homo sapiens
attttaaggcttatttaaaggc

SEQ ID NO: 7017310 - DNA, 22 bp, Homo sapiens
gaattgtatgctgtcttgatag

SEQ ID NO: 7017311 - DNA, 22 bp, Homo sapiens
ttcacagtgctcacagttcagt

SEQ ID NO: 7017312 - DNA, 18 bp, Homo sapiens
caggtgggtctcctgccc

SEQ ID NO: 7017313 - DNA, 22 bp, Homo sapiens
ggttttaaccattcacaagtga

SEQ ID NO: 7017314 - DNA, 22 bp, Homo sapiens
tttaaataggactcctgggggt

SEQ ID NO: 7017315 - DNA, 22 bp, Homo sapiens
gtgctttaggtgtttggctgaa

SEQ ID NO: 7017316 - DNA, 22 bp, Homo sapiens
aggtgattcaactgtgcagtga

SEQ ID NO: 7017317 - DNA, 18 bp, Homo sapiens
ctgcttgggagacgtcag

SEQ ID NO: 7017318 - DNA, 18 bp, Homo sapiens
tctcataaaggggtgtgt

SEQ ID NO: 7017319 - DNA, 22 bp, Homo sapiens
attcaataagtcactgtggaat

SEQ ID NO: 7017320 - DNA, 22 bp, Homo sapiens
actatgctcattgttaatattt

SEQ ID NO: 7017321 - DNA, 22 bp, Homo sapiens
tcctgatgatattgctctttct

SEQ ID NO: 7017322 - DNA, 22 bp, Homo sapiens
aattccagaccacaagtgattt

SEQ ID NO: 7017323 - DNA, 22 bp, Homo sapiens
taggggaagtctcagaatgcag

SEQ ID NO: 7017324 - DNA, 22 bp, Homo sapiens
cagctgacgccagagtggaatt

SEQ ID NO: 7017325 - DNA, 22 bp, Homo sapiens
ccagatagcaggtcagaagtgc

SEQ ID NO: 7017326 - DNA, 22 bp, Homo sapiens
tagtttagacttcaaccctttg

SEQ ID NO: 7017327 - DNA, 23 bp, Homo sapiens
tgcacttctccatagatgcatct

SEQ ID NO: 7017328 - DNA, 22 bp, Homo sapiens
ttatctgttttctgtgcgtttc

SEQ ID NO: 7017329 - DNA, 22 bp, Homo sapiens
gtctatgatattttgttatagc

SEQ ID NO: 7017330 - DNA, 23 bp, Homo sapiens
ggacagtagtgtggtatttagaa

SEQ ID NO: 7017331 - DNA, 22 bp, Homo sapiens
tggagatgcctggagattaggg

SEQ ID NO: 7017332 - DNA, 22 bp, Homo sapiens
ctgtggcttcagcattcagagc

SEQ ID NO: 7017333 - DNA, 22 bp, Homo sapiens
ggaatactatgacacacaggtg

SEQ ID NO: 7017334 - DNA, 22 bp, Homo sapiens
gcatggagaagtgggaacaggt

SEQ ID NO: 7017335 - DNA, 22 bp, Homo sapiens
tttgtgcattcaagtaggagcc

SEQ ID NO: 7017336 - DNA, 22 bp, Homo sapiens
ctcaggctggtccttagtgaca

SEQ ID NO: 7017337 - DNA, 22 bp, Homo sapiens
tttctatatgaggagctaaagt

SEQ ID NO: 7017338 - DNA, 22 bp, Homo sapiens
atgctgaagagtgcacaggcta

SEQ ID NO: 7017339 - DNA, 22 bp, Homo sapiens
tgttcttttctctaaactgata

SEQ ID NO: 7017340 - DNA, 22 bp, Homo sapiens
gaggcctggtgtgtctcccgct

SEQ ID NO: 7017341 - DNA, 22 bp, Homo sapiens
ctgtgtcccacacgaggtgtat

SEQ ID NO: 7017342 - DNA, 22 bp, Homo sapiens
ttgagaaatgttttttaagctg

SEQ ID NO: 7017343 - DNA, 22 bp, Homo sapiens
gctggagtgctggagtgcagtg

SEQ ID NO: 7017344 - DNA, 22 bp, Homo sapiens
cctgccatgccagcatgcccgt

SEQ ID NO: 7017345 - DNA, 22 bp, Homo sapiens
atctgctgtcacatgtttgaag

SEQ ID NO: 7017346 - DNA, 22 bp, Homo sapiens
ttattcacttcttggtccctca

SEQ ID NO: 7017347 - DNA, 20 bp, Homo sapiens
atggcctgctagaagtctgt

SEQ ID NO: 7017348 - DNA, 22 bp, Homo sapiens
gtttccaagtctctcaacaccc

SEQ ID NO: 7017349 - DNA, 22 bp, Homo sapiens
gtgccctgatcgctaggctccc

SEQ ID NO: 7017350 - DNA, 22 bp, Homo sapiens
tttacaacgttcctggtgctaa

SEQ ID NO: 7017351 - DNA, 22 bp, Homo sapiens
tgtttacatgcataagcttaag

SEQ ID NO: 7017352 - DNA, 22 bp, Homo sapiens
tgccctcttaggtctgcgcagc

SEQ ID NO: 7017353 - DNA, 22 bp, Homo sapiens
aaagttttattcaagcattagt

SEQ ID NO: 7017354 - DNA, 22 bp, Homo sapiens
ggagagagacctccatgcccag

SEQ ID NO: 7017355 - DNA, 19 bp, Homo sapiens
agtgttctgagtactcctc

SEQ ID NO: 7017356 - DNA, 22 bp, Homo sapiens
tttctgtcatagttatctttgt

SEQ ID NO: 7017357 - DNA, 22 bp, Homo sapiens
atgtacaatctagggtttgcat

SEQ ID NO: 7017358 - DNA, 22 bp, Homo sapiens
agattctactctagatccatgg

SEQ ID NO: 7017359 - DNA, 22 bp, Homo sapiens
ttctgcacagtcactcctggct

SEQ ID NO: 7017360 - DNA, 22 bp, Homo sapiens
gctggcacaggtggatgctggc

SEQ ID NO: 7017361 - DNA, 22 bp, Homo sapiens
aatgaaactatatttagagagg

SEQ ID NO: 7017362 - DNA, 22 bp, Homo sapiens
tcaggatgaagtcagaggggtc

SEQ ID NO: 7017363 - DNA, 22 bp, Homo sapiens
actttgatagtttaatctagga

SEQ ID NO: 7017364 - DNA, 22 bp, Homo sapiens
tgctccctgctcagagaggcca

SEQ ID NO: 7017365 - DNA, 22 bp, Homo sapiens
agcagagtcttcaagggcaggc

SEQ ID NO: 7017366 - DNA, 22 bp, Homo sapiens
cacatggtggtgcttgataagc

SEQ ID NO: 7017367 - DNA, 22 bp, Homo sapiens
tggcagagagagtgcagtcgac

SEQ ID NO: 7017368 - DNA, 21 bp, Homo sapiens
gggtggtctgctgaagaggga

SEQ ID NO: 7017369 - DNA, 22 bp, Homo sapiens
gtgcataaatagcagagctgtg

SEQ ID NO: 7017370 - DNA, 22 bp, Homo sapiens
atgggaggatcacttgaggcca

SEQ ID NO: 7017371 - DNA, 22 bp, Homo sapiens
gtcgggtagtgctggaaggatt

SEQ ID NO: 7017372 - DNA, 22 bp, Homo sapiens
ccttggcatcctctgaagaaat

SEQ ID NO: 7017373 - DNA, 22 bp, Homo sapiens
ttgcctgggctagtaagccaga

SEQ ID NO: 7017374 - DNA, 22 bp, Homo sapiens
agcaaagcagtggctaagctga

SEQ ID NO: 7017375 - DNA, 22 bp, Homo sapiens
aacactgaaatgtcttaagatt

SEQ ID NO: 7017376 - DNA, 22 bp, Homo sapiens
gacataaatgaagtttgactat

SEQ ID NO: 7017377 - DNA, 22 bp, Homo sapiens
atcggcttaaggcgcaccctct

SEQ ID NO: 7017378 - DNA, 22 bp, Homo sapiens
ccctggagcatctctgctgtct

SEQ ID NO: 7017379 - DNA, 22 bp, Homo sapiens
accaagtgagtacttggcagaa

SEQ ID NO: 7017380 - DNA, 22 bp, Homo sapiens
gtggaagcctaagagtagggag

SEQ ID NO: 7017381 - DNA, 22 bp, Homo sapiens
aacactttggatgcagaaccaa

SEQ ID NO: 7017382 - DNA, 22 bp, Homo sapiens
gatgattacacttttaaaacag

SEQ ID NO: 7017383 - DNA, 22 bp, Homo sapiens
atttcaggccaccagatgtctt

SEQ ID NO: 7017384 - DNA, 22 bp, Homo sapiens
tcagcaaggctgcattctcatc

SEQ ID NO: 7017385 - DNA, 22 bp, Homo sapiens
tgggctgtggagaggagctgga

SEQ ID NO: 7017386 - DNA, 22 bp, Homo sapiens
cctgggatgaaagcagcccact

SEQ ID NO: 7017387 - DNA, 19 bp, Homo sapiens
tattctgttaacctttgtc

SEQ ID NO: 7017388 - DNA, 22 bp, Homo sapiens
ccagaaagttcagctgtgaatg

SEQ ID NO: 7017389 - DNA, 20 bp, Homo sapiens
ctccagtgttcaggggagtg

SEQ ID NO: 7017390 - DNA, 22 bp, Homo sapiens
tatgaaaaggtggccaatgtag

SEQ ID NO: 7017391 - DNA, 22 bp, Homo sapiens
cggtctgagagcaggagaaggg

SEQ ID NO: 7017392 - DNA, 22 bp, Homo sapiens
atgcaggtaaccacacttcaca

SEQ ID NO: 7017393 - DNA, 22 bp, Homo sapiens
acgaggtatcacattgcatctc

SEQ ID NO: 7017394 - DNA, 22 bp, Homo sapiens
tcacagctggacacgttggcat

SEQ ID NO: 7017395 - DNA, 22 bp, Homo sapiens
attactatgatttgatcattac

SEQ ID NO: 7017396 - DNA, 19 bp, Homo sapiens
ccagcctctcttccacccc

SEQ ID NO: 7017397 - DNA, 22 bp, Homo sapiens
aacccaggaggcagaggctgca

SEQ ID NO: 7017398 - DNA, 22 bp, Homo sapiens
gtcagagttccaaattaatcaa

SEQ ID NO: 7017399 - DNA, 22 bp, Homo sapiens
atgtatgcatgctacagttttc

SEQ ID NO: 7017400 - DNA, 22 bp, Homo sapiens
aatttcaaactaataggaacca

SEQ ID NO: 7017401 - DNA, 22 bp, Homo sapiens
agtgtattatgcagcggaggtc

SEQ ID NO: 7017402 - DNA, 22 bp, Homo sapiens
tgaattcttcccctgcaccaac

SEQ ID NO: 7017403 - DNA, 22 bp, Homo sapiens
aagacagcattgctgagggctt

SEQ ID NO: 7017404 - DNA, 23 bp, Homo sapiens
agcattagagatgccagccctgt

SEQ ID NO: 7017405 - DNA, 22 bp, Homo sapiens
tggcactggcgcaggatggcgg

SEQ ID NO: 7017406 - DNA, 22 bp, Homo sapiens
ctctttctggaaggcagagtgg

SEQ ID NO: 7017407 - DNA, 22 bp, Homo sapiens
ggagcccttgctgaccttccaa

SEQ ID NO: 7017408 - DNA, 22 bp, Homo sapiens
aaactgcaattacttttgcagc

SEQ ID NO: 7017409 - DNA, 22 bp, Homo sapiens
tcttctgaaggtaggaagcatt

SEQ ID NO: 7017410 - DNA, 22 bp, Homo sapiens
aggctagtagctgaatgaactt

SEQ ID NO: 7017411 - DNA, 22 bp, Homo sapiens
ccagagctgagggagcctgagc

SEQ ID NO: 7017412 - DNA, 22 bp, Homo sapiens
aagggccattgctgagagcagt

SEQ ID NO: 7017413 - DNA, 22 bp, Homo sapiens
agctgggaggctcctctgtgac

SEQ ID NO: 7017414 - DNA, 22 bp, Homo sapiens
tatctatgtggtgatcttattt

SEQ ID NO: 7017415 - DNA, 22 bp, Homo sapiens
cttaataaatggtagctgttat

SEQ ID NO: 7017416 - DNA, 22 bp, Homo sapiens
cccacccactctgaccagaagc

SEQ ID NO: 7017417 - DNA, 19 bp, Homo sapiens
tgaacgatgtctcagggca

SEQ ID NO: 7017418 - DNA, 18 bp, Homo sapiens
tggctctgcagccagatg

SEQ ID NO: 7017419 - DNA, 22 bp, Homo sapiens
tctccacaagctgatgctagga

SEQ ID NO: 7017420 - DNA, 22 bp, Homo sapiens
ttcacagcttaataaggctcag

SEQ ID NO: 7017421 - DNA, 22 bp, Homo sapiens
aggtctgagaactacctatagg

SEQ ID NO: 7017422 - DNA, 22 bp, Homo sapiens
aagcagaagttgatctaccata

SEQ ID NO: 7017423 - DNA, 22 bp, Homo sapiens
aggctcattcttgcctctgagc

SEQ ID NO: 7017424 - DNA, 19 bp, Homo sapiens
aagtagtcatcccattctt

SEQ ID NO: 7017425 - DNA, 22 bp, Homo sapiens
tgacaggatgatgagcaggggg

SEQ ID NO: 7017426 - DNA, 22 bp, Homo sapiens
cactttctcatgaatttggccc

SEQ ID NO: 7017427 - DNA, 22 bp, Homo sapiens
ggggccaagggaatgtattgtg

SEQ ID NO: 7017428 - DNA, 22 bp, Homo sapiens
ggatggtcagaggaccaaatac

SEQ ID NO: 7017429 - DNA, 23 bp, Homo sapiens
gggaccaggcccttcctggtttg

SEQ ID NO: 7017430 - DNA, 22 bp, Homo sapiens
tttggcagagtcatttcagaaa

SEQ ID NO: 7017431 - DNA, 22 bp, Homo sapiens
actgagcctgtgccctcatcag

SEQ ID NO: 7017432 - DNA, 22 bp, Homo sapiens
gaagatttcagttaagtatcta

SEQ ID NO: 7017433 - DNA, 22 bp, Homo sapiens
acaagatactcagctacaagac

SEQ ID NO: 7017434 - DNA, 22 bp, Homo sapiens
tgctaggcattgtctgggagta

SEQ ID NO: 7017435 - DNA, 22 bp, Homo sapiens
gctcagggaaagagctcctgtc

SEQ ID NO: 7017436 - DNA, 22 bp, Homo sapiens
acatctctccaaaggaaggtgc

SEQ ID NO: 7017437 - DNA, 22 bp, Homo sapiens
cagtccagtccaatcctcaatg

SEQ ID NO: 7017438 - DNA, 22 bp, Homo sapiens
ggggcctgcgaggttcaacttc

SEQ ID NO: 7017439 - DNA, 22 bp, Homo sapiens
agagccagttacaactgtggag

SEQ ID NO: 7017440 - DNA, 22 bp, Homo sapiens
catttagttttgcagtagcagg

SEQ ID NO: 7017441 - DNA, 22 bp, Homo sapiens
aagatggtcttgagatattata

SEQ ID NO: 7017442 - DNA, 22 bp, Homo sapiens
tacatttataaggcttctctgt

SEQ ID NO: 7017443 - DNA, 22 bp, Homo sapiens
ctgggaccatctgtgtctactt

SEQ ID NO: 7017444 - DNA, 22 bp, Homo sapiens
tggaggcctgggtgtgttgagc

SEQ ID NO: 7017445 - DNA, 22 bp, Homo sapiens
agattgggctctatggtgccac

SEQ ID NO: 7017446 - DNA, 22 bp, Homo sapiens
taggtccacaagatcaatgcag

SEQ ID NO: 7017447 - DNA, 22 bp, Homo sapiens
cacctgccctttcttgctccac

SEQ ID NO: 7017448 - DNA, 22 bp, Homo sapiens
ttccaggacttcatggctctga

SEQ ID NO: 7017449 - DNA, 22 bp, Homo sapiens
catggatcataaatgtgctaaa

SEQ ID NO: 7017450 - DNA, 22 bp, Homo sapiens
ggtaacttacagggccccttta

SEQ ID NO: 7017451 - DNA, 22 bp, Homo sapiens
ctgaatccacacaaggtgatgg

SEQ ID NO: 7017452 - DNA, 22 bp, Homo sapiens
aaagtttggattagcagttaga

SEQ ID NO: 7017453 - DNA, 22 bp, Homo sapiens
atgctgataggagttaatggtg

SEQ ID NO: 7017454 - DNA, 22 bp, Homo sapiens
acagcagtggattagaggatgg

SEQ ID NO: 7017455 - DNA, 22 bp, Homo sapiens
ttattggattcttgccccaggt

SEQ ID NO: 7017456 - DNA, 18 bp, Homo sapiens
agcatgagagaggctgtg

SEQ ID NO: 7017457 - DNA, 22 bp, Homo sapiens
gtccttaatctgattggtgcag

SEQ ID NO: 7017458 - DNA, 22 bp, Homo sapiens
ttcctgggccttaaatcttttg

SEQ ID NO: 7017459 - DNA, 22 bp, Homo sapiens
gcctcagttgatctgtgtgagc

SEQ ID NO: 7017460 - DNA, 22 bp, Homo sapiens
aaggcttctttgcaggctttag

SEQ ID NO: 7017461 - DNA, 22 bp, Homo sapiens
cccagcctttgcttcctggttc

SEQ ID NO: 7017462 - DNA, 22 bp, Homo sapiens
tgataaatccatgtaaatggta

SEQ ID NO: 7017463 - DNA, 22 bp, Homo sapiens
tggcattgacgctgacctgcac

SEQ ID NO: 7017464 - DNA, 22 bp, Homo sapiens
agctctcttccagatccacttg

SEQ ID NO: 7017465 - DNA, 22 bp, Homo sapiens
tggtgccgcaggctggccttcg

SEQ ID NO: 7017466 - DNA, 22 bp, Homo sapiens
aactttctccagtgccaactat

SEQ ID NO: 7017467 - DNA, 22 bp, Homo sapiens
tctcattggtatgatgtgtaga

SEQ ID NO: 7017468 - DNA, 22 bp, Homo sapiens
cggggctgtagcacagctgagc

SEQ ID NO: 7017469 - DNA, 22 bp, Homo sapiens
cctggctttagctgccttccct

SEQ ID NO: 7017470 - DNA, 22 bp, Homo sapiens
acagaacatattgcttctctca

SEQ ID NO: 7017471 - DNA, 22 bp, Homo sapiens
ttgtttccctggatctagagct

SEQ ID NO: 7017472 - DNA, 22 bp, Homo sapiens
ttgagcaatgtcactgaggctt

SEQ ID NO: 7017473 - DNA, 22 bp, Homo sapiens
actgagcagggttccgcatgga

SEQ ID NO: 7017474 - DNA, 18 bp, Homo sapiens
tcagagagcagctttatt

SEQ ID NO: 7017475 - DNA, 22 bp, Homo sapiens
tcacatttgcaattgcattgtt

SEQ ID NO: 7017476 - DNA, 22 bp, Homo sapiens
agtggtgtgtcaggagcaaatt

SEQ ID NO: 7017477 - DNA, 22 bp, Homo sapiens
acaggttgataaggtgatattc

SEQ ID NO: 7017478 - DNA, 22 bp, Homo sapiens
agaggccaatagtaggtggcat

SEQ ID NO: 7017479 - DNA, 20 bp, Homo sapiens
tgggcctgtggcagaagtct

SEQ ID NO: 7017480 - DNA, 22 bp, Homo sapiens
cagaaagccgacttacaatgga

SEQ ID NO: 7017481 - DNA, 22 bp, Homo sapiens
gctctgagacagtagagatggc

SEQ ID NO: 7017482 - DNA, 22 bp, Homo sapiens
acacatacatggggaagatgag

SEQ ID NO: 7017483 - DNA, 22 bp, Homo sapiens
tctgacttggtgctaccagcca

SEQ ID NO: 7017484 - DNA, 22 bp, Homo sapiens
tagctttccttctagccctgaa

SEQ ID NO: 7017485 - DNA, 22 bp, Homo sapiens
tcctctggttatacttgcaccc

SEQ ID NO: 7017486 - DNA, 18 bp, Homo sapiens
tggagctgagtgctgtgc

SEQ ID NO: 7017487 - DNA, 22 bp, Homo sapiens
ttgggagacaaaggctctgtct

SEQ ID NO: 7017488 - DNA, 22 bp, Homo sapiens
tccaatatttctcatatatgga

SEQ ID NO: 7017489 - DNA, 22 bp, Homo sapiens
gaagttgatatctactctcatg

SEQ ID NO: 7017490 - DNA, 22 bp, Homo sapiens
taatagcttttatgcagtctgt

SEQ ID NO: 7017491 - DNA, 22 bp, Homo sapiens
caattgtatgtgagaaataaat

SEQ ID NO: 7017492 - DNA, 22 bp, Homo sapiens
aggaaatgcaggcaaatactct

SEQ ID NO: 7017493 - DNA, 22 bp, Homo sapiens
gtgccctggaggggttgaaggg

SEQ ID NO: 7017494 - DNA, 22 bp, Homo sapiens
gtccttggcagcagtccacccc

SEQ ID NO: 7017495 - DNA, 22 bp, Homo sapiens
tatgtaggtaaacacagacata

SEQ ID NO: 7017496 - DNA, 22 bp, Homo sapiens
tagaatgtaaattccaagggca

SEQ ID NO: 7017497 - DNA, 22 bp, Homo sapiens
gtgcagctgccgatcagatagg

SEQ ID NO: 7017498 - DNA, 22 bp, Homo sapiens
tgatgcctaatatacttcaatt

SEQ ID NO: 7017499 - DNA, 22 bp, Homo sapiens
tttgcattacttgactttagtt

SEQ ID NO: 7017500 - DNA, 22 bp, Homo sapiens
ccaccaggcactcacagggaag

SEQ ID NO: 7017501 - DNA, 22 bp, Homo sapiens
ctgaggcagagggcagaccaga

SEQ ID NO: 7017502 - DNA, 22 bp, Homo sapiens
ggcagcatctcatatcttcagg

SEQ ID NO: 7017503 - DNA, 20 bp, Homo sapiens
ctgctgccctgtcagcctct

SEQ ID NO: 7017504 - DNA, 22 bp, Homo sapiens
acaagccttgaagctgtaatct

SEQ ID NO: 7017505 - DNA, 22 bp, Homo sapiens
tgtggctgccaccctgaagccg

SEQ ID NO: 7017506 - DNA, 22 bp, Homo sapiens
tttactgagtgacctagaataa

SEQ ID NO: 7017507 - DNA, 22 bp, Homo sapiens
cagtgacctaatattctgccac

SEQ ID NO: 7017508 - DNA, 22 bp, Homo sapiens
tggtcaacaacattgactggat

SEQ ID NO: 7017509 - DNA, 17 bp, Homo sapiens
ggtaatggaggggaaag

SEQ ID NO: 7017510 - DNA, 22 bp, Homo sapiens
acaaataggtagatttgcaaca

SEQ ID NO: 7017511 - DNA, 17 bp, Homo sapiens
aatagtgtattatacat

SEQ ID NO: 7017512 - DNA, 22 bp, Homo sapiens
actgtgtgtttgtctagcacag

SEQ ID NO: 7017513 - DNA, 22 bp, Homo sapiens
ataggcaagcacaaagtcagga

SEQ ID NO: 7017514 - DNA, 22 bp, Homo sapiens
aaaatctcattatcaggaaggg

SEQ ID NO: 7017515 - DNA, 18 bp, Homo sapiens
gctcagctatgggaggtt

SEQ ID NO: 7017516 - DNA, 22 bp, Homo sapiens
aaatgcttcacctcattaaact

SEQ ID NO: 7017517 - DNA, 22 bp, Homo sapiens
tgggtaaggtactgtagatctg

SEQ ID NO: 7017518 - DNA, 22 bp, Homo sapiens
attcctgtgtatgtcttgctgc

SEQ ID NO: 7017519 - DNA, 19 bp, Homo sapiens
gcagccaggtgctctacct

SEQ ID NO: 7017520 - DNA, 22 bp, Homo sapiens
tatgcttattgtctcatccact

SEQ ID NO: 7017521 - DNA, 19 bp, Homo sapiens
ctccagaatacatgttcct

SEQ ID NO: 7017522 - DNA, 22 bp, Homo sapiens
tgtcatctcttgcaggaagcct

SEQ ID NO: 7017523 - DNA, 22 bp, Homo sapiens
cttctggcgttggaggtctgag

SEQ ID NO: 7017524 - DNA, 22 bp, Homo sapiens
tcatctctagacaggaggctgg

SEQ ID NO: 7017525 - DNA, 22 bp, Homo sapiens
tacaatgagctgtacatctcca

SEQ ID NO: 7017526 - DNA, 22 bp, Homo sapiens
ggaagggtttggaaagccgaga

SEQ ID NO: 7017527 - DNA, 22 bp, Homo sapiens
tttcacacttgatttgcagtta

SEQ ID NO: 7017528 - DNA, 22 bp, Homo sapiens
ctgcctgtggacaccctggagg

SEQ ID NO: 7017529 - DNA, 22 bp, Homo sapiens
tcatgcaagaataataggaagg

SEQ ID NO: 7017530 - DNA, 22 bp, Homo sapiens
caatctctggtgcttctgagag

SEQ ID NO: 7017531 - DNA, 22 bp, Homo sapiens
ttctattaatatgttaattctg

SEQ ID NO: 7017532 - DNA, 22 bp, Homo sapiens
catggcaggaaggacatgcact

SEQ ID NO: 7017533 - DNA, 22 bp, Homo sapiens
tgccatcttccttcctctgcac

SEQ ID NO: 7017534 - DNA, 20 bp, Homo sapiens
ttttgatagcaaagacggta

SEQ ID NO: 7017535 - DNA, 22 bp, Homo sapiens
atacctctggcactcaagactt

SEQ ID NO: 7017536 - DNA, 22 bp, Homo sapiens
aatggttttgctttagtattct

SEQ ID NO: 7017537 - DNA, 20 bp, Homo sapiens
tatttacaacttagagcctc

SEQ ID NO: 7017538 - DNA, 22 bp, Homo sapiens
caggcaagcacggtgaacctgg

SEQ ID NO: 7017539 - DNA, 20 bp, Homo sapiens
cctggccaatgagataggaa

SEQ ID NO: 7017540 - DNA, 22 bp, Homo sapiens
tcttcattttgaagaggcagaa

SEQ ID NO: 7017541 - DNA, 22 bp, Homo sapiens
aaagctgctatgaacattctat

SEQ ID NO: 7017542 - DNA, 22 bp, Homo sapiens
ttcttaaaacttatggacaggt

SEQ ID NO: 7017543 - DNA, 22 bp, Homo sapiens
tgtcttgattgaagagatagaa

SEQ ID NO: 7017544 - DNA, 22 bp, Homo sapiens
ggtgtgactcgccctcagggac

SEQ ID NO: 7017545 - DNA, 22 bp, Homo sapiens
ctctggcttagtatgctccaaa

SEQ ID NO: 7017546 - DNA, 22 bp, Homo sapiens
acaaggacatgcaatttggatt

SEQ ID NO: 7017547 - DNA, 21 bp, Homo sapiens
caggccccaggcctggggtgc

SEQ ID NO: 7017548 - DNA, 22 bp, Homo sapiens
aactaagtcatagagtccctca

SEQ ID NO: 7017549 - DNA, 22 bp, Homo sapiens
gtccttcaagagtcccctactg

SEQ ID NO: 7017550 - DNA, 22 bp, Homo sapiens
ttttgtgtagagatggggtctt

SEQ ID NO: 7017551 - DNA, 22 bp, Homo sapiens
gtggcctgtcagaagccgtggg

SEQ ID NO: 7017552 - DNA, 22 bp, Homo sapiens
gtttgcctgtgatgtacatttc

SEQ ID NO: 7017553 - DNA, 22 bp, Homo sapiens
tcagaaggcccgttgctaagag

SEQ ID NO: 7017554 - DNA, 22 bp, Homo sapiens
tccctgggcctcctgctatgca

SEQ ID NO: 7017555 - DNA, 22 bp, Homo sapiens
aagcacagtgggcagagcagcc

SEQ ID NO: 7017556 - DNA, 22 bp, Homo sapiens
tagcagtatggagcgaggccca

SEQ ID NO: 7017557 - DNA, 18 bp, Homo sapiens
tccagaggtgttggagcc

SEQ ID NO: 7017558 - DNA, 22 bp, Homo sapiens
aaggctccctcttctcgagtgt

SEQ ID NO: 7017559 - DNA, 22 bp, Homo sapiens
ttccttggaaattctgacttca

SEQ ID NO: 7017560 - DNA, 22 bp, Homo sapiens
ggcatggacgtctctgaggcca

SEQ ID NO: 7017561 - DNA, 22 bp, Homo sapiens
tggccacagtgtccagcagcag

SEQ ID NO: 7017562 - DNA, 22 bp, Homo sapiens
gttcaagtctggggctgccagt

SEQ ID NO: 7017563 - DNA, 20 bp, Homo sapiens
gagcatctgtctgctgtgca

SEQ ID NO: 7017564 - DNA, 22 bp, Homo sapiens
acccaggacttggcaacctcat

SEQ ID NO: 7017565 - DNA, 22 bp, Homo sapiens
aggcatttgatgaagattggct

SEQ ID NO: 7017566 - DNA, 22 bp, Homo sapiens
gtcatttatgaggaagtgggcc

SEQ ID NO: 7017567 - DNA, 21 bp, Homo sapiens
ggagctgcaggagccgaaggc

SEQ ID NO: 7017568 - DNA, 22 bp, Homo sapiens
tccttgcaaatagctttctgag

SEQ ID NO: 7017569 - DNA, 22 bp, Homo sapiens
agtgtatacttttagtagaatt

SEQ ID NO: 7017570 - DNA, 22 bp, Homo sapiens
tccagcttgacaaatgatttta

SEQ ID NO: 7017571 - DNA, 22 bp, Homo sapiens
agacatctgtcaggggttctta

SEQ ID NO: 7017572 - DNA, 22 bp, Homo sapiens
aactcctatgacccactgaact

SEQ ID NO: 7017573 - DNA, 22 bp, Homo sapiens
gtcctcagtcagtttggtgggg

SEQ ID NO: 7017574 - DNA, 22 bp, Homo sapiens
tccaggtagatttattccagcc

SEQ ID NO: 7017575 - DNA, 22 bp, Homo sapiens
ctggaagggtacataggaaact

SEQ ID NO: 7017576 - DNA, 21 bp, Homo sapiens
tggtgccttcagctgtctttt

SEQ ID NO: 7017577 - DNA, 22 bp, Homo sapiens
ttagcaccagctatggatgtgc

SEQ ID NO: 7017578 - DNA, 22 bp, Homo sapiens
gttagcaacaagtctcaatgac

SEQ ID NO: 7017579 - DNA, 22 bp, Homo sapiens
aatgccaacttggatatacatt

SEQ ID NO: 7017580 - DNA, 18 bp, Homo sapiens
acctgcctgttcttctct

SEQ ID NO: 7017581 - DNA, 19 bp, Homo sapiens
gctgtacagtaaggagaca

SEQ ID NO: 7017582 - DNA, 22 bp, Homo sapiens
aacagtttatcaagtttttaca

SEQ ID NO: 7017583 - DNA, 22 bp, Homo sapiens
ttcaaagtaccgtacttaatgg

SEQ ID NO: 7017584 - DNA, 22 bp, Homo sapiens
tagtctttttaataaataatgc

SEQ ID NO: 7017585 - DNA, 23 bp, Homo sapiens
tatctactttgcaattcagtacc

SEQ ID NO: 7017586 - DNA, 22 bp, Homo sapiens
gctgctggagagcgagactgtt

SEQ ID NO: 7017587 - DNA, 22 bp, Homo sapiens
cagaatatgaccctaggccttt

SEQ ID NO: 7017588 - DNA, 22 bp, Homo sapiens
gttttgaagaagaccttgaaac

SEQ ID NO: 7017589 - DNA, 22 bp, Homo sapiens
cccatgcaccctctaagaagga

SEQ ID NO: 7017590 - DNA, 22 bp, Homo sapiens
ggaccatctctagccagagctt

SEQ ID NO: 7017591 - DNA, 21 bp, Homo sapiens
tccaggagtggctgggcaggg

SEQ ID NO: 7017592 - DNA, 22 bp, Homo sapiens
tgttaatggctgaagacatcct

SEQ ID NO: 7017593 - DNA, 22 bp, Homo sapiens
aaggccttgcctgacagcacca

SEQ ID NO: 7017594 - DNA, 22 bp, Homo sapiens
cctttttcagcttctagaggct

SEQ ID NO: 7017595 - DNA, 22 bp, Homo sapiens
tatactacgcaccaaacaaagg

SEQ ID NO: 7017596 - DNA, 22 bp, Homo sapiens
ctccagtgagcgcggggcatgg

SEQ ID NO: 7017597 - DNA, 22 bp, Homo sapiens
aagctgggacttagcgcagata

SEQ ID NO: 7017598 - DNA, 22 bp, Homo sapiens
gctttttcaaatgaaagctggt

SEQ ID NO: 7017599 - DNA, 22 bp, Homo sapiens
gcagtttggaaaatgtgcctct

SEQ ID NO: 7017600 - DNA, 22 bp, Homo sapiens
aatctcagagatatctgtgtcc

SEQ ID NO: 7017601 - DNA, 22 bp, Homo sapiens
tattcacaggttccggagatta

SEQ ID NO: 7017602 - DNA, 22 bp, Homo sapiens
ttatgtgtacctcaatctgagg

SEQ ID NO: 7017603 - DNA, 22 bp, Homo sapiens
tttagagttgagtattcattgg

SEQ ID NO: 7017604 - DNA, 22 bp, Homo sapiens
gacctcagtattgttcaggatg

SEQ ID NO: 7017605 - DNA, 22 bp, Homo sapiens
tcccttgtcacctcacactatg

SEQ ID NO: 7017606 - DNA, 22 bp, Homo sapiens
tagggccagataggcttcttga

SEQ ID NO: 7017607 - DNA, 22 bp, Homo sapiens
tgtttacagctgatcaggcatc

SEQ ID NO: 7017608 - DNA, 22 bp, Homo sapiens
gagttgacaggccaaggcccat

SEQ ID NO: 7017609 - DNA, 22 bp, Homo sapiens
ttgctgagcagtgtttaattgt

SEQ ID NO: 7017610 - DNA, 22 bp, Homo sapiens
ctttacaaattagctctcggga

SEQ ID NO: 7017611 - DNA, 22 bp, Homo sapiens
aggccaaatgtgtataaaacat

SEQ ID NO: 7017612 - DNA, 22 bp, Homo sapiens
ttgtatcaatgccaggagaaat

SEQ ID NO: 7017613 - DNA, 22 bp, Homo sapiens
cagcttgtgaaatgtcaccact

SEQ ID NO: 7017614 - DNA, 19 bp, Homo sapiens
ttatgaatagcttcatcca

SEQ ID NO: 7017615 - DNA, 19 bp, Homo sapiens
agaaccactgctctcttca

SEQ ID NO: 7017616 - DNA, 22 bp, Homo sapiens
ttggagtcatatggaattcaca

SEQ ID NO: 7017617 - DNA, 22 bp, Homo sapiens
aggctgggcaccgttttgatcc

SEQ ID NO: 7017618 - DNA, 22 bp, Homo sapiens
tacattgaaagtcatttaatcc

SEQ ID NO: 7017619 - DNA, 22 bp, Homo sapiens
tttgtccttgaatcaattcaca

SEQ ID NO: 7017620 - DNA, 22 bp, Homo sapiens
ctctttttcacctctgtcagcg

SEQ ID NO: 7017621 - DNA, 22 bp, Homo sapiens
agaatgcttgtacctttgtttt

SEQ ID NO: 7017622 - DNA, 15 bp, Homo sapiens
gattaggcagctgaa

SEQ ID NO: 7017623 - DNA, 22 bp, Homo sapiens
aataagaacaactaaggtttat

SEQ ID NO: 7017624 - DNA, 22 bp, Homo sapiens
taagatccaccttgaaatggac

SEQ ID NO: 7017625 - DNA, 22 bp, Homo sapiens
atctgcctcttcttcattgcga

SEQ ID NO: 7017626 - DNA, 22 bp, Homo sapiens
acacaggaggaggatggtggtc

SEQ ID NO: 7017627 - DNA, 22 bp, Homo sapiens
ctgcaccatctggagcacctcc

SEQ ID NO: 7017628 - DNA, 21 bp, Homo sapiens
ttggcagtcagaaatgtgagg

SEQ ID NO: 7017629 - DNA, 22 bp, Homo sapiens
tatcagtgattgctgtatacaa

SEQ ID NO: 7017630 - DNA, 17 bp, Homo sapiens
acagggcagaaacagct

SEQ ID NO: 7017631 - DNA, 22 bp, Homo sapiens
cattttactgactcttgaatta

SEQ ID NO: 7017632 - DNA, 22 bp, Homo sapiens
cttttcatgccagcccatcaca

SEQ ID NO: 7017633 - DNA, 22 bp, Homo sapiens
tgtggaacaaaatgttgggaga

SEQ ID NO: 7017634 - DNA, 22 bp, Homo sapiens
gggacttaatgcagagagggac

SEQ ID NO: 7017635 - DNA, 22 bp, Homo sapiens
gccttcaggtgtccctgtgggc

SEQ ID NO: 7017636 - DNA, 22 bp, Homo sapiens
cagcagctgggaaggaggctga

SEQ ID NO: 7017637 - DNA, 20 bp, Homo sapiens
ccaaggttggaggcagggtg

SEQ ID NO: 7017638 - DNA, 22 bp, Homo sapiens
agtttccaaagcatgttcacac

SEQ ID NO: 7017639 - DNA, 22 bp, Homo sapiens
gctttcaattatgtcagcctgt

SEQ ID NO: 7017640 - DNA, 22 bp, Homo sapiens
tcctggaatcagctttggagac

SEQ ID NO: 7017641 - DNA, 22 bp, Homo sapiens
tttgtaaatagcagtactcatg

SEQ ID NO: 7017642 - DNA, 22 bp, Homo sapiens
tgcctaggaaacctcatgcttc

SEQ ID NO: 7017643 - DNA, 22 bp, Homo sapiens
taaggctatctgagtttatgtg

SEQ ID NO: 7017644 - DNA, 22 bp, Homo sapiens
tgtgagttgctcttttgctact

SEQ ID NO: 7017645 - DNA, 17 bp, Homo sapiens
tgcagcagttcccatct

SEQ ID NO: 7017646 - DNA, 22 bp, Homo sapiens
aagggccaagctcttctcccat

SEQ ID NO: 7017647 - DNA, 17 bp, Homo sapiens
tgcattgtaggctagcc

SEQ ID NO: 7017648 - DNA, 22 bp, Homo sapiens
gtccagccaggctgcagcaccc

SEQ ID NO: 7017649 - DNA, 22 bp, Homo sapiens
aaggaacttgccacagaaaaga

SEQ ID NO: 7017650 - DNA, 22 bp, Homo sapiens
ttctgcaggatgctctggtggt

SEQ ID NO: 7017651 - DNA, 22 bp, Homo sapiens
gagtcatttgggggcttcttga

SEQ ID NO: 7017652 - DNA, 22 bp, Homo sapiens
gtatcctttgcggaaatttcta

SEQ ID NO: 7017653 - DNA, 19 bp, Homo sapiens
tggctggagatctgctact

SEQ ID NO: 7017654 - DNA, 22 bp, Homo sapiens
tcagtgtcacaggatgctatgc

SEQ ID NO: 7017655 - DNA, 22 bp, Homo sapiens
tctttgattttgttactaagac

SEQ ID NO: 7017656 - DNA, 22 bp, Homo sapiens
tctgggctgtgggaattcaaca

SEQ ID NO: 7017657 - DNA, 22 bp, Homo sapiens
tactgtctctgccctggccagg

SEQ ID NO: 7017658 - DNA, 22 bp, Homo sapiens
cagccctgttgcgcttccggcg

SEQ ID NO: 7017659 - DNA, 22 bp, Homo sapiens
atgcaaatgctagagaatgttg

SEQ ID NO: 7017660 - DNA, 22 bp, Homo sapiens
aaaaactgcaattacttttgtc

SEQ ID NO: 7017661 - DNA, 22 bp, Homo sapiens
cagaggacttcccactcatctg

SEQ ID NO: 7017662 - DNA, 22 bp, Homo sapiens
aagctcttgttgaatcttgtca

SEQ ID NO: 7017663 - DNA, 22 bp, Homo sapiens
aagtgaatttcattccaattct

SEQ ID NO: 7017664 - DNA, 22 bp, Homo sapiens
cagcttcatgtccaggtactgt

SEQ ID NO: 7017665 - DNA, 22 bp, Homo sapiens
cgcgggcctccagacccagtat

SEQ ID NO: 7017666 - DNA, 22 bp, Homo sapiens
agcaggcccaagctggggggaa

SEQ ID NO: 7017667 - DNA, 22 bp, Homo sapiens
ttgtgcaaggtctggactatag

SEQ ID NO: 7017668 - DNA, 22 bp, Homo sapiens
gctgtctgtggtgtcagctgac

SEQ ID NO: 7017669 - DNA, 22 bp, Homo sapiens
ctcattgcaacctccgcctccc

SEQ ID NO: 7017670 - DNA, 22 bp, Homo sapiens
tcagggcctgagcttttaatta

SEQ ID NO: 7017671 - DNA, 22 bp, Homo sapiens
accaaccagggacttggctccc

SEQ ID NO: 7017672 - DNA, 22 bp, Homo sapiens
ggttccacctggcgaggggtat

SEQ ID NO: 7017673 - DNA, 22 bp, Homo sapiens
cttagtatctatgaagtgaaaa

SEQ ID NO: 7017674 - DNA, 22 bp, Homo sapiens
ggccatggtgaggtcttctcag

SEQ ID NO: 7017675 - DNA, 22 bp, Homo sapiens
gtggacttgctgtcctggactt

SEQ ID NO: 7017676 - DNA, 22 bp, Homo sapiens
attagcaatggtggtattagga

SEQ ID NO: 7017677 - DNA, 22 bp, Homo sapiens
acattcaagatgcattcactta

SEQ ID NO: 7017678 - DNA, 22 bp, Homo sapiens
tgtacacatggtgtacactccc

SEQ ID NO: 7017679 - DNA, 22 bp, Homo sapiens
catcttcaggggctacatctgt

SEQ ID NO: 7017680 - DNA, 19 bp, Homo sapiens
gtgagaccctgcatagggc

SEQ ID NO: 7017681 - DNA, 22 bp, Homo sapiens
ttcaacaaggctgtcaaaagtt

SEQ ID NO: 7017682 - DNA, 23 bp, Homo sapiens
ctctggatcctgtagctcctggc

SEQ ID NO: 7017683 - DNA, 22 bp, Homo sapiens
ttcctggcactgcagtggttga

SEQ ID NO: 7017684 - DNA, 22 bp, Homo sapiens
actgcacacctccagggcacta

SEQ ID NO: 7017685 - DNA, 22 bp, Homo sapiens
gcttacactaaacaagtttcct

SEQ ID NO: 7017686 - DNA, 22 bp, Homo sapiens
tttgacagtgctgctaaaatgc

SEQ ID NO: 7017687 - DNA, 22 bp, Homo sapiens
ataaagcaaataggactattgc

SEQ ID NO: 7017688 - DNA, 22 bp, Homo sapiens
catctcctggcagctgttagga

SEQ ID NO: 7017689 - DNA, 22 bp, Homo sapiens
tgtaccagatgtctaaagccat

SEQ ID NO: 7017690 - DNA, 22 bp, Homo sapiens
ggtggcctgttttcaggtttgc

SEQ ID NO: 7017691 - DNA, 22 bp, Homo sapiens
gtgtgcgttcctagtaaacgtg

SEQ ID NO: 7017692 - DNA, 22 bp, Homo sapiens
tctccattagtgggtggcagtg

SEQ ID NO: 7017693 - DNA, 22 bp, Homo sapiens
tagccagctgaatgcactacag

SEQ ID NO: 7017694 - DNA, 22 bp, Homo sapiens
agtgcagcatgaagcacatgtg

SEQ ID NO: 7017695 - DNA, 22 bp, Homo sapiens
gcagctggagccagccagacac

SEQ ID NO: 7017696 - DNA, 22 bp, Homo sapiens
actctctcacagcttggctgat

SEQ ID NO: 7017697 - DNA, 22 bp, Homo sapiens
aaagttgcagtgaaataaggct

SEQ ID NO: 7017698 - DNA, 22 bp, Homo sapiens
gctgtaggttcagtctccatgc

SEQ ID NO: 7017699 - DNA, 22 bp, Homo sapiens
tagcaccaatatgtgcttttca

SEQ ID NO: 7017700 - DNA, 22 bp, Homo sapiens
tcatctgaggcaccagagcata

SEQ ID NO: 7017701 - DNA, 22 bp, Homo sapiens
gcttctgaggaaggctcagcct

SEQ ID NO: 7017702 - DNA, 22 bp, Homo sapiens
gcctttatcttgggccaagttt

SEQ ID NO: 7017703 - DNA, 22 bp, Homo sapiens
gcagagtcagcctccgagacag

SEQ ID NO: 7017704 - DNA, 23 bp, Homo sapiens
tgctctgtgaatagttggtgact

SEQ ID NO: 7017705 - DNA, 22 bp, Homo sapiens
tcttattattgttgtaaaagca

SEQ ID NO: 7017706 - DNA, 21 bp, Homo sapiens
gggctccagagatgtagcttc

SEQ ID NO: 7017707 - DNA, 16 bp, Homo sapiens
ttattgaggccaagga

SEQ ID NO: 7017708 - DNA, 22 bp, Homo sapiens
tcagagtgcagcgggaggctgg

SEQ ID NO: 7017709 - DNA, 22 bp, Homo sapiens
aggcaggctagtcgcttgagcc

SEQ ID NO: 7017710 - DNA, 22 bp, Homo sapiens
tggcaagttggtgggtttagtg

SEQ ID NO: 7017711 - DNA, 22 bp, Homo sapiens
tgcaattttaatacattagagg

SEQ ID NO: 7017712 - DNA, 22 bp, Homo sapiens
agccctctccctttcttcttag

SEQ ID NO: 7017713 - DNA, 22 bp, Homo sapiens
gctgtcttttcctggcagtaaa

SEQ ID NO: 7017714 - DNA, 22 bp, Homo sapiens
tgagctgtgtcttggtgagagt

SEQ ID NO: 7017715 - DNA, 22 bp, Homo sapiens
ttggttttcatagctccactct

SEQ ID NO: 7017716 - DNA, 22 bp, Homo sapiens
gagtcacatactatgtaataga

SEQ ID NO: 7017717 - DNA, 22 bp, Homo sapiens
tttatctctgcatagaagtgat

SEQ ID NO: 7017718 - DNA, 22 bp, Homo sapiens
cactgtgtaagaagatgggctt

SEQ ID NO: 7017719 - DNA, 22 bp, Homo sapiens
gagctctttcggttgttttcga

SEQ ID NO: 7017720 - DNA, 19 bp, Homo sapiens
tctatgggctttttgtagt

SEQ ID NO: 7017721 - DNA, 22 bp, Homo sapiens
cactctgagaagtacaagctcc

SEQ ID NO: 7017722 - DNA, 22 bp, Homo sapiens
ttggctgccttcacccctggcc

SEQ ID NO: 7017723 - DNA, 22 bp, Homo sapiens
agttcctaatttagtattgccg

SEQ ID NO: 7017724 - DNA, 22 bp, Homo sapiens
taggtagacaaagaaatgtgtt

SEQ ID NO: 7017725 - DNA, 22 bp, Homo sapiens
ctagtctggacatctcacatgt

SEQ ID NO: 7017726 - DNA, 22 bp, Homo sapiens
ccctggcactagcgacggccat

SEQ ID NO: 7017727 - DNA, 22 bp, Homo sapiens
aacatgtaaccagcattcatct

SEQ ID NO: 7017728 - DNA, 22 bp, Homo sapiens
ggccggggcctccccgcgtcgc

SEQ ID NO: 7017729 - DNA, 21 bp, Homo sapiens
cagagcttgctgagaggcctg

SEQ ID NO: 7017730 - DNA, 15 bp, Homo sapiens
attatttgtgctcag

SEQ ID NO: 7017731 - DNA, 22 bp, Homo sapiens
cagcagaggttttgctccatga

SEQ ID NO: 7017732 - DNA, 22 bp, Homo sapiens
gatgtatagggccatgacacca

SEQ ID NO: 7017733 - DNA, 22 bp, Homo sapiens
ggccagtttccatgcactattt

SEQ ID NO: 7017734 - DNA, 20 bp, Homo sapiens
tatcttactttagtcatttg

SEQ ID NO: 7017735 - DNA, 17 bp, Homo sapiens
taggtggttgctggtct

SEQ ID NO: 7017736 - DNA, 22 bp, Homo sapiens
cacctagcagagcactactgca

SEQ ID NO: 7017737 - DNA, 22 bp, Homo sapiens
aggccctgaagtcggcccctca

SEQ ID NO: 7017738 - DNA, 22 bp, Homo sapiens
cacatatttgatgaagctttgt

SEQ ID NO: 7017739 - DNA, 22 bp, Homo sapiens
agaggacacatctttcctcaaa

SEQ ID NO: 7017740 - DNA, 22 bp, Homo sapiens
acaggctttaaatttaaaacca

SEQ ID NO: 7017741 - DNA, 22 bp, Homo sapiens
atgccctgccaagcaggctaaa

SEQ ID NO: 7017742 - DNA, 22 bp, Homo sapiens
ttacagagtagggaattgaagt

SEQ ID NO: 7017743 - DNA, 22 bp, Homo sapiens
acattttgaaagggaaattgtt

SEQ ID NO: 7017744 - DNA, 22 bp, Homo sapiens
aggacacagctgctctgcagag

SEQ ID NO: 7017745 - DNA, 22 bp, Homo sapiens
agtttcattgagatgtttgcta

SEQ ID NO: 7017746 - DNA, 22 bp, Homo sapiens
catgaaggaataattgtttaga

SEQ ID NO: 7017747 - DNA, 19 bp, Homo sapiens
ccctggcaggcaagcctgg

SEQ ID NO: 7017748 - DNA, 22 bp, Homo sapiens
tgctgggcatttttatggctcc

SEQ ID NO: 7017749 - DNA, 22 bp, Homo sapiens
acattctagaagtctttgcaat

SEQ ID NO: 7017750 - DNA, 22 bp, Homo sapiens
gggacctgggccagaggacagt

SEQ ID NO: 7017751 - DNA, 22 bp, Homo sapiens
cacattcttggtcaccttgtgg

SEQ ID NO: 7017752 - DNA, 22 bp, Homo sapiens
ttaaaggatctttgtcattaat

SEQ ID NO: 7017753 - DNA, 21 bp, Homo sapiens
tctggcaggcacgggcccagc

SEQ ID NO: 7017754 - DNA, 22 bp, Homo sapiens
ttacagtattggtcacgtttgt

SEQ ID NO: 7017755 - DNA, 22 bp, Homo sapiens
cctgtgctttaggcctcaaact

SEQ ID NO: 7017756 - DNA, 21 bp, Homo sapiens
tgtcactttaagctagctcta

SEQ ID NO: 7017757 - DNA, 22 bp, Homo sapiens
tctcagctcatggcagccttga

SEQ ID NO: 7017758 - DNA, 22 bp, Homo sapiens
agctttgggcaaaggcttgtga

SEQ ID NO: 7017759 - DNA, 22 bp, Homo sapiens
gagaaggatgaggaaatggtat

SEQ ID NO: 7017760 - DNA, 23 bp, Homo sapiens
aatttggttgatgaaagcattgt

SEQ ID NO: 7017761 - DNA, 22 bp, Homo sapiens
caaattgcttgtctgtagtgga

SEQ ID NO: 7017762 - DNA, 22 bp, Homo sapiens
ttcttttctgcagctggtattt

SEQ ID NO: 7017763 - DNA, 22 bp, Homo sapiens
ggctactgtgatggtctgcaag

SEQ ID NO: 7017764 - DNA, 22 bp, Homo sapiens
acttcctgtaaatagaattcca

SEQ ID NO: 7017765 - DNA, 22 bp, Homo sapiens
tggagagagtcgggatagtaca

SEQ ID NO: 7017766 - DNA, 22 bp, Homo sapiens
ttgtgtaacttgagcaaacaca

SEQ ID NO: 7017767 - DNA, 22 bp, Homo sapiens
tggcccagactctgctcttatc

SEQ ID NO: 7017768 - DNA, 22 bp, Homo sapiens
acctcaagaatgtataacacag

SEQ ID NO: 7017769 - DNA, 22 bp, Homo sapiens
gtcaagtacaactcagaaaggt

SEQ ID NO: 7017770 - DNA, 22 bp, Homo sapiens
aagtgagtggtaaggagcatgg

SEQ ID NO: 7017771 - DNA, 22 bp, Homo sapiens
attttacataaggaaggtttaa

SEQ ID NO: 7017772 - DNA, 23 bp, Homo sapiens
ttccacaatgaaaataaagcagg

SEQ ID NO: 7017773 - DNA, 22 bp, Homo sapiens
tttaagacccacagggaagttg

SEQ ID NO: 7017774 - DNA, 22 bp, Homo sapiens
tcctcccacataggacaatggg

SEQ ID NO: 7017775 - DNA, 22 bp, Homo sapiens
tgagcagtggcaccaggtcacc

SEQ ID NO: 7017776 - DNA, 22 bp, Homo sapiens
ctctctaagaacttgatcttgt

SEQ ID NO: 7017777 - DNA, 20 bp, Homo sapiens
ttgaagagtcaggtagggcc

SEQ ID NO: 7017778 - DNA, 22 bp, Homo sapiens
aggccatgggatttccaattgg

SEQ ID NO: 7017779 - DNA, 16 bp, Homo sapiens
tggaggtgtttctagt

SEQ ID NO: 7017780 - DNA, 22 bp, Homo sapiens
caggtcagcacttggaggtgca

SEQ ID NO: 7017781 - DNA, 22 bp, Homo sapiens
tttatcagaagttagagaaaga

SEQ ID NO: 7017782 - DNA, 22 bp, Homo sapiens
ttgcagttgtttagaatatgtg

SEQ ID NO: 7017783 - DNA, 22 bp, Homo sapiens
agcttggtgttgcctgcttgag

SEQ ID NO: 7017784 - DNA, 22 bp, Homo sapiens
gcagcttcagccagagggccag

SEQ ID NO: 7017785 - DNA, 22 bp, Homo sapiens
agagcctgaggtctaacagggg

SEQ ID NO: 7017786 - DNA, 22 bp, Homo sapiens
cctgtctctgttaccacatttg

SEQ ID NO: 7017787 - DNA, 22 bp, Homo sapiens
agctgggctggagctccaagcg

SEQ ID NO: 7017788 - DNA, 21 bp, Homo sapiens
atgtgcttagctgctggtagt

SEQ ID NO: 7017789 - DNA, 22 bp, Homo sapiens
tttagtaggcactaggagggga

SEQ ID NO: 7017790 - DNA, 22 bp, Homo sapiens
tggctacagaatgaatgctgcc

SEQ ID NO: 7017791 - DNA, 22 bp, Homo sapiens
agagaaaagccatcccagccaa

SEQ ID NO: 7017792 - DNA, 22 bp, Homo sapiens
tgattctatattggaaaagggg

SEQ ID NO: 7017793 - DNA, 22 bp, Homo sapiens
agggcctgtgaattctccctgc

SEQ ID NO: 7017794 - DNA, 22 bp, Homo sapiens
tctaggccgtaggatacagagc

SEQ ID NO: 7017795 - DNA, 22 bp, Homo sapiens
tgtggcctcaaggctgccctca

SEQ ID NO: 7017796 - DNA, 22 bp, Homo sapiens
ctatttgtaagagccccacacc

SEQ ID NO: 7017797 - DNA, 22 bp, Homo sapiens
tgcttaaacatactatttatat

SEQ ID NO: 7017798 - DNA, 22 bp, Homo sapiens
tacttagtctttctgatgaaat

SEQ ID NO: 7017799 - DNA, 22 bp, Homo sapiens
tgaccctttcattattctcatt

SEQ ID NO: 7017800 - DNA, 22 bp, Homo sapiens
gcagccctttctgggcagggga

SEQ ID NO: 7017801 - DNA, 22 bp, Homo sapiens
ttattccagtgggtggtttctc

SEQ ID NO: 7017802 - DNA, 23 bp, Homo sapiens
atgaaacatcacaatggtaccat

SEQ ID NO: 7017803 - DNA, 22 bp, Homo sapiens
gttataggagcccgaactaaga

SEQ ID NO: 7017804 - DNA, 22 bp, Homo sapiens
tgctatgtgtgccagggactgt

SEQ ID NO: 7017805 - DNA, 22 bp, Homo sapiens
cttgcatgcatttgaagatcat

SEQ ID NO: 7017806 - DNA, 22 bp, Homo sapiens
aggaagcagcccatggatatag

SEQ ID NO: 7017807 - DNA, 22 bp, Homo sapiens
aaaacattctgtgaactctcaa

SEQ ID NO: 7017808 - DNA, 22 bp, Homo sapiens
aagcacattaaggaacattgaa

SEQ ID NO: 7017809 - DNA, 18 bp, Homo sapiens
ggaccacatcaacttgaa

SEQ ID NO: 7017810 - DNA, 22 bp, Homo sapiens
acttggttgttttaacttggca

SEQ ID NO: 7017811 - DNA, 22 bp, Homo sapiens
agtttacatcttcaatctcatt

SEQ ID NO: 7017812 - DNA, 22 bp, Homo sapiens
ctcgggcttgaggctgtttacc

SEQ ID NO: 7017813 - DNA, 22 bp, Homo sapiens
tcactgtaataggtttgaagat

SEQ ID NO: 7017814 - DNA, 22 bp, Homo sapiens
tacagtcaatactaggaccata

SEQ ID NO: 7017815 - DNA, 22 bp, Homo sapiens
aggcaatcccctgaggatactt

SEQ ID NO: 7017816 - DNA, 22 bp, Homo sapiens
ttaaatcagtaggctactcctt

SEQ ID NO: 7017817 - DNA, 22 bp, Homo sapiens
agccttgctttttcagtagcac

SEQ ID NO: 7017818 - DNA, 22 bp, Homo sapiens
aagaactttgatttcattgcat

SEQ ID NO: 7017819 - DNA, 22 bp, Homo sapiens
caggagtttggtgatttcttgc

SEQ ID NO: 7017820 - DNA, 22 bp, Homo sapiens
tgggggcacttcgaggtcgcct

SEQ ID NO: 7017821 - DNA, 22 bp, Homo sapiens
tgttcctgtgtggaaaagggcc

SEQ ID NO: 7017822 - DNA, 22 bp, Homo sapiens
atttagtggctgtaatcacctt

SEQ ID NO: 7017823 - DNA, 22 bp, Homo sapiens
acaacacatgtgtatatgtgtg

SEQ ID NO: 7017824 - DNA, 23 bp, Homo sapiens
gcttccagaagactcattgacat

SEQ ID NO: 7017825 - DNA, 22 bp, Homo sapiens
gagcctgcagctttcacagcat

SEQ ID NO: 7017826 - DNA, 22 bp, Homo sapiens
tgactcccaggataggatctgg

SEQ ID NO: 7017827 - DNA, 22 bp, Homo sapiens
tgaggccagagtttttaattcc

SEQ ID NO: 7017828 - DNA, 22 bp, Homo sapiens
caggccttgcgtcccatggcct

SEQ ID NO: 7017829 - DNA, 22 bp, Homo sapiens
atacatcatttatgatgtgtgt

SEQ ID NO: 7017830 - DNA, 22 bp, Homo sapiens
cctgccttctaaagcgcccgcc

SEQ ID NO: 7017831 - DNA, 17 bp, Homo sapiens
tctgatgactagaggaa

SEQ ID NO: 7017832 - DNA, 22 bp, Homo sapiens
gcaaacatgttgtgagatacca

SEQ ID NO: 7017833 - DNA, 20 bp, Homo sapiens
cacagcttgccttttatgac

SEQ ID NO: 7017834 - DNA, 22 bp, Homo sapiens
tccgtgttctccagagataatc

SEQ ID NO: 7017835 - DNA, 22 bp, Homo sapiens
cttctctgtgtagagattcaga

SEQ ID NO: 7017836 - DNA, 22 bp, Homo sapiens
agtatttagagacacaagatgg

SEQ ID NO: 7017837 - DNA, 22 bp, Homo sapiens
tcatgcattaacacttcatttt

SEQ ID NO: 7017838 - DNA, 22 bp, Homo sapiens
aactgttcttgtgtttgctatg

SEQ ID NO: 7017839 - DNA, 20 bp, Homo sapiens
tccagctgtctttcagagac

SEQ ID NO: 7017840 - DNA, 22 bp, Homo sapiens
ctggatggtcccatgagcagct

SEQ ID NO: 7017841 - DNA, 22 bp, Homo sapiens
acacaccatgatttatttaccc

SEQ ID NO: 7017842 - DNA, 22 bp, Homo sapiens
tatctgttaaaacaagctttaa

SEQ ID NO: 7017843 - DNA, 22 bp, Homo sapiens
accagatgctctggcgccttcc

SEQ ID NO: 7017844 - DNA, 22 bp, Homo sapiens
agttacatgactgccggcggtg

SEQ ID NO: 7017845 - DNA, 22 bp, Homo sapiens
attatataggacttgcccttcc

SEQ ID NO: 7017846 - DNA, 23 bp, Homo sapiens
atattagggagattagccctcta

SEQ ID NO: 7017847 - DNA, 22 bp, Homo sapiens
ataactggaaggacacgtgtgt

SEQ ID NO: 7017848 - DNA, 22 bp, Homo sapiens
catgcacaaaggtaagatgcgt

SEQ ID NO: 7017849 - DNA, 22 bp, Homo sapiens
ctggctttgctggactgggagt

SEQ ID NO: 7017850 - DNA, 22 bp, Homo sapiens
aatgtgcagtgcctgaagcatg

SEQ ID NO: 7017851 - DNA, 22 bp, Homo sapiens
tttaagacttaggaaagaggat

SEQ ID NO: 7017852 - DNA, 22 bp, Homo sapiens
ccaccaggacagccctgagggg

SEQ ID NO: 7017853 - DNA, 22 bp, Homo sapiens
ggtcaggagcccttggccccct

SEQ ID NO: 7017854 - DNA, 22 bp, Homo sapiens
ctgctttagacaactgctggga

SEQ ID NO: 7017855 - DNA, 22 bp, Homo sapiens
tagataagaatggcatcttctc

SEQ ID NO: 7017856 - DNA, 22 bp, Homo sapiens
gagtttgtaaactattcactaa

SEQ ID NO: 7017857 - DNA, 22 bp, Homo sapiens
cactgcaacaacctctacctcc

SEQ ID NO: 7017858 - DNA, 22 bp, Homo sapiens
atcaggaaaaattgtgaaaggg

SEQ ID NO: 7017859 - DNA, 22 bp, Homo sapiens
tctgggttgggttcctggaatt

SEQ ID NO: 7017860 - DNA, 18 bp, Homo sapiens
ctggcattcttccctgga

SEQ ID NO: 7017861 - DNA, 22 bp, Homo sapiens
actcactgggtcccggaagccc

SEQ ID NO: 7017862 - DNA, 22 bp, Homo sapiens
gggttcagactaaagctatgca

SEQ ID NO: 7017863 - DNA, 22 bp, Homo sapiens
ccagccctgaaccctgctgcat

SEQ ID NO: 7017864 - DNA, 22 bp, Homo sapiens
ctgtctggatgtgagtcaccta

SEQ ID NO: 7017865 - DNA, 22 bp, Homo sapiens
taatgtttgggaaggtgctttg

SEQ ID NO: 7017866 - DNA, 22 bp, Homo sapiens
gcaatgaggagtggtagggata

SEQ ID NO: 7017867 - DNA, 22 bp, Homo sapiens
tgagtctcattaattatgaatg

SEQ ID NO: 7017868 - DNA, 22 bp, Homo sapiens
gccaagggggcagtgcatgggt

SEQ ID NO: 7017869 - DNA, 22 bp, Homo sapiens
cttatttgcccatgtttcttta

SEQ ID NO: 7017870 - DNA, 22 bp, Homo sapiens
gctctgtggcattcatgggcag

SEQ ID NO: 7017871 - DNA, 22 bp, Homo sapiens
gtgacatccgctgacatcgcca

SEQ ID NO: 7017872 - DNA, 22 bp, Homo sapiens
ttccagccagatttgctgggtt

SEQ ID NO: 7017873 - DNA, 22 bp, Homo sapiens
gttcagtggtgtatccccagtg

SEQ ID NO: 7017874 - DNA, 22 bp, Homo sapiens
actgtgtattctaatgactaaa

SEQ ID NO: 7017875 - DNA, 22 bp, Homo sapiens
tccctggggatgttggcctgcc

SEQ ID NO: 7017876 - DNA, 22 bp, Homo sapiens
aatatcaggatgcaaagctgtg

SEQ ID NO: 7017877 - DNA, 21 bp, Homo sapiens
agtttttactcttaactgtgg

SEQ ID NO: 7017878 - DNA, 22 bp, Homo sapiens
tccccaaagctttgtggtcagg

SEQ ID NO: 7017879 - DNA, 22 bp, Homo sapiens
gtgggtggggagctctctggag

SEQ ID NO: 7017880 - DNA, 22 bp, Homo sapiens
tcgagctgggcaagcttccata

SEQ ID NO: 7017881 - DNA, 22 bp, Homo sapiens
gcttggcattggtttctctaag

SEQ ID NO: 7017882 - DNA, 22 bp, Homo sapiens
ccagggttgctttagattctga

SEQ ID NO: 7017883 - DNA, 22 bp, Homo sapiens
ctgagcagtggttcttgagcgc

SEQ ID NO: 7017884 - DNA, 22 bp, Homo sapiens
ttggcttctggcagtctggacg

SEQ ID NO: 7017885 - DNA, 22 bp, Homo sapiens
acaactgtcagtaaagaatatt

SEQ ID NO: 7017886 - DNA, 22 bp, Homo sapiens
tagcaggcatccaataaatact

SEQ ID NO: 7017887 - DNA, 22 bp, Homo sapiens
tgggtggcaaaggcccattgtc

SEQ ID NO: 7017888 - DNA, 22 bp, Homo sapiens
tgagatggttgaccagagagca

SEQ ID NO: 7017889 - DNA, 22 bp, Homo sapiens
ttaagacacatttctcagacgg

SEQ ID NO: 7017890 - DNA, 23 bp, Homo sapiens
tctgtggctccttcaggctgctg

SEQ ID NO: 7017891 - DNA, 22 bp, Homo sapiens
tcttgaggttattaagctgtta

SEQ ID NO: 7017892 - DNA, 22 bp, Homo sapiens
catgaagcatgttttgtcatga

SEQ ID NO: 7017893 - DNA, 22 bp, Homo sapiens
tgttacagcagaattgaaagag

SEQ ID NO: 7017894 - DNA, 22 bp, Homo sapiens
gcttaaaatccatgatttttac

SEQ ID NO: 7017895 - DNA, 22 bp, Homo sapiens
gtgaaggctgtgtgaaagttct

SEQ ID NO: 7017896 - DNA, 22 bp, Homo sapiens
ttgcacatctaataatgctaga

SEQ ID NO: 7017897 - DNA, 22 bp, Homo sapiens
acttatttcatggatcataatg

SEQ ID NO: 7017898 - DNA, 22 bp, Homo sapiens
ctgggcctggacgggcagatct

SEQ ID NO: 7017899 - DNA, 22 bp, Homo sapiens
aactgttcacactgatgtgacg

SEQ ID NO: 7017900 - DNA, 22 bp, Homo sapiens
taagagctgaggcattgggaca

SEQ ID NO: 7017901 - DNA, 20 bp, Homo sapiens
aggtcctgttccttgtctcc

SEQ ID NO: 7017902 - DNA, 22 bp, Homo sapiens
atatgcttccaagttattccac

SEQ ID NO: 7017903 - DNA, 22 bp, Homo sapiens
aggtttccagcaggccatagat

SEQ ID NO: 7017904 - DNA, 22 bp, Homo sapiens
cttctgagggcctttgcttcca

SEQ ID NO: 7017905 - DNA, 22 bp, Homo sapiens
gggcaggttggcatcccgggca

SEQ ID NO: 7017906 - DNA, 22 bp, Homo sapiens
aggctgttttgtataaactgga

SEQ ID NO: 7017907 - DNA, 22 bp, Homo sapiens
cctcagaggttctgtgtgggaa

SEQ ID NO: 7017908 - DNA, 22 bp, Homo sapiens
tgtgattcaagaaagtaaaatg

SEQ ID NO: 7017909 - DNA, 22 bp, Homo sapiens
tagatacatttttctttcctgt

SEQ ID NO: 7017910 - DNA, 22 bp, Homo sapiens
tcagaacagcagggtgtggctg

SEQ ID NO: 7017911 - DNA, 22 bp, Homo sapiens
gaggagctggctgtcgggaggc

SEQ ID NO: 7017912 - DNA, 22 bp, Homo sapiens
agacatttatgtttctctagga

SEQ ID NO: 7017913 - DNA, 22 bp, Homo sapiens
cccagtgtcaccaacaggacac

SEQ ID NO: 7017914 - DNA, 22 bp, Homo sapiens
tttagacatctataattgctaa

SEQ ID NO: 7017915 - DNA, 22 bp, Homo sapiens
taatgactgtaccaaggcttca

SEQ ID NO: 7017916 - DNA, 21 bp, Homo sapiens
attagcaaggggaggcctcag

SEQ ID NO: 7017917 - DNA, 22 bp, Homo sapiens
tactctgccccagccaataatg

SEQ ID NO: 7017918 - DNA, 22 bp, Homo sapiens
cgcaggtgccggcagatggggt

SEQ ID NO: 7017919 - DNA, 22 bp, Homo sapiens
cttgcacaaagtcacctagtca

SEQ ID NO: 7017920 - DNA, 22 bp, Homo sapiens
aaagatttatgaagttcaatta

SEQ ID NO: 7017921 - DNA, 20 bp, Homo sapiens
ttctgagagttcacagcccc

SEQ ID NO: 7017922 - DNA, 22 bp, Homo sapiens
taatttatagaatttcttggat

SEQ ID NO: 7017923 - DNA, 22 bp, Homo sapiens
tctccaggtgagggtggttaga

SEQ ID NO: 7017924 - DNA, 22 bp, Homo sapiens
ctgggccacaagcctgtgtgat

SEQ ID NO: 7017925 - DNA, 22 bp, Homo sapiens
aaagtgcgaggttgctgtaatt

SEQ ID NO: 7017926 - DNA, 22 bp, Homo sapiens
gaggctttcacaaggttagttc

SEQ ID NO: 7017927 - DNA, 22 bp, Homo sapiens
ggcctctgaggacagccttggc

SEQ ID NO: 7017928 - DNA, 22 bp, Homo sapiens
tcagccaggccaggcattcaca

SEQ ID NO: 7017929 - DNA, 22 bp, Homo sapiens
tcaagagccaggtaagcacagg

SEQ ID NO: 7017930 - DNA, 20 bp, Homo sapiens
tagcatccattcctaccttc

SEQ ID NO: 7017931 - DNA, 22 bp, Homo sapiens
agaggctctaaggttggatcaa

SEQ ID NO: 7017932 - DNA, 22 bp, Homo sapiens
gggatgcagtcagagcccctgt

SEQ ID NO: 7017933 - DNA, 22 bp, Homo sapiens
tttcctctgagtgagctgggag

SEQ ID NO: 7017934 - DNA, 22 bp, Homo sapiens
tttgacagatctcagagcattt

SEQ ID NO: 7017935 - DNA, 22 bp, Homo sapiens
caagagctagaaattggttaga

SEQ ID NO: 7017936 - DNA, 22 bp, Homo sapiens
cagctggaggagcagcttccag

SEQ ID NO: 7017937 - DNA, 22 bp, Homo sapiens
agctcttacatttaggtctatg

SEQ ID NO: 7017938 - DNA, 22 bp, Homo sapiens
acagggagatatcttcaatatc

SEQ ID NO: 7017939 - DNA, 22 bp, Homo sapiens
gcatcaagacgatgtgaaatcg

SEQ ID NO: 7017940 - DNA, 22 bp, Homo sapiens
atcaagaattgggagctattga

SEQ ID NO: 7017941 - DNA, 22 bp, Homo sapiens
ggaacactcgtcaaatagcggg

SEQ ID NO: 7017942 - DNA, 22 bp, Homo sapiens
gacccaggagagagggttgcat

SEQ ID NO: 7017943 - DNA, 22 bp, Homo sapiens
tttctaattgtggccgaggtag

SEQ ID NO: 7017944 - DNA, 22 bp, Homo sapiens
aagtctgcctaaccttcatgtt

SEQ ID NO: 7017945 - DNA, 19 bp, Homo sapiens
tggcagtgtggggtatgaa

SEQ ID NO: 7017946 - DNA, 22 bp, Homo sapiens
aatggaggtgtctggcctggta

SEQ ID NO: 7017947 - DNA, 22 bp, Homo sapiens
aggtggtcttaaactgctctgg

SEQ ID NO: 7017948 - DNA, 21 bp, Homo sapiens
ctcttggtcctccctgtgacc

SEQ ID NO: 7017949 - DNA, 22 bp, Homo sapiens
tggctcagtaatcgagtctcct

SEQ ID NO: 7017950 - DNA, 22 bp, Homo sapiens
agagtggtggccgtggtgtcac

SEQ ID NO: 7017951 - DNA, 22 bp, Homo sapiens
acagcaaatggttttctgtctg

SEQ ID NO: 7017952 - DNA, 23 bp, Homo sapiens
gaggacacagcccagacagccgt

SEQ ID NO: 7017953 - DNA, 22 bp, Homo sapiens
acatgctggatgaattacctac

SEQ ID NO: 7017954 - DNA, 22 bp, Homo sapiens
tgagcacctaccttgtccagtg

SEQ ID NO: 7017955 - DNA, 22 bp, Homo sapiens
aatctgaagggagatacatgta

SEQ ID NO: 7017956 - DNA, 22 bp, Homo sapiens
ccagtgttcagtatgcattaag

SEQ ID NO: 7017957 - DNA, 22 bp, Homo sapiens
ggagctcctggcagtgacagag

SEQ ID NO: 7017958 - DNA, 22 bp, Homo sapiens
tcagtccataggtgggcctgag

SEQ ID NO: 7017959 - DNA, 22 bp, Homo sapiens
ctttggagaagaatgcatcctt

SEQ ID NO: 7017960 - DNA, 22 bp, Homo sapiens
gaataatcatgaaattcagtga

SEQ ID NO: 7017961 - DNA, 22 bp, Homo sapiens
acatctgttcaaatatgcattt

SEQ ID NO: 7017962 - DNA, 22 bp, Homo sapiens
atacatcatttatggaataagg

SEQ ID NO: 7017963 - DNA, 22 bp, Homo sapiens
gcacagaggtggaggacaaata

SEQ ID NO: 7017964 - DNA, 22 bp, Homo sapiens
tgagccagcaggcctccagtgg

SEQ ID NO: 7017965 - DNA, 22 bp, Homo sapiens
atgctacgaatgagagcatata

SEQ ID NO: 7017966 - DNA, 22 bp, Homo sapiens
gcagctggacccacacggctta

SEQ ID NO: 7017967 - DNA, 20 bp, Homo sapiens
tccagctgggaacagctgat

SEQ ID NO: 7017968 - DNA, 22 bp, Homo sapiens
ttactgcaacataatgtagtct

SEQ ID NO: 7017969 - DNA, 22 bp, Homo sapiens
tagacagatttaaaggaatgga

SEQ ID NO: 7017970 - DNA, 21 bp, Homo sapiens
cctaaacaagactgacacaca

SEQ ID NO: 7017971 - DNA, 22 bp, Homo sapiens
ttgtatagcccagagagtgaga

SEQ ID NO: 7017972 - DNA, 22 bp, Homo sapiens
agagtgtttttctgtcaaggac

SEQ ID NO: 7017973 - DNA, 22 bp, Homo sapiens
ttcttgtaatttggagaaatga

SEQ ID NO: 7017974 - DNA, 22 bp, Homo sapiens
gactttaagtcctatctgtgcg

SEQ ID NO: 7017975 - DNA, 22 bp, Homo sapiens
agccatgttggggaaggtgggc

SEQ ID NO: 7017976 - DNA, 22 bp, Homo sapiens
gccaggaatttcaagagccact

SEQ ID NO: 7017977 - DNA, 22 bp, Homo sapiens
gtctttcatggatattcagttt

SEQ ID NO: 7017978 - DNA, 22 bp, Homo sapiens
tattggagtatggggctggagt

SEQ ID NO: 7017979 - DNA, 22 bp, Homo sapiens
atggctgtagtcatctgaaggc

SEQ ID NO: 7017980 - DNA, 22 bp, Homo sapiens
atttggcaaaagttagaagaaa

SEQ ID NO: 7017981 - DNA, 22 bp, Homo sapiens
ccaggggttggaggttgcagtg

SEQ ID NO: 7017982 - DNA, 20 bp, Homo sapiens
agagatggggtatcaccgta

SEQ ID NO: 7017983 - DNA, 22 bp, Homo sapiens
tacactaatgtttttgcaaagc

SEQ ID NO: 7017984 - DNA, 22 bp, Homo sapiens
gtccctcacccagatgctccca

SEQ ID NO: 7017985 - DNA, 22 bp, Homo sapiens
tctctgcttggtgtatgtgagt

SEQ ID NO: 7017986 - DNA, 22 bp, Homo sapiens
aatcttacaccgaatttaaact

SEQ ID NO: 7017987 - DNA, 22 bp, Homo sapiens
aatgagtcatgaagattagcaa

SEQ ID NO: 7017988 - DNA, 22 bp, Homo sapiens
agctgcccaaggtcacagagct

SEQ ID NO: 7017989 - DNA, 22 bp, Homo sapiens
atgaatggatggggtcaagata

SEQ ID NO: 7017990 - DNA, 22 bp, Homo sapiens
tcactctggagtccgctaccag

SEQ ID NO: 7017991 - DNA, 22 bp, Homo sapiens
gcttccgcgatgtcctaggtgg

SEQ ID NO: 7017992 - DNA, 22 bp, Homo sapiens
acagaggcctcggcctgcccag

SEQ ID NO: 7017993 - DNA, 22 bp, Homo sapiens
aagcattttagtaatgaacttg

SEQ ID NO: 7017994 - DNA, 22 bp, Homo sapiens
aaactgataaaataagtacatt

SEQ ID NO: 7017995 - DNA, 22 bp, Homo sapiens
tgaaacaagtttaagggatcta

SEQ ID NO: 7017996 - DNA, 22 bp, Homo sapiens
acaggccttaggagagatgggg

SEQ ID NO: 7017997 - DNA, 22 bp, Homo sapiens
tcataaaagtactcatgttcat

SEQ ID NO: 7017998 - DNA, 22 bp, Homo sapiens
caggctccacaggggaatccgg

SEQ ID NO: 7017999 - DNA, 22 bp, Homo sapiens
gtgcttggcttggtgtgacctg

SEQ ID NO: 7018000 - DNA, 23 bp, Homo sapiens
accctgggcaagtcacctaacct

SEQ ID NO: 7018001 - DNA, 22 bp, Homo sapiens
tttcacactagtcagaatacca

SEQ ID NO: 7018002 - DNA, 22 bp, Homo sapiens
ttgcatttggttctgcctggta

SEQ ID NO: 7018003 - DNA, 22 bp, Homo sapiens
aggcagagctgatgttctgtga

SEQ ID NO: 7018004 - DNA, 22 bp, Homo sapiens
catttgctagcaggccttttat

SEQ ID NO: 7018005 - DNA, 22 bp, Homo sapiens
tcacaggctctagggattaaga

SEQ ID NO: 7018006 - DNA, 22 bp, Homo sapiens
atatttgtaaaattctgtgtct

SEQ ID NO: 7018007 - DNA, 22 bp, Homo sapiens
acaggcattgggatggaggttg

SEQ ID NO: 7018008 - DNA, 22 bp, Homo sapiens
acatttctttctattcagtagc

SEQ ID NO: 7018009 - DNA, 20 bp, Homo sapiens
ttcctgtcctctctttcagg

SEQ ID NO: 7018010 - DNA, 22 bp, Homo sapiens
gcctattatcagagctagtgat

SEQ ID NO: 7018011 - DNA, 22 bp, Homo sapiens
agagacagggttttgtcgtgtt

SEQ ID NO: 7018012 - DNA, 22 bp, Homo sapiens
ttccagaggcttcagggaagaa

SEQ ID NO: 7018013 - DNA, 22 bp, Homo sapiens
gtaagaggagtgggaagcctca

SEQ ID NO: 7018014 - DNA, 22 bp, Homo sapiens
cagactttctggaagctaaaaa

SEQ ID NO: 7018015 - DNA, 22 bp, Homo sapiens
tctgtttcttcttctgttatat

SEQ ID NO: 7018016 - DNA, 22 bp, Homo sapiens
attgcttcatgtcctttgccgg

SEQ ID NO: 7018017 - DNA, 22 bp, Homo sapiens
aggccacaggattgcacagcat

SEQ ID NO: 7018018 - DNA, 22 bp, Homo sapiens
cctctggctgtaccactggcac

SEQ ID NO: 7018019 - DNA, 22 bp, Homo sapiens
gttaatggctgatgaggctact

SEQ ID NO: 7018020 - DNA, 22 bp, Homo sapiens
ctctggaggccgttggccctta

SEQ ID NO: 7018021 - DNA, 20 bp, Homo sapiens
ctgctgtgattccctcctcc

SEQ ID NO: 7018022 - DNA, 22 bp, Homo sapiens
cctccctcagaatgaagaaagg

SEQ ID NO: 7018023 - DNA, 22 bp, Homo sapiens
gctggccaggtgctttggttct

SEQ ID NO: 7018024 - DNA, 22 bp, Homo sapiens
gatcacatgaatggaatagaag

SEQ ID NO: 7018025 - DNA, 22 bp, Homo sapiens
gaagatacctcaattctttgaa

SEQ ID NO: 7018026 - DNA, 22 bp, Homo sapiens
gcagctgagagaagaacagggc

SEQ ID NO: 7018027 - DNA, 22 bp, Homo sapiens
tggccctcagtcttgctcctgc

SEQ ID NO: 7018028 - DNA, 22 bp, Homo sapiens
tcttgacattgcaatcttcaga

SEQ ID NO: 7018029 - DNA, 22 bp, Homo sapiens
tttctgccaaccatttaaactc

SEQ ID NO: 7018030 - DNA, 22 bp, Homo sapiens
gcctggcaggggcctgggagtg

SEQ ID NO: 7018031 - DNA, 22 bp, Homo sapiens
aaggctgtttattagaaaaagt

SEQ ID NO: 7018032 - DNA, 22 bp, Homo sapiens
tttagaggttagaggctgatag

SEQ ID NO: 7018033 - DNA, 22 bp, Homo sapiens
ctcaggcccacagcagacccac

SEQ ID NO: 7018034 - DNA, 19 bp, Homo sapiens
tccaggtggagagacaccc

SEQ ID NO: 7018035 - DNA, 22 bp, Homo sapiens
gcttccagggtgggggatgttt

SEQ ID NO: 7018036 - DNA, 22 bp, Homo sapiens
tggcaggcaagttcagctccac

SEQ ID NO: 7018037 - DNA, 20 bp, Homo sapiens
tcctaactataaagtggctc

SEQ ID NO: 7018038 - DNA, 22 bp, Homo sapiens
tgtgcagaaactgggaaggaag

SEQ ID NO: 7018039 - DNA, 22 bp, Homo sapiens
aaatctcactggcaggcaggca

SEQ ID NO: 7018040 - DNA, 22 bp, Homo sapiens
gattcctagatctcccctttag

SEQ ID NO: 7018041 - DNA, 22 bp, Homo sapiens
gcagacatgaccaccaaccagg

SEQ ID NO: 7018042 - DNA, 22 bp, Homo sapiens
gacactttggtgctttgtggtt

SEQ ID NO: 7018043 - DNA, 22 bp, Homo sapiens
ctgtgagtaatgacctgtcttg

SEQ ID NO: 7018044 - DNA, 22 bp, Homo sapiens
tccagacctagctggtcattaa

SEQ ID NO: 7018045 - DNA, 22 bp, Homo sapiens
tatatcagcaaagcatttaaaa

SEQ ID NO: 7018046 - DNA, 22 bp, Homo sapiens
gagtaatattctgtactggagg

SEQ ID NO: 7018047 - DNA, 22 bp, Homo sapiens
agtctcaccgggagcttgggag

SEQ ID NO: 7018048 - DNA, 22 bp, Homo sapiens
acatctagactcttgccctctt

SEQ ID NO: 7018049 - DNA, 19 bp, Homo sapiens
cctggctctgagcccagcc

SEQ ID NO: 7018050 - DNA, 22 bp, Homo sapiens
gaagctgagtggactctggcca

SEQ ID NO: 7018051 - DNA, 22 bp, Homo sapiens
ttcgggcccaggccgaggacct

SEQ ID NO: 7018052 - DNA, 22 bp, Homo sapiens
ctgaagttaaagtagtttttat

SEQ ID NO: 7018053 - DNA, 22 bp, Homo sapiens
gcctggctgctggttctgagga

SEQ ID NO: 7018054 - DNA, 22 bp, Homo sapiens
gattcctttcgcctgccgagct

SEQ ID NO: 7018055 - DNA, 18 bp, Homo sapiens
tcacatgacagctgttgc

SEQ ID NO: 7018056 - DNA, 22 bp, Homo sapiens
tctgccagcttctggtggttgc

SEQ ID NO: 7018057 - DNA, 22 bp, Homo sapiens
gagggatgtgcctgaaggcagg

SEQ ID NO: 7018058 - DNA, 22 bp, Homo sapiens
taccaaaaccaagccattatct

SEQ ID NO: 7018059 - DNA, 22 bp, Homo sapiens
aagtcagaaaacagagcaatta

SEQ ID NO: 7018060 - DNA, 22 bp, Homo sapiens
agtagccaaagatagagccgtt

SEQ ID NO: 7018061 - DNA, 22 bp, Homo sapiens
gggcaatgtgtgttcactatat

SEQ ID NO: 7018062 - DNA, 17 bp, Homo sapiens
ccagagagtagttagga

SEQ ID NO: 7018063 - DNA, 19 bp, Homo sapiens
gcctaaatgtggaattagt

SEQ ID NO: 7018064 - DNA, 22 bp, Homo sapiens
aatgtcttttgcagttcaagat

SEQ ID NO: 7018065 - DNA, 22 bp, Homo sapiens
aaactcaagtctatgaacaagg

SEQ ID NO: 7018066 - DNA, 22 bp, Homo sapiens
ctgaagagcaaaccaactggac

SEQ ID NO: 7018067 - DNA, 22 bp, Homo sapiens
agcccctctccgccctgagtcg

SEQ ID NO: 7018068 - DNA, 18 bp, Homo sapiens
atttaatgaactgaaagc

SEQ ID NO: 7018069 - DNA, 22 bp, Homo sapiens
agagctctcaatggtcaatgct

SEQ ID NO: 7018070 - DNA, 22 bp, Homo sapiens
tggcatgtttgcttgtgcatat

SEQ ID NO: 7018071 - DNA, 22 bp, Homo sapiens
agtaaacagtatctttagtgtc

SEQ ID NO: 7018072 - DNA, 23 bp, Homo sapiens
tgaatgcgagatgacagctccca

SEQ ID NO: 7018073 - DNA, 22 bp, Homo sapiens
gtagatcatgagaatgtttttg

SEQ ID NO: 7018074 - DNA, 22 bp, Homo sapiens
atattttcactgaaccaaagta

SEQ ID NO: 7018075 - DNA, 22 bp, Homo sapiens
tctttctgcacttagtggggct

SEQ ID NO: 7018076 - DNA, 20 bp, Homo sapiens
agctgcccttttcacatgtt

SEQ ID NO: 7018077 - DNA, 22 bp, Homo sapiens
aggtgattctaatgtgcagtca

SEQ ID NO: 7018078 - DNA, 22 bp, Homo sapiens
gataatgatgacaatgacaacc

SEQ ID NO: 7018079 - DNA, 22 bp, Homo sapiens
aatagcaaacagacatgcacaa

SEQ ID NO: 7018080 - DNA, 22 bp, Homo sapiens
aaagcagctgatagtctcatct

SEQ ID NO: 7018081 - DNA, 23 bp, Homo sapiens
ccaggcagtagctattgaagtga

SEQ ID NO: 7018082 - DNA, 22 bp, Homo sapiens
tcaggaacccccgctgggtgaa

SEQ ID NO: 7018083 - DNA, 22 bp, Homo sapiens
ttaggaatatgtattttaaagt

SEQ ID NO: 7018084 - DNA, 22 bp, Homo sapiens
atagaggggctccccagtaagg

SEQ ID NO: 7018085 - DNA, 22 bp, Homo sapiens
ttgtgtatttcctgaaggtaag

SEQ ID NO: 7018086 - DNA, 22 bp, Homo sapiens
atggaagagtccccatggatga

SEQ ID NO: 7018087 - DNA, 22 bp, Homo sapiens
tatattctgattccatctgtgt

SEQ ID NO: 7018088 - DNA, 19 bp, Homo sapiens
actgaagttacccaaatgg

SEQ ID NO: 7018089 - DNA, 18 bp, Homo sapiens
ttacttgacccctctgaa

SEQ ID NO: 7018090 - DNA, 22 bp, Homo sapiens
ccttcagacctagacaggaatc

SEQ ID NO: 7018091 - DNA, 19 bp, Homo sapiens
tgctcagtggctaaaagca

SEQ ID NO: 7018092 - DNA, 17 bp, Homo sapiens
agtgacttggaaagagc

SEQ ID NO: 7018093 - DNA, 22 bp, Homo sapiens
tgaaaagtgatcatggattagg

SEQ ID NO: 7018094 - DNA, 22 bp, Homo sapiens
ctgtattctgggcagggaagga

SEQ ID NO: 7018095 - DNA, 22 bp, Homo sapiens
gatgacacttgtgagaaatcaa

SEQ ID NO: 7018096 - DNA, 22 bp, Homo sapiens
aggctctgtcaggcggagcagc

SEQ ID NO: 7018097 - DNA, 22 bp, Homo sapiens
gccaagcctgtagacacaagct

SEQ ID NO: 7018098 - DNA, 21 bp, Homo sapiens
aggagctggagaaaactttcc

SEQ ID NO: 7018099 - DNA, 22 bp, Homo sapiens
atggatggaactctgctgtggt

SEQ ID NO: 7018100 - DNA, 22 bp, Homo sapiens
tggaacactttcagtagctatt

SEQ ID NO: 7018101 - DNA, 22 bp, Homo sapiens
gtcaggaaaacccgggttgact

SEQ ID NO: 7018102 - DNA, 22 bp, Homo sapiens
tccttggaggtcaacgggacgg

SEQ ID NO: 7018103 - DNA, 22 bp, Homo sapiens
ggcaggtgcgcatgttgcatta

SEQ ID NO: 7018104 - DNA, 22 bp, Homo sapiens
actgaaatggggacagtcctta

SEQ ID NO: 7018105 - DNA, 22 bp, Homo sapiens
agacaaatttgttttcctgtct

SEQ ID NO: 7018106 - DNA, 22 bp, Homo sapiens
tgcaatatcagattcaacacat

SEQ ID NO: 7018107 - DNA, 22 bp, Homo sapiens
tctctgtacagtacatgccgtg

SEQ ID NO: 7018108 - DNA, 22 bp, Homo sapiens
acttgcatttcaggcacttgtg

SEQ ID NO: 7018109 - DNA, 22 bp, Homo sapiens
tgagaagctgcttgtgctgtat

SEQ ID NO: 7018110 - DNA, 22 bp, Homo sapiens
cactgagaaagtgacctgccaa

SEQ ID NO: 7018111 - DNA, 17 bp, Homo sapiens
gaaggcctgcacaggcc

SEQ ID NO: 7018112 - DNA, 20 bp, Homo sapiens
aacactgagggctactcttc

SEQ ID NO: 7018113 - DNA, 22 bp, Homo sapiens
ctgcaggagcaagcctgggaga

SEQ ID NO: 7018114 - DNA, 18 bp, Homo sapiens
agtccatgcatggctata

SEQ ID NO: 7018115 - DNA, 22 bp, Homo sapiens
catgcgggttccaggctgcact

SEQ ID NO: 7018116 - DNA, 22 bp, Homo sapiens
tagattaacagttttgttgaag

SEQ ID NO: 7018117 - DNA, 22 bp, Homo sapiens
cattacagaatatgtaatgatc

SEQ ID NO: 7018118 - DNA, 22 bp, Homo sapiens
gtgggtgtggttcgtttaagac

SEQ ID NO: 7018119 - DNA, 22 bp, Homo sapiens
tcatggttggagattgagggca

SEQ ID NO: 7018120 - DNA, 20 bp, Homo sapiens
aggaagatcctttcttttaa

SEQ ID NO: 7018121 - DNA, 22 bp, Homo sapiens
agccttctctgattctcctagt

SEQ ID NO: 7018122 - DNA, 20 bp, Homo sapiens
tggcatctctcaattgtagg

SEQ ID NO: 7018123 - DNA, 22 bp, Homo sapiens
gcaaataaatgctcactgctgt

SEQ ID NO: 7018124 - DNA, 22 bp, Homo sapiens
acttgcatgattaatttggtga

SEQ ID NO: 7018125 - DNA, 22 bp, Homo sapiens
aggacctgccaggtgcaaagca

SEQ ID NO: 7018126 - DNA, 22 bp, Homo sapiens
tgagatggagttctgctcttgt

SEQ ID NO: 7018127 - DNA, 22 bp, Homo sapiens
ttactgtttttaactaattgtg

SEQ ID NO: 7018128 - DNA, 22 bp, Homo sapiens
gcctgatcaggtcctcggcata

SEQ ID NO: 7018129 - DNA, 22 bp, Homo sapiens
aattctgatgatactgcattgt

SEQ ID NO: 7018130 - DNA, 18 bp, Homo sapiens
tcattacttgtctcccct

SEQ ID NO: 7018131 - DNA, 15 bp, Homo sapiens
aaagttgatggctct

SEQ ID NO: 7018132 - DNA, 22 bp, Homo sapiens
tgcattaagaatttctgaggat

SEQ ID NO: 7018133 - DNA, 22 bp, Homo sapiens
tccagtctctggctgtttgtga

SEQ ID NO: 7018134 - DNA, 22 bp, Homo sapiens
tgctgtgcaaaggtgatgtgag

SEQ ID NO: 7018135 - DNA, 19 bp, Homo sapiens
tggagaggaaatgctgctc

SEQ ID NO: 7018136 - DNA, 22 bp, Homo sapiens
atgcaacacccctatggatgga

SEQ ID NO: 7018137 - DNA, 22 bp, Homo sapiens
ctggcccttctcttgcttcctg

SEQ ID NO: 7018138 - DNA, 22 bp, Homo sapiens
cttctgcaggccctgtctgacc

SEQ ID NO: 7018139 - DNA, 22 bp, Homo sapiens
ccaattcatcctctggggcttc

SEQ ID NO: 7018140 - DNA, 22 bp, Homo sapiens
aacagctttgtatacagtaact

SEQ ID NO: 7018141 - DNA, 22 bp, Homo sapiens
tcactgtcaggctaaggttata

SEQ ID NO: 7018142 - DNA, 22 bp, Homo sapiens
ggcttgttgaaacacagattgt

SEQ ID NO: 7018143 - DNA, 22 bp, Homo sapiens
tctggatgaagacccagaggct

SEQ ID NO: 7018144 - DNA, 22 bp, Homo sapiens
taagatcatgggaaatggacat

SEQ ID NO: 7018145 - DNA, 22 bp, Homo sapiens
cactaattaacacgtcgtctct

SEQ ID NO: 7018146 - DNA, 22 bp, Homo sapiens
agtaacagaaggcctgacttaa

SEQ ID NO: 7018147 - DNA, 22 bp, Homo sapiens
ctcctaggacgccgctgctcct

SEQ ID NO: 7018148 - DNA, 22 bp, Homo sapiens
tggttgaatgtagcatttatgg

SEQ ID NO: 7018149 - DNA, 22 bp, Homo sapiens
tcagaggcttgaagcccaagcc

SEQ ID NO: 7018150 - DNA, 22 bp, Homo sapiens
ttttaagaggaggctgtttgaa

SEQ ID NO: 7018151 - DNA, 22 bp, Homo sapiens
tttggtcaatatggtagcagca

SEQ ID NO: 7018152 - DNA, 22 bp, Homo sapiens
tgtgactggttgtcccgctttc

SEQ ID NO: 7018153 - DNA, 22 bp, Homo sapiens
tgggtgtcaatgtcacacgatt

SEQ ID NO: 7018154 - DNA, 22 bp, Homo sapiens
gggcttcaaaattggcactctt

SEQ ID NO: 7018155 - DNA, 22 bp, Homo sapiens
ttttcctttgaaaggtgagggc

SEQ ID NO: 7018156 - DNA, 22 bp, Homo sapiens
attcagtgattcatttgtacaa

SEQ ID NO: 7018157 - DNA, 21 bp, Homo sapiens
tttgctgaatgattccagggc

SEQ ID NO: 7018158 - DNA, 22 bp, Homo sapiens
ccagcatttgcttctggtgggg

SEQ ID NO: 7018159 - DNA, 20 bp, Homo sapiens
tgcctgcccaggtcctgcac

SEQ ID NO: 7018160 - DNA, 22 bp, Homo sapiens
tttggccacttgggagtccagg

SEQ ID NO: 7018161 - DNA, 22 bp, Homo sapiens
cctgtgctcccatagcttctgt

SEQ ID NO: 7018162 - DNA, 22 bp, Homo sapiens
tgctggaataatttcatgttaa

SEQ ID NO: 7018163 - DNA, 22 bp, Homo sapiens
aagagaaggccctgacccaccc

SEQ ID NO: 7018164 - DNA, 22 bp, Homo sapiens
tatgttctaaccttgtctttcc

SEQ ID NO: 7018165 - DNA, 22 bp, Homo sapiens
tgtgactatcattctaaacatc

SEQ ID NO: 7018166 - DNA, 22 bp, Homo sapiens
actgcagcctagggaccacagt

SEQ ID NO: 7018167 - DNA, 22 bp, Homo sapiens
cttcttcataggcagtcctgtt

SEQ ID NO: 7018168 - DNA, 22 bp, Homo sapiens
tacagggcatgtgcagacacat

SEQ ID NO: 7018169 - DNA, 19 bp, Homo sapiens
ctgaagtcttttcagctgg

SEQ ID NO: 7018170 - DNA, 22 bp, Homo sapiens
aggctgcagcttgtctcgtggg

SEQ ID NO: 7018171 - DNA, 22 bp, Homo sapiens
gattctctctggatcccatgga

SEQ ID NO: 7018172 - DNA, 22 bp, Homo sapiens
tctttacaagtcacattttctg

SEQ ID NO: 7018173 - DNA, 22 bp, Homo sapiens
ttgcagatatttccgatgctat

SEQ ID NO: 7018174 - DNA, 22 bp, Homo sapiens
aacagataatttctaagttact

SEQ ID NO: 7018175 - DNA, 22 bp, Homo sapiens
aaactctgttgagataatattt

SEQ ID NO: 7018176 - DNA, 19 bp, Homo sapiens
ccaggcctgcgggcgttgg

SEQ ID NO: 7018177 - DNA, 22 bp, Homo sapiens
tatgtagaagctgctcaaagaa

SEQ ID NO: 7018178 - DNA, 22 bp, Homo sapiens
gcggtttaggccaacctccctg

SEQ ID NO: 7018179 - DNA, 22 bp, Homo sapiens
cctcctgttgtcaccaggcgtg

SEQ ID NO: 7018180 - DNA, 22 bp, Homo sapiens
tgaggttatgcttgttgaggtt

SEQ ID NO: 7018181 - DNA, 22 bp, Homo sapiens
tgaggcctagagaggttaataa

SEQ ID NO: 7018182 - DNA, 22 bp, Homo sapiens
atgaataagtaaactcctttgg

SEQ ID NO: 7018183 - DNA, 22 bp, Homo sapiens
gtaattaggaataaaatgggaa

SEQ ID NO: 7018184 - DNA, 22 bp, Homo sapiens
cttcagtgatataggcttctcc

SEQ ID NO: 7018185 - DNA, 22 bp, Homo sapiens
atgttcccaagggatagaaaga

SEQ ID NO: 7018186 - DNA, 22 bp, Homo sapiens
ggagatgctacagttcagctct

SEQ ID NO: 7018187 - DNA, 22 bp, Homo sapiens
cagaaactgtttgttaatattt

SEQ ID NO: 7018188 - DNA, 22 bp, Homo sapiens
tgacatgtccaggtggtcctgt

SEQ ID NO: 7018189 - DNA, 22 bp, Homo sapiens
gttaaactgaaaggctcgttca

SEQ ID NO: 7018190 - DNA, 22 bp, Homo sapiens
gaagttagatgtggtcactgac

SEQ ID NO: 7018191 - DNA, 22 bp, Homo sapiens
gccaccctggaccaccctgggc

SEQ ID NO: 7018192 - DNA, 22 bp, Homo sapiens
catcaggaggagatgaagaaaa

SEQ ID NO: 7018193 - DNA, 22 bp, Homo sapiens
ggtgtccgcgctgtagaaggtc

SEQ ID NO: 7018194 - DNA, 22 bp, Homo sapiens
tctgcaggaagctggcggctga

SEQ ID NO: 7018195 - DNA, 22 bp, Homo sapiens
ttccgtcaggtgcaggtcagtg

SEQ ID NO: 7018196 - DNA, 22 bp, Homo sapiens
acattgcaattaggtacctatg

SEQ ID NO: 7018197 - DNA, 22 bp, Homo sapiens
ttttatcagcagggataacaag

SEQ ID NO: 7018198 - DNA, 22 bp, Homo sapiens
tacatatgaactttataacttg

SEQ ID NO: 7018199 - DNA, 22 bp, Homo sapiens
cccagtttcaactttccagtgg

SEQ ID NO: 7018200 - DNA, 21 bp, Homo sapiens
aatgtcattgaatggtgagac

SEQ ID NO: 7018201 - DNA, 22 bp, Homo sapiens
gatacattccgggagggctacc

SEQ ID NO: 7018202 - DNA, 22 bp, Homo sapiens
tggccctgactgatgtggaggg

SEQ ID NO: 7018203 - DNA, 22 bp, Homo sapiens
atcattgagattttttacaact

SEQ ID NO: 7018204 - DNA, 22 bp, Homo sapiens
gcagatgttcgcgttaatgcat

SEQ ID NO: 7018205 - DNA, 22 bp, Homo sapiens
tgaggcctctgaggcctaggct

SEQ ID NO: 7018206 - DNA, 20 bp, Homo sapiens
atgtatgcaaatgtcttcca

SEQ ID NO: 7018207 - DNA, 22 bp, Homo sapiens
aatccactttgtgcccctctct

SEQ ID NO: 7018208 - DNA, 22 bp, Homo sapiens
tgtgagattgttttactataat

SEQ ID NO: 7018209 - DNA, 22 bp, Homo sapiens
aattgtcttgaaagcaacactt

SEQ ID NO: 7018210 - DNA, 22 bp, Homo sapiens
aagacagcctttccctggtgcc

SEQ ID NO: 7018211 - DNA, 19 bp, Homo sapiens
tagatttgatcatctggat

SEQ ID NO: 7018212 - DNA, 22 bp, Homo sapiens
tgcatagggttcaaaggctgta

SEQ ID NO: 7018213 - DNA, 22 bp, Homo sapiens
aaatgcatgtatgtaatatgct

SEQ ID NO: 7018214 - DNA, 22 bp, Homo sapiens
tccaaacaccctccatgctgca

SEQ ID NO: 7018215 - DNA, 22 bp, Homo sapiens
tcccagtgaggtcctggctgtc

SEQ ID NO: 7018216 - DNA, 22 bp, Homo sapiens
catgagcttaactgtgaaatgg

SEQ ID NO: 7018217 - DNA, 22 bp, Homo sapiens
ttcaaagctgcagactcctggg

SEQ ID NO: 7018218 - DNA, 22 bp, Homo sapiens
ctcgcctgcctgtgtctctccc

SEQ ID NO: 7018219 - DNA, 22 bp, Homo sapiens
atacagaagttttccacttatt

SEQ ID NO: 7018220 - DNA, 18 bp, Homo sapiens
ggtggtttggaagcaggt

SEQ ID NO: 7018221 - DNA, 22 bp, Homo sapiens
tcagggaaaacatcccgcctaa

SEQ ID NO: 7018222 - DNA, 22 bp, Homo sapiens
aaagggcagagttcactagaaa

SEQ ID NO: 7018223 - DNA, 22 bp, Homo sapiens
ctcaggaaccgcggcagcagcc

SEQ ID NO: 7018224 - DNA, 22 bp, Homo sapiens
gaaaggaagaaaggtcatttta

SEQ ID NO: 7018225 - DNA, 22 bp, Homo sapiens
ggccagcagacctcagggactc

SEQ ID NO: 7018226 - DNA, 22 bp, Homo sapiens
aggcttcaaggttcttggcagg

SEQ ID NO: 7018227 - DNA, 22 bp, Homo sapiens
attccagttgggttctaataca

SEQ ID NO: 7018228 - DNA, 22 bp, Homo sapiens
atgaggtaaggtattcagggaa

SEQ ID NO: 7018229 - DNA, 22 bp, Homo sapiens
actttatgatacagggaagggt

SEQ ID NO: 7018230 - DNA, 22 bp, Homo sapiens
tcctgaggctcactttgaatgt

SEQ ID NO: 7018231 - DNA, 22 bp, Homo sapiens
agtttccttgggcatttgttta

SEQ ID NO: 7018232 - DNA, 18 bp, Homo sapiens
ccacagcggaatggacat

SEQ ID NO: 7018233 - DNA, 21 bp, Homo sapiens
catgtgtcattggagagcaat

SEQ ID NO: 7018234 - DNA, 22 bp, Homo sapiens
aaggccttgccgaaggatgcca

SEQ ID NO: 7018235 - DNA, 22 bp, Homo sapiens
gttagtgtgactgaggaatgca

SEQ ID NO: 7018236 - DNA, 22 bp, Homo sapiens
cagagccctgtgtgccatgtga

SEQ ID NO: 7018237 - DNA, 22 bp, Homo sapiens
tatgtacaccaaggattgaaaa

SEQ ID NO: 7018238 - DNA, 22 bp, Homo sapiens
agtcaaagggtatttggattga

SEQ ID NO: 7018239 - DNA, 22 bp, Homo sapiens
cagctgaagcccaggcagaacc

SEQ ID NO: 7018240 - DNA, 22 bp, Homo sapiens
ctcatgtcggcaggactcgccc

SEQ ID NO: 7018241 - DNA, 22 bp, Homo sapiens
gctccaggtatttgccctttta

SEQ ID NO: 7018242 - DNA, 22 bp, Homo sapiens
cttttgcagccattattgctgc

SEQ ID NO: 7018243 - DNA, 15 bp, Homo sapiens
gagtggctttcagaa

SEQ ID NO: 7018244 - DNA, 22 bp, Homo sapiens
ggccagtcccctaatccagggc

SEQ ID NO: 7018245 - DNA, 22 bp, Homo sapiens
tctgctgaacttgctgcccaga

SEQ ID NO: 7018246 - DNA, 22 bp, Homo sapiens
tagagaaaagcagggatcagga

SEQ ID NO: 7018247 - DNA, 22 bp, Homo sapiens
agcccagcagtaagattagaga

SEQ ID NO: 7018248 - DNA, 22 bp, Homo sapiens
ttaaaaaccatcttcctttcct

SEQ ID NO: 7018249 - DNA, 22 bp, Homo sapiens
atgttcaacagtttgcacacat

SEQ ID NO: 7018250 - DNA, 22 bp, Homo sapiens
tcctgggaccgagggaagagct

SEQ ID NO: 7018251 - DNA, 22 bp, Homo sapiens
ctctgggaccacgtgactctgc

SEQ ID NO: 7018252 - DNA, 23 bp, Homo sapiens
tgggccagttctgttgaaagcca

SEQ ID NO: 7018253 - DNA, 22 bp, Homo sapiens
attgcttgaattaccatgtaat

SEQ ID NO: 7018254 - DNA, 20 bp, Homo sapiens
agaagtcagctcagaagtga

SEQ ID NO: 7018255 - DNA, 22 bp, Homo sapiens
gctgctgtggcagattggattc

SEQ ID NO: 7018256 - DNA, 22 bp, Homo sapiens
ctgaggctggggaagggaagtg

SEQ ID NO: 7018257 - DNA, 22 bp, Homo sapiens
cagtggcttctcatgtcattca

SEQ ID NO: 7018258 - DNA, 22 bp, Homo sapiens
tcacaactcacagccaccggtg

SEQ ID NO: 7018259 - DNA, 22 bp, Homo sapiens
catcttcagtgattacctaaaa

SEQ ID NO: 7018260 - DNA, 22 bp, Homo sapiens
gcagggtgatagtgaggctcag

SEQ ID NO: 7018261 - DNA, 22 bp, Homo sapiens
tttcacattcagatatagactt

SEQ ID NO: 7018262 - DNA, 22 bp, Homo sapiens
tgctgggcccagggagcctctg

SEQ ID NO: 7018263 - DNA, 22 bp, Homo sapiens
tggctatgaggagcgcaggtgt

SEQ ID NO: 7018264 - DNA, 22 bp, Homo sapiens
attcccatgtctttacctgttg

SEQ ID NO: 7018265 - DNA, 22 bp, Homo sapiens
cccagcagccagaatgaggagc

SEQ ID NO: 7018266 - DNA, 18 bp, Homo sapiens
aggcagcagcatcttctc

SEQ ID NO: 7018267 - DNA, 22 bp, Homo sapiens
aaacaacctaaagttactgatc

SEQ ID NO: 7018268 - DNA, 22 bp, Homo sapiens
gtcttatcacgtggctagctca

SEQ ID NO: 7018269 - DNA, 22 bp, Homo sapiens
atgctaaataactggtttgact

SEQ ID NO: 7018270 - DNA, 22 bp, Homo sapiens
tgctcacactcatgtccacgct

SEQ ID NO: 7018271 - DNA, 22 bp, Homo sapiens
gatgggtattggcagaagaggg

SEQ ID NO: 7018272 - DNA, 22 bp, Homo sapiens
agtcttagtctctattgtgttt

SEQ ID NO: 7018273 - DNA, 20 bp, Homo sapiens
gtctcagaatggatttgcat

SEQ ID NO: 7018274 - DNA, 22 bp, Homo sapiens
ttgtttctctggtcttgagtga

SEQ ID NO: 7018275 - DNA, 22 bp, Homo sapiens
aagcttcatatatgtgtgagtc

SEQ ID NO: 7018276 - DNA, 22 bp, Homo sapiens
atctcataatcgtcattgcttt

SEQ ID NO: 7018277 - DNA, 22 bp, Homo sapiens
ccacgtgtaggtggacaggatc

SEQ ID NO: 7018278 - DNA, 22 bp, Homo sapiens
cagcattgggttacctttgttt

SEQ ID NO: 7018279 - DNA, 22 bp, Homo sapiens
tgtctgcctgtctctgtgcaaa

SEQ ID NO: 7018280 - DNA, 22 bp, Homo sapiens
tgtttatagatggccacaatga

SEQ ID NO: 7018281 - DNA, 22 bp, Homo sapiens
aagcagcctggcatgatgcttt

SEQ ID NO: 7018282 - DNA, 22 bp, Homo sapiens
aggcttggctctcctatgagaa

SEQ ID NO: 7018283 - DNA, 22 bp, Homo sapiens
tgggcctcctccgacagccggg

SEQ ID NO: 7018284 - DNA, 21 bp, Homo sapiens
gtggcctgattatgaatgggt

SEQ ID NO: 7018285 - DNA, 22 bp, Homo sapiens
ttccttttcttatgcatcatta

SEQ ID NO: 7018286 - DNA, 22 bp, Homo sapiens
ctctgcatcagcttcattctgt

SEQ ID NO: 7018287 - DNA, 22 bp, Homo sapiens
cccagagcctcattctgttggg

SEQ ID NO: 7018288 - DNA, 22 bp, Homo sapiens
aggaaattttgaatcagtgtct

SEQ ID NO: 7018289 - DNA, 22 bp, Homo sapiens
tggacagaaacccgagtgatct

SEQ ID NO: 7018290 - DNA, 22 bp, Homo sapiens
attctagccaaccatctgagat

SEQ ID NO: 7018291 - DNA, 17 bp, Homo sapiens
gtcactttgtttaaagg

SEQ ID NO: 7018292 - DNA, 22 bp, Homo sapiens
caaagtttggctctcatgacat

SEQ ID NO: 7018293 - DNA, 23 bp, Homo sapiens
tggtgccacagctgaagtcaggt

SEQ ID NO: 7018294 - DNA, 22 bp, Homo sapiens
acatcatgagagacttaaattg

SEQ ID NO: 7018295 - DNA, 22 bp, Homo sapiens
tttcaacatacctcagtgtatg

SEQ ID NO: 7018296 - DNA, 22 bp, Homo sapiens
agcagcacacgggagaaagaca

SEQ ID NO: 7018297 - DNA, 22 bp, Homo sapiens
gtgcagttgaagcatggggaga

SEQ ID NO: 7018298 - DNA, 22 bp, Homo sapiens
tctctagtctcctttaacctga

SEQ ID NO: 7018299 - DNA, 22 bp, Homo sapiens
agcagtgagtgggaggaccatg

SEQ ID NO: 7018300 - DNA, 22 bp, Homo sapiens
gttatgtactttttaaatcttg

SEQ ID NO: 7018301 - DNA, 22 bp, Homo sapiens
gtacaggatgtgtaaacttggg

SEQ ID NO: 7018302 - DNA, 22 bp, Homo sapiens
catgtgtgtccatgtgactaag

SEQ ID NO: 7018303 - DNA, 22 bp, Homo sapiens
gtatctatgatcctttatatct

SEQ ID NO: 7018304 - DNA, 22 bp, Homo sapiens
ctagggcttccaagatgccttc

SEQ ID NO: 7018305 - DNA, 22 bp, Homo sapiens
atttctagcaaaggctctgcta

SEQ ID NO: 7018306 - DNA, 22 bp, Homo sapiens
agatagatagtgaggtaatagc

SEQ ID NO: 7018307 - DNA, 23 bp, Homo sapiens
tcagccatgcagccgggaagtgg

SEQ ID NO: 7018308 - DNA, 22 bp, Homo sapiens
gcctgagattcccggagccgtg

SEQ ID NO: 7018309 - DNA, 22 bp, Homo sapiens
ttggccaagtcactggttaatg

SEQ ID NO: 7018310 - DNA, 22 bp, Homo sapiens
agcaggaaggtctgtgtgagtc

SEQ ID NO: 7018311 - DNA, 19 bp, Homo sapiens
ttcaagtaaactattatta

SEQ ID NO: 7018312 - DNA, 22 bp, Homo sapiens
tagctttgccacacatgtagat

SEQ ID NO: 7018313 - DNA, 22 bp, Homo sapiens
acaggtttgcagcttgttacct

SEQ ID NO: 7018314 - DNA, 22 bp, Homo sapiens
gctccaggaggctcccgcgtct

SEQ ID NO: 7018315 - DNA, 22 bp, Homo sapiens
gagggaaggagagttgtagctg

SEQ ID NO: 7018316 - DNA, 22 bp, Homo sapiens
acactgtgcatgcatatacaca

SEQ ID NO: 7018317 - DNA, 22 bp, Homo sapiens
tctgctgtctgattcccacttc

SEQ ID NO: 7018318 - DNA, 22 bp, Homo sapiens
ggccagaggtgtcctcagttct

SEQ ID NO: 7018319 - DNA, 22 bp, Homo sapiens
cgccagtatgtggctgtctttg

SEQ ID NO: 7018320 - DNA, 22 bp, Homo sapiens
ttgtatttctccactttctgtt

SEQ ID NO: 7018321 - DNA, 22 bp, Homo sapiens
agaaatgcagtctcgtcaaaag

SEQ ID NO: 7018322 - DNA, 19 bp, Homo sapiens
gcctgccagcctgaatctg

SEQ ID NO: 7018323 - DNA, 22 bp, Homo sapiens
caggatcttttaatgtctccag

SEQ ID NO: 7018324 - DNA, 22 bp, Homo sapiens
tacctagacatgaacacagatg

SEQ ID NO: 7018325 - DNA, 22 bp, Homo sapiens
tgggctccagcacctgtgctct

SEQ ID NO: 7018326 - DNA, 22 bp, Homo sapiens
acaagagtaatttcaacagagt

SEQ ID NO: 7018327 - DNA, 22 bp, Homo sapiens
tctggctctctcatcacccaat

SEQ ID NO: 7018328 - DNA, 22 bp, Homo sapiens
tctgtgcattgtaacaactaaa

SEQ ID NO: 7018329 - DNA, 22 bp, Homo sapiens
gctctgtgcaaatagcacccct

SEQ ID NO: 7018330 - DNA, 22 bp, Homo sapiens
tgaagctatataagttacagca

SEQ ID NO: 7018331 - DNA, 19 bp, Homo sapiens
atacacgtgtatacataca

SEQ ID NO: 7018332 - DNA, 22 bp, Homo sapiens
tgtgaatgtatagtttgtatat

SEQ ID NO: 7018333 - DNA, 22 bp, Homo sapiens
ttaatgacctggaagaagtgat

SEQ ID NO: 7018334 - DNA, 22 bp, Homo sapiens
cttcagctcttggtaaatgttt

SEQ ID NO: 7018335 - DNA, 22 bp, Homo sapiens
cctgggtgaaatagtcctcaag

SEQ ID NO: 7018336 - DNA, 22 bp, Homo sapiens
cccagtggggagctgaggttca

SEQ ID NO: 7018337 - DNA, 22 bp, Homo sapiens
cctgagctgaactaagcagttt

SEQ ID NO: 7018338 - DNA, 22 bp, Homo sapiens
gcattacagcagttcaacttgg

SEQ ID NO: 7018339 - DNA, 22 bp, Homo sapiens
agcttctctcagggtatctttc

SEQ ID NO: 7018340 - DNA, 22 bp, Homo sapiens
ggccacacagatgactgctttc

SEQ ID NO: 7018341 - DNA, 22 bp, Homo sapiens
aatatctagcctttagcagctt

SEQ ID NO: 7018342 - DNA, 22 bp, Homo sapiens
atctggctcacttagtctagga

SEQ ID NO: 7018343 - DNA, 22 bp, Homo sapiens
ttcagattttttaataggtaat

SEQ ID NO: 7018344 - DNA, 22 bp, Homo sapiens
ctctgagctcctggaagcgtgc

SEQ ID NO: 7018345 - DNA, 22 bp, Homo sapiens
cttggctgtaaaatcagaggct

SEQ ID NO: 7018346 - DNA, 20 bp, Homo sapiens
ctgcagtcccctctgaatca

SEQ ID NO: 7018347 - DNA, 22 bp, Homo sapiens
ttgcactagtctcagaggcaaa

SEQ ID NO: 7018348 - DNA, 22 bp, Homo sapiens
tgggccagaagtatgcatgttt

SEQ ID NO: 7018349 - DNA, 22 bp, Homo sapiens
agagactgtgtccatcgtgcct

SEQ ID NO: 7018350 - DNA, 22 bp, Homo sapiens
tctgcagcacttaatgtttcgt

SEQ ID NO: 7018351 - DNA, 22 bp, Homo sapiens
ttatgcatgagataaaaattgg

SEQ ID NO: 7018352 - DNA, 22 bp, Homo sapiens
acagcaggatttggcgatgttg

SEQ ID NO: 7018353 - DNA, 22 bp, Homo sapiens
atttgcctctgctttcaaggat

SEQ ID NO: 7018354 - DNA, 22 bp, Homo sapiens
tgcaaatagcctgatgaaagaa

SEQ ID NO: 7018355 - DNA, 22 bp, Homo sapiens
tgtgggtcatagtatcgtgtta

SEQ ID NO: 7018356 - DNA, 18 bp, Homo sapiens
gctctgtgaccttgagca

SEQ ID NO: 7018357 - DNA, 22 bp, Homo sapiens
actggagtaaaggtcacttgtg

SEQ ID NO: 7018358 - DNA, 22 bp, Homo sapiens
tgttgcgatgaagagcttcacg

SEQ ID NO: 7018359 - DNA, 22 bp, Homo sapiens
cgggctccgggtctttgcagtc

SEQ ID NO: 7018360 - DNA, 22 bp, Homo sapiens
aggatcaagttggttgagcttt

SEQ ID NO: 7018361 - DNA, 22 bp, Homo sapiens
tgggtccctctggagtagtaca

SEQ ID NO: 7018362 - DNA, 22 bp, Homo sapiens
ttctggctttggagaggatagc

SEQ ID NO: 7018363 - DNA, 22 bp, Homo sapiens
ttttctgacctatctacattta

SEQ ID NO: 7018364 - DNA, 22 bp, Homo sapiens
cctgggtgaatgatattctaaa

SEQ ID NO: 7018365 - DNA, 23 bp, Homo sapiens
agtgttagtagttgtcttatgct

SEQ ID NO: 7018366 - DNA, 21 bp, Homo sapiens
aggaagtcctgctgtgctgtc

SEQ ID NO: 7018367 - DNA, 22 bp, Homo sapiens
agggtctctacgcactagaggg

SEQ ID NO: 7018368 - DNA, 22 bp, Homo sapiens
tagttaaggccacttgcctaag

SEQ ID NO: 7018369 - DNA, 22 bp, Homo sapiens
aggaaaggattggcttctctgt

SEQ ID NO: 7018370 - DNA, 22 bp, Homo sapiens
tcaggagtcctgcctgcagcct

SEQ ID NO: 7018371 - DNA, 22 bp, Homo sapiens
gtttcagagttagtgctggctg

SEQ ID NO: 7018372 - DNA, 20 bp, Homo sapiens
tagatccgcagtaaaacttt

SEQ ID NO: 7018373 - DNA, 22 bp, Homo sapiens
aagccctggcaatgtcagatga

SEQ ID NO: 7018374 - DNA, 23 bp, Homo sapiens
actgccagagcaggctttgcctg

SEQ ID NO: 7018375 - DNA, 22 bp, Homo sapiens
aacacatggcaagagcaggaaa

SEQ ID NO: 7018376 - DNA, 22 bp, Homo sapiens
acagcaaaagacaagaacttaa

SEQ ID NO: 7018377 - DNA, 21 bp, Homo sapiens
ggactctacacaggccatctt

SEQ ID NO: 7018378 - DNA, 22 bp, Homo sapiens
cagcttgcagtacttgtttttg

SEQ ID NO: 7018379 - DNA, 21 bp, Homo sapiens
tgctgaatctgccatattttc

SEQ ID NO: 7018380 - DNA, 22 bp, Homo sapiens
ctggcacaactccacctcagcg

SEQ ID NO: 7018381 - DNA, 22 bp, Homo sapiens
gtcctgtgctcagacatggggg

SEQ ID NO: 7018382 - DNA, 22 bp, Homo sapiens
gatataaattaatcaagtgcaa

SEQ ID NO: 7018383 - DNA, 22 bp, Homo sapiens
ggcaggacagtcccagttcaaa

SEQ ID NO: 7018384 - DNA, 22 bp, Homo sapiens
agggcagcacaaggcatggact

SEQ ID NO: 7018385 - DNA, 22 bp, Homo sapiens
catttattctcagatccttgtc

SEQ ID NO: 7018386 - DNA, 22 bp, Homo sapiens
tctgcgtggctgctgtgagcgt

SEQ ID NO: 7018387 - DNA, 22 bp, Homo sapiens
tcaggcctgcagtgccaaccca

SEQ ID NO: 7018388 - DNA, 22 bp, Homo sapiens
tcagctctgcctgtggaggcac

SEQ ID NO: 7018389 - DNA, 22 bp, Homo sapiens
ctctgctgagccagagtcccca

SEQ ID NO: 7018390 - DNA, 22 bp, Homo sapiens
tgcttcagcactttgagagcct

SEQ ID NO: 7018391 - DNA, 22 bp, Homo sapiens
agaggtgtggccaggactcaag

SEQ ID NO: 7018392 - DNA, 22 bp, Homo sapiens
gagaccttaggaacagcctcaa

SEQ ID NO: 7018393 - DNA, 22 bp, Homo sapiens
cactgcttggccctgagggcag

SEQ ID NO: 7018394 - DNA, 21 bp, Homo sapiens
gcagcatgagaaagccccaaa

SEQ ID NO: 7018395 - DNA, 18 bp, Homo sapiens
tgtctgagagctgggcgc

SEQ ID NO: 7018396 - DNA, 22 bp, Homo sapiens
gctgatctcccttttctcacag

SEQ ID NO: 7018397 - DNA, 22 bp, Homo sapiens
aagttttattggctatagcact

SEQ ID NO: 7018398 - DNA, 22 bp, Homo sapiens
cattgcactccagcctgggtaa

SEQ ID NO: 7018399 - DNA, 22 bp, Homo sapiens
aactagaacgagaaagctgaac

SEQ ID NO: 7018400 - DNA, 22 bp, Homo sapiens
catgaaatggccaaccttcggc

SEQ ID NO: 7018401 - DNA, 22 bp, Homo sapiens
tccttaggcaatttgggagagt

SEQ ID NO: 7018402 - DNA, 22 bp, Homo sapiens
tagaaatgattggttgagctct

SEQ ID NO: 7018403 - DNA, 22 bp, Homo sapiens
ctgtggatttaggcagagctga

SEQ ID NO: 7018404 - DNA, 22 bp, Homo sapiens
cactgtggagcaaatttattta

SEQ ID NO: 7018405 - DNA, 22 bp, Homo sapiens
ggagctctgaggatgcattggt

SEQ ID NO: 7018406 - DNA, 22 bp, Homo sapiens
tatttcctgtggatacttttag

SEQ ID NO: 7018407 - DNA, 22 bp, Homo sapiens
tctgtgcagaactcacagaagg

SEQ ID NO: 7018408 - DNA, 22 bp, Homo sapiens
cactggaatgttgaggagacaa

SEQ ID NO: 7018409 - DNA, 22 bp, Homo sapiens
agaattgttggggtaataaaag

SEQ ID NO: 7018410 - DNA, 22 bp, Homo sapiens
atgcagatctgtgaaaggaata

SEQ ID NO: 7018411 - DNA, 22 bp, Homo sapiens
ctaatagagcttcggaactctg

SEQ ID NO: 7018412 - DNA, 22 bp, Homo sapiens
ttgtatcactccaccagctgag

SEQ ID NO: 7018413 - DNA, 22 bp, Homo sapiens
cggaggcctcagctcatggttt

SEQ ID NO: 7018414 - DNA, 19 bp, Homo sapiens
tgcctgctcctggcttcca

SEQ ID NO: 7018415 - DNA, 22 bp, Homo sapiens
acagatgagttagaataggcag

SEQ ID NO: 7018416 - DNA, 22 bp, Homo sapiens
ctgactctctgagctcaaggtt

SEQ ID NO: 7018417 - DNA, 22 bp, Homo sapiens
atgaaagcaagaagtgagttga

SEQ ID NO: 7018418 - DNA, 22 bp, Homo sapiens
gctttaaacctctactctgtcc

SEQ ID NO: 7018419 - DNA, 22 bp, Homo sapiens
tctgctgaatcagatagctaag

SEQ ID NO: 7018420 - DNA, 22 bp, Homo sapiens
attgtcattccagtcattgtta

SEQ ID NO: 7018421 - DNA, 22 bp, Homo sapiens
attgtgctttaattgaactgcc

SEQ ID NO: 7018422 - DNA, 22 bp, Homo sapiens
tgccggctggacctgagccagc

SEQ ID NO: 7018423 - DNA, 22 bp, Homo sapiens
gatgcattcgggatgtttactt

SEQ ID NO: 7018424 - DNA, 22 bp, Homo sapiens
gaggagctgggctgagagggtc

SEQ ID NO: 7018425 - DNA, 22 bp, Homo sapiens
taaagtgcccagggaaagcggg

SEQ ID NO: 7018426 - DNA, 22 bp, Homo sapiens
ctctggacccagacaaacctgg

SEQ ID NO: 7018427 - DNA, 22 bp, Homo sapiens
ggagtgactcacagctgggaca

SEQ ID NO: 7018428 - DNA, 22 bp, Homo sapiens
gaccctggtgtccaggtcctgc

SEQ ID NO: 7018429 - DNA, 22 bp, Homo sapiens
tctgcacatggcgctggtcctg

SEQ ID NO: 7018430 - DNA, 23 bp, Homo sapiens
gtaatgatgggaatttacttaga

SEQ ID NO: 7018431 - DNA, 22 bp, Homo sapiens
cccgagggccgaaagctgcttt

SEQ ID NO: 7018432 - DNA, 22 bp, Homo sapiens
gctgaggctgggagcagcctgt

SEQ ID NO: 7018433 - DNA, 22 bp, Homo sapiens
gggtcagagtaagcaaggacaa

SEQ ID NO: 7018434 - DNA, 22 bp, Homo sapiens
tctgaagcagaaaatggggata

SEQ ID NO: 7018435 - DNA, 22 bp, Homo sapiens
cctcacagcctcatgcccagcc

SEQ ID NO: 7018436 - DNA, 22 bp, Homo sapiens
agagaagcattcttctcagggc

SEQ ID NO: 7018437 - DNA, 22 bp, Homo sapiens
ttgtttcaggatggtttgttac

SEQ ID NO: 7018438 - DNA, 22 bp, Homo sapiens
aaagttgttgttcacaggttat

SEQ ID NO: 7018439 - DNA, 22 bp, Homo sapiens
acatgccatcactttcattcct

SEQ ID NO: 7018440 - DNA, 22 bp, Homo sapiens
aattggcaagcaagttatccag

SEQ ID NO: 7018441 - DNA, 22 bp, Homo sapiens
acagaggacaactaggcgctca

SEQ ID NO: 7018442 - DNA, 22 bp, Homo sapiens
tcttcccagctgctgcgatgcc

SEQ ID NO: 7018443 - DNA, 21 bp, Homo sapiens
agcagccatggatggtatgta

SEQ ID NO: 7018444 - DNA, 22 bp, Homo sapiens
gtgcagggctggcaccggaggc

SEQ ID NO: 7018445 - DNA, 22 bp, Homo sapiens
agctttacctgaaatttgatcc

SEQ ID NO: 7018446 - DNA, 17 bp, Homo sapiens
ttgaactgctgagtcag

SEQ ID NO: 7018447 - DNA, 22 bp, Homo sapiens
cggctggggctgtccccatgac

SEQ ID NO: 7018448 - DNA, 22 bp, Homo sapiens
atcttcaagggaagaaagagta

SEQ ID NO: 7018449 - DNA, 22 bp, Homo sapiens
ctcctgggtcattgccagcaaa

SEQ ID NO: 7018450 - DNA, 22 bp, Homo sapiens
acagggcttagaacttggcctc

SEQ ID NO: 7018451 - DNA, 22 bp, Homo sapiens
tgtcttctaccttgacagcatt

SEQ ID NO: 7018452 - DNA, 22 bp, Homo sapiens
gtaaccttgggaaatttgacct

SEQ ID NO: 7018453 - DNA, 22 bp, Homo sapiens
gctgcgagctcttgttctgaga

SEQ ID NO: 7018454 - DNA, 22 bp, Homo sapiens
ttagtcacatgcccatctctga

SEQ ID NO: 7018455 - DNA, 22 bp, Homo sapiens
cacagttagctccagtcttagc

SEQ ID NO: 7018456 - DNA, 22 bp, Homo sapiens
cttctctacttcctggaagggg

SEQ ID NO: 7018457 - DNA, 22 bp, Homo sapiens
atggtggctcatgcatgcaatc

SEQ ID NO: 7018458 - DNA, 19 bp, Homo sapiens
acctttgagaagaaatgtc

SEQ ID NO: 7018459 - DNA, 20 bp, Homo sapiens
tggtaaaggagggctggagg

SEQ ID NO: 7018460 - DNA, 22 bp, Homo sapiens
ttctataagactcatatttctt

SEQ ID NO: 7018461 - DNA, 22 bp, Homo sapiens
ccagcactctattgaatattct

SEQ ID NO: 7018462 - DNA, 22 bp, Homo sapiens
agttactcactgagggtttatt

SEQ ID NO: 7018463 - DNA, 21 bp, Homo sapiens
gaataggaacctgatcatggg

SEQ ID NO: 7018464 - DNA, 19 bp, Homo sapiens
agttttctgtgatccattt

SEQ ID NO: 7018465 - DNA, 22 bp, Homo sapiens
tacaaactctttatatttcata

SEQ ID NO: 7018466 - DNA, 22 bp, Homo sapiens
tatgtctttagtatcttttgga

SEQ ID NO: 7018467 - DNA, 20 bp, Homo sapiens
tgaaggcaggtaagaaagat

SEQ ID NO: 7018468 - DNA, 22 bp, Homo sapiens
aagaccctatactcagtgaccc

SEQ ID NO: 7018469 - DNA, 22 bp, Homo sapiens
aggtatttgttatttgagagtg

SEQ ID NO: 7018470 - DNA, 22 bp, Homo sapiens
tctgcaggtagagctcaggaat

SEQ ID NO: 7018471 - DNA, 22 bp, Homo sapiens
ctgcatcactcttactggcttt

SEQ ID NO: 7018472 - DNA, 22 bp, Homo sapiens
acagtaatgattctgagtctct

SEQ ID NO: 7018473 - DNA, 22 bp, Homo sapiens
cgtgatttctggctttctatat

SEQ ID NO: 7018474 - DNA, 22 bp, Homo sapiens
aagggcccagccaagctatgct

SEQ ID NO: 7018475 - DNA, 22 bp, Homo sapiens
gataaattgcactttttcttac

SEQ ID NO: 7018476 - DNA, 22 bp, Homo sapiens
cattgctcaggcccagcaggaa

SEQ ID NO: 7018477 - DNA, 22 bp, Homo sapiens
taaggcacgcggtgaatgccaa

SEQ ID NO: 7018478 - DNA, 22 bp, Homo sapiens
gaaggcttgattgaggaatgcc

SEQ ID NO: 7018479 - DNA, 22 bp, Homo sapiens
gaaatctgcggtgaggcctgag

SEQ ID NO: 7018480 - DNA, 22 bp, Homo sapiens
tcattactataacctaatcctt

SEQ ID NO: 7018481 - DNA, 22 bp, Homo sapiens
gatttctcaatcctagtactat

SEQ ID NO: 7018482 - DNA, 22 bp, Homo sapiens
ggcagcatctctggcagcagct

SEQ ID NO: 7018483 - DNA, 22 bp, Homo sapiens
aatcaacaggatgtgcattgta

SEQ ID NO: 7018484 - DNA, 22 bp, Homo sapiens
ttacttgaaaaccaccagtatt

SEQ ID NO: 7018485 - DNA, 22 bp, Homo sapiens
tgggcctgacacttactaggga

SEQ ID NO: 7018486 - DNA, 22 bp, Homo sapiens
tattcatgggaggtcacaactt

SEQ ID NO: 7018487 - DNA, 22 bp, Homo sapiens
ccgggcctcgggacaccgggta

SEQ ID NO: 7018488 - DNA, 22 bp, Homo sapiens
taacacatagatattttaactt

SEQ ID NO: 7018489 - DNA, 22 bp, Homo sapiens
agtgctcctgaagcttgaggca

SEQ ID NO: 7018490 - DNA, 22 bp, Homo sapiens
aaggcctttctagctttgtgct

SEQ ID NO: 7018491 - DNA, 22 bp, Homo sapiens
ttcatacaatgggatattatga

SEQ ID NO: 7018492 - DNA, 22 bp, Homo sapiens
tagaaacatatgtttgagacat

SEQ ID NO: 7018493 - DNA, 22 bp, Homo sapiens
ccttgggaccctgctggaggtt

SEQ ID NO: 7018494 - DNA, 20 bp, Homo sapiens
acacatgtgcgtgttcagta

SEQ ID NO: 7018495 - DNA, 22 bp, Homo sapiens
aagtgtttaggtttgcagtcga

SEQ ID NO: 7018496 - DNA, 22 bp, Homo sapiens
cacttgctggatggtggctcag

SEQ ID NO: 7018497 - DNA, 22 bp, Homo sapiens
cagcaggacccaggaatcctgc

SEQ ID NO: 7018498 - DNA, 22 bp, Homo sapiens
tctggcttctgcaggattacta

SEQ ID NO: 7018499 - DNA, 19 bp, Homo sapiens
gagccctctccatggccac

SEQ ID NO: 7018500 - DNA, 22 bp, Homo sapiens
tattcctaagtcccaactacat

SEQ ID NO: 7018501 - DNA, 22 bp, Homo sapiens
agaagtcaagtggtctatgaaa

SEQ ID NO: 7018502 - DNA, 22 bp, Homo sapiens
agaagctgtggtatgaaatgtg

SEQ ID NO: 7018503 - DNA, 22 bp, Homo sapiens
ccatcagcatgggagcatgggc

SEQ ID NO: 7018504 - DNA, 22 bp, Homo sapiens
gtatcctccccgctggccttca

SEQ ID NO: 7018505 - DNA, 22 bp, Homo sapiens
gtggcaggggcgggctgttccg

SEQ ID NO: 7018506 - DNA, 22 bp, Homo sapiens
tcagagcattcgggtgacaaat

SEQ ID NO: 7018507 - DNA, 22 bp, Homo sapiens
tttcttggagctcttagggtcg

SEQ ID NO: 7018508 - DNA, 22 bp, Homo sapiens
gatgtttcccgttaagagaaaa

SEQ ID NO: 7018509 - DNA, 19 bp, Homo sapiens
cctggctgtgaagcctgca

SEQ ID NO: 7018510 - DNA, 22 bp, Homo sapiens
gttctattcattgctccacgag

SEQ ID NO: 7018511 - DNA, 22 bp, Homo sapiens
gccagccacaagggaggcttgt

SEQ ID NO: 7018512 - DNA, 22 bp, Homo sapiens
tgggcgggcaggagcgcacctg

SEQ ID NO: 7018513 - DNA, 22 bp, Homo sapiens
cctcaggccctgtccctgcgcc

SEQ ID NO: 7018514 - DNA, 22 bp, Homo sapiens
ggcatgctaggcattttatggg

SEQ ID NO: 7018515 - DNA, 22 bp, Homo sapiens
tgaaggtgagcatttgctgatt

SEQ ID NO: 7018516 - DNA, 22 bp, Homo sapiens
tgattttacttagcatgatgtt

SEQ ID NO: 7018517 - DNA, 22 bp, Homo sapiens
tatgacatgtgatctcaagagg

SEQ ID NO: 7018518 - DNA, 22 bp, Homo sapiens
aggactaaagggagcctagact

SEQ ID NO: 7018519 - DNA, 22 bp, Homo sapiens
atatgcaagcacatagaatact

SEQ ID NO: 7018520 - DNA, 22 bp, Homo sapiens
ggacttggcttctttcagagac

SEQ ID NO: 7018521 - DNA, 22 bp, Homo sapiens
aatgtttgagcatctacatgct

SEQ ID NO: 7018522 - DNA, 22 bp, Homo sapiens
ttctccagaccactgcctctgt

SEQ ID NO: 7018523 - DNA, 22 bp, Homo sapiens
tgactttaaagctcactctttt

SEQ ID NO: 7018524 - DNA, 22 bp, Homo sapiens
gcccatcttctagcagctgtta

SEQ ID NO: 7018525 - DNA, 22 bp, Homo sapiens
ttgaatgaagggatgaccgaag

SEQ ID NO: 7018526 - DNA, 22 bp, Homo sapiens
tctctgacttgatgcaatggcc

SEQ ID NO: 7018527 - DNA, 22 bp, Homo sapiens
gatttcttgataattcaaatcc

SEQ ID NO: 7018528 - DNA, 22 bp, Homo sapiens
gctttgctagcactgcgcttcc

SEQ ID NO: 7018529 - DNA, 22 bp, Homo sapiens
gggcagcattctgtgggcaggt

SEQ ID NO: 7018530 - DNA, 22 bp, Homo sapiens
tttgttcactgatgtatcccaa

SEQ ID NO: 7018531 - DNA, 22 bp, Homo sapiens
ctcctggccccagatcccaatc

SEQ ID NO: 7018532 - DNA, 22 bp, Homo sapiens
gcctggtgaaaggcagagagcg

SEQ ID NO: 7018533 - DNA, 22 bp, Homo sapiens
tggcctggccctgaggccctgt

SEQ ID NO: 7018534 - DNA, 22 bp, Homo sapiens
ggctggaaggccctttgttgat

SEQ ID NO: 7018535 - DNA, 22 bp, Homo sapiens
cagtgctcccgctgccgctgtg

SEQ ID NO: 7018536 - DNA, 22 bp, Homo sapiens
ttacataaaagttcacgtaggc

SEQ ID NO: 7018537 - DNA, 21 bp, Homo sapiens
ctgtgactccctgggcaatcc

SEQ ID NO: 7018538 - DNA, 22 bp, Homo sapiens
atgcaccacagatatctgcgta

SEQ ID NO: 7018539 - DNA, 22 bp, Homo sapiens
tattgcttggggtacaaggtat

SEQ ID NO: 7018540 - DNA, 22 bp, Homo sapiens
tgcatgttaagaaaatattgag

SEQ ID NO: 7018541 - DNA, 22 bp, Homo sapiens
ctttcacacacatacatttgga

SEQ ID NO: 7018542 - DNA, 22 bp, Homo sapiens
catgacaatatgttctttcatt

SEQ ID NO: 7018543 - DNA, 22 bp, Homo sapiens
tttagccaatcagcttgggagc

SEQ ID NO: 7018544 - DNA, 22 bp, Homo sapiens
tcacagaaacagaatggcacag

SEQ ID NO: 7018545 - DNA, 22 bp, Homo sapiens
cctcgtccacaatccttgcaca

SEQ ID NO: 7018546 - DNA, 22 bp, Homo sapiens
atcagaacaaaagaacagttta

SEQ ID NO: 7018547 - DNA, 22 bp, Homo sapiens
ctggtctgccacccacacccct

SEQ ID NO: 7018548 - DNA, 22 bp, Homo sapiens
catcagtttggagaggcggttt

SEQ ID NO: 7018549 - DNA, 22 bp, Homo sapiens
gcttattttatcctattcacta

SEQ ID NO: 7018550 - DNA, 17 bp, Homo sapiens
tcagcagtaatggtggg

SEQ ID NO: 7018551 - DNA, 22 bp, Homo sapiens
gacaaactgaagtatatttaga

SEQ ID NO: 7018552 - DNA, 22 bp, Homo sapiens
taagagaactggatagatagga

SEQ ID NO: 7018553 - DNA, 22 bp, Homo sapiens
ctagtaaagctatgattctgcc

SEQ ID NO: 7018554 - DNA, 22 bp, Homo sapiens
aatcagtttcttggcaagttta

SEQ ID NO: 7018555 - DNA, 19 bp, Homo sapiens
cactggtcttctatttagg

SEQ ID NO: 7018556 - DNA, 22 bp, Homo sapiens
agtactttgcactttgctcaga

SEQ ID NO: 7018557 - DNA, 22 bp, Homo sapiens
gatcgggtgggttctgccatca

SEQ ID NO: 7018558 - DNA, 22 bp, Homo sapiens
attaagggccaatcctccagcc

SEQ ID NO: 7018559 - DNA, 22 bp, Homo sapiens
agtttcatttcttagtaccagt

SEQ ID NO: 7018560 - DNA, 22 bp, Homo sapiens
cctgaagggactccagagagca

SEQ ID NO: 7018561 - DNA, 22 bp, Homo sapiens
agtctgtgaaaagataggaagt

SEQ ID NO: 7018562 - DNA, 20 bp, Homo sapiens
tccagctgttgagatctgag

SEQ ID NO: 7018563 - DNA, 22 bp, Homo sapiens
agctacagatgagcccagtatc

SEQ ID NO: 7018564 - DNA, 22 bp, Homo sapiens
ggcagtcagtttggagatggat

SEQ ID NO: 7018565 - DNA, 17 bp, Homo sapiens
agaaagaggatccacag

SEQ ID NO: 7018566 - DNA, 22 bp, Homo sapiens
cctctgcgcccttgatcagcca

SEQ ID NO: 7018567 - DNA, 22 bp, Homo sapiens
agtagaaagttgcaggaggaat

SEQ ID NO: 7018568 - DNA, 22 bp, Homo sapiens
atgaatatgagactgagagcct

SEQ ID NO: 7018569 - DNA, 22 bp, Homo sapiens
gagctgttctgtgattgatcta

SEQ ID NO: 7018570 - DNA, 22 bp, Homo sapiens
tatggcagaggagaggcactag

SEQ ID NO: 7018571 - DNA, 22 bp, Homo sapiens
atgcacaaacccacaattagtc

SEQ ID NO: 7018572 - DNA, 22 bp, Homo sapiens
cactcacccggtccttcccagt

SEQ ID NO: 7018573 - DNA, 22 bp, Homo sapiens
tcatggatgggcccagctctgt

SEQ ID NO: 7018574 - DNA, 22 bp, Homo sapiens
ttcaaggaaaccagcatttggt

SEQ ID NO: 7018575 - DNA, 22 bp, Homo sapiens
gatgctgactgaccaaaaggat

SEQ ID NO: 7018576 - DNA, 22 bp, Homo sapiens
agagaattaattaggagcactg

SEQ ID NO: 7018577 - DNA, 22 bp, Homo sapiens
tgggccactaccttctctggat

SEQ ID NO: 7018578 - DNA, 23 bp, Homo sapiens
agcaggctgcttctccacagctg

SEQ ID NO: 7018579 - DNA, 22 bp, Homo sapiens
ggcagctctgatgatgctctgg

SEQ ID NO: 7018580 - DNA, 22 bp, Homo sapiens
ctaagaagtcaggggacagagg

SEQ ID NO: 7018581 - DNA, 22 bp, Homo sapiens
gctcgcagatcacctgggggcg

SEQ ID NO: 7018582 - DNA, 22 bp, Homo sapiens
tatcatgttgaatttctgagaa

SEQ ID NO: 7018583 - DNA, 22 bp, Homo sapiens
ctaggctgtaacccctgccagg

SEQ ID NO: 7018584 - DNA, 22 bp, Homo sapiens
gaattcaaatattaaacacgac

SEQ ID NO: 7018585 - DNA, 22 bp, Homo sapiens
ctggaagaggaagccagctgga

SEQ ID NO: 7018586 - DNA, 22 bp, Homo sapiens
gagataataatcgcttgatgga

SEQ ID NO: 7018587 - DNA, 22 bp, Homo sapiens
attctgacctgaatagacttgg

SEQ ID NO: 7018588 - DNA, 22 bp, Homo sapiens
gctatagggtacatttgtgttt

SEQ ID NO: 7018589 - DNA, 21 bp, Homo sapiens
catgtgtcttgtgttactgct

SEQ ID NO: 7018590 - DNA, 22 bp, Homo sapiens
cagtccttagtctggatggctt

SEQ ID NO: 7018591 - DNA, 22 bp, Homo sapiens
cctggagcactctccctggctg

SEQ ID NO: 7018592 - DNA, 22 bp, Homo sapiens
tggtcattttggcatcttgggt

SEQ ID NO: 7018593 - DNA, 22 bp, Homo sapiens
atggctagcaccgcgttgctgg

SEQ ID NO: 7018594 - DNA, 22 bp, Homo sapiens
agtgcaattttgctttcccaat

SEQ ID NO: 7018595 - DNA, 22 bp, Homo sapiens
tcccagcataacaaactgcccg

SEQ ID NO: 7018596 - DNA, 22 bp, Homo sapiens
ttatctctcacttttaaggaca

SEQ ID NO: 7018597 - DNA, 22 bp, Homo sapiens
tttgcaaagtccattgaagtta

SEQ ID NO: 7018598 - DNA, 22 bp, Homo sapiens
caggaaattgcaacagtctgag

SEQ ID NO: 7018599 - DNA, 19 bp, Homo sapiens
tctcaatgttcagaaagct

SEQ ID NO: 7018600 - DNA, 22 bp, Homo sapiens
agacatagactttctactgtgt

SEQ ID NO: 7018601 - DNA, 22 bp, Homo sapiens
agagattcatgtttactgtagg

SEQ ID NO: 7018602 - DNA, 22 bp, Homo sapiens
gagctgtggtcaacaggaaatt

SEQ ID NO: 7018603 - DNA, 22 bp, Homo sapiens
ttcacactgaatgggactttat

SEQ ID NO: 7018604 - DNA, 22 bp, Homo sapiens
aagatgacagatgcttagagtc

SEQ ID NO: 7018605 - DNA, 22 bp, Homo sapiens
tacactggggctctgggagtga

SEQ ID NO: 7018606 - DNA, 22 bp, Homo sapiens
tcctctggccttggaatccttt

SEQ ID NO: 7018607 - DNA, 22 bp, Homo sapiens
gtctgtcccaatagccaacagg

SEQ ID NO: 7018608 - DNA, 22 bp, Homo sapiens
aagaatcttaatccagaaacct

SEQ ID NO: 7018609 - DNA, 22 bp, Homo sapiens
agctcctgtggctgaaagagga

SEQ ID NO: 7018610 - DNA, 22 bp, Homo sapiens
atgtgttctgaggcagatgact

SEQ ID NO: 7018611 - DNA, 22 bp, Homo sapiens
aaggccctggcaggaagcagga

SEQ ID NO: 7018612 - DNA, 22 bp, Homo sapiens
tagatctgatacaattcatctg

SEQ ID NO: 7018613 - DNA, 22 bp, Homo sapiens
ctctctccttagctgcagacca

SEQ ID NO: 7018614 - DNA, 19 bp, Homo sapiens
tttgagaagttattatcta

SEQ ID NO: 7018615 - DNA, 20 bp, Homo sapiens
caagtgtagaaactaataag

SEQ ID NO: 7018616 - DNA, 22 bp, Homo sapiens
accacagtttcattcatgcagg

SEQ ID NO: 7018617 - DNA, 22 bp, Homo sapiens
atttgctttaaggtataaaagg

SEQ ID NO: 7018618 - DNA, 22 bp, Homo sapiens
atttctcattttgcttcaaagg

SEQ ID NO: 7018619 - DNA, 22 bp, Homo sapiens
tatggcttctcagtcatgaaaa

SEQ ID NO: 7018620 - DNA, 22 bp, Homo sapiens
gcagcaatcttcacagtgtcat

SEQ ID NO: 7018621 - DNA, 22 bp, Homo sapiens
aggccagggtagggcccattgt

SEQ ID NO: 7018622 - DNA, 22 bp, Homo sapiens
ccgcgccacccattcccactga

SEQ ID NO: 7018623 - DNA, 22 bp, Homo sapiens
tgtctttggaatatttagctga

SEQ ID NO: 7018624 - DNA, 22 bp, Homo sapiens
tagtgtcttcaggagatatgag

SEQ ID NO: 7018625 - DNA, 22 bp, Homo sapiens
gaatactgacactcaggtggga

SEQ ID NO: 7018626 - DNA, 22 bp, Homo sapiens
gtatcctcactaattaggaggg

SEQ ID NO: 7018627 - DNA, 21 bp, Homo sapiens
tttgattcttcctctccccag

SEQ ID NO: 7018628 - DNA, 22 bp, Homo sapiens
gcactgattacccattgctgct

SEQ ID NO: 7018629 - DNA, 18 bp, Homo sapiens
gccagagcatatctccag

SEQ ID NO: 7018630 - DNA, 22 bp, Homo sapiens
gtgttcaggcttccactgtatg

SEQ ID NO: 7018631 - DNA, 22 bp, Homo sapiens
accagaagttctccaaaaagat

SEQ ID NO: 7018632 - DNA, 22 bp, Homo sapiens
ctcggctctccatttttgtttg

SEQ ID NO: 7018633 - DNA, 22 bp, Homo sapiens
gcacttggatatacaaatgaag

SEQ ID NO: 7018634 - DNA, 22 bp, Homo sapiens
catttggccattccagtcacat

SEQ ID NO: 7018635 - DNA, 22 bp, Homo sapiens
atttcagcaaagttttgattgg

SEQ ID NO: 7018636 - DNA, 22 bp, Homo sapiens
gtatgtcagtgtttaggcaatg

SEQ ID NO: 7018637 - DNA, 23 bp, Homo sapiens
tgcagtgtcgctgcgagcccggc

SEQ ID NO: 7018638 - DNA, 22 bp, Homo sapiens
ataacagatgcttcagcataaa

SEQ ID NO: 7018639 - DNA, 22 bp, Homo sapiens
gtccctgggtagctcagtggct

SEQ ID NO: 7018640 - DNA, 22 bp, Homo sapiens
cccaggtctccctgcagccctg

SEQ ID NO: 7018641 - DNA, 22 bp, Homo sapiens
gctccctctgctcaggcacttg

SEQ ID NO: 7018642 - DNA, 22 bp, Homo sapiens
cattgcactccagcctgggcca

SEQ ID NO: 7018643 - DNA, 22 bp, Homo sapiens
aacaagaataagtggtttctgg

SEQ ID NO: 7018644 - DNA, 22 bp, Homo sapiens
tcccgcatgccgccggtgaaca

SEQ ID NO: 7018645 - DNA, 22 bp, Homo sapiens
cagctctcacaccctcctccca

SEQ ID NO: 7018646 - DNA, 22 bp, Homo sapiens
catgaacagctaacattttggg

SEQ ID NO: 7018647 - DNA, 22 bp, Homo sapiens
atagtgtcagaaaatcataaga

SEQ ID NO: 7018648 - DNA, 22 bp, Homo sapiens
aagccttgctcttgaaaaagtt

SEQ ID NO: 7018649 - DNA, 22 bp, Homo sapiens
tgtgtaatgaatagctttactg

SEQ ID NO: 7018650 - DNA, 22 bp, Homo sapiens
aatgtgttcacaggaaatacag

SEQ ID NO: 7018651 - DNA, 22 bp, Homo sapiens
tgcaaggtccagtataacttaa

SEQ ID NO: 7018652 - DNA, 22 bp, Homo sapiens
ggactgggagaatggaggcaag

SEQ ID NO: 7018653 - DNA, 22 bp, Homo sapiens
tcccagggtcagtggtgaggcc

SEQ ID NO: 7018654 - DNA, 22 bp, Homo sapiens
agcatttaatcctacatagatc

SEQ ID NO: 7018655 - DNA, 22 bp, Homo sapiens
gctcaaagaggcctccaaatcc

SEQ ID NO: 7018656 - DNA, 22 bp, Homo sapiens
ccatgtggctagcgtgcctgca

SEQ ID NO: 7018657 - DNA, 22 bp, Homo sapiens
tccttggaagagcattcccagg

SEQ ID NO: 7018658 - DNA, 22 bp, Homo sapiens
tgctgcacactattgtttagct

SEQ ID NO: 7018659 - DNA, 17 bp, Homo sapiens
tgcaagaagattaggaa

SEQ ID NO: 7018660 - DNA, 22 bp, Homo sapiens
ccacagcggcgggagcgcgggt

SEQ ID NO: 7018661 - DNA, 22 bp, Homo sapiens
ccagagctccagggctacagaa

SEQ ID NO: 7018662 - DNA, 22 bp, Homo sapiens
agttctgtcctccccactcttt

SEQ ID NO: 7018663 - DNA, 22 bp, Homo sapiens
gggagtggtcctttcctatctg

SEQ ID NO: 7018664 - DNA, 19 bp, Homo sapiens
tagtgtcaaggaggagggt

SEQ ID NO: 7018665 - DNA, 22 bp, Homo sapiens
tagattcaagtattcagtttgg

SEQ ID NO: 7018666 - DNA, 22 bp, Homo sapiens
ttctgccagggaattctgctta

SEQ ID NO: 7018667 - DNA, 22 bp, Homo sapiens
ctggttcaatactaaacttctt

SEQ ID NO: 7018668 - DNA, 22 bp, Homo sapiens
gggcctgttcatgccaccggga

SEQ ID NO: 7018669 - DNA, 22 bp, Homo sapiens
atcatccactctgggtcaagtg

SEQ ID NO: 7018670 - DNA, 22 bp, Homo sapiens
agagcttgtaattgagtcaggt

SEQ ID NO: 7018671 - DNA, 23 bp, Homo sapiens
aagcttctagggtgggcaagatg

SEQ ID NO: 7018672 - DNA, 22 bp, Homo sapiens
caggttggggacttaggatgac

SEQ ID NO: 7018673 - DNA, 20 bp, Homo sapiens
tcagcacagctgacaaggtt

SEQ ID NO: 7018674 - DNA, 22 bp, Homo sapiens
tagaaatcacaaaccagtagtt

SEQ ID NO: 7018675 - DNA, 18 bp, Homo sapiens
taacatcggctatgcatc

SEQ ID NO: 7018676 - DNA, 21 bp, Homo sapiens
acatgtcccctatgcttaagg

SEQ ID NO: 7018677 - DNA, 22 bp, Homo sapiens
aactgaggccaagtgaggaaag

SEQ ID NO: 7018678 - DNA, 22 bp, Homo sapiens
gaggtctgcttatctctcacag

SEQ ID NO: 7018679 - DNA, 22 bp, Homo sapiens
tatacgtgcaggtcacagggga

SEQ ID NO: 7018680 - DNA, 22 bp, Homo sapiens
tagcagctgcatcattttacag

SEQ ID NO: 7018681 - DNA, 22 bp, Homo sapiens
cccaggtgggcacctcgaggaa

SEQ ID NO: 7018682 - DNA, 22 bp, Homo sapiens
gctggctcaagtgtgcttccca

SEQ ID NO: 7018683 - DNA, 22 bp, Homo sapiens
gaaggcacccggcgtgcggcgg

SEQ ID NO: 7018684 - DNA, 22 bp, Homo sapiens
cctggaaagagaatgaatgagc

SEQ ID NO: 7018685 - DNA, 22 bp, Homo sapiens
ttacctctagctctttgcttgt

SEQ ID NO: 7018686 - DNA, 22 bp, Homo sapiens
attagaattatgcttgctaatg

SEQ ID NO: 7018687 - DNA, 22 bp, Homo sapiens
aactaggagtttttcttgagaa

SEQ ID NO: 7018688 - DNA, 22 bp, Homo sapiens
gattacaaaggtccttttctct

SEQ ID NO: 7018689 - DNA, 22 bp, Homo sapiens
taggcagcgcttggctgtgctt

SEQ ID NO: 7018690 - DNA, 21 bp, Homo sapiens
gacaaagtgaagcaggcagga

SEQ ID NO: 7018691 - DNA, 22 bp, Homo sapiens
ttacagtgagggtgacatttac

SEQ ID NO: 7018692 - DNA, 22 bp, Homo sapiens
ctgtataaacatattttcaagt

SEQ ID NO: 7018693 - DNA, 22 bp, Homo sapiens
tgaagattgtgcttggcctgta

SEQ ID NO: 7018694 - DNA, 22 bp, Homo sapiens
tcagaattttctggaatggagc

SEQ ID NO: 7018695 - DNA, 22 bp, Homo sapiens
tttcagacatgggggcaaacag

SEQ ID NO: 7018696 - DNA, 21 bp, Homo sapiens
tggcttcagccattttctctg

SEQ ID NO: 7018697 - DNA, 22 bp, Homo sapiens
cacagttgtttgttcataagaa

SEQ ID NO: 7018698 - DNA, 23 bp, Homo sapiens
tcaggtgtgcggactgctgagtc

SEQ ID NO: 7018699 - DNA, 22 bp, Homo sapiens
aagtgcaatgaatagctgcaat

SEQ ID NO: 7018700 - DNA, 22 bp, Homo sapiens
tgctgcctggtttcttcttgct

SEQ ID NO: 7018701 - DNA, 22 bp, Homo sapiens
gcagctcctttaggctgcaaag

SEQ ID NO: 7018702 - DNA, 22 bp, Homo sapiens
gcttagctgcatgcatgttctt

SEQ ID NO: 7018703 - DNA, 22 bp, Homo sapiens
cttcatgctcccatttcctaca

SEQ ID NO: 7018704 - DNA, 22 bp, Homo sapiens
gaggcagcagggctggttcctt

SEQ ID NO: 7018705 - DNA, 22 bp, Homo sapiens
aagaatcatctgaactttgagg

SEQ ID NO: 7018706 - DNA, 22 bp, Homo sapiens
agtgtttcaagaagcaggaagt

SEQ ID NO: 7018707 - DNA, 22 bp, Homo sapiens
gcagggtataatacttaggtga

SEQ ID NO: 7018708 - DNA, 21 bp, Homo sapiens
agcagactgaatacattctta

SEQ ID NO: 7018709 - DNA, 22 bp, Homo sapiens
tgacaaacagggagtttgctca

SEQ ID NO: 7018710 - DNA, 22 bp, Homo sapiens
cttgggaccctcacatttgatg

SEQ ID NO: 7018711 - DNA, 22 bp, Homo sapiens
aagagcccttttcagtctagtt

SEQ ID NO: 7018712 - DNA, 22 bp, Homo sapiens
ctttcaagtgatggggcatata

SEQ ID NO: 7018713 - DNA, 22 bp, Homo sapiens
aacagtgaggtgaatatgctcc

SEQ ID NO: 7018714 - DNA, 22 bp, Homo sapiens
aaagtgaggacttgagtactgt

SEQ ID NO: 7018715 - DNA, 22 bp, Homo sapiens
tgggtgtgtccatattttgact

SEQ ID NO: 7018716 - DNA, 22 bp, Homo sapiens
aagctgcaaggaagtgtgccag

SEQ ID NO: 7018717 - DNA, 22 bp, Homo sapiens
gcagctgtcatttacaacaggg

SEQ ID NO: 7018718 - DNA, 22 bp, Homo sapiens
aaagtacatgagattcaagggg

SEQ ID NO: 7018719 - DNA, 22 bp, Homo sapiens
ctcagggagagccaagagttcc

SEQ ID NO: 7018720 - DNA, 22 bp, Homo sapiens
tttgcaaaattattcccagcat

SEQ ID NO: 7018721 - DNA, 19 bp, Homo sapiens
tagtgagtagtgaattaga

SEQ ID NO: 7018722 - DNA, 21 bp, Homo sapiens
actgtgactgggtgtatgggt

SEQ ID NO: 7018723 - DNA, 19 bp, Homo sapiens
agggctgctctggcctggg

SEQ ID NO: 7018724 - DNA, 22 bp, Homo sapiens
agacaaggctggagtttaggca

SEQ ID NO: 7018725 - DNA, 22 bp, Homo sapiens
ggcactgagaggctcttcctaa

SEQ ID NO: 7018726 - DNA, 19 bp, Homo sapiens
ttctaccttactgtaggct

SEQ ID NO: 7018727 - DNA, 22 bp, Homo sapiens
tccagtcatggtgtcctcacaa

SEQ ID NO: 7018728 - DNA, 22 bp, Homo sapiens
aagtgctttcatatagtcttaa

SEQ ID NO: 7018729 - DNA, 22 bp, Homo sapiens
atgtgtaaggcttctcctctct

SEQ ID NO: 7018730 - DNA, 22 bp, Homo sapiens
tcatgcagcaatatgcattagg

SEQ ID NO: 7018731 - DNA, 22 bp, Homo sapiens
ttgcatgttgtttaatttcgag

SEQ ID NO: 7018732 - DNA, 22 bp, Homo sapiens
aggctagatagagggtcatctt

SEQ ID NO: 7018733 - DNA, 22 bp, Homo sapiens
gccagctgacaccttgattttg

SEQ ID NO: 7018734 - DNA, 22 bp, Homo sapiens
gcaatctgggcaagcaggtagt

SEQ ID NO: 7018735 - DNA, 20 bp, Homo sapiens
agcattcattcagcaagcct

SEQ ID NO: 7018736 - DNA, 22 bp, Homo sapiens
ttcaattcaattctaaatatat

SEQ ID NO: 7018737 - DNA, 22 bp, Homo sapiens
gtgacccaggacactgtgtatc

SEQ ID NO: 7018738 - DNA, 15 bp, Homo sapiens
tctgtgcagcaaggg

SEQ ID NO: 7018739 - DNA, 22 bp, Homo sapiens
tggtttcccattatctgcagga

SEQ ID NO: 7018740 - DNA, 22 bp, Homo sapiens
tcatgcagttactgttatgcaa

SEQ ID NO: 7018741 - DNA, 22 bp, Homo sapiens
atactaagcccaagaacacatg

SEQ ID NO: 7018742 - DNA, 22 bp, Homo sapiens
agtcctggccccaaggaaggat

SEQ ID NO: 7018743 - DNA, 22 bp, Homo sapiens
gctgtcagcgcccaaggagctc

SEQ ID NO: 7018744 - DNA, 22 bp, Homo sapiens
tcatcagtttagaaaaaatatg

SEQ ID NO: 7018745 - DNA, 22 bp, Homo sapiens
ccagggaagtcacattgtctag

SEQ ID NO: 7018746 - DNA, 22 bp, Homo sapiens
agcctgccttgggctgcttgag

SEQ ID NO: 7018747 - DNA, 22 bp, Homo sapiens
agctacagttgccctcagcagg

SEQ ID NO: 7018748 - DNA, 22 bp, Homo sapiens
aaaaagcttaaatgagcagttc

SEQ ID NO: 7018749 - DNA, 22 bp, Homo sapiens
tactgagtggcaaaggcaagaa

SEQ ID NO: 7018750 - DNA, 22 bp, Homo sapiens
atagtgggtacaggggcagaga

SEQ ID NO: 7018751 - DNA, 22 bp, Homo sapiens
ctgtcaatgacagttatttggg

SEQ ID NO: 7018752 - DNA, 20 bp, Homo sapiens
tggagccacagtcaggttcc

SEQ ID NO: 7018753 - DNA, 19 bp, Homo sapiens
agggcggggcccaggcaca

SEQ ID NO: 7018754 - DNA, 22 bp, Homo sapiens
tctcacaagctcaaggattagt

SEQ ID NO: 7018755 - DNA, 22 bp, Homo sapiens
ttaacattgtccttagcagatt

SEQ ID NO: 7018756 - DNA, 22 bp, Homo sapiens
gtcttgatctcctgaccttgtg

SEQ ID NO: 7018757 - DNA, 22 bp, Homo sapiens
agtgcaaactttattgtgacct

SEQ ID NO: 7018758 - DNA, 22 bp, Homo sapiens
ttatatatatgtagaggtcacg

SEQ ID NO: 7018759 - DNA, 22 bp, Homo sapiens
ccagacagcagttaaaggacat

SEQ ID NO: 7018760 - DNA, 22 bp, Homo sapiens
ttccccagggaagctcctgcgc

SEQ ID NO: 7018761 - DNA, 19 bp, Homo sapiens
ttctctggactagatgctg

SEQ ID NO: 7018762 - DNA, 22 bp, Homo sapiens
atgacataagtgaaaaacatca

SEQ ID NO: 7018763 - DNA, 22 bp, Homo sapiens
ctaggtgatccactgctctctt

SEQ ID NO: 7018764 - DNA, 22 bp, Homo sapiens
gcctggcattggagccggggca

SEQ ID NO: 7018765 - DNA, 22 bp, Homo sapiens
aggcttcagaggaagtgcggcc

SEQ ID NO: 7018766 - DNA, 22 bp, Homo sapiens
tttctctgggcactctccaaac

SEQ ID NO: 7018767 - DNA, 22 bp, Homo sapiens
gatggtttggaatgaagtagct

SEQ ID NO: 7018768 - DNA, 19 bp, Homo sapiens
ttgcagcaaagttaggacc

SEQ ID NO: 7018769 - DNA, 22 bp, Homo sapiens
agaggtatgttcacttcccttt

SEQ ID NO: 7018770 - DNA, 23 bp, Homo sapiens
taaggcattttttctgtatcagt

SEQ ID NO: 7018771 - DNA, 22 bp, Homo sapiens
ggaaaatactgattcatgccat

SEQ ID NO: 7018772 - DNA, 22 bp, Homo sapiens
tagctcttcaatcactgtctcc

SEQ ID NO: 7018773 - DNA, 22 bp, Homo sapiens
aagccctgggatgttcagcagt

SEQ ID NO: 7018774 - DNA, 22 bp, Homo sapiens
gcagttagcttgtcacagtcct

SEQ ID NO: 7018775 - DNA, 22 bp, Homo sapiens
acaggcagtgggccagatttgt

SEQ ID NO: 7018776 - DNA, 22 bp, Homo sapiens
acagtttaggatgagagaacac

SEQ ID NO: 7018777 - DNA, 22 bp, Homo sapiens
ctctggtttcgcaggaaataga

SEQ ID NO: 7018778 - DNA, 22 bp, Homo sapiens
tggagtcagtctgggttgcaat

SEQ ID NO: 7018779 - DNA, 22 bp, Homo sapiens
gactaagggagagctgtgcttg

SEQ ID NO: 7018780 - DNA, 22 bp, Homo sapiens
gcgctcagaaaagattttcttc

SEQ ID NO: 7018781 - DNA, 22 bp, Homo sapiens
ggagaggtgaatggctgctcta

SEQ ID NO: 7018782 - DNA, 22 bp, Homo sapiens
gcagggctctgctgtagtccta

SEQ ID NO: 7018783 - DNA, 22 bp, Homo sapiens
gagaaggcttcttttcctctga

SEQ ID NO: 7018784 - DNA, 21 bp, Homo sapiens
aggagttgctgtggcctggtt

SEQ ID NO: 7018785 - DNA, 22 bp, Homo sapiens
ttagccatgcttcttgggtcta

SEQ ID NO: 7018786 - DNA, 22 bp, Homo sapiens
acacagaggtggccactctttt

SEQ ID NO: 7018787 - DNA, 22 bp, Homo sapiens
aatctggacacagttctcatgc

SEQ ID NO: 7018788 - DNA, 22 bp, Homo sapiens
gaggtgagaagggggtcagatg

SEQ ID NO: 7018789 - DNA, 22 bp, Homo sapiens
ttgtgacacatgccgtcctgag

SEQ ID NO: 7018790 - DNA, 22 bp, Homo sapiens
tgcattattgaaggccctgtgg

SEQ ID NO: 7018791 - DNA, 22 bp, Homo sapiens
tcctgctggattgtgtctggtg

SEQ ID NO: 7018792 - DNA, 22 bp, Homo sapiens
cccatgagattctgaatttggc

SEQ ID NO: 7018793 - DNA, 22 bp, Homo sapiens
ttcctctttctctgtgctatgt

SEQ ID NO: 7018794 - DNA, 22 bp, Homo sapiens
tattgcctgagtgtttcataat

SEQ ID NO: 7018795 - DNA, 23 bp, Homo sapiens
tggaatcagccttttttccaagg

SEQ ID NO: 7018796 - DNA, 22 bp, Homo sapiens
tggggatgtcatataagaggaa

SEQ ID NO: 7018797 - DNA, 22 bp, Homo sapiens
tttctcaagtactgcacatgaa

SEQ ID NO: 7018798 - DNA, 22 bp, Homo sapiens
tgcaggctgggaagagggacaa

SEQ ID NO: 7018799 - DNA, 22 bp, Homo sapiens
gccaaatcttgcacactcttgt

SEQ ID NO: 7018800 - DNA, 22 bp, Homo sapiens
ctggcctcggcagcaggaacag

SEQ ID NO: 7018801 - DNA, 22 bp, Homo sapiens
aagttctaacatctacgtggaa

SEQ ID NO: 7018802 - DNA, 22 bp, Homo sapiens
agatgggccttcgagcatgccc

SEQ ID NO: 7018803 - DNA, 22 bp, Homo sapiens
tcttgcacttcatgaatatgtt

SEQ ID NO: 7018804 - DNA, 15 bp, Homo sapiens
atctctctagctgct

SEQ ID NO: 7018805 - DNA, 22 bp, Homo sapiens
ttgcaagagagtctgaaaaatg

SEQ ID NO: 7018806 - DNA, 22 bp, Homo sapiens
acagtgcagggtgggaagaagg

SEQ ID NO: 7018807 - DNA, 22 bp, Homo sapiens
taagtgatgatagtacctagaa

SEQ ID NO: 7018808 - DNA, 22 bp, Homo sapiens
ggtcagtgtatgtattgataag

SEQ ID NO: 7018809 - DNA, 22 bp, Homo sapiens
tgagggtagaggcaggagtgca

SEQ ID NO: 7018810 - DNA, 22 bp, Homo sapiens
taggtgtcttgtcactaccgtt

SEQ ID NO: 7018811 - DNA, 22 bp, Homo sapiens
agcacacaggccacctccactt

SEQ ID NO: 7018812 - DNA, 22 bp, Homo sapiens
ttctgcactaaatatcaaatat

SEQ ID NO: 7018813 - DNA, 22 bp, Homo sapiens
tctttagatgtttagaggaaga

SEQ ID NO: 7018814 - DNA, 22 bp, Homo sapiens
gctgccattatgggaacgagaa

SEQ ID NO: 7018815 - DNA, 22 bp, Homo sapiens
catggcagagaaggggaactgg

SEQ ID NO: 7018816 - DNA, 22 bp, Homo sapiens
aggtacgggtctgagagccatg

SEQ ID NO: 7018817 - DNA, 22 bp, Homo sapiens
ggcatgggccgaggtgcctcct

SEQ ID NO: 7018818 - DNA, 22 bp, Homo sapiens
gcagataacttgtccaacacca

SEQ ID NO: 7018819 - DNA, 22 bp, Homo sapiens
tcacaagatggctgctgcagcc

SEQ ID NO: 7018820 - DNA, 22 bp, Homo sapiens
tcacactttccatggctgttaa

SEQ ID NO: 7018821 - DNA, 22 bp, Homo sapiens
tgatgaaaatgttcagcaatta

SEQ ID NO: 7018822 - DNA, 20 bp, Homo sapiens
tgagaagctcctgtctcctc

SEQ ID NO: 7018823 - DNA, 22 bp, Homo sapiens
tacagtggtgacaatatggaca

SEQ ID NO: 7018824 - DNA, 22 bp, Homo sapiens
cttgactttgccttttaaatgt

SEQ ID NO: 7018825 - DNA, 22 bp, Homo sapiens
tacaaagtcacattgaaatgaa

SEQ ID NO: 7018826 - DNA, 22 bp, Homo sapiens
tctgggatttttgacactgaag

SEQ ID NO: 7018827 - DNA, 22 bp, Homo sapiens
gtgaaggtcagtggccctgggg

SEQ ID NO: 7018828 - DNA, 22 bp, Homo sapiens
caaatgcatagaaagatgaaac

SEQ ID NO: 7018829 - DNA, 22 bp, Homo sapiens
taattggcagtaatgtgattta

SEQ ID NO: 7018830 - DNA, 22 bp, Homo sapiens
acagatatgttgggttcttgtt

SEQ ID NO: 7018831 - DNA, 22 bp, Homo sapiens
aggcagctttgtagtaaagcta

SEQ ID NO: 7018832 - DNA, 19 bp, Homo sapiens
tcaggaggtcgacctggca

SEQ ID NO: 7018833 - DNA, 22 bp, Homo sapiens
caggagtggtgtgagggactcc

SEQ ID NO: 7018834 - DNA, 22 bp, Homo sapiens
ggttccagagtgggctgggaaa

SEQ ID NO: 7018835 - DNA, 22 bp, Homo sapiens
ttctggattagcatgatcccta

SEQ ID NO: 7018836 - DNA, 22 bp, Homo sapiens
atgtgctgagtgtgtatataca

SEQ ID NO: 7018837 - DNA, 22 bp, Homo sapiens
acagcagagcctagcttaatct

SEQ ID NO: 7018838 - DNA, 22 bp, Homo sapiens
gatgagtcattcacagtcgtga

SEQ ID NO: 7018839 - DNA, 22 bp, Homo sapiens
ttgcagctgttgcaaagtctct

SEQ ID NO: 7018840 - DNA, 22 bp, Homo sapiens
cagagacacttaacaggaatgg

SEQ ID NO: 7018841 - DNA, 22 bp, Homo sapiens
gcttacaggtgaggcagcaaga

SEQ ID NO: 7018842 - DNA, 22 bp, Homo sapiens
attctgatatcttattctagct

SEQ ID NO: 7018843 - DNA, 22 bp, Homo sapiens
ggggaagatggccctccatgtg

SEQ ID NO: 7018844 - DNA, 23 bp, Homo sapiens
aaagttgatttgcagtttaagag

SEQ ID NO: 7018845 - DNA, 22 bp, Homo sapiens
taaggcagaaatatgagcaggg

SEQ ID NO: 7018846 - DNA, 22 bp, Homo sapiens
aatcaggaggaagccttgggca

SEQ ID NO: 7018847 - DNA, 22 bp, Homo sapiens
agtagtggggccagggtttgaa

SEQ ID NO: 7018848 - DNA, 22 bp, Homo sapiens
caccaggttccgggcagagctg

SEQ ID NO: 7018849 - DNA, 22 bp, Homo sapiens
ctccatggggaaatgaaggtgg

SEQ ID NO: 7018850 - DNA, 22 bp, Homo sapiens
tcacatgaggcatccccgggca

SEQ ID NO: 7018851 - DNA, 22 bp, Homo sapiens
cacaaataccagtttcctaaca

SEQ ID NO: 7018852 - DNA, 22 bp, Homo sapiens
ctcattgcagttaatgagatgt

SEQ ID NO: 7018853 - DNA, 22 bp, Homo sapiens
atatatctgcagtactgaagaa

SEQ ID NO: 7018854 - DNA, 22 bp, Homo sapiens
aagacagagactctgcaacagg

SEQ ID NO: 7018855 - DNA, 22 bp, Homo sapiens
agactgatattaactttagtgt

SEQ ID NO: 7018856 - DNA, 22 bp, Homo sapiens
aataccatgataattaattcat

SEQ ID NO: 7018857 - DNA, 22 bp, Homo sapiens
caggatgcctttgaactctgga

SEQ ID NO: 7018858 - DNA, 21 bp, Homo sapiens
attatgttcccatctgtttgg

SEQ ID NO: 7018859 - DNA, 22 bp, Homo sapiens
ttattcactcattaaagcagga

SEQ ID NO: 7018860 - DNA, 22 bp, Homo sapiens
aaacttttttaggttcataggc

SEQ ID NO: 7018861 - DNA, 22 bp, Homo sapiens
atgcatgttaagcctgactgga

SEQ ID NO: 7018862 - DNA, 22 bp, Homo sapiens
ctggccaatgcctggggaatag

SEQ ID NO: 7018863 - DNA, 22 bp, Homo sapiens
caggtggtgcctcctcccttcc

SEQ ID NO: 7018864 - DNA, 22 bp, Homo sapiens
agcagtttccacaacctcccct

SEQ ID NO: 7018865 - DNA, 22 bp, Homo sapiens
gcatcagcaccaaccttccagg

SEQ ID NO: 7018866 - DNA, 22 bp, Homo sapiens
ccagcctgaaatgcctcatcct

SEQ ID NO: 7018867 - DNA, 22 bp, Homo sapiens
aagaagtggtccttttctttct

SEQ ID NO: 7018868 - DNA, 22 bp, Homo sapiens
tggccaaagtagaaaataatag

SEQ ID NO: 7018869 - DNA, 23 bp, Homo sapiens
atgttaaacataactgaagagcc

SEQ ID NO: 7018870 - DNA, 20 bp, Homo sapiens
ccctctgcacatggctgtgg

SEQ ID NO: 7018871 - DNA, 22 bp, Homo sapiens
cttggagtgaatgggggcaggt

SEQ ID NO: 7018872 - DNA, 22 bp, Homo sapiens
caaatggtcatttctcttttgt

SEQ ID NO: 7018873 - DNA, 22 bp, Homo sapiens
gaccagaaatgattctccagct

SEQ ID NO: 7018874 - DNA, 22 bp, Homo sapiens
tcccagagtgtgggcatcaagg

SEQ ID NO: 7018875 - DNA, 21 bp, Homo sapiens
cttttctgtgttcctccctgt

SEQ ID NO: 7018876 - DNA, 22 bp, Homo sapiens
tatgcattgtgagactgtggga

SEQ ID NO: 7018877 - DNA, 22 bp, Homo sapiens
tgtttcttgataaagcagaaaa

SEQ ID NO: 7018878 - DNA, 22 bp, Homo sapiens
gagcctggattgaagtgggtgg

SEQ ID NO: 7018879 - DNA, 22 bp, Homo sapiens
cagtttcttcaattcagacact

SEQ ID NO: 7018880 - DNA, 22 bp, Homo sapiens
gttttcaaggggatttaactga

SEQ ID NO: 7018881 - DNA, 22 bp, Homo sapiens
aaggacaggagaaaacgggatc

SEQ ID NO: 7018882 - DNA, 22 bp, Homo sapiens
taagatgtcaaagggtcacagt

SEQ ID NO: 7018883 - DNA, 22 bp, Homo sapiens
aaggtggttcgctggtacccag

SEQ ID NO: 7018884 - DNA, 22 bp, Homo sapiens
tatttcctgcatggtgatgtaa

SEQ ID NO: 7018885 - DNA, 22 bp, Homo sapiens
aagctgaggtcaagtagctagt

SEQ ID NO: 7018886 - DNA, 22 bp, Homo sapiens
aggtgaatgcctgaggcctctg

SEQ ID NO: 7018887 - DNA, 22 bp, Homo sapiens
cctgaaatccatagtttacact

SEQ ID NO: 7018888 - DNA, 22 bp, Homo sapiens
tcaaggtgcatacattctggct

SEQ ID NO: 7018889 - DNA, 22 bp, Homo sapiens
gctttcttatttagaagatttg

SEQ ID NO: 7018890 - DNA, 17 bp, Homo sapiens
tggtcattttaatttta

SEQ ID NO: 7018891 - DNA, 22 bp, Homo sapiens
ttttaaaggcagattatggctt

SEQ ID NO: 7018892 - DNA, 23 bp, Homo sapiens
taatgccagccctgcagttaagc

SEQ ID NO: 7018893 - DNA, 22 bp, Homo sapiens
ttaaagacatcacagattacac

SEQ ID NO: 7018894 - DNA, 22 bp, Homo sapiens
tttggccacttcatagatcatt

SEQ ID NO: 7018895 - DNA, 22 bp, Homo sapiens
tgtgtgtcagagtctccatggt

SEQ ID NO: 7018896 - DNA, 22 bp, Homo sapiens
tctggatgaaagggctatatat

SEQ ID NO: 7018897 - DNA, 22 bp, Homo sapiens
aggggtctatcctgagatggtc

SEQ ID NO: 7018898 - DNA, 22 bp, Homo sapiens
ggccactgtttcctgggcagtt

SEQ ID NO: 7018899 - DNA, 19 bp, Homo sapiens
taccctgggctctctgccc

SEQ ID NO: 7018900 - DNA, 22 bp, Homo sapiens
tcctggggttttggccgcagct

SEQ ID NO: 7018901 - DNA, 22 bp, Homo sapiens
cacagacagtgtccctttgttg

SEQ ID NO: 7018902 - DNA, 22 bp, Homo sapiens
agactacagaatggcattgttt

SEQ ID NO: 7018903 - DNA, 22 bp, Homo sapiens
tggaatgcatggctctgtgacg

SEQ ID NO: 7018904 - DNA, 22 bp, Homo sapiens
caacttcactgtgcctctagtt

SEQ ID NO: 7018905 - DNA, 22 bp, Homo sapiens
tgccagtgtagtagctggttta

SEQ ID NO: 7018906 - DNA, 20 bp, Homo sapiens
ccaaggacatctatgactgt

SEQ ID NO: 7018907 - DNA, 22 bp, Homo sapiens
ttacaggttgtgtattcagtga

SEQ ID NO: 7018908 - DNA, 22 bp, Homo sapiens
cctttcttttatccaccagcca

SEQ ID NO: 7018909 - DNA, 22 bp, Homo sapiens
ccgccgtgcaggccgcgacgtg

SEQ ID NO: 7018910 - DNA, 19 bp, Homo sapiens
tccccaagagttctagctc

SEQ ID NO: 7018911 - DNA, 22 bp, Homo sapiens
ctgaggatctaattattgggtc

SEQ ID NO: 7018912 - DNA, 22 bp, Homo sapiens
tgataaacattttaggaactaa

SEQ ID NO: 7018913 - DNA, 22 bp, Homo sapiens
tggcagattttctctggaggag

SEQ ID NO: 7018914 - DNA, 22 bp, Homo sapiens
cagctgctggctccgggctaag

SEQ ID NO: 7018915 - DNA, 22 bp, Homo sapiens
cagggagtcaacaaacagatca

SEQ ID NO: 7018916 - DNA, 22 bp, Homo sapiens
aggacacagctcttcagtaaga

SEQ ID NO: 7018917 - DNA, 22 bp, Homo sapiens
agtgctgaggaaggggcccatt

SEQ ID NO: 7018918 - DNA, 22 bp, Homo sapiens
attatgccaggacatttcccta

SEQ ID NO: 7018919 - DNA, 22 bp, Homo sapiens
tgtttgatgacgacattgtaga

SEQ ID NO: 7018920 - DNA, 22 bp, Homo sapiens
tcttgattttgttaaaattaga

SEQ ID NO: 7018921 - DNA, 22 bp, Homo sapiens
agagacagaggcaatatagctt

SEQ ID NO: 7018922 - DNA, 22 bp, Homo sapiens
ggctggctgcatgccccctcct

SEQ ID NO: 7018923 - DNA, 22 bp, Homo sapiens
atgcatgtgtgtttacatgctt

SEQ ID NO: 7018924 - DNA, 22 bp, Homo sapiens
tccagtggtacatggagacact

SEQ ID NO: 7018925 - DNA, 22 bp, Homo sapiens
tacagcttatccagcttgatag

SEQ ID NO: 7018926 - DNA, 22 bp, Homo sapiens
cactctgagccaaaactaattc

SEQ ID NO: 7018927 - DNA, 22 bp, Homo sapiens
tgcccagggtggagtgcagcgg

SEQ ID NO: 7018928 - DNA, 22 bp, Homo sapiens
cttcagttagtttcatgtgagc

SEQ ID NO: 7018929 - DNA, 22 bp, Homo sapiens
ttagctttatatatttggatcg

SEQ ID NO: 7018930 - DNA, 22 bp, Homo sapiens
tgacagagtcggggcaagctgt

SEQ ID NO: 7018931 - DNA, 20 bp, Homo sapiens
agctgaggcacctgaggtta

SEQ ID NO: 7018932 - DNA, 20 bp, Homo sapiens
ctgtgctccgggttcctgga

SEQ ID NO: 7018933 - DNA, 23 bp, Homo sapiens
gtgctgcaaaatcggccactgca

SEQ ID NO: 7018934 - DNA, 23 bp, Homo sapiens
gaagttctttcttctcatgctgt

SEQ ID NO: 7018935 - DNA, 23 bp, Homo sapiens
gtaatactagtcatagtagcagg

SEQ ID NO: 7018936 - DNA, 22 bp, Homo sapiens
gtttgtaattacctcttttgac

SEQ ID NO: 7018937 - DNA, 22 bp, Homo sapiens
tcttgattgttttctgacctta

SEQ ID NO: 7018938 - DNA, 22 bp, Homo sapiens
actgtaaccagtgtggtgagag

SEQ ID NO: 7018939 - DNA, 22 bp, Homo sapiens
aaattgtaggatcacatgacct

SEQ ID NO: 7018940 - DNA, 22 bp, Homo sapiens
gttttggagtcaggcttagatg

SEQ ID NO: 7018941 - DNA, 22 bp, Homo sapiens
cttgaccgattctagtggacat

SEQ ID NO: 7018942 - DNA, 22 bp, Homo sapiens
gacctttaatgtttctaccact

SEQ ID NO: 7018943 - DNA, 22 bp, Homo sapiens
ggggaaagtgaattgtgtagtg

SEQ ID NO: 7018944 - DNA, 22 bp, Homo sapiens
gcacaggttgcaaaagttcaca

SEQ ID NO: 7018945 - DNA, 22 bp, Homo sapiens
gttagtatgctcttatgcccat

SEQ ID NO: 7018946 - DNA, 22 bp, Homo sapiens
tgagcagagtcgctccagagtg

SEQ ID NO: 7018947 - DNA, 22 bp, Homo sapiens
aaggaagaggcaggttttgctg

SEQ ID NO: 7018948 - DNA, 22 bp, Homo sapiens
ttctttgtgctgaagaagccct

SEQ ID NO: 7018949 - DNA, 22 bp, Homo sapiens
aagtttcaaatataaaattaca

SEQ ID NO: 7018950 - DNA, 22 bp, Homo sapiens
accgtgtctgacactttgggcg

SEQ ID NO: 7018951 - DNA, 22 bp, Homo sapiens
gatcacatctttatgagtattt

SEQ ID NO: 7018952 - DNA, 23 bp, Homo sapiens
ggatggacgtgatgccttagcca

SEQ ID NO: 7018953 - DNA, 22 bp, Homo sapiens
cagctccagcccaggcagctcc

SEQ ID NO: 7018954 - DNA, 22 bp, Homo sapiens
tgagaatttttggcagaaacaa

SEQ ID NO: 7018955 - DNA, 22 bp, Homo sapiens
ggagaggcttccagagtcgtgc

SEQ ID NO: 7018956 - DNA, 22 bp, Homo sapiens
actaattgaaatgagactggtg

SEQ ID NO: 7018957 - DNA, 22 bp, Homo sapiens
ccgttggaaagctccgagttga

SEQ ID NO: 7018958 - DNA, 22 bp, Homo sapiens
ctgctatgtatattttatgaga

SEQ ID NO: 7018959 - DNA, 22 bp, Homo sapiens
gtccagtgctaacaggttgagg

SEQ ID NO: 7018960 - DNA, 21 bp, Homo sapiens
tctgacttgatctattctccc

SEQ ID NO: 7018961 - DNA, 22 bp, Homo sapiens
caggacactaaaaagccaagct

SEQ ID NO: 7018962 - DNA, 22 bp, Homo sapiens
tcttggctctgccactaattag

SEQ ID NO: 7018963 - DNA, 22 bp, Homo sapiens
ctgaggagagatcacgtggtgt

SEQ ID NO: 7018964 - DNA, 22 bp, Homo sapiens
accaggaagcatccctttgtaa

SEQ ID NO: 7018965 - DNA, 22 bp, Homo sapiens
ggtcttagccaagtttctttat

SEQ ID NO: 7018966 - DNA, 22 bp, Homo sapiens
tgttacagaaatattgcttctt

SEQ ID NO: 7018967 - DNA, 22 bp, Homo sapiens
aatgttccaccaacatttggga

SEQ ID NO: 7018968 - DNA, 22 bp, Homo sapiens
ggaacattggcattttaaggct

SEQ ID NO: 7018969 - DNA, 21 bp, Homo sapiens
atcaggctcaaatcatcccaa

SEQ ID NO: 7018970 - DNA, 22 bp, Homo sapiens
tacaagataagaattggcaagg

SEQ ID NO: 7018971 - DNA, 22 bp, Homo sapiens
tcaggcaaggcccttagagtgt

SEQ ID NO: 7018972 - DNA, 22 bp, Homo sapiens
aggcctgtctgaggtccccact

SEQ ID NO: 7018973 - DNA, 22 bp, Homo sapiens
ttagcaaaggcccctacaccca

SEQ ID NO: 7018974 - DNA, 22 bp, Homo sapiens
acctgtctgggctacatttgca

SEQ ID NO: 7018975 - DNA, 22 bp, Homo sapiens
cttagcaataagagggaatata

SEQ ID NO: 7018976 - DNA, 23 bp, Homo sapiens
aggaaactgaaggggccctctat

SEQ ID NO: 7018977 - DNA, 22 bp, Homo sapiens
ttctgcagtgtgcagggcctgt

SEQ ID NO: 7018978 - DNA, 22 bp, Homo sapiens
tttttccttggatgtgtctctc

SEQ ID NO: 7018979 - DNA, 20 bp, Homo sapiens
cttaacaatggctctgatga

SEQ ID NO: 7018980 - DNA, 22 bp, Homo sapiens
ctatccattttcctatgacact

SEQ ID NO: 7018981 - DNA, 23 bp, Homo sapiens
tattagggccaggactggcaaat

SEQ ID NO: 7018982 - DNA, 22 bp, Homo sapiens
agcagggcttctgtgcctgtgc

SEQ ID NO: 7018983 - DNA, 22 bp, Homo sapiens
atctttcagtttcataccaatt

SEQ ID NO: 7018984 - DNA, 22 bp, Homo sapiens
aagcaaacaggagaagagctgt

SEQ ID NO: 7018985 - DNA, 22 bp, Homo sapiens
cctgtgggtcacatgggtgact

SEQ ID NO: 7018986 - DNA, 22 bp, Homo sapiens
cctgggcctggcgggtcggctc

SEQ ID NO: 7018987 - DNA, 22 bp, Homo sapiens
atagaaccacccagagcctttt

SEQ ID NO: 7018988 - DNA, 22 bp, Homo sapiens
aaggcataggacaaatcagtga

SEQ ID NO: 7018989 - DNA, 22 bp, Homo sapiens
acatattccattgttgggatcc

SEQ ID NO: 7018990 - DNA, 21 bp, Homo sapiens
atggtcaattcattagaaaga

SEQ ID NO: 7018991 - DNA, 22 bp, Homo sapiens
tggtcaaagaccaggaaatgct

SEQ ID NO: 7018992 - DNA, 22 bp, Homo sapiens
gctcagagatgttcagtagctt

SEQ ID NO: 7018993 - DNA, 22 bp, Homo sapiens
tcctaaatacatatcaaagatc

SEQ ID NO: 7018994 - DNA, 22 bp, Homo sapiens
attattaaagctacatcaagga

SEQ ID NO: 7018995 - DNA, 21 bp, Homo sapiens
tgcttgggggcttcaggagct

SEQ ID NO: 7018996 - DNA, 22 bp, Homo sapiens
tgttatcacttgtaaaagcaat

SEQ ID NO: 7018997 - DNA, 22 bp, Homo sapiens
cacttgaagtgaattgctcacc

SEQ ID NO: 7018998 - DNA, 22 bp, Homo sapiens
aaagattagataagatagattt

SEQ ID NO: 7018999 - DNA, 22 bp, Homo sapiens
ctggcacatagtcagcactcaa

SEQ ID NO: 7019000 - DNA, 22 bp, Homo sapiens
taggcactgggctaggacaggt

SEQ ID NO: 7019001 - DNA, 22 bp, Homo sapiens
ctccctgaaattcagatgcctc

SEQ ID NO: 7019002 - DNA, 22 bp, Homo sapiens
ggtgagtccagagtccaaatcc

SEQ ID NO: 7019003 - DNA, 22 bp, Homo sapiens
gcccagccctgaggtcacagct

SEQ ID NO: 7019004 - DNA, 22 bp, Homo sapiens
aggctgtgaactctatgctgaa

SEQ ID NO: 7019005 - DNA, 22 bp, Homo sapiens
tgtaagaacaactgtcaaatgt

SEQ ID NO: 7019006 - DNA, 22 bp, Homo sapiens
ggcactggaagtcccattgtct

SEQ ID NO: 7019007 - DNA, 22 bp, Homo sapiens
ggggaagaggcgtgatggatcc

SEQ ID NO: 7019008 - DNA, 22 bp, Homo sapiens
agaggtcatatctcagaagaga

SEQ ID NO: 7019009 - DNA, 22 bp, Homo sapiens
aactagctgtgtgacttgtgta

SEQ ID NO: 7019010 - DNA, 22 bp, Homo sapiens
aagcagggctttaagcggtttt

SEQ ID NO: 7019011 - DNA, 22 bp, Homo sapiens
gcctgtgactcgtcttgggcca

SEQ ID NO: 7019012 - DNA, 22 bp, Homo sapiens
tgggccgggcactgtactgggc

SEQ ID NO: 7019013 - DNA, 22 bp, Homo sapiens
ttccgctggaggctaatgctct

SEQ ID NO: 7019014 - DNA, 22 bp, Homo sapiens
ataagttcaggtaaagaaatca

SEQ ID NO: 7019015 - DNA, 22 bp, Homo sapiens
tggtttcagtgccaatacagta

SEQ ID NO: 7019016 - DNA, 22 bp, Homo sapiens
aggtgggcactccgctcgaggt

SEQ ID NO: 7019017 - DNA, 22 bp, Homo sapiens
ccaggctggagtatagtggcgc

SEQ ID NO: 7019018 - DNA, 22 bp, Homo sapiens
taggcaagtggaccagaggttt

SEQ ID NO: 7019019 - DNA, 22 bp, Homo sapiens
ccaggctagagtgcaatggcat

SEQ ID NO: 7019020 - DNA, 22 bp, Homo sapiens
agtgggagaatgaataagggcc

SEQ ID NO: 7019021 - DNA, 22 bp, Homo sapiens
tttaaggcttgtcttgcggttt

SEQ ID NO: 7019022 - DNA, 22 bp, Homo sapiens
agagatgtagcaaagaaccaca

SEQ ID NO: 7019023 - DNA, 22 bp, Homo sapiens
ctgccattaaagagcgttcaga

SEQ ID NO: 7019024 - DNA, 21 bp, Homo sapiens
agaaaagtagagttttcagag

SEQ ID NO: 7019025 - DNA, 22 bp, Homo sapiens
tggaggcccaagattctacagc

SEQ ID NO: 7019026 - DNA, 22 bp, Homo sapiens
ctacaagtgcaacctgtgcgac

SEQ ID NO: 7019027 - DNA, 21 bp, Homo sapiens
tctgccagctgaagaggtgga

SEQ ID NO: 7019028 - DNA, 22 bp, Homo sapiens
ggcactcaataaatgttgccaa

SEQ ID NO: 7019029 - DNA, 22 bp, Homo sapiens
ctggaacacctgagttaccact

SEQ ID NO: 7019030 - DNA, 22 bp, Homo sapiens
ttccagtgggaaagcatagcca

SEQ ID NO: 7019031 - DNA, 20 bp, Homo sapiens
gatgcattagatgcagggta

SEQ ID NO: 7019032 - DNA, 19 bp, Homo sapiens
tgcagggctgcgcctgggg

SEQ ID NO: 7019033 - DNA, 22 bp, Homo sapiens
aacaaatgtgtggcagtgtggg

SEQ ID NO: 7019034 - DNA, 22 bp, Homo sapiens
agccagcaggaacgtctaggtt

SEQ ID NO: 7019035 - DNA, 22 bp, Homo sapiens
cacactgtcaggtaaataacac

SEQ ID NO: 7019036 - DNA, 22 bp, Homo sapiens
tggcccagagcactgctgggca

SEQ ID NO: 7019037 - DNA, 23 bp, Homo sapiens
ctagaattttgctaaaagactag

SEQ ID NO: 7019038 - DNA, 22 bp, Homo sapiens
ggggaggacctttccaaggctt

SEQ ID NO: 7019039 - DNA, 22 bp, Homo sapiens
ttcccacagagattacattgaa

SEQ ID NO: 7019040 - DNA, 19 bp, Homo sapiens
gtgccaaatgtgttataca

SEQ ID NO: 7019041 - DNA, 21 bp, Homo sapiens
acagggcttcagggagggtta

SEQ ID NO: 7019042 - DNA, 22 bp, Homo sapiens
tcaccagttaaaataacagtaa

SEQ ID NO: 7019043 - DNA, 22 bp, Homo sapiens
taaatcactcttctctcaccac

SEQ ID NO: 7019044 - DNA, 22 bp, Homo sapiens
gaacagctataatcatctgtcc

SEQ ID NO: 7019045 - DNA, 22 bp, Homo sapiens
ccagcagacacacaggcgtggg

SEQ ID NO: 7019046 - DNA, 23 bp, Homo sapiens
ttaaggttcagctttcccatgac

SEQ ID NO: 7019047 - DNA, 22 bp, Homo sapiens
gggctatgtgtgtcttagtcaa

SEQ ID NO: 7019048 - DNA, 22 bp, Homo sapiens
agtgtatctaggtatctatagt

SEQ ID NO: 7019049 - DNA, 22 bp, Homo sapiens
gtgggcaacgattaagaggcaa

SEQ ID NO: 7019050 - DNA, 22 bp, Homo sapiens
tctggaaagatcattaaatcca

SEQ ID NO: 7019051 - DNA, 22 bp, Homo sapiens
tttatgcacacttagacatggc

SEQ ID NO: 7019052 - DNA, 22 bp, Homo sapiens
ctcccttccaatgactatgctt

SEQ ID NO: 7019053 - DNA, 22 bp, Homo sapiens
catttggtcactatcctttttg

SEQ ID NO: 7019054 - DNA, 22 bp, Homo sapiens
caggagctcaagaccaccctgg

SEQ ID NO: 7019055 - DNA, 21 bp, Homo sapiens
aggtgcagaggcctcactcac

SEQ ID NO: 7019056 - DNA, 22 bp, Homo sapiens
ctgcgatgaccctctcttgctg

SEQ ID NO: 7019057 - DNA, 22 bp, Homo sapiens
gaaacatagttgagacactgct

SEQ ID NO: 7019058 - DNA, 22 bp, Homo sapiens
tcagttaatggattctgtcaga

SEQ ID NO: 7019059 - DNA, 22 bp, Homo sapiens
atctgtggtcaaaatagaaact

SEQ ID NO: 7019060 - DNA, 22 bp, Homo sapiens
aagagtgtgaggttgtgctttt

SEQ ID NO: 7019061 - DNA, 22 bp, Homo sapiens
cagaggcacaagaaagcaaggc

SEQ ID NO: 7019062 - DNA, 17 bp, Homo sapiens
agtgtgtaacttgtgta

SEQ ID NO: 7019063 - DNA, 22 bp, Homo sapiens
tgggccacaagccatgggacca

SEQ ID NO: 7019064 - DNA, 23 bp, Homo sapiens
actgggtctatctccagagaaga

SEQ ID NO: 7019065 - DNA, 22 bp, Homo sapiens
actgtactccagccttggcgac

SEQ ID NO: 7019066 - DNA, 20 bp, Homo sapiens
tgccttagagataaaggctt

SEQ ID NO: 7019067 - DNA, 22 bp, Homo sapiens
atattatggccccatctaagct

SEQ ID NO: 7019068 - DNA, 18 bp, Homo sapiens
tcagatttaactgtatcc

SEQ ID NO: 7019069 - DNA, 22 bp, Homo sapiens
tagtaacagcagcttccctgtg

SEQ ID NO: 7019070 - DNA, 22 bp, Homo sapiens
ttgaagagtaaagtgttttctc

SEQ ID NO: 7019071 - DNA, 22 bp, Homo sapiens
tatggtcaaagatatgaagccc

SEQ ID NO: 7019072 - DNA, 22 bp, Homo sapiens
aatgtctttctcataacagata

SEQ ID NO: 7019073 - DNA, 20 bp, Homo sapiens
aggctggggtgttttgccca

SEQ ID NO: 7019074 - DNA, 22 bp, Homo sapiens
cttgccttcagtccatcagtca

SEQ ID NO: 7019075 - DNA, 21 bp, Homo sapiens
tgcccatcagctccaggatgt

SEQ ID NO: 7019076 - DNA, 22 bp, Homo sapiens
cttcagtctccaatgctctgtg

SEQ ID NO: 7019077 - DNA, 22 bp, Homo sapiens
agcagtcttgagggatgctaga

SEQ ID NO: 7019078 - DNA, 22 bp, Homo sapiens
cagcagcagcttagtggtcccc

SEQ ID NO: 7019079 - DNA, 22 bp, Homo sapiens
ggttcagagcctgcccagtata

SEQ ID NO: 7019080 - DNA, 22 bp, Homo sapiens
agaacagggactggaggcttca

SEQ ID NO: 7019081 - DNA, 22 bp, Homo sapiens
cttgcccgcgaagaagctagga

SEQ ID NO: 7019082 - DNA, 22 bp, Homo sapiens
gccagccagagtccatctgaga

SEQ ID NO: 7019083 - DNA, 22 bp, Homo sapiens
aaaatgaggaacggatcatggc

SEQ ID NO: 7019084 - DNA, 21 bp, Homo sapiens
taatttattcagcacagtgtt

SEQ ID NO: 7019085 - DNA, 22 bp, Homo sapiens
ctggtcacgtgccatatttcct

SEQ ID NO: 7019086 - DNA, 22 bp, Homo sapiens
tactgcatgtgtttgatgatgg

SEQ ID NO: 7019087 - DNA, 22 bp, Homo sapiens
ttcagcatgggtgtgataaatg

SEQ ID NO: 7019088 - DNA, 22 bp, Homo sapiens
atgaggcagatgttgcatgagg

SEQ ID NO: 7019089 - DNA, 22 bp, Homo sapiens
gtctcctgtcctgcaggatgga

SEQ ID NO: 7019090 - DNA, 20 bp, Homo sapiens
gaactgtgcactggtcacag

SEQ ID NO: 7019091 - DNA, 22 bp, Homo sapiens
gatacacagggctaagatggat

SEQ ID NO: 7019092 - DNA, 22 bp, Homo sapiens
aaagtgtttacattgctataag

SEQ ID NO: 7019093 - DNA, 22 bp, Homo sapiens
agagatgaatcttgagactctg

SEQ ID NO: 7019094 - DNA, 22 bp, Homo sapiens
agagtttgtatttttcagtgaa

SEQ ID NO: 7019095 - DNA, 22 bp, Homo sapiens
agaacagatgtgggcagacctg

SEQ ID NO: 7019096 - DNA, 22 bp, Homo sapiens
tgctaggaatacacagagcaat

SEQ ID NO: 7019097 - DNA, 22 bp, Homo sapiens
cctgagagcgagtggcctcatg

SEQ ID NO: 7019098 - DNA, 22 bp, Homo sapiens
agcatcctccttcccagagatg

SEQ ID NO: 7019099 - DNA, 22 bp, Homo sapiens
ggcagcttcctgagccagcagc

SEQ ID NO: 7019100 - DNA, 21 bp, Homo sapiens
tggtctgaaagtatttgtggc

SEQ ID NO: 7019101 - DNA, 22 bp, Homo sapiens
gtcccctgctggtgttgctgct

SEQ ID NO: 7019102 - DNA, 22 bp, Homo sapiens
aagaaatgcacacaactgctgg

SEQ ID NO: 7019103 - DNA, 22 bp, Homo sapiens
agactgttgatggctgaattca

SEQ ID NO: 7019104 - DNA, 21 bp, Homo sapiens
gtatgtatggataatgagagg

SEQ ID NO: 7019105 - DNA, 22 bp, Homo sapiens
tgagatggttcacagagaaggc

SEQ ID NO: 7019106 - DNA, 22 bp, Homo sapiens
gccttcccaagacgcctgagtt

SEQ ID NO: 7019107 - DNA, 22 bp, Homo sapiens
gatgtctttgaggctcactgct

SEQ ID NO: 7019108 - DNA, 22 bp, Homo sapiens
tggtgcaggtgttgatgcagga

SEQ ID NO: 7019109 - DNA, 19 bp, Homo sapiens
tcctgaaaacttctggaat

SEQ ID NO: 7019110 - DNA, 22 bp, Homo sapiens
attacaagatgcatccatattt

SEQ ID NO: 7019111 - DNA, 22 bp, Homo sapiens
ttcagaccaagctggtggcatg

SEQ ID NO: 7019112 - DNA, 22 bp, Homo sapiens
ctttggaggacctatgtgcaat

SEQ ID NO: 7019113 - DNA, 22 bp, Homo sapiens
ctgaagttcatacaatggccat

SEQ ID NO: 7019114 - DNA, 22 bp, Homo sapiens
tatcttaaatgcatgatagaca

SEQ ID NO: 7019115 - DNA, 22 bp, Homo sapiens
agtcagcttggctcctcccatg

SEQ ID NO: 7019116 - DNA, 22 bp, Homo sapiens
gcattcattcaggctcccaggg

SEQ ID NO: 7019117 - DNA, 22 bp, Homo sapiens
tgtgaactggcaggtggacggg

SEQ ID NO: 7019118 - DNA, 22 bp, Homo sapiens
gatttcagccccgctcccagct

SEQ ID NO: 7019119 - DNA, 22 bp, Homo sapiens
aggaatcaggagatgagcacgg

SEQ ID NO: 7019120 - DNA, 22 bp, Homo sapiens
agattgtctctttttcagaaga

SEQ ID NO: 7019121 - DNA, 22 bp, Homo sapiens
gctagggcgggagtgctggaga

SEQ ID NO: 7019122 - DNA, 22 bp, Homo sapiens
cacaggtacatccttatcccca

SEQ ID NO: 7019123 - DNA, 22 bp, Homo sapiens
tggagcagagatgggagcccaa

SEQ ID NO: 7019124 - DNA, 18 bp, Homo sapiens
gcgaattcctccatggca

SEQ ID NO: 7019125 - DNA, 22 bp, Homo sapiens
tttatatgtttgtacaattaag

SEQ ID NO: 7019126 - DNA, 22 bp, Homo sapiens
gagaagtcatttgaccacctag

SEQ ID NO: 7019127 - DNA, 22 bp, Homo sapiens
gctccaggaggatgaccttcct

SEQ ID NO: 7019128 - DNA, 22 bp, Homo sapiens
gtgaactattgggtatcataaa

SEQ ID NO: 7019129 - DNA, 22 bp, Homo sapiens
taagacataccaagttgtgtga

SEQ ID NO: 7019130 - DNA, 22 bp, Homo sapiens
gcagatttcatttaaacctttc

SEQ ID NO: 7019131 - DNA, 22 bp, Homo sapiens
tcaagtattatattctcatttt

SEQ ID NO: 7019132 - DNA, 22 bp, Homo sapiens
taagaacagataaagtttcccc

SEQ ID NO: 7019133 - DNA, 22 bp, Homo sapiens
atgaacagtatgcaacatgatt

SEQ ID NO: 7019134 - DNA, 22 bp, Homo sapiens
gtctagcaatgatgatgagcta

SEQ ID NO: 7019135 - DNA, 22 bp, Homo sapiens
aatgtttggactggaaggtccc

SEQ ID NO: 7019136 - DNA, 22 bp, Homo sapiens
gaatagcttagattccttagtg

SEQ ID NO: 7019137 - DNA, 22 bp, Homo sapiens
tcattgccatggcatttgcaga

SEQ ID NO: 7019138 - DNA, 22 bp, Homo sapiens
cctaggagaggtaatgaagttc

SEQ ID NO: 7019139 - DNA, 22 bp, Homo sapiens
agctgcccttctcttgcccttg

SEQ ID NO: 7019140 - DNA, 22 bp, Homo sapiens
gtccctgggtctaaggcagtaa

SEQ ID NO: 7019141 - DNA, 22 bp, Homo sapiens
tgtaattatttctgtgcagtca

SEQ ID NO: 7019142 - DNA, 22 bp, Homo sapiens
cagcagctcagtctctcagtag

SEQ ID NO: 7019143 - DNA, 22 bp, Homo sapiens
caggaagccttccttgtctgct

SEQ ID NO: 7019144 - DNA, 22 bp, Homo sapiens
tagaagataagacaagtgctgc

SEQ ID NO: 7019145 - DNA, 22 bp, Homo sapiens
ctgttcagatggcacattcagt

SEQ ID NO: 7019146 - DNA, 22 bp, Homo sapiens
ttggcagtcagtcttggtgctt

SEQ ID NO: 7019147 - DNA, 19 bp, Homo sapiens
agaagctgtgaaatgaagg

SEQ ID NO: 7019148 - DNA, 22 bp, Homo sapiens
atcatgcattgtattgagttga

SEQ ID NO: 7019149 - DNA, 22 bp, Homo sapiens
taaaggtccaaagagggctacg

SEQ ID NO: 7019150 - DNA, 22 bp, Homo sapiens
tacaaaggaggtgcatagaaca

SEQ ID NO: 7019151 - DNA, 19 bp, Homo sapiens
gttttgcaggcagagggga

SEQ ID NO: 7019152 - DNA, 22 bp, Homo sapiens
ttcgtcaagggctgttggacta

SEQ ID NO: 7019153 - DNA, 22 bp, Homo sapiens
atgctgcacaagccacatgtag

SEQ ID NO: 7019154 - DNA, 22 bp, Homo sapiens
tttgttggttgcactggtgggt

SEQ ID NO: 7019155 - DNA, 22 bp, Homo sapiens
attggactgcagcacaaaagcc

SEQ ID NO: 7019156 - DNA, 22 bp, Homo sapiens
acataccatctcctggaaagct

SEQ ID NO: 7019157 - DNA, 22 bp, Homo sapiens
tgcctctggcctttggtgccca

SEQ ID NO: 7019158 - DNA, 22 bp, Homo sapiens
ataataactcctgttgaagaac

SEQ ID NO: 7019159 - DNA, 22 bp, Homo sapiens
agttagttttgtaattccaccc

SEQ ID NO: 7019160 - DNA, 22 bp, Homo sapiens
aagagtttgacctgtgccatcc

SEQ ID NO: 7019161 - DNA, 22 bp, Homo sapiens
ggatgggcccgggacggcgctg

SEQ ID NO: 7019162 - DNA, 22 bp, Homo sapiens
ttgtcacagacatcccaggtga

SEQ ID NO: 7019163 - DNA, 22 bp, Homo sapiens
ataagatgagatcagctttctg

SEQ ID NO: 7019164 - DNA, 22 bp, Homo sapiens
ccatgggctggctgccttatca

SEQ ID NO: 7019165 - DNA, 22 bp, Homo sapiens
tactgtggggatattgattgta

SEQ ID NO: 7019166 - DNA, 22 bp, Homo sapiens
gagaaacctgtaaggaaggaag

SEQ ID NO: 7019167 - DNA, 22 bp, Homo sapiens
agcaaagctcatgacattacag

SEQ ID NO: 7019168 - DNA, 22 bp, Homo sapiens
ttacattagacccactttcatg

SEQ ID NO: 7019169 - DNA, 22 bp, Homo sapiens
caccctgggctgggcctgttaa

SEQ ID NO: 7019170 - DNA, 22 bp, Homo sapiens
tcttcaaatgctagtaatatca

SEQ ID NO: 7019171 - DNA, 22 bp, Homo sapiens
ctgccaggttggcgctcgctct

SEQ ID NO: 7019172 - DNA, 22 bp, Homo sapiens
agcagcaaagccaggggatggg

SEQ ID NO: 7019173 - DNA, 22 bp, Homo sapiens
agtttagattgctggggctagt

SEQ ID NO: 7019174 - DNA, 22 bp, Homo sapiens
ttcagaggtagagaggatcttg

SEQ ID NO: 7019175 - DNA, 22 bp, Homo sapiens
atcaagagtattgacaagacca

SEQ ID NO: 7019176 - DNA, 22 bp, Homo sapiens
tggaggcatttctttttggtcg

SEQ ID NO: 7019177 - DNA, 19 bp, Homo sapiens
gctgccaggacagttactg

SEQ ID NO: 7019178 - DNA, 20 bp, Homo sapiens
aatgtatattttatgccagg

SEQ ID NO: 7019179 - DNA, 22 bp, Homo sapiens
tgccagcctggcctgagtcttt

SEQ ID NO: 7019180 - DNA, 22 bp, Homo sapiens
ctggagcatccatgcccagggt

SEQ ID NO: 7019181 - DNA, 22 bp, Homo sapiens
tagcaaagcccacgtgccaagc

SEQ ID NO: 7019182 - DNA, 22 bp, Homo sapiens
gggggaggtgaatgcaataagg

SEQ ID NO: 7019183 - DNA, 22 bp, Homo sapiens
tagacacatcaaggatcagttt

SEQ ID NO: 7019184 - DNA, 22 bp, Homo sapiens
tgaaagctctgtcatcattcct

SEQ ID NO: 7019185 - DNA, 22 bp, Homo sapiens
tgcagggagggcccagcaatct

SEQ ID NO: 7019186 - DNA, 22 bp, Homo sapiens
gtgccatttctcaaaacacagt

SEQ ID NO: 7019187 - DNA, 22 bp, Homo sapiens
ctggaagacgtttgaagccatg

SEQ ID NO: 7019188 - DNA, 22 bp, Homo sapiens
tccagtggtttgaaaggggtgt

SEQ ID NO: 7019189 - DNA, 22 bp, Homo sapiens
tctgaaggttgagaagggctga

SEQ ID NO: 7019190 - DNA, 22 bp, Homo sapiens
attcacatgttgaagccctaac

SEQ ID NO: 7019191 - DNA, 22 bp, Homo sapiens
tgagctgtaaggctgtcactga

SEQ ID NO: 7019192 - DNA, 22 bp, Homo sapiens
cagcagaaaatgtgggtgattt

SEQ ID NO: 7019193 - DNA, 22 bp, Homo sapiens
taacaaggagatggtgggtcat

SEQ ID NO: 7019194 - DNA, 22 bp, Homo sapiens
tcttctgtgagaattcaagcaa

SEQ ID NO: 7019195 - DNA, 22 bp, Homo sapiens
tgggagcaagctacttagggaa

SEQ ID NO: 7019196 - DNA, 18 bp, Homo sapiens
aaatgctaggctacatga

SEQ ID NO: 7019197 - DNA, 22 bp, Homo sapiens
cacacatggctgccagggaggt

SEQ ID NO: 7019198 - DNA, 22 bp, Homo sapiens
cttatgattcaaataggatctt

SEQ ID NO: 7019199 - DNA, 22 bp, Homo sapiens
gtcaactgtacctaaagaaagt

SEQ ID NO: 7019200 - DNA, 22 bp, Homo sapiens
ctctccagccacagaagctgct

SEQ ID NO: 7019201 - DNA, 22 bp, Homo sapiens
gaatcatttcttctgaaaggta

SEQ ID NO: 7019202 - DNA, 22 bp, Homo sapiens
aggcaactcatcatgaaagact

SEQ ID NO: 7019203 - DNA, 22 bp, Homo sapiens
aaactcttggtcaacatgagga

SEQ ID NO: 7019204 - DNA, 22 bp, Homo sapiens
aacaaagaagactggttatttt

SEQ ID NO: 7019205 - DNA, 20 bp, Homo sapiens
gcttgcccacatctgcactg

SEQ ID NO: 7019206 - DNA, 22 bp, Homo sapiens
accatcagtcattgtcagtggg

SEQ ID NO: 7019207 - DNA, 22 bp, Homo sapiens
agtgctgggctatctactgcta

SEQ ID NO: 7019208 - DNA, 19 bp, Homo sapiens
tgtccagtgatgtcaagga

SEQ ID NO: 7019209 - DNA, 22 bp, Homo sapiens
aagcctctggggcctcatctgt

SEQ ID NO: 7019210 - DNA, 22 bp, Homo sapiens
ctgaagcacagcatataaataa

SEQ ID NO: 7019211 - DNA, 22 bp, Homo sapiens
agctggtggattatgctgtaca

SEQ ID NO: 7019212 - DNA, 22 bp, Homo sapiens
tcttgcagcttcatctgcaatt

SEQ ID NO: 7019213 - DNA, 22 bp, Homo sapiens
gagtgcagtggcgtgatctctg

SEQ ID NO: 7019214 - DNA, 22 bp, Homo sapiens
gaaggctgagtgggtacggagg

SEQ ID NO: 7019215 - DNA, 22 bp, Homo sapiens
tttggcagctcttgactgttct

SEQ ID NO: 7019216 - DNA, 22 bp, Homo sapiens
atgtcctgggctgggttatgtt

SEQ ID NO: 7019217 - DNA, 22 bp, Homo sapiens
tctgaaatgaactcttgaactt

SEQ ID NO: 7019218 - DNA, 22 bp, Homo sapiens
ttttccagagctgtctcttgca

SEQ ID NO: 7019219 - DNA, 22 bp, Homo sapiens
cttggagaccagtgacattgct

SEQ ID NO: 7019220 - DNA, 22 bp, Homo sapiens
cctggcttatttttatagcagt

SEQ ID NO: 7019221 - DNA, 21 bp, Homo sapiens
aggcaggattcaaacacagag

SEQ ID NO: 7019222 - DNA, 22 bp, Homo sapiens
actctgaaacttgcaacacatt

SEQ ID NO: 7019223 - DNA, 22 bp, Homo sapiens
aggggagagaacataaggaagt

SEQ ID NO: 7019224 - DNA, 22 bp, Homo sapiens
ttacaagataacctgatgctgt

SEQ ID NO: 7019225 - DNA, 15 bp, Homo sapiens
aggtggtcagtagca

SEQ ID NO: 7019226 - DNA, 22 bp, Homo sapiens
ttgtgtctggaatgcgtggagc

SEQ ID NO: 7019227 - DNA, 22 bp, Homo sapiens
taaggacaatcaggttagtagc

SEQ ID NO: 7019228 - DNA, 22 bp, Homo sapiens
gtttaacatctgtgaagctgct

SEQ ID NO: 7019229 - DNA, 22 bp, Homo sapiens
ggatgggtgactttgggcaatg

SEQ ID NO: 7019230 - DNA, 22 bp, Homo sapiens
tcatagaaatgtggccagaaac

SEQ ID NO: 7019231 - DNA, 22 bp, Homo sapiens
acccaggctagggtgcagtggc

SEQ ID NO: 7019232 - DNA, 22 bp, Homo sapiens
tgcttctgtctcttatgccttg

SEQ ID NO: 7019233 - DNA, 22 bp, Homo sapiens
tagtcaatcagtatgtattgga

SEQ ID NO: 7019234 - DNA, 22 bp, Homo sapiens
ggtagtcagtgttagtttgatt

SEQ ID NO: 7019235 - DNA, 22 bp, Homo sapiens
agaaaagttttctgagactgac

SEQ ID NO: 7019236 - DNA, 22 bp, Homo sapiens
gcactgagatacatttctaagg

SEQ ID NO: 7019237 - DNA, 21 bp, Homo sapiens
cctatgtcgcactcctaggat

SEQ ID NO: 7019238 - DNA, 22 bp, Homo sapiens
gcaaatgacagactcaccttgg

SEQ ID NO: 7019239 - DNA, 22 bp, Homo sapiens
atcagctaattagaattaggat

SEQ ID NO: 7019240 - DNA, 23 bp, Homo sapiens
taagacacccgactccagagatg

SEQ ID NO: 7019241 - DNA, 22 bp, Homo sapiens
ggctatttcatttagtactagg

SEQ ID NO: 7019242 - DNA, 22 bp, Homo sapiens
gcagatggcagcccaggctggg

SEQ ID NO: 7019243 - DNA, 22 bp, Homo sapiens
tcaggagctgtgaatacaaagg

SEQ ID NO: 7019244 - DNA, 22 bp, Homo sapiens
gctagcaaatgtcatttggaag

SEQ ID NO: 7019245 - DNA, 22 bp, Homo sapiens
agcagctgttagaaacaggaag

SEQ ID NO: 7019246 - DNA, 23 bp, Homo sapiens
ttcataactcaaggtgatataat

SEQ ID NO: 7019247 - DNA, 22 bp, Homo sapiens
tctctctaggcatctattttca

SEQ ID NO: 7019248 - DNA, 22 bp, Homo sapiens
taatgaggaaggagactttcac

SEQ ID NO: 7019249 - DNA, 22 bp, Homo sapiens
catggcttcatgagggttttgc

SEQ ID NO: 7019250 - DNA, 22 bp, Homo sapiens
tggcaggtcatgagtggccacc

SEQ ID NO: 7019251 - DNA, 22 bp, Homo sapiens
gatgtgggtgtcttcagctggt

SEQ ID NO: 7019252 - DNA, 22 bp, Homo sapiens
tcgcgcccccaagcgtcattgg

SEQ ID NO: 7019253 - DNA, 22 bp, Homo sapiens
gaaaggagggctcacaaaagtg

SEQ ID NO: 7019254 - DNA, 19 bp, Homo sapiens
aggggcactgtctctagag

SEQ ID NO: 7019255 - DNA, 20 bp, Homo sapiens
tcctttggccttagagctgt

SEQ ID NO: 7019256 - DNA, 22 bp, Homo sapiens
aagatacacgttgtattgaata

SEQ ID NO: 7019257 - DNA, 22 bp, Homo sapiens
tgactattcacaattacaatag

SEQ ID NO: 7019258 - DNA, 22 bp, Homo sapiens
acagtgttttcttaaggagaaa

SEQ ID NO: 7019259 - DNA, 22 bp, Homo sapiens
aagggcttaggattttgctgtg

SEQ ID NO: 7019260 - DNA, 22 bp, Homo sapiens
caggtgccgggaatgcagcaat

SEQ ID NO: 7019261 - DNA, 22 bp, Homo sapiens
gagacacacacaggaggtggca

SEQ ID NO: 7019262 - DNA, 22 bp, Homo sapiens
accatcagagcacagtccgtgc

SEQ ID NO: 7019263 - DNA, 22 bp, Homo sapiens
gcaagctgtccttttgcatggc

SEQ ID NO: 7019264 - DNA, 22 bp, Homo sapiens
cagtatcttatgaaccctgatc

SEQ ID NO: 7019265 - DNA, 22 bp, Homo sapiens
ttaatagtgctaaaccattgac

SEQ ID NO: 7019266 - DNA, 22 bp, Homo sapiens
agtgtttattagatttcccttt

SEQ ID NO: 7019267 - DNA, 22 bp, Homo sapiens
tacagaatagaatagggacagg

SEQ ID NO: 7019268 - DNA, 22 bp, Homo sapiens
gagagctgatagatgagctact

SEQ ID NO: 7019269 - DNA, 22 bp, Homo sapiens
tggttgtggtcctccacatcgc

SEQ ID NO: 7019270 - DNA, 22 bp, Homo sapiens
tgtcagatgattctcaggagac

SEQ ID NO: 7019271 - DNA, 22 bp, Homo sapiens
tttggaacaagacaaaacatta

SEQ ID NO: 7019272 - DNA, 19 bp, Homo sapiens
ctccttccctggtttctgt

SEQ ID NO: 7019273 - DNA, 22 bp, Homo sapiens
tataaagctgactcatgaaact

SEQ ID NO: 7019274 - DNA, 22 bp, Homo sapiens
tgtgcatgtattgatttgtacc

SEQ ID NO: 7019275 - DNA, 22 bp, Homo sapiens
gattgctgggtcccactcccag

SEQ ID NO: 7019276 - DNA, 22 bp, Homo sapiens
taagcgctacttccagggttgc

SEQ ID NO: 7019277 - DNA, 22 bp, Homo sapiens
gacctggcaactgtagcttctg

SEQ ID NO: 7019278 - DNA, 22 bp, Homo sapiens
ctaacctagttcaacaactgtc

SEQ ID NO: 7019279 - DNA, 22 bp, Homo sapiens
tcaggtggcttcggggagtggc

SEQ ID NO: 7019280 - DNA, 22 bp, Homo sapiens
aggaagtgtcagggataacgat

SEQ ID NO: 7019281 - DNA, 22 bp, Homo sapiens
tgcagcaacaagatagaatggc

SEQ ID NO: 7019282 - DNA, 22 bp, Homo sapiens
tggtacaagagtatttgcggtt

SEQ ID NO: 7019283 - DNA, 22 bp, Homo sapiens
ctctagggaagaatgagagccc

SEQ ID NO: 7019284 - DNA, 22 bp, Homo sapiens
ttctgatacagtcccaacacaa

SEQ ID NO: 7019285 - DNA, 22 bp, Homo sapiens
cagagatggggccagctgctcc

SEQ ID NO: 7019286 - DNA, 22 bp, Homo sapiens
tatgtacatgttaaagggcaaa

SEQ ID NO: 7019287 - DNA, 22 bp, Homo sapiens
tagagatagcagtattgattcg

SEQ ID NO: 7019288 - DNA, 22 bp, Homo sapiens
cagaatgttaccagttagtctg

SEQ ID NO: 7019289 - DNA, 22 bp, Homo sapiens
caacttcttggcttcctaatgg

SEQ ID NO: 7019290 - DNA, 22 bp, Homo sapiens
gcatttttcatccctcttgggt

SEQ ID NO: 7019291 - DNA, 22 bp, Homo sapiens
tctgttggagcctaggatgaca

SEQ ID NO: 7019292 - DNA, 19 bp, Homo sapiens
aaagatctgggattgagac

SEQ ID NO: 7019293 - DNA, 21 bp, Homo sapiens
ctctagaaatcgaataacctt

SEQ ID NO: 7019294 - DNA, 22 bp, Homo sapiens
cactgggcacttgggttgcttc

SEQ ID NO: 7019295 - DNA, 22 bp, Homo sapiens
aactgggcccagtctgagttgg

SEQ ID NO: 7019296 - DNA, 22 bp, Homo sapiens
tactttgaattaaatatttcag

SEQ ID NO: 7019297 - DNA, 22 bp, Homo sapiens
aaagagctttccacactagtca

SEQ ID NO: 7019298 - DNA, 22 bp, Homo sapiens
ctgctgtggtgtcaagcatctc

SEQ ID NO: 7019299 - DNA, 22 bp, Homo sapiens
ctgagcaatttcagctctcact

SEQ ID NO: 7019300 - DNA, 22 bp, Homo sapiens
agcacaggaccaaggaagctgt

SEQ ID NO: 7019301 - DNA, 22 bp, Homo sapiens
gactggcctggggctgggcaca

SEQ ID NO: 7019302 - DNA, 22 bp, Homo sapiens
ttctgcttctgtgtgtcccagg

SEQ ID NO: 7019303 - DNA, 22 bp, Homo sapiens
ggatgggctgaaaggtagcccc

SEQ ID NO: 7019304 - DNA, 22 bp, Homo sapiens
ttcacaaacaccagaatggcta

SEQ ID NO: 7019305 - DNA, 22 bp, Homo sapiens
gcaatgtttttccttccatatt

SEQ ID NO: 7019306 - DNA, 22 bp, Homo sapiens
tctttgctattgtgagtagtgc

SEQ ID NO: 7019307 - DNA, 23 bp, Homo sapiens
tgccaaagtttacctaacactgg

SEQ ID NO: 7019308 - DNA, 22 bp, Homo sapiens
ctgagtcattgcagatgtggag

SEQ ID NO: 7019309 - DNA, 22 bp, Homo sapiens
tgtgaaatgagtatatttgaat

SEQ ID NO: 7019310 - DNA, 19 bp, Homo sapiens
caatttggcagattctccc

SEQ ID NO: 7019311 - DNA, 22 bp, Homo sapiens
cagcttggattttggcacgtgt

SEQ ID NO: 7019312 - DNA, 22 bp, Homo sapiens
gttcatacttaacggtattgtc

SEQ ID NO: 7019313 - DNA, 22 bp, Homo sapiens
aagcatctcctcatcatttggg

SEQ ID NO: 7019314 - DNA, 22 bp, Homo sapiens
ggggccagtaggagtgatgtac

SEQ ID NO: 7019315 - DNA, 22 bp, Homo sapiens
gcctttggtgacaggcatgtgt

SEQ ID NO: 7019316 - DNA, 22 bp, Homo sapiens
tcagcaccagttatcctcaggg

SEQ ID NO: 7019317 - DNA, 21 bp, Homo sapiens
acaatagacataagcagagca

SEQ ID NO: 7019318 - DNA, 16 bp, Homo sapiens
atggggtacaaccagt

SEQ ID NO: 7019319 - DNA, 21 bp, Homo sapiens
aggccaagttggatttcttca

SEQ ID NO: 7019320 - DNA, 22 bp, Homo sapiens
actgttcgaggctgacaaagta

SEQ ID NO: 7019321 - DNA, 22 bp, Homo sapiens
tgggtagggcctgcgcctgtgc

SEQ ID NO: 7019322 - DNA, 22 bp, Homo sapiens
catgtgtaggtatacaaaattc

SEQ ID NO: 7019323 - DNA, 22 bp, Homo sapiens
gatacactggagcttcctgaca

SEQ ID NO: 7019324 - DNA, 22 bp, Homo sapiens
caatgtcaaggagaccaaaacg

SEQ ID NO: 7019325 - DNA, 22 bp, Homo sapiens
agaatgcttcctttgaaactga

SEQ ID NO: 7019326 - DNA, 22 bp, Homo sapiens
tcacatgagtattattttccaa

SEQ ID NO: 7019327 - DNA, 22 bp, Homo sapiens
agatggcttccttctcactgtg

SEQ ID NO: 7019328 - DNA, 22 bp, Homo sapiens
agagatgctgcccgcagacgtg

SEQ ID NO: 7019329 - DNA, 22 bp, Homo sapiens
gtttacactccaggctggggtg

SEQ ID NO: 7019330 - DNA, 22 bp, Homo sapiens
tcacagactggtcagtcaactt

SEQ ID NO: 7019331 - DNA, 22 bp, Homo sapiens
tggtaatgtaagcagcaaatgt

SEQ ID NO: 7019332 - DNA, 22 bp, Homo sapiens
catcatttttgtaagctggtag

SEQ ID NO: 7019333 - DNA, 22 bp, Homo sapiens
gaacatagtaaatgtcacattt

SEQ ID NO: 7019334 - DNA, 22 bp, Homo sapiens
gaacaactttgaaacatgaaga

SEQ ID NO: 7019335 - DNA, 22 bp, Homo sapiens
tttgaaagtcctaggagagtcc

SEQ ID NO: 7019336 - DNA, 22 bp, Homo sapiens
ttgttacagcacttaacctttt

SEQ ID NO: 7019337 - DNA, 22 bp, Homo sapiens
agcaccaagcctagagtgatgt

SEQ ID NO: 7019338 - DNA, 22 bp, Homo sapiens
cggcagggctccatgcatttct

SEQ ID NO: 7019339 - DNA, 22 bp, Homo sapiens
tagtgatttcagtgggttttgc

SEQ ID NO: 7019340 - DNA, 22 bp, Homo sapiens
ttgactgcaccactcagccctc

SEQ ID NO: 7019341 - DNA, 22 bp, Homo sapiens
atgggaagtgaagtcagggagg

SEQ ID NO: 7019342 - DNA, 22 bp, Homo sapiens
gtgggcgatcatctcagccgtc

SEQ ID NO: 7019343 - DNA, 22 bp, Homo sapiens
tcacaagatatttcagtccttt

SEQ ID NO: 7019344 - DNA, 22 bp, Homo sapiens
tcagaaaagaccacattattct

SEQ ID NO: 7019345 - DNA, 18 bp, Homo sapiens
tggcagtgccaccttctc

SEQ ID NO: 7019346 - DNA, 22 bp, Homo sapiens
ttcaagaggcttaattctggat

SEQ ID NO: 7019347 - DNA, 22 bp, Homo sapiens
gaagcagagcctaaggcagaca

SEQ ID NO: 7019348 - DNA, 22 bp, Homo sapiens
ctgccccaggacctcttctgga

SEQ ID NO: 7019349 - DNA, 22 bp, Homo sapiens
cagtctgaacactgggctactc

SEQ ID NO: 7019350 - DNA, 22 bp, Homo sapiens
ggaggcctcagtaccttgcttt

SEQ ID NO: 7019351 - DNA, 22 bp, Homo sapiens
tcaattctagagccttacattg

SEQ ID NO: 7019352 - DNA, 21 bp, Homo sapiens
tcagggatggctgtacaatgg

SEQ ID NO: 7019353 - DNA, 22 bp, Homo sapiens
aacaataggctatatgctaggc

SEQ ID NO: 7019354 - DNA, 22 bp, Homo sapiens
tgaacactctggggtgggaggt

SEQ ID NO: 7019355 - DNA, 22 bp, Homo sapiens
gctctggcccaaaccctttcta

SEQ ID NO: 7019356 - DNA, 22 bp, Homo sapiens
aaatagcttctaagccttttga

SEQ ID NO: 7019357 - DNA, 22 bp, Homo sapiens
tatgaattctcttgtgtatagt

SEQ ID NO: 7019358 - DNA, 22 bp, Homo sapiens
atctatttctgctaataacaat

SEQ ID NO: 7019359 - DNA, 22 bp, Homo sapiens
atgcagacatgggagagttgag

SEQ ID NO: 7019360 - DNA, 22 bp, Homo sapiens
attgatggtgatagtgctgtgg

SEQ ID NO: 7019361 - DNA, 22 bp, Homo sapiens
aaacattgagtgcctttggtat

SEQ ID NO: 7019362 - DNA, 22 bp, Homo sapiens
ttctggcttcatctgacaagcc

SEQ ID NO: 7019363 - DNA, 22 bp, Homo sapiens
taaggtaattgttgctgaaatt

SEQ ID NO: 7019364 - DNA, 22 bp, Homo sapiens
gagacacaggcacagaagaggc

SEQ ID NO: 7019365 - DNA, 22 bp, Homo sapiens
tttcatgagattcctccacatc

SEQ ID NO: 7019366 - DNA, 22 bp, Homo sapiens
attcaataaatatgctacatgg

SEQ ID NO: 7019367 - DNA, 22 bp, Homo sapiens
aagcatgggaatcccacagggt

SEQ ID NO: 7019368 - DNA, 22 bp, Homo sapiens
attttctatgttgtaattgtta

SEQ ID NO: 7019369 - DNA, 22 bp, Homo sapiens
tagaactagaacaaggatttga

SEQ ID NO: 7019370 - DNA, 22 bp, Homo sapiens
aggatgacatgaagtggtgttc

SEQ ID NO: 7019371 - DNA, 20 bp, Homo sapiens
gaaatcagttaatgatggtt

SEQ ID NO: 7019372 - DNA, 22 bp, Homo sapiens
tggatgctcacttctgcagggt

SEQ ID NO: 7019373 - DNA, 22 bp, Homo sapiens
ctagttatcttatctcagtgta

SEQ ID NO: 7019374 - DNA, 22 bp, Homo sapiens
gaattgtacgctttacataggt

SEQ ID NO: 7019375 - DNA, 22 bp, Homo sapiens
aaggcagggaaagtggattagg

SEQ ID NO: 7019376 - DNA, 22 bp, Homo sapiens
tgaccactgtagccacttaaga

SEQ ID NO: 7019377 - DNA, 22 bp, Homo sapiens
ctgatcatgtgggaggatatgt

SEQ ID NO: 7019378 - DNA, 22 bp, Homo sapiens
cagggacagagactgcaccttg

SEQ ID NO: 7019379 - DNA, 22 bp, Homo sapiens
tccagcagcctgacttccctct

SEQ ID NO: 7019380 - DNA, 18 bp, Homo sapiens
tggcttcttgagctaaca

SEQ ID NO: 7019381 - DNA, 17 bp, Homo sapiens
acagagcacatcaagat

SEQ ID NO: 7019382 - DNA, 22 bp, Homo sapiens
gccagcctgtgggggctctgtg

SEQ ID NO: 7019383 - DNA, 22 bp, Homo sapiens
tggtacctgccaccttttccct

SEQ ID NO: 7019384 - DNA, 22 bp, Homo sapiens
tgcgggagtgcgccgagctctc

SEQ ID NO: 7019385 - DNA, 22 bp, Homo sapiens
attccaggaagtgtgggaccaa

SEQ ID NO: 7019386 - DNA, 22 bp, Homo sapiens
gtagtggagtctcctgtcctgg

SEQ ID NO: 7019387 - DNA, 22 bp, Homo sapiens
tggcttgcttcttctgctgtcg

SEQ ID NO: 7019388 - DNA, 22 bp, Homo sapiens
tggtcctgtagcacttgattag

SEQ ID NO: 7019389 - DNA, 22 bp, Homo sapiens
agagtctgatatttgtaccaga

SEQ ID NO: 7019390 - DNA, 22 bp, Homo sapiens
cgaaaatagatctgtttcccag

SEQ ID NO: 7019391 - DNA, 22 bp, Homo sapiens
tttgatgatgggggtgcaggac

SEQ ID NO: 7019392 - DNA, 22 bp, Homo sapiens
tagagtccattaatgcaagttt

SEQ ID NO: 7019393 - DNA, 22 bp, Homo sapiens
tttagcagaaactcattaaatt

SEQ ID NO: 7019394 - DNA, 21 bp, Homo sapiens
ggaagctgtgtccatgctcct

SEQ ID NO: 7019395 - DNA, 21 bp, Homo sapiens
ttaccaatggcttctctttcc

SEQ ID NO: 7019396 - DNA, 22 bp, Homo sapiens
aagagcagtgttttactcagct

SEQ ID NO: 7019397 - DNA, 22 bp, Homo sapiens
gaggccacggaagggagctgtg

SEQ ID NO: 7019398 - DNA, 22 bp, Homo sapiens
agtcacagggggcccctgcaac

SEQ ID NO: 7019399 - DNA, 22 bp, Homo sapiens
tggataactggtgtgagtaagc

SEQ ID NO: 7019400 - DNA, 22 bp, Homo sapiens
ttatcacttatgagctttttgc

SEQ ID NO: 7019401 - DNA, 22 bp, Homo sapiens
taatcacaattcagatgtctta

SEQ ID NO: 7019402 - DNA, 22 bp, Homo sapiens
ttcagtatgtgtaaactacttt

SEQ ID NO: 7019403 - DNA, 22 bp, Homo sapiens
gaggaggtcccccgacatgcct

SEQ ID NO: 7019404 - DNA, 22 bp, Homo sapiens
ggggaaacatgttgttcagacc

SEQ ID NO: 7019405 - DNA, 16 bp, Homo sapiens
atgaggcataggctgc

SEQ ID NO: 7019406 - DNA, 21 bp, Homo sapiens
ctaccctcactcccattcctc

SEQ ID NO: 7019407 - DNA, 22 bp, Homo sapiens
tagaaatcttgttactatgtgt

SEQ ID NO: 7019408 - DNA, 22 bp, Homo sapiens
tgttagcctgcctgaagagact

SEQ ID NO: 7019409 - DNA, 20 bp, Homo sapiens
ttatttgctctttatctgca

SEQ ID NO: 7019410 - DNA, 23 bp, Homo sapiens
aaacatgcagcacatgaatgcta

SEQ ID NO: 7019411 - DNA, 19 bp, Homo sapiens
attctctggtttgctggct

SEQ ID NO: 7019412 - DNA, 22 bp, Homo sapiens
tgcaaacagccttgaaagaggg

SEQ ID NO: 7019413 - DNA, 22 bp, Homo sapiens
aggctgaggagggatgttgctt

SEQ ID NO: 7019414 - DNA, 20 bp, Homo sapiens
aggaggggatagaatcaaag

SEQ ID NO: 7019415 - DNA, 22 bp, Homo sapiens
caggctccagcttcctgctcag

SEQ ID NO: 7019416 - DNA, 22 bp, Homo sapiens
atatatatgctgatggctgcca

SEQ ID NO: 7019417 - DNA, 22 bp, Homo sapiens
tctgtgtgatttcagggaagtc

SEQ ID NO: 7019418 - DNA, 22 bp, Homo sapiens
ctgggctgtggtgtggcccaaa

SEQ ID NO: 7019419 - DNA, 22 bp, Homo sapiens
gcacctgattgatttcactgct

SEQ ID NO: 7019420 - DNA, 22 bp, Homo sapiens
caggaatgagttctggtgctct

SEQ ID NO: 7019421 - DNA, 22 bp, Homo sapiens
aggactttatcttctagacctc

SEQ ID NO: 7019422 - DNA, 22 bp, Homo sapiens
ttctggaagctggaaaaggcaa

SEQ ID NO: 7019423 - DNA, 22 bp, Homo sapiens
ccatctggatctgtccactgac

SEQ ID NO: 7019424 - DNA, 22 bp, Homo sapiens
gtgggacagctggagggtccct

SEQ ID NO: 7019425 - DNA, 22 bp, Homo sapiens
gcacttgtggatttgatataca

SEQ ID NO: 7019426 - DNA, 23 bp, Homo sapiens
agtatgggggatcacgtggccct

SEQ ID NO: 7019427 - DNA, 22 bp, Homo sapiens
tcactgtttgcagtgaagagaa

SEQ ID NO: 7019428 - DNA, 22 bp, Homo sapiens
gcagctcttttcttaaagagat

SEQ ID NO: 7019429 - DNA, 20 bp, Homo sapiens
gctttcaagcttgtcattgt

SEQ ID NO: 7019430 - DNA, 22 bp, Homo sapiens
ctctcaggtagagcccaagaat

SEQ ID NO: 7019431 - DNA, 22 bp, Homo sapiens
agcaacagccctgtttcattag

SEQ ID NO: 7019432 - DNA, 22 bp, Homo sapiens
cagcagcttctgttgatcagaa

SEQ ID NO: 7019433 - DNA, 22 bp, Homo sapiens
aattatatgttaatcttcaatt

SEQ ID NO: 7019434 - DNA, 22 bp, Homo sapiens
agcaagaaatcttcagtgttct

SEQ ID NO: 7019435 - DNA, 22 bp, Homo sapiens
cccaggctagtatgatatcagt

SEQ ID NO: 7019436 - DNA, 22 bp, Homo sapiens
ccagaaggcggagattgcagtg

SEQ ID NO: 7019437 - DNA, 22 bp, Homo sapiens
atttggaagaaatctgtcacag

SEQ ID NO: 7019438 - DNA, 22 bp, Homo sapiens
tcaggctttccgaagcgcgcgg

SEQ ID NO: 7019439 - DNA, 22 bp, Homo sapiens
tagaacacttgaccactgctcc

SEQ ID NO: 7019440 - DNA, 22 bp, Homo sapiens
tggggaaaatgcttgtagtcag

SEQ ID NO: 7019441 - DNA, 22 bp, Homo sapiens
aggaagcttggggcagggctac

SEQ ID NO: 7019442 - DNA, 22 bp, Homo sapiens
tgatgcttcacgctgaatatgc

SEQ ID NO: 7019443 - DNA, 22 bp, Homo sapiens
tggcttctcaaaataactggtt

SEQ ID NO: 7019444 - DNA, 22 bp, Homo sapiens
taggctttccttgttgccatgt

SEQ ID NO: 7019445 - DNA, 22 bp, Homo sapiens
tcatctgttcatacacatgcgt

SEQ ID NO: 7019446 - DNA, 22 bp, Homo sapiens
gtcagcctgcactcagggagcg

SEQ ID NO: 7019447 - DNA, 20 bp, Homo sapiens
acgtggccaccagtggctta

SEQ ID NO: 7019448 - DNA, 22 bp, Homo sapiens
tgccagaatttgcttccaatgt

SEQ ID NO: 7019449 - DNA, 22 bp, Homo sapiens
tcctatgttttcccctagagaa

SEQ ID NO: 7019450 - DNA, 22 bp, Homo sapiens
aggctctgcttttctggatata

SEQ ID NO: 7019451 - DNA, 22 bp, Homo sapiens
cagtcaggaatgcctccttcct

SEQ ID NO: 7019452 - DNA, 22 bp, Homo sapiens
agtaaggcatttttcatgttta

SEQ ID NO: 7019453 - DNA, 22 bp, Homo sapiens
aaactgttcctttttcagcaac

SEQ ID NO: 7019454 - DNA, 22 bp, Homo sapiens
tacagtgacctagaataaatac

SEQ ID NO: 7019455 - DNA, 22 bp, Homo sapiens
aatacagaggaaacatttaata

SEQ ID NO: 7019456 - DNA, 22 bp, Homo sapiens
attaatatttgcaccttctgtc

SEQ ID NO: 7019457 - DNA, 22 bp, Homo sapiens
ctgcttctagcaccaagtccct

SEQ ID NO: 7019458 - DNA, 23 bp, Homo sapiens
ttggcagcgggtcaggctgtggg

SEQ ID NO: 7019459 - DNA, 22 bp, Homo sapiens
catgctatttatacataagtct

SEQ ID NO: 7019460 - DNA, 22 bp, Homo sapiens
agaaggctcatttgactgcatt

SEQ ID NO: 7019461 - DNA, 22 bp, Homo sapiens
ctgcctgaagaattgtgttgca

SEQ ID NO: 7019462 - DNA, 22 bp, Homo sapiens
ggtggcctccagggcataggtg

SEQ ID NO: 7019463 - DNA, 22 bp, Homo sapiens
agagttgctaccaagatgctag

SEQ ID NO: 7019464 - DNA, 22 bp, Homo sapiens
aatctggaatatttgcattgta

SEQ ID NO: 7019465 - DNA, 22 bp, Homo sapiens
tggtgttggagatggttgcatt

SEQ ID NO: 7019466 - DNA, 22 bp, Homo sapiens
cattgttaattggtatcttaca

SEQ ID NO: 7019467 - DNA, 23 bp, Homo sapiens
tgtcctttttgaggcctcctcct

SEQ ID NO: 7019468 - DNA, 22 bp, Homo sapiens
ggttagtagcacagatgctgaa

SEQ ID NO: 7019469 - DNA, 22 bp, Homo sapiens
ctctcttcccgtgagtgttgca

SEQ ID NO: 7019470 - DNA, 23 bp, Homo sapiens
tggcagagacccagaatctacat

SEQ ID NO: 7019471 - DNA, 22 bp, Homo sapiens
ttcccttttttctagtaggtag

SEQ ID NO: 7019472 - DNA, 20 bp, Homo sapiens
gtgggcagagcaccacctgg

SEQ ID NO: 7019473 - DNA, 22 bp, Homo sapiens
agggagttagtgatgtggtctc

SEQ ID NO: 7019474 - DNA, 22 bp, Homo sapiens
aagatccttctcactgcagtgt

SEQ ID NO: 7019475 - DNA, 22 bp, Homo sapiens
ggccggggcctgctcgcctgtg

SEQ ID NO: 7019476 - DNA, 22 bp, Homo sapiens
agagtgcccaagcctggcaggg

SEQ ID NO: 7019477 - DNA, 22 bp, Homo sapiens
ctgtcagtagaccccaagctag

SEQ ID NO: 7019478 - DNA, 22 bp, Homo sapiens
agaaaacattacataggtgtgt

SEQ ID NO: 7019479 - DNA, 22 bp, Homo sapiens
atccattttaactgttagtgca

SEQ ID NO: 7019480 - DNA, 17 bp, Homo sapiens
gaacttgttcactgtga

SEQ ID NO: 7019481 - DNA, 22 bp, Homo sapiens
ctggccactggaggtggcaccc

SEQ ID NO: 7019482 - DNA, 22 bp, Homo sapiens
atgtggctagtgcaactgagaa

SEQ ID NO: 7019483 - DNA, 22 bp, Homo sapiens
agaaagacgtgatgaagaagta

SEQ ID NO: 7019484 - DNA, 22 bp, Homo sapiens
gattggggggcaggagaagtgt

SEQ ID NO: 7019485 - DNA, 22 bp, Homo sapiens
acatgcatactgctgccaacgc

SEQ ID NO: 7019486 - DNA, 22 bp, Homo sapiens
tgtgaaaggaaggcatgaaaag

SEQ ID NO: 7019487 - DNA, 23 bp, Homo sapiens
tggaggcaggatgctaaggagtc

SEQ ID NO: 7019488 - DNA, 22 bp, Homo sapiens
actgtacatatggattctaaga

SEQ ID NO: 7019489 - DNA, 22 bp, Homo sapiens
tagtgtctgatccgtagttaca

SEQ ID NO: 7019490 - DNA, 22 bp, Homo sapiens
aggtctcaaactggcaccctgt

SEQ ID NO: 7019491 - DNA, 22 bp, Homo sapiens
tgcaaagccacaatgaaatcag

SEQ ID NO: 7019492 - DNA, 22 bp, Homo sapiens
agtggcagagaccccagccagc

SEQ ID NO: 7019493 - DNA, 22 bp, Homo sapiens
gtacccaagcaatcagtggaca

SEQ ID NO: 7019494 - DNA, 22 bp, Homo sapiens
gctcaagaccaagggagcgggg

SEQ ID NO: 7019495 - DNA, 22 bp, Homo sapiens
aggctggcttggctctcctgtg

SEQ ID NO: 7019496 - DNA, 22 bp, Homo sapiens
ccatcagacaattctttctctt

SEQ ID NO: 7019497 - DNA, 20 bp, Homo sapiens
tctttgttaattttatctcc

SEQ ID NO: 7019498 - DNA, 22 bp, Homo sapiens
tgcctgtctcctctgcagggtg

SEQ ID NO: 7019499 - DNA, 22 bp, Homo sapiens
catgtggaaaattcattgtgag

SEQ ID NO: 7019500 - DNA, 22 bp, Homo sapiens
cactccaagacctactttctct

SEQ ID NO: 7019501 - DNA, 17 bp, Homo sapiens
tacaatgtgattcaatc

SEQ ID NO: 7019502 - DNA, 22 bp, Homo sapiens
ctggcatgctaatacagcctgt

SEQ ID NO: 7019503 - DNA, 22 bp, Homo sapiens
gttaatgagtgggctgtggaga

SEQ ID NO: 7019504 - DNA, 22 bp, Homo sapiens
cctgtcacgatgactgcactct

SEQ ID NO: 7019505 - DNA, 22 bp, Homo sapiens
aggtggcagcagcctggtgaaa

SEQ ID NO: 7019506 - DNA, 22 bp, Homo sapiens
ctttgcctcctagagcacgttc

SEQ ID NO: 7019507 - DNA, 22 bp, Homo sapiens
tcaggggaggttgaatcgtctc

SEQ ID NO: 7019508 - DNA, 22 bp, Homo sapiens
aagacactgatactctgtgatt

SEQ ID NO: 7019509 - DNA, 22 bp, Homo sapiens
ctcttgaaaattggaacacaga

SEQ ID NO: 7019510 - DNA, 22 bp, Homo sapiens
tctgcctggattccattctcca

SEQ ID NO: 7019511 - DNA, 22 bp, Homo sapiens
aacatagaataaatgagttagg

SEQ ID NO: 7019512 - DNA, 22 bp, Homo sapiens
tgaaataggaaacagatgtttc

SEQ ID NO: 7019513 - DNA, 22 bp, Homo sapiens
tctgcctgtggtggaggaagtt

SEQ ID NO: 7019514 - DNA, 22 bp, Homo sapiens
cttaaaggaggttttgtttcca

SEQ ID NO: 7019515 - DNA, 22 bp, Homo sapiens
gacagcctcatgtgcatgaact

SEQ ID NO: 7019516 - DNA, 22 bp, Homo sapiens
aaggcaatggtttctgtgcctt

SEQ ID NO: 7019517 - DNA, 22 bp, Homo sapiens
tgcagttagcctaggattgagc

SEQ ID NO: 7019518 - DNA, 20 bp, Homo sapiens
tctctgggttctcactcagc

SEQ ID NO: 7019519 - DNA, 22 bp, Homo sapiens
ctaaatgttttatcttcctggc

SEQ ID NO: 7019520 - DNA, 22 bp, Homo sapiens
acagactccccaggttatctca

SEQ ID NO: 7019521 - DNA, 22 bp, Homo sapiens
gactgtggggaagcagatgcca

SEQ ID NO: 7019522 - DNA, 20 bp, Homo sapiens
ttcacaactcttagaagctg

SEQ ID NO: 7019523 - DNA, 22 bp, Homo sapiens
gccaagaaagaacagcagggaa

SEQ ID NO: 7019524 - DNA, 23 bp, Homo sapiens
aactggtccaagatagattgtcc

SEQ ID NO: 7019525 - DNA, 22 bp, Homo sapiens
gctggagaaacaggaggaggaa

SEQ ID NO: 7019526 - DNA, 22 bp, Homo sapiens
cctgcccttctttccccagcat

SEQ ID NO: 7019527 - DNA, 22 bp, Homo sapiens
ctttactgaagtgaagacctgg

SEQ ID NO: 7019528 - DNA, 22 bp, Homo sapiens
ttctattgcacacaaataatta

SEQ ID NO: 7019529 - DNA, 22 bp, Homo sapiens
cactggtgaaagtttaattgtt

SEQ ID NO: 7019530 - DNA, 22 bp, Homo sapiens
ccagagggaagaggaagcgctg

SEQ ID NO: 7019531 - DNA, 22 bp, Homo sapiens
tggctctggattaatctaggaa

SEQ ID NO: 7019532 - DNA, 22 bp, Homo sapiens
ccctgaacaaagcccaggctct

SEQ ID NO: 7019533 - DNA, 22 bp, Homo sapiens
tattcctatggccactgctact

SEQ ID NO: 7019534 - DNA, 22 bp, Homo sapiens
tgcaccttgtccatttttggcc

SEQ ID NO: 7019535 - DNA, 22 bp, Homo sapiens
ggaaagccaggtgctctggtgt

SEQ ID NO: 7019536 - DNA, 22 bp, Homo sapiens
tttacttgatatggagctgagg

SEQ ID NO: 7019537 - DNA, 22 bp, Homo sapiens
agtggctggtctaaggtcacag

SEQ ID NO: 7019538 - DNA, 22 bp, Homo sapiens
atacaggtggaactaaataaat

SEQ ID NO: 7019539 - DNA, 22 bp, Homo sapiens
ggcactgagctgccttggggca

SEQ ID NO: 7019540 - DNA, 20 bp, Homo sapiens
agttcacaggccaaatttct

SEQ ID NO: 7019541 - DNA, 17 bp, Homo sapiens
atgattccatcaggatt

SEQ ID NO: 7019542 - DNA, 20 bp, Homo sapiens
ttggtaaggatgaagagcaa

SEQ ID NO: 7019543 - DNA, 22 bp, Homo sapiens
gcctggctgggctgaatgctta

SEQ ID NO: 7019544 - DNA, 22 bp, Homo sapiens
tgcactattgtgttcactatta

SEQ ID NO: 7019545 - DNA, 22 bp, Homo sapiens
ctcaggattaaggaatctaaat

SEQ ID NO: 7019546 - DNA, 22 bp, Homo sapiens
tttagtagctacagttagaagg

SEQ ID NO: 7019547 - DNA, 22 bp, Homo sapiens
gggagtggagagcaatggatga

SEQ ID NO: 7019548 - DNA, 22 bp, Homo sapiens
gaaatactgtaaagttattatt

SEQ ID NO: 7019549 - DNA, 22 bp, Homo sapiens
ttgaatgcatggttcactctgt

SEQ ID NO: 7019550 - DNA, 22 bp, Homo sapiens
accttattcttgcccttagatg

SEQ ID NO: 7019551 - DNA, 22 bp, Homo sapiens
atgcagttagcactacagaaga

SEQ ID NO: 7019552 - DNA, 22 bp, Homo sapiens
tctctgtatcagcacctgctgg

SEQ ID NO: 7019553 - DNA, 22 bp, Homo sapiens
ttcatgtttgtaggactgaggc

SEQ ID NO: 7019554 - DNA, 23 bp, Homo sapiens
ttgagaacaggtgtgagaatggc

SEQ ID NO: 7019555 - DNA, 22 bp, Homo sapiens
taaacagagatgcctgggtctg

SEQ ID NO: 7019556 - DNA, 22 bp, Homo sapiens
ggctgagaagacagtggggtgg

SEQ ID NO: 7019557 - DNA, 22 bp, Homo sapiens
tgatcatccagtttcttgtcca

SEQ ID NO: 7019558 - DNA, 22 bp, Homo sapiens
tgtaataccactgttggacatt

SEQ ID NO: 7019559 - DNA, 22 bp, Homo sapiens
cggcagggttggttttctctga

SEQ ID NO: 7019560 - DNA, 22 bp, Homo sapiens
aggagaggcatcaagaaaatcg

SEQ ID NO: 7019561 - DNA, 22 bp, Homo sapiens
ggctgcctgaggctgaggcccg

SEQ ID NO: 7019562 - DNA, 23 bp, Homo sapiens
actgccagattgaaggtttctta

SEQ ID NO: 7019563 - DNA, 22 bp, Homo sapiens
cttaaagttgacacagtccctg

SEQ ID NO: 7019564 - DNA, 22 bp, Homo sapiens
tctctgctaagattgtgtctag

SEQ ID NO: 7019565 - DNA, 22 bp, Homo sapiens
agccccacgttgtctagcacct

SEQ ID NO: 7019566 - DNA, 22 bp, Homo sapiens
ctgtttatctctaacctgttta

SEQ ID NO: 7019567 - DNA, 22 bp, Homo sapiens
tttaactggtctcctgctgctt

SEQ ID NO: 7019568 - DNA, 22 bp, Homo sapiens
gccctagaatcacatttcttgt

SEQ ID NO: 7019569 - DNA, 20 bp, Homo sapiens
gacattcatagttattacca

SEQ ID NO: 7019570 - DNA, 22 bp, Homo sapiens
aagtttgagaagcttatagata

SEQ ID NO: 7019571 - DNA, 22 bp, Homo sapiens
tgatctttactgctgtttataa

SEQ ID NO: 7019572 - DNA, 22 bp, Homo sapiens
ctgcagggagaggggacagcct

SEQ ID NO: 7019573 - DNA, 22 bp, Homo sapiens
tagggatggatgatgcctggca

SEQ ID NO: 7019574 - DNA, 22 bp, Homo sapiens
gctctatgcatgggagcaggag

SEQ ID NO: 7019575 - DNA, 20 bp, Homo sapiens
gatggctttagaagctggta

SEQ ID NO: 7019576 - DNA, 22 bp, Homo sapiens
ttggaactgatggccttcatcc

SEQ ID NO: 7019577 - DNA, 22 bp, Homo sapiens
cctggctccgtgtcacgtgccc

SEQ ID NO: 7019578 - DNA, 22 bp, Homo sapiens
tcactgattatgaaaatgaagg

SEQ ID NO: 7019579 - DNA, 23 bp, Homo sapiens
agatcacatgctgatggaaaatg

SEQ ID NO: 7019580 - DNA, 22 bp, Homo sapiens
tcctttctccagctggcattgt

SEQ ID NO: 7019581 - DNA, 16 bp, Homo sapiens
tcctggcccctatgga

SEQ ID NO: 7019582 - DNA, 22 bp, Homo sapiens
tgggcagaattgtggtagttaa

SEQ ID NO: 7019583 - DNA, 22 bp, Homo sapiens
gccaggcaggccacgctgtgtt

SEQ ID NO: 7019584 - DNA, 22 bp, Homo sapiens
cgatgcttcttttggagaagtc

SEQ ID NO: 7019585 - DNA, 22 bp, Homo sapiens
taagtactgtctgtgccttctt

SEQ ID NO: 7019586 - DNA, 22 bp, Homo sapiens
aaagctgtaatgcatgctttct

SEQ ID NO: 7019587 - DNA, 22 bp, Homo sapiens
ggtccagggaactttgaaggat

SEQ ID NO: 7019588 - DNA, 22 bp, Homo sapiens
ttttcctctgttattagtgtga

SEQ ID NO: 7019589 - DNA, 20 bp, Homo sapiens
cagagattttacttcctcac

SEQ ID NO: 7019590 - DNA, 22 bp, Homo sapiens
actgttggcttctggtagtgac

SEQ ID NO: 7019591 - DNA, 22 bp, Homo sapiens
atgtgctaaactcaacaaatct

SEQ ID NO: 7019592 - DNA, 22 bp, Homo sapiens
caatgggcctggagagagctgg

SEQ ID NO: 7019593 - DNA, 22 bp, Homo sapiens
ctcacaggttctgcagctcaca

SEQ ID NO: 7019594 - DNA, 22 bp, Homo sapiens
ttgtttcaaatatttcagaata

SEQ ID NO: 7019595 - DNA, 20 bp, Homo sapiens
ttcctgattgtcatttctgc

SEQ ID NO: 7019596 - DNA, 22 bp, Homo sapiens
gagcaaatggagcttgtctact

SEQ ID NO: 7019597 - DNA, 22 bp, Homo sapiens
tcagcctcctaatttcctgtga

SEQ ID NO: 7019598 - DNA, 22 bp, Homo sapiens
tttgtgagtgcacatgcccaca

SEQ ID NO: 7019599 - DNA, 22 bp, Homo sapiens
agctctggtatttctttaatcc

SEQ ID NO: 7019600 - DNA, 22 bp, Homo sapiens
actaaatgagatactgtcttca

SEQ ID NO: 7019601 - DNA, 22 bp, Homo sapiens
tcacagctaagcttggtcactg

SEQ ID NO: 7019602 - DNA, 22 bp, Homo sapiens
ttccccttatcaccagcctgtc

SEQ ID NO: 7019603 - DNA, 21 bp, Homo sapiens
ttcaagatatttaaaaggtgg

SEQ ID NO: 7019604 - DNA, 22 bp, Homo sapiens
aacattcaattgaggaagttaa

SEQ ID NO: 7019605 - DNA, 22 bp, Homo sapiens
aactgcaagagtaaatgtctag

SEQ ID NO: 7019606 - DNA, 22 bp, Homo sapiens
ttccctaagcattgcaatggcg

SEQ ID NO: 7019607 - DNA, 22 bp, Homo sapiens
ttaacttgtcagaaaatacagt

SEQ ID NO: 7019608 - DNA, 22 bp, Homo sapiens
ttggacataggtggtaatagtg

SEQ ID NO: 7019609 - DNA, 23 bp, Homo sapiens
ttacatggtagtcaaagctaaag

SEQ ID NO: 7019610 - DNA, 22 bp, Homo sapiens
agctggtttaggaaaaggtagg

SEQ ID NO: 7019611 - DNA, 22 bp, Homo sapiens
atactgattagttgagaaagca

SEQ ID NO: 7019612 - DNA, 22 bp, Homo sapiens
ttccagtcaagtaagaatatct

SEQ ID NO: 7019613 - DNA, 22 bp, Homo sapiens
gagtggctgagtaagaggggag

SEQ ID NO: 7019614 - DNA, 22 bp, Homo sapiens
ttgtatgatcaaaagaaatgta

SEQ ID NO: 7019615 - DNA, 22 bp, Homo sapiens
aaatgcaggattaacagctttg

SEQ ID NO: 7019616 - DNA, 22 bp, Homo sapiens
accgctgtgcccctgaaagtag

SEQ ID NO: 7019617 - DNA, 22 bp, Homo sapiens
gggtctggcatgctgagatgga

SEQ ID NO: 7019618 - DNA, 22 bp, Homo sapiens
aaggctgggtttgggatgtgat

SEQ ID NO: 7019619 - DNA, 22 bp, Homo sapiens
gttaaggctgagcaggacactg

SEQ ID NO: 7019620 - DNA, 22 bp, Homo sapiens
tgcctgtgggcagagggccaga

SEQ ID NO: 7019621 - DNA, 22 bp, Homo sapiens
ttttgttgacctctcccacctt

SEQ ID NO: 7019622 - DNA, 22 bp, Homo sapiens
tgtgcatgtttgttttcagggt

SEQ ID NO: 7019623 - DNA, 22 bp, Homo sapiens
cccatttagagtataagagaga

SEQ ID NO: 7019624 - DNA, 22 bp, Homo sapiens
cagtggcacttgtcatttctga

SEQ ID NO: 7019625 - DNA, 22 bp, Homo sapiens
caggcagaatgaccgacctcgc

SEQ ID NO: 7019626 - DNA, 21 bp, Homo sapiens
cagcagagtaatgcattcgta

SEQ ID NO: 7019627 - DNA, 22 bp, Homo sapiens
ctctggcctgcagatccatgct

SEQ ID NO: 7019628 - DNA, 22 bp, Homo sapiens
tatttcacaagatgctgatgct

SEQ ID NO: 7019629 - DNA, 22 bp, Homo sapiens
tctggcagaaggcagaaattca

SEQ ID NO: 7019630 - DNA, 22 bp, Homo sapiens
gtatggctaagacaattccaga

SEQ ID NO: 7019631 - DNA, 22 bp, Homo sapiens
gctggagtctggaggtgtgcca

SEQ ID NO: 7019632 - DNA, 22 bp, Homo sapiens
tccatgattggtcatcatagaa

SEQ ID NO: 7019633 - DNA, 22 bp, Homo sapiens
gtacctatgtgtatgacagcat

SEQ ID NO: 7019634 - DNA, 22 bp, Homo sapiens
caggctgcggccgtgtgagcat

SEQ ID NO: 7019635 - DNA, 22 bp, Homo sapiens
agaaatcagaaccctgaagttc

SEQ ID NO: 7019636 - DNA, 22 bp, Homo sapiens
aataaagcacttgggttggtaa

SEQ ID NO: 7019637 - DNA, 22 bp, Homo sapiens
aagccagtgtggtctgcccatt

SEQ ID NO: 7019638 - DNA, 22 bp, Homo sapiens
aggtgagggtgccagtgcatgg

SEQ ID NO: 7019639 - DNA, 22 bp, Homo sapiens
aagaatgtggcatttatttata

SEQ ID NO: 7019640 - DNA, 23 bp, Homo sapiens
cttctcagtagtacacacactat

SEQ ID NO: 7019641 - DNA, 17 bp, Homo sapiens
ggacacctggagtctcc

SEQ ID NO: 7019642 - DNA, 22 bp, Homo sapiens
ggaggagtgtggggcactctgc

SEQ ID NO: 7019643 - DNA, 22 bp, Homo sapiens
aactcttttctgggtcagcaca

SEQ ID NO: 7019644 - DNA, 22 bp, Homo sapiens
agtcattttctgcctgtaatct

SEQ ID NO: 7019645 - DNA, 22 bp, Homo sapiens
aagccatggctgcatcagcctg

SEQ ID NO: 7019646 - DNA, 22 bp, Homo sapiens
attcttcatggctgtgagtcct

SEQ ID NO: 7019647 - DNA, 22 bp, Homo sapiens
tcaggagtttggcctacagagg

SEQ ID NO: 7019648 - DNA, 22 bp, Homo sapiens
catgcaagacaatctttaaaat

SEQ ID NO: 7019649 - DNA, 22 bp, Homo sapiens
ttactcttccaaatgaatttca

SEQ ID NO: 7019650 - DNA, 22 bp, Homo sapiens
ctctggtccttctgacaacctg

SEQ ID NO: 7019651 - DNA, 22 bp, Homo sapiens
cccaggagggtggcctctgccc

SEQ ID NO: 7019652 - DNA, 22 bp, Homo sapiens
ctgaggccgtctgggtctgcag

SEQ ID NO: 7019653 - DNA, 22 bp, Homo sapiens
agtctgtctgtcacttctgcag

SEQ ID NO: 7019654 - DNA, 22 bp, Homo sapiens
ctggaagagcatttgcataggg

SEQ ID NO: 7019655 - DNA, 22 bp, Homo sapiens
cagacatggcgccaagtgctag

SEQ ID NO: 7019656 - DNA, 22 bp, Homo sapiens
atattggtgattagccaatgct

SEQ ID NO: 7019657 - DNA, 22 bp, Homo sapiens
ccagcagagtatcaatgtattt

SEQ ID NO: 7019658 - DNA, 22 bp, Homo sapiens
tcatacaggctcaagctatacg

SEQ ID NO: 7019659 - DNA, 22 bp, Homo sapiens
tacttcattcaagttcgctata

SEQ ID NO: 7019660 - DNA, 22 bp, Homo sapiens
gatgttaagaaggaattgaagt

SEQ ID NO: 7019661 - DNA, 22 bp, Homo sapiens
gccattcttaacagtcatcact

SEQ ID NO: 7019662 - DNA, 23 bp, Homo sapiens
acagggaaaagtcatcagtgtga

SEQ ID NO: 7019663 - DNA, 22 bp, Homo sapiens
gaggctggttctgaagtactgt

SEQ ID NO: 7019664 - DNA, 22 bp, Homo sapiens
aatcagaaaggctaaggaagca

SEQ ID NO: 7019665 - DNA, 22 bp, Homo sapiens
tcaggagaaggcaatgtggaaa

SEQ ID NO: 7019666 - DNA, 22 bp, Homo sapiens
actagttagaaatgcttttcat

SEQ ID NO: 7019667 - DNA, 22 bp, Homo sapiens
cacaagatggtcacataagtgc

SEQ ID NO: 7019668 - DNA, 22 bp, Homo sapiens
aggccaccaccctatctcctgg

SEQ ID NO: 7019669 - DNA, 22 bp, Homo sapiens
tgtacaggagaacaatgagaaa

SEQ ID NO: 7019670 - DNA, 22 bp, Homo sapiens
acagacatctatccatttaatt

SEQ ID NO: 7019671 - DNA, 22 bp, Homo sapiens
acagttaccacttagcagttac

SEQ ID NO: 7019672 - DNA, 22 bp, Homo sapiens
ggcttagaaggcaaatgacttg

SEQ ID NO: 7019673 - DNA, 22 bp, Homo sapiens
cttagtgagaaggagcccatgc

SEQ ID NO: 7019674 - DNA, 22 bp, Homo sapiens
tatgggtctggaaaatggcttg

SEQ ID NO: 7019675 - DNA, 22 bp, Homo sapiens
gcttttgtcatggtgactcagt

SEQ ID NO: 7019676 - DNA, 23 bp, Homo sapiens
aggtcagcaggcaaggaaatggc

SEQ ID NO: 7019677 - DNA, 22 bp, Homo sapiens
cctgttgtttagcacttagaac

SEQ ID NO: 7019678 - DNA, 23 bp, Homo sapiens
ggcggggataacagccccttgtc

SEQ ID NO: 7019679 - DNA, 22 bp, Homo sapiens
atggctgtcacgccactgtgag

SEQ ID NO: 7019680 - DNA, 16 bp, Homo sapiens
ttgtcctgtctcactg

SEQ ID NO: 7019681 - DNA, 22 bp, Homo sapiens
catgaagatcctgtatgttttt

SEQ ID NO: 7019682 - DNA, 22 bp, Homo sapiens
aaattgctggatcctactccca

SEQ ID NO: 7019683 - DNA, 22 bp, Homo sapiens
ttacatgtttatgtggtacatg

SEQ ID NO: 7019684 - DNA, 22 bp, Homo sapiens
ctggtgaccggacctcagtttt

SEQ ID NO: 7019685 - DNA, 22 bp, Homo sapiens
gacaggtgtgtgtatattaggg

SEQ ID NO: 7019686 - DNA, 22 bp, Homo sapiens
gggagggccaggctcacccagg

SEQ ID NO: 7019687 - DNA, 19 bp, Homo sapiens
tctctttcatggggctagt

SEQ ID NO: 7019688 - DNA, 22 bp, Homo sapiens
aaactctgatgcttattgggaa

SEQ ID NO: 7019689 - DNA, 21 bp, Homo sapiens
tccaggcctcaggaagggatg

SEQ ID NO: 7019690 - DNA, 22 bp, Homo sapiens
ctgccatcgggggccccactgc

SEQ ID NO: 7019691 - DNA, 22 bp, Homo sapiens
tggggtccagtgcctggcaagg

SEQ ID NO: 7019692 - DNA, 22 bp, Homo sapiens
gtgtctctatctatgcctgaag

SEQ ID NO: 7019693 - DNA, 22 bp, Homo sapiens
tcagtttctccatcgctccagt

SEQ ID NO: 7019694 - DNA, 22 bp, Homo sapiens
aataatctccctttttgtatgt

SEQ ID NO: 7019695 - DNA, 22 bp, Homo sapiens
cacatgatcgtcatgtgaaagt

SEQ ID NO: 7019696 - DNA, 22 bp, Homo sapiens
aaattctctaaagaaaacatga

SEQ ID NO: 7019697 - DNA, 22 bp, Homo sapiens
caccctgtcagttgcaggatag

SEQ ID NO: 7019698 - DNA, 22 bp, Homo sapiens
ggagacagtatggcttgtagct

SEQ ID NO: 7019699 - DNA, 22 bp, Homo sapiens
tctggcagaggaaggaggcctg

SEQ ID NO: 7019700 - DNA, 21 bp, Homo sapiens
cagaccctctagaggccacct

SEQ ID NO: 7019701 - DNA, 22 bp, Homo sapiens
taaagttcttagaacaaggcct

SEQ ID NO: 7019702 - DNA, 22 bp, Homo sapiens
aactcaaagatgcatgacgctt

SEQ ID NO: 7019703 - DNA, 22 bp, Homo sapiens
catgagttcatctgcttctctt

SEQ ID NO: 7019704 - DNA, 22 bp, Homo sapiens
cagagcccctgggttgggagct

SEQ ID NO: 7019705 - DNA, 22 bp, Homo sapiens
cattcatacaagtttgtttcat

SEQ ID NO: 7019706 - DNA, 22 bp, Homo sapiens
ttcagtttctaaagatgttcct

SEQ ID NO: 7019707 - DNA, 22 bp, Homo sapiens
gttccaattccaaattccaagg

SEQ ID NO: 7019708 - DNA, 22 bp, Homo sapiens
ttcagcaacctataaatcccag

SEQ ID NO: 7019709 - DNA, 22 bp, Homo sapiens
attaaggtgtcaatgtatttgg

SEQ ID NO: 7019710 - DNA, 22 bp, Homo sapiens
acactgtagctgagggcatgcg

SEQ ID NO: 7019711 - DNA, 22 bp, Homo sapiens
aaatctgaaatagtgtgaagta

SEQ ID NO: 7019712 - DNA, 20 bp, Homo sapiens
agctaggagaaagcatggag

SEQ ID NO: 7019713 - DNA, 21 bp, Homo sapiens
agacaactgtgactattccct

SEQ ID NO: 7019714 - DNA, 21 bp, Homo sapiens
tctcccaaggaggtcctgagg

SEQ ID NO: 7019715 - DNA, 22 bp, Homo sapiens
ttatgtgagatgtttacattgg

SEQ ID NO: 7019716 - DNA, 22 bp, Homo sapiens
gtcatttaggtctgtcagaaat

SEQ ID NO: 7019717 - DNA, 22 bp, Homo sapiens
ggctccagctaatggtttctat

SEQ ID NO: 7019718 - DNA, 19 bp, Homo sapiens
tgtttcttcctccatctga

SEQ ID NO: 7019719 - DNA, 22 bp, Homo sapiens
ctttgcagtttcagaaccctga

SEQ ID NO: 7019720 - DNA, 18 bp, Homo sapiens
cagatgctaggcctccag

SEQ ID NO: 7019721 - DNA, 22 bp, Homo sapiens
ttcaaacactggcttagccaat

SEQ ID NO: 7019722 - DNA, 16 bp, Homo sapiens
cagaggcacctggctc

SEQ ID NO: 7019723 - DNA, 22 bp, Homo sapiens
aagggcctgccagctcttcatg

SEQ ID NO: 7019724 - DNA, 22 bp, Homo sapiens
taggcaggtgtgcactgcccac

SEQ ID NO: 7019725 - DNA, 22 bp, Homo sapiens
taggcactgtgtttgtaggagt

SEQ ID NO: 7019726 - DNA, 22 bp, Homo sapiens
tgagcaccctctggaaaatggg

SEQ ID NO: 7019727 - DNA, 22 bp, Homo sapiens
gtccagctgggccagggcactc

SEQ ID NO: 7019728 - DNA, 22 bp, Homo sapiens
gacaacagcatatggactgtca

SEQ ID NO: 7019729 - DNA, 22 bp, Homo sapiens
tactgagggcaaagagtgaagc

SEQ ID NO: 7019730 - DNA, 22 bp, Homo sapiens
ggagatggaatagattctgact

SEQ ID NO: 7019731 - DNA, 22 bp, Homo sapiens
gcctttatgtctgaaaatcagc

SEQ ID NO: 7019732 - DNA, 22 bp, Homo sapiens
taaatactttacaggatgtctc

SEQ ID NO: 7019733 - DNA, 22 bp, Homo sapiens
cactgctttaaggctgagtaac

SEQ ID NO: 7019734 - DNA, 22 bp, Homo sapiens
tgggtcaccacttcagaggaga

SEQ ID NO: 7019735 - DNA, 22 bp, Homo sapiens
aatgagctagacctgcttcctc

SEQ ID NO: 7019736 - DNA, 22 bp, Homo sapiens
cagcaatctttcttggtcttct

SEQ ID NO: 7019737 - DNA, 21 bp, Homo sapiens
agtgtccttttactgtgaata

SEQ ID NO: 7019738 - DNA, 22 bp, Homo sapiens
ggctgctctgccttccagctgg

SEQ ID NO: 7019739 - DNA, 22 bp, Homo sapiens
agggctcctatgatgctctgcc

SEQ ID NO: 7019740 - DNA, 18 bp, Homo sapiens
tctgggcttcccgaggct

SEQ ID NO: 7019741 - DNA, 22 bp, Homo sapiens
agaaggactttgtagggttgtt

SEQ ID NO: 7019742 - DNA, 22 bp, Homo sapiens
tacattccatgtgtgtgtattc

SEQ ID NO: 7019743 - DNA, 22 bp, Homo sapiens
gccttagaaaaataagatttta

SEQ ID NO: 7019744 - DNA, 22 bp, Homo sapiens
gcttctacccacgagatgcaaa

SEQ ID NO: 7019745 - DNA, 22 bp, Homo sapiens
atattcaaattacatttactaa

SEQ ID NO: 7019746 - DNA, 22 bp, Homo sapiens
aaacaaggcacaattcaggatt

SEQ ID NO: 7019747 - DNA, 22 bp, Homo sapiens
cacattccttacattcatagag

SEQ ID NO: 7019748 - DNA, 22 bp, Homo sapiens
gtaaatcataaaatttgagctc

SEQ ID NO: 7019749 - DNA, 22 bp, Homo sapiens
ctagtaaatcagaagctgtggg

SEQ ID NO: 7019750 - DNA, 22 bp, Homo sapiens
tgctcacaggtgaccctgggca

SEQ ID NO: 7019751 - DNA, 22 bp, Homo sapiens
tgaaatgtacaagtgctttttt

SEQ ID NO: 7019752 - DNA, 22 bp, Homo sapiens
accaaatgcttggctgctgtga

SEQ ID NO: 7019753 - DNA, 17 bp, Homo sapiens
cactagtagtctctggc

SEQ ID NO: 7019754 - DNA, 22 bp, Homo sapiens
agccatggcgccactagaggga

SEQ ID NO: 7019755 - DNA, 22 bp, Homo sapiens
cagccagtgtgaccgaggagga

SEQ ID NO: 7019756 - DNA, 22 bp, Homo sapiens
gtacatctgtcttgttctgttg

SEQ ID NO: 7019757 - DNA, 22 bp, Homo sapiens
gggtaatgaacaggtggcagag

SEQ ID NO: 7019758 - DNA, 22 bp, Homo sapiens
gagaggtggtgaggacttgtct

SEQ ID NO: 7019759 - DNA, 22 bp, Homo sapiens
ctgggctgctgtccactagggt

SEQ ID NO: 7019760 - DNA, 22 bp, Homo sapiens
atacttcatgcttcatgtctgt

SEQ ID NO: 7019761 - DNA, 22 bp, Homo sapiens
gcagagttggagccagcccagg

SEQ ID NO: 7019762 - DNA, 22 bp, Homo sapiens
tggctgggcccccacctgcctc

SEQ ID NO: 7019763 - DNA, 22 bp, Homo sapiens
caggaggaagaactctgcaaca

SEQ ID NO: 7019764 - DNA, 22 bp, Homo sapiens
aggaaagctcccagtagggctc

SEQ ID NO: 7019765 - DNA, 22 bp, Homo sapiens
actttgccctacagcagctctg

SEQ ID NO: 7019766 - DNA, 22 bp, Homo sapiens
agaggatcatctagtttgactc

SEQ ID NO: 7019767 - DNA, 22 bp, Homo sapiens
agacaaagaaaccgtagaagca

SEQ ID NO: 7019768 - DNA, 22 bp, Homo sapiens
ttaccaatgtgcttttgctaca

SEQ ID NO: 7019769 - DNA, 22 bp, Homo sapiens
acaggatgagaatatcatattt

SEQ ID NO: 7019770 - DNA, 22 bp, Homo sapiens
ggctcaggccagaccacgactc

SEQ ID NO: 7019771 - DNA, 22 bp, Homo sapiens
ccaaggttttctggcactattt

SEQ ID NO: 7019772 - DNA, 22 bp, Homo sapiens
gcatttcatgctccttggaacc

SEQ ID NO: 7019773 - DNA, 22 bp, Homo sapiens
cttcccttctgcagatctttgg

SEQ ID NO: 7019774 - DNA, 21 bp, Homo sapiens
aacagtgcttagtagatgttc

SEQ ID NO: 7019775 - DNA, 22 bp, Homo sapiens
gacatgtttgctatagggattt

SEQ ID NO: 7019776 - DNA, 22 bp, Homo sapiens
gtgtgcgcgcgcgtcccgggtg

SEQ ID NO: 7019777 - DNA, 22 bp, Homo sapiens
acagcagagcctggtacttact

SEQ ID NO: 7019778 - DNA, 22 bp, Homo sapiens
ttatgttatgaatggatgatct

SEQ ID NO: 7019779 - DNA, 22 bp, Homo sapiens
gatcatttacttgttctggact

SEQ ID NO: 7019780 - DNA, 22 bp, Homo sapiens
ttcagggactttgatgtatcag

SEQ ID NO: 7019781 - DNA, 22 bp, Homo sapiens
gtgcagctgtggtggagccagg

SEQ ID NO: 7019782 - DNA, 22 bp, Homo sapiens
ctcactgacagagattgaaaat

SEQ ID NO: 7019783 - DNA, 22 bp, Homo sapiens
cattgaaatatggaaactgatg

SEQ ID NO: 7019784 - DNA, 18 bp, Homo sapiens
agcaggactgtggggtgg

SEQ ID NO: 7019785 - DNA, 22 bp, Homo sapiens
tttgctgcctctcccagctccc

SEQ ID NO: 7019786 - DNA, 22 bp, Homo sapiens
ggctgctcaaggactctgatcg

SEQ ID NO: 7019787 - DNA, 22 bp, Homo sapiens
tgctgagatctgccagtagatg

SEQ ID NO: 7019788 - DNA, 22 bp, Homo sapiens
gggctctgggtcgtgtctccat

SEQ ID NO: 7019789 - DNA, 22 bp, Homo sapiens
aagtttttggtagagaaaagta

SEQ ID NO: 7019790 - DNA, 22 bp, Homo sapiens
ctcagcactttggaaggctgat

SEQ ID NO: 7019791 - DNA, 22 bp, Homo sapiens
ttcagcagtgcagacacccagt

SEQ ID NO: 7019792 - DNA, 23 bp, Homo sapiens
cctcctgggcacaggcctgatgg

SEQ ID NO: 7019793 - DNA, 22 bp, Homo sapiens
tgagcagcttctgtctgaaggc

SEQ ID NO: 7019794 - DNA, 22 bp, Homo sapiens
tgcattgtaggatgtttagcag

SEQ ID NO: 7019795 - DNA, 22 bp, Homo sapiens
gccctcagcttgatgttgttct

SEQ ID NO: 7019796 - DNA, 22 bp, Homo sapiens
aagctttaagtgtcagtcagcc

SEQ ID NO: 7019797 - DNA, 17 bp, Homo sapiens
aggtataaaatggtagc

SEQ ID NO: 7019798 - DNA, 22 bp, Homo sapiens
gccaatttgactagacctcttg

SEQ ID NO: 7019799 - DNA, 22 bp, Homo sapiens
tggacactggtcttactcagct

SEQ ID NO: 7019800 - DNA, 22 bp, Homo sapiens
gggtggcaaaggcgctgaaagg

SEQ ID NO: 7019801 - DNA, 22 bp, Homo sapiens
ggtcagaacaagggtaaataaa

SEQ ID NO: 7019802 - DNA, 22 bp, Homo sapiens
tcattgttgacataccaagagc

SEQ ID NO: 7019803 - DNA, 22 bp, Homo sapiens
agagtttaggggacacagaata

SEQ ID NO: 7019804 - DNA, 22 bp, Homo sapiens
gaagagctccaaaaacagtgag

SEQ ID NO: 7019805 - DNA, 22 bp, Homo sapiens
taggaaaaatacagaattatat

SEQ ID NO: 7019806 - DNA, 22 bp, Homo sapiens
ttctttacagtgggttttgaat

SEQ ID NO: 7019807 - DNA, 22 bp, Homo sapiens
gctgcctcctgagatttgggca

SEQ ID NO: 7019808 - DNA, 21 bp, Homo sapiens
accactgcctccaaggttcag

SEQ ID NO: 7019809 - DNA, 22 bp, Homo sapiens
ttgccctgtggggcctccagcc

SEQ ID NO: 7019810 - DNA, 22 bp, Homo sapiens
ttactttgggtcctgcttataa

SEQ ID NO: 7019811 - DNA, 22 bp, Homo sapiens
acagtgtctcctggtacccagt

SEQ ID NO: 7019812 - DNA, 22 bp, Homo sapiens
aaatcagaggcaacaactactt

SEQ ID NO: 7019813 - DNA, 22 bp, Homo sapiens
ttgggccactttagtttcctta

SEQ ID NO: 7019814 - DNA, 22 bp, Homo sapiens
acattctgttgaggctgggtca

SEQ ID NO: 7019815 - DNA, 22 bp, Homo sapiens
attaggattttgtccaagtagc

SEQ ID NO: 7019816 - DNA, 22 bp, Homo sapiens
agtttggaggcagggttgatga

SEQ ID NO: 7019817 - DNA, 22 bp, Homo sapiens
cctagacacttatggaagtgag

SEQ ID NO: 7019818 - DNA, 22 bp, Homo sapiens
gggaccagtgtctgtgagaaaa

SEQ ID NO: 7019819 - DNA, 22 bp, Homo sapiens
ttggccttaacctctctgtgcc

SEQ ID NO: 7019820 - DNA, 22 bp, Homo sapiens
gcagactgcgtgaggcgccgcc

SEQ ID NO: 7019821 - DNA, 22 bp, Homo sapiens
cttatttgagagaaaagaaact

SEQ ID NO: 7019822 - DNA, 22 bp, Homo sapiens
gcctgcagaactgtgaggcaat

SEQ ID NO: 7019823 - DNA, 22 bp, Homo sapiens
gggagcatttccctgtgttgaa

SEQ ID NO: 7019824 - DNA, 22 bp, Homo sapiens
agtgtttagcatgaagttcatt

SEQ ID NO: 7019825 - DNA, 22 bp, Homo sapiens
tcatgaaaaattttccatgtca

SEQ ID NO: 7019826 - DNA, 22 bp, Homo sapiens
tcttcacatggagaagcaactc

SEQ ID NO: 7019827 - DNA, 22 bp, Homo sapiens
gatgttctctgattggtggtag

SEQ ID NO: 7019828 - DNA, 22 bp, Homo sapiens
gtggaacattcaaagtggagag

SEQ ID NO: 7019829 - DNA, 22 bp, Homo sapiens
ggcatgcttgctgtttgggaat

SEQ ID NO: 7019830 - DNA, 22 bp, Homo sapiens
cgtgcaaatatatgtgtgatga

SEQ ID NO: 7019831 - DNA, 22 bp, Homo sapiens
ctgctgtgagcactccagcctg

SEQ ID NO: 7019832 - DNA, 22 bp, Homo sapiens
tgacagagtgacactcttgtct

SEQ ID NO: 7019833 - DNA, 22 bp, Homo sapiens
ccatatttgcttcttgctgata

SEQ ID NO: 7019834 - DNA, 22 bp, Homo sapiens
ggctctggggttggcccatctc

SEQ ID NO: 7019835 - DNA, 18 bp, Homo sapiens
ctgttgagatgtggctga

SEQ ID NO: 7019836 - DNA, 22 bp, Homo sapiens
aatcttcactcttaactgtgca

SEQ ID NO: 7019837 - DNA, 22 bp, Homo sapiens
gctcagagagtttcacaagttt

SEQ ID NO: 7019838 - DNA, 22 bp, Homo sapiens
aaataacagtcagggacaacat

SEQ ID NO: 7019839 - DNA, 18 bp, Homo sapiens
cctggacctgtctccttt

SEQ ID NO: 7019840 - DNA, 22 bp, Homo sapiens
tggcatgtccacttcaacagtt

SEQ ID NO: 7019841 - DNA, 22 bp, Homo sapiens
tagcactccattatgatgtggc

SEQ ID NO: 7019842 - DNA, 22 bp, Homo sapiens
tgctggagttcgacattgcaaa

SEQ ID NO: 7019843 - DNA, 22 bp, Homo sapiens
cacatttatctctctccggtga

SEQ ID NO: 7019844 - DNA, 22 bp, Homo sapiens
tggaacacattaaccacaggga

SEQ ID NO: 7019845 - DNA, 22 bp, Homo sapiens
aatgatggttaaacactggagg

SEQ ID NO: 7019846 - DNA, 22 bp, Homo sapiens
gtgcaaattccactggaaagct

SEQ ID NO: 7019847 - DNA, 22 bp, Homo sapiens
taaaggtctgaacacagtgagg

SEQ ID NO: 7019848 - DNA, 22 bp, Homo sapiens
agacctgggttcgagtcctaac

SEQ ID NO: 7019849 - DNA, 22 bp, Homo sapiens
aggtgacttaggctgtggctcg

SEQ ID NO: 7019850 - DNA, 22 bp, Homo sapiens
gaggcttgggacattagttgca

SEQ ID NO: 7019851 - DNA, 20 bp, Homo sapiens
tccactgccggaccggggtt

SEQ ID NO: 7019852 - DNA, 22 bp, Homo sapiens
gttcaaattgagatggtataaa

SEQ ID NO: 7019853 - DNA, 22 bp, Homo sapiens
gcataaactccaaaaggcaggg

SEQ ID NO: 7019854 - DNA, 23 bp, Homo sapiens
tcagagaataattctgatagact

SEQ ID NO: 7019855 - DNA, 22 bp, Homo sapiens
tctgtctttgagatctcagcct

SEQ ID NO: 7019856 - DNA, 22 bp, Homo sapiens
gcttcaagctgttcagaactat

SEQ ID NO: 7019857 - DNA, 22 bp, Homo sapiens
aagtaactaaagatatccattt

SEQ ID NO: 7019858 - DNA, 22 bp, Homo sapiens
caaggtaagcgagagatgaggt

SEQ ID NO: 7019859 - DNA, 22 bp, Homo sapiens
cagcatctccatggctttggag

SEQ ID NO: 7019860 - DNA, 19 bp, Homo sapiens
gtgaggatactgctcagag

SEQ ID NO: 7019861 - DNA, 22 bp, Homo sapiens
agcaggcacttcatagggttcc

SEQ ID NO: 7019862 - DNA, 22 bp, Homo sapiens
ggctttgcctgaataagcccac

SEQ ID NO: 7019863 - DNA, 22 bp, Homo sapiens
gcagatgggagccccaggggag

SEQ ID NO: 7019864 - DNA, 20 bp, Homo sapiens
cccaggggttgtggtgagga

SEQ ID NO: 7019865 - DNA, 22 bp, Homo sapiens
caccaggaccccacggtgggtt

SEQ ID NO: 7019866 - DNA, 18 bp, Homo sapiens
gcaggagatgggtggggt

SEQ ID NO: 7019867 - DNA, 22 bp, Homo sapiens
tctcagaaaaaggagaaactgg

SEQ ID NO: 7019868 - DNA, 22 bp, Homo sapiens
ttctaagaggctaatgaagaat

SEQ ID NO: 7019869 - DNA, 22 bp, Homo sapiens
tgcattcaatacagtaagaata

SEQ ID NO: 7019870 - DNA, 22 bp, Homo sapiens
gaaggctcctcaacctctcggg

SEQ ID NO: 7019871 - DNA, 22 bp, Homo sapiens
attgcctgttgaagattcgaca

SEQ ID NO: 7019872 - DNA, 22 bp, Homo sapiens
tcatctgtcccaggcttttttc

SEQ ID NO: 7019873 - DNA, 22 bp, Homo sapiens
aatggttaatatttgtaatatg

SEQ ID NO: 7019874 - DNA, 22 bp, Homo sapiens
agttgctatcgtgaagcacgtg

SEQ ID NO: 7019875 - DNA, 22 bp, Homo sapiens
atgggccttgacacatggagtg

SEQ ID NO: 7019876 - DNA, 22 bp, Homo sapiens
aacttgtttagaagaggttact

SEQ ID NO: 7019877 - DNA, 22 bp, Homo sapiens
aaatgcacagaggccagagagg

SEQ ID NO: 7019878 - DNA, 22 bp, Homo sapiens
tctctaattcaaccagacactt

SEQ ID NO: 7019879 - DNA, 22 bp, Homo sapiens
acagatgtaccttagtgatggg

SEQ ID NO: 7019880 - DNA, 22 bp, Homo sapiens
cactggcccattcctgtctggc

SEQ ID NO: 7019881 - DNA, 22 bp, Homo sapiens
ctttagtttgtaagagcaagag

SEQ ID NO: 7019882 - DNA, 22 bp, Homo sapiens
gtggaacagtattttaaaagct

SEQ ID NO: 7019883 - DNA, 22 bp, Homo sapiens
atgcaccccagaagctgcagtg

SEQ ID NO: 7019884 - DNA, 22 bp, Homo sapiens
tgctccgggaaagagcagccgc

SEQ ID NO: 7019885 - DNA, 22 bp, Homo sapiens
tctgagaaatcagtggtgaata

SEQ ID NO: 7019886 - DNA, 22 bp, Homo sapiens
gcatgctgcccagggactctct

SEQ ID NO: 7019887 - DNA, 22 bp, Homo sapiens
tggcttctccagaaatcttggt

SEQ ID NO: 7019888 - DNA, 19 bp, Homo sapiens
gagatactgaagtgaggaa

SEQ ID NO: 7019889 - DNA, 22 bp, Homo sapiens
ggctggttttcagttactgagt

SEQ ID NO: 7019890 - DNA, 22 bp, Homo sapiens
gtgcaattctagtgtccctaaa

SEQ ID NO: 7019891 - DNA, 22 bp, Homo sapiens
tcataaagcttgcctgcagtgt

SEQ ID NO: 7019892 - DNA, 19 bp, Homo sapiens
aagcgtttcccacttgctt

SEQ ID NO: 7019893 - DNA, 22 bp, Homo sapiens
cccgaatagctggaattacagg

SEQ ID NO: 7019894 - DNA, 22 bp, Homo sapiens
ctgttactgtatttaatcatct

SEQ ID NO: 7019895 - DNA, 22 bp, Homo sapiens
actgaagtctcttttgttctct

SEQ ID NO: 7019896 - DNA, 22 bp, Homo sapiens
aagcacacatctctggctgggt

SEQ ID NO: 7019897 - DNA, 22 bp, Homo sapiens
ccactcccttccggtccagggc

SEQ ID NO: 7019898 - DNA, 22 bp, Homo sapiens
gaggagaagctattggaaggac

SEQ ID NO: 7019899 - DNA, 22 bp, Homo sapiens
aaagcagaactgagagagctgg

SEQ ID NO: 7019900 - DNA, 22 bp, Homo sapiens
ggctgaggtgtggggaactata

SEQ ID NO: 7019901 - DNA, 22 bp, Homo sapiens
agagatttctactgcactcttt

SEQ ID NO: 7019902 - DNA, 22 bp, Homo sapiens
gtaacactagctctgtcacttt

SEQ ID NO: 7019903 - DNA, 22 bp, Homo sapiens
tctgcgccaccttgtgcttgtg

SEQ ID NO: 7019904 - DNA, 22 bp, Homo sapiens
tgtctcagttcccttctctgga

SEQ ID NO: 7019905 - DNA, 22 bp, Homo sapiens
gactcctgcctcctctgtttgc

SEQ ID NO: 7019906 - DNA, 22 bp, Homo sapiens
gagctgggctggcttcctccct

SEQ ID NO: 7019907 - DNA, 23 bp, Homo sapiens
agacatcaggatggtggctggga

SEQ ID NO: 7019908 - DNA, 22 bp, Homo sapiens
ccagtgattcattcatttacct

SEQ ID NO: 7019909 - DNA, 22 bp, Homo sapiens
caatacctgtggagctgagcct

SEQ ID NO: 7019910 - DNA, 22 bp, Homo sapiens
tgctgctcctgcctggctccca

SEQ ID NO: 7019911 - DNA, 22 bp, Homo sapiens
gatgaggaatgctcagctcaat

SEQ ID NO: 7019912 - DNA, 21 bp, Homo sapiens
cctctggcttgtgctgtgccc

SEQ ID NO: 7019913 - DNA, 22 bp, Homo sapiens
gccctccatgagacacagtgta

SEQ ID NO: 7019914 - DNA, 22 bp, Homo sapiens
cacagcagaaatatgaaggcag

SEQ ID NO: 7019915 - DNA, 22 bp, Homo sapiens
agtccttcttttagttgcttgg

SEQ ID NO: 7019916 - DNA, 18 bp, Homo sapiens
tgcagcaagtgctaaata

SEQ ID NO: 7019917 - DNA, 22 bp, Homo sapiens
tgtgaaagatactaggcagagg

SEQ ID NO: 7019918 - DNA, 22 bp, Homo sapiens
attaaaccccagttctcttact

SEQ ID NO: 7019919 - DNA, 22 bp, Homo sapiens
cagggagcaggctctgtccatc

SEQ ID NO: 7019920 - DNA, 20 bp, Homo sapiens
gcagtctattcctcccccta

SEQ ID NO: 7019921 - DNA, 22 bp, Homo sapiens
gcagggcatgggccctgtctgc

SEQ ID NO: 7019922 - DNA, 22 bp, Homo sapiens
cactatatgcctttgaaataca

SEQ ID NO: 7019923 - DNA, 22 bp, Homo sapiens
tagtggagtagaaaccaaagaa

SEQ ID NO: 7019924 - DNA, 22 bp, Homo sapiens
ttgctccaggctgcagactctg

SEQ ID NO: 7019925 - DNA, 22 bp, Homo sapiens
ccctggactgttcagggcctga

SEQ ID NO: 7019926 - DNA, 22 bp, Homo sapiens
catgagtgggcgccaggaagag

SEQ ID NO: 7019927 - DNA, 22 bp, Homo sapiens
caaaggcacacatacctttctg

SEQ ID NO: 7019928 - DNA, 22 bp, Homo sapiens
acagaggtaggacatgagatat

SEQ ID NO: 7019929 - DNA, 22 bp, Homo sapiens
aatgatgggaaggagaaaagca

SEQ ID NO: 7019930 - DNA, 22 bp, Homo sapiens
ccagccttctgggactctcatc

SEQ ID NO: 7019931 - DNA, 22 bp, Homo sapiens
attcagtggatatcttcacttt

SEQ ID NO: 7019932 - DNA, 22 bp, Homo sapiens
aatgctttttgcgaaatgtgca

SEQ ID NO: 7019933 - DNA, 21 bp, Homo sapiens
tggctgactcttcctatcatt

SEQ ID NO: 7019934 - DNA, 22 bp, Homo sapiens
gagctccaccaccttcaggcag

SEQ ID NO: 7019935 - DNA, 22 bp, Homo sapiens
ggtccagcacaacactggcatg

SEQ ID NO: 7019936 - DNA, 22 bp, Homo sapiens
acatgaaacccagccgtggtcc

SEQ ID NO: 7019937 - DNA, 22 bp, Homo sapiens
atcactgtggcccaaaacctca

SEQ ID NO: 7019938 - DNA, 22 bp, Homo sapiens
aaagagcttgcttgctttatat

SEQ ID NO: 7019939 - DNA, 22 bp, Homo sapiens
actcaggctgttttttccttgt

SEQ ID NO: 7019940 - DNA, 22 bp, Homo sapiens
ttggacagtaaattgtgcttaa

SEQ ID NO: 7019941 - DNA, 21 bp, Homo sapiens
aggtgggagaccatgtaggtc

SEQ ID NO: 7019942 - DNA, 22 bp, Homo sapiens
tagtatgttgtctgatgttacc

SEQ ID NO: 7019943 - DNA, 22 bp, Homo sapiens
tagctagaatgcttcgtgatat

SEQ ID NO: 7019944 - DNA, 22 bp, Homo sapiens
gatggcttcagtctccttgggt

SEQ ID NO: 7019945 - DNA, 22 bp, Homo sapiens
tgtgggaggaattagaatggga

SEQ ID NO: 7019946 - DNA, 22 bp, Homo sapiens
ttacatgactgcccttgtcagg

SEQ ID NO: 7019947 - DNA, 22 bp, Homo sapiens
gagtctttggtaaagtctgctg

SEQ ID NO: 7019948 - DNA, 22 bp, Homo sapiens
tagaagagacatagcctgtggt

SEQ ID NO: 7019949 - DNA, 22 bp, Homo sapiens
gccaggcagacaggtcatcagg

SEQ ID NO: 7019950 - DNA, 22 bp, Homo sapiens
cagtgatttcagaatggattat

SEQ ID NO: 7019951 - DNA, 22 bp, Homo sapiens
ttgcagggaaatcagtgaggat

SEQ ID NO: 7019952 - DNA, 22 bp, Homo sapiens
gtgcagaccttccagaaagaac

SEQ ID NO: 7019953 - DNA, 22 bp, Homo sapiens
caatgcattattctcccacttc

SEQ ID NO: 7019954 - DNA, 22 bp, Homo sapiens
agatacattgcacgatgcagat

SEQ ID NO: 7019955 - DNA, 18 bp, Homo sapiens
gatgaggctgtctgagaa

SEQ ID NO: 7019956 - DNA, 22 bp, Homo sapiens
ttttaatgggcgactattatgg

SEQ ID NO: 7019957 - DNA, 22 bp, Homo sapiens
gttgaggtgatgccagccctgc

SEQ ID NO: 7019958 - DNA, 22 bp, Homo sapiens
atggcattgctgtgctccactg

SEQ ID NO: 7019959 - DNA, 22 bp, Homo sapiens
tctgtcataagtgctgaagtat

SEQ ID NO: 7019960 - DNA, 22 bp, Homo sapiens
tccaggacagagtagaagcagc

SEQ ID NO: 7019961 - DNA, 22 bp, Homo sapiens
agaatgcaaatgatcccacaca

SEQ ID NO: 7019962 - DNA, 22 bp, Homo sapiens
ttgggcctcggccaaggacggg

SEQ ID NO: 7019963 - DNA, 22 bp, Homo sapiens
ggaaggctgttcactaacatgt

SEQ ID NO: 7019964 - DNA, 19 bp, Homo sapiens
atcaaagactgcaggattt

SEQ ID NO: 7019965 - DNA, 22 bp, Homo sapiens
tctcttattttgcctttgacaa

SEQ ID NO: 7019966 - DNA, 22 bp, Homo sapiens
tgacagatgaagctggggacca

SEQ ID NO: 7019967 - DNA, 22 bp, Homo sapiens
attcttttgtcctagcttgata

SEQ ID NO: 7019968 - DNA, 22 bp, Homo sapiens
aggttctccttatcaatgaaga

SEQ ID NO: 7019969 - DNA, 22 bp, Homo sapiens
gttaatacaaccatgatcttct

SEQ ID NO: 7019970 - DNA, 22 bp, Homo sapiens
atggaacagattaaagtgaggg

SEQ ID NO: 7019971 - DNA, 22 bp, Homo sapiens
tggtgagataactttcggcaag

SEQ ID NO: 7019972 - DNA, 22 bp, Homo sapiens
agcaagatttaaacccaggtca

SEQ ID NO: 7019973 - DNA, 22 bp, Homo sapiens
caacatctttgtgtatgtgaga

SEQ ID NO: 7019974 - DNA, 22 bp, Homo sapiens
ttctagggttgtagcccccagt

SEQ ID NO: 7019975 - DNA, 22 bp, Homo sapiens
acgtttgaagtacttcctttgg

SEQ ID NO: 7019976 - DNA, 22 bp, Homo sapiens
cagctctggctttggggagctt

SEQ ID NO: 7019977 - DNA, 22 bp, Homo sapiens
atttctactgtgagaaacatga

SEQ ID NO: 7019978 - DNA, 22 bp, Homo sapiens
gtagattccagtggtctgtgtc

SEQ ID NO: 7019979 - DNA, 22 bp, Homo sapiens
gctctttgtattttggaatcaa

SEQ ID NO: 7019980 - DNA, 22 bp, Homo sapiens
aagatgtttaggtaaaaagttt

SEQ ID NO: 7019981 - DNA, 22 bp, Homo sapiens
agagtttttcatttacccgttg

SEQ ID NO: 7019982 - DNA, 22 bp, Homo sapiens
acaggtgtcctcacagggggtg

SEQ ID NO: 7019983 - DNA, 19 bp, Homo sapiens
tgctaagtcctttagaggc

SEQ ID NO: 7019984 - DNA, 22 bp, Homo sapiens
atagtttacaaaaatgatgcat

SEQ ID NO: 7019985 - DNA, 22 bp, Homo sapiens
acctttggataatctttgtgtt

SEQ ID NO: 7019986 - DNA, 22 bp, Homo sapiens
actgcttttcagagtctgcctg

SEQ ID NO: 7019987 - DNA, 22 bp, Homo sapiens
gttgacagaattgtgtggctgg

SEQ ID NO: 7019988 - DNA, 22 bp, Homo sapiens
tctgagagcaggaggagctgct

SEQ ID NO: 7019989 - DNA, 22 bp, Homo sapiens
gtttcttttaaaatatgtagac

SEQ ID NO: 7019990 - DNA, 22 bp, Homo sapiens
ggcacactcacttctgccctga

SEQ ID NO: 7019991 - DNA, 22 bp, Homo sapiens
tctggtaacctttatccctcct

SEQ ID NO: 7019992 - DNA, 22 bp, Homo sapiens
tctaggagcatgaagggaaggc

SEQ ID NO: 7019993 - DNA, 22 bp, Homo sapiens
ccaaggcccctgtggtctagcc

SEQ ID NO: 7019994 - DNA, 19 bp, Homo sapiens
ttttctcgtgcttgtctgc

SEQ ID NO: 7019995 - DNA, 22 bp, Homo sapiens
aaactagattaccactgctaga

SEQ ID NO: 7019996 - DNA, 22 bp, Homo sapiens
tgcacacagttctcaggaaaga

SEQ ID NO: 7019997 - DNA, 21 bp, Homo sapiens
cggagctgggcagggcatccc

SEQ ID NO: 7019998 - DNA, 22 bp, Homo sapiens
ggatgacagcaagggggtgaag

SEQ ID NO: 7019999 - DNA, 22 bp, Homo sapiens
ccagccttctgagctgcctgga

SEQ ID NO: 7020000 - DNA, 22 bp, Homo sapiens
gctgtactatttgagactactg

SEQ ID NO: 7020001 - DNA, 22 bp, Homo sapiens
tgctctatatgtctgttttgag

SEQ ID NO: 7020002 - DNA, 22 bp, Homo sapiens
gaggtaacaactgaaatgagaa

SEQ ID NO: 7020003 - DNA, 22 bp, Homo sapiens
tgtacacaatgataaattatta

SEQ ID NO: 7020004 - DNA, 22 bp, Homo sapiens
cagatagtaacctttctagagc

SEQ ID NO: 7020005 - DNA, 22 bp, Homo sapiens
aggtggtctagcatcacggtga

SEQ ID NO: 7020006 - DNA, 22 bp, Homo sapiens
ccacatcatggatacagttatg

SEQ ID NO: 7020007 - DNA, 22 bp, Homo sapiens
atgtccagcatgacacattctc

SEQ ID NO: 7020008 - DNA, 22 bp, Homo sapiens
gagtggcaggcactgtgacgga

SEQ ID NO: 7020009 - DNA, 22 bp, Homo sapiens
agtgattagaaagtacacttgg

SEQ ID NO: 7020010 - DNA, 22 bp, Homo sapiens
tctgacttcttcatccttgcca

SEQ ID NO: 7020011 - DNA, 22 bp, Homo sapiens
tatgtacatcgttgaattcaaa

SEQ ID NO: 7020012 - DNA, 18 bp, Homo sapiens
atgtgcaattttgtattt

SEQ ID NO: 7020013 - DNA, 22 bp, Homo sapiens
acatgtgtggacatgaatctac

SEQ ID NO: 7020014 - DNA, 21 bp, Homo sapiens
tctctggttggagttgtgcca

SEQ ID NO: 7020015 - DNA, 22 bp, Homo sapiens
agagcctgctgtgtaagtcaca

SEQ ID NO: 7020016 - DNA, 20 bp, Homo sapiens
ctggaaaccctgctgatggt

SEQ ID NO: 7020017 - DNA, 19 bp, Homo sapiens
gcagctgcttgaaaagaaa

SEQ ID NO: 7020018 - DNA, 22 bp, Homo sapiens
cttcttgtcaatttgccattgt

SEQ ID NO: 7020019 - DNA, 22 bp, Homo sapiens
cagttgttcccagcaatgaaag

SEQ ID NO: 7020020 - DNA, 22 bp, Homo sapiens
gggagcacacagaggtgccctt

SEQ ID NO: 7020021 - DNA, 22 bp, Homo sapiens
gagtgattggagttagcattct

SEQ ID NO: 7020022 - DNA, 22 bp, Homo sapiens
cacagggaacaactagaacaaa

SEQ ID NO: 7020023 - DNA, 22 bp, Homo sapiens
cagtcttatcctgaaaacaaca

SEQ ID NO: 7020024 - DNA, 22 bp, Homo sapiens
tcacatttcaagtgctcaaaag

SEQ ID NO: 7020025 - DNA, 22 bp, Homo sapiens
ctgtcacctctgccctttgccc

SEQ ID NO: 7020026 - DNA, 22 bp, Homo sapiens
actttcaaaagagaagtcatga

SEQ ID NO: 7020027 - DNA, 22 bp, Homo sapiens
gcagggcagccacaggccccct

SEQ ID NO: 7020028 - DNA, 22 bp, Homo sapiens
tcagtgtttgaacccagggtta

SEQ ID NO: 7020029 - DNA, 22 bp, Homo sapiens
gtagaagagattttattcctta

SEQ ID NO: 7020030 - DNA, 22 bp, Homo sapiens
gccaggaagtcagccaagccca

SEQ ID NO: 7020031 - DNA, 22 bp, Homo sapiens
aagtcacagaacccattgtaac

SEQ ID NO: 7020032 - DNA, 22 bp, Homo sapiens
ggccttccattgctcttttcta

SEQ ID NO: 7020033 - DNA, 19 bp, Homo sapiens
tggctaattttatagaggc

SEQ ID NO: 7020034 - DNA, 21 bp, Homo sapiens
tgcagttcaagtcaatctact

SEQ ID NO: 7020035 - DNA, 17 bp, Homo sapiens
tctgagaacttgaagca

SEQ ID NO: 7020036 - DNA, 22 bp, Homo sapiens
tccagaatatttgggaaagatg

SEQ ID NO: 7020037 - DNA, 22 bp, Homo sapiens
atcccatttcctgttttgtcaa

SEQ ID NO: 7020038 - DNA, 22 bp, Homo sapiens
agagtggcccgttggcctgaac

SEQ ID NO: 7020039 - DNA, 20 bp, Homo sapiens
tataacagtgttgggtgtgt

SEQ ID NO: 7020040 - DNA, 22 bp, Homo sapiens
tccatgtgaccttgagctgctt

SEQ ID NO: 7020041 - DNA, 22 bp, Homo sapiens
atttccttcggacagtttgggt

SEQ ID NO: 7020042 - DNA, 22 bp, Homo sapiens
agtagtcacttcacccatccca

SEQ ID NO: 7020043 - DNA, 21 bp, Homo sapiens
tccctcagaaggtagccaagc

SEQ ID NO: 7020044 - DNA, 22 bp, Homo sapiens
agcccccagtctaaactgttgg

SEQ ID NO: 7020045 - DNA, 22 bp, Homo sapiens
accagttctttctctgtttctg

SEQ ID NO: 7020046 - DNA, 22 bp, Homo sapiens
attccaggttgtagaaaagttt

SEQ ID NO: 7020047 - DNA, 22 bp, Homo sapiens
ttctgggcaccaccacagactt

SEQ ID NO: 7020048 - DNA, 22 bp, Homo sapiens
tccagcttcagctcttggatag

SEQ ID NO: 7020049 - DNA, 22 bp, Homo sapiens
tctgaaagatgagtggtccatt

SEQ ID NO: 7020050 - DNA, 22 bp, Homo sapiens
tagctttgcccgtgctggattt

SEQ ID NO: 7020051 - DNA, 22 bp, Homo sapiens
gaaagtgccagaataggaggcc

SEQ ID NO: 7020052 - DNA, 22 bp, Homo sapiens
ttgttaaatggatgcagaataa

SEQ ID NO: 7020053 - DNA, 16 bp, Homo sapiens
cgtttccatcctttgt

SEQ ID NO: 7020054 - DNA, 22 bp, Homo sapiens
acagaccaaaaaaggatattgg

SEQ ID NO: 7020055 - DNA, 22 bp, Homo sapiens
aatgtgaaaccgcacagaataa

SEQ ID NO: 7020056 - DNA, 23 bp, Homo sapiens
aagttgtttttggccagggaaag

SEQ ID NO: 7020057 - DNA, 21 bp, Homo sapiens
gactggataatgtataaacag

SEQ ID NO: 7020058 - DNA, 22 bp, Homo sapiens
tgggagctctgagcctgctgtg

SEQ ID NO: 7020059 - DNA, 21 bp, Homo sapiens
cagacatgagtctcagctttg

SEQ ID NO: 7020060 - DNA, 22 bp, Homo sapiens
tggtgcaggagttggcagggac

SEQ ID NO: 7020061 - DNA, 22 bp, Homo sapiens
atgacaggtgattttatgcttt

SEQ ID NO: 7020062 - DNA, 22 bp, Homo sapiens
gctctgactgagcttcctgcct

SEQ ID NO: 7020063 - DNA, 22 bp, Homo sapiens
cctgggcttggttgttgagaac

SEQ ID NO: 7020064 - DNA, 22 bp, Homo sapiens
gggatggggagctggaaagggg

SEQ ID NO: 7020065 - DNA, 22 bp, Homo sapiens
cagcaggacatggaggagtaaa

SEQ ID NO: 7020066 - DNA, 22 bp, Homo sapiens
gaggctcacctagggagcactg

SEQ ID NO: 7020067 - DNA, 22 bp, Homo sapiens
tggtgtcaggcactagcatgca

SEQ ID NO: 7020068 - DNA, 22 bp, Homo sapiens
ttgcccaccttagtcttcagac

SEQ ID NO: 7020069 - DNA, 22 bp, Homo sapiens
atgccaggccccacgctgggca

SEQ ID NO: 7020070 - DNA, 22 bp, Homo sapiens
agacacagcaataactactgtt

SEQ ID NO: 7020071 - DNA, 19 bp, Homo sapiens
gctcctgggcctcactcat

SEQ ID NO: 7020072 - DNA, 22 bp, Homo sapiens
tgtctgtggcaattgtgggtaa

SEQ ID NO: 7020073 - DNA, 22 bp, Homo sapiens
tcagtaaacaggtttaagtcct

SEQ ID NO: 7020074 - DNA, 15 bp, Homo sapiens
tctgggctgtgagca

SEQ ID NO: 7020075 - DNA, 22 bp, Homo sapiens
tgagtatattttccctgggtgg

SEQ ID NO: 7020076 - DNA, 23 bp, Homo sapiens
caagctgcagtttggttggtggg

SEQ ID NO: 7020077 - DNA, 22 bp, Homo sapiens
ttagcagttcattgattatcgt

SEQ ID NO: 7020078 - DNA, 22 bp, Homo sapiens
ttcactgaattaaaaagagtat

SEQ ID NO: 7020079 - DNA, 22 bp, Homo sapiens
agtcaacagcattatggatgaa

SEQ ID NO: 7020080 - DNA, 22 bp, Homo sapiens
agcaagaatatttctgccactg

SEQ ID NO: 7020081 - DNA, 22 bp, Homo sapiens
gccaagagtttccagctgcaag

SEQ ID NO: 7020082 - DNA, 22 bp, Homo sapiens
atcaatagtctggaaagttctg

SEQ ID NO: 7020083 - DNA, 22 bp, Homo sapiens
gtgactgtgaactgtttctgat

SEQ ID NO: 7020084 - DNA, 21 bp, Homo sapiens
ttgttcttccagaagcaaagt

SEQ ID NO: 7020085 - DNA, 21 bp, Homo sapiens
tgaggctctgttgtgcctgca

SEQ ID NO: 7020086 - DNA, 18 bp, Homo sapiens
aggaagcaggaggaaggc

SEQ ID NO: 7020087 - DNA, 22 bp, Homo sapiens
caaggacaacttcatattgtgg

SEQ ID NO: 7020088 - DNA, 22 bp, Homo sapiens
tgtaaagagaatggtatatgga

SEQ ID NO: 7020089 - DNA, 22 bp, Homo sapiens
tgtggagcccccaggagtgggg

SEQ ID NO: 7020090 - DNA, 22 bp, Homo sapiens
tgggccagatccatggcaataa

SEQ ID NO: 7020091 - DNA, 22 bp, Homo sapiens
ccatggcaatggtcagtctatt

SEQ ID NO: 7020092 - DNA, 16 bp, Homo sapiens
cttggtgttggcagag

SEQ ID NO: 7020093 - DNA, 22 bp, Homo sapiens
caatgatttttccattgcagga

SEQ ID NO: 7020094 - DNA, 22 bp, Homo sapiens
tcatggggccacagctgccagc

SEQ ID NO: 7020095 - DNA, 18 bp, Homo sapiens
atgtacatgtactcacac

SEQ ID NO: 7020096 - DNA, 22 bp, Homo sapiens
aaggaggacacccaggactggg

SEQ ID NO: 7020097 - DNA, 22 bp, Homo sapiens
gtccagagagtaaagggggtaa

SEQ ID NO: 7020098 - DNA, 22 bp, Homo sapiens
ccacagctctagctccctccca

SEQ ID NO: 7020099 - DNA, 21 bp, Homo sapiens
aatcaagagtactggtgtggc

SEQ ID NO: 7020100 - DNA, 22 bp, Homo sapiens
gtttatcacaataaataattct

SEQ ID NO: 7020101 - DNA, 22 bp, Homo sapiens
taggaatgaaaatggccataga

SEQ ID NO: 7020102 - DNA, 19 bp, Homo sapiens
tttctctgtgcaccttttc

SEQ ID NO: 7020103 - DNA, 22 bp, Homo sapiens
aacatttgtgaagtacttagat

SEQ ID NO: 7020104 - DNA, 18 bp, Homo sapiens
agagacagcagcaaaaga

SEQ ID NO: 7020105 - DNA, 22 bp, Homo sapiens
gactcgttcatagttccaattt

SEQ ID NO: 7020106 - DNA, 22 bp, Homo sapiens
ccacctcctaggcctggagaag

SEQ ID NO: 7020107 - DNA, 22 bp, Homo sapiens
ttcagataatgacaggtcagga

SEQ ID NO: 7020108 - DNA, 22 bp, Homo sapiens
ttggagggacagatggctaggc

SEQ ID NO: 7020109 - DNA, 22 bp, Homo sapiens
cttgtccgaggagacgcggaag

SEQ ID NO: 7020110 - DNA, 22 bp, Homo sapiens
cagggtttcaccatgttagcag

SEQ ID NO: 7020111 - DNA, 22 bp, Homo sapiens
actgtgatgcagttgccatcca

SEQ ID NO: 7020112 - DNA, 22 bp, Homo sapiens
cttgaaatgacaggagcacatc

SEQ ID NO: 7020113 - DNA, 20 bp, Homo sapiens
tcagaagtgcagctgcccct

SEQ ID NO: 7020114 - DNA, 22 bp, Homo sapiens
cagatgtagtagctttattgca

SEQ ID NO: 7020115 - DNA, 22 bp, Homo sapiens
gtgctgagtgcagagtgcagag

SEQ ID NO: 7020116 - DNA, 22 bp, Homo sapiens
aatacataataagttttgtctg

SEQ ID NO: 7020117 - DNA, 22 bp, Homo sapiens
cttgtacaggaatccatggtat

SEQ ID NO: 7020118 - DNA, 22 bp, Homo sapiens
gaaattgtcagtgatatgatac

SEQ ID NO: 7020119 - DNA, 22 bp, Homo sapiens
tgtcagacctgtgatttcagca

SEQ ID NO: 7020120 - DNA, 22 bp, Homo sapiens
gccaatcagcgctcagacgacc

SEQ ID NO: 7020121 - DNA, 22 bp, Homo sapiens
ctggccataggttctcagtgtg

SEQ ID NO: 7020122 - DNA, 22 bp, Homo sapiens
caggttggagatctgtctatgg

SEQ ID NO: 7020123 - DNA, 22 bp, Homo sapiens
agttagaatagtcagattgtag

SEQ ID NO: 7020124 - DNA, 22 bp, Homo sapiens
atcactgatacctttattttca

SEQ ID NO: 7020125 - DNA, 22 bp, Homo sapiens
ttacaaagagtgttcttttcca

SEQ ID NO: 7020126 - DNA, 21 bp, Homo sapiens
tttgactcctcatttttatat

SEQ ID NO: 7020127 - DNA, 22 bp, Homo sapiens
gtcattttctagaattatttga

SEQ ID NO: 7020128 - DNA, 23 bp, Homo sapiens
acatgcaaaaatcacagtctcct

SEQ ID NO: 7020129 - DNA, 20 bp, Homo sapiens
agaggccagttaggagtcta

SEQ ID NO: 7020130 - DNA, 23 bp, Homo sapiens
ttagagatgattaaaaaatcttg

SEQ ID NO: 7020131 - DNA, 22 bp, Homo sapiens
cagtttcttctattttgaacta

SEQ ID NO: 7020132 - DNA, 22 bp, Homo sapiens
cacccctacctgagtcaggagt

SEQ ID NO: 7020133 - DNA, 22 bp, Homo sapiens
ttttcctatatgcaaagaatgc

SEQ ID NO: 7020134 - DNA, 23 bp, Homo sapiens
tctctgcatgtcctgagcacatc

SEQ ID NO: 7020135 - DNA, 22 bp, Homo sapiens
agtgactttagttgaatcttgt

SEQ ID NO: 7020136 - DNA, 22 bp, Homo sapiens
attagatcagatcggcagtaat

SEQ ID NO: 7020137 - DNA, 16 bp, Homo sapiens
gcctgggagggaacag

SEQ ID NO: 7020138 - DNA, 22 bp, Homo sapiens
gagcaacacattgaatgaggat

SEQ ID NO: 7020139 - DNA, 22 bp, Homo sapiens
caggcagatgctgacaagagtt

SEQ ID NO: 7020140 - DNA, 22 bp, Homo sapiens
tatttcactattctctgtaact

SEQ ID NO: 7020141 - DNA, 22 bp, Homo sapiens
gtccatatgtcaggtgtgaatt

SEQ ID NO: 7020142 - DNA, 23 bp, Homo sapiens
tcatttggacaaggcacagcaga

SEQ ID NO: 7020143 - DNA, 22 bp, Homo sapiens
tctggctcagggctctgaggga

SEQ ID NO: 7020144 - DNA, 22 bp, Homo sapiens
cccaggagacatatagaaggac

SEQ ID NO: 7020145 - DNA, 23 bp, Homo sapiens
tgcttattcaaaaggtgctttca

SEQ ID NO: 7020146 - DNA, 22 bp, Homo sapiens
ttactgcacgtgggacatatat

SEQ ID NO: 7020147 - DNA, 18 bp, Homo sapiens
agcaagacagtggtgtga

SEQ ID NO: 7020148 - DNA, 22 bp, Homo sapiens
tggtcagaaggaagggctccta

SEQ ID NO: 7020149 - DNA, 22 bp, Homo sapiens
aagaactatctctggctgtagg

SEQ ID NO: 7020150 - DNA, 22 bp, Homo sapiens
tctgcaggcttggagtggcagc

SEQ ID NO: 7020151 - DNA, 22 bp, Homo sapiens
agacctctgctcccttcatggt

SEQ ID NO: 7020152 - DNA, 19 bp, Homo sapiens
tttctaagctaaatgcttc

SEQ ID NO: 7020153 - DNA, 20 bp, Homo sapiens
ttccaaggtctatgcttctt

SEQ ID NO: 7020154 - DNA, 23 bp, Homo sapiens
ctcaaccctagtaagggagtagg

SEQ ID NO: 7020155 - DNA, 22 bp, Homo sapiens
catatcataggtcttggataat

SEQ ID NO: 7020156 - DNA, 18 bp, Homo sapiens
cctaagctccagccccag

SEQ ID NO: 7020157 - DNA, 22 bp, Homo sapiens
tgctaactgtgagtacttcagg

SEQ ID NO: 7020158 - DNA, 22 bp, Homo sapiens
gaattcttctgtctttaactga

SEQ ID NO: 7020159 - DNA, 20 bp, Homo sapiens
gcatgtcagaaatcaatggg

SEQ ID NO: 7020160 - DNA, 22 bp, Homo sapiens
gctgggcaatgccagagaggag

SEQ ID NO: 7020161 - DNA, 22 bp, Homo sapiens
cccaggaaatagccaggaggtg

SEQ ID NO: 7020162 - DNA, 22 bp, Homo sapiens
aagctggaacatcttgaggaag

SEQ ID NO: 7020163 - DNA, 22 bp, Homo sapiens
ttattgctggcaccttcaattc

SEQ ID NO: 7020164 - DNA, 22 bp, Homo sapiens
tgggcagcttccacttagttag

SEQ ID NO: 7020165 - DNA, 22 bp, Homo sapiens
tcagggctggcttttgcagagc

SEQ ID NO: 7020166 - DNA, 22 bp, Homo sapiens
agttgggattcttggttctggg

SEQ ID NO: 7020167 - DNA, 19 bp, Homo sapiens
tctgccgagctagaccact

SEQ ID NO: 7020168 - DNA, 22 bp, Homo sapiens
tatcaatacatgttatcagtgt

SEQ ID NO: 7020169 - DNA, 22 bp, Homo sapiens
cagatccttaggacaaccatcc

SEQ ID NO: 7020170 - DNA, 23 bp, Homo sapiens
ttgaggagcagcgctttttaccg

SEQ ID NO: 7020171 - DNA, 22 bp, Homo sapiens
acagtgtagcatggtagcaatg

SEQ ID NO: 7020172 - DNA, 22 bp, Homo sapiens
aaagttgagtgctgatctgatt

SEQ ID NO: 7020173 - DNA, 22 bp, Homo sapiens
cacttaaaactcctggaattgt

SEQ ID NO: 7020174 - DNA, 22 bp, Homo sapiens
aatgtacagctgctgctgaagg

SEQ ID NO: 7020175 - DNA, 22 bp, Homo sapiens
gtggcttggaccagtcacagtg

SEQ ID NO: 7020176 - DNA, 22 bp, Homo sapiens
cagccaggttcaagtccttata

SEQ ID NO: 7020177 - DNA, 22 bp, Homo sapiens
caggtaggttttaggctaaaca

SEQ ID NO: 7020178 - DNA, 22 bp, Homo sapiens
ctgctcaattccggcacgctgg

SEQ ID NO: 7020179 - DNA, 22 bp, Homo sapiens
agctctttggaaggtgtgcact

SEQ ID NO: 7020180 - DNA, 22 bp, Homo sapiens
aaagtcaaaatgctctcctgtc

SEQ ID NO: 7020181 - DNA, 22 bp, Homo sapiens
ccattagtacctctggaaaatt

SEQ ID NO: 7020182 - DNA, 20 bp, Homo sapiens
caccaagctaaggttacttt

SEQ ID NO: 7020183 - DNA, 22 bp, Homo sapiens
gaatgagttaatatttgcttgg

SEQ ID NO: 7020184 - DNA, 22 bp, Homo sapiens
attataggcttgagccaccgtg

SEQ ID NO: 7020185 - DNA, 22 bp, Homo sapiens
agagctgtgctttgcaccacgt

SEQ ID NO: 7020186 - DNA, 21 bp, Homo sapiens
attccagtataagcctctttg

SEQ ID NO: 7020187 - DNA, 22 bp, Homo sapiens
atggacagctgacactcacatt

SEQ ID NO: 7020188 - DNA, 19 bp, Homo sapiens
tgacatagcaagacaaaac

SEQ ID NO: 7020189 - DNA, 22 bp, Homo sapiens
gtgggcttctgttagggaggct

SEQ ID NO: 7020190 - DNA, 22 bp, Homo sapiens
atttcagattcgagaggaagtg

SEQ ID NO: 7020191 - DNA, 22 bp, Homo sapiens
tcaagatatagagggttctaga

SEQ ID NO: 7020192 - DNA, 22 bp, Homo sapiens
ttcattttataaaccctgctga

SEQ ID NO: 7020193 - DNA, 22 bp, Homo sapiens
agggctgacagtaaaagtatga

SEQ ID NO: 7020194 - DNA, 22 bp, Homo sapiens
tcttaactatcatttgaacacc

SEQ ID NO: 7020195 - DNA, 22 bp, Homo sapiens
cttgtcaggtaggtgtcatttc

SEQ ID NO: 7020196 - DNA, 22 bp, Homo sapiens
tctggctcctgagtccatgctc

SEQ ID NO: 7020197 - DNA, 20 bp, Homo sapiens
acagatggcagttattacat

SEQ ID NO: 7020198 - DNA, 22 bp, Homo sapiens
atgcacacaagcttatgtatta

SEQ ID NO: 7020199 - DNA, 22 bp, Homo sapiens
ggacaaaggtctggggaacctg

SEQ ID NO: 7020200 - DNA, 22 bp, Homo sapiens
gtaaagcaaaatgtagagattg

SEQ ID NO: 7020201 - DNA, 22 bp, Homo sapiens
tcccaagtgtcttggaccaggg

SEQ ID NO: 7020202 - DNA, 22 bp, Homo sapiens
ttactgtagcttgacatatgtc

SEQ ID NO: 7020203 - DNA, 22 bp, Homo sapiens
actgtcttcatatctgtgtctc

SEQ ID NO: 7020204 - DNA, 22 bp, Homo sapiens
tgctggctgggctgctggagac

SEQ ID NO: 7020205 - DNA, 22 bp, Homo sapiens
tgagaagtactacaagagaggg

SEQ ID NO: 7020206 - DNA, 22 bp, Homo sapiens
tcttcagttgtaaaagtgttgg

SEQ ID NO: 7020207 - DNA, 22 bp, Homo sapiens
ttaggaagcacacagtaaatat

SEQ ID NO: 7020208 - DNA, 22 bp, Homo sapiens
tatttggtggctgattatcttt

SEQ ID NO: 7020209 - DNA, 22 bp, Homo sapiens
tctataatggaaagtggatgtg

SEQ ID NO: 7020210 - DNA, 22 bp, Homo sapiens
tttaaacaaataggattgccta

SEQ ID NO: 7020211 - DNA, 22 bp, Homo sapiens
tgggatagtggccaggaccccc

SEQ ID NO: 7020212 - DNA, 23 bp, Homo sapiens
caaattctaggcaggctcttttg

SEQ ID NO: 7020213 - DNA, 22 bp, Homo sapiens
tgcaaatcataaacaatagtgt

SEQ ID NO: 7020214 - DNA, 22 bp, Homo sapiens
ctggctctgactccgcatattt

SEQ ID NO: 7020215 - DNA, 22 bp, Homo sapiens
tgtcatggagcttatattccag

SEQ ID NO: 7020216 - DNA, 22 bp, Homo sapiens
ggcctctcgaagcttcagtcca

SEQ ID NO: 7020217 - DNA, 22 bp, Homo sapiens
tctgatgtcccacatcctacag

SEQ ID NO: 7020218 - DNA, 16 bp, Homo sapiens
tatgtgtctcatctac

SEQ ID NO: 7020219 - DNA, 22 bp, Homo sapiens
tccacatgacttctaataactg

SEQ ID NO: 7020220 - DNA, 22 bp, Homo sapiens
ttccagaggcttgaggaaaatt

SEQ ID NO: 7020221 - DNA, 22 bp, Homo sapiens
atcagagaagtttcactggcat

SEQ ID NO: 7020222 - DNA, 22 bp, Homo sapiens
tggcatttgggctggcttttct

SEQ ID NO: 7020223 - DNA, 22 bp, Homo sapiens
ctaagaaggaggaaaagtgcca

SEQ ID NO: 7020224 - DNA, 23 bp, Homo sapiens
aggttacagttgttaagttgcaa

SEQ ID NO: 7020225 - DNA, 22 bp, Homo sapiens
tcctcactgcagtgctccgagc

SEQ ID NO: 7020226 - DNA, 22 bp, Homo sapiens
cagagttttatcatacgtggat

SEQ ID NO: 7020227 - DNA, 22 bp, Homo sapiens
ctgggtgaatttgaaggaaagg

SEQ ID NO: 7020228 - DNA, 19 bp, Homo sapiens
cagcccagggtgctaccaa

SEQ ID NO: 7020229 - DNA, 19 bp, Homo sapiens
caaccatgaactgtggtgt

SEQ ID NO: 7020230 - DNA, 22 bp, Homo sapiens
cagaataccctatagacagaat

SEQ ID NO: 7020231 - DNA, 22 bp, Homo sapiens
tatgcttttaacctgtaactga

SEQ ID NO: 7020232 - DNA, 22 bp, Homo sapiens
tggtccttcgtggtgcagttct

SEQ ID NO: 7020233 - DNA, 22 bp, Homo sapiens
agatggagtctcactcttgttg

SEQ ID NO: 7020234 - DNA, 19 bp, Homo sapiens
gagctgccttttgaagacc

SEQ ID NO: 7020235 - DNA, 22 bp, Homo sapiens
tagcacagtgttcacaacagtg

SEQ ID NO: 7020236 - DNA, 22 bp, Homo sapiens
tgatttttagctattctgaaga

SEQ ID NO: 7020237 - DNA, 21 bp, Homo sapiens
agtctggggaagggatcccag

SEQ ID NO: 7020238 - DNA, 22 bp, Homo sapiens
aggagctggagtccaggcaagt

SEQ ID NO: 7020239 - DNA, 22 bp, Homo sapiens
tcagaacattctcattgactgc

SEQ ID NO: 7020240 - DNA, 22 bp, Homo sapiens
ctgtgtgcagggcacaatggaa

SEQ ID NO: 7020241 - DNA, 22 bp, Homo sapiens
tgacaagtttcctggtgatttt

SEQ ID NO: 7020242 - DNA, 22 bp, Homo sapiens
tcatgaggatgactgacccctt

SEQ ID NO: 7020243 - DNA, 21 bp, Homo sapiens
caaagccaggcaactctctcc

SEQ ID NO: 7020244 - DNA, 21 bp, Homo sapiens
gatgcacaatgggtaagtaca

SEQ ID NO: 7020245 - DNA, 22 bp, Homo sapiens
ttgtatcagttagctattgctg

SEQ ID NO: 7020246 - DNA, 22 bp, Homo sapiens
aaatgagtagcgatgcacatta

SEQ ID NO: 7020247 - DNA, 22 bp, Homo sapiens
agaatgcattttgtgtagctat

SEQ ID NO: 7020248 - DNA, 22 bp, Homo sapiens
ttaggaaggccttgaatgccag

SEQ ID NO: 7020249 - DNA, 22 bp, Homo sapiens
agtccaggactgtttcagctga

SEQ ID NO: 7020250 - DNA, 22 bp, Homo sapiens
agtgcaaagctgctgctgtggt

SEQ ID NO: 7020251 - DNA, 22 bp, Homo sapiens
gactgtctcctgtcatgaggga

SEQ ID NO: 7020252 - DNA, 19 bp, Homo sapiens
cattcctttgtctgccaaa

SEQ ID NO: 7020253 - DNA, 22 bp, Homo sapiens
cagtgctgagagcctggccagg

SEQ ID NO: 7020254 - DNA, 22 bp, Homo sapiens
tgcacagttggctacatcgtgg

SEQ ID NO: 7020255 - DNA, 22 bp, Homo sapiens
cagttacatgctcatgtcatca

SEQ ID NO: 7020256 - DNA, 22 bp, Homo sapiens
ttagacaatctgttggtaaggt

SEQ ID NO: 7020257 - DNA, 22 bp, Homo sapiens
gcagggtgccgacttcagggat

SEQ ID NO: 7020258 - DNA, 22 bp, Homo sapiens
atcctcgtctgcacatcaaagg

SEQ ID NO: 7020259 - DNA, 20 bp, Homo sapiens
caataatttacttccctatt

SEQ ID NO: 7020260 - DNA, 22 bp, Homo sapiens
gtgcaaaagtaattacagtttt

SEQ ID NO: 7020261 - DNA, 22 bp, Homo sapiens
gcctgtgcatagcagcggactc

SEQ ID NO: 7020262 - DNA, 22 bp, Homo sapiens
agtgtgtagcaatatgctggca

SEQ ID NO: 7020263 - DNA, 22 bp, Homo sapiens
agtgtatgagtttcagttcttc

SEQ ID NO: 7020264 - DNA, 22 bp, Homo sapiens
tggctacaaggtggctattcta

SEQ ID NO: 7020265 - DNA, 22 bp, Homo sapiens
aaggacctatattgtcagagga

SEQ ID NO: 7020266 - DNA, 22 bp, Homo sapiens
cctgggcaggccggacgctggg

SEQ ID NO: 7020267 - DNA, 19 bp, Homo sapiens
agggtttcttgactttgct

SEQ ID NO: 7020268 - DNA, 22 bp, Homo sapiens
ggcgccagcccaggccgtcgtg

SEQ ID NO: 7020269 - DNA, 22 bp, Homo sapiens
tggctgccagctcctcgccttg

SEQ ID NO: 7020270 - DNA, 22 bp, Homo sapiens
ggtgtcctgtcagctagagtga

SEQ ID NO: 7020271 - DNA, 20 bp, Homo sapiens
acttgctgggctttgttacc

SEQ ID NO: 7020272 - DNA, 22 bp, Homo sapiens
tttaaattctgtctgccgctta

SEQ ID NO: 7020273 - DNA, 22 bp, Homo sapiens
gaggttcaggaaatgggcaaag

SEQ ID NO: 7020274 - DNA, 22 bp, Homo sapiens
tccttcctgctctaacattcag

SEQ ID NO: 7020275 - DNA, 22 bp, Homo sapiens
ataacagaataagtcattaccg

SEQ ID NO: 7020276 - DNA, 19 bp, Homo sapiens
ggagccagctgtggaaggc

SEQ ID NO: 7020277 - DNA, 22 bp, Homo sapiens
ttctggtatgggaaatttcaag

SEQ ID NO: 7020278 - DNA, 22 bp, Homo sapiens
tgtgaaaggggtcacagggaaa

SEQ ID NO: 7020279 - DNA, 22 bp, Homo sapiens
tgggagagaataatcaataggt

SEQ ID NO: 7020280 - DNA, 17 bp, Homo sapiens
aggagggaaatagcttg

SEQ ID NO: 7020281 - DNA, 18 bp, Homo sapiens
cctggagctccacagcaa

SEQ ID NO: 7020282 - DNA, 22 bp, Homo sapiens
atagctaccatgttggacagta

SEQ ID NO: 7020283 - DNA, 22 bp, Homo sapiens
agaagtcatttatgttagatga

SEQ ID NO: 7020284 - DNA, 22 bp, Homo sapiens
agggaagggcagggtctatgca

SEQ ID NO: 7020285 - DNA, 19 bp, Homo sapiens
gtcaccatttccaaatgcc

SEQ ID NO: 7020286 - DNA, 21 bp, Homo sapiens
aagtaacaccactcctggagt

SEQ ID NO: 7020287 - DNA, 22 bp, Homo sapiens
ctgtgactgcagcaccaagtaa

SEQ ID NO: 7020288 - DNA, 20 bp, Homo sapiens
tcctgtggacattgctggcc

SEQ ID NO: 7020289 - DNA, 22 bp, Homo sapiens
aactcttcttataatgcgtgat

SEQ ID NO: 7020290 - DNA, 23 bp, Homo sapiens
agatcacatagttatcagatgac

SEQ ID NO: 7020291 - DNA, 22 bp, Homo sapiens
tacacaaaggcactctgttgtt

SEQ ID NO: 7020292 - DNA, 22 bp, Homo sapiens
tccaaatatcttggtggttagg

SEQ ID NO: 7020293 - DNA, 21 bp, Homo sapiens
ggtgattttagagaattgctg

SEQ ID NO: 7020294 - DNA, 22 bp, Homo sapiens
ttttttgttgggtagaacggaa

SEQ ID NO: 7020295 - DNA, 18 bp, Homo sapiens
agcctctggcagagagaa

SEQ ID NO: 7020296 - DNA, 22 bp, Homo sapiens
aggcaactgagaggcccgtgtt

SEQ ID NO: 7020297 - DNA, 22 bp, Homo sapiens
ataacagtgacctctcagcacc

SEQ ID NO: 7020298 - DNA, 22 bp, Homo sapiens
caggagggcccgagactcttcc

SEQ ID NO: 7020299 - DNA, 22 bp, Homo sapiens
tgctgggcccccagtgaccttc

SEQ ID NO: 7020300 - DNA, 22 bp, Homo sapiens
taagaatattgggaatggatgg

SEQ ID NO: 7020301 - DNA, 22 bp, Homo sapiens
ctctagtagctgagattacagg

SEQ ID NO: 7020302 - DNA, 22 bp, Homo sapiens
tgtggacagctcttcccatatg

SEQ ID NO: 7020303 - DNA, 22 bp, Homo sapiens
cacatgaccactctttacttct

SEQ ID NO: 7020304 - DNA, 22 bp, Homo sapiens
agattcctagtgttatttctgt

SEQ ID NO: 7020305 - DNA, 22 bp, Homo sapiens
tcagaggttccggccataacca

SEQ ID NO: 7020306 - DNA, 20 bp, Homo sapiens
acatttgagtatcatctact

SEQ ID NO: 7020307 - DNA, 22 bp, Homo sapiens
agattagcctaaaaatgtatag

SEQ ID NO: 7020308 - DNA, 22 bp, Homo sapiens
tatgcagcatgagatcatcata

SEQ ID NO: 7020309 - DNA, 22 bp, Homo sapiens
gtgtggaaagagtggcctctca

SEQ ID NO: 7020310 - DNA, 19 bp, Homo sapiens
gtgcattccaaagcaccat

SEQ ID NO: 7020311 - DNA, 22 bp, Homo sapiens
ctgcagcagggcttgcccacct

SEQ ID NO: 7020312 - DNA, 22 bp, Homo sapiens
tagaaagcgttaaatctacaga

SEQ ID NO: 7020313 - DNA, 22 bp, Homo sapiens
gccagagccacttttgggtgat

SEQ ID NO: 7020314 - DNA, 22 bp, Homo sapiens
ccaggtgtctgtctctttttca

SEQ ID NO: 7020315 - DNA, 22 bp, Homo sapiens
gactgagggacagggcagtgga

SEQ ID NO: 7020316 - DNA, 22 bp, Homo sapiens
aagttgctaaaggagttctttg

SEQ ID NO: 7020317 - DNA, 22 bp, Homo sapiens
tattgctgactgtcttctgagt

SEQ ID NO: 7020318 - DNA, 22 bp, Homo sapiens
atctggttctttgtatttcctt

SEQ ID NO: 7020319 - DNA, 22 bp, Homo sapiens
agaggatcctaagaagatatga

SEQ ID NO: 7020320 - DNA, 22 bp, Homo sapiens
ttctgaaaggcatgtcaggtag

SEQ ID NO: 7020321 - DNA, 22 bp, Homo sapiens
tgctttactaaataacttacca

SEQ ID NO: 7020322 - DNA, 22 bp, Homo sapiens
cagcccagcagtcttagcctgc

SEQ ID NO: 7020323 - DNA, 22 bp, Homo sapiens
aagcttcacattgaacttgggt

SEQ ID NO: 7020324 - DNA, 22 bp, Homo sapiens
gcacttgagccaatgctagtag

SEQ ID NO: 7020325 - DNA, 22 bp, Homo sapiens
cagtattttcaggatttggaag

SEQ ID NO: 7020326 - DNA, 22 bp, Homo sapiens
tggggtacacgtggggcaggat

SEQ ID NO: 7020327 - DNA, 22 bp, Homo sapiens
aaggatgattggtaatgacact

SEQ ID NO: 7020328 - DNA, 22 bp, Homo sapiens
gagcccagctgtccttggcaaa

SEQ ID NO: 7020329 - DNA, 22 bp, Homo sapiens
tgggtgacagacacctctctgt

SEQ ID NO: 7020330 - DNA, 22 bp, Homo sapiens
aaagactttcacctagcaaaga

SEQ ID NO: 7020331 - DNA, 22 bp, Homo sapiens
tgtgtgctctaatgcctagtac

SEQ ID NO: 7020332 - DNA, 22 bp, Homo sapiens
taaatggtatccttgctgtgct

SEQ ID NO: 7020333 - DNA, 23 bp, Homo sapiens
ataataacgtctgtcttgtctct

SEQ ID NO: 7020334 - DNA, 22 bp, Homo sapiens
tctctgggtctcagtttgtaca

SEQ ID NO: 7020335 - DNA, 22 bp, Homo sapiens
tctattctgataaatgcatgga

SEQ ID NO: 7020336 - DNA, 22 bp, Homo sapiens
aggcaacttttggggatgatgg

SEQ ID NO: 7020337 - DNA, 22 bp, Homo sapiens
gggcagagaaatggacagttgg

SEQ ID NO: 7020338 - DNA, 22 bp, Homo sapiens
gaccttcttgctgtgtcctaac

SEQ ID NO: 7020339 - DNA, 22 bp, Homo sapiens
caacatgtgttagacaatagac

SEQ ID NO: 7020340 - DNA, 22 bp, Homo sapiens
tgggagatggttctgagacttt

SEQ ID NO: 7020341 - DNA, 22 bp, Homo sapiens
aaggaaagacaggacggaattc

SEQ ID NO: 7020342 - DNA, 22 bp, Homo sapiens
atgtcacatggttctggggcct

SEQ ID NO: 7020343 - DNA, 22 bp, Homo sapiens
gcatgctgcagggaatgcttgt

SEQ ID NO: 7020344 - DNA, 22 bp, Homo sapiens
ctgcccagaatcactcactcga

SEQ ID NO: 7020345 - DNA, 22 bp, Homo sapiens
agctggggctgcagagaacagg

SEQ ID NO: 7020346 - DNA, 22 bp, Homo sapiens
gccgttagataataacaagcat

SEQ ID NO: 7020347 - DNA, 22 bp, Homo sapiens
aagtcaggtgtctgatttgaac

SEQ ID NO: 7020348 - DNA, 22 bp, Homo sapiens
ctgccagggccctactcagttt

SEQ ID NO: 7020349 - DNA, 20 bp, Homo sapiens
aaggcactatgtctgctagc

SEQ ID NO: 7020350 - DNA, 22 bp, Homo sapiens
aggaacatctatcacataaacg

SEQ ID NO: 7020351 - DNA, 22 bp, Homo sapiens
tagatttctcattcatagattg

SEQ ID NO: 7020352 - DNA, 22 bp, Homo sapiens
acagaggtgtgtgtaggacagt

SEQ ID NO: 7020353 - DNA, 22 bp, Homo sapiens
tctttacacaagacaagaataa

SEQ ID NO: 7020354 - DNA, 22 bp, Homo sapiens
ttagtgcattttaatagagatg

SEQ ID NO: 7020355 - DNA, 22 bp, Homo sapiens
ttttcagtggcttgcatatgtt

SEQ ID NO: 7020356 - DNA, 22 bp, Homo sapiens
ggtgggcacattcagtctctgt

SEQ ID NO: 7020357 - DNA, 22 bp, Homo sapiens
aaatatgtaaccaaggtgaagt

SEQ ID NO: 7020358 - DNA, 20 bp, Homo sapiens
cagcaggctatggggcaccc

SEQ ID NO: 7020359 - DNA, 22 bp, Homo sapiens
tttgggctggtttgccatgccc

SEQ ID NO: 7020360 - DNA, 19 bp, Homo sapiens
tagaaagccagaaaacaga

SEQ ID NO: 7020361 - DNA, 22 bp, Homo sapiens
atctttagtcaggcgtgggtat

SEQ ID NO: 7020362 - DNA, 22 bp, Homo sapiens
agggtctgtatttctggcaagc

SEQ ID NO: 7020363 - DNA, 22 bp, Homo sapiens
actggctttgagggaatagcta

SEQ ID NO: 7020364 - DNA, 22 bp, Homo sapiens
agcaaagacagggacgaccaag

SEQ ID NO: 7020365 - DNA, 22 bp, Homo sapiens
actcagaatgactgatgctgtg

SEQ ID NO: 7020366 - DNA, 19 bp, Homo sapiens
tctgaagtccagggcatac

SEQ ID NO: 7020367 - DNA, 22 bp, Homo sapiens
agtccatggttctgactcatct

SEQ ID NO: 7020368 - DNA, 19 bp, Homo sapiens
actgaagcagggactgaaa

SEQ ID NO: 7020369 - DNA, 22 bp, Homo sapiens
cgtatttagaaggctgctgaaa

SEQ ID NO: 7020370 - DNA, 21 bp, Homo sapiens
aaaagtttgacaggaaaggga

SEQ ID NO: 7020371 - DNA, 22 bp, Homo sapiens
ttgacacattagagcttgtaaa

SEQ ID NO: 7020372 - DNA, 22 bp, Homo sapiens
atggcccaagtgccctgacctg

SEQ ID NO: 7020373 - DNA, 22 bp, Homo sapiens
atacatgattttttgagggtgg

SEQ ID NO: 7020374 - DNA, 22 bp, Homo sapiens
tgagttataacatattcgtagt

SEQ ID NO: 7020375 - DNA, 22 bp, Homo sapiens
caggaggttggtagcagtagat

SEQ ID NO: 7020376 - DNA, 22 bp, Homo sapiens
aagtatatttagctgagcttgt

SEQ ID NO: 7020377 - DNA, 16 bp, Homo sapiens
gaggagcccctctgcc

SEQ ID NO: 7020378 - DNA, 22 bp, Homo sapiens
gccatcctctgagcactaggca

SEQ ID NO: 7020379 - DNA, 18 bp, Homo sapiens
aggctgcactgtcttaaa

SEQ ID NO: 7020380 - DNA, 22 bp, Homo sapiens
tggaggcctggactttaaggga

SEQ ID NO: 7020381 - DNA, 19 bp, Homo sapiens
ccaaggttggcagctgggc

SEQ ID NO: 7020382 - DNA, 22 bp, Homo sapiens
ttccaagggaatgtttatgagt

SEQ ID NO: 7020383 - DNA, 22 bp, Homo sapiens
cagggctcagggactgcagaaa

SEQ ID NO: 7020384 - DNA, 22 bp, Homo sapiens
actggtttttctcatgaaaatg

SEQ ID NO: 7020385 - DNA, 22 bp, Homo sapiens
aggctctcaccctctgaccaga

SEQ ID NO: 7020386 - DNA, 22 bp, Homo sapiens
tgccagtccattgcctgcgttc

SEQ ID NO: 7020387 - DNA, 22 bp, Homo sapiens
ttacaaagaaaattaggcattt

SEQ ID NO: 7020388 - DNA, 22 bp, Homo sapiens
ttcacagtcacccttctccatg

SEQ ID NO: 7020389 - DNA, 17 bp, Homo sapiens
ttctgggtcccagggcc

SEQ ID NO: 7020390 - DNA, 22 bp, Homo sapiens
cccagagagctttctttgtgct

SEQ ID NO: 7020391 - DNA, 19 bp, Homo sapiens
ttttggaaatgtgaacagc

SEQ ID NO: 7020392 - DNA, 22 bp, Homo sapiens
tgaggcaggagaatcacatgaa

SEQ ID NO: 7020393 - DNA, 22 bp, Homo sapiens
aatgaactggatcagggtttct

SEQ ID NO: 7020394 - DNA, 22 bp, Homo sapiens
ctatggtctggaccgaggtcct

SEQ ID NO: 7020395 - DNA, 22 bp, Homo sapiens
gtgattaatgccaatgggcctt

SEQ ID NO: 7020396 - DNA, 22 bp, Homo sapiens
ttcacagaccaggaggctgtga

SEQ ID NO: 7020397 - DNA, 21 bp, Homo sapiens
gagactctcatgttatttgga

SEQ ID NO: 7020398 - DNA, 22 bp, Homo sapiens
gatgagctgtgattaataagta

SEQ ID NO: 7020399 - DNA, 22 bp, Homo sapiens
ctctgctttttaaaaggagtcc

SEQ ID NO: 7020400 - DNA, 18 bp, Homo sapiens
tcctggttctgtggccac

SEQ ID NO: 7020401 - DNA, 17 bp, Homo sapiens
ccaaggctatttgtagt

SEQ ID NO: 7020402 - DNA, 22 bp, Homo sapiens
ccagagctgaggagatgggctt

SEQ ID NO: 7020403 - DNA, 22 bp, Homo sapiens
ctgcccagattttaccacctgc

SEQ ID NO: 7020404 - DNA, 22 bp, Homo sapiens
tctgcattgtcccagaagtgac

SEQ ID NO: 7020405 - DNA, 22 bp, Homo sapiens
gctcctgggctctaccttgcta

SEQ ID NO: 7020406 - DNA, 22 bp, Homo sapiens
ttaggtaaggatggtgacagta

SEQ ID NO: 7020407 - DNA, 22 bp, Homo sapiens
cagagcagacgttgagattaag

SEQ ID NO: 7020408 - DNA, 22 bp, Homo sapiens
tttacttttggtaaggtcattt

SEQ ID NO: 7020409 - DNA, 17 bp, Homo sapiens
agcacttgaaaatttct

SEQ ID NO: 7020410 - DNA, 22 bp, Homo sapiens
tcccacttccggaggcctttgg

SEQ ID NO: 7020411 - DNA, 22 bp, Homo sapiens
cagacacaccaggcccattctg

SEQ ID NO: 7020412 - DNA, 21 bp, Homo sapiens
taagttctgatccctatcaac

SEQ ID NO: 7020413 - DNA, 22 bp, Homo sapiens
agaagtggtctgtcttccagat

SEQ ID NO: 7020414 - DNA, 22 bp, Homo sapiens
gcaacttaggagttagagcatg

SEQ ID NO: 7020415 - DNA, 22 bp, Homo sapiens
cttccttctgtaagaccagttg

SEQ ID NO: 7020416 - DNA, 16 bp, Homo sapiens
gaaggcttactgcagg

SEQ ID NO: 7020417 - DNA, 22 bp, Homo sapiens
aagagttagctcaataacttga

SEQ ID NO: 7020418 - DNA, 22 bp, Homo sapiens
acagcttggggaggccctggga

SEQ ID NO: 7020419 - DNA, 22 bp, Homo sapiens
tcctgctggaagtagggaatga

SEQ ID NO: 7020420 - DNA, 22 bp, Homo sapiens
agattgaataaccacctttttc

SEQ ID NO: 7020421 - DNA, 22 bp, Homo sapiens
gcctgcctcaaaatcccagttc

SEQ ID NO: 7020422 - DNA, 22 bp, Homo sapiens
tgagtagacgtgatctagtaac

SEQ ID NO: 7020423 - DNA, 22 bp, Homo sapiens
attctgtctttttatacatcta

SEQ ID NO: 7020424 - DNA, 22 bp, Homo sapiens
ctgggcagtttacattcctacc

SEQ ID NO: 7020425 - DNA, 22 bp, Homo sapiens
cctggcctgtgaatctgagagc

SEQ ID NO: 7020426 - DNA, 22 bp, Homo sapiens
aaggttgctgttttgcttcaaa

SEQ ID NO: 7020427 - DNA, 22 bp, Homo sapiens
tggattctcatgggaccagtag

SEQ ID NO: 7020428 - DNA, 22 bp, Homo sapiens
tcacaggaggaacctggcctgg

SEQ ID NO: 7020429 - DNA, 22 bp, Homo sapiens
tccagcagaccatcaaggctca

SEQ ID NO: 7020430 - DNA, 22 bp, Homo sapiens
ctctctggacttgagtatcagc

SEQ ID NO: 7020431 - DNA, 22 bp, Homo sapiens
ataacctaggagggtagaggta

SEQ ID NO: 7020432 - DNA, 22 bp, Homo sapiens
aagtgtgtgggcaggcagtggt

SEQ ID NO: 7020433 - DNA, 22 bp, Homo sapiens
ggacttgggctggtctgtttct

SEQ ID NO: 7020434 - DNA, 22 bp, Homo sapiens
tcaacaatgggtctgtaatgga

SEQ ID NO: 7020435 - DNA, 22 bp, Homo sapiens
aagatgtgtcaccccatgactg

SEQ ID NO: 7020436 - DNA, 22 bp, Homo sapiens
ttctgtgaatggccatgacaag

SEQ ID NO: 7020437 - DNA, 22 bp, Homo sapiens
tcagagacaccagagagctgtg

SEQ ID NO: 7020438 - DNA, 22 bp, Homo sapiens
gaggcctggctgggaggaggtg

SEQ ID NO: 7020439 - DNA, 22 bp, Homo sapiens
ccactggttttattgtagctta

SEQ ID NO: 7020440 - DNA, 22 bp, Homo sapiens
ctttgggatttcatgagagcta

SEQ ID NO: 7020441 - DNA, 22 bp, Homo sapiens
tccttatacctttgctccgctt

SEQ ID NO: 7020442 - DNA, 22 bp, Homo sapiens
tgagacttggcactgaggaact

SEQ ID NO: 7020443 - DNA, 22 bp, Homo sapiens
aagggcagcctgactcacggtc

SEQ ID NO: 7020444 - DNA, 22 bp, Homo sapiens
atgcccaggcccatacctagat

SEQ ID NO: 7020445 - DNA, 22 bp, Homo sapiens
gatcatgtgatttgaagtaatg

SEQ ID NO: 7020446 - DNA, 22 bp, Homo sapiens
cttaggctctattcatgggaag

SEQ ID NO: 7020447 - DNA, 22 bp, Homo sapiens
ctgcaaagctgttcacaaattt

SEQ ID NO: 7020448 - DNA, 22 bp, Homo sapiens
ggaactgaatgtctcggtataa

SEQ ID NO: 7020449 - DNA, 22 bp, Homo sapiens
gaacaatgagtcattcaggtga

SEQ ID NO: 7020450 - DNA, 22 bp, Homo sapiens
acagccatagatgcttatgtaa

SEQ ID NO: 7020451 - DNA, 22 bp, Homo sapiens
taatgcaatttagcaaagtttt

SEQ ID NO: 7020452 - DNA, 22 bp, Homo sapiens
gcaggagcaaactgcagtgtgg

SEQ ID NO: 7020453 - DNA, 22 bp, Homo sapiens
ttgtttcaaggaagaattagga

SEQ ID NO: 7020454 - DNA, 18 bp, Homo sapiens
cattgacagtatatcttt

SEQ ID NO: 7020455 - DNA, 22 bp, Homo sapiens
tatttcagtcacttcttctctg

SEQ ID NO: 7020456 - DNA, 22 bp, Homo sapiens
tcaatttatgtggctattcatt

SEQ ID NO: 7020457 - DNA, 22 bp, Homo sapiens
cataacttgctttggagcccgg

SEQ ID NO: 7020458 - DNA, 22 bp, Homo sapiens
caggtgttgcagttgaagactg

SEQ ID NO: 7020459 - DNA, 22 bp, Homo sapiens
atctactcctgaatatatctag

SEQ ID NO: 7020460 - DNA, 20 bp, Homo sapiens
tttaagaagtttctgaggaa

SEQ ID NO: 7020461 - DNA, 22 bp, Homo sapiens
cagtcagaaggaagatgcttaa

SEQ ID NO: 7020462 - DNA, 22 bp, Homo sapiens
tctgggagagctgctgtcagag

SEQ ID NO: 7020463 - DNA, 22 bp, Homo sapiens
ctcatttacactatgggaacta

SEQ ID NO: 7020464 - DNA, 22 bp, Homo sapiens
tgtgtgaatagcagtggctggt

SEQ ID NO: 7020465 - DNA, 22 bp, Homo sapiens
catgactgtgttagaagaatga

SEQ ID NO: 7020466 - DNA, 22 bp, Homo sapiens
ctattacaattctgcaaggagt

SEQ ID NO: 7020467 - DNA, 22 bp, Homo sapiens
gaccagaatctggactctgatt

SEQ ID NO: 7020468 - DNA, 22 bp, Homo sapiens
tcaggtgccttggctaattgtt

SEQ ID NO: 7020469 - DNA, 22 bp, Homo sapiens
agatggagaatgacaattaagg

SEQ ID NO: 7020470 - DNA, 22 bp, Homo sapiens
gccacaggtggaattaagaaat

SEQ ID NO: 7020471 - DNA, 22 bp, Homo sapiens
tggagcagaggaagaaggcttt

SEQ ID NO: 7020472 - DNA, 22 bp, Homo sapiens
ggatgtctcccagcaccaaagt

SEQ ID NO: 7020473 - DNA, 22 bp, Homo sapiens
cttctgggccatggccttcctc

SEQ ID NO: 7020474 - DNA, 22 bp, Homo sapiens
tcactctgacttggcctccaac

SEQ ID NO: 7020475 - DNA, 23 bp, Homo sapiens
acagctgttgaaatttcagtggg

SEQ ID NO: 7020476 - DNA, 22 bp, Homo sapiens
aacaaatggggccttgtatgaa

SEQ ID NO: 7020477 - DNA, 22 bp, Homo sapiens
tggactgggctaatggcagaca

SEQ ID NO: 7020478 - DNA, 19 bp, Homo sapiens
ttgtacagcaaccaaccct

SEQ ID NO: 7020479 - DNA, 18 bp, Homo sapiens
aggaagaccatcagatat

SEQ ID NO: 7020480 - DNA, 22 bp, Homo sapiens
agcaagtcacatgaccaagccc

SEQ ID NO: 7020481 - DNA, 22 bp, Homo sapiens
aaggctccgtgactggggctga

SEQ ID NO: 7020482 - DNA, 22 bp, Homo sapiens
ggatcaagaaagtcagatgaag

SEQ ID NO: 7020483 - DNA, 22 bp, Homo sapiens
tgcatgcatgtttttacccaca

SEQ ID NO: 7020484 - DNA, 22 bp, Homo sapiens
tgaggggcgctggcaggttcct

SEQ ID NO: 7020485 - DNA, 23 bp, Homo sapiens
ccagctcccaggtctgaggactg

SEQ ID NO: 7020486 - DNA, 22 bp, Homo sapiens
gaggtaggcagggtgacttggc

SEQ ID NO: 7020487 - DNA, 22 bp, Homo sapiens
atcttcagcgaggtttcctttc

SEQ ID NO: 7020488 - DNA, 22 bp, Homo sapiens
ctgttatgactaaataggaagg

SEQ ID NO: 7020489 - DNA, 22 bp, Homo sapiens
cagcaaaggggatgcgtcctaa

SEQ ID NO: 7020490 - DNA, 22 bp, Homo sapiens
tcagtgatgaggtggctttcaa

SEQ ID NO: 7020491 - DNA, 22 bp, Homo sapiens
cctgagagtaggtgtctcttta

SEQ ID NO: 7020492 - DNA, 22 bp, Homo sapiens
tgctctatctaaaagtcctgga

SEQ ID NO: 7020493 - DNA, 22 bp, Homo sapiens
tgtggcttaagaatgcctttaa

SEQ ID NO: 7020494 - DNA, 22 bp, Homo sapiens
aaggcatgatgtaatcaatgat

SEQ ID NO: 7020495 - DNA, 22 bp, Homo sapiens
gttctctgagtcctggcaaaat

SEQ ID NO: 7020496 - DNA, 22 bp, Homo sapiens
atgctttacgacaaaaaactca

SEQ ID NO: 7020497 - DNA, 22 bp, Homo sapiens
ctaggccagttaggaagagaag

SEQ ID NO: 7020498 - DNA, 22 bp, Homo sapiens
cctcccagatgtgcccaatgga

SEQ ID NO: 7020499 - DNA, 22 bp, Homo sapiens
aatctaaggacttagcattgct

SEQ ID NO: 7020500 - DNA, 22 bp, Homo sapiens
caaatgtattctcacttcaggg

SEQ ID NO: 7020501 - DNA, 22 bp, Homo sapiens
tctatttttatagttgaagtgc

SEQ ID NO: 7020502 - DNA, 21 bp, Homo sapiens
acttaaattccttgatattta

SEQ ID NO: 7020503 - DNA, 22 bp, Homo sapiens
aagtttgttcattcattcatcc

SEQ ID NO: 7020504 - DNA, 22 bp, Homo sapiens
gcattctgtgctacagccattc

SEQ ID NO: 7020505 - DNA, 22 bp, Homo sapiens
tctggtcctctctgtgatgcta

SEQ ID NO: 7020506 - DNA, 22 bp, Homo sapiens
aggcacttggaggtctctgccc

SEQ ID NO: 7020507 - DNA, 22 bp, Homo sapiens
catgatggcgagtttctaggtt

SEQ ID NO: 7020508 - DNA, 22 bp, Homo sapiens
gggcactgtgttcagagtgcag

SEQ ID NO: 7020509 - DNA, 22 bp, Homo sapiens
tgccttgtccttcgtcagggct

SEQ ID NO: 7020510 - DNA, 22 bp, Homo sapiens
cagccctgctggttttgggcaa

SEQ ID NO: 7020511 - DNA, 22 bp, Homo sapiens
cagagagcacataggatacttt

SEQ ID NO: 7020512 - DNA, 22 bp, Homo sapiens
gggaatgtgcctggagtgttca

SEQ ID NO: 7020513 - DNA, 22 bp, Homo sapiens
ataggtacagcagatattctta

SEQ ID NO: 7020514 - DNA, 22 bp, Homo sapiens
gtgcatggggagggaagcgctc

SEQ ID NO: 7020515 - DNA, 22 bp, Homo sapiens
ggcagggtatgattacctctga

SEQ ID NO: 7020516 - DNA, 22 bp, Homo sapiens
cctctttaatcccatccatgtg

SEQ ID NO: 7020517 - DNA, 22 bp, Homo sapiens
taagggttcagaatgcagtggt

SEQ ID NO: 7020518 - DNA, 22 bp, Homo sapiens
cctctgtaagcctcagtttctt

SEQ ID NO: 7020519 - DNA, 22 bp, Homo sapiens
cacctggcagctgttggccacg

SEQ ID NO: 7020520 - DNA, 22 bp, Homo sapiens
ttcatgagcagaagggaggggt

SEQ ID NO: 7020521 - DNA, 22 bp, Homo sapiens
tggcagacctgaaggttcggcg

SEQ ID NO: 7020522 - DNA, 22 bp, Homo sapiens
tgctcttacattaattcagcat

SEQ ID NO: 7020523 - DNA, 20 bp, Homo sapiens
tatgtgattttctcatcaat

SEQ ID NO: 7020524 - DNA, 22 bp, Homo sapiens
taagaagtacctcttttcctga

SEQ ID NO: 7020525 - DNA, 22 bp, Homo sapiens
acacttctattccctgcacaaa

SEQ ID NO: 7020526 - DNA, 22 bp, Homo sapiens
attgaatagatgcattatacta

SEQ ID NO: 7020527 - DNA, 22 bp, Homo sapiens
tggctacatttgttgatcactt

SEQ ID NO: 7020528 - DNA, 22 bp, Homo sapiens
agtaacatgagtttttctaatg

SEQ ID NO: 7020529 - DNA, 22 bp, Homo sapiens
ttccaggaacaaactcacctta

SEQ ID NO: 7020530 - DNA, 19 bp, Homo sapiens
agaggcctcagcagctggc

SEQ ID NO: 7020531 - DNA, 22 bp, Homo sapiens
ggagccccaattgagcagtacg

SEQ ID NO: 7020532 - DNA, 22 bp, Homo sapiens
atccagagttgctgtatatctt

SEQ ID NO: 7020533 - DNA, 22 bp, Homo sapiens
ttgggagcaaataggaaagagg

SEQ ID NO: 7020534 - DNA, 22 bp, Homo sapiens
agtgttcagtgattgtcaaccg

SEQ ID NO: 7020535 - DNA, 22 bp, Homo sapiens
agcagctgctccacttgcttaa

SEQ ID NO: 7020536 - DNA, 22 bp, Homo sapiens
attatctatgtagaatgatttt

SEQ ID NO: 7020537 - DNA, 22 bp, Homo sapiens
ttttatgtaataaactgtacac

SEQ ID NO: 7020538 - DNA, 22 bp, Homo sapiens
ctccacagcccctccagtggca

SEQ ID NO: 7020539 - DNA, 22 bp, Homo sapiens
gtgctgaggagagggggtggtc

SEQ ID NO: 7020540 - DNA, 22 bp, Homo sapiens
attgacctggcagactggactg

SEQ ID NO: 7020541 - DNA, 22 bp, Homo sapiens
gagggcaagagttggaaacggt

SEQ ID NO: 7020542 - DNA, 22 bp, Homo sapiens
ataaggaaaattggagaaattg

SEQ ID NO: 7020543 - DNA, 22 bp, Homo sapiens
tctctgaggttgtttccagcac

SEQ ID NO: 7020544 - DNA, 22 bp, Homo sapiens
ctctgtctatcccattctgtgc

SEQ ID NO: 7020545 - DNA, 22 bp, Homo sapiens
ggtgaggctggcttgccttctt

SEQ ID NO: 7020546 - DNA, 22 bp, Homo sapiens
gtcatttttcactgcatataga

SEQ ID NO: 7020547 - DNA, 22 bp, Homo sapiens
cactggaccaaggaaactcttc

SEQ ID NO: 7020548 - DNA, 21 bp, Homo sapiens
tctctggcggtgtttggctcc

SEQ ID NO: 7020549 - DNA, 22 bp, Homo sapiens
ctgttctccggccagtccagag

SEQ ID NO: 7020550 - DNA, 22 bp, Homo sapiens
gcaccgccttggaccgcccgct

SEQ ID NO: 7020551 - DNA, 22 bp, Homo sapiens
cagcaatatacacagtctatgg

SEQ ID NO: 7020552 - DNA, 22 bp, Homo sapiens
tgctcagcgccaaagctgatgg

SEQ ID NO: 7020553 - DNA, 22 bp, Homo sapiens
ttgttcatctggaacccagagc

SEQ ID NO: 7020554 - DNA, 22 bp, Homo sapiens
tgaagcaaatttttctcagagt

SEQ ID NO: 7020555 - DNA, 22 bp, Homo sapiens
tggagtgggcaatgtaggcaag

SEQ ID NO: 7020556 - DNA, 22 bp, Homo sapiens
tccagtcctatctgcccttgga

SEQ ID NO: 7020557 - DNA, 22 bp, Homo sapiens
ttgtaagaatatgaatacaaat

SEQ ID NO: 7020558 - DNA, 22 bp, Homo sapiens
tttcttgccagagaaaaagagt

SEQ ID NO: 7020559 - DNA, 22 bp, Homo sapiens
cagccctgtgcggagggccctg

SEQ ID NO: 7020560 - DNA, 22 bp, Homo sapiens
ggctgctgtactgatgtcagtt

SEQ ID NO: 7020561 - DNA, 22 bp, Homo sapiens
ctggagctgccagggctgccgc

SEQ ID NO: 7020562 - DNA, 22 bp, Homo sapiens
gaaggctctgatttcttgcaaa

SEQ ID NO: 7020563 - DNA, 22 bp, Homo sapiens
tgggttaaaatgataccttgca

SEQ ID NO: 7020564 - DNA, 22 bp, Homo sapiens
ggggaagacctggcactacagc

SEQ ID NO: 7020565 - DNA, 22 bp, Homo sapiens
gagctccacttagcaaggccac

SEQ ID NO: 7020566 - DNA, 22 bp, Homo sapiens
acacatcagcctcagctttggg

SEQ ID NO: 7020567 - DNA, 22 bp, Homo sapiens
ccatcccttctctggccagcag

SEQ ID NO: 7020568 - DNA, 21 bp, Homo sapiens
agcaggtaggcattcatactg

SEQ ID NO: 7020569 - DNA, 22 bp, Homo sapiens
tatgaagctgataatcactgat

SEQ ID NO: 7020570 - DNA, 22 bp, Homo sapiens
agaagctgagaatgaattaaga

SEQ ID NO: 7020571 - DNA, 23 bp, Homo sapiens
tagcccattgtgcttgtggtttt

SEQ ID NO: 7020572 - DNA, 22 bp, Homo sapiens
tttaaactaacagtacacgttg

SEQ ID NO: 7020573 - DNA, 22 bp, Homo sapiens
ctggtctgctagaaagatgcat

SEQ ID NO: 7020574 - DNA, 22 bp, Homo sapiens
cactgcacttcagcctgggcaa

SEQ ID NO: 7020575 - DNA, 22 bp, Homo sapiens
tggctcagtttctgcccagctg

SEQ ID NO: 7020576 - DNA, 22 bp, Homo sapiens
gaagtggcctgaagtgaatgct

SEQ ID NO: 7020577 - DNA, 23 bp, Homo sapiens
agctttgtgaaagcagacatggg

SEQ ID NO: 7020578 - DNA, 22 bp, Homo sapiens
catgaaggaccatttcacggtc

SEQ ID NO: 7020579 - DNA, 22 bp, Homo sapiens
ggagttccagaatctgcttttt

SEQ ID NO: 7020580 - DNA, 22 bp, Homo sapiens
tgacaaagtgaggtcttcagta

SEQ ID NO: 7020581 - DNA, 21 bp, Homo sapiens
tcctgcagaatgccttcctac

SEQ ID NO: 7020582 - DNA, 22 bp, Homo sapiens
gctgctggggtcacatggtaag

SEQ ID NO: 7020583 - DNA, 22 bp, Homo sapiens
taaaatgcacagcagttgaaag

SEQ ID NO: 7020584 - DNA, 22 bp, Homo sapiens
tggcagcataaagcatttagct

SEQ ID NO: 7020585 - DNA, 22 bp, Homo sapiens
tccgggagctgaacgtcttgcg

SEQ ID NO: 7020586 - DNA, 22 bp, Homo sapiens
gaggcggcggccgagcctggct

SEQ ID NO: 7020587 - DNA, 20 bp, Homo sapiens
ttggatgtgcatggccgtgc

SEQ ID NO: 7020588 - DNA, 22 bp, Homo sapiens
atggttgaatcaaggtagacaa

SEQ ID NO: 7020589 - DNA, 22 bp, Homo sapiens
cacaggagaacccacagattct

SEQ ID NO: 7020590 - DNA, 21 bp, Homo sapiens
actgtgggtctgaccacctgg

SEQ ID NO: 7020591 - DNA, 22 bp, Homo sapiens
aaaattcatagaactgtacgct

SEQ ID NO: 7020592 - DNA, 22 bp, Homo sapiens
tggacaggttgagtaggaggag

SEQ ID NO: 7020593 - DNA, 22 bp, Homo sapiens
gggtgggactgaagtctgaggg

SEQ ID NO: 7020594 - DNA, 22 bp, Homo sapiens
ttcctctattctaacaaaagta

SEQ ID NO: 7020595 - DNA, 23 bp, Homo sapiens
aggatgtgcatatgacctaatca

SEQ ID NO: 7020596 - DNA, 22 bp, Homo sapiens
gcagattactggactgattcca

SEQ ID NO: 7020597 - DNA, 22 bp, Homo sapiens
cagctacagtctgattggttca

SEQ ID NO: 7020598 - DNA, 22 bp, Homo sapiens
gagacaggccaggtggtactta

SEQ ID NO: 7020599 - DNA, 22 bp, Homo sapiens
tcatccactggggatcccatgt

SEQ ID NO: 7020600 - DNA, 18 bp, Homo sapiens
cagctgtgccctgtttgg

SEQ ID NO: 7020601 - DNA, 22 bp, Homo sapiens
cagaaagtgatttgctattcca

SEQ ID NO: 7020602 - DNA, 22 bp, Homo sapiens
agctgcccctcattttcaccac

SEQ ID NO: 7020603 - DNA, 22 bp, Homo sapiens
taaagtgtttgtatgcagataa

SEQ ID NO: 7020604 - DNA, 22 bp, Homo sapiens
tttgaagccatgtcaatagttt

SEQ ID NO: 7020605 - DNA, 19 bp, Homo sapiens
gctgcattcatggtgagtg

SEQ ID NO: 7020606 - DNA, 20 bp, Homo sapiens
gagccttcccctcaccactg

SEQ ID NO: 7020607 - DNA, 22 bp, Homo sapiens
atgcaaaattaccattctgttc

SEQ ID NO: 7020608 - DNA, 22 bp, Homo sapiens
attgcagattcttctcagggag

SEQ ID NO: 7020609 - DNA, 22 bp, Homo sapiens
actatcttccttatgcctatca

SEQ ID NO: 7020610 - DNA, 22 bp, Homo sapiens
atggctctctagggcccaggtt

SEQ ID NO: 7020611 - DNA, 22 bp, Homo sapiens
gtgggacagtcagaagtgagca

SEQ ID NO: 7020612 - DNA, 22 bp, Homo sapiens
ttcatttaatcagaatctctaa

SEQ ID NO: 7020613 - DNA, 22 bp, Homo sapiens
aattctgcataaggtggctctg

SEQ ID NO: 7020614 - DNA, 22 bp, Homo sapiens
gtttactgctctaggttgcaca

SEQ ID NO: 7020615 - DNA, 22 bp, Homo sapiens
ctctcctattgtgtggtaagga

SEQ ID NO: 7020616 - DNA, 22 bp, Homo sapiens
gagggggaaagtccctggagtc

SEQ ID NO: 7020617 - DNA, 22 bp, Homo sapiens
ttgcagagccatgaggctggct

SEQ ID NO: 7020618 - DNA, 22 bp, Homo sapiens
ctgcttttgagcccagtgctca

SEQ ID NO: 7020619 - DNA, 22 bp, Homo sapiens
aaacagatgagttataatagcc

SEQ ID NO: 7020620 - DNA, 22 bp, Homo sapiens
tgagagaggggactgcctgctt

SEQ ID NO: 7020621 - DNA, 22 bp, Homo sapiens
agcattcaagtaattcacttgg

SEQ ID NO: 7020622 - DNA, 23 bp, Homo sapiens
tccaccccagctgaggcttagcc

SEQ ID NO: 7020623 - DNA, 22 bp, Homo sapiens
tccagggccccccagttgcacg

SEQ ID NO: 7020624 - DNA, 22 bp, Homo sapiens
ctatctcagataacctgcacca

SEQ ID NO: 7020625 - DNA, 22 bp, Homo sapiens
tctacgaatggtccccggtgtg

SEQ ID NO: 7020626 - DNA, 22 bp, Homo sapiens
cagggcccaggccactgggttg

SEQ ID NO: 7020627 - DNA, 22 bp, Homo sapiens
taaatgcaaagcttggcgctta

SEQ ID NO: 7020628 - DNA, 23 bp, Homo sapiens
agggcactgaagctggaattggg

SEQ ID NO: 7020629 - DNA, 22 bp, Homo sapiens
tgtaaacatatcagactttctt

SEQ ID NO: 7020630 - DNA, 22 bp, Homo sapiens
gcagcagagctttgtcctggct

SEQ ID NO: 7020631 - DNA, 22 bp, Homo sapiens
acagtttggcaaatgtcccaca

SEQ ID NO: 7020632 - DNA, 22 bp, Homo sapiens
ctatctctccacaatgccagtg

SEQ ID NO: 7020633 - DNA, 22 bp, Homo sapiens
tctgaatcgttcccatgcagga

SEQ ID NO: 7020634 - DNA, 22 bp, Homo sapiens
tgggcaaatgtcactttctttt

SEQ ID NO: 7020635 - DNA, 22 bp, Homo sapiens
agccaacttggaaagtcagatt

SEQ ID NO: 7020636 - DNA, 23 bp, Homo sapiens
agttgctctcaagaatatcttgt

SEQ ID NO: 7020637 - DNA, 22 bp, Homo sapiens
agttaagaatacacatcataat

SEQ ID NO: 7020638 - DNA, 22 bp, Homo sapiens
acactgtagatatagagttagt

SEQ ID NO: 7020639 - DNA, 22 bp, Homo sapiens
tcccaagattaggttggaaagg

SEQ ID NO: 7020640 - DNA, 22 bp, Homo sapiens
ggtgacatgcacctatcccttg

SEQ ID NO: 7020641 - DNA, 22 bp, Homo sapiens
atatgttactctttcaagcaga

SEQ ID NO: 7020642 - DNA, 22 bp, Homo sapiens
tgtcccaggcctcatgttgcca

SEQ ID NO: 7020643 - DNA, 22 bp, Homo sapiens
cttatatttgtcaactttacaa

SEQ ID NO: 7020644 - DNA, 22 bp, Homo sapiens
atggcttttttcttgggcactc

SEQ ID NO: 7020645 - DNA, 22 bp, Homo sapiens
tggtgcagtccaaagggagcag

SEQ ID NO: 7020646 - DNA, 22 bp, Homo sapiens
cagtccaacctgccccttgggc

SEQ ID NO: 7020647 - DNA, 22 bp, Homo sapiens
ggcagcaagcagaagttctatg

SEQ ID NO: 7020648 - DNA, 17 bp, Homo sapiens
gtgtctttgctgttgtg

SEQ ID NO: 7020649 - DNA, 22 bp, Homo sapiens
gggctggaggcctgcctggtta

SEQ ID NO: 7020650 - DNA, 22 bp, Homo sapiens
tgcactgatcctgaccagtgaa

SEQ ID NO: 7020651 - DNA, 21 bp, Homo sapiens
ttgggatctgagaagtgaaaa

SEQ ID NO: 7020652 - DNA, 22 bp, Homo sapiens
tgttaacttcctcctcctctgc

SEQ ID NO: 7020653 - DNA, 22 bp, Homo sapiens
actagaatgcaagctccacaag

SEQ ID NO: 7020654 - DNA, 22 bp, Homo sapiens
tgagcagactctgcagagccac

SEQ ID NO: 7020655 - DNA, 22 bp, Homo sapiens
gtatacactgtctcctctaggt

SEQ ID NO: 7020656 - DNA, 22 bp, Homo sapiens
ctttggatggctgtgtgtttat

SEQ ID NO: 7020657 - DNA, 22 bp, Homo sapiens
aactagttttagccacagaaca

SEQ ID NO: 7020658 - DNA, 22 bp, Homo sapiens
atgcattctggaaagtagcaat

SEQ ID NO: 7020659 - DNA, 21 bp, Homo sapiens
ctttagctctatgtcctgagg

SEQ ID NO: 7020660 - DNA, 23 bp, Homo sapiens
tgcagaggcatgatcactgctca

SEQ ID NO: 7020661 - DNA, 22 bp, Homo sapiens
gcctggagtagcatggcaagcc

SEQ ID NO: 7020662 - DNA, 22 bp, Homo sapiens
ctgagcctgtgtttctctggca

SEQ ID NO: 7020663 - DNA, 22 bp, Homo sapiens
ataacttcatcaaataggcaca

SEQ ID NO: 7020664 - DNA, 22 bp, Homo sapiens
tgatcaggtctgaacagggagg

SEQ ID NO: 7020665 - DNA, 22 bp, Homo sapiens
aactgtttttcacgtgtctcat

SEQ ID NO: 7020666 - DNA, 22 bp, Homo sapiens
aggcaggcacacttcctccagg

SEQ ID NO: 7020667 - DNA, 22 bp, Homo sapiens
aggtagcaagacacctgctttt

SEQ ID NO: 7020668 - DNA, 22 bp, Homo sapiens
agcttgttggggaaggagaaag

SEQ ID NO: 7020669 - DNA, 22 bp, Homo sapiens
tagagcttggactgcattttcg

SEQ ID NO: 7020670 - DNA, 19 bp, Homo sapiens
ccagagttggcagagcagg

SEQ ID NO: 7020671 - DNA, 21 bp, Homo sapiens
agaatccattcagaccttctc

SEQ ID NO: 7020672 - DNA, 22 bp, Homo sapiens
tggattctaatgcacttcaaat

SEQ ID NO: 7020673 - DNA, 22 bp, Homo sapiens
tcttggctcctcacagcatcag

SEQ ID NO: 7020674 - DNA, 22 bp, Homo sapiens
agggtgtcagccacggaatggg

SEQ ID NO: 7020675 - DNA, 22 bp, Homo sapiens
tctgggagagcacgtggctgac

SEQ ID NO: 7020676 - DNA, 22 bp, Homo sapiens
tttattgttgggtcttaagctg

SEQ ID NO: 7020677 - DNA, 22 bp, Homo sapiens
ttgtcctgcaggtggctgggag

SEQ ID NO: 7020678 - DNA, 22 bp, Homo sapiens
ggaagccaggctgggggatctg

SEQ ID NO: 7020679 - DNA, 22 bp, Homo sapiens
ggatatgtagggcatatctaca

SEQ ID NO: 7020680 - DNA, 22 bp, Homo sapiens
ctcttcctagtgtgcagcgtgg

SEQ ID NO: 7020681 - DNA, 22 bp, Homo sapiens
gctcagagttaaatatagtgct

SEQ ID NO: 7020682 - DNA, 22 bp, Homo sapiens
gaataatcatatcgtctcacat

SEQ ID NO: 7020683 - DNA, 22 bp, Homo sapiens
cctcagtgcgtactgaacagtg

SEQ ID NO: 7020684 - DNA, 22 bp, Homo sapiens
tcgccatcgtcggacacagtga

SEQ ID NO: 7020685 - DNA, 22 bp, Homo sapiens
gaaagtgctctctctatacaca

SEQ ID NO: 7020686 - DNA, 22 bp, Homo sapiens
agctgcactgacctgtatgaag

SEQ ID NO: 7020687 - DNA, 22 bp, Homo sapiens
tcctcagtaaggcatggctttg

SEQ ID NO: 7020688 - DNA, 22 bp, Homo sapiens
ttcctgatcaggttcccatgtg

SEQ ID NO: 7020689 - DNA, 22 bp, Homo sapiens
tactgatatgatgtgctttaga

SEQ ID NO: 7020690 - DNA, 22 bp, Homo sapiens
tccagagccccagtctagtggg

SEQ ID NO: 7020691 - DNA, 22 bp, Homo sapiens
tagcaccaaacatatactcagt

SEQ ID NO: 7020692 - DNA, 22 bp, Homo sapiens
aaacacaagaggcagggtacag

SEQ ID NO: 7020693 - DNA, 21 bp, Homo sapiens
taaagctcgttcaggaaagtc

SEQ ID NO: 7020694 - DNA, 22 bp, Homo sapiens
ctttggaaaaagtgactggctc

SEQ ID NO: 7020695 - DNA, 22 bp, Homo sapiens
tggcccagtgcttatgctctga

SEQ ID NO: 7020696 - DNA, 22 bp, Homo sapiens
acattcacgctctcaaagctga

SEQ ID NO: 7020697 - DNA, 22 bp, Homo sapiens
cgtgaggggggtaaggcgtccg

SEQ ID NO: 7020698 - DNA, 22 bp, Homo sapiens
caagcactgtggcactcgcagg

SEQ ID NO: 7020699 - DNA, 22 bp, Homo sapiens
cagaggtacaagctaagttggg

SEQ ID NO: 7020700 - DNA, 22 bp, Homo sapiens
aaaggtcaaaatcgtgacattg

SEQ ID NO: 7020701 - DNA, 22 bp, Homo sapiens
ctaaagtcatacaaggtgggag

SEQ ID NO: 7020702 - DNA, 22 bp, Homo sapiens
tattctccccggatcagggcaa

SEQ ID NO: 7020703 - DNA, 22 bp, Homo sapiens
tacagggactcccgcagagata

SEQ ID NO: 7020704 - DNA, 20 bp, Homo sapiens
caaatcacaggtaattgcaa

SEQ ID NO: 7020705 - DNA, 19 bp, Homo sapiens
attcttctcttcctgctgt

SEQ ID NO: 7020706 - DNA, 22 bp, Homo sapiens
tgctccacttgggcacccccca

SEQ ID NO: 7020707 - DNA, 22 bp, Homo sapiens
gtactaagtcaggagaagaatt

SEQ ID NO: 7020708 - DNA, 22 bp, Homo sapiens
agcagctctgtttacctggagg

SEQ ID NO: 7020709 - DNA, 22 bp, Homo sapiens
gaacctgtcctgagtgaggagt

SEQ ID NO: 7020710 - DNA, 22 bp, Homo sapiens
atgggagggtggaaaggctctg

SEQ ID NO: 7020711 - DNA, 22 bp, Homo sapiens
gtagatggaggggctgcagggc

SEQ ID NO: 7020712 - DNA, 22 bp, Homo sapiens
acagttactcatagaagcactt

SEQ ID NO: 7020713 - DNA, 22 bp, Homo sapiens
atggcccactctggtcccggca

SEQ ID NO: 7020714 - DNA, 22 bp, Homo sapiens
aggccctattcaatggggccca

SEQ ID NO: 7020715 - DNA, 22 bp, Homo sapiens
gcttattgtttctaatagacga

SEQ ID NO: 7020716 - DNA, 19 bp, Homo sapiens
ctgagagatgcttcacaca

SEQ ID NO: 7020717 - DNA, 22 bp, Homo sapiens
tcctccagttccttggtttcag

SEQ ID NO: 7020718 - DNA, 22 bp, Homo sapiens
tgaggtatgtgatgtcttttag

SEQ ID NO: 7020719 - DNA, 22 bp, Homo sapiens
tcctggcaggtgtattggctgt

SEQ ID NO: 7020720 - DNA, 22 bp, Homo sapiens
gattcatgttatagagagtcag

SEQ ID NO: 7020721 - DNA, 22 bp, Homo sapiens
tttgtagactaccagtaattgt

SEQ ID NO: 7020722 - DNA, 22 bp, Homo sapiens
gcagcagatgtgggcccagagc

SEQ ID NO: 7020723 - DNA, 22 bp, Homo sapiens
tctggggatgaggtccagtgat

SEQ ID NO: 7020724 - DNA, 22 bp, Homo sapiens
gagcagagacagtacaactggc

SEQ ID NO: 7020725 - DNA, 22 bp, Homo sapiens
ttatgttttaagtgtgtatctt

SEQ ID NO: 7020726 - DNA, 22 bp, Homo sapiens
catggggtggtgggcaacctca

SEQ ID NO: 7020727 - DNA, 22 bp, Homo sapiens
acctgaggaagggcgagaagct

SEQ ID NO: 7020728 - DNA, 20 bp, Homo sapiens
agtgtttctcaacatggggc

SEQ ID NO: 7020729 - DNA, 22 bp, Homo sapiens
tctgtaaaacttctttgtaaat

SEQ ID NO: 7020730 - DNA, 22 bp, Homo sapiens
gagctctggacgaggggagtgg

SEQ ID NO: 7020731 - DNA, 22 bp, Homo sapiens
tggcaggaaagtaacagagcac

SEQ ID NO: 7020732 - DNA, 18 bp, Homo sapiens
ctgcctgctctccagctt

SEQ ID NO: 7020733 - DNA, 22 bp, Homo sapiens
gtgcttcactgacctgttttca

SEQ ID NO: 7020734 - DNA, 22 bp, Homo sapiens
ctcttttagagatgaaaattgg

SEQ ID NO: 7020735 - DNA, 22 bp, Homo sapiens
gctctggactggggcctgagaa

SEQ ID NO: 7020736 - DNA, 22 bp, Homo sapiens
ttcaagatgcacagtggcattc

SEQ ID NO: 7020737 - DNA, 22 bp, Homo sapiens
gaagcgtgcaggtccgtatact

SEQ ID NO: 7020738 - DNA, 22 bp, Homo sapiens
tcagcaactctcattccgcttt

SEQ ID NO: 7020739 - DNA, 22 bp, Homo sapiens
caactcctccccagcatgccaa

SEQ ID NO: 7020740 - DNA, 20 bp, Homo sapiens
tggagccagaggttatagca

SEQ ID NO: 7020741 - DNA, 22 bp, Homo sapiens
tttaagatggtattttataaag

SEQ ID NO: 7020742 - DNA, 17 bp, Homo sapiens
ctcccccccacgtgtcc

SEQ ID NO: 7020743 - DNA, 22 bp, Homo sapiens
tagtgaaatgataacagagcag

SEQ ID NO: 7020744 - DNA, 22 bp, Homo sapiens
ctcctcagaagagggtaacaca

SEQ ID NO: 7020745 - DNA, 22 bp, Homo sapiens
ggtatttatagtggtgcttagt

SEQ ID NO: 7020746 - DNA, 21 bp, Homo sapiens
aactatggaggaaataagtcc

SEQ ID NO: 7020747 - DNA, 22 bp, Homo sapiens
actgggcaaggatatgatgggt

SEQ ID NO: 7020748 - DNA, 22 bp, Homo sapiens
ttatctgtgacagccttgtatg

SEQ ID NO: 7020749 - DNA, 22 bp, Homo sapiens
tgctccttcctcatcctgtgca

SEQ ID NO: 7020750 - DNA, 22 bp, Homo sapiens
aggtctgttggtaccagtgtgg

SEQ ID NO: 7020751 - DNA, 22 bp, Homo sapiens
ctactttacctccatcagactg

SEQ ID NO: 7020752 - DNA, 22 bp, Homo sapiens
tcctgggaggcaggaccccttt

SEQ ID NO: 7020753 - DNA, 22 bp, Homo sapiens
aggcctccagctgagttttgct

SEQ ID NO: 7020754 - DNA, 22 bp, Homo sapiens
ttgctgctttcatttatacagt

SEQ ID NO: 7020755 - DNA, 22 bp, Homo sapiens
ctatctcatgcatcaactcttc

SEQ ID NO: 7020756 - DNA, 22 bp, Homo sapiens
ttatcaactagtttaggtttga

SEQ ID NO: 7020757 - DNA, 22 bp, Homo sapiens
gagtctgtcaaaacaatcctct

SEQ ID NO: 7020758 - DNA, 20 bp, Homo sapiens
tcatgcaggtgttctaggtt

SEQ ID NO: 7020759 - DNA, 22 bp, Homo sapiens
tacaagaatttctttctggttg

SEQ ID NO: 7020760 - DNA, 22 bp, Homo sapiens
gcatccagtcttggctcctgga

SEQ ID NO: 7020761 - DNA, 19 bp, Homo sapiens
taccagcctcctgcctgat

SEQ ID NO: 7020762 - DNA, 22 bp, Homo sapiens
gagaggctgatcctgcagagaa

SEQ ID NO: 7020763 - DNA, 21 bp, Homo sapiens
tgctatcacactctttctgct

SEQ ID NO: 7020764 - DNA, 22 bp, Homo sapiens
aggtgctaggtgtgtagtggag

SEQ ID NO: 7020765 - DNA, 22 bp, Homo sapiens
gcctcagagggccctagggaca

SEQ ID NO: 7020766 - DNA, 22 bp, Homo sapiens
tggcagaggtaattcaaatccc

SEQ ID NO: 7020767 - DNA, 22 bp, Homo sapiens
tgggggacaccagtctctctct

SEQ ID NO: 7020768 - DNA, 22 bp, Homo sapiens
atgcatgcattgtttatcatgg

SEQ ID NO: 7020769 - DNA, 22 bp, Homo sapiens
ttagttgctggcagaccctagg

SEQ ID NO: 7020770 - DNA, 22 bp, Homo sapiens
agctatttcaaagtttgagaca

SEQ ID NO: 7020771 - DNA, 22 bp, Homo sapiens
gtactgcttaggtcaggtcagt

SEQ ID NO: 7020772 - DNA, 22 bp, Homo sapiens
gagtccttggcatcatcagtac

SEQ ID NO: 7020773 - DNA, 19 bp, Homo sapiens
ctgcttcaggcgccttgcc

SEQ ID NO: 7020774 - DNA, 22 bp, Homo sapiens
ttttgcctgagatccgagtctg

SEQ ID NO: 7020775 - DNA, 22 bp, Homo sapiens
gttttattggaacacagccatg

SEQ ID NO: 7020776 - DNA, 22 bp, Homo sapiens
ttgattctgatcctttgctagc

SEQ ID NO: 7020777 - DNA, 22 bp, Homo sapiens
tgaaaatgccctctatgtctca

SEQ ID NO: 7020778 - DNA, 22 bp, Homo sapiens
ggacatagaggccctgcatggc

SEQ ID NO: 7020779 - DNA, 22 bp, Homo sapiens
agtggctgtcttccaaaatctg

SEQ ID NO: 7020780 - DNA, 20 bp, Homo sapiens
atcgcttaaatcatagcact

SEQ ID NO: 7020781 - DNA, 20 bp, Homo sapiens
actcatttccagcatctgat

SEQ ID NO: 7020782 - DNA, 22 bp, Homo sapiens
tgaggtgaaggagttttaaagt

SEQ ID NO: 7020783 - DNA, 22 bp, Homo sapiens
tttggaattacttactcaagcc

SEQ ID NO: 7020784 - DNA, 22 bp, Homo sapiens
tttacaccaaaatgacacagag

SEQ ID NO: 7020785 - DNA, 22 bp, Homo sapiens
ggctgctgaacaagggaaccct

SEQ ID NO: 7020786 - DNA, 22 bp, Homo sapiens
aggggaggagcttttcttgcct

SEQ ID NO: 7020787 - DNA, 22 bp, Homo sapiens
tctttggttgcactgcaggtgt

SEQ ID NO: 7020788 - DNA, 22 bp, Homo sapiens
agccatgcaccttactcttgct

SEQ ID NO: 7020789 - DNA, 22 bp, Homo sapiens
agaaactacttggaggaaagat

SEQ ID NO: 7020790 - DNA, 22 bp, Homo sapiens
tgagcagagacgggggcctcca

SEQ ID NO: 7020791 - DNA, 22 bp, Homo sapiens
agctacctggcttatcactgtc

SEQ ID NO: 7020792 - DNA, 22 bp, Homo sapiens
gtttgtgcgggacatgatccgg

SEQ ID NO: 7020793 - DNA, 22 bp, Homo sapiens
ctagaactacatcttttaatag

SEQ ID NO: 7020794 - DNA, 22 bp, Homo sapiens
tattgtacatttcaaagtagct

SEQ ID NO: 7020795 - DNA, 22 bp, Homo sapiens
caagggcagatagctggtccaa

SEQ ID NO: 7020796 - DNA, 22 bp, Homo sapiens
agcagcaggtgcttctggatct

SEQ ID NO: 7020797 - DNA, 22 bp, Homo sapiens
ctgggagatgactcagagcagg

SEQ ID NO: 7020798 - DNA, 22 bp, Homo sapiens
aggtggagtgaaggaaaggcag

SEQ ID NO: 7020799 - DNA, 22 bp, Homo sapiens
cctgttccattcatatcctatt

SEQ ID NO: 7020800 - DNA, 22 bp, Homo sapiens
actatacaagattagggatttg

SEQ ID NO: 7020801 - DNA, 22 bp, Homo sapiens
cagtttcctgaagagaaagaat

SEQ ID NO: 7020802 - DNA, 22 bp, Homo sapiens
atgtgtgtacacacgtgactct

SEQ ID NO: 7020803 - DNA, 20 bp, Homo sapiens
ttggcagcagttccaagtga

SEQ ID NO: 7020804 - DNA, 22 bp, Homo sapiens
atagcactggtttttcttggtt

SEQ ID NO: 7020805 - DNA, 20 bp, Homo sapiens
tgtggccatgttccaactca

SEQ ID NO: 7020806 - DNA, 22 bp, Homo sapiens
tctcagtccaaatgagaggttg

SEQ ID NO: 7020807 - DNA, 22 bp, Homo sapiens
tctgatataaaagtgacattca

SEQ ID NO: 7020808 - DNA, 22 bp, Homo sapiens
ctggggcagagcccagcaattt

SEQ ID NO: 7020809 - DNA, 22 bp, Homo sapiens
ggagagaaattgaggtagcaag

SEQ ID NO: 7020810 - DNA, 22 bp, Homo sapiens
tggccagattcatgcatgtatc

SEQ ID NO: 7020811 - DNA, 22 bp, Homo sapiens
ggcagccctgtggagaggccca

SEQ ID NO: 7020812 - DNA, 22 bp, Homo sapiens
tgagcttgcagtgccagccttg

SEQ ID NO: 7020813 - DNA, 22 bp, Homo sapiens
ttctgagatacttttggcacca

SEQ ID NO: 7020814 - DNA, 22 bp, Homo sapiens
acctgaatccccagggccttcc

SEQ ID NO: 7020815 - DNA, 18 bp, Homo sapiens
agcaggcgttgcctggga

SEQ ID NO: 7020816 - DNA, 22 bp, Homo sapiens
gtactaaacagagaaccaatat

SEQ ID NO: 7020817 - DNA, 22 bp, Homo sapiens
agctgtatttgtgaatatttaa

SEQ ID NO: 7020818 - DNA, 22 bp, Homo sapiens
catcagtcagtcaacgcagttt

SEQ ID NO: 7020819 - DNA, 18 bp, Homo sapiens
attaaggctttgatagta

SEQ ID NO: 7020820 - DNA, 22 bp, Homo sapiens
ggctgctttggctggggcccta

SEQ ID NO: 7020821 - DNA, 22 bp, Homo sapiens
agtgtcatcgtgaaaacatagc

SEQ ID NO: 7020822 - DNA, 22 bp, Homo sapiens
ggctgcagaggtcactttatag

SEQ ID NO: 7020823 - DNA, 22 bp, Homo sapiens
actcagacttgcttcctggtgc

SEQ ID NO: 7020824 - DNA, 22 bp, Homo sapiens
cctcctttcctgttttcctgag

SEQ ID NO: 7020825 - DNA, 22 bp, Homo sapiens
catttgtgcttttataaaatag

SEQ ID NO: 7020826 - DNA, 22 bp, Homo sapiens
gagggatggtagttgacactga

SEQ ID NO: 7020827 - DNA, 22 bp, Homo sapiens
gctttcagccactgtgtttctg

SEQ ID NO: 7020828 - DNA, 22 bp, Homo sapiens
cagcaggaaacttaaaggtaat

SEQ ID NO: 7020829 - DNA, 22 bp, Homo sapiens
tggaacaccttgctccagaaag

SEQ ID NO: 7020830 - DNA, 22 bp, Homo sapiens
agcataaaggacatttgtcact

SEQ ID NO: 7020831 - DNA, 22 bp, Homo sapiens
ctgatcattgttgttgctgtaa

SEQ ID NO: 7020832 - DNA, 22 bp, Homo sapiens
gctggctctcctcacagtacag

SEQ ID NO: 7020833 - DNA, 22 bp, Homo sapiens
agatacaactcagaagtgtggt

SEQ ID NO: 7020834 - DNA, 22 bp, Homo sapiens
aaagatgcctaactcagaagat

SEQ ID NO: 7020835 - DNA, 22 bp, Homo sapiens
tcatttatagctaaccttgaat

SEQ ID NO: 7020836 - DNA, 22 bp, Homo sapiens
tcctgagggcattttggtgact

SEQ ID NO: 7020837 - DNA, 22 bp, Homo sapiens
tgcattgatagaaaaacatgga

SEQ ID NO: 7020838 - DNA, 22 bp, Homo sapiens
tatcttcagctgaagcagagtc

SEQ ID NO: 7020839 - DNA, 22 bp, Homo sapiens
ccagctctgattttgacctcca

SEQ ID NO: 7020840 - DNA, 22 bp, Homo sapiens
accatgccagtggcagccagac

SEQ ID NO: 7020841 - DNA, 22 bp, Homo sapiens
ctacccagagtgaatctcttaa

SEQ ID NO: 7020842 - DNA, 22 bp, Homo sapiens
tgctgtcctgctgagggatgtg

SEQ ID NO: 7020843 - DNA, 22 bp, Homo sapiens
attcagtttcatggcacagcta

SEQ ID NO: 7020844 - DNA, 22 bp, Homo sapiens
cctaactttcattaggccccag

SEQ ID NO: 7020845 - DNA, 22 bp, Homo sapiens
agtcctgtgagtttttctagtt

SEQ ID NO: 7020846 - DNA, 22 bp, Homo sapiens
aacacagtttctctatgagagt

SEQ ID NO: 7020847 - DNA, 21 bp, Homo sapiens
agcaaggcagcctctcagcct

SEQ ID NO: 7020848 - DNA, 22 bp, Homo sapiens
ctctggatgaggtcctgtctgt

SEQ ID NO: 7020849 - DNA, 20 bp, Homo sapiens
aaaagcagccagagatggta

SEQ ID NO: 7020850 - DNA, 22 bp, Homo sapiens
acttgcatgttatttttatagg

SEQ ID NO: 7020851 - DNA, 22 bp, Homo sapiens
acagaagtccccatgaagaagc

SEQ ID NO: 7020852 - DNA, 17 bp, Homo sapiens
agagagaaaagggccat

SEQ ID NO: 7020853 - DNA, 22 bp, Homo sapiens
tctctagtgaagggctttccaa

SEQ ID NO: 7020854 - DNA, 22 bp, Homo sapiens
aaattgctaaggatctcatgtg

SEQ ID NO: 7020855 - DNA, 21 bp, Homo sapiens
attgttagtaatagtccacac

SEQ ID NO: 7020856 - DNA, 22 bp, Homo sapiens
tcttcaattagatttaccaatt

SEQ ID NO: 7020857 - DNA, 22 bp, Homo sapiens
atcagtctgttggaatatcgct

SEQ ID NO: 7020858 - DNA, 22 bp, Homo sapiens
tgggatgtggccatggttctct

SEQ ID NO: 7020859 - DNA, 22 bp, Homo sapiens
ggctctgctcctggtgccagtg

SEQ ID NO: 7020860 - DNA, 22 bp, Homo sapiens
ctgttttaagtggcgtgtggta

SEQ ID NO: 7020861 - DNA, 19 bp, Homo sapiens
tgccaggaatactccagaa

SEQ ID NO: 7020862 - DNA, 22 bp, Homo sapiens
tcatggggaaagcccgccctca

SEQ ID NO: 7020863 - DNA, 22 bp, Homo sapiens
tcattgtaattatctgtggtat

SEQ ID NO: 7020864 - DNA, 22 bp, Homo sapiens
cctgcacatgtgtgcgcctgta

SEQ ID NO: 7020865 - DNA, 22 bp, Homo sapiens
agaggcaccatctggaacagcc

SEQ ID NO: 7020866 - DNA, 22 bp, Homo sapiens
tttgcttaactggtagaatgcg

SEQ ID NO: 7020867 - DNA, 22 bp, Homo sapiens
gcccagcactcctctctgacat

SEQ ID NO: 7020868 - DNA, 22 bp, Homo sapiens
tgagtctcaggtttcccgtgcc

SEQ ID NO: 7020869 - DNA, 22 bp, Homo sapiens
tagtagtatcacaaagtaaaat

SEQ ID NO: 7020870 - DNA, 22 bp, Homo sapiens
ccttggtccctccccagaccaa

SEQ ID NO: 7020871 - DNA, 22 bp, Homo sapiens
aacttctctgaagtgacctgtt

SEQ ID NO: 7020872 - DNA, 22 bp, Homo sapiens
taagtcttgaaatatttcctat

SEQ ID NO: 7020873 - DNA, 22 bp, Homo sapiens
gatttagagcaggaatgcatgg

SEQ ID NO: 7020874 - DNA, 23 bp, Homo sapiens
ttgggctggctctcgatgcctct

SEQ ID NO: 7020875 - DNA, 22 bp, Homo sapiens
ttcacccactagagaactcagg

SEQ ID NO: 7020876 - DNA, 22 bp, Homo sapiens
ttcatgatggcaagggccgtga

SEQ ID NO: 7020877 - DNA, 22 bp, Homo sapiens
cattggtcttctaacagagaga

SEQ ID NO: 7020878 - DNA, 20 bp, Homo sapiens
gtgaaggctaagcacagagg

SEQ ID NO: 7020879 - DNA, 22 bp, Homo sapiens
ccacactgaccagctgtgagac

SEQ ID NO: 7020880 - DNA, 22 bp, Homo sapiens
acaagcacttcactgtcctctg

SEQ ID NO: 7020881 - DNA, 22 bp, Homo sapiens
tgggtggttgctgaggctcctt

SEQ ID NO: 7020882 - DNA, 22 bp, Homo sapiens
tttaattctggcataatagctc

SEQ ID NO: 7020883 - DNA, 22 bp, Homo sapiens
tctgagtgtgactggttaatga

SEQ ID NO: 7020884 - DNA, 22 bp, Homo sapiens
tgcctagtggccttatgagtat

SEQ ID NO: 7020885 - DNA, 22 bp, Homo sapiens
ttaagtctaggaggaactaggt

SEQ ID NO: 7020886 - DNA, 22 bp, Homo sapiens
ctttccaggtctaaaggcaggg

SEQ ID NO: 7020887 - DNA, 22 bp, Homo sapiens
aatcacatctcattcaacagcc

SEQ ID NO: 7020888 - DNA, 22 bp, Homo sapiens
acagctaacttaaactaaccta

SEQ ID NO: 7020889 - DNA, 22 bp, Homo sapiens
catgctgtgtgttttagctcca

SEQ ID NO: 7020890 - DNA, 22 bp, Homo sapiens
acactatacttccattgctggt

SEQ ID NO: 7020891 - DNA, 22 bp, Homo sapiens
agttcacaccaaagttaggtag

SEQ ID NO: 7020892 - DNA, 22 bp, Homo sapiens
agcttagtcactcttaaattta

SEQ ID NO: 7020893 - DNA, 22 bp, Homo sapiens
gcaccacatcaatgaggggagc

SEQ ID NO: 7020894 - DNA, 23 bp, Homo sapiens
tgtctggttcatgcttattttgg

SEQ ID NO: 7020895 - DNA, 22 bp, Homo sapiens
acagcaaaggacgaacactctg

SEQ ID NO: 7020896 - DNA, 22 bp, Homo sapiens
attagggaaactgacttgtctc

SEQ ID NO: 7020897 - DNA, 22 bp, Homo sapiens
tgatggctggaagttcaaaaat

SEQ ID NO: 7020898 - DNA, 22 bp, Homo sapiens
ccaaaggccaggcactgaggtt

SEQ ID NO: 7020899 - DNA, 22 bp, Homo sapiens
ttgcatgttccaaagaattttg

SEQ ID NO: 7020900 - DNA, 22 bp, Homo sapiens
agggcacagcctaaagcctatg

SEQ ID NO: 7020901 - DNA, 22 bp, Homo sapiens
tttatagatgtctgtattataa

SEQ ID NO: 7020902 - DNA, 22 bp, Homo sapiens
tctagatgaatgtgaggatatc

SEQ ID NO: 7020903 - DNA, 22 bp, Homo sapiens
tgtatgtgtatgtacatatgca

SEQ ID NO: 7020904 - DNA, 23 bp, Homo sapiens
ggggaagtggcagtgagtgaggc

SEQ ID NO: 7020905 - DNA, 22 bp, Homo sapiens
aagccaggtgtgcccaggatcc

SEQ ID NO: 7020906 - DNA, 22 bp, Homo sapiens
cctggggaaaagcaggcattta

SEQ ID NO: 7020907 - DNA, 22 bp, Homo sapiens
agcataaaggcactagaaagag

SEQ ID NO: 7020908 - DNA, 22 bp, Homo sapiens
ccacagtctatgcaacaaggtc

SEQ ID NO: 7020909 - DNA, 20 bp, Homo sapiens
tctgaagaaagacagggact

SEQ ID NO: 7020910 - DNA, 20 bp, Homo sapiens
acagttgacattgctctgtg

SEQ ID NO: 7020911 - DNA, 22 bp, Homo sapiens
tggcaagaaactgaggcctgct

SEQ ID NO: 7020912 - DNA, 23 bp, Homo sapiens
tgctgtccaacagactggccatg

SEQ ID NO: 7020913 - DNA, 22 bp, Homo sapiens
gtcactttaaagggttaacagg

SEQ ID NO: 7020914 - DNA, 22 bp, Homo sapiens
gcagcatctagggcactggcct

SEQ ID NO: 7020915 - DNA, 22 bp, Homo sapiens
aagcccagtaccttcagtgagg

SEQ ID NO: 7020916 - DNA, 22 bp, Homo sapiens
gaacatatgcatgtttgttttg

SEQ ID NO: 7020917 - DNA, 23 bp, Homo sapiens
ggcactgaagctacaatggtgag

SEQ ID NO: 7020918 - DNA, 22 bp, Homo sapiens
caatgattctgcaactgtgtgc

SEQ ID NO: 7020919 - DNA, 21 bp, Homo sapiens
tgggggtgaggcctaggaatc

SEQ ID NO: 7020920 - DNA, 22 bp, Homo sapiens
ctctggccagagcctgcgggaa

SEQ ID NO: 7020921 - DNA, 22 bp, Homo sapiens
atctagaggagggctgctggat

SEQ ID NO: 7020922 - DNA, 22 bp, Homo sapiens
tttctagatgatacggtatgtg

SEQ ID NO: 7020923 - DNA, 22 bp, Homo sapiens
catgttgattagagagcttaga

SEQ ID NO: 7020924 - DNA, 19 bp, Homo sapiens
agctggggcggtgtgtgtt

SEQ ID NO: 7020925 - DNA, 22 bp, Homo sapiens
cagccagtcccatttcaaatag

SEQ ID NO: 7020926 - DNA, 22 bp, Homo sapiens
tggcagcacaaggtggcccatg

SEQ ID NO: 7020927 - DNA, 22 bp, Homo sapiens
ctcagtccttatttgcctctac

SEQ ID NO: 7020928 - DNA, 22 bp, Homo sapiens
tagattcttgaaccagtgcctc

SEQ ID NO: 7020929 - DNA, 22 bp, Homo sapiens
aagtgcttttttcttgaggcca

SEQ ID NO: 7020930 - DNA, 22 bp, Homo sapiens
tatttcttgagtggtcagtttc

SEQ ID NO: 7020931 - DNA, 19 bp, Homo sapiens
tgctgactgggcctcaccg

SEQ ID NO: 7020932 - DNA, 22 bp, Homo sapiens
tgatgtgtgggcatgcagacag

SEQ ID NO: 7020933 - DNA, 22 bp, Homo sapiens
agctgctcattcccagcacatg

SEQ ID NO: 7020934 - DNA, 22 bp, Homo sapiens
aaggcagtcagttgttttgaaa

SEQ ID NO: 7020935 - DNA, 22 bp, Homo sapiens
agtgtcccctctgaggagtgag

SEQ ID NO: 7020936 - DNA, 22 bp, Homo sapiens
tgcatattctcctttattttgt

SEQ ID NO: 7020937 - DNA, 22 bp, Homo sapiens
gtgttcaggctgacttggagag

SEQ ID NO: 7020938 - DNA, 22 bp, Homo sapiens
acatgggttattgtgaggttaa

SEQ ID NO: 7020939 - DNA, 22 bp, Homo sapiens
ctttctggacaagacagaggga

SEQ ID NO: 7020940 - DNA, 22 bp, Homo sapiens
tcttagatgaataaaaagttat

SEQ ID NO: 7020941 - DNA, 23 bp, Homo sapiens
ccttgtctggctggctggacttt

SEQ ID NO: 7020942 - DNA, 22 bp, Homo sapiens
tctccttgctacccagtatgtc

SEQ ID NO: 7020943 - DNA, 22 bp, Homo sapiens
tggccactcagggatgcaggaa

SEQ ID NO: 7020944 - DNA, 22 bp, Homo sapiens
gggtgcaactaagaagaggtga

SEQ ID NO: 7020945 - DNA, 19 bp, Homo sapiens
aggcttcaggccacatgct

SEQ ID NO: 7020946 - DNA, 22 bp, Homo sapiens
gctttctaggcagagatgactg

SEQ ID NO: 7020947 - DNA, 22 bp, Homo sapiens
ctgggttgcaaagcgctggctg

SEQ ID NO: 7020948 - DNA, 22 bp, Homo sapiens
tgcaaggcccagacaagagctc

SEQ ID NO: 7020949 - DNA, 20 bp, Homo sapiens
gatgtcttttctggtctcct

SEQ ID NO: 7020950 - DNA, 22 bp, Homo sapiens
agccagactcatttggaagtat

SEQ ID NO: 7020951 - DNA, 22 bp, Homo sapiens
ctggctgtgcagtcttccagaa

SEQ ID NO: 7020952 - DNA, 22 bp, Homo sapiens
tggatctatctccaggggtcct

SEQ ID NO: 7020953 - DNA, 22 bp, Homo sapiens
tcgagctctggagccaaggatg

SEQ ID NO: 7020954 - DNA, 22 bp, Homo sapiens
gtgtggggtcttctcttggcct

SEQ ID NO: 7020955 - DNA, 22 bp, Homo sapiens
ggtgaggggagagtgaaagaaa

SEQ ID NO: 7020956 - DNA, 22 bp, Homo sapiens
ggctccagggagtggagagaag

SEQ ID NO: 7020957 - DNA, 22 bp, Homo sapiens
tcgaaaatgaagagtcaattaa

SEQ ID NO: 7020958 - DNA, 22 bp, Homo sapiens
ctttcataaggggttttataat

SEQ ID NO: 7020959 - DNA, 22 bp, Homo sapiens
ctattattagcaaaaggtggat

SEQ ID NO: 7020960 - DNA, 22 bp, Homo sapiens
tgcctgccaggcaacctgggag

SEQ ID NO: 7020961 - DNA, 22 bp, Homo sapiens
ggttgaatatctttatgttggt

SEQ ID NO: 7020962 - DNA, 22 bp, Homo sapiens
tgattccaaagaatttaagttc

SEQ ID NO: 7020963 - DNA, 22 bp, Homo sapiens
ttccataatcaccttattcttt

SEQ ID NO: 7020964 - DNA, 22 bp, Homo sapiens
agggctctgttggggtcagcac

SEQ ID NO: 7020965 - DNA, 22 bp, Homo sapiens
agtagccattcttttatttctt

SEQ ID NO: 7020966 - DNA, 22 bp, Homo sapiens
ggtcctttgccatctctccacc

SEQ ID NO: 7020967 - DNA, 22 bp, Homo sapiens
tttctcatggaacatagctcct

SEQ ID NO: 7020968 - DNA, 18 bp, Homo sapiens
aatttctttgacaactta

SEQ ID NO: 7020969 - DNA, 18 bp, Homo sapiens
tgaggctcagctcctggt

SEQ ID NO: 7020970 - DNA, 22 bp, Homo sapiens
cagagtcaatgtccaagaagct

SEQ ID NO: 7020971 - DNA, 22 bp, Homo sapiens
taggccacagagaggagatttc

SEQ ID NO: 7020972 - DNA, 22 bp, Homo sapiens
agctgcagataggatgttattt

SEQ ID NO: 7020973 - DNA, 20 bp, Homo sapiens
gtcttcataatgaccttatt

SEQ ID NO: 7020974 - DNA, 22 bp, Homo sapiens
gtacacttgactcataggaaat

SEQ ID NO: 7020975 - DNA, 22 bp, Homo sapiens
ctgggtggaaagtgctgagaat

SEQ ID NO: 7020976 - DNA, 22 bp, Homo sapiens
atgtgtcttgcggcagttggta

SEQ ID NO: 7020977 - DNA, 22 bp, Homo sapiens
cttgtcagtcaaggtgtgcagg

SEQ ID NO: 7020978 - DNA, 22 bp, Homo sapiens
attaggcagacaacgtagccgg

SEQ ID NO: 7020979 - DNA, 22 bp, Homo sapiens
tttacacttattatgaagcttt

SEQ ID NO: 7020980 - DNA, 22 bp, Homo sapiens
ctgacagtaactaatgtggaga

SEQ ID NO: 7020981 - DNA, 20 bp, Homo sapiens
gctggctttcctaaactgct

SEQ ID NO: 7020982 - DNA, 22 bp, Homo sapiens
ttcctgtgtacgtgtttcgctg

SEQ ID NO: 7020983 - DNA, 22 bp, Homo sapiens
ccattttgtctgacttcttgct

SEQ ID NO: 7020984 - DNA, 23 bp, Homo sapiens
tttgcaaattggacacaaccaca

SEQ ID NO: 7020985 - DNA, 22 bp, Homo sapiens
acactgaatcagaaattgttgg

SEQ ID NO: 7020986 - DNA, 22 bp, Homo sapiens
ggagagcagggaggctgctctg

SEQ ID NO: 7020987 - DNA, 22 bp, Homo sapiens
gagctggcaagtctgtccttgg

SEQ ID NO: 7020988 - DNA, 22 bp, Homo sapiens
cttctgttactgttagctgaag

SEQ ID NO: 7020989 - DNA, 22 bp, Homo sapiens
gtgtgccaccagtcaaggtgaa

SEQ ID NO: 7020990 - DNA, 20 bp, Homo sapiens
caggcagaggatgctgacca

SEQ ID NO: 7020991 - DNA, 22 bp, Homo sapiens
tgaggtaggtgtcgagagaggt

SEQ ID NO: 7020992 - DNA, 22 bp, Homo sapiens
aaactcaaattaaactagctta

SEQ ID NO: 7020993 - DNA, 19 bp, Homo sapiens
tagaatagttacacagatt

SEQ ID NO: 7020994 - DNA, 22 bp, Homo sapiens
gtataaagtataagcttgtttt

SEQ ID NO: 7020995 - DNA, 22 bp, Homo sapiens
aaaggttaatgttgtcatgtta

SEQ ID NO: 7020996 - DNA, 22 bp, Homo sapiens
ccaagataatctgtgaaaaatc

SEQ ID NO: 7020997 - DNA, 22 bp, Homo sapiens
aaaacattgaattgcacactat

SEQ ID NO: 7020998 - DNA, 22 bp, Homo sapiens
cctggatccatgaaaaggctac

SEQ ID NO: 7020999 - DNA, 22 bp, Homo sapiens
atcacagggtgaggattagacc

SEQ ID NO: 7021000 - DNA, 23 bp, Homo sapiens
tctggctttgctggaagttttga

SEQ ID NO: 7021001 - DNA, 22 bp, Homo sapiens
tggccttggccttttctgctcc

SEQ ID NO: 7021002 - DNA, 22 bp, Homo sapiens
gggctctgtggatgtgagagct

SEQ ID NO: 7021003 - DNA, 22 bp, Homo sapiens
aattgcttatcttgttgaatag

SEQ ID NO: 7021004 - DNA, 22 bp, Homo sapiens
ctgtgccctttcgctgcactgt

SEQ ID NO: 7021005 - DNA, 22 bp, Homo sapiens
gcggtggagccaggcctgggct

SEQ ID NO: 7021006 - DNA, 22 bp, Homo sapiens
cttgaaggacagcatctccgag

SEQ ID NO: 7021007 - DNA, 22 bp, Homo sapiens
tattcttgtcttttccagaaat

SEQ ID NO: 7021008 - DNA, 22 bp, Homo sapiens
tctgaaggaaaagggtagatat

SEQ ID NO: 7021009 - DNA, 22 bp, Homo sapiens
ttgcaaaggggaataaagcaat

SEQ ID NO: 7021010 - DNA, 22 bp, Homo sapiens
ctgttaaatgagaaagcagact

SEQ ID NO: 7021011 - DNA, 22 bp, Homo sapiens
gtggaagctgatgggagacagg

SEQ ID NO: 7021012 - DNA, 22 bp, Homo sapiens
tgggaagatgataattcacagt

SEQ ID NO: 7021013 - DNA, 22 bp, Homo sapiens
cctgctgtagggcccctggggc

SEQ ID NO: 7021014 - DNA, 19 bp, Homo sapiens
ccagtgcaaggtaagatag

SEQ ID NO: 7021015 - DNA, 22 bp, Homo sapiens
gaagttacaggcttatgggggc

SEQ ID NO: 7021016 - DNA, 22 bp, Homo sapiens
ccactgtttttcagttaacttt

SEQ ID NO: 7021017 - DNA, 22 bp, Homo sapiens
attactgaggcaaagtagtttt

SEQ ID NO: 7021018 - DNA, 22 bp, Homo sapiens
tactttgtgccaggcactgggt

SEQ ID NO: 7021019 - DNA, 22 bp, Homo sapiens
agggctgacagtgaggagtcaa

SEQ ID NO: 7021020 - DNA, 22 bp, Homo sapiens
tggagatccttcattttggtgt

SEQ ID NO: 7021021 - DNA, 22 bp, Homo sapiens
ggctgacttttatgcacactaa

SEQ ID NO: 7021022 - DNA, 22 bp, Homo sapiens
tttctcagcctccttgctggag

SEQ ID NO: 7021023 - DNA, 22 bp, Homo sapiens
tgaccctggcagcccactggcc

SEQ ID NO: 7021024 - DNA, 22 bp, Homo sapiens
aagctttgactactgcctcttg

SEQ ID NO: 7021025 - DNA, 22 bp, Homo sapiens
gccacagggaggcgttttcagg

SEQ ID NO: 7021026 - DNA, 16 bp, Homo sapiens
gccctttccttggctg

SEQ ID NO: 7021027 - DNA, 17 bp, Homo sapiens
gtaatataataagcctt

SEQ ID NO: 7021028 - DNA, 22 bp, Homo sapiens
attacaatcgagagaaacaaat

SEQ ID NO: 7021029 - DNA, 22 bp, Homo sapiens
cttcctctcaataagatgagaa

SEQ ID NO: 7021030 - DNA, 22 bp, Homo sapiens
aagatgttactcaaccaggata

SEQ ID NO: 7021031 - DNA, 22 bp, Homo sapiens
gctggttcttttccgtattata

SEQ ID NO: 7021032 - DNA, 22 bp, Homo sapiens
tggcaagcagagtctggtgggg

SEQ ID NO: 7021033 - DNA, 22 bp, Homo sapiens
agaatgtgtgattgaagctctt

SEQ ID NO: 7021034 - DNA, 22 bp, Homo sapiens
tctgcatattgttaatggaatg

SEQ ID NO: 7021035 - DNA, 22 bp, Homo sapiens
ttctttctgaatacagttgagt

SEQ ID NO: 7021036 - DNA, 22 bp, Homo sapiens
tctctgcacagaagtagatagc

SEQ ID NO: 7021037 - DNA, 21 bp, Homo sapiens
gagatgctttttattcaaccc

SEQ ID NO: 7021038 - DNA, 22 bp, Homo sapiens
ttagaacttttcaactccattc

SEQ ID NO: 7021039 - DNA, 22 bp, Homo sapiens
aaattgtgagactgaaccaaat

SEQ ID NO: 7021040 - DNA, 22 bp, Homo sapiens
tcctggatctactctcaattgg

SEQ ID NO: 7021041 - DNA, 21 bp, Homo sapiens
gttcaaatgggtagattcaca

SEQ ID NO: 7021042 - DNA, 19 bp, Homo sapiens
gaactgaggtctgaggctt

SEQ ID NO: 7021043 - DNA, 21 bp, Homo sapiens
gtgtgctgatacattggagaa

SEQ ID NO: 7021044 - DNA, 20 bp, Homo sapiens
actagaaagtcactgggggg

SEQ ID NO: 7021045 - DNA, 22 bp, Homo sapiens
agcagctgtactttcatctgtt

SEQ ID NO: 7021046 - DNA, 21 bp, Homo sapiens
ttccacagtgagaactgcaag

SEQ ID NO: 7021047 - DNA, 22 bp, Homo sapiens
gtgtcagtccagaggcagccac

SEQ ID NO: 7021048 - DNA, 22 bp, Homo sapiens
cttgttaaaatgcagattccaa

SEQ ID NO: 7021049 - DNA, 22 bp, Homo sapiens
tcagaaggtactgaagacatgg

SEQ ID NO: 7021050 - DNA, 22 bp, Homo sapiens
tacaatgctgtttgtttctact

SEQ ID NO: 7021051 - DNA, 22 bp, Homo sapiens
ctttgtgatgaggcctaagaca

SEQ ID NO: 7021052 - DNA, 22 bp, Homo sapiens
acagaagtgttgaagttttcat

SEQ ID NO: 7021053 - DNA, 22 bp, Homo sapiens
caggaggctcctagggctctgt

SEQ ID NO: 7021054 - DNA, 22 bp, Homo sapiens
caagaagcccttcctgggtgga

SEQ ID NO: 7021055 - DNA, 19 bp, Homo sapiens
taagatggcaagtgtctct

SEQ ID NO: 7021056 - DNA, 22 bp, Homo sapiens
accccaggagctgtgcctagtc

SEQ ID NO: 7021057 - DNA, 22 bp, Homo sapiens
tctcccaagtgaccaggaaaga

SEQ ID NO: 7021058 - DNA, 19 bp, Homo sapiens
caaagtacctggcacagtg

SEQ ID NO: 7021059 - DNA, 22 bp, Homo sapiens
tgactctgaatttatgaaatgg

SEQ ID NO: 7021060 - DNA, 22 bp, Homo sapiens
tgagggtcatttggaagtggaa

SEQ ID NO: 7021061 - DNA, 21 bp, Homo sapiens
aatcatacaaaacatgtcagg

SEQ ID NO: 7021062 - DNA, 22 bp, Homo sapiens
tattactctgccatcaccagta

SEQ ID NO: 7021063 - DNA, 22 bp, Homo sapiens
tgggagcagttgtgaagctcag

SEQ ID NO: 7021064 - DNA, 22 bp, Homo sapiens
acgttttctagagaatatgcag

SEQ ID NO: 7021065 - DNA, 22 bp, Homo sapiens
gatattctggtgaaacctttgg

SEQ ID NO: 7021066 - DNA, 22 bp, Homo sapiens
tcagaacagcacagggtgattt

SEQ ID NO: 7021067 - DNA, 22 bp, Homo sapiens
cccaggctggagtgtaatggtg

SEQ ID NO: 7021068 - DNA, 22 bp, Homo sapiens
taggaaatgaatgcaggctccc

SEQ ID NO: 7021069 - DNA, 22 bp, Homo sapiens
ctgtcccaggagctgtaagaca

SEQ ID NO: 7021070 - DNA, 22 bp, Homo sapiens
ggaaatggagagctacattgga

SEQ ID NO: 7021071 - DNA, 22 bp, Homo sapiens
aatctggggctcttttctctgg

SEQ ID NO: 7021072 - DNA, 22 bp, Homo sapiens
acagagagaaacaatcagcagc

SEQ ID NO: 7021073 - DNA, 22 bp, Homo sapiens
atgactttcctggcaaaagttg

SEQ ID NO: 7021074 - DNA, 22 bp, Homo sapiens
tggatggagactgatatgggta

SEQ ID NO: 7021075 - DNA, 22 bp, Homo sapiens
aacgacatctgtgtagggcatc

SEQ ID NO: 7021076 - DNA, 22 bp, Homo sapiens
agccagtgtcgtgtgacatgag

SEQ ID NO: 7021077 - DNA, 22 bp, Homo sapiens
tgaattgtggctttttccaatt

SEQ ID NO: 7021078 - DNA, 22 bp, Homo sapiens
gagccagctacatggtctgcaa

SEQ ID NO: 7021079 - DNA, 20 bp, Homo sapiens
acacatatagcagcataaac

SEQ ID NO: 7021080 - DNA, 22 bp, Homo sapiens
tttgagatctcaatgaggacta

SEQ ID NO: 7021081 - DNA, 21 bp, Homo sapiens
tcccagggccaggtgccatca

SEQ ID NO: 7021082 - DNA, 22 bp, Homo sapiens
aatgcagagtaaatatttaatt

SEQ ID NO: 7021083 - DNA, 22 bp, Homo sapiens
ttggaaagattattattatgaa

SEQ ID NO: 7021084 - DNA, 22 bp, Homo sapiens
tgtagaactgacattttggact

SEQ ID NO: 7021085 - DNA, 22 bp, Homo sapiens
atcatgcaataaggtgaggcct

SEQ ID NO: 7021086 - DNA, 22 bp, Homo sapiens
caggaggtgacttccaggggtt

SEQ ID NO: 7021087 - DNA, 22 bp, Homo sapiens
cccaggctggagggcagtgtca

SEQ ID NO: 7021088 - DNA, 22 bp, Homo sapiens
gacctccagcggccctgcagag

SEQ ID NO: 7021089 - DNA, 22 bp, Homo sapiens
ccacagaccttggcttccacct

SEQ ID NO: 7021090 - DNA, 20 bp, Homo sapiens
tggatgtcaaattaggctgg

SEQ ID NO: 7021091 - DNA, 22 bp, Homo sapiens
cttctcagttgcaagtgtcaga

SEQ ID NO: 7021092 - DNA, 22 bp, Homo sapiens
ttacacagaaacactgttcaga

SEQ ID NO: 7021093 - DNA, 22 bp, Homo sapiens
gccagcatagtaagcagtcatc

SEQ ID NO: 7021094 - DNA, 23 bp, Homo sapiens
agtgagcagctgtagggcaagga

SEQ ID NO: 7021095 - DNA, 22 bp, Homo sapiens
atctaattttcactcatttgct

SEQ ID NO: 7021096 - DNA, 22 bp, Homo sapiens
agacaaggcccccttgggctct

SEQ ID NO: 7021097 - DNA, 22 bp, Homo sapiens
tgctctgggattcagcagcctg

SEQ ID NO: 7021098 - DNA, 22 bp, Homo sapiens
ggcactagtgacaaggggacat

SEQ ID NO: 7021099 - DNA, 22 bp, Homo sapiens
tgtcagaactctattgatgtcc

SEQ ID NO: 7021100 - DNA, 22 bp, Homo sapiens
attgaacagaaaaactcagaga

SEQ ID NO: 7021101 - DNA, 23 bp, Homo sapiens
tatctttttcaatgttggaaata

SEQ ID NO: 7021102 - DNA, 22 bp, Homo sapiens
tattagaaaggctattgcatag

SEQ ID NO: 7021103 - DNA, 22 bp, Homo sapiens
ggaaaagacagaattctagaat

SEQ ID NO: 7021104 - DNA, 22 bp, Homo sapiens
ggcataggcactttaatttgga

SEQ ID NO: 7021105 - DNA, 22 bp, Homo sapiens
ggaacagactgacttcttgaat

SEQ ID NO: 7021106 - DNA, 22 bp, Homo sapiens
tcccagaggttgagtcacttat

SEQ ID NO: 7021107 - DNA, 22 bp, Homo sapiens
gggaggaaggcttgggtgagta

SEQ ID NO: 7021108 - DNA, 22 bp, Homo sapiens
ggccagcccagtggtcctctct

SEQ ID NO: 7021109 - DNA, 22 bp, Homo sapiens
tactgtgcaaaaatgaatattg

SEQ ID NO: 7021110 - DNA, 22 bp, Homo sapiens
ggctcagactcccaggccctct

SEQ ID NO: 7021111 - DNA, 22 bp, Homo sapiens
tttctagttctaccacagtaat

SEQ ID NO: 7021112 - DNA, 22 bp, Homo sapiens
atttgctgatggcatttgagct

SEQ ID NO: 7021113 - DNA, 22 bp, Homo sapiens
gggcctctcccttctcacgcat

SEQ ID NO: 7021114 - DNA, 22 bp, Homo sapiens
tatcagtgtgcatctctgaatg

SEQ ID NO: 7021115 - DNA, 22 bp, Homo sapiens
ggaggccacctgacctgctgtt

SEQ ID NO: 7021116 - DNA, 22 bp, Homo sapiens
tctgggtgtcactcctgcctgc

SEQ ID NO: 7021117 - DNA, 22 bp, Homo sapiens
ccagaggtcctgctcactggtg

SEQ ID NO: 7021118 - DNA, 22 bp, Homo sapiens
ttcaactagatttatacaattc

SEQ ID NO: 7021119 - DNA, 22 bp, Homo sapiens
gcgctcaggtgccaggcctgcg

SEQ ID NO: 7021120 - DNA, 22 bp, Homo sapiens
tctctgggtgatggcagggcac

SEQ ID NO: 7021121 - DNA, 22 bp, Homo sapiens
ctgcgcaggggtggcgccagaa

SEQ ID NO: 7021122 - DNA, 22 bp, Homo sapiens
aactgtagcaaagaacagctct

SEQ ID NO: 7021123 - DNA, 22 bp, Homo sapiens
gggctcagaggagtggcctggg

SEQ ID NO: 7021124 - DNA, 22 bp, Homo sapiens
ccaaaagcagctgtctgtgaat

SEQ ID NO: 7021125 - DNA, 22 bp, Homo sapiens
acagcttttatgggaccagcca

SEQ ID NO: 7021126 - DNA, 22 bp, Homo sapiens
tagcagagtagtgcctccagat

SEQ ID NO: 7021127 - DNA, 22 bp, Homo sapiens
cacagtccagactcctggagtt

SEQ ID NO: 7021128 - DNA, 19 bp, Homo sapiens
atggctctgggatcactgc

SEQ ID NO: 7021129 - DNA, 22 bp, Homo sapiens
ccacatgatgaggaagctgaac

SEQ ID NO: 7021130 - DNA, 21 bp, Homo sapiens
acactgcaggtgaagtgcact

SEQ ID NO: 7021131 - DNA, 22 bp, Homo sapiens
gaaggtccagcgtggccaagtc

SEQ ID NO: 7021132 - DNA, 22 bp, Homo sapiens
gagttctgtgattatttgggac

SEQ ID NO: 7021133 - DNA, 22 bp, Homo sapiens
tagccaaagaaggtatatttgt

SEQ ID NO: 7021134 - DNA, 22 bp, Homo sapiens
atagtgattgaaaacattctgt

SEQ ID NO: 7021135 - DNA, 22 bp, Homo sapiens
agtatatcacatgtagtaatgg

SEQ ID NO: 7021136 - DNA, 22 bp, Homo sapiens
tccagtgctgtttccaatgtaa

SEQ ID NO: 7021137 - DNA, 22 bp, Homo sapiens
tcataggaatgatattttatct

SEQ ID NO: 7021138 - DNA, 22 bp, Homo sapiens
acaagaaccaaagaaggatatt

SEQ ID NO: 7021139 - DNA, 22 bp, Homo sapiens
tcactttgacggccaacttcta

SEQ ID NO: 7021140 - DNA, 23 bp, Homo sapiens
gatgtgtagggaaagtcagactc

SEQ ID NO: 7021141 - DNA, 22 bp, Homo sapiens
aggttaggaagatacagaatgt

SEQ ID NO: 7021142 - DNA, 22 bp, Homo sapiens
acatttgatatggagttgtgta

SEQ ID NO: 7021143 - DNA, 23 bp, Homo sapiens
tcctttgtctttgcatagatggt

SEQ ID NO: 7021144 - DNA, 22 bp, Homo sapiens
gtgacagtgacagctagatagt

SEQ ID NO: 7021145 - DNA, 22 bp, Homo sapiens
tatcataagttaattaaacagt

SEQ ID NO: 7021146 - DNA, 22 bp, Homo sapiens
aaaaagtctgcaaaggaggttg

SEQ ID NO: 7021147 - DNA, 22 bp, Homo sapiens
atttctgctactgcaccctagt

SEQ ID NO: 7021148 - DNA, 22 bp, Homo sapiens
cagctcccagaactgaccatgt

SEQ ID NO: 7021149 - DNA, 22 bp, Homo sapiens
aaataaaggaactgttttccca

SEQ ID NO: 7021150 - DNA, 22 bp, Homo sapiens
ttataaggtgccctgtgtccag

SEQ ID NO: 7021151 - DNA, 22 bp, Homo sapiens
cacagcttctccccgctgcggc

SEQ ID NO: 7021152 - DNA, 22 bp, Homo sapiens
tgggccagcactgggtgctcat

SEQ ID NO: 7021153 - DNA, 22 bp, Homo sapiens
tgtgtataggttgtgctaatag

SEQ ID NO: 7021154 - DNA, 22 bp, Homo sapiens
tttgaagactactgggagtgaa

SEQ ID NO: 7021155 - DNA, 22 bp, Homo sapiens
tggcaagtggcttgtatacgcc

SEQ ID NO: 7021156 - DNA, 22 bp, Homo sapiens
gcacagccacgtaatgtggtca

SEQ ID NO: 7021157 - DNA, 22 bp, Homo sapiens
aggtttctactgtgttaagaaa

SEQ ID NO: 7021158 - DNA, 22 bp, Homo sapiens
gctttggaaataagaggctaaa

SEQ ID NO: 7021159 - DNA, 22 bp, Homo sapiens
tacagtatttgaagaatatgag

SEQ ID NO: 7021160 - DNA, 20 bp, Homo sapiens
aggtaatgggagaaaatgtt

SEQ ID NO: 7021161 - DNA, 22 bp, Homo sapiens
ggagacagcaggaagaaatatc

SEQ ID NO: 7021162 - DNA, 22 bp, Homo sapiens
gtgtctgcacataggatctcaa

SEQ ID NO: 7021163 - DNA, 22 bp, Homo sapiens
gtgctaggtactttgatcggtt

SEQ ID NO: 7021164 - DNA, 22 bp, Homo sapiens
cagggccccagggatgtctgct

SEQ ID NO: 7021165 - DNA, 22 bp, Homo sapiens
tgcaggtcatgtggcgggactg

SEQ ID NO: 7021166 - DNA, 22 bp, Homo sapiens
cagaccagccatttgcctcttc

SEQ ID NO: 7021167 - DNA, 22 bp, Homo sapiens
agttgctcagtaagtcctgagc

SEQ ID NO: 7021168 - DNA, 22 bp, Homo sapiens
tagtccagtaaaacagctaacg

SEQ ID NO: 7021169 - DNA, 22 bp, Homo sapiens
aactttcaggcaatgaatattt

SEQ ID NO: 7021170 - DNA, 22 bp, Homo sapiens
acctccccgggagcagcctcct

SEQ ID NO: 7021171 - DNA, 22 bp, Homo sapiens
caaacttttgaggagttcagga

SEQ ID NO: 7021172 - DNA, 22 bp, Homo sapiens
tagattttttggagactctctg

SEQ ID NO: 7021173 - DNA, 22 bp, Homo sapiens
gcctgctctgacatccatccca

SEQ ID NO: 7021174 - DNA, 17 bp, Homo sapiens
ctgcttggcctctgggg

SEQ ID NO: 7021175 - DNA, 22 bp, Homo sapiens
cagagacagaaaatggatctag

SEQ ID NO: 7021176 - DNA, 22 bp, Homo sapiens
tgactggagacctcagtagggt

SEQ ID NO: 7021177 - DNA, 22 bp, Homo sapiens
gtagttctttctcaatgttcaa

SEQ ID NO: 7021178 - DNA, 22 bp, Homo sapiens
aaggcagtaggatcttccacag

SEQ ID NO: 7021179 - DNA, 22 bp, Homo sapiens
acacactgctcatgaggagcat

SEQ ID NO: 7021180 - DNA, 22 bp, Homo sapiens
atcagacctgtctcctcttgcc

SEQ ID NO: 7021181 - DNA, 22 bp, Homo sapiens
gctccagtggatacagcagtgg

SEQ ID NO: 7021182 - DNA, 22 bp, Homo sapiens
gccatgcaatggaataaaatca

SEQ ID NO: 7021183 - DNA, 20 bp, Homo sapiens
tgacgggaagctgaaggcac

SEQ ID NO: 7021184 - DNA, 22 bp, Homo sapiens
aggtctgtgattcactttgagt

SEQ ID NO: 7021185 - DNA, 21 bp, Homo sapiens
ctgtccacatcacagagcctc

SEQ ID NO: 7021186 - DNA, 22 bp, Homo sapiens
cctctccagttttaacgtgacc

SEQ ID NO: 7021187 - DNA, 22 bp, Homo sapiens
tggcagcctgcgtgaaggagct

SEQ ID NO: 7021188 - DNA, 23 bp, Homo sapiens
tgcttgtcatgacatcaccaagc

SEQ ID NO: 7021189 - DNA, 22 bp, Homo sapiens
catttagagaagattacaagga

SEQ ID NO: 7021190 - DNA, 17 bp, Homo sapiens
taacctctctgaacctg

SEQ ID NO: 7021191 - DNA, 20 bp, Homo sapiens
cagagacccaggcttcagct

SEQ ID NO: 7021192 - DNA, 22 bp, Homo sapiens
aaatactggcaagtgctaattc

SEQ ID NO: 7021193 - DNA, 20 bp, Homo sapiens
ctgtccttttgttggaagac

SEQ ID NO: 7021194 - DNA, 22 bp, Homo sapiens
tgccagggtcagctgcagctct

SEQ ID NO: 7021195 - DNA, 22 bp, Homo sapiens
ctctctctatgcgttgttccta

SEQ ID NO: 7021196 - DNA, 22 bp, Homo sapiens
gctgaaatgaaaacacaggtcg

SEQ ID NO: 7021197 - DNA, 22 bp, Homo sapiens
gtgggagccatttccagtatgc

SEQ ID NO: 7021198 - DNA, 22 bp, Homo sapiens
gtcaggacaggctctggactga

SEQ ID NO: 7021199 - DNA, 22 bp, Homo sapiens
agcagggagaccatctcttcct

SEQ ID NO: 7021200 - DNA, 22 bp, Homo sapiens
ggccttgggaggagggtcagaa

SEQ ID NO: 7021201 - DNA, 22 bp, Homo sapiens
agtttcactaaggtctgtgtgt

SEQ ID NO: 7021202 - DNA, 22 bp, Homo sapiens
ctctccaagttatcaagatgaa

SEQ ID NO: 7021203 - DNA, 22 bp, Homo sapiens
ctgcgtgtctctgtctcatggc

SEQ ID NO: 7021204 - DNA, 19 bp, Homo sapiens
gtggctcatgtagtgggcc

SEQ ID NO: 7021205 - DNA, 22 bp, Homo sapiens
aatttctccagacagctgtgca

SEQ ID NO: 7021206 - DNA, 22 bp, Homo sapiens
agccagagattgagatgcaggc

SEQ ID NO: 7021207 - DNA, 22 bp, Homo sapiens
cctgggcaacatagtgagaccc

SEQ ID NO: 7021208 - DNA, 22 bp, Homo sapiens
gtgggacagcggggtgggacag

SEQ ID NO: 7021209 - DNA, 22 bp, Homo sapiens
aggtggtccctataatgtggga

SEQ ID NO: 7021210 - DNA, 19 bp, Homo sapiens
tcatggaagaaatgtgata

SEQ ID NO: 7021211 - DNA, 22 bp, Homo sapiens
ctacaagcatctatgtttcaag

SEQ ID NO: 7021212 - DNA, 22 bp, Homo sapiens
tgagaagctgctgacttagcct

SEQ ID NO: 7021213 - DNA, 23 bp, Homo sapiens
tggaagtatccccagcaccctag

SEQ ID NO: 7021214 - DNA, 22 bp, Homo sapiens
aagcttcaatgagataattgtt

SEQ ID NO: 7021215 - DNA, 22 bp, Homo sapiens
agcctggggtttcagtttgcac

SEQ ID NO: 7021216 - DNA, 22 bp, Homo sapiens
gggcaagttacttaatctctct

SEQ ID NO: 7021217 - DNA, 22 bp, Homo sapiens
tcccaggatgtgcgtgccgccg

SEQ ID NO: 7021218 - DNA, 22 bp, Homo sapiens
tgaatgtttgatgagaaataga

SEQ ID NO: 7021219 - DNA, 22 bp, Homo sapiens
tggcagatttaacattggaact

SEQ ID NO: 7021220 - DNA, 22 bp, Homo sapiens
tcacatttatttcaaagttact

SEQ ID NO: 7021221 - DNA, 22 bp, Homo sapiens
cttgtcctttacttgagactca

SEQ ID NO: 7021222 - DNA, 22 bp, Homo sapiens
ggcttcagaggagaagagggtg

SEQ ID NO: 7021223 - DNA, 22 bp, Homo sapiens
ctgaatgatataagatctttct

SEQ ID NO: 7021224 - DNA, 22 bp, Homo sapiens
tgacatctctgtgggttcaggt

SEQ ID NO: 7021225 - DNA, 22 bp, Homo sapiens
aaactactttatagtgccttca

SEQ ID NO: 7021226 - DNA, 22 bp, Homo sapiens
tttcctggaagttattcctcat

SEQ ID NO: 7021227 - DNA, 22 bp, Homo sapiens
tggccagtagataggcaggcaa

SEQ ID NO: 7021228 - DNA, 22 bp, Homo sapiens
ctctattagtctttgctaaata

SEQ ID NO: 7021229 - DNA, 22 bp, Homo sapiens
tggccaggaggctgcttctgac

SEQ ID NO: 7021230 - DNA, 20 bp, Homo sapiens
agttatagtatctagccatg

SEQ ID NO: 7021231 - DNA, 22 bp, Homo sapiens
tatattaaccatagggttctag

SEQ ID NO: 7021232 - DNA, 22 bp, Homo sapiens
gcctctgggttggtgacaggct

SEQ ID NO: 7021233 - DNA, 22 bp, Homo sapiens
gcatatgatcacgtgtgtcggt

SEQ ID NO: 7021234 - DNA, 22 bp, Homo sapiens
ggcagctgggtcacaccgatct

SEQ ID NO: 7021235 - DNA, 22 bp, Homo sapiens
acagcagttactgaaataaagt

SEQ ID NO: 7021236 - DNA, 20 bp, Homo sapiens
aaatgctgtaatgtttggga

SEQ ID NO: 7021237 - DNA, 22 bp, Homo sapiens
atgggtgcagcatggtgggaac

SEQ ID NO: 7021238 - DNA, 22 bp, Homo sapiens
ccagctcccattcttcacctgt

SEQ ID NO: 7021239 - DNA, 22 bp, Homo sapiens
tctacattccttttataatatc

SEQ ID NO: 7021240 - DNA, 22 bp, Homo sapiens
tggtgaatagtagcttcagact

SEQ ID NO: 7021241 - DNA, 22 bp, Homo sapiens
tctgtgtgttgtcaggaggatt

SEQ ID NO: 7021242 - DNA, 19 bp, Homo sapiens
gagtgatggatctccttgc

SEQ ID NO: 7021243 - DNA, 22 bp, Homo sapiens
agagtcagcttatgacacagtc

SEQ ID NO: 7021244 - DNA, 21 bp, Homo sapiens
ccaggactccatggggtctct

SEQ ID NO: 7021245 - DNA, 21 bp, Homo sapiens
gagtaaacaggatggtgacct

SEQ ID NO: 7021246 - DNA, 22 bp, Homo sapiens
cagtctctgggaaagaggacag

SEQ ID NO: 7021247 - DNA, 22 bp, Homo sapiens
cagactgtgagctccttgaggg

SEQ ID NO: 7021248 - DNA, 22 bp, Homo sapiens
cagatctgtagtaaaagatctc

SEQ ID NO: 7021249 - DNA, 22 bp, Homo sapiens
aagaatgttagtttctgataca

SEQ ID NO: 7021250 - DNA, 22 bp, Homo sapiens
catggccagcccccagttcctc

SEQ ID NO: 7021251 - DNA, 22 bp, Homo sapiens
aggtggcccagctgacagatag

SEQ ID NO: 7021252 - DNA, 20 bp, Homo sapiens
cttcaaaggcagtaacagcc

SEQ ID NO: 7021253 - DNA, 22 bp, Homo sapiens
gcctggattacaaacagccaac

SEQ ID NO: 7021254 - DNA, 22 bp, Homo sapiens
aaagacagagctgtaggggaaa

SEQ ID NO: 7021255 - DNA, 22 bp, Homo sapiens
acttgcatgatattcaacagag

SEQ ID NO: 7021256 - DNA, 22 bp, Homo sapiens
aacaggtagggactctaacttg

SEQ ID NO: 7021257 - DNA, 21 bp, Homo sapiens
ttcaaaatggtgtgtttgtct

SEQ ID NO: 7021258 - DNA, 22 bp, Homo sapiens
gaccagtcattactcatgccct

SEQ ID NO: 7021259 - DNA, 20 bp, Homo sapiens
atacacattcatagaaaaat

SEQ ID NO: 7021260 - DNA, 22 bp, Homo sapiens
tcaccagggaggcttaacttat

SEQ ID NO: 7021261 - DNA, 22 bp, Homo sapiens
ccagtgttctggtgttcatttc

SEQ ID NO: 7021262 - DNA, 22 bp, Homo sapiens
tgcattatacatggatctaaag

SEQ ID NO: 7021263 - DNA, 22 bp, Homo sapiens
ctcaggtagagtctgcatgggg

SEQ ID NO: 7021264 - DNA, 22 bp, Homo sapiens
tgcagtgtagaaaaagagtgag

SEQ ID NO: 7021265 - DNA, 22 bp, Homo sapiens
tgaactcatactaaaaaatatt

SEQ ID NO: 7021266 - DNA, 22 bp, Homo sapiens
ttgaataatatgttcaggagga

SEQ ID NO: 7021267 - DNA, 22 bp, Homo sapiens
cagtggcaatgggacagagcac

SEQ ID NO: 7021268 - DNA, 22 bp, Homo sapiens
tactgcattaaatttaggttat

SEQ ID NO: 7021269 - DNA, 22 bp, Homo sapiens
gatatgcacattcaaaaattgc

SEQ ID NO: 7021270 - DNA, 22 bp, Homo sapiens
gagaggccacctgacgagcagt

SEQ ID NO: 7021271 - DNA, 16 bp, Homo sapiens
cctggatcccctgtgg

SEQ ID NO: 7021272 - DNA, 22 bp, Homo sapiens
atgtggctgtcacagcataatg

SEQ ID NO: 7021273 - DNA, 22 bp, Homo sapiens
actgagagaacgggctgctccc

SEQ ID NO: 7021274 - DNA, 22 bp, Homo sapiens
tctctgaagaatcgatgattct

SEQ ID NO: 7021275 - DNA, 22 bp, Homo sapiens
ccttcgagatttaaacactgat

SEQ ID NO: 7021276 - DNA, 22 bp, Homo sapiens
tcattttggccatgatacagac

SEQ ID NO: 7021277 - DNA, 22 bp, Homo sapiens
tggggacccggactcctgggtc

SEQ ID NO: 7021278 - DNA, 20 bp, Homo sapiens
tgtgaaagcagtagaatgac

SEQ ID NO: 7021279 - DNA, 22 bp, Homo sapiens
actgccagaagacagcttttca

SEQ ID NO: 7021280 - DNA, 22 bp, Homo sapiens
ttttgcttttgtaacacagtgt

SEQ ID NO: 7021281 - DNA, 22 bp, Homo sapiens
ttcagagttagacgaaaagcaa

SEQ ID NO: 7021282 - DNA, 22 bp, Homo sapiens
tgctgccaatttctggtcttga

SEQ ID NO: 7021283 - DNA, 22 bp, Homo sapiens
cagacatcacactcagattgca

SEQ ID NO: 7021284 - DNA, 22 bp, Homo sapiens
gccatatatattttgcactagg

SEQ ID NO: 7021285 - DNA, 22 bp, Homo sapiens
tagcaaagcgaaagagatttat

SEQ ID NO: 7021286 - DNA, 22 bp, Homo sapiens
ctacatgaatgggtgtattact

SEQ ID NO: 7021287 - DNA, 22 bp, Homo sapiens
aggacactgctgaggatcagat

SEQ ID NO: 7021288 - DNA, 22 bp, Homo sapiens
atctttctccatatacatcttt

SEQ ID NO: 7021289 - DNA, 22 bp, Homo sapiens
aactgcaacttgtttgattctt

SEQ ID NO: 7021290 - DNA, 22 bp, Homo sapiens
tctggattgtggctattgttct

SEQ ID NO: 7021291 - DNA, 22 bp, Homo sapiens
gcagtgttaatgcgagtgttca

SEQ ID NO: 7021292 - DNA, 22 bp, Homo sapiens
aagtgagttaatggatgtgaac

SEQ ID NO: 7021293 - DNA, 22 bp, Homo sapiens
gagccctcttccctagtgatcg

SEQ ID NO: 7021294 - DNA, 22 bp, Homo sapiens
gtttaagtttcagaagctaaga

SEQ ID NO: 7021295 - DNA, 22 bp, Homo sapiens
cactgactgcccgctgtacatt

SEQ ID NO: 7021296 - DNA, 22 bp, Homo sapiens
tagcccaggctggagggcagtg

SEQ ID NO: 7021297 - DNA, 22 bp, Homo sapiens
gtcttattgggtccaaggtggc

SEQ ID NO: 7021298 - DNA, 22 bp, Homo sapiens
taaagtgcagattgtgattcag

SEQ ID NO: 7021299 - DNA, 22 bp, Homo sapiens
ccaaggagctgcaggcacttgt

SEQ ID NO: 7021300 - DNA, 22 bp, Homo sapiens
agtgctgggattgcaggcatga

SEQ ID NO: 7021301 - DNA, 22 bp, Homo sapiens
agtgctgggattacaggcataa

SEQ ID NO: 7021302 - DNA, 22 bp, Homo sapiens
tgaaacaggaagtaaacagaca

SEQ ID NO: 7021303 - DNA, 22 bp, Homo sapiens
tcttcagtgcatgccctcaggc

SEQ ID NO: 7021304 - DNA, 22 bp, Homo sapiens
tgcctgtgtatttccggcctgc

SEQ ID NO: 7021305 - DNA, 19 bp, Homo sapiens
aggcaccttgatggcttcc

SEQ ID NO: 7021306 - DNA, 22 bp, Homo sapiens
tttggaatgtagtttaatcatc

SEQ ID NO: 7021307 - DNA, 22 bp, Homo sapiens
tgcatacacacataggtatggg

SEQ ID NO: 7021308 - DNA, 22 bp, Homo sapiens
gaagtataggagacaaacaaga

SEQ ID NO: 7021309 - DNA, 22 bp, Homo sapiens
attcagaagcaatcacagtgag

SEQ ID NO: 7021310 - DNA, 22 bp, Homo sapiens
aatcacagttagtaagggagaa

SEQ ID NO: 7021311 - DNA, 22 bp, Homo sapiens
gtgagcagagatcgcgtgattg

SEQ ID NO: 7021312 - DNA, 23 bp, Homo sapiens
tagacactcctttgtctgtcctt

SEQ ID NO: 7021313 - DNA, 20 bp, Homo sapiens
tctgttattgcatgtacata

SEQ ID NO: 7021314 - DNA, 22 bp, Homo sapiens
ctgcctctcaggtccctgagat

SEQ ID NO: 7021315 - DNA, 22 bp, Homo sapiens
taggaaaaagaggctggcaagg

SEQ ID NO: 7021316 - DNA, 22 bp, Homo sapiens
tgtcaccttgatgatggcctag

SEQ ID NO: 7021317 - DNA, 22 bp, Homo sapiens
caggataacagaaaatagctga

SEQ ID NO: 7021318 - DNA, 22 bp, Homo sapiens
cagtccaggttctttctctaaa

SEQ ID NO: 7021319 - DNA, 22 bp, Homo sapiens
gcctcagctcccagcccaggct

SEQ ID NO: 7021320 - DNA, 22 bp, Homo sapiens
tgctcctgaattacactactac

SEQ ID NO: 7021321 - DNA, 22 bp, Homo sapiens
tcactgacgtggggctacttga

SEQ ID NO: 7021322 - DNA, 22 bp, Homo sapiens
ccagggctccattgctcatcct

SEQ ID NO: 7021323 - DNA, 22 bp, Homo sapiens
tggccctgggcatctttcgtga

SEQ ID NO: 7021324 - DNA, 22 bp, Homo sapiens
tctagaaagtactagagctggt

SEQ ID NO: 7021325 - DNA, 22 bp, Homo sapiens
gatgttgattcttactctcaat

SEQ ID NO: 7021326 - DNA, 22 bp, Homo sapiens
cagaaacttttgatgagtgtat

SEQ ID NO: 7021327 - DNA, 22 bp, Homo sapiens
tctgtaagggaaggtgatttgc

SEQ ID NO: 7021328 - DNA, 22 bp, Homo sapiens
tatggtttcaatttctgggtag

SEQ ID NO: 7021329 - DNA, 22 bp, Homo sapiens
ttctgccttggcagggtggtcc

SEQ ID NO: 7021330 - DNA, 22 bp, Homo sapiens
gcctgtttgactggtctctgct

SEQ ID NO: 7021331 - DNA, 15 bp, Homo sapiens
ctatttcatccttct

SEQ ID NO: 7021332 - DNA, 22 bp, Homo sapiens
gcagtttgtttgtggacacctt

SEQ ID NO: 7021333 - DNA, 22 bp, Homo sapiens
cagccagctggcactgtgagta

SEQ ID NO: 7021334 - DNA, 22 bp, Homo sapiens
aaaacttagctaggcaagtttt

SEQ ID NO: 7021335 - DNA, 19 bp, Homo sapiens
tgtcagtagttgtctaggg

SEQ ID NO: 7021336 - DNA, 22 bp, Homo sapiens
ccaaggctgtcattcagtagct

SEQ ID NO: 7021337 - DNA, 19 bp, Homo sapiens
tggcattggtccagataaa

SEQ ID NO: 7021338 - DNA, 22 bp, Homo sapiens
tgaggtggaaggatcctttgaa

SEQ ID NO: 7021339 - DNA, 22 bp, Homo sapiens
ttcagaagtagctaagcagtca

SEQ ID NO: 7021340 - DNA, 22 bp, Homo sapiens
caacgctgcccatatttgtact

SEQ ID NO: 7021341 - DNA, 22 bp, Homo sapiens
gcttggccctgccgcctgggtc

SEQ ID NO: 7021342 - DNA, 22 bp, Homo sapiens
cccctttctcccgcgactggcc

SEQ ID NO: 7021343 - DNA, 22 bp, Homo sapiens
tcaagcaacagaactgtgagac

SEQ ID NO: 7021344 - DNA, 22 bp, Homo sapiens
gatacacatgcatgtgcatgta

SEQ ID NO: 7021345 - DNA, 22 bp, Homo sapiens
catggtctacaatttcatttta

SEQ ID NO: 7021346 - DNA, 17 bp, Homo sapiens
gtgaatggcatagtcgg

SEQ ID NO: 7021347 - DNA, 22 bp, Homo sapiens
agtcttctgctctgtcactaac

SEQ ID NO: 7021348 - DNA, 22 bp, Homo sapiens
gcccaggaggcagaggttgtgg

SEQ ID NO: 7021349 - DNA, 22 bp, Homo sapiens
agggcttgtttcctgtttcata

SEQ ID NO: 7021350 - DNA, 22 bp, Homo sapiens
tctgtgatagtttttcagctat

SEQ ID NO: 7021351 - DNA, 22 bp, Homo sapiens
ggagccggagggccactggcag

SEQ ID NO: 7021352 - DNA, 22 bp, Homo sapiens
gctactttgcagctagctagga

SEQ ID NO: 7021353 - DNA, 22 bp, Homo sapiens
tgggtctccagttcagggcagg

SEQ ID NO: 7021354 - DNA, 22 bp, Homo sapiens
tttatgcagcactttacatttg

SEQ ID NO: 7021355 - DNA, 22 bp, Homo sapiens
ctttacaaagcaattttgtctc

SEQ ID NO: 7021356 - DNA, 22 bp, Homo sapiens
gccccagcctagttttctttca

SEQ ID NO: 7021357 - DNA, 22 bp, Homo sapiens
gcctggtctctggggttgggta

SEQ ID NO: 7021358 - DNA, 22 bp, Homo sapiens
tggcttcacacaggcacttccg

SEQ ID NO: 7021359 - DNA, 22 bp, Homo sapiens
ctggaaagatttctttggagtc

SEQ ID NO: 7021360 - DNA, 22 bp, Homo sapiens
taatacattacctaacctctct

SEQ ID NO: 7021361 - DNA, 22 bp, Homo sapiens
ccaagcatggggttcagtagga

SEQ ID NO: 7021362 - DNA, 22 bp, Homo sapiens
gactctccattagtctttggta

SEQ ID NO: 7021363 - DNA, 21 bp, Homo sapiens
tcccagagtgcttgggactgc

SEQ ID NO: 7021364 - DNA, 22 bp, Homo sapiens
ataccagaacaaatgagatcct

SEQ ID NO: 7021365 - DNA, 22 bp, Homo sapiens
tctccaggagaaatatgaagga

SEQ ID NO: 7021366 - DNA, 22 bp, Homo sapiens
aagcccatgaaatggcctcaat

SEQ ID NO: 7021367 - DNA, 22 bp, Homo sapiens
cttctcagtcacctgtgagtct

SEQ ID NO: 7021368 - DNA, 18 bp, Homo sapiens
gtcagaggatggggaaat

SEQ ID NO: 7021369 - DNA, 22 bp, Homo sapiens
tttagcatcgaagtaaatttag

SEQ ID NO: 7021370 - DNA, 22 bp, Homo sapiens
tggagcctgtgtttctgcccag

SEQ ID NO: 7021371 - DNA, 22 bp, Homo sapiens
tcctttggtagttttcttaaag

SEQ ID NO: 7021372 - DNA, 22 bp, Homo sapiens
gattagaatgggaagatacaag

SEQ ID NO: 7021373 - DNA, 22 bp, Homo sapiens
agcatggccatctgggccgtcc

SEQ ID NO: 7021374 - DNA, 22 bp, Homo sapiens
gtgccagctctccccacatctg

SEQ ID NO: 7021375 - DNA, 22 bp, Homo sapiens
tattcactttgggagagccatt

SEQ ID NO: 7021376 - DNA, 22 bp, Homo sapiens
ttggaagaccagaggccttgtc

SEQ ID NO: 7021377 - DNA, 22 bp, Homo sapiens
gttcacaaaattctggccagtg

SEQ ID NO: 7021378 - DNA, 22 bp, Homo sapiens
gtctggaaattcaatttaatgc

SEQ ID NO: 7021379 - DNA, 22 bp, Homo sapiens
tcacagtgacagccaatgtttt

SEQ ID NO: 7021380 - DNA, 22 bp, Homo sapiens
gctgtgggttcctggcatttga

SEQ ID NO: 7021381 - DNA, 22 bp, Homo sapiens
caggaagtgcctggtgagagga

SEQ ID NO: 7021382 - DNA, 22 bp, Homo sapiens
taatgccgtctctacaagactc

SEQ ID NO: 7021383 - DNA, 22 bp, Homo sapiens
caggggaaggagccttgaaact

SEQ ID NO: 7021384 - DNA, 22 bp, Homo sapiens
aattcacaggatcacaggagag

SEQ ID NO: 7021385 - DNA, 22 bp, Homo sapiens
actttcacatgtgtgcagacag

SEQ ID NO: 7021386 - DNA, 22 bp, Homo sapiens
aggggagaatttcaactcaggt

SEQ ID NO: 7021387 - DNA, 22 bp, Homo sapiens
aactggattcttactgggctga

SEQ ID NO: 7021388 - DNA, 22 bp, Homo sapiens
tttcttatggggtagtccttta

SEQ ID NO: 7021389 - DNA, 22 bp, Homo sapiens
tccactgcagcttctgatggaa

SEQ ID NO: 7021390 - DNA, 19 bp, Homo sapiens
gctgcctgtcttagccagt

SEQ ID NO: 7021391 - DNA, 22 bp, Homo sapiens
cagtccaggcctggaggagcca

SEQ ID NO: 7021392 - DNA, 22 bp, Homo sapiens
actggggactctggccttttga

SEQ ID NO: 7021393 - DNA, 22 bp, Homo sapiens
cggcacaggccccatcctgact

SEQ ID NO: 7021394 - DNA, 22 bp, Homo sapiens
tctatcagagtagaaggcaacg

SEQ ID NO: 7021395 - DNA, 22 bp, Homo sapiens
agcacacaggacttgattcatg

SEQ ID NO: 7021396 - DNA, 22 bp, Homo sapiens
ttgaaagttatctagattctga

SEQ ID NO: 7021397 - DNA, 22 bp, Homo sapiens
ctttgattcagagagaattagc

SEQ ID NO: 7021398 - DNA, 22 bp, Homo sapiens
ccagcaggcagtcatatccttt

SEQ ID NO: 7021399 - DNA, 22 bp, Homo sapiens
tgtggctgcagacactggagcc

SEQ ID NO: 7021400 - DNA, 22 bp, Homo sapiens
acatggcaaaagggactttaca

SEQ ID NO: 7021401 - DNA, 22 bp, Homo sapiens
ttcaagtactgtagatttcagg

SEQ ID NO: 7021402 - DNA, 22 bp, Homo sapiens
tgcagctctgaacagtcatgaa

SEQ ID NO: 7021403 - DNA, 22 bp, Homo sapiens
atctggagtgggacacagaaat

SEQ ID NO: 7021404 - DNA, 22 bp, Homo sapiens
ggcttcactcataattaggttc

SEQ ID NO: 7021405 - DNA, 22 bp, Homo sapiens
gatcagaattcttgtgtgtttc

SEQ ID NO: 7021406 - DNA, 22 bp, Homo sapiens
tcagaacaattcctttataaca

SEQ ID NO: 7021407 - DNA, 22 bp, Homo sapiens
cagtctcaccctggaggcccca

SEQ ID NO: 7021408 - DNA, 22 bp, Homo sapiens
tgaaattcattgttttatgtgt

SEQ ID NO: 7021409 - DNA, 22 bp, Homo sapiens
gacaagtgggctgcagcttttg

SEQ ID NO: 7021410 - DNA, 22 bp, Homo sapiens
ttcctggcattatgggaggctg

SEQ ID NO: 7021411 - DNA, 22 bp, Homo sapiens
aaggcagcaagaattccaggtt

SEQ ID NO: 7021412 - DNA, 22 bp, Homo sapiens
cccagtggcttttgcccaggtt

SEQ ID NO: 7021413 - DNA, 22 bp, Homo sapiens
tagaatatacactacagcttaa

SEQ ID NO: 7021414 - DNA, 22 bp, Homo sapiens
attggcagtgttttctgttcca

SEQ ID NO: 7021415 - DNA, 23 bp, Homo sapiens
gtgagcagcccactaggaatgcc

SEQ ID NO: 7021416 - DNA, 22 bp, Homo sapiens
tgtcatttggtgccaggaaaga

SEQ ID NO: 7021417 - DNA, 22 bp, Homo sapiens
agtcacactggttgtttacagt

SEQ ID NO: 7021418 - DNA, 22 bp, Homo sapiens
ggtagaaataatcttcaggctg

SEQ ID NO: 7021419 - DNA, 22 bp, Homo sapiens
tggggctgtccttagtctgaga

SEQ ID NO: 7021420 - DNA, 22 bp, Homo sapiens
cccttgctgccacagctgccca

SEQ ID NO: 7021421 - DNA, 22 bp, Homo sapiens
tcagaacttcagttttcttaat

SEQ ID NO: 7021422 - DNA, 22 bp, Homo sapiens
tacgtttagctttatgagacat

SEQ ID NO: 7021423 - DNA, 22 bp, Homo sapiens
tggctcctcacgtcctcagagc

SEQ ID NO: 7021424 - DNA, 22 bp, Homo sapiens
tccctggcactgctgtgattag

SEQ ID NO: 7021425 - DNA, 22 bp, Homo sapiens
tccagctgtagtggatttgaga

SEQ ID NO: 7021426 - DNA, 22 bp, Homo sapiens
cttaacatcctgcatttttctt

SEQ ID NO: 7021427 - DNA, 22 bp, Homo sapiens
agcttccattaactgctacact

SEQ ID NO: 7021428 - DNA, 22 bp, Homo sapiens
tgccacacagctgtatgaggga

SEQ ID NO: 7021429 - DNA, 22 bp, Homo sapiens
gccctggatgtacaggcatgtt

SEQ ID NO: 7021430 - DNA, 22 bp, Homo sapiens
agacccttcagacggctagagc

SEQ ID NO: 7021431 - DNA, 22 bp, Homo sapiens
atgacccttactgcatcataca

SEQ ID NO: 7021432 - DNA, 22 bp, Homo sapiens
aactgcctggccaggctgcaac

SEQ ID NO: 7021433 - DNA, 22 bp, Homo sapiens
tctgcctgtgctgtgttttcat

SEQ ID NO: 7021434 - DNA, 20 bp, Homo sapiens
ttagagttagctgttatgca

SEQ ID NO: 7021435 - DNA, 23 bp, Homo sapiens
tcacagggcactggctggggttg

SEQ ID NO: 7021436 - DNA, 22 bp, Homo sapiens
cgagggtgtgctgacccagctc

SEQ ID NO: 7021437 - DNA, 22 bp, Homo sapiens
gagggctccattccccgtgccc

SEQ ID NO: 7021438 - DNA, 22 bp, Homo sapiens
gagctgaggatacatcagtgaa

SEQ ID NO: 7021439 - DNA, 22 bp, Homo sapiens
tgagtccatgtggaggggaggt

SEQ ID NO: 7021440 - DNA, 22 bp, Homo sapiens
agtacaaaggcccttgattact

SEQ ID NO: 7021441 - DNA, 22 bp, Homo sapiens
actccctttccaggaaacacaa

SEQ ID NO: 7021442 - DNA, 22 bp, Homo sapiens
ccttttctatgtaccagcagtg

SEQ ID NO: 7021443 - DNA, 22 bp, Homo sapiens
caggttgggctgcgaggaggag

SEQ ID NO: 7021444 - DNA, 22 bp, Homo sapiens
ggaggcaccctatttgaggcct

SEQ ID NO: 7021445 - DNA, 20 bp, Homo sapiens
ttcatgggagcaaagaggcc

SEQ ID NO: 7021446 - DNA, 22 bp, Homo sapiens
atggtcatatgctaattcagga

SEQ ID NO: 7021447 - DNA, 22 bp, Homo sapiens
agagactgcgtgtcagcgctgg

SEQ ID NO: 7021448 - DNA, 22 bp, Homo sapiens
aggaccaagagcagaggcatca

SEQ ID NO: 7021449 - DNA, 22 bp, Homo sapiens
ttcacacagcaactgtatgaat

SEQ ID NO: 7021450 - DNA, 22 bp, Homo sapiens
agtagtggcttcctggagtgct

SEQ ID NO: 7021451 - DNA, 22 bp, Homo sapiens
ttcatcatgatgttcccctcta

SEQ ID NO: 7021452 - DNA, 22 bp, Homo sapiens
tgtgttttgtgtgacccagctc

SEQ ID NO: 7021453 - DNA, 22 bp, Homo sapiens
aagacagaagtgatttgatgtg

SEQ ID NO: 7021454 - DNA, 22 bp, Homo sapiens
ttatgcttgttcacagaggtca

SEQ ID NO: 7021455 - DNA, 22 bp, Homo sapiens
accttggaactgaagtgttttt

SEQ ID NO: 7021456 - DNA, 22 bp, Homo sapiens
acatgtttggctctatgctata

SEQ ID NO: 7021457 - DNA, 22 bp, Homo sapiens
cttttaatgagcattgctgtct

SEQ ID NO: 7021458 - DNA, 22 bp, Homo sapiens
gaatgaatctgtaagtgacaag

SEQ ID NO: 7021459 - DNA, 19 bp, Homo sapiens
gcaaggccagcttgatgtg

SEQ ID NO: 7021460 - DNA, 22 bp, Homo sapiens
agtctggtgtatgaaagtgaat

SEQ ID NO: 7021461 - DNA, 22 bp, Homo sapiens
ggcaggcaggagctctgtctcc

SEQ ID NO: 7021462 - DNA, 22 bp, Homo sapiens
tcaatgagccagaatgtagtac

SEQ ID NO: 7021463 - DNA, 22 bp, Homo sapiens
agccacagtgggctaccagctc

SEQ ID NO: 7021464 - DNA, 22 bp, Homo sapiens
acactggtatgactgttccagt

SEQ ID NO: 7021465 - DNA, 21 bp, Homo sapiens
ctgcatctgagtcattatgcc

SEQ ID NO: 7021466 - DNA, 22 bp, Homo sapiens
gtgcccacacatgttcttacat

SEQ ID NO: 7021467 - DNA, 22 bp, Homo sapiens
ggtgtaagatgtcagctgagca

SEQ ID NO: 7021468 - DNA, 22 bp, Homo sapiens
ccagccagcaagctcccagttc

SEQ ID NO: 7021469 - DNA, 22 bp, Homo sapiens
agccaggctgcagttggctggc

SEQ ID NO: 7021470 - DNA, 22 bp, Homo sapiens
gcacagttaaagggtcatgtga

SEQ ID NO: 7021471 - DNA, 22 bp, Homo sapiens
ctccacaggtggtgtttgcttc

SEQ ID NO: 7021472 - DNA, 18 bp, Homo sapiens
ctgttagtagatatttac

SEQ ID NO: 7021473 - DNA, 22 bp, Homo sapiens
caaagtggctggccgggagatc

SEQ ID NO: 7021474 - DNA, 22 bp, Homo sapiens
tgaggtagtttttcaagtattt

SEQ ID NO: 7021475 - DNA, 19 bp, Homo sapiens
ggtatcacttgttttttgt

SEQ ID NO: 7021476 - DNA, 22 bp, Homo sapiens
ttaggaaaatcatgagagatga

SEQ ID NO: 7021477 - DNA, 20 bp, Homo sapiens
tcataaagaggaaataaata

SEQ ID NO: 7021478 - DNA, 18 bp, Homo sapiens
cccaggttggcctacaga

SEQ ID NO: 7021479 - DNA, 22 bp, Homo sapiens
atgcagctgagggtagtggagc

SEQ ID NO: 7021480 - DNA, 22 bp, Homo sapiens
ctgagcaggcggtggagcggct

SEQ ID NO: 7021481 - DNA, 22 bp, Homo sapiens
ctacagtagagaggatgtagaa

SEQ ID NO: 7021482 - DNA, 22 bp, Homo sapiens
tctccaaatcaatcaatatgaa

SEQ ID NO: 7021483 - DNA, 19 bp, Homo sapiens
ctccaggatggctgggcga

SEQ ID NO: 7021484 - DNA, 22 bp, Homo sapiens
cccaggctcctactgtattctg

SEQ ID NO: 7021485 - DNA, 22 bp, Homo sapiens
ttctcggctcagtctcagcgaa

SEQ ID NO: 7021486 - DNA, 22 bp, Homo sapiens
cgcaacctgacagagccacgtc

SEQ ID NO: 7021487 - DNA, 22 bp, Homo sapiens
tcatatttgggggtgtgtgttt

SEQ ID NO: 7021488 - DNA, 22 bp, Homo sapiens
gttcctcatccagtcatgacta

SEQ ID NO: 7021489 - DNA, 22 bp, Homo sapiens
tgcagcagaatatggctgcagg

SEQ ID NO: 7021490 - DNA, 22 bp, Homo sapiens
atacttctttgatgttcacagg

SEQ ID NO: 7021491 - DNA, 22 bp, Homo sapiens
tgtctgtccatctgtctgggac

SEQ ID NO: 7021492 - DNA, 22 bp, Homo sapiens
ccagacctgcaaggctgagagg

SEQ ID NO: 7021493 - DNA, 19 bp, Homo sapiens
gacaattagagatcactca

SEQ ID NO: 7021494 - DNA, 20 bp, Homo sapiens
aagtttcatgctctggggat

SEQ ID NO: 7021495 - DNA, 22 bp, Homo sapiens
aaagactctaggtagcttataa

SEQ ID NO: 7021496 - DNA, 23 bp, Homo sapiens
ttacagtaggagttggaaaacca

SEQ ID NO: 7021497 - DNA, 22 bp, Homo sapiens
ttgggcttgacaagctgtcaag

SEQ ID NO: 7021498 - DNA, 22 bp, Homo sapiens
tctctggcagactggctgggct

SEQ ID NO: 7021499 - DNA, 22 bp, Homo sapiens
agcaggtggtaggcagtcagca

SEQ ID NO: 7021500 - DNA, 22 bp, Homo sapiens
ctgatggagtgatggagaaatt

SEQ ID NO: 7021501 - DNA, 20 bp, Homo sapiens
tgctgctgtgagcgtccctg

SEQ ID NO: 7021502 - DNA, 22 bp, Homo sapiens
aacaaacctgggtggagaaagg

SEQ ID NO: 7021503 - DNA, 22 bp, Homo sapiens
cctcatggtacttactgtagct

SEQ ID NO: 7021504 - DNA, 22 bp, Homo sapiens
gtttacaacatcttgtccttca

SEQ ID NO: 7021505 - DNA, 22 bp, Homo sapiens
aacccaggagacggagtttgtg

SEQ ID NO: 7021506 - DNA, 22 bp, Homo sapiens
atctgacaacctattgacttga

SEQ ID NO: 7021507 - DNA, 20 bp, Homo sapiens
attctcacatggctccgggc

SEQ ID NO: 7021508 - DNA, 22 bp, Homo sapiens
tctgtgctgcccaacttctcaa

SEQ ID NO: 7021509 - DNA, 22 bp, Homo sapiens
gcagccaagaccccaagaactg

SEQ ID NO: 7021510 - DNA, 22 bp, Homo sapiens
tctccccagaccctggacataa

SEQ ID NO: 7021511 - DNA, 18 bp, Homo sapiens
tcctgggaacttgctagc

SEQ ID NO: 7021512 - DNA, 22 bp, Homo sapiens
tgactgaaattgcattttaaaa

SEQ ID NO: 7021513 - DNA, 22 bp, Homo sapiens
ttgcccactggctgttggtcag

SEQ ID NO: 7021514 - DNA, 22 bp, Homo sapiens
ggctgccttccctgagccccgg

SEQ ID NO: 7021515 - DNA, 21 bp, Homo sapiens
ccttctccattacagtaagct

SEQ ID NO: 7021516 - DNA, 22 bp, Homo sapiens
tgtggactcgcatggctgaggc

SEQ ID NO: 7021517 - DNA, 22 bp, Homo sapiens
ccacgcatccctccacagagag

SEQ ID NO: 7021518 - DNA, 22 bp, Homo sapiens
ccagctggaaacaaatagagtg

SEQ ID NO: 7021519 - DNA, 22 bp, Homo sapiens
aaaggtcttcagtgctttcact

SEQ ID NO: 7021520 - DNA, 22 bp, Homo sapiens
tctctgggaatgggcctgggta

SEQ ID NO: 7021521 - DNA, 21 bp, Homo sapiens
aaagtggtaaggattattttg

SEQ ID NO: 7021522 - DNA, 22 bp, Homo sapiens
gaggctccctcaactctgggtg

SEQ ID NO: 7021523 - DNA, 22 bp, Homo sapiens
gacaagtgcccattattcttta

SEQ ID NO: 7021524 - DNA, 22 bp, Homo sapiens
gtatccacaataaagccctttg

SEQ ID NO: 7021525 - DNA, 22 bp, Homo sapiens
cagtacttggtcaaggaagcag

SEQ ID NO: 7021526 - DNA, 23 bp, Homo sapiens
gcctttattaggcacaggggtac

SEQ ID NO: 7021527 - DNA, 22 bp, Homo sapiens
tggcagagcccagaactgagca

SEQ ID NO: 7021528 - DNA, 22 bp, Homo sapiens
ttggcagaaaatgcttcctcag

SEQ ID NO: 7021529 - DNA, 22 bp, Homo sapiens
ttggtcatagcattcaaaatgg

SEQ ID NO: 7021530 - DNA, 22 bp, Homo sapiens
ataactttcttcacccttgctg

SEQ ID NO: 7021531 - DNA, 22 bp, Homo sapiens
tggagcaggcatctttctctct

SEQ ID NO: 7021532 - DNA, 22 bp, Homo sapiens
ttggtcagattgggcttccatt

SEQ ID NO: 7021533 - DNA, 22 bp, Homo sapiens
tggcaatgtggaatggtccagg

SEQ ID NO: 7021534 - DNA, 22 bp, Homo sapiens
agcagggggcatccttgccctt

SEQ ID NO: 7021535 - DNA, 22 bp, Homo sapiens
agctgggacagacaactatgtt

SEQ ID NO: 7021536 - DNA, 22 bp, Homo sapiens
caaatgctactaataggcaagt

SEQ ID NO: 7021537 - DNA, 22 bp, Homo sapiens
ggccctctgtggctgccatgga

SEQ ID NO: 7021538 - DNA, 22 bp, Homo sapiens
catgtgtgtgagggaaacatgt

SEQ ID NO: 7021539 - DNA, 23 bp, Homo sapiens
ttgtggaagggagatggcaacag

SEQ ID NO: 7021540 - DNA, 22 bp, Homo sapiens
tgaggaagggtgtgacggcacc

SEQ ID NO: 7021541 - DNA, 22 bp, Homo sapiens
tgcctgcgaggcatgggtgaga

SEQ ID NO: 7021542 - DNA, 22 bp, Homo sapiens
ctttgttgtgcctgagtgcacc

SEQ ID NO: 7021543 - DNA, 19 bp, Homo sapiens
catcattatcagttcactg

SEQ ID NO: 7021544 - DNA, 22 bp, Homo sapiens
atcaggattattaaatctggat

SEQ ID NO: 7021545 - DNA, 22 bp, Homo sapiens
acccaggctggagtgcagtggg

SEQ ID NO: 7021546 - DNA, 22 bp, Homo sapiens
atgatgtaatggaaagaacaga

SEQ ID NO: 7021547 - DNA, 22 bp, Homo sapiens
acccccaaacatcaagggctga

SEQ ID NO: 7021548 - DNA, 22 bp, Homo sapiens
gaccttgtgatccgcccgcctt

SEQ ID NO: 7021549 - DNA, 22 bp, Homo sapiens
cgctgctccgccttgtccatat

SEQ ID NO: 7021550 - DNA, 22 bp, Homo sapiens
tcacagttactccttcagatga

SEQ ID NO: 7021551 - DNA, 22 bp, Homo sapiens
ggaaagtcttgtgtagatgtct

SEQ ID NO: 7021552 - DNA, 22 bp, Homo sapiens
agcaaggcttcagagctgtctg

SEQ ID NO: 7021553 - DNA, 22 bp, Homo sapiens
atccatggctaagtatatagag

SEQ ID NO: 7021554 - DNA, 22 bp, Homo sapiens
acacatcatgccaagtttcacc

SEQ ID NO: 7021555 - DNA, 22 bp, Homo sapiens
ttggctgttttataggtcagtt

SEQ ID NO: 7021556 - DNA, 22 bp, Homo sapiens
tgctggatggagtaaaactgga

SEQ ID NO: 7021557 - DNA, 22 bp, Homo sapiens
tggttgtgcacggagctgcagg

SEQ ID NO: 7021558 - DNA, 22 bp, Homo sapiens
aagtgctgggattacaggggtg

SEQ ID NO: 7021559 - DNA, 22 bp, Homo sapiens
cctacagacaaaccagtgacta

SEQ ID NO: 7021560 - DNA, 19 bp, Homo sapiens
agtgccgggtggcgctcag

SEQ ID NO: 7021561 - DNA, 22 bp, Homo sapiens
tctcatttacttccacaggctg

SEQ ID NO: 7021562 - DNA, 22 bp, Homo sapiens
ttcataggtcaaaaaacaagag

SEQ ID NO: 7021563 - DNA, 17 bp, Homo sapiens
tgtgctctctcactcag

SEQ ID NO: 7021564 - DNA, 22 bp, Homo sapiens
tacacatgtgcacgcgtgtcct

SEQ ID NO: 7021565 - DNA, 22 bp, Homo sapiens
aggtcacttcctgtctggataa

SEQ ID NO: 7021566 - DNA, 22 bp, Homo sapiens
aaatggtaggttttcttaagaa

SEQ ID NO: 7021567 - DNA, 22 bp, Homo sapiens
tcaggtacttaagactctttag

SEQ ID NO: 7021568 - DNA, 23 bp, Homo sapiens
gaagttctgttcagccagacaag

SEQ ID NO: 7021569 - DNA, 22 bp, Homo sapiens
tcagtggatatttctgtggctg

SEQ ID NO: 7021570 - DNA, 22 bp, Homo sapiens
tttcaagtcattctataatatc

SEQ ID NO: 7021571 - DNA, 22 bp, Homo sapiens
gattcccatcctcagcagcagc

SEQ ID NO: 7021572 - DNA, 17 bp, Homo sapiens
ggtgagtgtccaggtgg

SEQ ID NO: 7021573 - DNA, 22 bp, Homo sapiens
cctcagagttatttgaagtgaa

SEQ ID NO: 7021574 - DNA, 22 bp, Homo sapiens
tgttccctggtaaactgactcc

SEQ ID NO: 7021575 - DNA, 22 bp, Homo sapiens
gaagaagggtaaggagtgttga

SEQ ID NO: 7021576 - DNA, 22 bp, Homo sapiens
tggaaagaaaaacaggccatga

SEQ ID NO: 7021577 - DNA, 22 bp, Homo sapiens
gttttgctcatttggtccaagg

SEQ ID NO: 7021578 - DNA, 22 bp, Homo sapiens
gttagcaattgcttaagactag

SEQ ID NO: 7021579 - DNA, 22 bp, Homo sapiens
taaagaacacagggaatagcac

SEQ ID NO: 7021580 - DNA, 22 bp, Homo sapiens
gtgtgtccaaggccacaatagc

SEQ ID NO: 7021581 - DNA, 22 bp, Homo sapiens
aggacagcccccaacagcaaca

SEQ ID NO: 7021582 - DNA, 22 bp, Homo sapiens
agggactcctctgctcggctgc

SEQ ID NO: 7021583 - DNA, 22 bp, Homo sapiens
gtctcccagcctacatctttct

SEQ ID NO: 7021584 - DNA, 22 bp, Homo sapiens
gtcataggtagggggaaggatg

SEQ ID NO: 7021585 - DNA, 19 bp, Homo sapiens
ggctggagtggccatctgt

SEQ ID NO: 7021586 - DNA, 22 bp, Homo sapiens
aggcttcacctgcacctgagct

SEQ ID NO: 7021587 - DNA, 22 bp, Homo sapiens
aacccaggaggtggaggttgtg

SEQ ID NO: 7021588 - DNA, 22 bp, Homo sapiens
ctattgttataattgttgacat

SEQ ID NO: 7021589 - DNA, 22 bp, Homo sapiens
ttgctgccttggagaagctcct

SEQ ID NO: 7021590 - DNA, 22 bp, Homo sapiens
tgcccacagcaaagaggtagga

SEQ ID NO: 7021591 - DNA, 22 bp, Homo sapiens
aacttcagggggcacattcaag

SEQ ID NO: 7021592 - DNA, 22 bp, Homo sapiens
cagtggaagctggctgtgaaga

SEQ ID NO: 7021593 - DNA, 22 bp, Homo sapiens
atacgcataatgtttattcctg

SEQ ID NO: 7021594 - DNA, 22 bp, Homo sapiens
tcatctgggagcttgttagaaa

SEQ ID NO: 7021595 - DNA, 22 bp, Homo sapiens
tatacacatcctccaaagatag

SEQ ID NO: 7021596 - DNA, 22 bp, Homo sapiens
tcccagggtcctcttctggaat

SEQ ID NO: 7021597 - DNA, 22 bp, Homo sapiens
tttacattgcattaggtattat

SEQ ID NO: 7021598 - DNA, 22 bp, Homo sapiens
gcactggaaggagggaatctta

SEQ ID NO: 7021599 - DNA, 22 bp, Homo sapiens
tcagctctaagttttatgcaaa

SEQ ID NO: 7021600 - DNA, 22 bp, Homo sapiens
ctgcacaggggatgagggcagt

SEQ ID NO: 7021601 - DNA, 22 bp, Homo sapiens
agcagcaaggaagcgaggatgg

SEQ ID NO: 7021602 - DNA, 22 bp, Homo sapiens
actcagcttgcacacatcaatg

SEQ ID NO: 7021603 - DNA, 22 bp, Homo sapiens
gcaatgttaagatcacacctgg

SEQ ID NO: 7021604 - DNA, 22 bp, Homo sapiens
gatctggtctttgattagacac

SEQ ID NO: 7021605 - DNA, 22 bp, Homo sapiens
gagggagtgagacacaaaagaa

SEQ ID NO: 7021606 - DNA, 22 bp, Homo sapiens
ccaggcaacggagcccactgcc

SEQ ID NO: 7021607 - DNA, 22 bp, Homo sapiens
gccatttagggaggcaaggtga

SEQ ID NO: 7021608 - DNA, 22 bp, Homo sapiens
agtgttctaacaactgctttca

SEQ ID NO: 7021609 - DNA, 22 bp, Homo sapiens
ctgaactatcctgcaactgcag

SEQ ID NO: 7021610 - DNA, 20 bp, Homo sapiens
gcatggctaatctgtactga

SEQ ID NO: 7021611 - DNA, 22 bp, Homo sapiens
tttgtgtagtctgttcccactg

SEQ ID NO: 7021612 - DNA, 22 bp, Homo sapiens
cacacaggtatatatatgtaca

SEQ ID NO: 7021613 - DNA, 22 bp, Homo sapiens
ttggtgacttgcagaaacagct

SEQ ID NO: 7021614 - DNA, 23 bp, Homo sapiens
ttagcacatgcccagagggatga

SEQ ID NO: 7021615 - DNA, 22 bp, Homo sapiens
ttgtgtgtcttcttcactgccc

SEQ ID NO: 7021616 - DNA, 22 bp, Homo sapiens
taagagttgaaggagattttca

SEQ ID NO: 7021617 - DNA, 17 bp, Homo sapiens
aagatttcattagctga

SEQ ID NO: 7021618 - DNA, 22 bp, Homo sapiens
aaactgtatagggaaaagtaga

SEQ ID NO: 7021619 - DNA, 22 bp, Homo sapiens
cccaccagccatctgagagtgt

SEQ ID NO: 7021620 - DNA, 22 bp, Homo sapiens
ggcatgattttggctcactgca

SEQ ID NO: 7021621 - DNA, 22 bp, Homo sapiens
atgaatgagagaatagtggagc

SEQ ID NO: 7021622 - DNA, 22 bp, Homo sapiens
gttgtgcatttatgaagaagtt

SEQ ID NO: 7021623 - DNA, 22 bp, Homo sapiens
atgagggaggggtggtgccgca

SEQ ID NO: 7021624 - DNA, 22 bp, Homo sapiens
gaagttagtcttgaagttagtc

SEQ ID NO: 7021625 - DNA, 22 bp, Homo sapiens
gtattcacatggtggtagattg

SEQ ID NO: 7021626 - DNA, 22 bp, Homo sapiens
gaaagtatgccatctacctctt

SEQ ID NO: 7021627 - DNA, 22 bp, Homo sapiens
tctgggcaatggatgcactcac

SEQ ID NO: 7021628 - DNA, 22 bp, Homo sapiens
agtcaaatatcttaaaaggcta

SEQ ID NO: 7021629 - DNA, 22 bp, Homo sapiens
acttagcattatgtaattacta

SEQ ID NO: 7021630 - DNA, 22 bp, Homo sapiens
tcagtgtgattaggctatctga

SEQ ID NO: 7021631 - DNA, 20 bp, Homo sapiens
taggtccaatgctcgtcttc

SEQ ID NO: 7021632 - DNA, 22 bp, Homo sapiens
tccagagaattctacgcagtgc

SEQ ID NO: 7021633 - DNA, 22 bp, Homo sapiens
ggctcccaggagggcctggagg

SEQ ID NO: 7021634 - DNA, 22 bp, Homo sapiens
ctttccaggaatcctcacagcc

SEQ ID NO: 7021635 - DNA, 22 bp, Homo sapiens
ctctttttcagccttaccaaag

SEQ ID NO: 7021636 - DNA, 22 bp, Homo sapiens
caccagggacaatgctaggggt

SEQ ID NO: 7021637 - DNA, 22 bp, Homo sapiens
tatgtatatgtgtgttgacaac

SEQ ID NO: 7021638 - DNA, 21 bp, Homo sapiens
gctctgtccctgctgtgtgtc

SEQ ID NO: 7021639 - DNA, 22 bp, Homo sapiens
gctgagcacacctagggtagag

SEQ ID NO: 7021640 - DNA, 20 bp, Homo sapiens
atgtactacaggtgataaag

SEQ ID NO: 7021641 - DNA, 22 bp, Homo sapiens
ttccagtcagggcaaactgcca

SEQ ID NO: 7021642 - DNA, 22 bp, Homo sapiens
tgaaccacagaagtcaggagct

SEQ ID NO: 7021643 - DNA, 22 bp, Homo sapiens
tccagtccactgccttgctctt

SEQ ID NO: 7021644 - DNA, 22 bp, Homo sapiens
tctgggaggggctgccattgct

SEQ ID NO: 7021645 - DNA, 21 bp, Homo sapiens
tggccttgagagtctccttgc

SEQ ID NO: 7021646 - DNA, 22 bp, Homo sapiens
tgagtgtgaggtgggagcttgg

SEQ ID NO: 7021647 - DNA, 22 bp, Homo sapiens
cccaggaccgcgcggctgagcg

SEQ ID NO: 7021648 - DNA, 22 bp, Homo sapiens
cagtgcctgggacccggctgtg

SEQ ID NO: 7021649 - DNA, 22 bp, Homo sapiens
tttagaggtaggtagagtccaa

SEQ ID NO: 7021650 - DNA, 22 bp, Homo sapiens
gtgtttcctctagaagccatgg

SEQ ID NO: 7021651 - DNA, 22 bp, Homo sapiens
gtcactggagctcttgcggttc

SEQ ID NO: 7021652 - DNA, 22 bp, Homo sapiens
tcctggggctgcaaggcctgtc

SEQ ID NO: 7021653 - DNA, 22 bp, Homo sapiens
ggctggcctctacagggaggca

SEQ ID NO: 7021654 - DNA, 22 bp, Homo sapiens
agccggggtaattaacacgggg

SEQ ID NO: 7021655 - DNA, 22 bp, Homo sapiens
gggtccagggccagtggctgag

SEQ ID NO: 7021656 - DNA, 22 bp, Homo sapiens
aggcatttaaagatgtaagact

SEQ ID NO: 7021657 - DNA, 22 bp, Homo sapiens
gctttacataaacatttattat

SEQ ID NO: 7021658 - DNA, 22 bp, Homo sapiens
agccaggctcaaggcctgctcc

SEQ ID NO: 7021659 - DNA, 21 bp, Homo sapiens
aagagacatttctcatcagca

SEQ ID NO: 7021660 - DNA, 22 bp, Homo sapiens
gtgaggtaaaatcggtaagatg

SEQ ID NO: 7021661 - DNA, 22 bp, Homo sapiens
ggtgttaacaaagattgaaatg

SEQ ID NO: 7021662 - DNA, 22 bp, Homo sapiens
atacagagcagtaatagaggag

SEQ ID NO: 7021663 - DNA, 22 bp, Homo sapiens
taaatctcactgggtatattgg

SEQ ID NO: 7021664 - DNA, 22 bp, Homo sapiens
ctggcacagagacagaaggatt

SEQ ID NO: 7021665 - DNA, 22 bp, Homo sapiens
tcaggaagtctcaattagctac

SEQ ID NO: 7021666 - DNA, 19 bp, Homo sapiens
taatccaaggctgctctta

SEQ ID NO: 7021667 - DNA, 22 bp, Homo sapiens
aactatttttggagctaactct

SEQ ID NO: 7021668 - DNA, 22 bp, Homo sapiens
atggactctggaggagatagag

SEQ ID NO: 7021669 - DNA, 19 bp, Homo sapiens
tgcaagtgtcttggacaag

SEQ ID NO: 7021670 - DNA, 20 bp, Homo sapiens
tctgccactgcactctgccc

SEQ ID NO: 7021671 - DNA, 22 bp, Homo sapiens
ggtagcgagaacagaccttaag

SEQ ID NO: 7021672 - DNA, 21 bp, Homo sapiens
gaaggagaaagcaagtgctgc

SEQ ID NO: 7021673 - DNA, 22 bp, Homo sapiens
gcccaagatcagtggggcagat

SEQ ID NO: 7021674 - DNA, 22 bp, Homo sapiens
taactgtagtaattctagtttt

SEQ ID NO: 7021675 - DNA, 22 bp, Homo sapiens
ggtggctgaagcagtcttcggg

SEQ ID NO: 7021676 - DNA, 22 bp, Homo sapiens
gccaggagtgtgtggctatgtt

SEQ ID NO: 7021677 - DNA, 22 bp, Homo sapiens
caggggctagcacttaatgttt

SEQ ID NO: 7021678 - DNA, 22 bp, Homo sapiens
cctcaggcttctagttcagtga

SEQ ID NO: 7021679 - DNA, 22 bp, Homo sapiens
cttcatatctctgtagagtttt

SEQ ID NO: 7021680 - DNA, 22 bp, Homo sapiens
ctggccatggagaaggtgaagc

SEQ ID NO: 7021681 - DNA, 22 bp, Homo sapiens
gtcagatgatacactgttgtca

SEQ ID NO: 7021682 - DNA, 22 bp, Homo sapiens
gggctgacaccacccaggcgca

SEQ ID NO: 7021683 - DNA, 22 bp, Homo sapiens
ggtacccagggttgcttcaagt

SEQ ID NO: 7021684 - DNA, 22 bp, Homo sapiens
acccaggctggagtgcagtagc

SEQ ID NO: 7021685 - DNA, 22 bp, Homo sapiens
actggggcaggaaagtatgctg

SEQ ID NO: 7021686 - DNA, 22 bp, Homo sapiens
agggaggcattagctactgcga

SEQ ID NO: 7021687 - DNA, 22 bp, Homo sapiens
cacagtttgggtctccggggca

SEQ ID NO: 7021688 - DNA, 22 bp, Homo sapiens
agggcgacaatggagagcgttt

SEQ ID NO: 7021689 - DNA, 22 bp, Homo sapiens
tctgaagttcttaaattagttt

SEQ ID NO: 7021690 - DNA, 22 bp, Homo sapiens
gctcatctcccttttgaagctg

SEQ ID NO: 7021691 - DNA, 22 bp, Homo sapiens
atgcttccagattggtaggggt

SEQ ID NO: 7021692 - DNA, 22 bp, Homo sapiens
agattctccaaatgcacttcta

SEQ ID NO: 7021693 - DNA, 22 bp, Homo sapiens
gctgaaatgtctttagcagtgt

SEQ ID NO: 7021694 - DNA, 22 bp, Homo sapiens
tcataaaaatagactctaaagt

SEQ ID NO: 7021695 - DNA, 22 bp, Homo sapiens
cataggctcttcagagaactga

SEQ ID NO: 7021696 - DNA, 22 bp, Homo sapiens
tttggctgagaagttgtgcttt

SEQ ID NO: 7021697 - DNA, 22 bp, Homo sapiens
tcttctctcctgcttggcagaa

SEQ ID NO: 7021698 - DNA, 22 bp, Homo sapiens
tgcagggaagtcccagctcctg

SEQ ID NO: 7021699 - DNA, 22 bp, Homo sapiens
ccacagaatcgctagtggagca

SEQ ID NO: 7021700 - DNA, 22 bp, Homo sapiens
ctgtgtcctttaaaaaagacac

SEQ ID NO: 7021701 - DNA, 22 bp, Homo sapiens
caggtgttcaagctggaggcca

SEQ ID NO: 7021702 - DNA, 22 bp, Homo sapiens
ctcccgtgccactggctcctgc

SEQ ID NO: 7021703 - DNA, 22 bp, Homo sapiens
atctctgttttaggagatagtg

SEQ ID NO: 7021704 - DNA, 22 bp, Homo sapiens
tgtctgtctgcacagctcatgg

SEQ ID NO: 7021705 - DNA, 20 bp, Homo sapiens
gcagggcaagggatatgaaa

SEQ ID NO: 7021706 - DNA, 22 bp, Homo sapiens
atctggtgctaacaaatgtgga

SEQ ID NO: 7021707 - DNA, 22 bp, Homo sapiens
agtctttagagtcttagtgttt

SEQ ID NO: 7021708 - DNA, 22 bp, Homo sapiens
ggctctgaggcagatcgatggg

SEQ ID NO: 7021709 - DNA, 22 bp, Homo sapiens
atgctgatctgtaataagattt

SEQ ID NO: 7021710 - DNA, 22 bp, Homo sapiens
ctcaggaagcacaggccctaca

SEQ ID NO: 7021711 - DNA, 22 bp, Homo sapiens
ttctctcagttaaactttgtga

SEQ ID NO: 7021712 - DNA, 22 bp, Homo sapiens
ttctgtccctctagagaaccat

SEQ ID NO: 7021713 - DNA, 22 bp, Homo sapiens
cctgcctggagctgagtgtgga

SEQ ID NO: 7021714 - DNA, 22 bp, Homo sapiens
tgacatcattggccattgggga

SEQ ID NO: 7021715 - DNA, 22 bp, Homo sapiens
tcctgctgctacctggcccacg

SEQ ID NO: 7021716 - DNA, 22 bp, Homo sapiens
tctctgcaactacatcttaggg

SEQ ID NO: 7021717 - DNA, 22 bp, Homo sapiens
caaagtcttcagttgattctga

SEQ ID NO: 7021718 - DNA, 22 bp, Homo sapiens
agggagctgtggtcagctcagt

SEQ ID NO: 7021719 - DNA, 22 bp, Homo sapiens
atcattgtaaataatgctgcca

SEQ ID NO: 7021720 - DNA, 22 bp, Homo sapiens
tgcttgcttctcacatgcacct

SEQ ID NO: 7021721 - DNA, 22 bp, Homo sapiens
ctgacagctgaattgcttgcat

SEQ ID NO: 7021722 - DNA, 22 bp, Homo sapiens
tatttattcattcagcaagcat

SEQ ID NO: 7021723 - DNA, 22 bp, Homo sapiens
tgaattgaattgaattgaattg

SEQ ID NO: 7021724 - DNA, 22 bp, Homo sapiens
ggccagcaggccctgtgatcct

SEQ ID NO: 7021725 - DNA, 17 bp, Homo sapiens
tgctggcaacatacaaa

SEQ ID NO: 7021726 - DNA, 22 bp, Homo sapiens
ccagtattcgatctggccagtt

SEQ ID NO: 7021727 - DNA, 23 bp, Homo sapiens
tctcaagccagaccaggcctcgc

SEQ ID NO: 7021728 - DNA, 22 bp, Homo sapiens
agctgcaccggctggaccactg

SEQ ID NO: 7021729 - DNA, 22 bp, Homo sapiens
tcttccaggctagagttgttgc

SEQ ID NO: 7021730 - DNA, 22 bp, Homo sapiens
aagcctttgtttgggaagtttt

SEQ ID NO: 7021731 - DNA, 22 bp, Homo sapiens
tgagattgtgtgcttcagaaat

SEQ ID NO: 7021732 - DNA, 22 bp, Homo sapiens
tttctaagtatcttgcagtttt

SEQ ID NO: 7021733 - DNA, 19 bp, Homo sapiens
cccagccaggtcttgcatc

SEQ ID NO: 7021734 - DNA, 18 bp, Homo sapiens
ctgaggccaactacactg

SEQ ID NO: 7021735 - DNA, 22 bp, Homo sapiens
tggtgtgaggcgggagtgtagt

SEQ ID NO: 7021736 - DNA, 22 bp, Homo sapiens
gctgggctcatttgtgtgtctg

SEQ ID NO: 7021737 - DNA, 22 bp, Homo sapiens
atgttattgatgcctgaggctt

SEQ ID NO: 7021738 - DNA, 21 bp, Homo sapiens
actgttccttcagacatcctt

SEQ ID NO: 7021739 - DNA, 22 bp, Homo sapiens
agctccagcctcttctggaggt

SEQ ID NO: 7021740 - DNA, 22 bp, Homo sapiens
tgggatataatctgaaaagtat

SEQ ID NO: 7021741 - DNA, 22 bp, Homo sapiens
acagggcttgtgacaactttaa

SEQ ID NO: 7021742 - DNA, 22 bp, Homo sapiens
catgttctaacaatgagaaacc

SEQ ID NO: 7021743 - DNA, 22 bp, Homo sapiens
catgtaatcctggggagatgaa

SEQ ID NO: 7021744 - DNA, 22 bp, Homo sapiens
atgaggtttgagcctcttgacc

SEQ ID NO: 7021745 - DNA, 22 bp, Homo sapiens
ctgttatcatcaggaggggata

SEQ ID NO: 7021746 - DNA, 20 bp, Homo sapiens
ctcagcagattcttctagaa

SEQ ID NO: 7021747 - DNA, 22 bp, Homo sapiens
tttcacagaaagaagctagttt

SEQ ID NO: 7021748 - DNA, 22 bp, Homo sapiens
aattcatagcaacaaagaccca

SEQ ID NO: 7021749 - DNA, 22 bp, Homo sapiens
cagcacagtacaaggcacggat

SEQ ID NO: 7021750 - DNA, 22 bp, Homo sapiens
caggcccatgagggcagccaca

SEQ ID NO: 7021751 - DNA, 22 bp, Homo sapiens
ctagaatcccaaatggactggg

SEQ ID NO: 7021752 - DNA, 22 bp, Homo sapiens
agagtttaaacactgtcacaga

SEQ ID NO: 7021753 - DNA, 22 bp, Homo sapiens
agggaagccccgaggaggcacc

SEQ ID NO: 7021754 - DNA, 22 bp, Homo sapiens
tacctgagaagaaacccgtgtt

SEQ ID NO: 7021755 - DNA, 22 bp, Homo sapiens
gctgggtctggatgctcaggtg

SEQ ID NO: 7021756 - DNA, 19 bp, Homo sapiens
ccttttttaacttcagcaa

SEQ ID NO: 7021757 - DNA, 22 bp, Homo sapiens
ccacttttctacccactgtgac

SEQ ID NO: 7021758 - DNA, 22 bp, Homo sapiens
ctaggctgcacctaggatggct

SEQ ID NO: 7021759 - DNA, 22 bp, Homo sapiens
tcactgaaaaccatacttcttt

SEQ ID NO: 7021760 - DNA, 22 bp, Homo sapiens
gttatattgccaagtatattgt

SEQ ID NO: 7021761 - DNA, 22 bp, Homo sapiens
gcattcatcaaaaatgttcctc

SEQ ID NO: 7021762 - DNA, 22 bp, Homo sapiens
gctgacattccctgtgaaactt

SEQ ID NO: 7021763 - DNA, 23 bp, Homo sapiens
tatggcttacagtgctttaggta

SEQ ID NO: 7021764 - DNA, 22 bp, Homo sapiens
tgtgtgtccttgacctcagtgg

SEQ ID NO: 7021765 - DNA, 22 bp, Homo sapiens
agatggcttgtgagatgaacaa

SEQ ID NO: 7021766 - DNA, 22 bp, Homo sapiens
atggccagtgttgagatcaggc

SEQ ID NO: 7021767 - DNA, 22 bp, Homo sapiens
gcagagaggaatgaagccatcc

SEQ ID NO: 7021768 - DNA, 22 bp, Homo sapiens
agggcagcaatgcagctgctgc

SEQ ID NO: 7021769 - DNA, 22 bp, Homo sapiens
agatgtttataactcatgagtg

SEQ ID NO: 7021770 - DNA, 18 bp, Homo sapiens
gtcactgtgtttctgagc

SEQ ID NO: 7021771 - DNA, 22 bp, Homo sapiens
agccagttcaagttatggcgtt

SEQ ID NO: 7021772 - DNA, 22 bp, Homo sapiens
tggattagtttcaaggcagcaa

SEQ ID NO: 7021773 - DNA, 22 bp, Homo sapiens
tgatttccacagtcaggggtgc

SEQ ID NO: 7021774 - DNA, 22 bp, Homo sapiens
tctgagggtaaggttaaggtag

SEQ ID NO: 7021775 - DNA, 22 bp, Homo sapiens
aagattctacaaactctggtaa

SEQ ID NO: 7021776 - DNA, 20 bp, Homo sapiens
gcagggcatcttggccccca

SEQ ID NO: 7021777 - DNA, 22 bp, Homo sapiens
cagagccaggcctgccctcttt

SEQ ID NO: 7021778 - DNA, 22 bp, Homo sapiens
agcaattatgataaggccgctg

SEQ ID NO: 7021779 - DNA, 22 bp, Homo sapiens
tagggtccatatggatgaatgg

SEQ ID NO: 7021780 - DNA, 22 bp, Homo sapiens
aatggaatacctaggtggccca

SEQ ID NO: 7021781 - DNA, 22 bp, Homo sapiens
tgcagcattatgtagctgtttt

SEQ ID NO: 7021782 - DNA, 22 bp, Homo sapiens
gatactgtggtgcatctggagt

SEQ ID NO: 7021783 - DNA, 22 bp, Homo sapiens
tgaccctgagagctgaatggct

SEQ ID NO: 7021784 - DNA, 22 bp, Homo sapiens
ctccacagagcatgcttatagg

SEQ ID NO: 7021785 - DNA, 22 bp, Homo sapiens
cagatggggcaaggccatctgt

SEQ ID NO: 7021786 - DNA, 22 bp, Homo sapiens
cctatagttttgtattctgtct

SEQ ID NO: 7021787 - DNA, 22 bp, Homo sapiens
gaggttgtttcaacagtagtct

SEQ ID NO: 7021788 - DNA, 22 bp, Homo sapiens
gaggaggctgaacaatgccctg

SEQ ID NO: 7021789 - DNA, 22 bp, Homo sapiens
tactgtgtgattccatttacgt

SEQ ID NO: 7021790 - DNA, 22 bp, Homo sapiens
tactttattcaggaaggctggt

SEQ ID NO: 7021791 - DNA, 22 bp, Homo sapiens
attgggcggtgtccagaggctc

SEQ ID NO: 7021792 - DNA, 22 bp, Homo sapiens
ttcttctgaaacataatcaata

SEQ ID NO: 7021793 - DNA, 22 bp, Homo sapiens
ggcactgtttttgtattcagtt

SEQ ID NO: 7021794 - DNA, 22 bp, Homo sapiens
gcctacatgcttttagtgtttc

SEQ ID NO: 7021795 - DNA, 22 bp, Homo sapiens
aggccaaagctcacctgcagct

SEQ ID NO: 7021796 - DNA, 22 bp, Homo sapiens
gagacaatttctaagatgcttc

SEQ ID NO: 7021797 - DNA, 22 bp, Homo sapiens
tatggcatatagtccagcataa

SEQ ID NO: 7021798 - DNA, 22 bp, Homo sapiens
tcatggcttttattatgttgag

SEQ ID NO: 7021799 - DNA, 22 bp, Homo sapiens
tcctgggatttgcccttttctc

SEQ ID NO: 7021800 - DNA, 19 bp, Homo sapiens
agccccttggtactgtcct

SEQ ID NO: 7021801 - DNA, 22 bp, Homo sapiens
ggaggtggtggcagtgacaatt

SEQ ID NO: 7021802 - DNA, 19 bp, Homo sapiens
gctgggtggggtccacagc

SEQ ID NO: 7021803 - DNA, 22 bp, Homo sapiens
cagtgctggctgttaggacagt

SEQ ID NO: 7021804 - DNA, 22 bp, Homo sapiens
cagaactggcctttcatcagtc

SEQ ID NO: 7021805 - DNA, 22 bp, Homo sapiens
aggggccacctgtggcaccctg

SEQ ID NO: 7021806 - DNA, 22 bp, Homo sapiens
gcagaacagtctgtcggttcta

SEQ ID NO: 7021807 - DNA, 22 bp, Homo sapiens
ttatgtacctgaattagtaaag

SEQ ID NO: 7021808 - DNA, 22 bp, Homo sapiens
tgaccagacatcaatttcaaag

SEQ ID NO: 7021809 - DNA, 22 bp, Homo sapiens
aacttcctgacttctaatgagt

SEQ ID NO: 7021810 - DNA, 22 bp, Homo sapiens
tggtggcaaatcaggacacttc

SEQ ID NO: 7021811 - DNA, 22 bp, Homo sapiens
ggagggagggctagaccaaaga

SEQ ID NO: 7021812 - DNA, 22 bp, Homo sapiens
tttcgagggattagctaggact

SEQ ID NO: 7021813 - DNA, 22 bp, Homo sapiens
cctggatcgatgccgagggaaa

SEQ ID NO: 7021814 - DNA, 17 bp, Homo sapiens
tgcaggctgttatagcc

SEQ ID NO: 7021815 - DNA, 22 bp, Homo sapiens
cgctgggtgcagtgattggcat

SEQ ID NO: 7021816 - DNA, 22 bp, Homo sapiens
catgcagcagaataatgactat

SEQ ID NO: 7021817 - DNA, 22 bp, Homo sapiens
aagatcaccaagtaacagtctg

SEQ ID NO: 7021818 - DNA, 22 bp, Homo sapiens
ttgtatagtaagtgaatgttta

SEQ ID NO: 7021819 - DNA, 22 bp, Homo sapiens
tcagtgcttgacagctctggga

SEQ ID NO: 7021820 - DNA, 22 bp, Homo sapiens
ggcaaaaacagcaatgactttt

SEQ ID NO: 7021821 - DNA, 22 bp, Homo sapiens
ctacactttggttgactttgtg

SEQ ID NO: 7021822 - DNA, 22 bp, Homo sapiens
cttatacaccctcttcccaggc

SEQ ID NO: 7021823 - DNA, 22 bp, Homo sapiens
tatttgcttttgtgccacagat

SEQ ID NO: 7021824 - DNA, 22 bp, Homo sapiens
aaatctgggtcaaggtggagtg

SEQ ID NO: 7021825 - DNA, 22 bp, Homo sapiens
attataaatattttctaggggt

SEQ ID NO: 7021826 - DNA, 17 bp, Homo sapiens
tgctgcagacccacccc

SEQ ID NO: 7021827 - DNA, 22 bp, Homo sapiens
cagaaacttctggtgtcaaata

SEQ ID NO: 7021828 - DNA, 22 bp, Homo sapiens
tgttttcatcacagaatgtaac

SEQ ID NO: 7021829 - DNA, 18 bp, Homo sapiens
tctgcaggacctcagggc

SEQ ID NO: 7021830 - DNA, 22 bp, Homo sapiens
ggtttcaactaaatcaagaagg

SEQ ID NO: 7021831 - DNA, 22 bp, Homo sapiens
gtgggggctggaaatcttgcca

SEQ ID NO: 7021832 - DNA, 22 bp, Homo sapiens
tctttcaaagctgtagtagatt

SEQ ID NO: 7021833 - DNA, 22 bp, Homo sapiens
ttcctagaatggttagaaaata

SEQ ID NO: 7021834 - DNA, 22 bp, Homo sapiens
tcagtgtcttctctttcctacc

SEQ ID NO: 7021835 - DNA, 22 bp, Homo sapiens
gcaagatggttataaaaaatgt

SEQ ID NO: 7021836 - DNA, 22 bp, Homo sapiens
cccatttaaacacaagctttca

SEQ ID NO: 7021837 - DNA, 22 bp, Homo sapiens
ctcctccagacttactgaatcc

SEQ ID NO: 7021838 - DNA, 20 bp, Homo sapiens
aaggttactgaaatccatta

SEQ ID NO: 7021839 - DNA, 22 bp, Homo sapiens
aaataacttggtttcatcagag

SEQ ID NO: 7021840 - DNA, 22 bp, Homo sapiens
tggaagggaacaggtgggtgtt

SEQ ID NO: 7021841 - DNA, 22 bp, Homo sapiens
gagtatatatagacatgtcaca

SEQ ID NO: 7021842 - DNA, 22 bp, Homo sapiens
gctttaacacaaaagcagccaa

SEQ ID NO: 7021843 - DNA, 23 bp, Homo sapiens
ggagggcttcatcagacccccag

SEQ ID NO: 7021844 - DNA, 22 bp, Homo sapiens
attcagttatttactttgctat

SEQ ID NO: 7021845 - DNA, 22 bp, Homo sapiens
tgcttattctttccacaattca

SEQ ID NO: 7021846 - DNA, 22 bp, Homo sapiens
gaggagacggggtgcctggagc

SEQ ID NO: 7021847 - DNA, 22 bp, Homo sapiens
gactttgccactgacctccaac

SEQ ID NO: 7021848 - DNA, 22 bp, Homo sapiens
ctaggtacttagtaaatattaa

SEQ ID NO: 7021849 - DNA, 22 bp, Homo sapiens
taagatggcagatgagcttgtt

SEQ ID NO: 7021850 - DNA, 22 bp, Homo sapiens
tggagctgatacagctggcttt

SEQ ID NO: 7021851 - DNA, 22 bp, Homo sapiens
aacagtatatgaaatgttagga

SEQ ID NO: 7021852 - DNA, 22 bp, Homo sapiens
gtaatacctttctaacacttga

SEQ ID NO: 7021853 - DNA, 20 bp, Homo sapiens
acaaattggcagaatgacaa

SEQ ID NO: 7021854 - DNA, 22 bp, Homo sapiens
atggccaagatcacagacttca

SEQ ID NO: 7021855 - DNA, 22 bp, Homo sapiens
tttggttaatttaggcttgcat

SEQ ID NO: 7021856 - DNA, 22 bp, Homo sapiens
gcctgccatgagctaatgacac

SEQ ID NO: 7021857 - DNA, 22 bp, Homo sapiens
gtatctttccacatcttcagta

SEQ ID NO: 7021858 - DNA, 22 bp, Homo sapiens
tcagacatatttttaacaaagt

SEQ ID NO: 7021859 - DNA, 21 bp, Homo sapiens
gagacagactttcgtcccctg

SEQ ID NO: 7021860 - DNA, 22 bp, Homo sapiens
agctgagagctgtgtcaagata

SEQ ID NO: 7021861 - DNA, 22 bp, Homo sapiens
ccatccagaagggtttgaaaga

SEQ ID NO: 7021862 - DNA, 23 bp, Homo sapiens
gcctgggttgtaactagtgcatc

SEQ ID NO: 7021863 - DNA, 22 bp, Homo sapiens
gggatgactttttgaaatggat

SEQ ID NO: 7021864 - DNA, 22 bp, Homo sapiens
attgtactctagcctctgggca

SEQ ID NO: 7021865 - DNA, 22 bp, Homo sapiens
aaacctttctcagtgctaaaat

SEQ ID NO: 7021866 - DNA, 22 bp, Homo sapiens
ctcccttcaggagaggctcaca

SEQ ID NO: 7021867 - DNA, 22 bp, Homo sapiens
gtggccaactcaatgtttttca

SEQ ID NO: 7021868 - DNA, 22 bp, Homo sapiens
cttatgctgagaatgaaagaat

SEQ ID NO: 7021869 - DNA, 22 bp, Homo sapiens
aggtttgaagacgtcattgagg

SEQ ID NO: 7021870 - DNA, 22 bp, Homo sapiens
aacttagttaagattaagtctc

SEQ ID NO: 7021871 - DNA, 22 bp, Homo sapiens
gtcactggaattacaggcatgc

SEQ ID NO: 7021872 - DNA, 22 bp, Homo sapiens
acagcaggaattaacatataag

SEQ ID NO: 7021873 - DNA, 22 bp, Homo sapiens
ggtgccatattatatacagttt

SEQ ID NO: 7021874 - DNA, 22 bp, Homo sapiens
gcctggcagcctccaaccttca

SEQ ID NO: 7021875 - DNA, 22 bp, Homo sapiens
actgcttcctggatggccagca

SEQ ID NO: 7021876 - DNA, 22 bp, Homo sapiens
cttcatgagggtaatctacaaa

SEQ ID NO: 7021877 - DNA, 22 bp, Homo sapiens
aggctctctctgccagccgtgc

SEQ ID NO: 7021878 - DNA, 21 bp, Homo sapiens
tgggccagatctgagtttcta

SEQ ID NO: 7021879 - DNA, 22 bp, Homo sapiens
cactatgcttacatgcttatat

SEQ ID NO: 7021880 - DNA, 22 bp, Homo sapiens
ctgtgacctccaggaaggggtg

SEQ ID NO: 7021881 - DNA, 19 bp, Homo sapiens
gcctttgttccttttgtct

SEQ ID NO: 7021882 - DNA, 22 bp, Homo sapiens
agaagcacctgtcagctacatg

SEQ ID NO: 7021883 - DNA, 22 bp, Homo sapiens
gacttgggggctttggataggc

SEQ ID NO: 7021884 - DNA, 22 bp, Homo sapiens
cactgtccctgtttcctggaaa

SEQ ID NO: 7021885 - DNA, 22 bp, Homo sapiens
ctgccaggtgcctttgtgcagt

SEQ ID NO: 7021886 - DNA, 22 bp, Homo sapiens
gagaacttgaacttttcctctg

SEQ ID NO: 7021887 - DNA, 22 bp, Homo sapiens
gactttaaagcctgacatttta

SEQ ID NO: 7021888 - DNA, 22 bp, Homo sapiens
tctcaggggcctggagtcctgg

SEQ ID NO: 7021889 - DNA, 22 bp, Homo sapiens
atcagaaggggaggtaaagaag

SEQ ID NO: 7021890 - DNA, 22 bp, Homo sapiens
cggaaactacgtgacacccgtt

SEQ ID NO: 7021891 - DNA, 22 bp, Homo sapiens
ctgtatttcccacattctctat

SEQ ID NO: 7021892 - DNA, 22 bp, Homo sapiens
cagggggctgtggctgtccagt

SEQ ID NO: 7021893 - DNA, 22 bp, Homo sapiens
gctcacagcccaggccagcgtg

SEQ ID NO: 7021894 - DNA, 22 bp, Homo sapiens
tctctggactcgagcttactca

SEQ ID NO: 7021895 - DNA, 22 bp, Homo sapiens
cctgggcttacgacctctgact

SEQ ID NO: 7021896 - DNA, 22 bp, Homo sapiens
tcctgctgctcttgggaaacct

SEQ ID NO: 7021897 - DNA, 22 bp, Homo sapiens
tccctggttacgtataaagatg

SEQ ID NO: 7021898 - DNA, 22 bp, Homo sapiens
cccgggaggcggaggttgcagt

SEQ ID NO: 7021899 - DNA, 22 bp, Homo sapiens
gcaaatgcactgcatttagatt

SEQ ID NO: 7021900 - DNA, 21 bp, Homo sapiens
aacaggtcccccacgggcttt

SEQ ID NO: 7021901 - DNA, 22 bp, Homo sapiens
tagaatctggaaggggctattc

SEQ ID NO: 7021902 - DNA, 19 bp, Homo sapiens
tcctgcagaccagacctgt

SEQ ID NO: 7021903 - DNA, 22 bp, Homo sapiens
agaacagcttgcctttaataga

SEQ ID NO: 7021904 - DNA, 21 bp, Homo sapiens
tggtacagaggaggtgaagtg

SEQ ID NO: 7021905 - DNA, 22 bp, Homo sapiens
gagctgagggtctaggagggtt

SEQ ID NO: 7021906 - DNA, 22 bp, Homo sapiens
agtcagagttcttggggagaca

SEQ ID NO: 7021907 - DNA, 22 bp, Homo sapiens
gaggcagcaataaaaagaattt

SEQ ID NO: 7021908 - DNA, 22 bp, Homo sapiens
tgatgccaataaaactctccct

SEQ ID NO: 7021909 - DNA, 22 bp, Homo sapiens
agtctgtggggtccctggggca

SEQ ID NO: 7021910 - DNA, 22 bp, Homo sapiens
tgggaggaagtgctaatgggag

SEQ ID NO: 7021911 - DNA, 23 bp, Homo sapiens
aattcctagtcgatctaaatcag

SEQ ID NO: 7021912 - DNA, 22 bp, Homo sapiens
gcagctttaaaggaggctctga

SEQ ID NO: 7021913 - DNA, 22 bp, Homo sapiens
tcttgtatgtcttcatctggtt

SEQ ID NO: 7021914 - DNA, 22 bp, Homo sapiens
ttcagcaagaccaccatgtacc

SEQ ID NO: 7021915 - DNA, 22 bp, Homo sapiens
taaatggcaacccctagagctg

SEQ ID NO: 7021916 - DNA, 22 bp, Homo sapiens
aaatgtcaaggtgatagatgca

SEQ ID NO: 7021917 - DNA, 22 bp, Homo sapiens
agagggcagggcggtaagtcct

SEQ ID NO: 7021918 - DNA, 22 bp, Homo sapiens
taggaagctgagcagcattcct

SEQ ID NO: 7021919 - DNA, 22 bp, Homo sapiens
ttggaattgctcataagagaga

SEQ ID NO: 7021920 - DNA, 22 bp, Homo sapiens
agcgcttgccgcactccaagca

SEQ ID NO: 7021921 - DNA, 22 bp, Homo sapiens
gctgcctctgcgactctgggcg

SEQ ID NO: 7021922 - DNA, 22 bp, Homo sapiens
cagcatccgttctcaggactga

SEQ ID NO: 7021923 - DNA, 22 bp, Homo sapiens
cagctttctttccataaggttt

SEQ ID NO: 7021924 - DNA, 22 bp, Homo sapiens
ggaacatttaaattcttatttg

SEQ ID NO: 7021925 - DNA, 22 bp, Homo sapiens
ggaaatcaagaagcagatgagt

SEQ ID NO: 7021926 - DNA, 22 bp, Homo sapiens
ccctgcctacagggttttcttt

SEQ ID NO: 7021927 - DNA, 22 bp, Homo sapiens
cctgaggtcacaacttgcttat

SEQ ID NO: 7021928 - DNA, 22 bp, Homo sapiens
ttcaaattaccacatttgctta

SEQ ID NO: 7021929 - DNA, 22 bp, Homo sapiens
ctgcattactaacaaactccca

SEQ ID NO: 7021930 - DNA, 22 bp, Homo sapiens
tctgccagttagaaactggtta

SEQ ID NO: 7021931 - DNA, 22 bp, Homo sapiens
cctttggtcacctccactctta

SEQ ID NO: 7021932 - DNA, 22 bp, Homo sapiens
gcagagtgaagggagaggtgtg

SEQ ID NO: 7021933 - DNA, 22 bp, Homo sapiens
ctctttgtcactcatacagtca

SEQ ID NO: 7021934 - DNA, 22 bp, Homo sapiens
cctgtggaccaggaggcagccc

SEQ ID NO: 7021935 - DNA, 22 bp, Homo sapiens
gtcatttttgactttgaagtga

SEQ ID NO: 7021936 - DNA, 22 bp, Homo sapiens
gaaaactattggcctagaacaa

SEQ ID NO: 7021937 - DNA, 22 bp, Homo sapiens
agtgtattttcttgctaggaat

SEQ ID NO: 7021938 - DNA, 22 bp, Homo sapiens
agcaggctttccacagaaggag

SEQ ID NO: 7021939 - DNA, 18 bp, Homo sapiens
tgaggctcagagacggtg

SEQ ID NO: 7021940 - DNA, 22 bp, Homo sapiens
ttagaggaaagactgggactaa

SEQ ID NO: 7021941 - DNA, 20 bp, Homo sapiens
ttgaatgaatgtctggctca

SEQ ID NO: 7021942 - DNA, 22 bp, Homo sapiens
ttcctgtattttgcgaattttc

SEQ ID NO: 7021943 - DNA, 22 bp, Homo sapiens
cagtgcataccctttccctcat

SEQ ID NO: 7021944 - DNA, 22 bp, Homo sapiens
ttgctgagagcgtgtcaacaag

SEQ ID NO: 7021945 - DNA, 22 bp, Homo sapiens
ctgcacccaggcctggtcccag

SEQ ID NO: 7021946 - DNA, 22 bp, Homo sapiens
tccgcccgcacgtatggagtgg

SEQ ID NO: 7021947 - DNA, 22 bp, Homo sapiens
tgggctaccagagttctaactt

SEQ ID NO: 7021948 - DNA, 22 bp, Homo sapiens
tttgagaaacagacgaaagaca

SEQ ID NO: 7021949 - DNA, 22 bp, Homo sapiens
atttgcagctaggatccaaagt

SEQ ID NO: 7021950 - DNA, 22 bp, Homo sapiens
tggaatgtatagatgttatgta

SEQ ID NO: 7021951 - DNA, 22 bp, Homo sapiens
aagggcagctattatcgtcatc

SEQ ID NO: 7021952 - DNA, 22 bp, Homo sapiens
gtggcagagttcaggcgtttgg

SEQ ID NO: 7021953 - DNA, 22 bp, Homo sapiens
gtatttcttccacggtggattt

SEQ ID NO: 7021954 - DNA, 22 bp, Homo sapiens
agatggtccatctattttctat

SEQ ID NO: 7021955 - DNA, 22 bp, Homo sapiens
actctgaggcaggtcagggcag

SEQ ID NO: 7021956 - DNA, 22 bp, Homo sapiens
gctgccactctgagcttgcttc

SEQ ID NO: 7021957 - DNA, 22 bp, Homo sapiens
ttgaactggtagttggaaatct

SEQ ID NO: 7021958 - DNA, 22 bp, Homo sapiens
aatgggaaaagagtatgattta

SEQ ID NO: 7021959 - DNA, 22 bp, Homo sapiens
agttttcattaccatgctgcaa

SEQ ID NO: 7021960 - DNA, 22 bp, Homo sapiens
atgtaacaaatggtatacatgt

SEQ ID NO: 7021961 - DNA, 22 bp, Homo sapiens
agctggttcatggactgcctgg

SEQ ID NO: 7021962 - DNA, 22 bp, Homo sapiens
taggcttgcttctcctccacag

SEQ ID NO: 7021963 - DNA, 22 bp, Homo sapiens
tttggcaggtagtcccaaaggg

SEQ ID NO: 7021964 - DNA, 21 bp, Homo sapiens
gctctatcaggccaaaatgtc

SEQ ID NO: 7021965 - DNA, 22 bp, Homo sapiens
tggggccacagcctcctagctt

SEQ ID NO: 7021966 - DNA, 22 bp, Homo sapiens
agttgcttccctattcttagca

SEQ ID NO: 7021967 - DNA, 22 bp, Homo sapiens
cagaatggcttttatggctcag

SEQ ID NO: 7021968 - DNA, 22 bp, Homo sapiens
gtggagggtttgcaatgtgcag

SEQ ID NO: 7021969 - DNA, 16 bp, Homo sapiens
atcttccaaagttatt

SEQ ID NO: 7021970 - DNA, 22 bp, Homo sapiens
cataaagtcatgatctgagtat

SEQ ID NO: 7021971 - DNA, 22 bp, Homo sapiens
gctggccacagatccccaggga

SEQ ID NO: 7021972 - DNA, 21 bp, Homo sapiens
gtttgacctaaggaaggattt

SEQ ID NO: 7021973 - DNA, 22 bp, Homo sapiens
ttctctggccatagctggctag

SEQ ID NO: 7021974 - DNA, 22 bp, Homo sapiens
tgaggagcgggcagggatgcag

SEQ ID NO: 7021975 - DNA, 22 bp, Homo sapiens
ctctcatgcaaaatttagttct

SEQ ID NO: 7021976 - DNA, 22 bp, Homo sapiens
tgtgccctgttaaatgcacagt

SEQ ID NO: 7021977 - DNA, 22 bp, Homo sapiens
tcaggaaagctgcggtcacctg

SEQ ID NO: 7021978 - DNA, 22 bp, Homo sapiens
gagccccaggacagctctagtt

SEQ ID NO: 7021979 - DNA, 22 bp, Homo sapiens
cagatattaggagctcaataat

SEQ ID NO: 7021980 - DNA, 17 bp, Homo sapiens
agctcctggggtcttta

SEQ ID NO: 7021981 - DNA, 22 bp, Homo sapiens
ctgctctgaccctttcaccttc

SEQ ID NO: 7021982 - DNA, 22 bp, Homo sapiens
aatatagtgttagctcatttga

SEQ ID NO: 7021983 - DNA, 22 bp, Homo sapiens
tacagcatatacagaatgaaca

SEQ ID NO: 7021984 - DNA, 19 bp, Homo sapiens
aactacagcgcactgtcct

SEQ ID NO: 7021985 - DNA, 23 bp, Homo sapiens
agacttctccaacaagcttggct

SEQ ID NO: 7021986 - DNA, 22 bp, Homo sapiens
aagtccagtgctttagattcca

SEQ ID NO: 7021987 - DNA, 22 bp, Homo sapiens
ttacacaatatatggtacttgg

SEQ ID NO: 7021988 - DNA, 22 bp, Homo sapiens
agctgctcagatcccggggaag

SEQ ID NO: 7021989 - DNA, 22 bp, Homo sapiens
agggtggcacctggaagggatg

SEQ ID NO: 7021990 - DNA, 22 bp, Homo sapiens
aacatctgtgtttgaatctcaa

SEQ ID NO: 7021991 - DNA, 22 bp, Homo sapiens
agctgaggaataataacaaggt

SEQ ID NO: 7021992 - DNA, 22 bp, Homo sapiens
atctttgctattgtaaatcacg

SEQ ID NO: 7021993 - DNA, 22 bp, Homo sapiens
ggggcactttactgcctcatct

SEQ ID NO: 7021994 - DNA, 22 bp, Homo sapiens
gcctctctcgggcttgtagcgg

SEQ ID NO: 7021995 - DNA, 22 bp, Homo sapiens
ttacaaggaggatagcatttcc

SEQ ID NO: 7021996 - DNA, 22 bp, Homo sapiens
actgatttcagggatgagaaga

SEQ ID NO: 7021997 - DNA, 22 bp, Homo sapiens
tacagcctcttccctggagtgg

SEQ ID NO: 7021998 - DNA, 22 bp, Homo sapiens
gagacggggccctggccaggcg

SEQ ID NO: 7021999 - DNA, 22 bp, Homo sapiens
aattcccaccttctctcttttg

SEQ ID NO: 7022000 - DNA, 22 bp, Homo sapiens
agaccagggtcccacagagtct

SEQ ID NO: 7022001 - DNA, 22 bp, Homo sapiens
tggccctgctatgatcctgcaa

SEQ ID NO: 7022002 - DNA, 22 bp, Homo sapiens
agtgggacagtgtagagcgtca

SEQ ID NO: 7022003 - DNA, 22 bp, Homo sapiens
cccagggagagcgcggaggcgg

SEQ ID NO: 7022004 - DNA, 22 bp, Homo sapiens
atttcatatgtatcacctagcc

SEQ ID NO: 7022005 - DNA, 22 bp, Homo sapiens
tcttgattaataccttagccct

SEQ ID NO: 7022006 - DNA, 21 bp, Homo sapiens
tcacaggctcagggagagagt

SEQ ID NO: 7022007 - DNA, 22 bp, Homo sapiens
tggcatcattttcagctggcca

SEQ ID NO: 7022008 - DNA, 21 bp, Homo sapiens
tcagcagcatctgcctagagt

SEQ ID NO: 7022009 - DNA, 22 bp, Homo sapiens
cttgagttacagctctccaaga

SEQ ID NO: 7022010 - DNA, 22 bp, Homo sapiens
cagcacatagtaggtattcact

SEQ ID NO: 7022011 - DNA, 22 bp, Homo sapiens
tgatgactgccattctattact

SEQ ID NO: 7022012 - DNA, 22 bp, Homo sapiens
tgctgcctgttgtggggccacg

SEQ ID NO: 7022013 - DNA, 22 bp, Homo sapiens
ttggggaaggcttccctgtacc

SEQ ID NO: 7022014 - DNA, 22 bp, Homo sapiens
ggcccagctctattgaattaca

SEQ ID NO: 7022015 - DNA, 19 bp, Homo sapiens
tggagactgagagtgagca

SEQ ID NO: 7022016 - DNA, 22 bp, Homo sapiens
ccagaggtgagggggattcttg

SEQ ID NO: 7022017 - DNA, 22 bp, Homo sapiens
aagcaggtgtgagccagtgggc

SEQ ID NO: 7022018 - DNA, 22 bp, Homo sapiens
ttatttcctagggaatttgcct

SEQ ID NO: 7022019 - DNA, 19 bp, Homo sapiens
aatgtcagcatgttaattt

SEQ ID NO: 7022020 - DNA, 22 bp, Homo sapiens
cctgtgtcagcccctgcctcca

SEQ ID NO: 7022021 - DNA, 22 bp, Homo sapiens
gtgagccattctactcctaacc

SEQ ID NO: 7022022 - DNA, 22 bp, Homo sapiens
ttgccctgtctcactatgttaa

SEQ ID NO: 7022023 - DNA, 22 bp, Homo sapiens
aagcagcatatgacagcatcca

SEQ ID NO: 7022024 - DNA, 22 bp, Homo sapiens
taaaggaagaattctctgtgat

SEQ ID NO: 7022025 - DNA, 22 bp, Homo sapiens
atatgaaaatgttttagctgta

SEQ ID NO: 7022026 - DNA, 22 bp, Homo sapiens
ggcggcgcgtagccggagactt

SEQ ID NO: 7022027 - DNA, 22 bp, Homo sapiens
ggcaatatggtgaaaccccatc

SEQ ID NO: 7022028 - DNA, 22 bp, Homo sapiens
tttcccattctaattactcatt

SEQ ID NO: 7022029 - DNA, 20 bp, Homo sapiens
tcagacccagattagcaggt

SEQ ID NO: 7022030 - DNA, 21 bp, Homo sapiens
acagaactgtatagtgataaa

SEQ ID NO: 7022031 - DNA, 22 bp, Homo sapiens
taactgtgaagtaattgtggat

SEQ ID NO: 7022032 - DNA, 22 bp, Homo sapiens
ccagcaggagatgcctgtgtct

SEQ ID NO: 7022033 - DNA, 22 bp, Homo sapiens
tctgtttttgaggctatcttct

SEQ ID NO: 7022034 - DNA, 22 bp, Homo sapiens
tacatgtttactccaagtcagg

SEQ ID NO: 7022035 - DNA, 22 bp, Homo sapiens
aggctgtgagaggtggctccca

SEQ ID NO: 7022036 - DNA, 22 bp, Homo sapiens
aagcagagaaaagcttaggttc

SEQ ID NO: 7022037 - DNA, 22 bp, Homo sapiens
gaatacattggaaatcagaata

SEQ ID NO: 7022038 - DNA, 20 bp, Homo sapiens
ttagttgagtagctcctgaa

SEQ ID NO: 7022039 - DNA, 22 bp, Homo sapiens
aatgagttagatgagaaaataa

SEQ ID NO: 7022040 - DNA, 22 bp, Homo sapiens
taaggaggctgctgtgaagaaa

SEQ ID NO: 7022041 - DNA, 22 bp, Homo sapiens
aagggttgggactattatgact

SEQ ID NO: 7022042 - DNA, 22 bp, Homo sapiens
tacttccagcagcctgcttgct

SEQ ID NO: 7022043 - DNA, 22 bp, Homo sapiens
gaagttctttgctccccagtac

SEQ ID NO: 7022044 - DNA, 22 bp, Homo sapiens
gttgtacatgttggggtacctt

SEQ ID NO: 7022045 - DNA, 22 bp, Homo sapiens
tactccacacgctattataatg

SEQ ID NO: 7022046 - DNA, 22 bp, Homo sapiens
aagggaaatcatatggtgcagt

SEQ ID NO: 7022047 - DNA, 20 bp, Homo sapiens
aggccaaacccagcgcgccc

SEQ ID NO: 7022048 - DNA, 22 bp, Homo sapiens
tggccctgtggcttcagaacag

SEQ ID NO: 7022049 - DNA, 23 bp, Homo sapiens
atgtttgcagtaacccatcctgg

SEQ ID NO: 7022050 - DNA, 22 bp, Homo sapiens
aagtagcattccatggtataga

SEQ ID NO: 7022051 - DNA, 22 bp, Homo sapiens
gcatccttgggcccagctcctg

SEQ ID NO: 7022052 - DNA, 22 bp, Homo sapiens
tgcttgctgggtcttgcatctg

SEQ ID NO: 7022053 - DNA, 22 bp, Homo sapiens
tccagtctctactctgagataa

SEQ ID NO: 7022054 - DNA, 22 bp, Homo sapiens
acttgtctggcagatcatgcaa

SEQ ID NO: 7022055 - DNA, 21 bp, Homo sapiens
agcaccaaatgcaggctctgg

SEQ ID NO: 7022056 - DNA, 22 bp, Homo sapiens
ggccctgctgagtggagtggag

SEQ ID NO: 7022057 - DNA, 22 bp, Homo sapiens
aattaagaaaatgttttatgat

SEQ ID NO: 7022058 - DNA, 22 bp, Homo sapiens
aggtgcccatgagctccatggc

SEQ ID NO: 7022059 - DNA, 22 bp, Homo sapiens
agggacttggcagcaatatgga

SEQ ID NO: 7022060 - DNA, 22 bp, Homo sapiens
cctgagctccagtagcagccag

SEQ ID NO: 7022061 - DNA, 22 bp, Homo sapiens
cttcctctgcggcgccgggcgc

SEQ ID NO: 7022062 - DNA, 22 bp, Homo sapiens
atatacatgggaatatgtggag

SEQ ID NO: 7022063 - DNA, 22 bp, Homo sapiens
attgctcttgcttagggaggca

SEQ ID NO: 7022064 - DNA, 22 bp, Homo sapiens
gtgtttccagttcagaaagcaa

SEQ ID NO: 7022065 - DNA, 22 bp, Homo sapiens
gccctctgtgtaacaatccaga

SEQ ID NO: 7022066 - DNA, 22 bp, Homo sapiens
aaaatactgtggagtgttgaaa

SEQ ID NO: 7022067 - DNA, 22 bp, Homo sapiens
tgtttttcaaatattgctctgt

SEQ ID NO: 7022068 - DNA, 22 bp, Homo sapiens
cttcccagacggggtggcagcc

SEQ ID NO: 7022069 - DNA, 22 bp, Homo sapiens
gtggcaggagactggaagatgg

SEQ ID NO: 7022070 - DNA, 22 bp, Homo sapiens
acagcttaatcagtatgagcct

SEQ ID NO: 7022071 - DNA, 22 bp, Homo sapiens
gccctgtcccttggcttctagg

SEQ ID NO: 7022072 - DNA, 22 bp, Homo sapiens
ctgaaaggtataaataagactt

SEQ ID NO: 7022073 - DNA, 22 bp, Homo sapiens
atggacaaacagcaggttttgg

SEQ ID NO: 7022074 - DNA, 22 bp, Homo sapiens
ttatcatgacaggatgatagaa

SEQ ID NO: 7022075 - DNA, 22 bp, Homo sapiens
tctcctggcatgtgggtcatct

SEQ ID NO: 7022076 - DNA, 22 bp, Homo sapiens
tccagtgatgctgcaagagtga

SEQ ID NO: 7022077 - DNA, 22 bp, Homo sapiens
ttctgtcacttttttggaatct

SEQ ID NO: 7022078 - DNA, 22 bp, Homo sapiens
gtagggaagggagcactggaca

SEQ ID NO: 7022079 - DNA, 22 bp, Homo sapiens
catcagcagtcacatgatgctg

SEQ ID NO: 7022080 - DNA, 19 bp, Homo sapiens
cagtggagattggaggagg

SEQ ID NO: 7022081 - DNA, 22 bp, Homo sapiens
gagacacttgctgtgaggtcgc

SEQ ID NO: 7022082 - DNA, 22 bp, Homo sapiens
ccccagataggttcatgcccta

SEQ ID NO: 7022083 - DNA, 22 bp, Homo sapiens
tcctggcagtgcttgttttgga

SEQ ID NO: 7022084 - DNA, 22 bp, Homo sapiens
cgcctgggagtccacacctgct

SEQ ID NO: 7022085 - DNA, 22 bp, Homo sapiens
taggctcctgagtccacagcac

SEQ ID NO: 7022086 - DNA, 21 bp, Homo sapiens
gcagaatagtctctgtcttca

SEQ ID NO: 7022087 - DNA, 22 bp, Homo sapiens
gagattctaatataaggatggg

SEQ ID NO: 7022088 - DNA, 22 bp, Homo sapiens
ctgacagaatcattaagaccat

SEQ ID NO: 7022089 - DNA, 22 bp, Homo sapiens
gtacagtcttcttaatgctttt

SEQ ID NO: 7022090 - DNA, 22 bp, Homo sapiens
gattgcttgatacccagtcaat

SEQ ID NO: 7022091 - DNA, 22 bp, Homo sapiens
ttgggagcttggacttagtgtg

SEQ ID NO: 7022092 - DNA, 22 bp, Homo sapiens
aatccttaggcagaccgtgatg

SEQ ID NO: 7022093 - DNA, 22 bp, Homo sapiens
cagtagctgtctagccttatgg

SEQ ID NO: 7022094 - DNA, 18 bp, Homo sapiens
acactgcagcagtctgct

SEQ ID NO: 7022095 - DNA, 22 bp, Homo sapiens
agaggagtgggaagcagtgcaa

SEQ ID NO: 7022096 - DNA, 22 bp, Homo sapiens
atatgctaattagagggcatta

SEQ ID NO: 7022097 - DNA, 22 bp, Homo sapiens
gccctgagtgcctgtgtaagaa

SEQ ID NO: 7022098 - DNA, 22 bp, Homo sapiens
gattctgatgctggtggaggaa

SEQ ID NO: 7022099 - DNA, 22 bp, Homo sapiens
ctgtggctctgcagtcccaaca

SEQ ID NO: 7022100 - DNA, 22 bp, Homo sapiens
gaaaaggattggtaaaatatct

SEQ ID NO: 7022101 - DNA, 22 bp, Homo sapiens
ctgcctggatgaatggcgcctt

SEQ ID NO: 7022102 - DNA, 22 bp, Homo sapiens
aagccaaataatgtaggtacat

SEQ ID NO: 7022103 - DNA, 22 bp, Homo sapiens
attgctaatgtgcgaatgtgta

SEQ ID NO: 7022104 - DNA, 22 bp, Homo sapiens
ggctgcatgttcagatgacact

SEQ ID NO: 7022105 - DNA, 22 bp, Homo sapiens
ttctgaatgatagtcttgaact

SEQ ID NO: 7022106 - DNA, 22 bp, Homo sapiens
gtgtttacagataaagtgagct

SEQ ID NO: 7022107 - DNA, 22 bp, Homo sapiens
gatgccgtcttctatctgcctt

SEQ ID NO: 7022108 - DNA, 20 bp, Homo sapiens
gaggaaaagctgccaggcct

SEQ ID NO: 7022109 - DNA, 22 bp, Homo sapiens
gtgagtgtcagtcaaaggtttt

SEQ ID NO: 7022110 - DNA, 22 bp, Homo sapiens
gaagtggggaagcaacaggaga

SEQ ID NO: 7022111 - DNA, 22 bp, Homo sapiens
tgacacaggtcaaatctacttt

SEQ ID NO: 7022112 - DNA, 22 bp, Homo sapiens
gctgccaggggcagctgtctca

SEQ ID NO: 7022113 - DNA, 22 bp, Homo sapiens
gtgtttgttcgtgactccaaag

SEQ ID NO: 7022114 - DNA, 20 bp, Homo sapiens
accctgcatactggaaggct

SEQ ID NO: 7022115 - DNA, 22 bp, Homo sapiens
tcaggataaaatgtaatggcaa

SEQ ID NO: 7022116 - DNA, 22 bp, Homo sapiens
gtgagcatcccttaccggaagt

SEQ ID NO: 7022117 - DNA, 22 bp, Homo sapiens
aagctgctttgtcaggaatatg

SEQ ID NO: 7022118 - DNA, 22 bp, Homo sapiens
tcacagacatggtgaggtaaca

SEQ ID NO: 7022119 - DNA, 22 bp, Homo sapiens
tctggggagggagccacaggtc

SEQ ID NO: 7022120 - DNA, 22 bp, Homo sapiens
cttcaatttttggtatgatgga

SEQ ID NO: 7022121 - DNA, 18 bp, Homo sapiens
ggaaggaagaatgcattt

SEQ ID NO: 7022122 - DNA, 22 bp, Homo sapiens
aggtaaagactgcaaggagaat

SEQ ID NO: 7022123 - DNA, 19 bp, Homo sapiens
tgtgtgcatgcgcacgtgt

SEQ ID NO: 7022124 - DNA, 22 bp, Homo sapiens
gggtgtgttcctaaggaaacca

SEQ ID NO: 7022125 - DNA, 22 bp, Homo sapiens
acctacatcaagggagtggtag

SEQ ID NO: 7022126 - DNA, 22 bp, Homo sapiens
aacattctatgtgcattcagaa

SEQ ID NO: 7022127 - DNA, 22 bp, Homo sapiens
ggaagctgaacttagcaaggaa

SEQ ID NO: 7022128 - DNA, 20 bp, Homo sapiens
tggctttagtgagggaacat

SEQ ID NO: 7022129 - DNA, 20 bp, Homo sapiens
catctttggcaggactcctt

SEQ ID NO: 7022130 - DNA, 22 bp, Homo sapiens
tcagcaggcaccggaagtgttt

SEQ ID NO: 7022131 - DNA, 22 bp, Homo sapiens
tgtcacactgaccacatctgta

SEQ ID NO: 7022132 - DNA, 22 bp, Homo sapiens
tacagtttgtgtggagctggag

SEQ ID NO: 7022133 - DNA, 22 bp, Homo sapiens
aagtctctggcaaatgatcttg

SEQ ID NO: 7022134 - DNA, 22 bp, Homo sapiens
gcagcctgttgtaccagcctgt

SEQ ID NO: 7022135 - DNA, 22 bp, Homo sapiens
gaggctcactaggcatcctggg

SEQ ID NO: 7022136 - DNA, 21 bp, Homo sapiens
ttagaagctaatgcagctggt

SEQ ID NO: 7022137 - DNA, 22 bp, Homo sapiens
atagtatgttgtggtaaataat

SEQ ID NO: 7022138 - DNA, 22 bp, Homo sapiens
atacaagttaaatgcagtgccc

SEQ ID NO: 7022139 - DNA, 22 bp, Homo sapiens
atatagatcaaatgatgctaat

SEQ ID NO: 7022140 - DNA, 22 bp, Homo sapiens
aaggtatatgtacaatagacat

SEQ ID NO: 7022141 - DNA, 22 bp, Homo sapiens
cacattctttcacagttctgaa

SEQ ID NO: 7022142 - DNA, 22 bp, Homo sapiens
gtagaggggtgattctgtgaga

SEQ ID NO: 7022143 - DNA, 22 bp, Homo sapiens
agtgattttctccagctggcag

SEQ ID NO: 7022144 - DNA, 22 bp, Homo sapiens
tgctttttagtactgtcttatt

SEQ ID NO: 7022145 - DNA, 22 bp, Homo sapiens
tgctctggggctccccaccaga

SEQ ID NO: 7022146 - DNA, 22 bp, Homo sapiens
tggaagatgaataaagattcta

SEQ ID NO: 7022147 - DNA, 22 bp, Homo sapiens
taggctgggctgagctggacgg

SEQ ID NO: 7022148 - DNA, 22 bp, Homo sapiens
atgtgcaacttcagcagaaagg

SEQ ID NO: 7022149 - DNA, 18 bp, Homo sapiens
atagtgcagatcaagccc

SEQ ID NO: 7022150 - DNA, 22 bp, Homo sapiens
gagtaggcaaggtagctctgtt

SEQ ID NO: 7022151 - DNA, 22 bp, Homo sapiens
tggacactggagattcgtcagt

SEQ ID NO: 7022152 - DNA, 22 bp, Homo sapiens
gcctttgcctgcgacgtggctg

SEQ ID NO: 7022153 - DNA, 22 bp, Homo sapiens
tcccaagatgacacagtggacg

SEQ ID NO: 7022154 - DNA, 22 bp, Homo sapiens
ttgcatccgaaacaatttctct

SEQ ID NO: 7022155 - DNA, 22 bp, Homo sapiens
aattcacatatacattattcct

SEQ ID NO: 7022156 - DNA, 22 bp, Homo sapiens
agagcagatttcaaatattggc

SEQ ID NO: 7022157 - DNA, 22 bp, Homo sapiens
gcttttcttcagcagcctgatg

SEQ ID NO: 7022158 - DNA, 22 bp, Homo sapiens
cctcagaaggacaagagacaaa

SEQ ID NO: 7022159 - DNA, 22 bp, Homo sapiens
ttcagttcacatgtatcatggc

SEQ ID NO: 7022160 - DNA, 22 bp, Homo sapiens
actgtcaccatcagagcgggaa

SEQ ID NO: 7022161 - DNA, 22 bp, Homo sapiens
cctgttcattttttgactctgc

SEQ ID NO: 7022162 - DNA, 22 bp, Homo sapiens
tggctccagcgtccacgtcctg

SEQ ID NO: 7022163 - DNA, 22 bp, Homo sapiens
gtattcccagagtgttacatac

SEQ ID NO: 7022164 - DNA, 22 bp, Homo sapiens
tgaagctattggtaaggaagtg

SEQ ID NO: 7022165 - DNA, 17 bp, Homo sapiens
gcccacccttaggagct

SEQ ID NO: 7022166 - DNA, 22 bp, Homo sapiens
ttgtgctgtgagaatgctcatt

SEQ ID NO: 7022167 - DNA, 23 bp, Homo sapiens
gcagccatgttcccgtctcagct

SEQ ID NO: 7022168 - DNA, 22 bp, Homo sapiens
agtctacaaagaaaagttattg

SEQ ID NO: 7022169 - DNA, 22 bp, Homo sapiens
aatcacattaagccctgttcag

SEQ ID NO: 7022170 - DNA, 22 bp, Homo sapiens
gacaagttacacctgtgcttga

SEQ ID NO: 7022171 - DNA, 20 bp, Homo sapiens
atccatgagagtctggattc

SEQ ID NO: 7022172 - DNA, 22 bp, Homo sapiens
atgccattgctttaaaattaag

SEQ ID NO: 7022173 - DNA, 22 bp, Homo sapiens
aatttcactgataaagactcca

SEQ ID NO: 7022174 - DNA, 22 bp, Homo sapiens
aaacaccaagagctagctatta

SEQ ID NO: 7022175 - DNA, 22 bp, Homo sapiens
aagcaatgtgtttgaaaggcca

SEQ ID NO: 7022176 - DNA, 22 bp, Homo sapiens
acagagtctgacaggtaggcgc

SEQ ID NO: 7022177 - DNA, 22 bp, Homo sapiens
attccaaagcacatcagaacta

SEQ ID NO: 7022178 - DNA, 22 bp, Homo sapiens
attgcatgacatatccacttgt

SEQ ID NO: 7022179 - DNA, 22 bp, Homo sapiens
gtggaacagcctgtgcaaacct

SEQ ID NO: 7022180 - DNA, 22 bp, Homo sapiens
gtgtacacttgaactgacggtt

SEQ ID NO: 7022181 - DNA, 22 bp, Homo sapiens
agggtggctggaggaatcagaa

SEQ ID NO: 7022182 - DNA, 22 bp, Homo sapiens
tcagggaaatttccatgtgttt

SEQ ID NO: 7022183 - DNA, 22 bp, Homo sapiens
tctctttctttgtatgtctatt

SEQ ID NO: 7022184 - DNA, 22 bp, Homo sapiens
ggttattgtggagaagttccgg

SEQ ID NO: 7022185 - DNA, 22 bp, Homo sapiens
taccctctcccggtccagcttt

SEQ ID NO: 7022186 - DNA, 22 bp, Homo sapiens
agctgcagatcaataggctcac

SEQ ID NO: 7022187 - DNA, 22 bp, Homo sapiens
ggtcccaggagaataggtgcaa

SEQ ID NO: 7022188 - DNA, 22 bp, Homo sapiens
ctcatttatccaaaagccagtt

SEQ ID NO: 7022189 - DNA, 22 bp, Homo sapiens
aacaggaattgatgggagtcct

SEQ ID NO: 7022190 - DNA, 22 bp, Homo sapiens
tgtcatcttgtccagccaggca

SEQ ID NO: 7022191 - DNA, 20 bp, Homo sapiens
tcatccagttggtttatggt

SEQ ID NO: 7022192 - DNA, 22 bp, Homo sapiens
accactggatatcagagatgta

SEQ ID NO: 7022193 - DNA, 22 bp, Homo sapiens
ttagctttcctactaataaata

SEQ ID NO: 7022194 - DNA, 22 bp, Homo sapiens
taggggaggccaggaagtttta

SEQ ID NO: 7022195 - DNA, 22 bp, Homo sapiens
tgagatggattgggttggttcc

SEQ ID NO: 7022196 - DNA, 22 bp, Homo sapiens
cctgggcagggctggactctca

SEQ ID NO: 7022197 - DNA, 22 bp, Homo sapiens
cagctgcctgtctggaggcaat

SEQ ID NO: 7022198 - DNA, 22 bp, Homo sapiens
tgccatttgctggttttctgat

SEQ ID NO: 7022199 - DNA, 22 bp, Homo sapiens
ctcctgagtagtagcattgtca

SEQ ID NO: 7022200 - DNA, 22 bp, Homo sapiens
tgcagggcccctctgcatgagt

SEQ ID NO: 7022201 - DNA, 22 bp, Homo sapiens
agacctgaagagtatcttcaga

SEQ ID NO: 7022202 - DNA, 22 bp, Homo sapiens
ccataatattaaatgcttttgt

SEQ ID NO: 7022203 - DNA, 22 bp, Homo sapiens
gtcagctatgtctgttgttgag

SEQ ID NO: 7022204 - DNA, 22 bp, Homo sapiens
gagctctgtgtagcctgagggt

SEQ ID NO: 7022205 - DNA, 22 bp, Homo sapiens
ccctgctgacaacttgattttg

SEQ ID NO: 7022206 - DNA, 22 bp, Homo sapiens
tgaatgatatattgggaataat

SEQ ID NO: 7022207 - DNA, 22 bp, Homo sapiens
tagaaacagagagatatgcccc

SEQ ID NO: 7022208 - DNA, 22 bp, Homo sapiens
aggcaagcatttaaccactcat

SEQ ID NO: 7022209 - DNA, 22 bp, Homo sapiens
ctaaggcaggtccattccagga

SEQ ID NO: 7022210 - DNA, 22 bp, Homo sapiens
acttattagctgtgtgaccttg

SEQ ID NO: 7022211 - DNA, 22 bp, Homo sapiens
aagcacaatgaacatcttagat

SEQ ID NO: 7022212 - DNA, 22 bp, Homo sapiens
aatgtcttttcccttactttcc

SEQ ID NO: 7022213 - DNA, 22 bp, Homo sapiens
ggcactgggttgtaggaattaa

SEQ ID NO: 7022214 - DNA, 22 bp, Homo sapiens
tattagagaaaagatggatgtg

SEQ ID NO: 7022215 - DNA, 22 bp, Homo sapiens
atatctaggctgaatgtaaaat

SEQ ID NO: 7022216 - DNA, 22 bp, Homo sapiens
gggctgcttcctggggaatgct

SEQ ID NO: 7022217 - DNA, 22 bp, Homo sapiens
tctcccctgttggccaggtttt

SEQ ID NO: 7022218 - DNA, 21 bp, Homo sapiens
ttacaaagcaagtgctgtgtc

SEQ ID NO: 7022219 - DNA, 22 bp, Homo sapiens
ctcctggcactgtcttgaccca

SEQ ID NO: 7022220 - DNA, 22 bp, Homo sapiens
gctttgattcttggcttatcag

SEQ ID NO: 7022221 - DNA, 22 bp, Homo sapiens
atctggataggttgttttgcat

SEQ ID NO: 7022222 - DNA, 22 bp, Homo sapiens
cttagaaattgttactcattca

SEQ ID NO: 7022223 - DNA, 22 bp, Homo sapiens
ttaaaccacaaggcaagttttg

SEQ ID NO: 7022224 - DNA, 22 bp, Homo sapiens
tgtctgctagctggtggcaatt

SEQ ID NO: 7022225 - DNA, 22 bp, Homo sapiens
tgaatagtaagagaatatttgc

SEQ ID NO: 7022226 - DNA, 22 bp, Homo sapiens
gaaggcaagtgctccttgggtc

SEQ ID NO: 7022227 - DNA, 22 bp, Homo sapiens
cctgccctaatccagagactag

SEQ ID NO: 7022228 - DNA, 22 bp, Homo sapiens
ggtgttcaaatgaacacatgca

SEQ ID NO: 7022229 - DNA, 21 bp, Homo sapiens
tctctgagaggtctgcttaga

SEQ ID NO: 7022230 - DNA, 22 bp, Homo sapiens
ggaagggagtagttggaatgca

SEQ ID NO: 7022231 - DNA, 22 bp, Homo sapiens
ccaagaggggaagggccgcagc

SEQ ID NO: 7022232 - DNA, 22 bp, Homo sapiens
tgtgcctgactaggtgaatcaa

SEQ ID NO: 7022233 - DNA, 22 bp, Homo sapiens
tgacaggagtggctagtgggag

SEQ ID NO: 7022234 - DNA, 22 bp, Homo sapiens
ctgtgctggtgaaacccacaga

SEQ ID NO: 7022235 - DNA, 22 bp, Homo sapiens
gctccctgtctctggggtccat

SEQ ID NO: 7022236 - DNA, 22 bp, Homo sapiens
ttcatccatatgcagagagctt

SEQ ID NO: 7022237 - DNA, 22 bp, Homo sapiens
tgtattaggagattccatgttt

SEQ ID NO: 7022238 - DNA, 22 bp, Homo sapiens
tacattatcttgttatctttca

SEQ ID NO: 7022239 - DNA, 22 bp, Homo sapiens
agctgcctgtgctgggagccca

SEQ ID NO: 7022240 - DNA, 22 bp, Homo sapiens
agtggccagcagcctagcctag

SEQ ID NO: 7022241 - DNA, 22 bp, Homo sapiens
attttcattttgcagggtgaga

SEQ ID NO: 7022242 - DNA, 22 bp, Homo sapiens
acagtgtactaggtacatgttc

SEQ ID NO: 7022243 - DNA, 22 bp, Homo sapiens
atttggcaacattaattgaatc

SEQ ID NO: 7022244 - DNA, 22 bp, Homo sapiens
ggcagaggaaggatgaattcac

SEQ ID NO: 7022245 - DNA, 22 bp, Homo sapiens
gctttgcattgtgatgggatgc

SEQ ID NO: 7022246 - DNA, 18 bp, Homo sapiens
tagagttactacatgatt

SEQ ID NO: 7022247 - DNA, 22 bp, Homo sapiens
cagagatttttatgcacaccaa

SEQ ID NO: 7022248 - DNA, 22 bp, Homo sapiens
caggtccctgcgccccggcctc

SEQ ID NO: 7022249 - DNA, 22 bp, Homo sapiens
ccagctgaggttgaagaaagag

SEQ ID NO: 7022250 - DNA, 22 bp, Homo sapiens
tctgactgaaccaattatttac

SEQ ID NO: 7022251 - DNA, 22 bp, Homo sapiens
gggctgacaatctctttactta

SEQ ID NO: 7022252 - DNA, 22 bp, Homo sapiens
caagaggctaaactgggctatt

SEQ ID NO: 7022253 - DNA, 22 bp, Homo sapiens
atctttgttatctcagatcttg

SEQ ID NO: 7022254 - DNA, 22 bp, Homo sapiens
ttcttctcagggtcccacatgg

SEQ ID NO: 7022255 - DNA, 22 bp, Homo sapiens
tgagatttcaggccaaggagtg

SEQ ID NO: 7022256 - DNA, 22 bp, Homo sapiens
gtagcttatgaaatgtgagggg

SEQ ID NO: 7022257 - DNA, 22 bp, Homo sapiens
gcctgctttgcctacaagcaga

SEQ ID NO: 7022258 - DNA, 22 bp, Homo sapiens
gaaggatttgagattatcctag

SEQ ID NO: 7022259 - DNA, 22 bp, Homo sapiens
ttacagagaggtgattgtgaag

SEQ ID NO: 7022260 - DNA, 21 bp, Homo sapiens
tatggctttactaagctgcac

SEQ ID NO: 7022261 - DNA, 22 bp, Homo sapiens
agcagcacctggctatctgatc

SEQ ID NO: 7022262 - DNA, 22 bp, Homo sapiens
caaggtgcagcgttgtcaagct

SEQ ID NO: 7022263 - DNA, 21 bp, Homo sapiens
tctgtctggttttagagtggc

SEQ ID NO: 7022264 - DNA, 19 bp, Homo sapiens
ccagcaggttcatttcagg

SEQ ID NO: 7022265 - DNA, 22 bp, Homo sapiens
cagcaagtgatggaaatcagag

SEQ ID NO: 7022266 - DNA, 22 bp, Homo sapiens
gcagatgaggaagctaatgctg

SEQ ID NO: 7022267 - DNA, 22 bp, Homo sapiens
aatagatctgtgtgcacatttg

SEQ ID NO: 7022268 - DNA, 22 bp, Homo sapiens
cagggcccagtccctgctgtca

SEQ ID NO: 7022269 - DNA, 22 bp, Homo sapiens
cagcatcttctccaaagctgcc

SEQ ID NO: 7022270 - DNA, 22 bp, Homo sapiens
ctcagggaggagcttctgggcc

SEQ ID NO: 7022271 - DNA, 22 bp, Homo sapiens
ttatgcaaagaaatagactaat

SEQ ID NO: 7022272 - DNA, 22 bp, Homo sapiens
ttaggaaattatggtttcagat

SEQ ID NO: 7022273 - DNA, 18 bp, Homo sapiens
tcctaacttagatactcc

SEQ ID NO: 7022274 - DNA, 21 bp, Homo sapiens
ggcaacagatattttgcttag

SEQ ID NO: 7022275 - DNA, 22 bp, Homo sapiens
tacaaggaaaattttatagtaa

SEQ ID NO: 7022276 - DNA, 22 bp, Homo sapiens
tgactattttttatagattcca

SEQ ID NO: 7022277 - DNA, 22 bp, Homo sapiens
ctcactgcaagctcagcctccc

SEQ ID NO: 7022278 - DNA, 22 bp, Homo sapiens
tctatgtgccctttgtgtgatg

SEQ ID NO: 7022279 - DNA, 22 bp, Homo sapiens
agggcccttacgcaggcccttc

SEQ ID NO: 7022280 - DNA, 22 bp, Homo sapiens
acaattcaagcaagagagacaa

SEQ ID NO: 7022281 - DNA, 22 bp, Homo sapiens
gcctctctctacccagtatgat

SEQ ID NO: 7022282 - DNA, 22 bp, Homo sapiens
cctgggcctcacccagctcttg

SEQ ID NO: 7022283 - DNA, 22 bp, Homo sapiens
tctggagttcctgcaggctgtg

SEQ ID NO: 7022284 - DNA, 22 bp, Homo sapiens
acatttggcttttggagtaaga

SEQ ID NO: 7022285 - DNA, 22 bp, Homo sapiens
gctaggctgaatatggtgctta

SEQ ID NO: 7022286 - DNA, 22 bp, Homo sapiens
tggtggaattgtaaaatagtgt

SEQ ID NO: 7022287 - DNA, 22 bp, Homo sapiens
gggcactgtacactgtgcatgg

SEQ ID NO: 7022288 - DNA, 22 bp, Homo sapiens
ggagatatggtctagtatagag

SEQ ID NO: 7022289 - DNA, 22 bp, Homo sapiens
cacccatgtttccctctgtctt

SEQ ID NO: 7022290 - DNA, 20 bp, Homo sapiens
tttagcttgcctggaaggga

SEQ ID NO: 7022291 - DNA, 21 bp, Homo sapiens
atgcagagaactccagggaag

SEQ ID NO: 7022292 - DNA, 22 bp, Homo sapiens
aaatcactgttattgatcttaa

SEQ ID NO: 7022293 - DNA, 22 bp, Homo sapiens
atcctccatctccatcggactg

SEQ ID NO: 7022294 - DNA, 22 bp, Homo sapiens
atacagagaagggaggcaaaat

SEQ ID NO: 7022295 - DNA, 22 bp, Homo sapiens
cattaacactttggatttagac

SEQ ID NO: 7022296 - DNA, 22 bp, Homo sapiens
ggctttaaacactgaaattgca

SEQ ID NO: 7022297 - DNA, 22 bp, Homo sapiens
aagatccttcatatgggttttg

SEQ ID NO: 7022298 - DNA, 22 bp, Homo sapiens
ggagccagggaagctgcttcct

SEQ ID NO: 7022299 - DNA, 22 bp, Homo sapiens
gccttctgatatctcttggcat

SEQ ID NO: 7022300 - DNA, 22 bp, Homo sapiens
tagaccaggcccacacacgggg

SEQ ID NO: 7022301 - DNA, 22 bp, Homo sapiens
ggaggccagcctgaggctgagg

SEQ ID NO: 7022302 - DNA, 22 bp, Homo sapiens
tggctggatgtgagatcaagag

SEQ ID NO: 7022303 - DNA, 21 bp, Homo sapiens
ttctaaactaggggaagcgtc

SEQ ID NO: 7022304 - DNA, 22 bp, Homo sapiens
tattagcacaaagcaaggtatt

SEQ ID NO: 7022305 - DNA, 22 bp, Homo sapiens
tgtccctggtggaggctggcag

SEQ ID NO: 7022306 - DNA, 22 bp, Homo sapiens
atgtccatgctttgctccagaa

SEQ ID NO: 7022307 - DNA, 23 bp, Homo sapiens
tgcccagtgggtgcagggggtat

SEQ ID NO: 7022308 - DNA, 22 bp, Homo sapiens
tggaatgttgcataagatctga

SEQ ID NO: 7022309 - DNA, 22 bp, Homo sapiens
gcaggtgttttaagacattgaa

SEQ ID NO: 7022310 - DNA, 22 bp, Homo sapiens
agtgtttgggggccttgtaaca

SEQ ID NO: 7022311 - DNA, 22 bp, Homo sapiens
ttgaggaggaactgtgaggcaa

SEQ ID NO: 7022312 - DNA, 22 bp, Homo sapiens
tggagctggaagaatgtagacg

SEQ ID NO: 7022313 - DNA, 22 bp, Homo sapiens
ttgagtctctgccaaaacacaa

SEQ ID NO: 7022314 - DNA, 22 bp, Homo sapiens
tatgcacacctgggtccttgtc

SEQ ID NO: 7022315 - DNA, 22 bp, Homo sapiens
gcaggcagccacgattcccttg

SEQ ID NO: 7022316 - DNA, 22 bp, Homo sapiens
aaagccttcaagtagatgtaag

SEQ ID NO: 7022317 - DNA, 22 bp, Homo sapiens
tgtgtcattgccatgaaaaggc

SEQ ID NO: 7022318 - DNA, 22 bp, Homo sapiens
ctgtccggtgcccgggcctccc

SEQ ID NO: 7022319 - DNA, 22 bp, Homo sapiens
tgtcctggccaaggccttgctt

SEQ ID NO: 7022320 - DNA, 22 bp, Homo sapiens
gttaataaaggtatagaatcag

SEQ ID NO: 7022321 - DNA, 22 bp, Homo sapiens
tgctgaggtttcgtctgcttgc

SEQ ID NO: 7022322 - DNA, 22 bp, Homo sapiens
tttccagttgtcctatcacctg

SEQ ID NO: 7022323 - DNA, 22 bp, Homo sapiens
taaagagctgggcttagacagg

SEQ ID NO: 7022324 - DNA, 22 bp, Homo sapiens
atctaagagttaacatcaagaa

SEQ ID NO: 7022325 - DNA, 22 bp, Homo sapiens
gaggccagaatgagtctctggg

SEQ ID NO: 7022326 - DNA, 22 bp, Homo sapiens
agctccagattaattgtaggag

SEQ ID NO: 7022327 - DNA, 22 bp, Homo sapiens
cgcgggcccctgcgctccgggc

SEQ ID NO: 7022328 - DNA, 22 bp, Homo sapiens
aagcattttagataaagcatca

SEQ ID NO: 7022329 - DNA, 19 bp, Homo sapiens
gaacagacttggggtgagg

SEQ ID NO: 7022330 - DNA, 22 bp, Homo sapiens
agccctagagaaccagcctgtg

SEQ ID NO: 7022331 - DNA, 22 bp, Homo sapiens
agctgcccaggttcattgggcc

SEQ ID NO: 7022332 - DNA, 22 bp, Homo sapiens
ctgtgttttgattaaaaagcaa

SEQ ID NO: 7022333 - DNA, 22 bp, Homo sapiens
ggccttggttctgtcacagccg

SEQ ID NO: 7022334 - DNA, 22 bp, Homo sapiens
ggaggctcctaagctgacttga

SEQ ID NO: 7022335 - DNA, 22 bp, Homo sapiens
aagtttaggccaaattagattt

SEQ ID NO: 7022336 - DNA, 22 bp, Homo sapiens
caggcctcctatgagcactagc

SEQ ID NO: 7022337 - DNA, 23 bp, Homo sapiens
aatgagagaccatgtggagcaga

SEQ ID NO: 7022338 - DNA, 22 bp, Homo sapiens
agctccaaggttgaggagtgag

SEQ ID NO: 7022339 - DNA, 22 bp, Homo sapiens
tagtgaaatatgtgctgatagc

SEQ ID NO: 7022340 - DNA, 22 bp, Homo sapiens
ggcccaaaggagtcttggacca

SEQ ID NO: 7022341 - DNA, 15 bp, Homo sapiens
ctctcaggcaggcag

SEQ ID NO: 7022342 - DNA, 22 bp, Homo sapiens
gtgggcctgatgctgccatgag

SEQ ID NO: 7022343 - DNA, 22 bp, Homo sapiens
actagccaagttttacgactaa

SEQ ID NO: 7022344 - DNA, 22 bp, Homo sapiens
gtcatagaggcctatataattt

SEQ ID NO: 7022345 - DNA, 22 bp, Homo sapiens
agcacctactgaatgctaggct

SEQ ID NO: 7022346 - DNA, 21 bp, Homo sapiens
acagtatattagatatttgaa

SEQ ID NO: 7022347 - DNA, 22 bp, Homo sapiens
ttaggcactggcatgcccggag

SEQ ID NO: 7022348 - DNA, 21 bp, Homo sapiens
gttcttcatttaggtgggctt

SEQ ID NO: 7022349 - DNA, 22 bp, Homo sapiens
tcagaagtttcaatcccagctg

SEQ ID NO: 7022350 - DNA, 19 bp, Homo sapiens
ccaggcctcctgggaggtc

SEQ ID NO: 7022351 - DNA, 22 bp, Homo sapiens
tcagagagcctcaggcactgcc

SEQ ID NO: 7022352 - DNA, 22 bp, Homo sapiens
atgtatcaacaaattgtacagt

SEQ ID NO: 7022353 - DNA, 22 bp, Homo sapiens
gaggagcaagaaatagtgccca

SEQ ID NO: 7022354 - DNA, 22 bp, Homo sapiens
gtgtttgacttaggtacattaa

SEQ ID NO: 7022355 - DNA, 22 bp, Homo sapiens
tctatattttgaaaggtattta

SEQ ID NO: 7022356 - DNA, 22 bp, Homo sapiens
ggtgaaggcacaagagggcaag

SEQ ID NO: 7022357 - DNA, 22 bp, Homo sapiens
actagtttgagtaattgtaatg

SEQ ID NO: 7022358 - DNA, 22 bp, Homo sapiens
caggaatccagagtgagcctcc

SEQ ID NO: 7022359 - DNA, 22 bp, Homo sapiens
tcccatttcacaacaaaactgg

SEQ ID NO: 7022360 - DNA, 22 bp, Homo sapiens
catttacacttctaaccacaag

SEQ ID NO: 7022361 - DNA, 22 bp, Homo sapiens
aatagctgattaatgtactacc

SEQ ID NO: 7022362 - DNA, 22 bp, Homo sapiens
tcccatgttgtgcctggctgca

SEQ ID NO: 7022363 - DNA, 22 bp, Homo sapiens
tcctgttaattacacagctggc

SEQ ID NO: 7022364 - DNA, 22 bp, Homo sapiens
attagtgtggaccctaatttaa

SEQ ID NO: 7022365 - DNA, 20 bp, Homo sapiens
agtcacaggcctggaacatg

SEQ ID NO: 7022366 - DNA, 22 bp, Homo sapiens
ctctggagggaggctgagctgg

SEQ ID NO: 7022367 - DNA, 22 bp, Homo sapiens
atccctgtctcaaagccagcaa

SEQ ID NO: 7022368 - DNA, 22 bp, Homo sapiens
ctcctggagggccaaagaaata

SEQ ID NO: 7022369 - DNA, 22 bp, Homo sapiens
gcagtgctgagaggtgatcgga

SEQ ID NO: 7022370 - DNA, 21 bp, Homo sapiens
tttatttatataggacacatg

SEQ ID NO: 7022371 - DNA, 22 bp, Homo sapiens
agatgtttttccaggtctaatt

SEQ ID NO: 7022372 - DNA, 22 bp, Homo sapiens
tgccttggaggaatgatgagag

SEQ ID NO: 7022373 - DNA, 22 bp, Homo sapiens
tcctccagcaggactgaggccc

SEQ ID NO: 7022374 - DNA, 22 bp, Homo sapiens
cctgccttcagccctgaagtct

SEQ ID NO: 7022375 - DNA, 22 bp, Homo sapiens
ggcctcagtgggccgctgcagg

SEQ ID NO: 7022376 - DNA, 18 bp, Homo sapiens
ggagctgggccccactcc

SEQ ID NO: 7022377 - DNA, 22 bp, Homo sapiens
ttcaaatcctgcttatgctacc

SEQ ID NO: 7022378 - DNA, 19 bp, Homo sapiens
gggctctggcctcagtggg

SEQ ID NO: 7022379 - DNA, 22 bp, Homo sapiens
tgcaacaggctgtgacatggaa

SEQ ID NO: 7022380 - DNA, 22 bp, Homo sapiens
ttatacagtttatacttagaat

SEQ ID NO: 7022381 - DNA, 22 bp, Homo sapiens
ccctggagggatttctcaatca

SEQ ID NO: 7022382 - DNA, 22 bp, Homo sapiens
tctccaggtaaatggcatcctg

SEQ ID NO: 7022383 - DNA, 22 bp, Homo sapiens
aggcactttgaaatttggagct

SEQ ID NO: 7022384 - DNA, 18 bp, Homo sapiens
gagccctgggagatctct

SEQ ID NO: 7022385 - DNA, 21 bp, Homo sapiens
ccagtcgccaggttgtgtgct

SEQ ID NO: 7022386 - DNA, 21 bp, Homo sapiens
cagggcacacagaggatggta

SEQ ID NO: 7022387 - DNA, 22 bp, Homo sapiens
tgacacaggcagctcccagcac

SEQ ID NO: 7022388 - DNA, 22 bp, Homo sapiens
aagtggtcagtcatgggagatt

SEQ ID NO: 7022389 - DNA, 22 bp, Homo sapiens
cctggccactcaggtgtggggc

SEQ ID NO: 7022390 - DNA, 22 bp, Homo sapiens
tcatctgtgcaggactcagaag

SEQ ID NO: 7022391 - DNA, 22 bp, Homo sapiens
tcaggagggtgacaggccctgg

SEQ ID NO: 7022392 - DNA, 22 bp, Homo sapiens
cctccctgtctacctgttgtgg

SEQ ID NO: 7022393 - DNA, 22 bp, Homo sapiens
tgcataattcatccttctggga

SEQ ID NO: 7022394 - DNA, 22 bp, Homo sapiens
gaaggaccctctggggtctcag

SEQ ID NO: 7022395 - DNA, 22 bp, Homo sapiens
gcaggaagaggctcgaagcccc

SEQ ID NO: 7022396 - DNA, 22 bp, Homo sapiens
agatgcactataaaagcatctt

SEQ ID NO: 7022397 - DNA, 22 bp, Homo sapiens
tgcggatggattaggagagccc

SEQ ID NO: 7022398 - DNA, 22 bp, Homo sapiens
tgaattctggccctctcactta

SEQ ID NO: 7022399 - DNA, 17 bp, Homo sapiens
gcagcctcttggtagtg

SEQ ID NO: 7022400 - DNA, 22 bp, Homo sapiens
caaatagaactcacagacaaga

SEQ ID NO: 7022401 - DNA, 22 bp, Homo sapiens
ttgagttctgtgtatcctttgt

SEQ ID NO: 7022402 - DNA, 22 bp, Homo sapiens
ttgtgtttgatgctgacacgca

SEQ ID NO: 7022403 - DNA, 22 bp, Homo sapiens
agcccatggtgtactctgtggc

SEQ ID NO: 7022404 - DNA, 22 bp, Homo sapiens
tttcatgttttcttaaatggca

SEQ ID NO: 7022405 - DNA, 17 bp, Homo sapiens
tttccctccttccactc

SEQ ID NO: 7022406 - DNA, 22 bp, Homo sapiens
ccagattcagatatggcagtgg

SEQ ID NO: 7022407 - DNA, 22 bp, Homo sapiens
acaagtgcatggaatcagctgt

SEQ ID NO: 7022408 - DNA, 22 bp, Homo sapiens
atttagtgccttagccctcagg

SEQ ID NO: 7022409 - DNA, 22 bp, Homo sapiens
cttgcaggcagggacactgtct

SEQ ID NO: 7022410 - DNA, 22 bp, Homo sapiens
tgagcctggagtcgtggagggg

SEQ ID NO: 7022411 - DNA, 22 bp, Homo sapiens
tttgtcatttccctgattaaag

SEQ ID NO: 7022412 - DNA, 22 bp, Homo sapiens
atctcacaggactgaaacgtaa

SEQ ID NO: 7022413 - DNA, 22 bp, Homo sapiens
aaccttataacctgagagtgtc

SEQ ID NO: 7022414 - DNA, 22 bp, Homo sapiens
ctagcttcaagtcctggctgtg

SEQ ID NO: 7022415 - DNA, 22 bp, Homo sapiens
ctgtttccccatgccctgactc

SEQ ID NO: 7022416 - DNA, 22 bp, Homo sapiens
cttcagctgtggtctccaaggc

SEQ ID NO: 7022417 - DNA, 22 bp, Homo sapiens
caaatgttagtgcccatccctc

SEQ ID NO: 7022418 - DNA, 22 bp, Homo sapiens
tatttgtcaagagagggggata

SEQ ID NO: 7022419 - DNA, 18 bp, Homo sapiens
actcaggaaatgatgaca

SEQ ID NO: 7022420 - DNA, 22 bp, Homo sapiens
ctcttctttccatccctagcca

SEQ ID NO: 7022421 - DNA, 22 bp, Homo sapiens
aagggctgggtctggttaaccc

SEQ ID NO: 7022422 - DNA, 20 bp, Homo sapiens
acacagactcagcttggatg

SEQ ID NO: 7022423 - DNA, 22 bp, Homo sapiens
acacatgcacaacagttctttc

SEQ ID NO: 7022424 - DNA, 22 bp, Homo sapiens
tgtcttgaggcgcagtgtagat

SEQ ID NO: 7022425 - DNA, 20 bp, Homo sapiens
gcattgagtatagacagatg

SEQ ID NO: 7022426 - DNA, 20 bp, Homo sapiens
acagcagataccacaactat

SEQ ID NO: 7022427 - DNA, 22 bp, Homo sapiens
ttaagagttatttgcacataat

SEQ ID NO: 7022428 - DNA, 22 bp, Homo sapiens
gggctctaggccaagagtcccg

SEQ ID NO: 7022429 - DNA, 22 bp, Homo sapiens
gctggcttccatcagagggtga

SEQ ID NO: 7022430 - DNA, 22 bp, Homo sapiens
cgcagctgctgctctgaaacag

SEQ ID NO: 7022431 - DNA, 22 bp, Homo sapiens
tgtgcctggagtccctgaggag

SEQ ID NO: 7022432 - DNA, 22 bp, Homo sapiens
ttttgccgaaggtatctgagat

SEQ ID NO: 7022433 - DNA, 21 bp, Homo sapiens
tgtctcaatcagaagtcatta

SEQ ID NO: 7022434 - DNA, 22 bp, Homo sapiens
aagctcagtgatgcctccaggg

SEQ ID NO: 7022435 - DNA, 22 bp, Homo sapiens
actagaaagcaaaagccatttc

SEQ ID NO: 7022436 - DNA, 22 bp, Homo sapiens
acatggaaaactaactgctttt

SEQ ID NO: 7022437 - DNA, 22 bp, Homo sapiens
agacaggctttgctgtatatca

SEQ ID NO: 7022438 - DNA, 22 bp, Homo sapiens
gttggccagcacagcttgcaag

SEQ ID NO: 7022439 - DNA, 22 bp, Homo sapiens
aacaaagtttcaggaagataga

SEQ ID NO: 7022440 - DNA, 22 bp, Homo sapiens
tgacctttgtgctagaaacata

SEQ ID NO: 7022441 - DNA, 22 bp, Homo sapiens
tggcttccactgtgtgccccct

SEQ ID NO: 7022442 - DNA, 22 bp, Homo sapiens
gggtacagttcttccagtgtca

SEQ ID NO: 7022443 - DNA, 22 bp, Homo sapiens
ccagctttatagcttcaaagga

SEQ ID NO: 7022444 - DNA, 22 bp, Homo sapiens
aacagactcacagctagagaag

SEQ ID NO: 7022445 - DNA, 22 bp, Homo sapiens
taactagatgtgagaatattca

SEQ ID NO: 7022446 - DNA, 22 bp, Homo sapiens
aagtgtctacatttgctaacca

SEQ ID NO: 7022447 - DNA, 22 bp, Homo sapiens
attcagttagccacagctattc

SEQ ID NO: 7022448 - DNA, 22 bp, Homo sapiens
tatctttgatgccagatgttac

SEQ ID NO: 7022449 - DNA, 22 bp, Homo sapiens
tgagccagataagggctcacgc

SEQ ID NO: 7022450 - DNA, 19 bp, Homo sapiens
tctggggtgtggcctggca

SEQ ID NO: 7022451 - DNA, 22 bp, Homo sapiens
aggaaagcttggcaaactaaat

SEQ ID NO: 7022452 - DNA, 22 bp, Homo sapiens
ttgcatcaggtagacaactata

SEQ ID NO: 7022453 - DNA, 22 bp, Homo sapiens
gaagtgcaaaaccacatggtaa

SEQ ID NO: 7022454 - DNA, 22 bp, Homo sapiens
tctggattctgtactgtaaagt

SEQ ID NO: 7022455 - DNA, 21 bp, Homo sapiens
tccaaaggagactgagtgtgt

SEQ ID NO: 7022456 - DNA, 20 bp, Homo sapiens
agcactaggtgtggcaggtg

SEQ ID NO: 7022457 - DNA, 22 bp, Homo sapiens
ggcagagccttctggagctcgc

SEQ ID NO: 7022458 - DNA, 22 bp, Homo sapiens
ctgaggtgagcttccctgggct

SEQ ID NO: 7022459 - DNA, 22 bp, Homo sapiens
tgtgaatagtgccgcaataaac

SEQ ID NO: 7022460 - DNA, 22 bp, Homo sapiens
ttagctttctttggcagacgtg

SEQ ID NO: 7022461 - DNA, 22 bp, Homo sapiens
agtgcacttttccacatccata

SEQ ID NO: 7022462 - DNA, 18 bp, Homo sapiens
agtgtgtgccctttcagg

SEQ ID NO: 7022463 - DNA, 19 bp, Homo sapiens
tcacaagagagataaagtg

SEQ ID NO: 7022464 - DNA, 22 bp, Homo sapiens
tgcttgcatccaacattaaggg

SEQ ID NO: 7022465 - DNA, 22 bp, Homo sapiens
caggacacagaataaggcagtt

SEQ ID NO: 7022466 - DNA, 20 bp, Homo sapiens
cagcagagacccatggggag

SEQ ID NO: 7022467 - DNA, 22 bp, Homo sapiens
caatcagatatgtgacatattt

SEQ ID NO: 7022468 - DNA, 22 bp, Homo sapiens
aaagtacacatttatcccttat

SEQ ID NO: 7022469 - DNA, 22 bp, Homo sapiens
gggttggattacttagggagaa

SEQ ID NO: 7022470 - DNA, 19 bp, Homo sapiens
ggctgctgaagagaattac

SEQ ID NO: 7022471 - DNA, 21 bp, Homo sapiens
tgcaatgcattgacagcagca

SEQ ID NO: 7022472 - DNA, 22 bp, Homo sapiens
ttcccaggtaattctgaggcag

SEQ ID NO: 7022473 - DNA, 22 bp, Homo sapiens
atatggctgttggtagccaaca

SEQ ID NO: 7022474 - DNA, 22 bp, Homo sapiens
ggtcaagaatttggccgtggct

SEQ ID NO: 7022475 - DNA, 22 bp, Homo sapiens
gtatttgctcatacagtgatac

SEQ ID NO: 7022476 - DNA, 22 bp, Homo sapiens
acatgatcttatgtagaagatc

SEQ ID NO: 7022477 - DNA, 22 bp, Homo sapiens
caccctgaggccacccagacct

SEQ ID NO: 7022478 - DNA, 22 bp, Homo sapiens
tagaaacacagagagacccatg

SEQ ID NO: 7022479 - DNA, 22 bp, Homo sapiens
gtgcagacttacagattatccc

SEQ ID NO: 7022480 - DNA, 22 bp, Homo sapiens
gagattgtttagctaccatggc

SEQ ID NO: 7022481 - DNA, 23 bp, Homo sapiens
tggcagtgatcaaaagcttacat

SEQ ID NO: 7022482 - DNA, 22 bp, Homo sapiens
tctgtcatctctaaaatagaaa

SEQ ID NO: 7022483 - DNA, 22 bp, Homo sapiens
atatatttgagaatattcatga

SEQ ID NO: 7022484 - DNA, 22 bp, Homo sapiens
acttttctgcagatgatctctt

SEQ ID NO: 7022485 - DNA, 22 bp, Homo sapiens
attccagagaggttctggaggt

SEQ ID NO: 7022486 - DNA, 21 bp, Homo sapiens
accttcaagccagaggtggtc

SEQ ID NO: 7022487 - DNA, 22 bp, Homo sapiens
gagacagatgctgctggagcat

SEQ ID NO: 7022488 - DNA, 22 bp, Homo sapiens
gactgggggcagccgcaccagt

SEQ ID NO: 7022489 - DNA, 21 bp, Homo sapiens
tttcaatttgccttgagtcat

SEQ ID NO: 7022490 - DNA, 22 bp, Homo sapiens
tgagacatcatggctgaaagta

SEQ ID NO: 7022491 - DNA, 22 bp, Homo sapiens
ttcccacttttacagttgtctg

SEQ ID NO: 7022492 - DNA, 16 bp, Homo sapiens
ccacagtaagaaatac

SEQ ID NO: 7022493 - DNA, 22 bp, Homo sapiens
cacatgcattggcaaaagtgta

SEQ ID NO: 7022494 - DNA, 22 bp, Homo sapiens
tttaacaggtaaagtaaatgtg

SEQ ID NO: 7022495 - DNA, 20 bp, Homo sapiens
gcatcctcccagcagagctg

SEQ ID NO: 7022496 - DNA, 22 bp, Homo sapiens
aagaggtttcatgattttctta

SEQ ID NO: 7022497 - DNA, 22 bp, Homo sapiens
ctggtcaccaggtagcattgta

SEQ ID NO: 7022498 - DNA, 22 bp, Homo sapiens
ctctagaaggtctccctgccag

SEQ ID NO: 7022499 - DNA, 21 bp, Homo sapiens
tcttggttccgtgtgtttgat

SEQ ID NO: 7022500 - DNA, 22 bp, Homo sapiens
gctggcctgcgagggcaggctg

SEQ ID NO: 7022501 - DNA, 22 bp, Homo sapiens
tttaggcaagaactcactgaga

SEQ ID NO: 7022502 - DNA, 22 bp, Homo sapiens
ctgtttcatgaatgcaatttca

SEQ ID NO: 7022503 - DNA, 22 bp, Homo sapiens
ctgaggagaccatcaactaatt

SEQ ID NO: 7022504 - DNA, 22 bp, Homo sapiens
tagttgacttctctatcccagc

SEQ ID NO: 7022505 - DNA, 22 bp, Homo sapiens
tgcaggaatattgatgaactta

SEQ ID NO: 7022506 - DNA, 22 bp, Homo sapiens
caacatattttccaagagtgaa

SEQ ID NO: 7022507 - DNA, 21 bp, Homo sapiens
tctcctgggtccaacccatgc

SEQ ID NO: 7022508 - DNA, 22 bp, Homo sapiens
cctggagacctgatggcagcgg

SEQ ID NO: 7022509 - DNA, 22 bp, Homo sapiens
aacccaggagttggaggctgtg

SEQ ID NO: 7022510 - DNA, 22 bp, Homo sapiens
acagagttgtaaacatttacca

SEQ ID NO: 7022511 - DNA, 22 bp, Homo sapiens
atacatgcacatttttatacat

SEQ ID NO: 7022512 - DNA, 22 bp, Homo sapiens
tgctgcaagtatttattctggg

SEQ ID NO: 7022513 - DNA, 22 bp, Homo sapiens
ctgcagctggctcatgggatat

SEQ ID NO: 7022514 - DNA, 22 bp, Homo sapiens
attcattccaggtcagtcagac

SEQ ID NO: 7022515 - DNA, 22 bp, Homo sapiens
tctttgaaacaccctaaccttt

SEQ ID NO: 7022516 - DNA, 22 bp, Homo sapiens
ctcttcagcaatgctttagtcc

SEQ ID NO: 7022517 - DNA, 22 bp, Homo sapiens
tgagtccatagtggatccttca

SEQ ID NO: 7022518 - DNA, 22 bp, Homo sapiens
tgaagcaggaaacttcttgttt

SEQ ID NO: 7022519 - DNA, 22 bp, Homo sapiens
tgtctgaagcagccagtgctgt

SEQ ID NO: 7022520 - DNA, 22 bp, Homo sapiens
tttaccaaggcatagtaatctc

SEQ ID NO: 7022521 - DNA, 22 bp, Homo sapiens
ctaaatgacaggtaccatagtg

SEQ ID NO: 7022522 - DNA, 22 bp, Homo sapiens
ttcttcttaatgtcctgggaac

SEQ ID NO: 7022523 - DNA, 22 bp, Homo sapiens
tttcaatcaccataaagcaact

SEQ ID NO: 7022524 - DNA, 22 bp, Homo sapiens
aatctctctggggttcagtcct

SEQ ID NO: 7022525 - DNA, 22 bp, Homo sapiens
cagtctctggtgagttgacagt

SEQ ID NO: 7022526 - DNA, 22 bp, Homo sapiens
gctgcccaggcaacattgactt

SEQ ID NO: 7022527 - DNA, 21 bp, Homo sapiens
actacatcatggtcacctact

SEQ ID NO: 7022528 - DNA, 22 bp, Homo sapiens
aggaagcaaaaggcagggtcta

SEQ ID NO: 7022529 - DNA, 22 bp, Homo sapiens
aatccattgctgtgctgccagg

SEQ ID NO: 7022530 - DNA, 22 bp, Homo sapiens
gggctccacctagggacactgg

SEQ ID NO: 7022531 - DNA, 22 bp, Homo sapiens
gcctagggttggcctgagaatc

SEQ ID NO: 7022532 - DNA, 22 bp, Homo sapiens
atgtccttctcctcttacctgc

SEQ ID NO: 7022533 - DNA, 18 bp, Homo sapiens
tctcagaggccatcctag

SEQ ID NO: 7022534 - DNA, 22 bp, Homo sapiens
cacatggttatatttgtaaagc

SEQ ID NO: 7022535 - DNA, 22 bp, Homo sapiens
tcaggctctgccacctagatta

SEQ ID NO: 7022536 - DNA, 22 bp, Homo sapiens
ctcctgcagccctcagcagcca

SEQ ID NO: 7022537 - DNA, 21 bp, Homo sapiens
cccaagggaggcaggataagg

SEQ ID NO: 7022538 - DNA, 22 bp, Homo sapiens
caggacacatttcttgttcagg

SEQ ID NO: 7022539 - DNA, 22 bp, Homo sapiens
tcacattcatggtgctaataaa

SEQ ID NO: 7022540 - DNA, 23 bp, Homo sapiens
tctgggctgagacttggaaggtc

SEQ ID NO: 7022541 - DNA, 22 bp, Homo sapiens
agctgggctgatgactcatgtt

SEQ ID NO: 7022542 - DNA, 22 bp, Homo sapiens
acctcagagacctctcaggtgc

SEQ ID NO: 7022543 - DNA, 20 bp, Homo sapiens
actatagcatattcagaaag

SEQ ID NO: 7022544 - DNA, 22 bp, Homo sapiens
attcccaggtaaaagtagagct

SEQ ID NO: 7022545 - DNA, 22 bp, Homo sapiens
ttcacagtctatcttggttttt

SEQ ID NO: 7022546 - DNA, 22 bp, Homo sapiens
aggtcagttttaggaaagagca

SEQ ID NO: 7022547 - DNA, 22 bp, Homo sapiens
ctggagccgcatggagcaggga

SEQ ID NO: 7022548 - DNA, 22 bp, Homo sapiens
agcagcaaagtattgggcaaga

SEQ ID NO: 7022549 - DNA, 22 bp, Homo sapiens
tgggtctttatgggggccagga

SEQ ID NO: 7022550 - DNA, 22 bp, Homo sapiens
tccaggcccctgcctgggcctg

SEQ ID NO: 7022551 - DNA, 22 bp, Homo sapiens
gtcaacataggcctcagtgagg

SEQ ID NO: 7022552 - DNA, 22 bp, Homo sapiens
gtgatttcaggtttttcatact

SEQ ID NO: 7022553 - DNA, 22 bp, Homo sapiens
tctgtgcagggaccccaagagt

SEQ ID NO: 7022554 - DNA, 22 bp, Homo sapiens
gcctgagagaactgaccaagag

SEQ ID NO: 7022555 - DNA, 22 bp, Homo sapiens
tccaagatcaaggtgttggcag

SEQ ID NO: 7022556 - DNA, 22 bp, Homo sapiens
cctctgtcctggggagtggagc

SEQ ID NO: 7022557 - DNA, 22 bp, Homo sapiens
cataggtgttcccgtgggtcac

SEQ ID NO: 7022558 - DNA, 22 bp, Homo sapiens
atggtattaggaaatctgaatg

SEQ ID NO: 7022559 - DNA, 21 bp, Homo sapiens
aagaggcatcactatttgtgt

SEQ ID NO: 7022560 - DNA, 22 bp, Homo sapiens
tgaacacatattaggtgctcat

SEQ ID NO: 7022561 - DNA, 22 bp, Homo sapiens
caagggttctgtgcctcctgct

SEQ ID NO: 7022562 - DNA, 22 bp, Homo sapiens
acccatttttaaatataacttg

SEQ ID NO: 7022563 - DNA, 22 bp, Homo sapiens
gagctggcaggaggctccccga

SEQ ID NO: 7022564 - DNA, 22 bp, Homo sapiens
tctgattcattcatgtgcacca

SEQ ID NO: 7022565 - DNA, 17 bp, Homo sapiens
gacctttctctagcatt

SEQ ID NO: 7022566 - DNA, 23 bp, Homo sapiens
ggccacaaatagtctcccctggc

SEQ ID NO: 7022567 - DNA, 22 bp, Homo sapiens
tgtctttctgacccaaggtagt

SEQ ID NO: 7022568 - DNA, 22 bp, Homo sapiens
ggacttcattattgggagaggc

SEQ ID NO: 7022569 - DNA, 22 bp, Homo sapiens
ctggaaggtaacaaggccatta

SEQ ID NO: 7022570 - DNA, 22 bp, Homo sapiens
tgatttccctcatcataacaga

SEQ ID NO: 7022571 - DNA, 22 bp, Homo sapiens
acaaatagagattcaaataaag

SEQ ID NO: 7022572 - DNA, 22 bp, Homo sapiens
cagatgtgagctggggagagtg

SEQ ID NO: 7022573 - DNA, 22 bp, Homo sapiens
ggccaagatcccattatacaaa

SEQ ID NO: 7022574 - DNA, 22 bp, Homo sapiens
gcactgtgcttagttcactatt

SEQ ID NO: 7022575 - DNA, 22 bp, Homo sapiens
tttcagtctgtaaaggtgagga

SEQ ID NO: 7022576 - DNA, 22 bp, Homo sapiens
ctatatttcttggctttaaaca

SEQ ID NO: 7022577 - DNA, 22 bp, Homo sapiens
aatcagcagaagagaggtctta

SEQ ID NO: 7022578 - DNA, 21 bp, Homo sapiens
atacattctattaagcattta

SEQ ID NO: 7022579 - DNA, 22 bp, Homo sapiens
aagaagcaggtcacagacaggg

SEQ ID NO: 7022580 - DNA, 22 bp, Homo sapiens
aagtccatagtttgcattaggg

SEQ ID NO: 7022581 - DNA, 23 bp, Homo sapiens
atatgtcatgcaccagcacttta

SEQ ID NO: 7022582 - DNA, 22 bp, Homo sapiens
aacacataggcagagcatgaca

SEQ ID NO: 7022583 - DNA, 22 bp, Homo sapiens
tgctctggggagctcctctgcg

SEQ ID NO: 7022584 - DNA, 22 bp, Homo sapiens
tacagcctggcactaccctggg

SEQ ID NO: 7022585 - DNA, 19 bp, Homo sapiens
atgttctgaattactgtaa

SEQ ID NO: 7022586 - DNA, 22 bp, Homo sapiens
gcttccatttgctaggggattt

SEQ ID NO: 7022587 - DNA, 22 bp, Homo sapiens
accccccagataatcccttgag

SEQ ID NO: 7022588 - DNA, 20 bp, Homo sapiens
agggtcagagagcgtgagtg

SEQ ID NO: 7022589 - DNA, 21 bp, Homo sapiens
tcctctactgagccatgcaga

SEQ ID NO: 7022590 - DNA, 22 bp, Homo sapiens
cccccaggctctgacacaggag

SEQ ID NO: 7022591 - DNA, 22 bp, Homo sapiens
tggagcagcattcatccagcag

SEQ ID NO: 7022592 - DNA, 21 bp, Homo sapiens
tgaaggagaggaccgagtgct

SEQ ID NO: 7022593 - DNA, 22 bp, Homo sapiens
gtaggccagtgtgaaacctggt

SEQ ID NO: 7022594 - DNA, 19 bp, Homo sapiens
tctctggcttgtctgcctg

SEQ ID NO: 7022595 - DNA, 22 bp, Homo sapiens
tccttagagtggttgtgctatg

SEQ ID NO: 7022596 - DNA, 22 bp, Homo sapiens
ctttgctagtgatttgtttagg

SEQ ID NO: 7022597 - DNA, 22 bp, Homo sapiens
atccatcctgccatctgagtag

SEQ ID NO: 7022598 - DNA, 22 bp, Homo sapiens
acaaggctaatttggaagatac

SEQ ID NO: 7022599 - DNA, 22 bp, Homo sapiens
catgagcataaatcagtcacga

SEQ ID NO: 7022600 - DNA, 22 bp, Homo sapiens
tttggcttctcctaccacctct

SEQ ID NO: 7022601 - DNA, 22 bp, Homo sapiens
cctggaaagcggttcattttgt

SEQ ID NO: 7022602 - DNA, 22 bp, Homo sapiens
gatgcttcctgttttaaatagg

SEQ ID NO: 7022603 - DNA, 22 bp, Homo sapiens
tgtggggtgtggtccaggcatc

SEQ ID NO: 7022604 - DNA, 22 bp, Homo sapiens
atgctgtggtagacagcattcc

SEQ ID NO: 7022605 - DNA, 22 bp, Homo sapiens
gcctgccttttggaggcacatt

SEQ ID NO: 7022606 - DNA, 22 bp, Homo sapiens
tgaaatcatgagatagtgtcac

SEQ ID NO: 7022607 - DNA, 22 bp, Homo sapiens
ttccttggtgcgcctgctgcag

SEQ ID NO: 7022608 - DNA, 22 bp, Homo sapiens
agacttcacctacagcagtctc

SEQ ID NO: 7022609 - DNA, 22 bp, Homo sapiens
ccagggctttgccaaagtccag

SEQ ID NO: 7022610 - DNA, 22 bp, Homo sapiens
tctgtacaaaggctatttggag

SEQ ID NO: 7022611 - DNA, 22 bp, Homo sapiens
cagaagtcaccctcagaataac

SEQ ID NO: 7022612 - DNA, 22 bp, Homo sapiens
atcaggatgacaactgctgggt

SEQ ID NO: 7022613 - DNA, 22 bp, Homo sapiens
tgcaggaagtttcctgaacttt

SEQ ID NO: 7022614 - DNA, 22 bp, Homo sapiens
tcataatacaaagagttctgca

SEQ ID NO: 7022615 - DNA, 22 bp, Homo sapiens
ttagctgactgtgtgatttggc

SEQ ID NO: 7022616 - DNA, 22 bp, Homo sapiens
cctgtcccccaggcctgtacca

SEQ ID NO: 7022617 - DNA, 22 bp, Homo sapiens
ccaaggatccagcccttcactc

SEQ ID NO: 7022618 - DNA, 22 bp, Homo sapiens
tgctcagcagtcaaggtcatag

SEQ ID NO: 7022619 - DNA, 22 bp, Homo sapiens
tgcaccctgcctgcctgcgggt

SEQ ID NO: 7022620 - DNA, 22 bp, Homo sapiens
taataggagccaggtcacatag

SEQ ID NO: 7022621 - DNA, 22 bp, Homo sapiens
ttcaacagacccttctttcttt

SEQ ID NO: 7022622 - DNA, 22 bp, Homo sapiens
aaatctcctttgatatcccatc

SEQ ID NO: 7022623 - DNA, 22 bp, Homo sapiens
agaggccactttgcctgtgatg

SEQ ID NO: 7022624 - DNA, 18 bp, Homo sapiens
agggcctccatcccctcc

SEQ ID NO: 7022625 - DNA, 22 bp, Homo sapiens
tctgccttttcactgccactaa

SEQ ID NO: 7022626 - DNA, 22 bp, Homo sapiens
tgtagaagttcttcaggagaat

SEQ ID NO: 7022627 - DNA, 20 bp, Homo sapiens
gcaagcttattagtgatatt

SEQ ID NO: 7022628 - DNA, 22 bp, Homo sapiens
gaggagcccagcaccatcactt

SEQ ID NO: 7022629 - DNA, 22 bp, Homo sapiens
ccttttatgaacttgagcaggt

SEQ ID NO: 7022630 - DNA, 22 bp, Homo sapiens
actgggcagcagctcgagccgc

SEQ ID NO: 7022631 - DNA, 22 bp, Homo sapiens
ggcttcagctggttatttcctt

SEQ ID NO: 7022632 - DNA, 22 bp, Homo sapiens
tacatctatttgacagatacag

SEQ ID NO: 7022633 - DNA, 22 bp, Homo sapiens
aagagccaggacagatccagct

SEQ ID NO: 7022634 - DNA, 22 bp, Homo sapiens
caattacatttattgagcattc

SEQ ID NO: 7022635 - DNA, 22 bp, Homo sapiens
aggctcaggtctcaggtctggc

SEQ ID NO: 7022636 - DNA, 22 bp, Homo sapiens
acagatgaatttatggatggaa

SEQ ID NO: 7022637 - DNA, 23 bp, Homo sapiens
tgtaaagatcaagtgactgattt

SEQ ID NO: 7022638 - DNA, 22 bp, Homo sapiens
cctgtcctccaagagcacatct

SEQ ID NO: 7022639 - DNA, 20 bp, Homo sapiens
tgtctgctgagctgctgccc

SEQ ID NO: 7022640 - DNA, 23 bp, Homo sapiens
tggcatagtgaggggcacagaga

SEQ ID NO: 7022641 - DNA, 22 bp, Homo sapiens
atttgagatggtaaataacttt

SEQ ID NO: 7022642 - DNA, 22 bp, Homo sapiens
tacatgtgggttaaaaacactc

SEQ ID NO: 7022643 - DNA, 22 bp, Homo sapiens
ttcactgtactgactgtcttat

SEQ ID NO: 7022644 - DNA, 22 bp, Homo sapiens
tagaaactcacgttatcattgc

SEQ ID NO: 7022645 - DNA, 22 bp, Homo sapiens
gtagtttacagaagaggagcaa

SEQ ID NO: 7022646 - DNA, 22 bp, Homo sapiens
tctgagccctcttttgcagccc

SEQ ID NO: 7022647 - DNA, 22 bp, Homo sapiens
gtttccacttatatggtaccta

SEQ ID NO: 7022648 - DNA, 22 bp, Homo sapiens
cctttcttgctaagagtttatg

SEQ ID NO: 7022649 - DNA, 19 bp, Homo sapiens
ctattgcacatagctgaag

SEQ ID NO: 7022650 - DNA, 22 bp, Homo sapiens
cccagagactttgtccgacgac

SEQ ID NO: 7022651 - DNA, 22 bp, Homo sapiens
acccaggctggagtgcagtgtc

SEQ ID NO: 7022652 - DNA, 22 bp, Homo sapiens
actgtatttggatataagatct

SEQ ID NO: 7022653 - DNA, 22 bp, Homo sapiens
tacttgttaaaatattagctat

SEQ ID NO: 7022654 - DNA, 22 bp, Homo sapiens
gcaatgcagggcaacatggggt

SEQ ID NO: 7022655 - DNA, 22 bp, Homo sapiens
cagatactgtaaaatttcagta

SEQ ID NO: 7022656 - DNA, 22 bp, Homo sapiens
tggtccctccttcttcccagat

SEQ ID NO: 7022657 - DNA, 22 bp, Homo sapiens
gcaggagtatctatacattaaa

SEQ ID NO: 7022658 - DNA, 22 bp, Homo sapiens
aaatgaactcttcctgcatccc

SEQ ID NO: 7022659 - DNA, 22 bp, Homo sapiens
gccattaaagtgcatgttttgc

SEQ ID NO: 7022660 - DNA, 22 bp, Homo sapiens
ccagcagctgtggctttgcctc

SEQ ID NO: 7022661 - DNA, 22 bp, Homo sapiens
agatgggcgccctggactgagg

SEQ ID NO: 7022662 - DNA, 20 bp, Homo sapiens
ctagaagcagaattgctgat

SEQ ID NO: 7022663 - DNA, 22 bp, Homo sapiens
tcagctggagatgagaaccgaa

SEQ ID NO: 7022664 - DNA, 22 bp, Homo sapiens
ctcagtgcaaccaaagtgatct

SEQ ID NO: 7022665 - DNA, 22 bp, Homo sapiens
gaaactgggaagtcccagatca

SEQ ID NO: 7022666 - DNA, 22 bp, Homo sapiens
atgttacggaatgtcaaggact

SEQ ID NO: 7022667 - DNA, 22 bp, Homo sapiens
cccagagtctctgctcttgcct

SEQ ID NO: 7022668 - DNA, 20 bp, Homo sapiens
acaggctttctgaggctggc

SEQ ID NO: 7022669 - DNA, 22 bp, Homo sapiens
tgaggctcaagaatctgcattt

SEQ ID NO: 7022670 - DNA, 22 bp, Homo sapiens
agaatctggtagaaccaaggat

SEQ ID NO: 7022671 - DNA, 22 bp, Homo sapiens
tggcatgagaatactgagggat

SEQ ID NO: 7022672 - DNA, 22 bp, Homo sapiens
tgcagccacatgacctgggtct

SEQ ID NO: 7022673 - DNA, 22 bp, Homo sapiens
ttccaagaaacaagtgatgcag

SEQ ID NO: 7022674 - DNA, 22 bp, Homo sapiens
aactgcattagctaacgtgagt

SEQ ID NO: 7022675 - DNA, 22 bp, Homo sapiens
gggcagcacgtttcaggaggat

SEQ ID NO: 7022676 - DNA, 18 bp, Homo sapiens
ctcaccattctgcccaat

SEQ ID NO: 7022677 - DNA, 22 bp, Homo sapiens
ctcaaatgtttccacttctgct

SEQ ID NO: 7022678 - DNA, 22 bp, Homo sapiens
ctggaggcacccttagagaggc

SEQ ID NO: 7022679 - DNA, 22 bp, Homo sapiens
ttgcttcagagaggaggaggtg

SEQ ID NO: 7022680 - DNA, 20 bp, Homo sapiens
tgtggaaaaacagaagcaga

SEQ ID NO: 7022681 - DNA, 21 bp, Homo sapiens
agaaccttggatgccattgca

SEQ ID NO: 7022682 - DNA, 22 bp, Homo sapiens
gaatgtcagggccagaagaggc

SEQ ID NO: 7022683 - DNA, 21 bp, Homo sapiens
tgacacccagagcctcctccc

SEQ ID NO: 7022684 - DNA, 22 bp, Homo sapiens
gaaatctactttgggttagaca

SEQ ID NO: 7022685 - DNA, 22 bp, Homo sapiens
gactccagagtgactatttgtc

SEQ ID NO: 7022686 - DNA, 22 bp, Homo sapiens
actgatgaaaactaataaatta

SEQ ID NO: 7022687 - DNA, 22 bp, Homo sapiens
tctctgactcatatttgtgcct

SEQ ID NO: 7022688 - DNA, 22 bp, Homo sapiens
taagacttccaggaaaaggtgg

SEQ ID NO: 7022689 - DNA, 20 bp, Homo sapiens
gaaggcttggacagtgacag

SEQ ID NO: 7022690 - DNA, 22 bp, Homo sapiens
agggagtcatatatacctgcat

SEQ ID NO: 7022691 - DNA, 22 bp, Homo sapiens
aaatggtagtagcattccatat

SEQ ID NO: 7022692 - DNA, 19 bp, Homo sapiens
ctcacctctgtgcgccccc

SEQ ID NO: 7022693 - DNA, 22 bp, Homo sapiens
actccagttaccttggctgagg

SEQ ID NO: 7022694 - DNA, 22 bp, Homo sapiens
aatatttcttctaaagcccttt

SEQ ID NO: 7022695 - DNA, 22 bp, Homo sapiens
aggtcctctcccagggtactgc

SEQ ID NO: 7022696 - DNA, 22 bp, Homo sapiens
ttgctcagcactggagccagct

SEQ ID NO: 7022697 - DNA, 22 bp, Homo sapiens
tccaccaagccggggccacttc

SEQ ID NO: 7022698 - DNA, 22 bp, Homo sapiens
tatatttaattagttgctggat

SEQ ID NO: 7022699 - DNA, 22 bp, Homo sapiens
tctttccacactgtatgcccat

SEQ ID NO: 7022700 - DNA, 22 bp, Homo sapiens
ttgcaaggagccactctgcctg

SEQ ID NO: 7022701 - DNA, 19 bp, Homo sapiens
tcatttgttagtagaagtt

SEQ ID NO: 7022702 - DNA, 22 bp, Homo sapiens
atctcaactaagcctaactttt

SEQ ID NO: 7022703 - DNA, 22 bp, Homo sapiens
agagaagtgagcttgttcactc

SEQ ID NO: 7022704 - DNA, 22 bp, Homo sapiens
tcagaaataatgaatgatgggg

SEQ ID NO: 7022705 - DNA, 22 bp, Homo sapiens
tttctagcaagaaagaggtgga

SEQ ID NO: 7022706 - DNA, 23 bp, Homo sapiens
tgctggttcaaaaaggaaggagg

SEQ ID NO: 7022707 - DNA, 22 bp, Homo sapiens
gagagcatactataatggaggt

SEQ ID NO: 7022708 - DNA, 20 bp, Homo sapiens
ggcatggcaaatgttcttgc

SEQ ID NO: 7022709 - DNA, 22 bp, Homo sapiens
ggagtctgagtcctcatagaca

SEQ ID NO: 7022710 - DNA, 22 bp, Homo sapiens
ttccttgtgtaaactctccatc

SEQ ID NO: 7022711 - DNA, 22 bp, Homo sapiens
atgtttgaggactcagaagacg

SEQ ID NO: 7022712 - DNA, 22 bp, Homo sapiens
tcactgcaatctctgccttcca

SEQ ID NO: 7022713 - DNA, 17 bp, Homo sapiens
actagaccttaatattt

SEQ ID NO: 7022714 - DNA, 22 bp, Homo sapiens
gaagcagaagtacgatttacta

SEQ ID NO: 7022715 - DNA, 22 bp, Homo sapiens
tagttaaagccctaaattgata

SEQ ID NO: 7022716 - DNA, 22 bp, Homo sapiens
ggcatgctcaggcttcttgctg

SEQ ID NO: 7022717 - DNA, 22 bp, Homo sapiens
tgtgaataccttgaattcatca

SEQ ID NO: 7022718 - DNA, 22 bp, Homo sapiens
tgtctttctgcaccacctcaca

SEQ ID NO: 7022719 - DNA, 22 bp, Homo sapiens
tttggcaacctcaatggctcta

SEQ ID NO: 7022720 - DNA, 21 bp, Homo sapiens
cttgaaaggtagagtctacag

SEQ ID NO: 7022721 - DNA, 22 bp, Homo sapiens
gtctactgcccaaatcaatatt

SEQ ID NO: 7022722 - DNA, 21 bp, Homo sapiens
aatatccaaatgattagatct

SEQ ID NO: 7022723 - DNA, 22 bp, Homo sapiens
ctggtcccagcagagctctgag

SEQ ID NO: 7022724 - DNA, 22 bp, Homo sapiens
atccctctgcagctggttcctg

SEQ ID NO: 7022725 - DNA, 22 bp, Homo sapiens
tcttcagaagatcacatcagtg

SEQ ID NO: 7022726 - DNA, 22 bp, Homo sapiens
atattaatgggatttagtcagg

SEQ ID NO: 7022727 - DNA, 22 bp, Homo sapiens
aagtagttggaaataagacaga

SEQ ID NO: 7022728 - DNA, 22 bp, Homo sapiens
gtgtgcaggggcttggtggagc

SEQ ID NO: 7022729 - DNA, 22 bp, Homo sapiens
atacttagttttaatccattag

SEQ ID NO: 7022730 - DNA, 22 bp, Homo sapiens
ttgttcatccaacacaaggttg

SEQ ID NO: 7022731 - DNA, 22 bp, Homo sapiens
gcatgatgaaggaggaggagtc

SEQ ID NO: 7022732 - DNA, 22 bp, Homo sapiens
gccaataaaatctgtgcatatt

SEQ ID NO: 7022733 - DNA, 22 bp, Homo sapiens
catcaaataggaatatttggca

SEQ ID NO: 7022734 - DNA, 22 bp, Homo sapiens
ttaggagatggtcctctaggga

SEQ ID NO: 7022735 - DNA, 22 bp, Homo sapiens
tggggagcacggtagggaaatg

SEQ ID NO: 7022736 - DNA, 22 bp, Homo sapiens
gctgcctggctttagtccactt

SEQ ID NO: 7022737 - DNA, 22 bp, Homo sapiens
atcactggagtgaaaggcaaac

SEQ ID NO: 7022738 - DNA, 22 bp, Homo sapiens
acaaagtttcttctaacatctg

SEQ ID NO: 7022739 - DNA, 22 bp, Homo sapiens
ctgcagctgggccagggccacc

SEQ ID NO: 7022740 - DNA, 22 bp, Homo sapiens
gaagttgatagagtacatgatt

SEQ ID NO: 7022741 - DNA, 22 bp, Homo sapiens
gagaagtttaatcattagacca

SEQ ID NO: 7022742 - DNA, 22 bp, Homo sapiens
gagcatgcgcgtgggagacacc

SEQ ID NO: 7022743 - DNA, 22 bp, Homo sapiens
atgaatgtgatgattctgttac

SEQ ID NO: 7022744 - DNA, 22 bp, Homo sapiens
cctttttctgagttgtagcttc

SEQ ID NO: 7022745 - DNA, 18 bp, Homo sapiens
tggaatcctgatgctggg

SEQ ID NO: 7022746 - DNA, 22 bp, Homo sapiens
aacatctttttgtttgctgaaa

SEQ ID NO: 7022747 - DNA, 19 bp, Homo sapiens
tagataagaggtgatagga

SEQ ID NO: 7022748 - DNA, 22 bp, Homo sapiens
gtatatatcggcactattttaa

SEQ ID NO: 7022749 - DNA, 21 bp, Homo sapiens
gactctggggtcagctcaacc

SEQ ID NO: 7022750 - DNA, 20 bp, Homo sapiens
tgaatatgaccttatttgga

SEQ ID NO: 7022751 - DNA, 22 bp, Homo sapiens
aaatgctctggatgaccttgga

SEQ ID NO: 7022752 - DNA, 22 bp, Homo sapiens
tttatgagcaatgctgagggga

SEQ ID NO: 7022753 - DNA, 22 bp, Homo sapiens
aggtctcaatctcaggtggtca

SEQ ID NO: 7022754 - DNA, 22 bp, Homo sapiens
caggccttatctccaccctgca

SEQ ID NO: 7022755 - DNA, 22 bp, Homo sapiens
gagcttcagagaccacttaact

SEQ ID NO: 7022756 - DNA, 22 bp, Homo sapiens
aaatacaatttcaggctgtaat

SEQ ID NO: 7022757 - DNA, 22 bp, Homo sapiens
catcagtgagccccttgatgag

SEQ ID NO: 7022758 - DNA, 22 bp, Homo sapiens
tgctgctcagaacccctgggct

SEQ ID NO: 7022759 - DNA, 22 bp, Homo sapiens
agcagccaattggaggatgaag

SEQ ID NO: 7022760 - DNA, 21 bp, Homo sapiens
gacattgagcgtgtcgcagtg

SEQ ID NO: 7022761 - DNA, 22 bp, Homo sapiens
tagggtgggcagttcttgggga

SEQ ID NO: 7022762 - DNA, 22 bp, Homo sapiens
acagatttattgaagctgctgc

SEQ ID NO: 7022763 - DNA, 22 bp, Homo sapiens
gtgataggcatttaactctaag

SEQ ID NO: 7022764 - DNA, 22 bp, Homo sapiens
ttgcttgggctggagtgcaatg

SEQ ID NO: 7022765 - DNA, 22 bp, Homo sapiens
ctgtctgagtgatgtcattcct

SEQ ID NO: 7022766 - DNA, 22 bp, Homo sapiens
acagccaggtaaaggcatggca

SEQ ID NO: 7022767 - DNA, 19 bp, Homo sapiens
ggacctggcaatctgcatt

SEQ ID NO: 7022768 - DNA, 22 bp, Homo sapiens
agtttatgattttatgtaagta

SEQ ID NO: 7022769 - DNA, 22 bp, Homo sapiens
tttgcaagtatcaaacatgtca

SEQ ID NO: 7022770 - DNA, 22 bp, Homo sapiens
tgaacacataaggctttcctgt

SEQ ID NO: 7022771 - DNA, 22 bp, Homo sapiens
attcatgtaacattagagaaat

SEQ ID NO: 7022772 - DNA, 22 bp, Homo sapiens
tcaggttctggtgagggccctt

SEQ ID NO: 7022773 - DNA, 22 bp, Homo sapiens
tcacatctgaaaaaatattgag

SEQ ID NO: 7022774 - DNA, 22 bp, Homo sapiens
tacagaaacagcgtggttagaa

SEQ ID NO: 7022775 - DNA, 22 bp, Homo sapiens
tgttcattgccccctgtgtaaa

SEQ ID NO: 7022776 - DNA, 22 bp, Homo sapiens
atccaatggggagtgagttctt

SEQ ID NO: 7022777 - DNA, 22 bp, Homo sapiens
caggaatgcattctagaatggc

SEQ ID NO: 7022778 - DNA, 22 bp, Homo sapiens
ctgggcctgtgactcccatcct

SEQ ID NO: 7022779 - DNA, 17 bp, Homo sapiens
ggagttctgcagtcagg

SEQ ID NO: 7022780 - DNA, 21 bp, Homo sapiens
gatttgcagaaactagacagg

SEQ ID NO: 7022781 - DNA, 22 bp, Homo sapiens
ggccatggggacagagggtgaa

SEQ ID NO: 7022782 - DNA, 22 bp, Homo sapiens
cttcactgtgcttcaagcagct

SEQ ID NO: 7022783 - DNA, 23 bp, Homo sapiens
ttgcttctgtgcaattcagtact

SEQ ID NO: 7022784 - DNA, 22 bp, Homo sapiens
tgctgggatatagcttctaggg

SEQ ID NO: 7022785 - DNA, 22 bp, Homo sapiens
ggattctgccttgttgcttcaa

SEQ ID NO: 7022786 - DNA, 22 bp, Homo sapiens
tggaatcagactcctgcatttt

SEQ ID NO: 7022787 - DNA, 22 bp, Homo sapiens
ggaatgtaccacctattgttag

SEQ ID NO: 7022788 - DNA, 22 bp, Homo sapiens
aatccatgcatgcaaggaaagg

SEQ ID NO: 7022789 - DNA, 22 bp, Homo sapiens
tgcccagggtttctaagagcag

SEQ ID NO: 7022790 - DNA, 21 bp, Homo sapiens
tcctctccatgatctgtttgt

SEQ ID NO: 7022791 - DNA, 22 bp, Homo sapiens
agctcacagtgtccttcctcaa

SEQ ID NO: 7022792 - DNA, 22 bp, Homo sapiens
agcaggggtaacagaaggaaag

SEQ ID NO: 7022793 - DNA, 22 bp, Homo sapiens
tggaaaggtaggatttcaagac

SEQ ID NO: 7022794 - DNA, 22 bp, Homo sapiens
agggtgcagtcacaggaaatgt

SEQ ID NO: 7022795 - DNA, 22 bp, Homo sapiens
tccccacagcagaagatctgag

SEQ ID NO: 7022796 - DNA, 22 bp, Homo sapiens
gtattcagaaggatgatctagt

SEQ ID NO: 7022797 - DNA, 22 bp, Homo sapiens
ggtggaagccttcagaacagca

SEQ ID NO: 7022798 - DNA, 22 bp, Homo sapiens
attatccaacacccagttacat

SEQ ID NO: 7022799 - DNA, 16 bp, Homo sapiens
gtggcagccccttctc

SEQ ID NO: 7022800 - DNA, 22 bp, Homo sapiens
gccaggtatagactccagttct

SEQ ID NO: 7022801 - DNA, 22 bp, Homo sapiens
ccttctgtgtgcccacgtttat

SEQ ID NO: 7022802 - DNA, 19 bp, Homo sapiens
tgctgcaggatgctgctgg

SEQ ID NO: 7022803 - DNA, 22 bp, Homo sapiens
ctgactctcctcaagcataaat

SEQ ID NO: 7022804 - DNA, 22 bp, Homo sapiens
tactacattaataaaacattca

SEQ ID NO: 7022805 - DNA, 22 bp, Homo sapiens
tagtgccaccttccaagtatca

SEQ ID NO: 7022806 - DNA, 22 bp, Homo sapiens
ctggaggacagaggccatgtct

SEQ ID NO: 7022807 - DNA, 22 bp, Homo sapiens
agagacttaaaactgttttcac

SEQ ID NO: 7022808 - DNA, 22 bp, Homo sapiens
ggctgcagattgtagtctgtta

SEQ ID NO: 7022809 - DNA, 22 bp, Homo sapiens
tataaagaaatgatttccagaa

SEQ ID NO: 7022810 - DNA, 22 bp, Homo sapiens
tttctagctgtaggaagctgag

SEQ ID NO: 7022811 - DNA, 22 bp, Homo sapiens
atctgtgtatgaaagtataact

SEQ ID NO: 7022812 - DNA, 22 bp, Homo sapiens
gctgccctgacaagctactccc

SEQ ID NO: 7022813 - DNA, 22 bp, Homo sapiens
acatgacaaggtttataaggct

SEQ ID NO: 7022814 - DNA, 22 bp, Homo sapiens
ctctggcggccatgctcgtggt

SEQ ID NO: 7022815 - DNA, 22 bp, Homo sapiens
ggcagctgctgcattacgttgt

SEQ ID NO: 7022816 - DNA, 22 bp, Homo sapiens
cctttgggttcaatctcggtct

SEQ ID NO: 7022817 - DNA, 16 bp, Homo sapiens
ttaccacctcaggccc

SEQ ID NO: 7022818 - DNA, 22 bp, Homo sapiens
actgaggtttcattttatcgct

SEQ ID NO: 7022819 - DNA, 20 bp, Homo sapiens
tcctggtggatactgcttaa

SEQ ID NO: 7022820 - DNA, 22 bp, Homo sapiens
gtcatcttatcattgttgctgt

SEQ ID NO: 7022821 - DNA, 22 bp, Homo sapiens
gaacctgtttatgttacctgcg

SEQ ID NO: 7022822 - DNA, 22 bp, Homo sapiens
aaagtgcttccttttagaggct

SEQ ID NO: 7022823 - DNA, 22 bp, Homo sapiens
tttgactcttgctttggtggct

SEQ ID NO: 7022824 - DNA, 21 bp, Homo sapiens
tgagcaaaatttagagtgatg

SEQ ID NO: 7022825 - DNA, 22 bp, Homo sapiens
tgtgtctggataggtaatggat

SEQ ID NO: 7022826 - DNA, 23 bp, Homo sapiens
taacttacatcattctgcacaag

SEQ ID NO: 7022827 - DNA, 22 bp, Homo sapiens
ggagatggtggaagctggtgca

SEQ ID NO: 7022828 - DNA, 22 bp, Homo sapiens
ctcaggagatgacagaaggtat

SEQ ID NO: 7022829 - DNA, 22 bp, Homo sapiens
cactggaatagcattgattctt

SEQ ID NO: 7022830 - DNA, 22 bp, Homo sapiens
ccattatccacgggcttcctga

SEQ ID NO: 7022831 - DNA, 22 bp, Homo sapiens
gggcactgtgctaggtgctgag

SEQ ID NO: 7022832 - DNA, 22 bp, Homo sapiens
ttactaagagaagtaaatattt

SEQ ID NO: 7022833 - DNA, 22 bp, Homo sapiens
atcagcatcgggtggtggtggg

SEQ ID NO: 7022834 - DNA, 22 bp, Homo sapiens
catgtgggactcctgctgtttt

SEQ ID NO: 7022835 - DNA, 22 bp, Homo sapiens
tcatagggcatcaagcagagca

SEQ ID NO: 7022836 - DNA, 22 bp, Homo sapiens
gtcagtgtaggttcatcagtgg

SEQ ID NO: 7022837 - DNA, 22 bp, Homo sapiens
ggcaaacaggagagtaaagaga

SEQ ID NO: 7022838 - DNA, 22 bp, Homo sapiens
gcagaggctgggtgtcccagtc

SEQ ID NO: 7022839 - DNA, 22 bp, Homo sapiens
atttagacttcttgcaggtaat

SEQ ID NO: 7022840 - DNA, 22 bp, Homo sapiens
atttactgcttgacacattggt

SEQ ID NO: 7022841 - DNA, 22 bp, Homo sapiens
gagcgattgcgggggtcagagg

SEQ ID NO: 7022842 - DNA, 22 bp, Homo sapiens
ccaagggaaaccgagaggctgg

SEQ ID NO: 7022843 - DNA, 22 bp, Homo sapiens
gttagcttagtagctgtttctt

SEQ ID NO: 7022844 - DNA, 22 bp, Homo sapiens
cagcagctaaggcatgttcctg

SEQ ID NO: 7022845 - DNA, 22 bp, Homo sapiens
attcttcacctgagtcagtcta

SEQ ID NO: 7022846 - DNA, 19 bp, Homo sapiens
gctgtgaaagcagccatat

SEQ ID NO: 7022847 - DNA, 22 bp, Homo sapiens
taaagacaataggaaagttgtt

SEQ ID NO: 7022848 - DNA, 22 bp, Homo sapiens
taatccttgcttagtgtggggc

SEQ ID NO: 7022849 - DNA, 22 bp, Homo sapiens
aaggcttttaaactgtcaagga

SEQ ID NO: 7022850 - DNA, 22 bp, Homo sapiens
agtctgaaccagatggcaaggt

SEQ ID NO: 7022851 - DNA, 18 bp, Homo sapiens
gtgctgaataactacttt

SEQ ID NO: 7022852 - DNA, 22 bp, Homo sapiens
tgtctggacattgacaatcatg

SEQ ID NO: 7022853 - DNA, 22 bp, Homo sapiens
atagtacaagggaagagtgaag

SEQ ID NO: 7022854 - DNA, 22 bp, Homo sapiens
ttcctttagggaaatcgtctca

SEQ ID NO: 7022855 - DNA, 18 bp, Homo sapiens
ctcccctgttttccctgc

SEQ ID NO: 7022856 - DNA, 22 bp, Homo sapiens
taatgagaagactttgaggctc

SEQ ID NO: 7022857 - DNA, 23 bp, Homo sapiens
tcctaactgattctgcagtctct

SEQ ID NO: 7022858 - DNA, 17 bp, Homo sapiens
tgggggcgccagggtct

SEQ ID NO: 7022859 - DNA, 19 bp, Homo sapiens
ctgggctgaggtctgcctt

SEQ ID NO: 7022860 - DNA, 22 bp, Homo sapiens
tcctctggtacttaaagtgctt

SEQ ID NO: 7022861 - DNA, 22 bp, Homo sapiens
cacactgtctttcagaatggtt

SEQ ID NO: 7022862 - DNA, 22 bp, Homo sapiens
aaggcagcttcaccacagcatt

SEQ ID NO: 7022863 - DNA, 22 bp, Homo sapiens
ggcctaggaaggggatgtaact

SEQ ID NO: 7022864 - DNA, 22 bp, Homo sapiens
ctgtgaggccctgggtgctgga

SEQ ID NO: 7022865 - DNA, 22 bp, Homo sapiens
acaaggctctaatttcattgaa

SEQ ID NO: 7022866 - DNA, 22 bp, Homo sapiens
tgcagggctataactccattct

SEQ ID NO: 7022867 - DNA, 19 bp, Homo sapiens
cctccccttggaccagcaa

SEQ ID NO: 7022868 - DNA, 22 bp, Homo sapiens
cataagaaatttaacagaactt

SEQ ID NO: 7022869 - DNA, 22 bp, Homo sapiens
aaatagttcagcttgtaaaccc

SEQ ID NO: 7022870 - DNA, 22 bp, Homo sapiens
tccctgcctctcagacttcctt

SEQ ID NO: 7022871 - DNA, 22 bp, Homo sapiens
gccctgtgctcatgggaacatc

SEQ ID NO: 7022872 - DNA, 22 bp, Homo sapiens
gtggtcagaatggagcccagga

SEQ ID NO: 7022873 - DNA, 18 bp, Homo sapiens
agactggcagggaaaggg

SEQ ID NO: 7022874 - DNA, 22 bp, Homo sapiens
acatttctatagtgcatctgtt

SEQ ID NO: 7022875 - DNA, 22 bp, Homo sapiens
aagtttactggggagatcacct

SEQ ID NO: 7022876 - DNA, 22 bp, Homo sapiens
catggatatattgtacagtagc

SEQ ID NO: 7022877 - DNA, 22 bp, Homo sapiens
tatatctggatggactgcagaa

SEQ ID NO: 7022878 - DNA, 21 bp, Homo sapiens
tcaaggctgttgcattaatgc

SEQ ID NO: 7022879 - DNA, 21 bp, Homo sapiens
tggctcgatttatagcatttc

SEQ ID NO: 7022880 - DNA, 22 bp, Homo sapiens
taagtcatagagcggaagacca

SEQ ID NO: 7022881 - DNA, 22 bp, Homo sapiens
tgagctgtgtcctgggggcagt

SEQ ID NO: 7022882 - DNA, 19 bp, Homo sapiens
ccccttaggggttaagcct

SEQ ID NO: 7022883 - DNA, 22 bp, Homo sapiens
agggtccatcaaggactgcaca

SEQ ID NO: 7022884 - DNA, 22 bp, Homo sapiens
ctctggcacactccttccaggt

SEQ ID NO: 7022885 - DNA, 22 bp, Homo sapiens
aatcgcaattacttttgcacca

SEQ ID NO: 7022886 - DNA, 22 bp, Homo sapiens
atggcgaaaactgtaattactt

SEQ ID NO: 7022887 - DNA, 22 bp, Homo sapiens
tatgaaatggtagtaggaaggg

SEQ ID NO: 7022888 - DNA, 23 bp, Homo sapiens
tggttctaggcctataattatat

SEQ ID NO: 7022889 - DNA, 22 bp, Homo sapiens
agtttactctggtgacaattta

SEQ ID NO: 7022890 - DNA, 18 bp, Homo sapiens
ttgagtctagccatggaa

SEQ ID NO: 7022891 - DNA, 22 bp, Homo sapiens
gagtcatgcactgtctttctcc

SEQ ID NO: 7022892 - DNA, 17 bp, Homo sapiens
gtgtgctactatcattt

SEQ ID NO: 7022893 - DNA, 22 bp, Homo sapiens
atgacccagtcaaagggaatgg

SEQ ID NO: 7022894 - DNA, 21 bp, Homo sapiens
tattggccattaaagggaaaa

SEQ ID NO: 7022895 - DNA, 22 bp, Homo sapiens
ctgggagtggtgacagctctcg

SEQ ID NO: 7022896 - DNA, 18 bp, Homo sapiens
tcttggagtaatgatcaa

SEQ ID NO: 7022897 - DNA, 22 bp, Homo sapiens
ggctgtgaacactcttagcatc

SEQ ID NO: 7022898 - DNA, 22 bp, Homo sapiens
attgaactctgcaggagctgcc

SEQ ID NO: 7022899 - DNA, 22 bp, Homo sapiens
tggtcttagctggaaggaggga

SEQ ID NO: 7022900 - DNA, 22 bp, Homo sapiens
gagctgggtctccaccttggca

SEQ ID NO: 7022901 - DNA, 21 bp, Homo sapiens
acagagaaagagcagcctcct

SEQ ID NO: 7022902 - DNA, 22 bp, Homo sapiens
aggcttcttgggcttcattctg

SEQ ID NO: 7022903 - DNA, 22 bp, Homo sapiens
gcagtggtggtgtttcagtgac

SEQ ID NO: 7022904 - DNA, 22 bp, Homo sapiens
aatgcctcttggaagaagactt

SEQ ID NO: 7022905 - DNA, 21 bp, Homo sapiens
tcaacccttgcgtcaccaagc

SEQ ID NO: 7022906 - DNA, 22 bp, Homo sapiens
cagcagccatgtaccacactca

SEQ ID NO: 7022907 - DNA, 22 bp, Homo sapiens
tttgcaaagtgactattatatg

SEQ ID NO: 7022908 - DNA, 22 bp, Homo sapiens
cttttctactaatgagtagcta

SEQ ID NO: 7022909 - DNA, 22 bp, Homo sapiens
aggcacttgaattgatgatgtt

SEQ ID NO: 7022910 - DNA, 21 bp, Homo sapiens
agaaaaaccagcatgttttca

SEQ ID NO: 7022911 - DNA, 22 bp, Homo sapiens
tggcaaagatggttctcaccat

SEQ ID NO: 7022912 - DNA, 19 bp, Homo sapiens
tgtgcctctatagcatgtg

SEQ ID NO: 7022913 - DNA, 23 bp, Homo sapiens
agacatggcaggaatacagcttc

SEQ ID NO: 7022914 - DNA, 22 bp, Homo sapiens
cagggatgagagatggcacaga

SEQ ID NO: 7022915 - DNA, 22 bp, Homo sapiens
ttgggaactctaacattttgca

SEQ ID NO: 7022916 - DNA, 22 bp, Homo sapiens
cctgaggatattcaccagcatg

SEQ ID NO: 7022917 - DNA, 20 bp, Homo sapiens
aggagccattgactgcagca

SEQ ID NO: 7022918 - DNA, 22 bp, Homo sapiens
agcacagcttagcacctggcac

SEQ ID NO: 7022919 - DNA, 22 bp, Homo sapiens
gcctgggttccatgatctccag

SEQ ID NO: 7022920 - DNA, 22 bp, Homo sapiens
ctctgtgtggtatgattgtcat

SEQ ID NO: 7022921 - DNA, 22 bp, Homo sapiens
tcactgcaacctctgccttccg

SEQ ID NO: 7022922 - DNA, 22 bp, Homo sapiens
ttgcattcccagccaagttagt

SEQ ID NO: 7022923 - DNA, 22 bp, Homo sapiens
gtgtcagatagtacaccaaggg

SEQ ID NO: 7022924 - DNA, 22 bp, Homo sapiens
ggagctgaggacactacatttt

SEQ ID NO: 7022925 - DNA, 22 bp, Homo sapiens
caacccaaaagcgtttccattt

SEQ ID NO: 7022926 - DNA, 22 bp, Homo sapiens
tggcatgtattagttggcagtt

SEQ ID NO: 7022927 - DNA, 22 bp, Homo sapiens
acatacatgggattaaaaaatt

SEQ ID NO: 7022928 - DNA, 22 bp, Homo sapiens
aacatatctacggatacgatta

SEQ ID NO: 7022929 - DNA, 19 bp, Homo sapiens
gggcttggggctgaagcct

SEQ ID NO: 7022930 - DNA, 22 bp, Homo sapiens
aagccagtggtgagaagatagc

SEQ ID NO: 7022931 - DNA, 22 bp, Homo sapiens
tcaggtgttctccactcagttt

SEQ ID NO: 7022932 - DNA, 22 bp, Homo sapiens
cttgctcttttcactgtaatat

SEQ ID NO: 7022933 - DNA, 22 bp, Homo sapiens
aggtagctaaaacaggcttttg

SEQ ID NO: 7022934 - DNA, 22 bp, Homo sapiens
gttagaaacgcaggctctccgg

SEQ ID NO: 7022935 - DNA, 22 bp, Homo sapiens
tggtcatgtagtagagacagct

SEQ ID NO: 7022936 - DNA, 21 bp, Homo sapiens
tacactcatcctctcccaagg

SEQ ID NO: 7022937 - DNA, 22 bp, Homo sapiens
tctgcatttttaacaagatccc

SEQ ID NO: 7022938 - DNA, 22 bp, Homo sapiens
ctgccgagtgggtcatgaggca

SEQ ID NO: 7022939 - DNA, 22 bp, Homo sapiens
tacagagaggtgacccttgggc

SEQ ID NO: 7022940 - DNA, 22 bp, Homo sapiens
aactatataatctgaaagtgaa

SEQ ID NO: 7022941 - DNA, 22 bp, Homo sapiens
ggaggccacggtttagcaccga

SEQ ID NO: 7022942 - DNA, 22 bp, Homo sapiens
catgaacaatttgctcactgat

SEQ ID NO: 7022943 - DNA, 22 bp, Homo sapiens
aaacactgtctctggtattgaa

SEQ ID NO: 7022944 - DNA, 22 bp, Homo sapiens
tcaaacttggtaagagaaatac

SEQ ID NO: 7022945 - DNA, 22 bp, Homo sapiens
ttatttcctaaatctctttgtt

SEQ ID NO: 7022946 - DNA, 22 bp, Homo sapiens
tcaggtcccactgctagtaagt

SEQ ID NO: 7022947 - DNA, 22 bp, Homo sapiens
tgttactgagtaatgtatagat

SEQ ID NO: 7022948 - DNA, 22 bp, Homo sapiens
tgatatgttggatctgttggtt

SEQ ID NO: 7022949 - DNA, 22 bp, Homo sapiens
tattgtgatgaacacaaggctt

SEQ ID NO: 7022950 - DNA, 22 bp, Homo sapiens
ggaacatactgtgtagactttg

SEQ ID NO: 7022951 - DNA, 21 bp, Homo sapiens
ctcaggatggcggcctggtgg

SEQ ID NO: 7022952 - DNA, 22 bp, Homo sapiens
aagaggcctggaggcagaggtg

SEQ ID NO: 7022953 - DNA, 22 bp, Homo sapiens
ataaaagtctgcttatttgggc

SEQ ID NO: 7022954 - DNA, 22 bp, Homo sapiens
gtgctgagattacaggtgtgag

SEQ ID NO: 7022955 - DNA, 22 bp, Homo sapiens
ggatgctgggagacagcaggca

SEQ ID NO: 7022956 - DNA, 22 bp, Homo sapiens
ttggaagacaatgctgattctc

SEQ ID NO: 7022957 - DNA, 22 bp, Homo sapiens
aagatcaatgttcattaagatg

SEQ ID NO: 7022958 - DNA, 22 bp, Homo sapiens
gttattgactctcttgtggctt

SEQ ID NO: 7022959 - DNA, 22 bp, Homo sapiens
ggaggccaccatggagtcactt

SEQ ID NO: 7022960 - DNA, 22 bp, Homo sapiens
gagctatttgaatgtatatgtt

SEQ ID NO: 7022961 - DNA, 22 bp, Homo sapiens
cctgtggggagagatctcttag

SEQ ID NO: 7022962 - DNA, 22 bp, Homo sapiens
ctatatgcctgtgcagtctttg

SEQ ID NO: 7022963 - DNA, 22 bp, Homo sapiens
tcaacagctagaaatatagaga

SEQ ID NO: 7022964 - DNA, 22 bp, Homo sapiens
gagctgtccaagatggtcgtaa

SEQ ID NO: 7022965 - DNA, 22 bp, Homo sapiens
agactttgagctcttagagaag

SEQ ID NO: 7022966 - DNA, 22 bp, Homo sapiens
agggcctgacacccttgccagc

SEQ ID NO: 7022967 - DNA, 22 bp, Homo sapiens
cacaggatacattgtctatatc

SEQ ID NO: 7022968 - DNA, 18 bp, Homo sapiens
tccagcttgcacttaaat

SEQ ID NO: 7022969 - DNA, 22 bp, Homo sapiens
aggtgaagttaaaaaccagtct

SEQ ID NO: 7022970 - DNA, 22 bp, Homo sapiens
attccaaagcctgaataatgga

SEQ ID NO: 7022971 - DNA, 22 bp, Homo sapiens
attcctattgccagcatagtat

SEQ ID NO: 7022972 - DNA, 22 bp, Homo sapiens
tatgccagggactgtttcacca

SEQ ID NO: 7022973 - DNA, 22 bp, Homo sapiens
cagggccactgtagatgaggag

SEQ ID NO: 7022974 - DNA, 22 bp, Homo sapiens
aattgcattacagaaactttca

SEQ ID NO: 7022975 - DNA, 22 bp, Homo sapiens
cagcccatttctgggacctgag

SEQ ID NO: 7022976 - DNA, 22 bp, Homo sapiens
gtattgtatttatttatgtgac

SEQ ID NO: 7022977 - DNA, 22 bp, Homo sapiens
tgggttatcagaggaatctttc

SEQ ID NO: 7022978 - DNA, 21 bp, Homo sapiens
tagccctctctgtctgtgtac

SEQ ID NO: 7022979 - DNA, 22 bp, Homo sapiens
gggaagccctgtgcttgcctgg

SEQ ID NO: 7022980 - DNA, 22 bp, Homo sapiens
taagtaactgcataattaaatt

SEQ ID NO: 7022981 - DNA, 22 bp, Homo sapiens
ctatacactttttgaaaataga

SEQ ID NO: 7022982 - DNA, 22 bp, Homo sapiens
attgacaaccctggtatgagca

SEQ ID NO: 7022983 - DNA, 19 bp, Homo sapiens
gcaggtgtgaatccgtaga

SEQ ID NO: 7022984 - DNA, 22 bp, Homo sapiens
ctggtgtctgattctcccctga

SEQ ID NO: 7022985 - DNA, 22 bp, Homo sapiens
ctcctcaaggtctcaggaataa

SEQ ID NO: 7022986 - DNA, 21 bp, Homo sapiens
gatatttatgactcattcctt

SEQ ID NO: 7022987 - DNA, 22 bp, Homo sapiens
ggttagagagctgagaaagttt

SEQ ID NO: 7022988 - DNA, 22 bp, Homo sapiens
aaagttggattagttgcaatag

SEQ ID NO: 7022989 - DNA, 22 bp, Homo sapiens
cttggtctctttaccggagtgt

SEQ ID NO: 7022990 - DNA, 17 bp, Homo sapiens
agggtcaggtgaagttc

SEQ ID NO: 7022991 - DNA, 22 bp, Homo sapiens
tcagagaatgtgaatattaaac

SEQ ID NO: 7022992 - DNA, 22 bp, Homo sapiens
tggcaattggcaatttcgtatg

SEQ ID NO: 7022993 - DNA, 22 bp, Homo sapiens
tgaaacagctatcagtagactg

SEQ ID NO: 7022994 - DNA, 22 bp, Homo sapiens
ccttttggataattctacccca

SEQ ID NO: 7022995 - DNA, 22 bp, Homo sapiens
gagcccaggctggggttcagag

SEQ ID NO: 7022996 - DNA, 23 bp, Homo sapiens
tgcagcagggtggtctacttctc

SEQ ID NO: 7022997 - DNA, 22 bp, Homo sapiens
tcaaagatgataggaaatcata

SEQ ID NO: 7022998 - DNA, 22 bp, Homo sapiens
atagcaattaagctccagaatt

SEQ ID NO: 7022999 - DNA, 22 bp, Homo sapiens
gaggggcaggattattgggatt

SEQ ID NO: 7023000 - DNA, 22 bp, Homo sapiens
gcctcattacagccaggaagca

SEQ ID NO: 7023001 - DNA, 22 bp, Homo sapiens
tggaaatttatcaagatataca

SEQ ID NO: 7023002 - DNA, 22 bp, Homo sapiens
aggtaaagaaaggtgtaacatt

SEQ ID NO: 7023003 - DNA, 22 bp, Homo sapiens
ctctgaatggacactccagtgt

SEQ ID NO: 7023004 - DNA, 22 bp, Homo sapiens
tcccagcctggaccctgccagt

SEQ ID NO: 7023005 - DNA, 22 bp, Homo sapiens
agatggcagcagaacaaacagg

SEQ ID NO: 7023006 - DNA, 22 bp, Homo sapiens
acatagcaagtgctcaataaat

SEQ ID NO: 7023007 - DNA, 17 bp, Homo sapiens
ggcagtggaggaagaga

SEQ ID NO: 7023008 - DNA, 18 bp, Homo sapiens
aaatggcagaatggatag

SEQ ID NO: 7023009 - DNA, 22 bp, Homo sapiens
ttccattggtaaaatgagagtg

SEQ ID NO: 7023010 - DNA, 22 bp, Homo sapiens
attaagtgactaaagtaatgct

SEQ ID NO: 7023011 - DNA, 22 bp, Homo sapiens
aattcagcaaaaagatacagga

SEQ ID NO: 7023012 - DNA, 23 bp, Homo sapiens
tgagttctaggcttaaaactagc

SEQ ID NO: 7023013 - DNA, 22 bp, Homo sapiens
tatccccctttctcaggaagct

SEQ ID NO: 7023014 - DNA, 22 bp, Homo sapiens
agacatctacctttcattcaaa

SEQ ID NO: 7023015 - DNA, 22 bp, Homo sapiens
atgagtgatgggtacattggct

SEQ ID NO: 7023016 - DNA, 22 bp, Homo sapiens
caaactgagcatcagaaagttt

SEQ ID NO: 7023017 - DNA, 22 bp, Homo sapiens
gtctggctttcatggctctgca

SEQ ID NO: 7023018 - DNA, 22 bp, Homo sapiens
tgcatgcatgctactgggaggt

SEQ ID NO: 7023019 - DNA, 22 bp, Homo sapiens
tttggaagggaaccaaaacatg

SEQ ID NO: 7023020 - DNA, 22 bp, Homo sapiens
aacgtgcaccaggaggtcatga

SEQ ID NO: 7023021 - DNA, 17 bp, Homo sapiens
taagtcctagttatttt

SEQ ID NO: 7023022 - DNA, 22 bp, Homo sapiens
acagtggatatattaaatgaga

SEQ ID NO: 7023023 - DNA, 22 bp, Homo sapiens
ttttagatagtttaactgcact

SEQ ID NO: 7023024 - DNA, 22 bp, Homo sapiens
tcattccttaacattcatttgc

SEQ ID NO: 7023025 - DNA, 19 bp, Homo sapiens
tgccagcattaggctgaag

SEQ ID NO: 7023026 - DNA, 18 bp, Homo sapiens
tacagtattttctcgcct

SEQ ID NO: 7023027 - DNA, 22 bp, Homo sapiens
gcaaagcacactggagatgtcg

SEQ ID NO: 7023028 - DNA, 22 bp, Homo sapiens
agactgcatattgtcctttaga

SEQ ID NO: 7023029 - DNA, 22 bp, Homo sapiens
tagactggtgaattagggggaa

SEQ ID NO: 7023030 - DNA, 22 bp, Homo sapiens
tacattctactttttcactccc

SEQ ID NO: 7023031 - DNA, 22 bp, Homo sapiens
tcctttggttgtagacaggaat

SEQ ID NO: 7023032 - DNA, 22 bp, Homo sapiens
caccaggaagtattcaaagggt

SEQ ID NO: 7023033 - DNA, 22 bp, Homo sapiens
gctggggaggcagcagagaaca

SEQ ID NO: 7023034 - DNA, 20 bp, Homo sapiens
tagtgcaaaggcagccatag

SEQ ID NO: 7023035 - DNA, 22 bp, Homo sapiens
attgaagggcattagtcatcag

SEQ ID NO: 7023036 - DNA, 17 bp, Homo sapiens
tggaaggcttcaatatt

SEQ ID NO: 7023037 - DNA, 22 bp, Homo sapiens
tggctgcaagggcacggaccct

SEQ ID NO: 7023038 - DNA, 21 bp, Homo sapiens
caatggcgagatcttggctca

SEQ ID NO: 7023039 - DNA, 22 bp, Homo sapiens
aagaaatggaagatccatggtg

SEQ ID NO: 7023040 - DNA, 22 bp, Homo sapiens
agacaatggctaagtaacctgt

SEQ ID NO: 7023041 - DNA, 21 bp, Homo sapiens
caaaagagactgattcttgga

SEQ ID NO: 7023042 - DNA, 22 bp, Homo sapiens
ctgtggtcaggggttagacagg

SEQ ID NO: 7023043 - DNA, 22 bp, Homo sapiens
agctgggcagtgcttggattca

SEQ ID NO: 7023044 - DNA, 22 bp, Homo sapiens
gctcagtttttagtttgtgaga

SEQ ID NO: 7023045 - DNA, 22 bp, Homo sapiens
atatgcagagagcatgaatagg

SEQ ID NO: 7023046 - DNA, 22 bp, Homo sapiens
tgagggtgtgcggcccagacag

SEQ ID NO: 7023047 - DNA, 23 bp, Homo sapiens
aggctgagctctcccagcttcag

SEQ ID NO: 7023048 - DNA, 22 bp, Homo sapiens
atagagctctttatgcatgggc

SEQ ID NO: 7023049 - DNA, 19 bp, Homo sapiens
tcacttgtgccaggcactg

SEQ ID NO: 7023050 - DNA, 22 bp, Homo sapiens
ccatgcaatttctgtaaaacca

SEQ ID NO: 7023051 - DNA, 22 bp, Homo sapiens
gcctggagtggacttggcccct

SEQ ID NO: 7023052 - DNA, 22 bp, Homo sapiens
agtgtggattggctggagctat

SEQ ID NO: 7023053 - DNA, 22 bp, Homo sapiens
tgtgttctcctacagataagga

SEQ ID NO: 7023054 - DNA, 22 bp, Homo sapiens
ggtctggaatggagtaggggtg

SEQ ID NO: 7023055 - DNA, 22 bp, Homo sapiens
agaagccagaggcagtgggtac

SEQ ID NO: 7023056 - DNA, 22 bp, Homo sapiens
gaaggaaatctgtgatttatgc

SEQ ID NO: 7023057 - DNA, 22 bp, Homo sapiens
gggctccaaccccagtgaactc

SEQ ID NO: 7023058 - DNA, 22 bp, Homo sapiens
aggatgtctgctgctgtgggct

SEQ ID NO: 7023059 - DNA, 22 bp, Homo sapiens
cttagtttctctgtatgtttac

SEQ ID NO: 7023060 - DNA, 22 bp, Homo sapiens
tgttttcatttgatgtaacaaa

SEQ ID NO: 7023061 - DNA, 22 bp, Homo sapiens
tattgcatattgtacttgaatg

SEQ ID NO: 7023062 - DNA, 22 bp, Homo sapiens
tggaatctgtgctgttttagtg

SEQ ID NO: 7023063 - DNA, 22 bp, Homo sapiens
catggtttgatgactggaagga

SEQ ID NO: 7023064 - DNA, 22 bp, Homo sapiens
caactacatccacactttgtta

SEQ ID NO: 7023065 - DNA, 22 bp, Homo sapiens
aagacataaaacagtcagcgaa

SEQ ID NO: 7023066 - DNA, 22 bp, Homo sapiens
ccagggggcttggtgaggccat

SEQ ID NO: 7023067 - DNA, 22 bp, Homo sapiens
ctggtgtccgcaacgggcagcg

SEQ ID NO: 7023068 - DNA, 22 bp, Homo sapiens
agcaacatatatcaatgcctga

SEQ ID NO: 7023069 - DNA, 22 bp, Homo sapiens
aacatctgatcgaacagtgcca

SEQ ID NO: 7023070 - DNA, 22 bp, Homo sapiens
aacactttttagtaaagattga

SEQ ID NO: 7023071 - DNA, 22 bp, Homo sapiens
gctttggacaataactgctttt

SEQ ID NO: 7023072 - DNA, 22 bp, Homo sapiens
ggaaggaattccaagactaaag

SEQ ID NO: 7023073 - DNA, 22 bp, Homo sapiens
cattcccatgactcctgctcag

SEQ ID NO: 7023074 - DNA, 22 bp, Homo sapiens
agacaagtaggaatggttgaag

SEQ ID NO: 7023075 - DNA, 18 bp, Homo sapiens
ccctcttgcacaaagcaa

SEQ ID NO: 7023076 - DNA, 22 bp, Homo sapiens
tgaggccttttctgtctggcta

SEQ ID NO: 7023077 - DNA, 22 bp, Homo sapiens
aattgctttagttaccatagtg

SEQ ID NO: 7023078 - DNA, 22 bp, Homo sapiens
aatcacatcactgagaatgagg

SEQ ID NO: 7023079 - DNA, 22 bp, Homo sapiens
gctgagactggcagcaggaagt

SEQ ID NO: 7023080 - DNA, 22 bp, Homo sapiens
ttcctcaggcttccctttgtcc

SEQ ID NO: 7023081 - DNA, 22 bp, Homo sapiens
ttagccataattgtttttccca

SEQ ID NO: 7023082 - DNA, 22 bp, Homo sapiens
gtgttacttacctgggacagca

SEQ ID NO: 7023083 - DNA, 20 bp, Homo sapiens
atcatctttacaatgtcagt

SEQ ID NO: 7023084 - DNA, 22 bp, Homo sapiens
agcgctatattcactgctgatt

SEQ ID NO: 7023085 - DNA, 22 bp, Homo sapiens
aaagcactcgttagtatttctg

SEQ ID NO: 7023086 - DNA, 21 bp, Homo sapiens
acaaaggaagtctcttttaag

SEQ ID NO: 7023087 - DNA, 22 bp, Homo sapiens
tcagaggagggactcagaccca

SEQ ID NO: 7023088 - DNA, 22 bp, Homo sapiens
ttgaccctggtgtcagagatgg

SEQ ID NO: 7023089 - DNA, 22 bp, Homo sapiens
atgttaccatcttttatctaca

SEQ ID NO: 7023090 - DNA, 22 bp, Homo sapiens
ctgtttattacactggatagca

SEQ ID NO: 7023091 - DNA, 22 bp, Homo sapiens
tgctgcaggaacttaagaagct

SEQ ID NO: 7023092 - DNA, 22 bp, Homo sapiens
tccagtttcatagctaaggaac

SEQ ID NO: 7023093 - DNA, 22 bp, Homo sapiens
actcagacgaaaacatgaacat

SEQ ID NO: 7023094 - DNA, 22 bp, Homo sapiens
gcctggaggcgagaacccaatg

SEQ ID NO: 7023095 - DNA, 22 bp, Homo sapiens
tcttgagaaataattaaacatg

SEQ ID NO: 7023096 - DNA, 22 bp, Homo sapiens
caggcccaggtgtcgatgttcc

SEQ ID NO: 7023097 - DNA, 22 bp, Homo sapiens
aacttcaaatgtgactttgcat

SEQ ID NO: 7023098 - DNA, 22 bp, Homo sapiens
catttgtgtgggaacccatcag

SEQ ID NO: 7023099 - DNA, 21 bp, Homo sapiens
tgtgtgggcatatctgctgca

SEQ ID NO: 7023100 - DNA, 22 bp, Homo sapiens
tgctttctgctctggaaacagg

SEQ ID NO: 7023101 - DNA, 23 bp, Homo sapiens
tgcttctctgcttgacagttctg

SEQ ID NO: 7023102 - DNA, 22 bp, Homo sapiens
gtgctaatgaattggagtgcct

SEQ ID NO: 7023103 - DNA, 22 bp, Homo sapiens
cttcagttagagtttacaaagt

SEQ ID NO: 7023104 - DNA, 22 bp, Homo sapiens
actactttgggccatttgttta

SEQ ID NO: 7023105 - DNA, 22 bp, Homo sapiens
acgagtatgtttgtattttctt

SEQ ID NO: 7023106 - DNA, 22 bp, Homo sapiens
gaagtgatcttccagaagaata

SEQ ID NO: 7023107 - DNA, 22 bp, Homo sapiens
gagagcatgtggtctagtttta

SEQ ID NO: 7023108 - DNA, 22 bp, Homo sapiens
aaactccagtgaatactagaat

SEQ ID NO: 7023109 - DNA, 22 bp, Homo sapiens
gcctgtctacactttctctgca

SEQ ID NO: 7023110 - DNA, 22 bp, Homo sapiens
cctggtggaaggtgagtgaggc

SEQ ID NO: 7023111 - DNA, 22 bp, Homo sapiens
gatcagagagttagaaatgtca

SEQ ID NO: 7023112 - DNA, 22 bp, Homo sapiens
agtgctctcatgctgactatta

SEQ ID NO: 7023113 - DNA, 22 bp, Homo sapiens
gagtgtctgaattagagcacaa

SEQ ID NO: 7023114 - DNA, 22 bp, Homo sapiens
accaaaggcagagctgaacact

SEQ ID NO: 7023115 - DNA, 18 bp, Homo sapiens
cctggcacactggctcat

SEQ ID NO: 7023116 - DNA, 22 bp, Homo sapiens
actccctgcaagattttccatg

SEQ ID NO: 7023117 - DNA, 22 bp, Homo sapiens
atgatgttgataaattacttta

SEQ ID NO: 7023118 - DNA, 22 bp, Homo sapiens
tgaaggcagtgagtttgtgttt

SEQ ID NO: 7023119 - DNA, 22 bp, Homo sapiens
attaagtgttttacatacatta

SEQ ID NO: 7023120 - DNA, 22 bp, Homo sapiens
ttgcttttgtgtgctctctgga

SEQ ID NO: 7023121 - DNA, 22 bp, Homo sapiens
ctggtagcagtgaagctgttga

SEQ ID NO: 7023122 - DNA, 22 bp, Homo sapiens
cagtgctatttggacacaggga

SEQ ID NO: 7023123 - DNA, 22 bp, Homo sapiens
aaacattccatttctatgtaag

SEQ ID NO: 7023124 - DNA, 22 bp, Homo sapiens
aacagaatatcaaaagattatg

SEQ ID NO: 7023125 - DNA, 22 bp, Homo sapiens
agagtgctcagatgcatgtctt

SEQ ID NO: 7023126 - DNA, 18 bp, Homo sapiens
gcagatgagtagtgtacc

SEQ ID NO: 7023127 - DNA, 20 bp, Homo sapiens
tgcgtgtgtatttattttct

SEQ ID NO: 7023128 - DNA, 22 bp, Homo sapiens
gtctttctgccatgtgaagaga

SEQ ID NO: 7023129 - DNA, 17 bp, Homo sapiens
agactgtactgtaaagc

SEQ ID NO: 7023130 - DNA, 22 bp, Homo sapiens
ctgaggagatgggctttttagg

SEQ ID NO: 7023131 - DNA, 22 bp, Homo sapiens
gcctggctgaggtggggaggca

SEQ ID NO: 7023132 - DNA, 19 bp, Homo sapiens
gcaggactcccagctcctc

SEQ ID NO: 7023133 - DNA, 22 bp, Homo sapiens
ctgccaggcctccgctgtcccc

SEQ ID NO: 7023134 - DNA, 22 bp, Homo sapiens
ttctcaaagaaagctgtcatta

SEQ ID NO: 7023135 - DNA, 17 bp, Homo sapiens
catgtatttgaaacaga

SEQ ID NO: 7023136 - DNA, 22 bp, Homo sapiens
tcacatttctcagcactgatga

SEQ ID NO: 7023137 - DNA, 22 bp, Homo sapiens
taacatctccctgacttttgct

SEQ ID NO: 7023138 - DNA, 22 bp, Homo sapiens
gaccctgactctaatgcttggc

SEQ ID NO: 7023139 - DNA, 22 bp, Homo sapiens
ccttttctagaaagggaggcaa

SEQ ID NO: 7023140 - DNA, 22 bp, Homo sapiens
ggtagcatctttggatgttatt

SEQ ID NO: 7023141 - DNA, 22 bp, Homo sapiens
agccagtccatcactaatgggt

SEQ ID NO: 7023142 - DNA, 22 bp, Homo sapiens
gatgaagaggcactgacatatt

SEQ ID NO: 7023143 - DNA, 22 bp, Homo sapiens
tggcatggactagtgctgaggt

SEQ ID NO: 7023144 - DNA, 22 bp, Homo sapiens
aatatatgtggtattgaccagc

SEQ ID NO: 7023145 - DNA, 22 bp, Homo sapiens
tgaggacattggtcaggacatg

SEQ ID NO: 7023146 - DNA, 22 bp, Homo sapiens
tgtttttatctctgtgtacaac

SEQ ID NO: 7023147 - DNA, 20 bp, Homo sapiens
gctgaggtccctgtggtttt

SEQ ID NO: 7023148 - DNA, 22 bp, Homo sapiens
tggagtcagctagacctgtgtt

SEQ ID NO: 7023149 - DNA, 22 bp, Homo sapiens
tcataaacaaaacagtttatgc

SEQ ID NO: 7023150 - DNA, 22 bp, Homo sapiens
gcaaatccttctgcgaccaggt

SEQ ID NO: 7023151 - DNA, 19 bp, Homo sapiens
tacatccgggttacttaag

SEQ ID NO: 7023152 - DNA, 22 bp, Homo sapiens
tgaataaactatgaggaggaat

SEQ ID NO: 7023153 - DNA, 22 bp, Homo sapiens
cagagaataaaagggcattcct

SEQ ID NO: 7023154 - DNA, 23 bp, Homo sapiens
cagcaggagggtgcctgggctgc

SEQ ID NO: 7023155 - DNA, 22 bp, Homo sapiens
tacaagtccgtaaagggcagat

SEQ ID NO: 7023156 - DNA, 22 bp, Homo sapiens
ttggattctttctaggctgtga

SEQ ID NO: 7023157 - DNA, 20 bp, Homo sapiens
tgtatttaatgaaggctttt

SEQ ID NO: 7023158 - DNA, 22 bp, Homo sapiens
ttcatctgcttcttcctattcc

SEQ ID NO: 7023159 - DNA, 22 bp, Homo sapiens
tggtggacgatgcccagctgga

SEQ ID NO: 7023160 - DNA, 22 bp, Homo sapiens
gagcttaaatggctaaatataa

SEQ ID NO: 7023161 - DNA, 22 bp, Homo sapiens
aagtaaacttacacatagtaaa

SEQ ID NO: 7023162 - DNA, 22 bp, Homo sapiens
acctgcctatcagctgcctgct

SEQ ID NO: 7023163 - DNA, 20 bp, Homo sapiens
atggttcaggccagctgtct

SEQ ID NO: 7023164 - DNA, 22 bp, Homo sapiens
agcacagagctcggggaatgga

SEQ ID NO: 7023165 - DNA, 22 bp, Homo sapiens
tgagaaagtgggtgcctagcaa

SEQ ID NO: 7023166 - DNA, 22 bp, Homo sapiens
aaacacattagccctgtggaaa

SEQ ID NO: 7023167 - DNA, 22 bp, Homo sapiens
acattaacaccgtgagtttggt

SEQ ID NO: 7023168 - DNA, 22 bp, Homo sapiens
tccctagtcgcatctgtggaga

SEQ ID NO: 7023169 - DNA, 22 bp, Homo sapiens
cctgaaacagtccttgccctca

SEQ ID NO: 7023170 - DNA, 22 bp, Homo sapiens
agaggaatgtatttccctgcaa

SEQ ID NO: 7023171 - DNA, 22 bp, Homo sapiens
tgtcctggtgcttcttgggatt

SEQ ID NO: 7023172 - DNA, 22 bp, Homo sapiens
aggaatagaccacttcactgag

SEQ ID NO: 7023173 - DNA, 22 bp, Homo sapiens
aacaggctaaattgtccatttc

SEQ ID NO: 7023174 - DNA, 19 bp, Homo sapiens
tgtctacataatagattga

SEQ ID NO: 7023175 - DNA, 22 bp, Homo sapiens
gcagggggtcattcacgctggc

SEQ ID NO: 7023176 - DNA, 22 bp, Homo sapiens
cagaacaggtcatgcttgctgt

SEQ ID NO: 7023177 - DNA, 17 bp, Homo sapiens
tttcatctgggaccacc

SEQ ID NO: 7023178 - DNA, 22 bp, Homo sapiens
ttgtgtactgttggttgatatt

SEQ ID NO: 7023179 - DNA, 18 bp, Homo sapiens
tggcagggaggaaatata

SEQ ID NO: 7023180 - DNA, 22 bp, Homo sapiens
aggtcagcatgagtagaaggta

SEQ ID NO: 7023181 - DNA, 22 bp, Homo sapiens
ttatcctggtggcccctaaatc

SEQ ID NO: 7023182 - DNA, 22 bp, Homo sapiens
agtccaccacccatgctcctct

SEQ ID NO: 7023183 - DNA, 22 bp, Homo sapiens
tctgtcttagccatctcaggct

SEQ ID NO: 7023184 - DNA, 22 bp, Homo sapiens
acagcttgaatcttaagctctt

SEQ ID NO: 7023185 - DNA, 22 bp, Homo sapiens
attcagttaaaaactgtacttc

SEQ ID NO: 7023186 - DNA, 22 bp, Homo sapiens
aggttccttatggggatggcta

SEQ ID NO: 7023187 - DNA, 22 bp, Homo sapiens
aaggcggggggatcacgaggtc

SEQ ID NO: 7023188 - DNA, 22 bp, Homo sapiens
cacacatttcagatgctacaat

SEQ ID NO: 7023189 - DNA, 22 bp, Homo sapiens
attcagcaagctatgggacagg

SEQ ID NO: 7023190 - DNA, 22 bp, Homo sapiens
ggcctggagcagagactaggga

SEQ ID NO: 7023191 - DNA, 22 bp, Homo sapiens
aatagcacctgaggtagtttgt

SEQ ID NO: 7023192 - DNA, 22 bp, Homo sapiens
gagaacatgtttagtgacagtc

SEQ ID NO: 7023193 - DNA, 22 bp, Homo sapiens
ctgagtgatagcgatggggaac

SEQ ID NO: 7023194 - DNA, 18 bp, Homo sapiens
gggtatccagaactggtc

SEQ ID NO: 7023195 - DNA, 22 bp, Homo sapiens
aaggccagcctgagagctaaca

SEQ ID NO: 7023196 - DNA, 22 bp, Homo sapiens
cagtttaagtagaactgagaat

SEQ ID NO: 7023197 - DNA, 22 bp, Homo sapiens
gcaggagttaaaatatgtaatg

SEQ ID NO: 7023198 - DNA, 22 bp, Homo sapiens
tgacaagagcattcccacacct

SEQ ID NO: 7023199 - DNA, 22 bp, Homo sapiens
tctaaacattgtgatagacctt

SEQ ID NO: 7023200 - DNA, 22 bp, Homo sapiens
acaggagcaacagactaagaca

SEQ ID NO: 7023201 - DNA, 22 bp, Homo sapiens
tgtcattttcagcttatgcttc

SEQ ID NO: 7023202 - DNA, 22 bp, Homo sapiens
atggtggaagagcatcagaaag

SEQ ID NO: 7023203 - DNA, 22 bp, Homo sapiens
agtccttgaattaatttgactc

SEQ ID NO: 7023204 - DNA, 22 bp, Homo sapiens
ttacaactgggcttgtcagctt

SEQ ID NO: 7023205 - DNA, 22 bp, Homo sapiens
agctggtgctcggggagctggc

SEQ ID NO: 7023206 - DNA, 22 bp, Homo sapiens
atttccatacacccatttctga

SEQ ID NO: 7023207 - DNA, 22 bp, Homo sapiens
atttctcagggtccaggtccca

SEQ ID NO: 7023208 - DNA, 22 bp, Homo sapiens
gcagagtgaagcagtatggaaa

SEQ ID NO: 7023209 - DNA, 19 bp, Homo sapiens
agccagcagcgtagcatct

SEQ ID NO: 7023210 - DNA, 22 bp, Homo sapiens
aggtggctctgacagctctggt

SEQ ID NO: 7023211 - DNA, 22 bp, Homo sapiens
ggtcagcagccatgccatgaat

SEQ ID NO: 7023212 - DNA, 20 bp, Homo sapiens
tcaagatgaggtcatactgg

SEQ ID NO: 7023213 - DNA, 22 bp, Homo sapiens
ccaggagtgcagggatggtatc

SEQ ID NO: 7023214 - DNA, 21 bp, Homo sapiens
aatgtataacagagcccatca

SEQ ID NO: 7023215 - DNA, 22 bp, Homo sapiens
ctactgtaatagatgaatttga

SEQ ID NO: 7023216 - DNA, 22 bp, Homo sapiens
agcatattgtctttggtgtctc

SEQ ID NO: 7023217 - DNA, 22 bp, Homo sapiens
gggggctcctcccagctgccag

SEQ ID NO: 7023218 - DNA, 19 bp, Homo sapiens
tgctgcttccagctcactc

SEQ ID NO: 7023219 - DNA, 22 bp, Homo sapiens
tcccagagacagagcctcctcc

SEQ ID NO: 7023220 - DNA, 22 bp, Homo sapiens
taagatgtacaaccacttctct

SEQ ID NO: 7023221 - DNA, 22 bp, Homo sapiens
tacaaggttgtactttctctct

SEQ ID NO: 7023222 - DNA, 22 bp, Homo sapiens
ttccaagtgaaagtagctttgt

SEQ ID NO: 7023223 - DNA, 22 bp, Homo sapiens
tcatgacattcaggtgctacat

SEQ ID NO: 7023224 - DNA, 22 bp, Homo sapiens
ggctttattatgtggccatgtg

SEQ ID NO: 7023225 - DNA, 22 bp, Homo sapiens
attgtcagtgggatttgtcaac

SEQ ID NO: 7023226 - DNA, 22 bp, Homo sapiens
actggaaaaccactgaaatgag

SEQ ID NO: 7023227 - DNA, 22 bp, Homo sapiens
gaaatggtagagtaggaagatt

SEQ ID NO: 7023228 - DNA, 22 bp, Homo sapiens
agagaagggggaaagatctcac

SEQ ID NO: 7023229 - DNA, 22 bp, Homo sapiens
ctctgctgcttgccagtcattg

SEQ ID NO: 7023230 - DNA, 22 bp, Homo sapiens
ctccagtgctcatgccgttgac

SEQ ID NO: 7023231 - DNA, 22 bp, Homo sapiens
taggcagaattgttgaatgaag

SEQ ID NO: 7023232 - DNA, 22 bp, Homo sapiens
caggaaaggtagtcacaatgta

SEQ ID NO: 7023233 - DNA, 17 bp, Homo sapiens
aatgaatgaattctttg

SEQ ID NO: 7023234 - DNA, 22 bp, Homo sapiens
ctgaggagccccctctcagcat

SEQ ID NO: 7023235 - DNA, 22 bp, Homo sapiens
atacctgcatagataggtagtt

SEQ ID NO: 7023236 - DNA, 22 bp, Homo sapiens
accaggaaaaacactgtgttgg

SEQ ID NO: 7023237 - DNA, 20 bp, Homo sapiens
tatttctgggcaaccattta

SEQ ID NO: 7023238 - DNA, 22 bp, Homo sapiens
ggctgccacatgccatgtcctc

SEQ ID NO: 7023239 - DNA, 22 bp, Homo sapiens
gagggaatggtgtgcaagaggt

SEQ ID NO: 7023240 - DNA, 22 bp, Homo sapiens
catccaatgtcctattaagact

SEQ ID NO: 7023241 - DNA, 22 bp, Homo sapiens
cctgaggtttttggatagttgt

SEQ ID NO: 7023242 - DNA, 22 bp, Homo sapiens
ttttcagtaatgtctacataat

SEQ ID NO: 7023243 - DNA, 22 bp, Homo sapiens
ttctgaaaacacactttgcagc

SEQ ID NO: 7023244 - DNA, 22 bp, Homo sapiens
gcggggctttgccatgctgttt

SEQ ID NO: 7023245 - DNA, 22 bp, Homo sapiens
ttgaggagtggcgctggactta

SEQ ID NO: 7023246 - DNA, 23 bp, Homo sapiens
agactgaggctgccagggtcaga

SEQ ID NO: 7023247 - DNA, 22 bp, Homo sapiens
atgtctttcttgtgtcccaaga

SEQ ID NO: 7023248 - DNA, 22 bp, Homo sapiens
tgaaatatttagagagtaagtt

SEQ ID NO: 7023249 - DNA, 22 bp, Homo sapiens
acagggctcctaggtggtgtgc

SEQ ID NO: 7023250 - DNA, 22 bp, Homo sapiens
tcatggggctcttcaagtggag

SEQ ID NO: 7023251 - DNA, 22 bp, Homo sapiens
tggacaacatagtgagacctca

SEQ ID NO: 7023252 - DNA, 18 bp, Homo sapiens
tcagcttccagcatgttt

SEQ ID NO: 7023253 - DNA, 22 bp, Homo sapiens
gagctgtgaaaagtgcctgggg

SEQ ID NO: 7023254 - DNA, 22 bp, Homo sapiens
acagtaattaaaatggatctgc

SEQ ID NO: 7023255 - DNA, 22 bp, Homo sapiens
actaattgaaatgtcctggcca

SEQ ID NO: 7023256 - DNA, 22 bp, Homo sapiens
gatgtttatgctgggacaggaa

SEQ ID NO: 7023257 - DNA, 22 bp, Homo sapiens
tgtgctgtcagtatcaagggat

SEQ ID NO: 7023258 - DNA, 22 bp, Homo sapiens
ggctctgagtttagaagggtgg

SEQ ID NO: 7023259 - DNA, 22 bp, Homo sapiens
gcatttggaaaatgtttggctt

SEQ ID NO: 7023260 - DNA, 22 bp, Homo sapiens
tagaggctcttcattgcagtag

SEQ ID NO: 7023261 - DNA, 22 bp, Homo sapiens
ctcgtgggggagccaaagaaga

SEQ ID NO: 7023262 - DNA, 22 bp, Homo sapiens
ataaaacttgggtatgatccct

SEQ ID NO: 7023263 - DNA, 22 bp, Homo sapiens
ctgaaaaacgggatttggctgg

SEQ ID NO: 7023264 - DNA, 22 bp, Homo sapiens
gagtaacaaatacttcagtagt

SEQ ID NO: 7023265 - DNA, 22 bp, Homo sapiens
ctggattctcatcagagccaga

SEQ ID NO: 7023266 - DNA, 22 bp, Homo sapiens
tagcaaagctccgtagttattt

SEQ ID NO: 7023267 - DNA, 22 bp, Homo sapiens
actatactgtctcttatagata

SEQ ID NO: 7023268 - DNA, 22 bp, Homo sapiens
tggctagataactagaatttca

SEQ ID NO: 7023269 - DNA, 22 bp, Homo sapiens
aacatgaaagttgctaagtgca

SEQ ID NO: 7023270 - DNA, 22 bp, Homo sapiens
gctcagggctaaggctgagggg

SEQ ID NO: 7023271 - DNA, 22 bp, Homo sapiens
tgcttaaaaagtaactgctgat

SEQ ID NO: 7023272 - DNA, 22 bp, Homo sapiens
agaactgtgaagtatgtgaaat

SEQ ID NO: 7023273 - DNA, 22 bp, Homo sapiens
aggtgcctgggagctccctgag

SEQ ID NO: 7023274 - DNA, 22 bp, Homo sapiens
tcctggatttagaagagcctcc

SEQ ID NO: 7023275 - DNA, 23 bp, Homo sapiens
acctaattgaaaatgatgtcata

SEQ ID NO: 7023276 - DNA, 22 bp, Homo sapiens
acatttctccttgcaggagtca

SEQ ID NO: 7023277 - DNA, 20 bp, Homo sapiens
tgtcccctagatcccagctc

SEQ ID NO: 7023278 - DNA, 22 bp, Homo sapiens
tcagcagttttatatgcagctt

SEQ ID NO: 7023279 - DNA, 22 bp, Homo sapiens
ggaacagggatttggcctggtt

SEQ ID NO: 7023280 - DNA, 22 bp, Homo sapiens
gcattctttagactgagagata

SEQ ID NO: 7023281 - DNA, 22 bp, Homo sapiens
cctgtaggcgagggatggacag

SEQ ID NO: 7023282 - DNA, 22 bp, Homo sapiens
acactggtaggaagagatggct

SEQ ID NO: 7023283 - DNA, 16 bp, Homo sapiens
ttgccgcacaggtcgc

SEQ ID NO: 7023284 - DNA, 22 bp, Homo sapiens
ataggtttgggaattaggcaga

SEQ ID NO: 7023285 - DNA, 22 bp, Homo sapiens
agagtattttgattatcctgga

SEQ ID NO: 7023286 - DNA, 22 bp, Homo sapiens
caagaacattgtgatcacttca

SEQ ID NO: 7023287 - DNA, 22 bp, Homo sapiens
caaggtcagcgtgaagttctgt

SEQ ID NO: 7023288 - DNA, 22 bp, Homo sapiens
atgcacaacagtggctgccttg

SEQ ID NO: 7023289 - DNA, 21 bp, Homo sapiens
gggacaccaactccagggctt

SEQ ID NO: 7023290 - DNA, 22 bp, Homo sapiens
tcacaggagaatgtacttacca

SEQ ID NO: 7023291 - DNA, 22 bp, Homo sapiens
cttaagattgtcagcttcagcc

SEQ ID NO: 7023292 - DNA, 22 bp, Homo sapiens
aacagcctgagagaacaatgat

SEQ ID NO: 7023293 - DNA, 23 bp, Homo sapiens
aggcatggcatggatggtggctc

SEQ ID NO: 7023294 - DNA, 22 bp, Homo sapiens
tgctttcactgatgtatcattt

SEQ ID NO: 7023295 - DNA, 22 bp, Homo sapiens
tggaatgtaaagggtatgggat

SEQ ID NO: 7023296 - DNA, 22 bp, Homo sapiens
aggcagatggtaactgtgatat

SEQ ID NO: 7023297 - DNA, 22 bp, Homo sapiens
cagtcagggacaccagctagga

SEQ ID NO: 7023298 - DNA, 22 bp, Homo sapiens
tcaggccaaggtagacatgact

SEQ ID NO: 7023299 - DNA, 22 bp, Homo sapiens
gtggcagagccaaggctggagc

SEQ ID NO: 7023300 - DNA, 22 bp, Homo sapiens
cttgtctgctataaaaatccag

SEQ ID NO: 7023301 - DNA, 22 bp, Homo sapiens
catagattcttatttccatctt

SEQ ID NO: 7023302 - DNA, 22 bp, Homo sapiens
ggcggtggcgtgaaggtggctg

SEQ ID NO: 7023303 - DNA, 22 bp, Homo sapiens
cactgcaagctccacctcccgg

SEQ ID NO: 7023304 - DNA, 22 bp, Homo sapiens
tgaggctcttcctcccctgctc

SEQ ID NO: 7023305 - DNA, 22 bp, Homo sapiens
tgtgtgaagtgattttaagtct

SEQ ID NO: 7023306 - DNA, 22 bp, Homo sapiens
tcccaaacatttttggccttga

SEQ ID NO: 7023307 - DNA, 22 bp, Homo sapiens
tttctctctggccctgattgtc

SEQ ID NO: 7023308 - DNA, 22 bp, Homo sapiens
acctttcacctcccatcctgtt

SEQ ID NO: 7023309 - DNA, 19 bp, Homo sapiens
acagggaatttccacagaa

SEQ ID NO: 7023310 - DNA, 22 bp, Homo sapiens
ttgacagttgagggttgtctaa

SEQ ID NO: 7023311 - DNA, 22 bp, Homo sapiens
tctttgatttaaaacagtcaaa

SEQ ID NO: 7023312 - DNA, 22 bp, Homo sapiens
ccttcaatcagcagtctagctt

SEQ ID NO: 7023313 - DNA, 21 bp, Homo sapiens
gccagcctgtttacctgtggt

SEQ ID NO: 7023314 - DNA, 22 bp, Homo sapiens
tgtgcatgtctgggcctgtaag

SEQ ID NO: 7023315 - DNA, 22 bp, Homo sapiens
agcccccacgtttcctgggtcc

SEQ ID NO: 7023316 - DNA, 22 bp, Homo sapiens
acagtgcaaacttttgtctcct

SEQ ID NO: 7023317 - DNA, 22 bp, Homo sapiens
gctgaagggagtgctgagtctg

SEQ ID NO: 7023318 - DNA, 22 bp, Homo sapiens
tgacacagggaaagcggatcca

SEQ ID NO: 7023319 - DNA, 22 bp, Homo sapiens
ggccagagtctatatgcagaca

SEQ ID NO: 7023320 - DNA, 22 bp, Homo sapiens
aagctttatgatctctcagcta

SEQ ID NO: 7023321 - DNA, 22 bp, Homo sapiens
ctgaccttcgggcgggctgcgg

SEQ ID NO: 7023322 - DNA, 21 bp, Homo sapiens
ggcagctcagcagatggggac

SEQ ID NO: 7023323 - DNA, 22 bp, Homo sapiens
cccgggttgtccgcgcgtccgg

SEQ ID NO: 7023324 - DNA, 22 bp, Homo sapiens
actgtgagtttatttatctgat

SEQ ID NO: 7023325 - DNA, 22 bp, Homo sapiens
catgcagtctggagccttctgt

SEQ ID NO: 7023326 - DNA, 23 bp, Homo sapiens
tccaagggctacaaacacagacc

SEQ ID NO: 7023327 - DNA, 22 bp, Homo sapiens
ctgtgaaatgctttgcgatggt

SEQ ID NO: 7023328 - DNA, 22 bp, Homo sapiens
acatagaacttcgatgtctttt

SEQ ID NO: 7023329 - DNA, 22 bp, Homo sapiens
aagtttggccaaggagacatgg

SEQ ID NO: 7023330 - DNA, 22 bp, Homo sapiens
tttaactctgagagtaactgag

SEQ ID NO: 7023331 - DNA, 22 bp, Homo sapiens
agggaaatctttcaacacttca

SEQ ID NO: 7023332 - DNA, 22 bp, Homo sapiens
aagaaggcctctgccctggctt

SEQ ID NO: 7023333 - DNA, 22 bp, Homo sapiens
gggggactaactggatcctgga

SEQ ID NO: 7023334 - DNA, 22 bp, Homo sapiens
cgtggcagtggtgtttcttagg

SEQ ID NO: 7023335 - DNA, 22 bp, Homo sapiens
gggctgtttgcatatgtttata

SEQ ID NO: 7023336 - DNA, 22 bp, Homo sapiens
agtcaggaacctcagcaagtct

SEQ ID NO: 7023337 - DNA, 22 bp, Homo sapiens
ttccttcagttcagggaaccct

SEQ ID NO: 7023338 - DNA, 22 bp, Homo sapiens
gctcagtgaaacatcaaatagt

SEQ ID NO: 7023339 - DNA, 22 bp, Homo sapiens
aagtcaatcacatgcacactga

SEQ ID NO: 7023340 - DNA, 22 bp, Homo sapiens
tgctagggatacagtggtgaat

SEQ ID NO: 7023341 - DNA, 22 bp, Homo sapiens
gtaattgaacattaagttgaag

SEQ ID NO: 7023342 - DNA, 22 bp, Homo sapiens
tcctggcccggccgggcctgct

SEQ ID NO: 7023343 - DNA, 20 bp, Homo sapiens
tttcactgtggtgctggaga

SEQ ID NO: 7023344 - DNA, 22 bp, Homo sapiens
gtgttgatggattttcgaggta

SEQ ID NO: 7023345 - DNA, 21 bp, Homo sapiens
tgtccttaatgcaatgtcctt

SEQ ID NO: 7023346 - DNA, 20 bp, Homo sapiens
ggcttccccgccatcttccg

SEQ ID NO: 7023347 - DNA, 22 bp, Homo sapiens
atatccatagtaaaagtcatta

SEQ ID NO: 7023348 - DNA, 22 bp, Homo sapiens
atggccaagaaattgccgactg

SEQ ID NO: 7023349 - DNA, 22 bp, Homo sapiens
ttcctggtcccgttcttcactg

SEQ ID NO: 7023350 - DNA, 22 bp, Homo sapiens
acagatgcgcttggttgccaga

SEQ ID NO: 7023351 - DNA, 20 bp, Homo sapiens
gctgaggattcctggcccct

SEQ ID NO: 7023352 - DNA, 20 bp, Homo sapiens
tgtttctgacggtaggagag

SEQ ID NO: 7023353 - DNA, 22 bp, Homo sapiens
gaacttgagatatgagtaggta

SEQ ID NO: 7023354 - DNA, 22 bp, Homo sapiens
gtcctggctagtcgtccgcgac

SEQ ID NO: 7023355 - DNA, 22 bp, Homo sapiens
tctacatagaattaggtaattt

SEQ ID NO: 7023356 - DNA, 22 bp, Homo sapiens
tggaggtggcacaagggaggtc

SEQ ID NO: 7023357 - DNA, 22 bp, Homo sapiens
aatgctgtaaagatgctatctg

SEQ ID NO: 7023358 - DNA, 23 bp, Homo sapiens
gaagagttgcaaagacgggacag

SEQ ID NO: 7023359 - DNA, 22 bp, Homo sapiens
cttgtacatagagaagaagcct

SEQ ID NO: 7023360 - DNA, 22 bp, Homo sapiens
aaagtgaatgtatcccgtaagt

SEQ ID NO: 7023361 - DNA, 22 bp, Homo sapiens
tgctataataatacagaggtga

SEQ ID NO: 7023362 - DNA, 22 bp, Homo sapiens
agttttctcacatcaaaaatga

SEQ ID NO: 7023363 - DNA, 22 bp, Homo sapiens
acagctgctcacctgtgagccc

SEQ ID NO: 7023364 - DNA, 22 bp, Homo sapiens
gttcacatgtggtcatgctgtc

SEQ ID NO: 7023365 - DNA, 22 bp, Homo sapiens
ttcacatctataacttagataa

SEQ ID NO: 7023366 - DNA, 22 bp, Homo sapiens
aaaggtctttattggtcagcca

SEQ ID NO: 7023367 - DNA, 22 bp, Homo sapiens
atgagttcccaggtgatttgtg

SEQ ID NO: 7023368 - DNA, 22 bp, Homo sapiens
cacagctggggaagctgaggcc

SEQ ID NO: 7023369 - DNA, 22 bp, Homo sapiens
aggagcctccttctcatgtgca

SEQ ID NO: 7023370 - DNA, 22 bp, Homo sapiens
ctttaagactctgctcttggtg

SEQ ID NO: 7023371 - DNA, 19 bp, Homo sapiens
gtcatcttttaataatgtg

SEQ ID NO: 7023372 - DNA, 22 bp, Homo sapiens
tcagagtttgaaataattttta

SEQ ID NO: 7023373 - DNA, 22 bp, Homo sapiens
atgtaatagggtaacataacat

SEQ ID NO: 7023374 - DNA, 22 bp, Homo sapiens
acaggcctggggtacaagttct

SEQ ID NO: 7023375 - DNA, 22 bp, Homo sapiens
ggaaatgtgcctgggaattaga

SEQ ID NO: 7023376 - DNA, 22 bp, Homo sapiens
atctaggatttgaatgcacagt

SEQ ID NO: 7023377 - DNA, 22 bp, Homo sapiens
ttggccagcagctctggcttag

SEQ ID NO: 7023378 - DNA, 22 bp, Homo sapiens
gcccccacaggcgggctcgggt

SEQ ID NO: 7023379 - DNA, 22 bp, Homo sapiens
cactgcagtcttcatcaaccaa

SEQ ID NO: 7023380 - DNA, 22 bp, Homo sapiens
tttagaggcatcttgcttttct

SEQ ID NO: 7023381 - DNA, 17 bp, Homo sapiens
ttggctctattgcctct

SEQ ID NO: 7023382 - DNA, 22 bp, Homo sapiens
gaaccacaagattcaaaggggt

SEQ ID NO: 7023383 - DNA, 22 bp, Homo sapiens
gccagcagcccagaaggacttt

SEQ ID NO: 7023384 - DNA, 22 bp, Homo sapiens
ggctcagaggccagcaggtaga

SEQ ID NO: 7023385 - DNA, 22 bp, Homo sapiens
gtcaaggctactgagtgccctg

SEQ ID NO: 7023386 - DNA, 22 bp, Homo sapiens
attggagaacagacttaaaaat

SEQ ID NO: 7023387 - DNA, 22 bp, Homo sapiens
tggccaagatgcgacctctcag

SEQ ID NO: 7023388 - DNA, 22 bp, Homo sapiens
tcatttggagccttcctgtttt

SEQ ID NO: 7023389 - DNA, 23 bp, Homo sapiens
agagggtgcaacatggggatcta

SEQ ID NO: 7023390 - DNA, 22 bp, Homo sapiens
ctctggctctgacagttgatcc

SEQ ID NO: 7023391 - DNA, 22 bp, Homo sapiens
cagccttttcttaaaatgcaag

SEQ ID NO: 7023392 - DNA, 22 bp, Homo sapiens
tcttgaggtcatcatctgaaac

SEQ ID NO: 7023393 - DNA, 22 bp, Homo sapiens
gctggagtacatctttggcggc

SEQ ID NO: 7023394 - DNA, 22 bp, Homo sapiens
cagggctcagaagacagacctc

SEQ ID NO: 7023395 - DNA, 22 bp, Homo sapiens
agagtgcttaaagctggctttg

SEQ ID NO: 7023396 - DNA, 22 bp, Homo sapiens
tggaagaatttggggataaatt

SEQ ID NO: 7023397 - DNA, 22 bp, Homo sapiens
cagtgagaccttctaaggtggt

SEQ ID NO: 7023398 - DNA, 22 bp, Homo sapiens
tgaacccttgtagaggatggag

SEQ ID NO: 7023399 - DNA, 22 bp, Homo sapiens
agtttaaatcatgttttgtaac

SEQ ID NO: 7023400 - DNA, 22 bp, Homo sapiens
gtgtgtccttgggcctctgcag

SEQ ID NO: 7023401 - DNA, 22 bp, Homo sapiens
agatactgaaatccaatggcca

SEQ ID NO: 7023402 - DNA, 22 bp, Homo sapiens
ttcatattatgatttgaaatgc

SEQ ID NO: 7023403 - DNA, 22 bp, Homo sapiens
ttcaggattctgtgtctgacaa

SEQ ID NO: 7023404 - DNA, 20 bp, Homo sapiens
cacagatgggacaggaaagg

SEQ ID NO: 7023405 - DNA, 22 bp, Homo sapiens
acgtgatatatttacttcccca

SEQ ID NO: 7023406 - DNA, 22 bp, Homo sapiens
tatctgtctaatgggcagcaga

SEQ ID NO: 7023407 - DNA, 21 bp, Homo sapiens
ttgctgttttcccaatgcagt

SEQ ID NO: 7023408 - DNA, 20 bp, Homo sapiens
tgttttcgttagttcatctc

SEQ ID NO: 7023409 - DNA, 22 bp, Homo sapiens
acatgtgtaaaagtggataaaa

SEQ ID NO: 7023410 - DNA, 22 bp, Homo sapiens
atatagtatgtcctccagaatt

SEQ ID NO: 7023411 - DNA, 22 bp, Homo sapiens
aggcagatcacttgaggccagg

SEQ ID NO: 7023412 - DNA, 22 bp, Homo sapiens
tgggttggaagcaggaggcacc

SEQ ID NO: 7023413 - DNA, 22 bp, Homo sapiens
aacttaaacaagctcccaagtt

SEQ ID NO: 7023414 - DNA, 22 bp, Homo sapiens
cccagcagggtctctgtgtcta

SEQ ID NO: 7023415 - DNA, 22 bp, Homo sapiens
actgttaagaaggaggatggaa

SEQ ID NO: 7023416 - DNA, 20 bp, Homo sapiens
gtgcttcagaagccattgct

SEQ ID NO: 7023417 - DNA, 22 bp, Homo sapiens
ggctctgcctgcccagcagcac

SEQ ID NO: 7023418 - DNA, 22 bp, Homo sapiens
tctgaaataagggagaagggaa

SEQ ID NO: 7023419 - DNA, 22 bp, Homo sapiens
tagctacatttatacactgtag

SEQ ID NO: 7023420 - DNA, 22 bp, Homo sapiens
agctgctcttcatttcccccca

SEQ ID NO: 7023421 - DNA, 22 bp, Homo sapiens
tttggtaaatgcaggttcttct

SEQ ID NO: 7023422 - DNA, 22 bp, Homo sapiens
tcagttcagtatacactattct

SEQ ID NO: 7023423 - DNA, 22 bp, Homo sapiens
tagctgacgctaaataaatgtt

SEQ ID NO: 7023424 - DNA, 22 bp, Homo sapiens
gtttgcatatttgcacaggaat

SEQ ID NO: 7023425 - DNA, 22 bp, Homo sapiens
tgaaatgtggagatggtaagta

SEQ ID NO: 7023426 - DNA, 22 bp, Homo sapiens
tgggaaggggagctggaaagga

SEQ ID NO: 7023427 - DNA, 22 bp, Homo sapiens
gagttagagccatagagcacgg

SEQ ID NO: 7023428 - DNA, 22 bp, Homo sapiens
gtcaccctcacggggactcctt

SEQ ID NO: 7023429 - DNA, 22 bp, Homo sapiens
gagctagacagcaagggcctgc

SEQ ID NO: 7023430 - DNA, 22 bp, Homo sapiens
tagattttgcatttctaacaag

SEQ ID NO: 7023431 - DNA, 22 bp, Homo sapiens
tatgctttcattcatatgtgag

SEQ ID NO: 7023432 - DNA, 22 bp, Homo sapiens
tttgaagtgtatgaaaatacag

SEQ ID NO: 7023433 - DNA, 22 bp, Homo sapiens
ttctgagatgcgttagaaattt

SEQ ID NO: 7023434 - DNA, 22 bp, Homo sapiens
cctgggccttgacctcgtgggc

SEQ ID NO: 7023435 - DNA, 22 bp, Homo sapiens
attagaaaccaagaggcaggct

SEQ ID NO: 7023436 - DNA, 21 bp, Homo sapiens
atgtggccattgtagtccacg

SEQ ID NO: 7023437 - DNA, 22 bp, Homo sapiens
gcttctttggcaaccctgacat

SEQ ID NO: 7023438 - DNA, 22 bp, Homo sapiens
aatcaaccatatatttgatggg

SEQ ID NO: 7023439 - DNA, 22 bp, Homo sapiens
tgtgccattgagaggtttcaga

SEQ ID NO: 7023440 - DNA, 22 bp, Homo sapiens
tctatgttagagatacatccta

SEQ ID NO: 7023441 - DNA, 22 bp, Homo sapiens
gcctggtgtccagaggcgagtg

SEQ ID NO: 7023442 - DNA, 20 bp, Homo sapiens
agacttaggcaatttaggct

SEQ ID NO: 7023443 - DNA, 22 bp, Homo sapiens
cagatatgctgagactcctgtg

SEQ ID NO: 7023444 - DNA, 22 bp, Homo sapiens
tgttgtacagatatatttgggt

SEQ ID NO: 7023445 - DNA, 22 bp, Homo sapiens
tgaggaaactgaggcacagatg

SEQ ID NO: 7023446 - DNA, 22 bp, Homo sapiens
ctgaaatgggcaaaagtagatt

SEQ ID NO: 7023447 - DNA, 22 bp, Homo sapiens
tggagctgactcacaccagcta

SEQ ID NO: 7023448 - DNA, 22 bp, Homo sapiens
gttaatgtcttcctattctaca

SEQ ID NO: 7023449 - DNA, 22 bp, Homo sapiens
atgtttcaccagcaaattacct

SEQ ID NO: 7023450 - DNA, 22 bp, Homo sapiens
tatatacaaggtaggtttaggt

SEQ ID NO: 7023451 - DNA, 22 bp, Homo sapiens
aataattttgagagcctggaaa

SEQ ID NO: 7023452 - DNA, 22 bp, Homo sapiens
aatgtggaatcatggactttat

SEQ ID NO: 7023453 - DNA, 22 bp, Homo sapiens
gggtggggttcaggaatcttca

SEQ ID NO: 7023454 - DNA, 22 bp, Homo sapiens
ttggaagagtagagttgaataa

SEQ ID NO: 7023455 - DNA, 22 bp, Homo sapiens
taatagttgtgactttgtaaag

SEQ ID NO: 7023456 - DNA, 22 bp, Homo sapiens
ctgtggagtgcttggctcagtg

SEQ ID NO: 7023457 - DNA, 22 bp, Homo sapiens
actgtaacactcatactgaagt

SEQ ID NO: 7023458 - DNA, 22 bp, Homo sapiens
agcccctctgtggctctgcctc

SEQ ID NO: 7023459 - DNA, 22 bp, Homo sapiens
gcttatggaaatggagcagttc

SEQ ID NO: 7023460 - DNA, 22 bp, Homo sapiens
tgggctactctgggagcctaac

SEQ ID NO: 7023461 - DNA, 22 bp, Homo sapiens
atggtgtagcatgtgatatgac

SEQ ID NO: 7023462 - DNA, 22 bp, Homo sapiens
aggaaaatggaccagagttgtt

SEQ ID NO: 7023463 - DNA, 22 bp, Homo sapiens
ctgccaggggcctcacaggcca

SEQ ID NO: 7023464 - DNA, 20 bp, Homo sapiens
aggatctgagatagaatgga

SEQ ID NO: 7023465 - DNA, 22 bp, Homo sapiens
ttgtgagcatgtgcagcctctg

SEQ ID NO: 7023466 - DNA, 22 bp, Homo sapiens
ggaggcaacatgcttgtttcta

SEQ ID NO: 7023467 - DNA, 22 bp, Homo sapiens
ctgtctgtacaaatgtggggcc

SEQ ID NO: 7023468 - DNA, 22 bp, Homo sapiens
ggaaaaatgacacatatctcaa

SEQ ID NO: 7023469 - DNA, 22 bp, Homo sapiens
gtatttggtgatgcctccaaac

SEQ ID NO: 7023470 - DNA, 22 bp, Homo sapiens
acactgtatgaaaacaggaaat

SEQ ID NO: 7023471 - DNA, 22 bp, Homo sapiens
tcctcagcaggtctgtgtacca

SEQ ID NO: 7023472 - DNA, 22 bp, Homo sapiens
gtctagggtctgtagtgcatgt

SEQ ID NO: 7023473 - DNA, 22 bp, Homo sapiens
ggaggtaagaggccctgggccg

SEQ ID NO: 7023474 - DNA, 20 bp, Homo sapiens
gtattggggcctggaggaag

SEQ ID NO: 7023475 - DNA, 22 bp, Homo sapiens
ggagcaggcagggccgtgtctg

SEQ ID NO: 7023476 - DNA, 22 bp, Homo sapiens
aagcaagcagtgtggaatttta

SEQ ID NO: 7023477 - DNA, 22 bp, Homo sapiens
gtgcaatcctcatagaactcat

SEQ ID NO: 7023478 - DNA, 22 bp, Homo sapiens
tcagcttctcaaaatggcttag

SEQ ID NO: 7023479 - DNA, 22 bp, Homo sapiens
acgagccttgaaggaaatatac

SEQ ID NO: 7023480 - DNA, 22 bp, Homo sapiens
ttgctctgtcagggcctcagtc

SEQ ID NO: 7023481 - DNA, 22 bp, Homo sapiens
gcagctgcacttctacctaatt

SEQ ID NO: 7023482 - DNA, 22 bp, Homo sapiens
ggatgccatcagagtgtctgtg

SEQ ID NO: 7023483 - DNA, 22 bp, Homo sapiens
tttgtaacaagttgatctggta

SEQ ID NO: 7023484 - DNA, 22 bp, Homo sapiens
gcagagcttctgtccttcagga

SEQ ID NO: 7023485 - DNA, 22 bp, Homo sapiens
ttagtgattctcttttgaattt

SEQ ID NO: 7023486 - DNA, 22 bp, Homo sapiens
acgtatcaatatattgtggcca

SEQ ID NO: 7023487 - DNA, 22 bp, Homo sapiens
aatatcccttgaagtggtgctg

SEQ ID NO: 7023488 - DNA, 22 bp, Homo sapiens
gtgtcatacagaatgcataagt

SEQ ID NO: 7023489 - DNA, 22 bp, Homo sapiens
tgtgcatgaatcaatgattccg

SEQ ID NO: 7023490 - DNA, 22 bp, Homo sapiens
agtgtattagcaagctctccag

SEQ ID NO: 7023491 - DNA, 22 bp, Homo sapiens
tcaagttacctggtcattacta

SEQ ID NO: 7023492 - DNA, 22 bp, Homo sapiens
ccagaatctcaatacctttcaa

SEQ ID NO: 7023493 - DNA, 22 bp, Homo sapiens
tatgtgcatatgcatacacaca

SEQ ID NO: 7023494 - DNA, 22 bp, Homo sapiens
aagggctggagaggaaaggttg

SEQ ID NO: 7023495 - DNA, 21 bp, Homo sapiens
acagcctgtcatctcatggtc

SEQ ID NO: 7023496 - DNA, 22 bp, Homo sapiens
gttagttgtaagtattctagag

SEQ ID NO: 7023497 - DNA, 18 bp, Homo sapiens
ggaagattggctatgtgc

SEQ ID NO: 7023498 - DNA, 22 bp, Homo sapiens
gcctgagctttaattttcttgt

SEQ ID NO: 7023499 - DNA, 21 bp, Homo sapiens
tgactccattctccatctgct

SEQ ID NO: 7023500 - DNA, 22 bp, Homo sapiens
gggtgcctgcctcaggcagtgt

SEQ ID NO: 7023501 - DNA, 22 bp, Homo sapiens
gttcagcagcagtgattttgtg

SEQ ID NO: 7023502 - DNA, 22 bp, Homo sapiens
atgtagcatgaggcactgtgcc

SEQ ID NO: 7023503 - DNA, 22 bp, Homo sapiens
tttctttgagtctcagtttgct

SEQ ID NO: 7023504 - DNA, 22 bp, Homo sapiens
tcttctttttgtcccacagaat

SEQ ID NO: 7023505 - DNA, 22 bp, Homo sapiens
tgacaaagtggttgtttggttg

SEQ ID NO: 7023506 - DNA, 22 bp, Homo sapiens
aggctgtgttctgccctctccc

SEQ ID NO: 7023507 - DNA, 22 bp, Homo sapiens
actgtgtctagcaccacgtgtc

SEQ ID NO: 7023508 - DNA, 22 bp, Homo sapiens
cattaacaatgactgcttgact

SEQ ID NO: 7023509 - DNA, 20 bp, Homo sapiens
ttgtcacagctttccatcag

SEQ ID NO: 7023510 - DNA, 23 bp, Homo sapiens
agcactcatgctgcagaagtcat

SEQ ID NO: 7023511 - DNA, 22 bp, Homo sapiens
ttgatggctgtgatttactcag

SEQ ID NO: 7023512 - DNA, 22 bp, Homo sapiens
catcaagtggttctccaggttg

SEQ ID NO: 7023513 - DNA, 22 bp, Homo sapiens
catcaggagaccaggtcctgct

SEQ ID NO: 7023514 - DNA, 22 bp, Homo sapiens
atgtgtatgcatgcactaagat

SEQ ID NO: 7023515 - DNA, 22 bp, Homo sapiens
ctcatttgttggcctagagtgg

SEQ ID NO: 7023516 - DNA, 22 bp, Homo sapiens
cctgctgtaccctactcggagt

SEQ ID NO: 7023517 - DNA, 22 bp, Homo sapiens
tttgcctgggaattctagtgta

SEQ ID NO: 7023518 - DNA, 22 bp, Homo sapiens
cagctcctctgttagccctggg

SEQ ID NO: 7023519 - DNA, 16 bp, Homo sapiens
aattgcttcttgctgc

SEQ ID NO: 7023520 - DNA, 22 bp, Homo sapiens
ctgggcagcctcacacaatgtt

SEQ ID NO: 7023521 - DNA, 22 bp, Homo sapiens
accttcatattctctgatacct

SEQ ID NO: 7023522 - DNA, 22 bp, Homo sapiens
agcacagataacatggagtgga

SEQ ID NO: 7023523 - DNA, 22 bp, Homo sapiens
tgtccctctgaggcttccctgg

SEQ ID NO: 7023524 - DNA, 22 bp, Homo sapiens
gctgtcagaaggtgaagggtaa

SEQ ID NO: 7023525 - DNA, 22 bp, Homo sapiens
gtctcatatgatataaatgcag

SEQ ID NO: 7023526 - DNA, 22 bp, Homo sapiens
atccatcatttcaccgccacta

SEQ ID NO: 7023527 - DNA, 22 bp, Homo sapiens
tagattgattgcaaagacaggc

SEQ ID NO: 7023528 - DNA, 22 bp, Homo sapiens
acatttcagatgtaatgtgatg

SEQ ID NO: 7023529 - DNA, 21 bp, Homo sapiens
cttggcacagggaagatgcac

SEQ ID NO: 7023530 - DNA, 22 bp, Homo sapiens
gcaggtctggcatagagcctgc

SEQ ID NO: 7023531 - DNA, 22 bp, Homo sapiens
caggtctgtattaacagagggt

SEQ ID NO: 7023532 - DNA, 22 bp, Homo sapiens
cttcataagattgttgtgagga

SEQ ID NO: 7023533 - DNA, 20 bp, Homo sapiens
tgtcattggcgtggttggct

SEQ ID NO: 7023534 - DNA, 22 bp, Homo sapiens
atgggcagcagctgccattcat

SEQ ID NO: 7023535 - DNA, 22 bp, Homo sapiens
ttgtctgaatctggagctctct

SEQ ID NO: 7023536 - DNA, 22 bp, Homo sapiens
atatgtcttgtttacagccttg

SEQ ID NO: 7023537 - DNA, 22 bp, Homo sapiens
tgtcagacacagccagagactg

SEQ ID NO: 7023538 - DNA, 22 bp, Homo sapiens
ctgaggagaggtggcctgtgtt

SEQ ID NO: 7023539 - DNA, 22 bp, Homo sapiens
aggtctgggagttcattccctg

SEQ ID NO: 7023540 - DNA, 21 bp, Homo sapiens
cattcctcggctcatagagga

SEQ ID NO: 7023541 - DNA, 20 bp, Homo sapiens
tccctcctgcagatagagaa

SEQ ID NO: 7023542 - DNA, 22 bp, Homo sapiens
tctagatgtactgctgaagagt

SEQ ID NO: 7023543 - DNA, 18 bp, Homo sapiens
aggcctctgtgtgcccag

SEQ ID NO: 7023544 - DNA, 18 bp, Homo sapiens
gggctctgatccttcacc

SEQ ID NO: 7023545 - DNA, 22 bp, Homo sapiens
cacaaatggccgtgttcaaaga

SEQ ID NO: 7023546 - DNA, 22 bp, Homo sapiens
ttcctggggggatagatttcac

SEQ ID NO: 7023547 - DNA, 22 bp, Homo sapiens
cctcagtctatttccagcaggt

SEQ ID NO: 7023548 - DNA, 22 bp, Homo sapiens
atacacacaatcaggttttgta

SEQ ID NO: 7023549 - DNA, 22 bp, Homo sapiens
agaacactgggaagttactaac

SEQ ID NO: 7023550 - DNA, 18 bp, Homo sapiens
gcattttaatctgaggca

SEQ ID NO: 7023551 - DNA, 22 bp, Homo sapiens
gtagaaaaagcagtaagtctca

SEQ ID NO: 7023552 - DNA, 22 bp, Homo sapiens
aaattactttacactttcatct

SEQ ID NO: 7023553 - DNA, 22 bp, Homo sapiens
agcctgttcagtccactctcca

SEQ ID NO: 7023554 - DNA, 22 bp, Homo sapiens
cactgaaggaaggactactgca

SEQ ID NO: 7023555 - DNA, 22 bp, Homo sapiens
attctccagtagtcattctatc

SEQ ID NO: 7023556 - DNA, 22 bp, Homo sapiens
tgggctctggagggcctaggat

SEQ ID NO: 7023557 - DNA, 22 bp, Homo sapiens
tgtattaacattaataaaatgg

SEQ ID NO: 7023558 - DNA, 22 bp, Homo sapiens
cacatgaattcacatgtatttt

SEQ ID NO: 7023559 - DNA, 22 bp, Homo sapiens
ccttgggacagccagcttcaga

SEQ ID NO: 7023560 - DNA, 22 bp, Homo sapiens
agcttatagatctctctgatat

SEQ ID NO: 7023561 - DNA, 22 bp, Homo sapiens
tacattgtgttaaaacagaaga

SEQ ID NO: 7023562 - DNA, 22 bp, Homo sapiens
cagttcttatttggccagtgtc

SEQ ID NO: 7023563 - DNA, 16 bp, Homo sapiens
tacattctgatcactg

SEQ ID NO: 7023564 - DNA, 22 bp, Homo sapiens
gtttcatggttgtttgatggca

SEQ ID NO: 7023565 - DNA, 21 bp, Homo sapiens
tgcagaaatggtttttctaag

SEQ ID NO: 7023566 - DNA, 22 bp, Homo sapiens
agaattacataaatacatgaat

SEQ ID NO: 7023567 - DNA, 22 bp, Homo sapiens
gtgagagaatttgagttaaatt

SEQ ID NO: 7023568 - DNA, 22 bp, Homo sapiens
tctgaggtctcatgacttgcat

SEQ ID NO: 7023569 - DNA, 22 bp, Homo sapiens
ttctgccattgccatgagggct

SEQ ID NO: 7023570 - DNA, 21 bp, Homo sapiens
tttaatttgcatgtatgacgc

SEQ ID NO: 7023571 - DNA, 22 bp, Homo sapiens
tgtatgtggctacttttcttgc

SEQ ID NO: 7023572 - DNA, 19 bp, Homo sapiens
ctttgcaggggatgggtga

SEQ ID NO: 7023573 - DNA, 22 bp, Homo sapiens
tcaacgcatgctccaagaaaga

SEQ ID NO: 7023574 - DNA, 22 bp, Homo sapiens
taagaattccatcgcagagtat

SEQ ID NO: 7023575 - DNA, 22 bp, Homo sapiens
cagcagagggagccattgaaat

SEQ ID NO: 7023576 - DNA, 22 bp, Homo sapiens
gaggactctgcaggctgctcct

SEQ ID NO: 7023577 - DNA, 22 bp, Homo sapiens
ggcagatatattcgtgaaatag

SEQ ID NO: 7023578 - DNA, 22 bp, Homo sapiens
tcttccagctccccacggtgtc

SEQ ID NO: 7023579 - DNA, 22 bp, Homo sapiens
tgacagggaggtggaataagta

SEQ ID NO: 7023580 - DNA, 22 bp, Homo sapiens
agttacagaatgtacagaggtt

SEQ ID NO: 7023581 - DNA, 22 bp, Homo sapiens
cagtgagttcatcaagacatga

SEQ ID NO: 7023582 - DNA, 22 bp, Homo sapiens
tggtcctaaggagagttctgta

SEQ ID NO: 7023583 - DNA, 22 bp, Homo sapiens
acattgttgcctagccatgagt

SEQ ID NO: 7023584 - DNA, 22 bp, Homo sapiens
aaactctcttttcttcagtagg

SEQ ID NO: 7023585 - DNA, 22 bp, Homo sapiens
taggtccagcacggtgtagctt

SEQ ID NO: 7023586 - DNA, 22 bp, Homo sapiens
gtagctttaaagactggctgat

SEQ ID NO: 7023587 - DNA, 22 bp, Homo sapiens
gatgatattttgactggagaat

SEQ ID NO: 7023588 - DNA, 20 bp, Homo sapiens
agagagttgtcagtagcttc

SEQ ID NO: 7023589 - DNA, 19 bp, Homo sapiens
agtgaaatggagtattcaa

SEQ ID NO: 7023590 - DNA, 22 bp, Homo sapiens
tgatggctcccatgggcatatg

SEQ ID NO: 7023591 - DNA, 22 bp, Homo sapiens
tctcaggctaccttgcacaagg

SEQ ID NO: 7023592 - DNA, 22 bp, Homo sapiens
acctgggcattttggatgatta

SEQ ID NO: 7023593 - DNA, 22 bp, Homo sapiens
tttgtgcaagagggccacctta

SEQ ID NO: 7023594 - DNA, 22 bp, Homo sapiens
agctttggatgatctttgatac

SEQ ID NO: 7023595 - DNA, 22 bp, Homo sapiens
tccagccctgtgtctgggagag

SEQ ID NO: 7023596 - DNA, 22 bp, Homo sapiens
gcctgctgaacctcatgcagtc

SEQ ID NO: 7023597 - DNA, 20 bp, Homo sapiens
tcacagaatgcctgaagaag

SEQ ID NO: 7023598 - DNA, 23 bp, Homo sapiens
gcagaggagcaagctggacacca

SEQ ID NO: 7023599 - DNA, 22 bp, Homo sapiens
tgagcttggaaggagaaacaga

SEQ ID NO: 7023600 - DNA, 22 bp, Homo sapiens
tctggatgctctgagcccaagg

SEQ ID NO: 7023601 - DNA, 23 bp, Homo sapiens
gagagagattgctaaaccactcc

SEQ ID NO: 7023602 - DNA, 22 bp, Homo sapiens
agctttgcaacctgaggccagt

SEQ ID NO: 7023603 - DNA, 16 bp, Homo sapiens
tcctaactggcagttc

SEQ ID NO: 7023604 - DNA, 22 bp, Homo sapiens
ttattaataaagtggcatagcc

SEQ ID NO: 7023605 - DNA, 20 bp, Homo sapiens
aacagtgaatgaggccagag

SEQ ID NO: 7023606 - DNA, 20 bp, Homo sapiens
cagggctctgggcctggcct

SEQ ID NO: 7023607 - DNA, 22 bp, Homo sapiens
tgcagagtaaaagcagatgcta

SEQ ID NO: 7023608 - DNA, 22 bp, Homo sapiens
ggggccagcaatgttgaggaat

SEQ ID NO: 7023609 - DNA, 22 bp, Homo sapiens
tgttttgctcatagctgcatcc

SEQ ID NO: 7023610 - DNA, 22 bp, Homo sapiens
agggaggagaatggactccttc

SEQ ID NO: 7023611 - DNA, 22 bp, Homo sapiens
agaatccgcttgactttgaagt

SEQ ID NO: 7023612 - DNA, 15 bp, Homo sapiens
ctcctctggcctccc

SEQ ID NO: 7023613 - DNA, 22 bp, Homo sapiens
aagggtgcccaggagatggact

SEQ ID NO: 7023614 - DNA, 22 bp, Homo sapiens
taagatattgagtggtaatttg

SEQ ID NO: 7023615 - DNA, 22 bp, Homo sapiens
attcataacggcaaatgtcacc

SEQ ID NO: 7023616 - DNA, 22 bp, Homo sapiens
ctctgggtcccacgtcattgct

SEQ ID NO: 7023617 - DNA, 19 bp, Homo sapiens
aatagattaattatcctct

SEQ ID NO: 7023618 - DNA, 22 bp, Homo sapiens
actgtacatgtaaacattgtca

SEQ ID NO: 7023619 - DNA, 22 bp, Homo sapiens
tgcaattatgggcaatttttaa

SEQ ID NO: 7023620 - DNA, 22 bp, Homo sapiens
catgcagagtttattaccatct

SEQ ID NO: 7023621 - DNA, 22 bp, Homo sapiens
tcttcagacttccggaaacgtg

SEQ ID NO: 7023622 - DNA, 22 bp, Homo sapiens
taacagtgtggacttgagatct

SEQ ID NO: 7023623 - DNA, 22 bp, Homo sapiens
tgcctccctggcaagtctctcc

SEQ ID NO: 7023624 - DNA, 22 bp, Homo sapiens
cgctgccttcatcccacgccta

SEQ ID NO: 7023625 - DNA, 22 bp, Homo sapiens
atggaatgctccctggggacat

SEQ ID NO: 7023626 - DNA, 22 bp, Homo sapiens
tacaatgcagtgacctccttta

SEQ ID NO: 7023627 - DNA, 23 bp, Homo sapiens
actaaatggggctttgcttaaag

SEQ ID NO: 7023628 - DNA, 22 bp, Homo sapiens
tgaagggggagatatatgtgtg

SEQ ID NO: 7023629 - DNA, 22 bp, Homo sapiens
gatatttattaagtggttggta

SEQ ID NO: 7023630 - DNA, 22 bp, Homo sapiens
tttgttactatagcatagagtg

SEQ ID NO: 7023631 - DNA, 22 bp, Homo sapiens
aaagctggcctctcaggcttta

SEQ ID NO: 7023632 - DNA, 22 bp, Homo sapiens
cagaagttgccacatgaccctt

SEQ ID NO: 7023633 - DNA, 21 bp, Homo sapiens
cctgtggtctggagggagcac

SEQ ID NO: 7023634 - DNA, 21 bp, Homo sapiens
acgctggggatggggtctaga

SEQ ID NO: 7023635 - DNA, 22 bp, Homo sapiens
tggagaaggacagcctgagaaa

SEQ ID NO: 7023636 - DNA, 22 bp, Homo sapiens
gacacagagtattttaagtact

SEQ ID NO: 7023637 - DNA, 20 bp, Homo sapiens
tgttccaaggagttgagggg

SEQ ID NO: 7023638 - DNA, 22 bp, Homo sapiens
aggagccaaggaaaacagtatt

SEQ ID NO: 7023639 - DNA, 22 bp, Homo sapiens
cccaagatctaggacagaaaga

SEQ ID NO: 7023640 - DNA, 16 bp, Homo sapiens
ccttccagtccagcag

SEQ ID NO: 7023641 - DNA, 22 bp, Homo sapiens
aactataatggggttaggaaat

SEQ ID NO: 7023642 - DNA, 22 bp, Homo sapiens
agctggcatctgaagtcagggc

SEQ ID NO: 7023643 - DNA, 22 bp, Homo sapiens
tttctggaggcccaagggcaga

SEQ ID NO: 7023644 - DNA, 22 bp, Homo sapiens
gtttatggagggggtgaaggca

SEQ ID NO: 7023645 - DNA, 19 bp, Homo sapiens
atcctgggtcctccagctg

SEQ ID NO: 7023646 - DNA, 22 bp, Homo sapiens
taactccattttacagagtagg

SEQ ID NO: 7023647 - DNA, 22 bp, Homo sapiens
aagccaagagttaactatttgt

SEQ ID NO: 7023648 - DNA, 22 bp, Homo sapiens
ttctcttcccactttctgtatt

SEQ ID NO: 7023649 - DNA, 22 bp, Homo sapiens
ggaggagcacttctgagctcag

SEQ ID NO: 7023650 - DNA, 22 bp, Homo sapiens
gcagtagagaagccaggctgta

SEQ ID NO: 7023651 - DNA, 22 bp, Homo sapiens
gctctgagccgggggcctgtcc

SEQ ID NO: 7023652 - DNA, 22 bp, Homo sapiens
cggggctgctcgtcctcctgtg

SEQ ID NO: 7023653 - DNA, 22 bp, Homo sapiens
cagcttcaataatggctgatgg

SEQ ID NO: 7023654 - DNA, 22 bp, Homo sapiens
tgacatttatcttctacaatga

SEQ ID NO: 7023655 - DNA, 22 bp, Homo sapiens
aacacaaagaagctgcaggatc

SEQ ID NO: 7023656 - DNA, 22 bp, Homo sapiens
atgtatgtgtgcaggcatgcgt

SEQ ID NO: 7023657 - DNA, 22 bp, Homo sapiens
ttgacaaggagccattgcatct

SEQ ID NO: 7023658 - DNA, 22 bp, Homo sapiens
cctccctgccggctggactagt

SEQ ID NO: 7023659 - DNA, 22 bp, Homo sapiens
agctgcaggaagtagaagcgga

SEQ ID NO: 7023660 - DNA, 22 bp, Homo sapiens
gcaggacttgaatccaggcagt

SEQ ID NO: 7023661 - DNA, 22 bp, Homo sapiens
ctgttgcatcatggctcttaat

SEQ ID NO: 7023662 - DNA, 22 bp, Homo sapiens
tggctgaaagcctggcctgcca

SEQ ID NO: 7023663 - DNA, 22 bp, Homo sapiens
acaatcattggcttcattacaa

SEQ ID NO: 7023664 - DNA, 22 bp, Homo sapiens
tctgtgctttccctgccttctt

SEQ ID NO: 7023665 - DNA, 22 bp, Homo sapiens
tggcatggtcaaggctatgtta

SEQ ID NO: 7023666 - DNA, 22 bp, Homo sapiens
tgacagattttgatggctaata

SEQ ID NO: 7023667 - DNA, 22 bp, Homo sapiens
gaggcagcattcgcatagacag

SEQ ID NO: 7023668 - DNA, 22 bp, Homo sapiens
agcaaagctaccaattattgag

SEQ ID NO: 7023669 - DNA, 22 bp, Homo sapiens
actgccagtattcacgttcctg

SEQ ID NO: 7023670 - DNA, 23 bp, Homo sapiens
agcctgggtagcctaaataacag

SEQ ID NO: 7023671 - DNA, 22 bp, Homo sapiens
ctaggcaagtaaggagttgcgg

SEQ ID NO: 7023672 - DNA, 22 bp, Homo sapiens
aaatactattgaccaggtctct

SEQ ID NO: 7023673 - DNA, 22 bp, Homo sapiens
agtacagttataagtggtcttg

SEQ ID NO: 7023674 - DNA, 22 bp, Homo sapiens
aaaccatgcagtctgtgtacat

SEQ ID NO: 7023675 - DNA, 22 bp, Homo sapiens
ctcttaatgaccttaattcaag

SEQ ID NO: 7023676 - DNA, 22 bp, Homo sapiens
aactttaaagaggaggcttggg

SEQ ID NO: 7023677 - DNA, 21 bp, Homo sapiens
atggtaggtggagcaggtgat

SEQ ID NO: 7023678 - DNA, 22 bp, Homo sapiens
aagtttagatataggtattctg

SEQ ID NO: 7023679 - DNA, 22 bp, Homo sapiens
agtctgggaggcttataaacag

SEQ ID NO: 7023680 - DNA, 22 bp, Homo sapiens
attcagcagttcctgcttcagt

SEQ ID NO: 7023681 - DNA, 21 bp, Homo sapiens
gatggtagcctcatagaagta

SEQ ID NO: 7023682 - DNA, 22 bp, Homo sapiens
ccaggaaatggcttgcttcttt

SEQ ID NO: 7023683 - DNA, 18 bp, Homo sapiens
actggaattaaacttttt

SEQ ID NO: 7023684 - DNA, 22 bp, Homo sapiens
gctttgccacattcttcacatt

SEQ ID NO: 7023685 - DNA, 15 bp, Homo sapiens
aacaggcatttatat

SEQ ID NO: 7023686 - DNA, 22 bp, Homo sapiens
tttgaaaattagacacaggcta

SEQ ID NO: 7023687 - DNA, 22 bp, Homo sapiens
tggcagcttcctgctcatagga

SEQ ID NO: 7023688 - DNA, 22 bp, Homo sapiens
tcacatcattaagacttctcct

SEQ ID NO: 7023689 - DNA, 22 bp, Homo sapiens
ctgggaaagcaaggttgtggat

SEQ ID NO: 7023690 - DNA, 22 bp, Homo sapiens
ataatgatcaacagcatcttgc

SEQ ID NO: 7023691 - DNA, 22 bp, Homo sapiens
cagcacagagtattttattgat

SEQ ID NO: 7023692 - DNA, 22 bp, Homo sapiens
tgacacagtatcaaacatgatt

SEQ ID NO: 7023693 - DNA, 20 bp, Homo sapiens
acacatagataagaagctga

SEQ ID NO: 7023694 - DNA, 22 bp, Homo sapiens
acagtataccattgtgactttg

SEQ ID NO: 7023695 - DNA, 22 bp, Homo sapiens
ttcttcaaagtaatagagacta

SEQ ID NO: 7023696 - DNA, 22 bp, Homo sapiens
gaatgcaaagctctctatgtta

SEQ ID NO: 7023697 - DNA, 23 bp, Homo sapiens
gcctccaaacctctaggctggtg

SEQ ID NO: 7023698 - DNA, 22 bp, Homo sapiens
acactgttgcttacagttttgg

SEQ ID NO: 7023699 - DNA, 23 bp, Homo sapiens
tgcttggagatgcagacctctga

SEQ ID NO: 7023700 - DNA, 21 bp, Homo sapiens
tctctgtgtacagtctcaccc

SEQ ID NO: 7023701 - DNA, 22 bp, Homo sapiens
gacatgtacttcaatttctctt

SEQ ID NO: 7023702 - DNA, 22 bp, Homo sapiens
cacacactcttcctggcaccta

SEQ ID NO: 7023703 - DNA, 22 bp, Homo sapiens
accatttaataagtatttccat

SEQ ID NO: 7023704 - DNA, 23 bp, Homo sapiens
gtcatcattaaagtcacagagac

SEQ ID NO: 7023705 - DNA, 22 bp, Homo sapiens
aggggagaaaaatgccttctgt

SEQ ID NO: 7023706 - DNA, 22 bp, Homo sapiens
tcacacagctgacagagccttt

SEQ ID NO: 7023707 - DNA, 22 bp, Homo sapiens
acaaaggcagccaatcatctgc

SEQ ID NO: 7023708 - DNA, 22 bp, Homo sapiens
cttatgtaaaacggaaagggaa

SEQ ID NO: 7023709 - DNA, 22 bp, Homo sapiens
tgccatccccatgtggtggaga

SEQ ID NO: 7023710 - DNA, 22 bp, Homo sapiens
gacttctctgcatgagataagt

SEQ ID NO: 7023711 - DNA, 22 bp, Homo sapiens
tgggcgctgtgctcctctttgt

SEQ ID NO: 7023712 - DNA, 22 bp, Homo sapiens
tgctgtgaggttgagaaggaag

SEQ ID NO: 7023713 - DNA, 22 bp, Homo sapiens
acttctgactcaaccgtgagct

SEQ ID NO: 7023714 - DNA, 22 bp, Homo sapiens
tcctgacttggctgttggccct

SEQ ID NO: 7023715 - DNA, 22 bp, Homo sapiens
agaggattcttagaattctgag

SEQ ID NO: 7023716 - DNA, 22 bp, Homo sapiens
aaagctctggtttggagcattt

SEQ ID NO: 7023717 - DNA, 22 bp, Homo sapiens
agccctggagcaaaggtgtctt

SEQ ID NO: 7023718 - DNA, 22 bp, Homo sapiens
ttctgggaacaaagtggagtgg

SEQ ID NO: 7023719 - DNA, 22 bp, Homo sapiens
ttcagtgtcacaagagcaagcc

SEQ ID NO: 7023720 - DNA, 22 bp, Homo sapiens
tctggactctagggggactgtg

SEQ ID NO: 7023721 - DNA, 22 bp, Homo sapiens
tttgtatcctctttataacgta

SEQ ID NO: 7023722 - DNA, 22 bp, Homo sapiens
cccggaaacaggtgacaatctc

SEQ ID NO: 7023723 - DNA, 22 bp, Homo sapiens
acagctctgggtgcaggaggtg

SEQ ID NO: 7023724 - DNA, 18 bp, Homo sapiens
tttctcaaggctgacatt

SEQ ID NO: 7023725 - DNA, 20 bp, Homo sapiens
atgtctgaagtaatccattt

SEQ ID NO: 7023726 - DNA, 22 bp, Homo sapiens
ggctgggtaccctgtttcccct

SEQ ID NO: 7023727 - DNA, 22 bp, Homo sapiens
gctgtttctcttgagtcaaaat

SEQ ID NO: 7023728 - DNA, 22 bp, Homo sapiens
ttgtgaatagtgctgcagtaaa

SEQ ID NO: 7023729 - DNA, 22 bp, Homo sapiens
acacatttacatgtttacgtat

SEQ ID NO: 7023730 - DNA, 22 bp, Homo sapiens
agaaagttctgtgagttgttca

SEQ ID NO: 7023731 - DNA, 22 bp, Homo sapiens
attccattcttgcttttgatct

SEQ ID NO: 7023732 - DNA, 22 bp, Homo sapiens
aggcataaccttttatctggat

SEQ ID NO: 7023733 - DNA, 22 bp, Homo sapiens
taaatgaagctcatgggccaca

SEQ ID NO: 7023734 - DNA, 22 bp, Homo sapiens
ctggggtgagcagaaacagggg

SEQ ID NO: 7023735 - DNA, 22 bp, Homo sapiens
ttgaagcccttcttgatagtca

SEQ ID NO: 7023736 - DNA, 22 bp, Homo sapiens
acaggcaggttgagaaacattt

SEQ ID NO: 7023737 - DNA, 22 bp, Homo sapiens
agggacagtctactgttcactg

SEQ ID NO: 7023738 - DNA, 22 bp, Homo sapiens
tttgttcgttcatgcacggtag

SEQ ID NO: 7023739 - DNA, 18 bp, Homo sapiens
tgcttggagcatttacca

SEQ ID NO: 7023740 - DNA, 22 bp, Homo sapiens
ctgtatatggcttactttatat

SEQ ID NO: 7023741 - DNA, 22 bp, Homo sapiens
cactttaaaactgacagccctt

SEQ ID NO: 7023742 - DNA, 22 bp, Homo sapiens
atcagtctgtgttagaaaagag

SEQ ID NO: 7023743 - DNA, 22 bp, Homo sapiens
attgtcagagtttgagaaagta

SEQ ID NO: 7023744 - DNA, 22 bp, Homo sapiens
tggcccagctcagggtgggcgg

SEQ ID NO: 7023745 - DNA, 22 bp, Homo sapiens
tgcagatagcgtcattcttgct

SEQ ID NO: 7023746 - DNA, 21 bp, Homo sapiens
agctgtttgaagctatattgg

SEQ ID NO: 7023747 - DNA, 22 bp, Homo sapiens
cggagtcttgctatgttgccca

SEQ ID NO: 7023748 - DNA, 22 bp, Homo sapiens
ttgcagctgtgagctttacacg

SEQ ID NO: 7023749 - DNA, 22 bp, Homo sapiens
gtgtgaaagtaattgcggtttt

SEQ ID NO: 7023750 - DNA, 22 bp, Homo sapiens
taacttttacatttggctcact

SEQ ID NO: 7023751 - DNA, 22 bp, Homo sapiens
tccccacacagatacagagtag

SEQ ID NO: 7023752 - DNA, 22 bp, Homo sapiens
caaagggaaacgcagtgtcaag

SEQ ID NO: 7023753 - DNA, 22 bp, Homo sapiens
tgggagcccaagggagctgccg

SEQ ID NO: 7023754 - DNA, 22 bp, Homo sapiens
cactctctcaggctttccttgt

SEQ ID NO: 7023755 - DNA, 22 bp, Homo sapiens
attaggcatatatgcttttaat

SEQ ID NO: 7023756 - DNA, 22 bp, Homo sapiens
cctgagaataattctccatagc

SEQ ID NO: 7023757 - DNA, 22 bp, Homo sapiens
taattctgacaacagtggcgtt

SEQ ID NO: 7023758 - DNA, 22 bp, Homo sapiens
gaggtggatgttgcagtgagct

SEQ ID NO: 7023759 - DNA, 17 bp, Homo sapiens
acccatccccagggcag

SEQ ID NO: 7023760 - DNA, 22 bp, Homo sapiens
aaatggaactgggctactaggt

SEQ ID NO: 7023761 - DNA, 22 bp, Homo sapiens
tggctgagggggcagttcagga

SEQ ID NO: 7023762 - DNA, 19 bp, Homo sapiens
ccagagtcatgtctccccc

SEQ ID NO: 7023763 - DNA, 22 bp, Homo sapiens
caatacttaatgctttttccta

SEQ ID NO: 7023764 - DNA, 22 bp, Homo sapiens
atgctcagcctgaggtggggag

SEQ ID NO: 7023765 - DNA, 22 bp, Homo sapiens
ttgtggaagccctatgagagac

SEQ ID NO: 7023766 - DNA, 22 bp, Homo sapiens
gatctgtgtgattggatgcatt

SEQ ID NO: 7023767 - DNA, 22 bp, Homo sapiens
ctcagtttcctcttctgttgaa

SEQ ID NO: 7023768 - DNA, 22 bp, Homo sapiens
acagcattgagagctaaattta

SEQ ID NO: 7023769 - DNA, 22 bp, Homo sapiens
tgcacaggccttgaagggagag

SEQ ID NO: 7023770 - DNA, 22 bp, Homo sapiens
cagctagtaaatggcaagacta

SEQ ID NO: 7023771 - DNA, 22 bp, Homo sapiens
aggcaaagaggatattttgggg

SEQ ID NO: 7023772 - DNA, 22 bp, Homo sapiens
agcagggccaacagtaaacacc

SEQ ID NO: 7023773 - DNA, 22 bp, Homo sapiens
ccagggcttcccacgtgccctg

SEQ ID NO: 7023774 - DNA, 22 bp, Homo sapiens
caatggttgaaccctgtcatga

SEQ ID NO: 7023775 - DNA, 22 bp, Homo sapiens
tcctcagcaaacacttcactct

SEQ ID NO: 7023776 - DNA, 22 bp, Homo sapiens
tcagctgcagcaggcaccattt

SEQ ID NO: 7023777 - DNA, 22 bp, Homo sapiens
ttctgccatctgcagaagggga

SEQ ID NO: 7023778 - DNA, 22 bp, Homo sapiens
ctggagtgcaacctctgcctcc

SEQ ID NO: 7023779 - DNA, 21 bp, Homo sapiens
agccagtctgttttctagtgc

SEQ ID NO: 7023780 - DNA, 22 bp, Homo sapiens
ctgggtggcgtctggggccagt

SEQ ID NO: 7023781 - DNA, 22 bp, Homo sapiens
cttcaagttgggcggcgggcag

SEQ ID NO: 7023782 - DNA, 22 bp, Homo sapiens
tccttggagtagttgttcttta

SEQ ID NO: 7023783 - DNA, 20 bp, Homo sapiens
tgcacatggcagccatctag

SEQ ID NO: 7023784 - DNA, 22 bp, Homo sapiens
cactgtggtgccaaacctggag

SEQ ID NO: 7023785 - DNA, 21 bp, Homo sapiens
aggacacagagacacctattg

SEQ ID NO: 7023786 - DNA, 21 bp, Homo sapiens
tgaatgcttcgtcatcctggc

SEQ ID NO: 7023787 - DNA, 22 bp, Homo sapiens
accctgctgacctgaaagaggg

SEQ ID NO: 7023788 - DNA, 22 bp, Homo sapiens
ctgtgctggattctgaggctac

SEQ ID NO: 7023789 - DNA, 22 bp, Homo sapiens
agatattgtttgtttcaccaat

SEQ ID NO: 7023790 - DNA, 22 bp, Homo sapiens
ccccagggtcagtgtgtggagg

SEQ ID NO: 7023791 - DNA, 22 bp, Homo sapiens
tccagggagatggcagaggctg

SEQ ID NO: 7023792 - DNA, 22 bp, Homo sapiens
gtggctccttttcaggaggctg

SEQ ID NO: 7023793 - DNA, 22 bp, Homo sapiens
ctcagagcccagggtacacccg

SEQ ID NO: 7023794 - DNA, 22 bp, Homo sapiens
ggctgggctccgggagcatgcg

SEQ ID NO: 7023795 - DNA, 22 bp, Homo sapiens
gcccagtctcttctggccctgt

SEQ ID NO: 7023796 - DNA, 22 bp, Homo sapiens
tgggaatgtagaatgtaaacca

SEQ ID NO: 7023797 - DNA, 22 bp, Homo sapiens
gtttccatgcagtagagcttag

SEQ ID NO: 7023798 - DNA, 22 bp, Homo sapiens
tttattgctcagcagttagttg

SEQ ID NO: 7023799 - DNA, 22 bp, Homo sapiens
agctttctctcagccaggctgc

SEQ ID NO: 7023800 - DNA, 22 bp, Homo sapiens
cacatttccttggcctttaatt

SEQ ID NO: 7023801 - DNA, 22 bp, Homo sapiens
aggtcacttggtgttattcagc

SEQ ID NO: 7023802 - DNA, 22 bp, Homo sapiens
ggtctcttgtccaaggtcacac

SEQ ID NO: 7023803 - DNA, 22 bp, Homo sapiens
agatccatcatcatattttcta

SEQ ID NO: 7023804 - DNA, 22 bp, Homo sapiens
tctcttcttgattttcactgga

SEQ ID NO: 7023805 - DNA, 22 bp, Homo sapiens
tcacagacagaagggatgggat

SEQ ID NO: 7023806 - DNA, 22 bp, Homo sapiens
gtttctcagtttggtctgcaga

SEQ ID NO: 7023807 - DNA, 22 bp, Homo sapiens
caggatccccaggtcgccgtcc

SEQ ID NO: 7023808 - DNA, 22 bp, Homo sapiens
atcatgacagagtctgccatcc

SEQ ID NO: 7023809 - DNA, 22 bp, Homo sapiens
gagacaaagcttcctgtgggta

SEQ ID NO: 7023810 - DNA, 22 bp, Homo sapiens
tcttgcataggtcttttatcag

SEQ ID NO: 7023811 - DNA, 22 bp, Homo sapiens
ccagtagttggacaaatagatt

SEQ ID NO: 7023812 - DNA, 20 bp, Homo sapiens
tgacaaagagtaagaggagg

SEQ ID NO: 7023813 - DNA, 22 bp, Homo sapiens
tcctgggagcccttgctccacc

SEQ ID NO: 7023814 - DNA, 22 bp, Homo sapiens
gcctgcagggtgatgggctgcc

SEQ ID NO: 7023815 - DNA, 22 bp, Homo sapiens
gtttcctgactgtggaattata

SEQ ID NO: 7023816 - DNA, 22 bp, Homo sapiens
aatgctagtgtgatatgtaagg

SEQ ID NO: 7023817 - DNA, 22 bp, Homo sapiens
tacattgagcacgtactatgtg

SEQ ID NO: 7023818 - DNA, 21 bp, Homo sapiens
ggcagcgtgtggacaggaagg

SEQ ID NO: 7023819 - DNA, 22 bp, Homo sapiens
tctgagggttgtagagagggac

SEQ ID NO: 7023820 - DNA, 22 bp, Homo sapiens
gggacattgtcaatggtggtag

SEQ ID NO: 7023821 - DNA, 22 bp, Homo sapiens
tgtcatttatgcttcttcagtg

SEQ ID NO: 7023822 - DNA, 22 bp, Homo sapiens
caggcagatttgctgccctcca

SEQ ID NO: 7023823 - DNA, 22 bp, Homo sapiens
ctctttactctgtgttattgtt

SEQ ID NO: 7023824 - DNA, 22 bp, Homo sapiens
ggccacacggagaggctggtct

SEQ ID NO: 7023825 - DNA, 21 bp, Homo sapiens
cagctccactaaagcagctgt

SEQ ID NO: 7023826 - DNA, 22 bp, Homo sapiens
aacaaatgacctgatttcttcc

SEQ ID NO: 7023827 - DNA, 22 bp, Homo sapiens
cctgggagagctgcccgggtga

SEQ ID NO: 7023828 - DNA, 22 bp, Homo sapiens
gtcagtgtttaacaaccagctc

SEQ ID NO: 7023829 - DNA, 22 bp, Homo sapiens
cctcccggatcatgtcccgcac

SEQ ID NO: 7023830 - DNA, 22 bp, Homo sapiens
ttatttcattgatttctaagac

SEQ ID NO: 7023831 - DNA, 22 bp, Homo sapiens
gagggccaatggatttcaactg

SEQ ID NO: 7023832 - DNA, 22 bp, Homo sapiens
cctggtcagagcagtcaggatc

SEQ ID NO: 7023833 - DNA, 22 bp, Homo sapiens
aacatattcagatgccaagtcc

SEQ ID NO: 7023834 - DNA, 22 bp, Homo sapiens
cattcctaaccacatgtgggct

SEQ ID NO: 7023835 - DNA, 22 bp, Homo sapiens
gtgttcatgccccagtgcagga

SEQ ID NO: 7023836 - DNA, 22 bp, Homo sapiens
tgggcactggggctccagaggt

SEQ ID NO: 7023837 - DNA, 22 bp, Homo sapiens
ttcaaacagatgactctgctct

SEQ ID NO: 7023838 - DNA, 22 bp, Homo sapiens
cctggcaagtcagaaccagcac

SEQ ID NO: 7023839 - DNA, 22 bp, Homo sapiens
atagcagcatttcttccaagga

SEQ ID NO: 7023840 - DNA, 22 bp, Homo sapiens
tggcatgttttgctcttgaaaa

SEQ ID NO: 7023841 - DNA, 22 bp, Homo sapiens
tttgcaaattcttgtctagcct

SEQ ID NO: 7023842 - DNA, 22 bp, Homo sapiens
ttcagtaaaacactgcaatgtc

SEQ ID NO: 7023843 - DNA, 22 bp, Homo sapiens
ccacagtgagttagattgacca

SEQ ID NO: 7023844 - DNA, 22 bp, Homo sapiens
atatttgtggtttttggctcct

SEQ ID NO: 7023845 - DNA, 22 bp, Homo sapiens
gcacctgggacccagaggcacc

SEQ ID NO: 7023846 - DNA, 22 bp, Homo sapiens
aagcactttatgtcaatgtcct

SEQ ID NO: 7023847 - DNA, 20 bp, Homo sapiens
tgctgcctgtttttgtgaat

SEQ ID NO: 7023848 - DNA, 22 bp, Homo sapiens
cagtaatcaggggagagggcaa

SEQ ID NO: 7023849 - DNA, 22 bp, Homo sapiens
gtatattttgatcaccctctat

SEQ ID NO: 7023850 - DNA, 22 bp, Homo sapiens
aagccagcattttcccattcct

SEQ ID NO: 7023851 - DNA, 22 bp, Homo sapiens
tgggatgagctatatagaaagt

SEQ ID NO: 7023852 - DNA, 22 bp, Homo sapiens
ttgtaattactccaggggtaaa

SEQ ID NO: 7023853 - DNA, 22 bp, Homo sapiens
gagtggcatagaagcatataga

SEQ ID NO: 7023854 - DNA, 22 bp, Homo sapiens
gctggtgcattagctgcagttc

SEQ ID NO: 7023855 - DNA, 22 bp, Homo sapiens
ctaagatagattttttcacttt

SEQ ID NO: 7023856 - DNA, 22 bp, Homo sapiens
gtagcagaatcagtgctacaga

SEQ ID NO: 7023857 - DNA, 22 bp, Homo sapiens
agacagtgtaatgtaattgtta

SEQ ID NO: 7023858 - DNA, 22 bp, Homo sapiens
aacttttagacttgggtataaa

SEQ ID NO: 7023859 - DNA, 22 bp, Homo sapiens
acaagtaatttatgcaaacgga

SEQ ID NO: 7023860 - DNA, 22 bp, Homo sapiens
cctggctcgctgacctcagggg

SEQ ID NO: 7023861 - DNA, 22 bp, Homo sapiens
cccaggaaaagcagtgccagca

SEQ ID NO: 7023862 - DNA, 23 bp, Homo sapiens
ttctttggaattgggctgcaagg

SEQ ID NO: 7023863 - DNA, 22 bp, Homo sapiens
gaaaataggctgcatctccttc

SEQ ID NO: 7023864 - DNA, 22 bp, Homo sapiens
gggtgctcctggcggcctcttt

SEQ ID NO: 7023865 - DNA, 22 bp, Homo sapiens
taccagcaatgtatgagtgttt

SEQ ID NO: 7023866 - DNA, 22 bp, Homo sapiens
atctagggtgtaggtcactgat

SEQ ID NO: 7023867 - DNA, 22 bp, Homo sapiens
aaagtcacatataacaagggca

SEQ ID NO: 7023868 - DNA, 22 bp, Homo sapiens
actcaggagggatcagctatca

SEQ ID NO: 7023869 - DNA, 22 bp, Homo sapiens
caattactggtccacagaaatt

SEQ ID NO: 7023870 - DNA, 22 bp, Homo sapiens
attctgggttcatgagtgagct

SEQ ID NO: 7023871 - DNA, 22 bp, Homo sapiens
tctggcagtgatttctgtgatc

SEQ ID NO: 7023872 - DNA, 22 bp, Homo sapiens
ctgcctgggccggccaccctct

SEQ ID NO: 7023873 - DNA, 22 bp, Homo sapiens
cagctcaggctctccatgctcc

SEQ ID NO: 7023874 - DNA, 22 bp, Homo sapiens
caagatattgatttccagctga

SEQ ID NO: 7023875 - DNA, 22 bp, Homo sapiens
gtgctgtgtctatcaggaataa

SEQ ID NO: 7023876 - DNA, 22 bp, Homo sapiens
gtcccattttgcagatagagca

SEQ ID NO: 7023877 - DNA, 22 bp, Homo sapiens
agggcctcgaaggcagagggat

SEQ ID NO: 7023878 - DNA, 16 bp, Homo sapiens
ttccacagtcgaggtg

SEQ ID NO: 7023879 - DNA, 22 bp, Homo sapiens
tactttgagtaatggtagagat

SEQ ID NO: 7023880 - DNA, 22 bp, Homo sapiens
gaagttacatactgtcacttct

SEQ ID NO: 7023881 - DNA, 19 bp, Homo sapiens
ggctgcagagccccggcgc

SEQ ID NO: 7023882 - DNA, 22 bp, Homo sapiens
ccttccagggagcaggcagtgt

SEQ ID NO: 7023883 - DNA, 22 bp, Homo sapiens
tgcaggtgctacaagaactcac

SEQ ID NO: 7023884 - DNA, 23 bp, Homo sapiens
atgtatgtttctgcatcttcaac

SEQ ID NO: 7023885 - DNA, 21 bp, Homo sapiens
gtctgtgatcttactgctgtg

SEQ ID NO: 7023886 - DNA, 18 bp, Homo sapiens
gtgctgatgagtggtttt

SEQ ID NO: 7023887 - DNA, 22 bp, Homo sapiens
tgcattgattgacaggaaagta

SEQ ID NO: 7023888 - DNA, 22 bp, Homo sapiens
tagagaaataagctttgccttg

SEQ ID NO: 7023889 - DNA, 22 bp, Homo sapiens
tcctggccacccgacagaagtc

SEQ ID NO: 7023890 - DNA, 22 bp, Homo sapiens
cttctgaagaggttatcataga

SEQ ID NO: 7023891 - DNA, 22 bp, Homo sapiens
gcagagatccttgctggatgac

SEQ ID NO: 7023892 - DNA, 22 bp, Homo sapiens
gctggcacagaataagcaggca

SEQ ID NO: 7023893 - DNA, 22 bp, Homo sapiens
actaaggcagtattacttctgt

SEQ ID NO: 7023894 - DNA, 20 bp, Homo sapiens
actgttagtatacttgtgcc

SEQ ID NO: 7023895 - DNA, 22 bp, Homo sapiens
atcaacatttgcatccttccac

SEQ ID NO: 7023896 - DNA, 22 bp, Homo sapiens
acaatcttattagtagtataga

SEQ ID NO: 7023897 - DNA, 22 bp, Homo sapiens
aacatgctttgataaataaaag

SEQ ID NO: 7023898 - DNA, 22 bp, Homo sapiens
gccaggcagctgggagggtgcc

SEQ ID NO: 7023899 - DNA, 22 bp, Homo sapiens
tgttgtgacctctctgcattca

SEQ ID NO: 7023900 - DNA, 22 bp, Homo sapiens
atttacagccttgccatctata

SEQ ID NO: 7023901 - DNA, 22 bp, Homo sapiens
gtgccagaaggttcccgctgca

SEQ ID NO: 7023902 - DNA, 22 bp, Homo sapiens
aaggacagggatggttgattgt

SEQ ID NO: 7023903 - DNA, 19 bp, Homo sapiens
tgcccctgcagtctaccca

SEQ ID NO: 7023904 - DNA, 22 bp, Homo sapiens
acagtgtataaaatcttaaaga

SEQ ID NO: 7023905 - DNA, 22 bp, Homo sapiens
tgctttaccttcccagaaacca

SEQ ID NO: 7023906 - DNA, 22 bp, Homo sapiens
ctagtaaggaataaattatgat

SEQ ID NO: 7023907 - DNA, 22 bp, Homo sapiens
tgggtggtccaggctcagcaga

SEQ ID NO: 7023908 - DNA, 22 bp, Homo sapiens
aggcaatcctcttacagatggg

SEQ ID NO: 7023909 - DNA, 22 bp, Homo sapiens
acatttcttcctaattatccct

SEQ ID NO: 7023910 - DNA, 22 bp, Homo sapiens
catttctaagaagatctgggta

SEQ ID NO: 7023911 - DNA, 22 bp, Homo sapiens
tggagaatgatattccatcatt

SEQ ID NO: 7023912 - DNA, 22 bp, Homo sapiens
tgttacaaggaagaatgtaggt

SEQ ID NO: 7023913 - DNA, 22 bp, Homo sapiens
tctcaaatttgctggaccagta

SEQ ID NO: 7023914 - DNA, 22 bp, Homo sapiens
gcacatggcggccagcaggtga

SEQ ID NO: 7023915 - DNA, 18 bp, Homo sapiens
aattgcatttgtttcctt

SEQ ID NO: 7023916 - DNA, 22 bp, Homo sapiens
gtaaggcttagggtgcctagat

SEQ ID NO: 7023917 - DNA, 18 bp, Homo sapiens
gtctcaggagtggcacgt

SEQ ID NO: 7023918 - DNA, 22 bp, Homo sapiens
atcagcaggtgctggtggagac

SEQ ID NO: 7023919 - DNA, 22 bp, Homo sapiens
tgcctgttaagggtgtagatat

SEQ ID NO: 7023920 - DNA, 22 bp, Homo sapiens
gctctgctgggtgggcagttat

SEQ ID NO: 7023921 - DNA, 22 bp, Homo sapiens
tctgaggtggacgatggagcct

SEQ ID NO: 7023922 - DNA, 22 bp, Homo sapiens
taaacagagagtgcagttatag

SEQ ID NO: 7023923 - DNA, 22 bp, Homo sapiens
agtgtgtccagaaatctgtatt

SEQ ID NO: 7023924 - DNA, 17 bp, Homo sapiens
gctgtcccttcaagagt

SEQ ID NO: 7023925 - DNA, 22 bp, Homo sapiens
tttggctactgtacagaaagcc

SEQ ID NO: 7023926 - DNA, 20 bp, Homo sapiens
tacactaagtatgaagtgct

SEQ ID NO: 7023927 - DNA, 22 bp, Homo sapiens
gctttgcacagattaggttatt

SEQ ID NO: 7023928 - DNA, 23 bp, Homo sapiens
cttgaatgggatggaattcactg

SEQ ID NO: 7023929 - DNA, 22 bp, Homo sapiens
caagcaggatgaagcccaggga

SEQ ID NO: 7023930 - DNA, 22 bp, Homo sapiens
acatagctcagtatcacttact

SEQ ID NO: 7023931 - DNA, 22 bp, Homo sapiens
tcggtgacaaattctctgccat

SEQ ID NO: 7023932 - DNA, 22 bp, Homo sapiens
gctggctcccagaggccccagc

SEQ ID NO: 7023933 - DNA, 19 bp, Homo sapiens
agatggcttggactgaaaa

SEQ ID NO: 7023934 - DNA, 22 bp, Homo sapiens
gcagagtatgagcatggcttta

SEQ ID NO: 7023935 - DNA, 22 bp, Homo sapiens
atctcaggtgaaacttctaggt

SEQ ID NO: 7023936 - DNA, 22 bp, Homo sapiens
gtgggcagttcaattctgggag

SEQ ID NO: 7023937 - DNA, 22 bp, Homo sapiens
gccaggtggctgagtgactgag

SEQ ID NO: 7023938 - DNA, 22 bp, Homo sapiens
ctgcattattctagtccaagcc

SEQ ID NO: 7023939 - DNA, 22 bp, Homo sapiens
cattagggtctctcagctgaat

SEQ ID NO: 7023940 - DNA, 22 bp, Homo sapiens
atgatgtacagaaagttggcgg

SEQ ID NO: 7023941 - DNA, 22 bp, Homo sapiens
tagctttacaaagtgctgcacc

SEQ ID NO: 7023942 - DNA, 22 bp, Homo sapiens
atgaatacaaaagagttgagga

SEQ ID NO: 7023943 - DNA, 22 bp, Homo sapiens
cctggctctggtgaggagaagt

SEQ ID NO: 7023944 - DNA, 22 bp, Homo sapiens
tgagggctgtggaaggctaacc

SEQ ID NO: 7023945 - DNA, 22 bp, Homo sapiens
ttttctgactctattgaggtat

SEQ ID NO: 7023946 - DNA, 22 bp, Homo sapiens
aagcatctataggttctaggag

SEQ ID NO: 7023947 - DNA, 21 bp, Homo sapiens
tcaggtggcagagtgtttatg

SEQ ID NO: 7023948 - DNA, 22 bp, Homo sapiens
gtgccatttttctccagaaata

SEQ ID NO: 7023949 - DNA, 21 bp, Homo sapiens
tttggcctagaggcttctctg

SEQ ID NO: 7023950 - DNA, 19 bp, Homo sapiens
ggtcacaggggttacaagg

SEQ ID NO: 7023951 - DNA, 18 bp, Homo sapiens
gcaggcttttcctgggtc

SEQ ID NO: 7023952 - DNA, 22 bp, Homo sapiens
tgagaacatttgcagggagagt

SEQ ID NO: 7023953 - DNA, 22 bp, Homo sapiens
gttttacaaggttaatcagcag

SEQ ID NO: 7023954 - DNA, 22 bp, Homo sapiens
atagtttgtgaaacacagcagt

SEQ ID NO: 7023955 - DNA, 22 bp, Homo sapiens
gcacctgctgggtgtagaggct

SEQ ID NO: 7023956 - DNA, 22 bp, Homo sapiens
ccagccttgggggatccaggac

SEQ ID NO: 7023957 - DNA, 16 bp, Homo sapiens
tcctggcctttggaag

SEQ ID NO: 7023958 - DNA, 22 bp, Homo sapiens
ttcattgagttactgcctgggc

SEQ ID NO: 7023959 - DNA, 22 bp, Homo sapiens
tccaagagaatactggagagta

SEQ ID NO: 7023960 - DNA, 22 bp, Homo sapiens
ctggttcctccatcagcaggaa

SEQ ID NO: 7023961 - DNA, 22 bp, Homo sapiens
gattcctagcaaactcttggag

SEQ ID NO: 7023962 - DNA, 22 bp, Homo sapiens
cagccctggtgccaaggttccc

SEQ ID NO: 7023963 - DNA, 22 bp, Homo sapiens
ggtcctgcctgctgtccttcaa

SEQ ID NO: 7023964 - DNA, 22 bp, Homo sapiens
atgggaggcaaagatcgcagaa

SEQ ID NO: 7023965 - DNA, 20 bp, Homo sapiens
ttatttctcattctcctact

SEQ ID NO: 7023966 - DNA, 22 bp, Homo sapiens
cctggggtcagggacgctgtgc

SEQ ID NO: 7023967 - DNA, 22 bp, Homo sapiens
ttgtgctgactgcgcccagctc

SEQ ID NO: 7023968 - DNA, 22 bp, Homo sapiens
cagctgttgtcacctcacatcc

SEQ ID NO: 7023969 - DNA, 19 bp, Homo sapiens
ggaaggtgacagtggtgaa

SEQ ID NO: 7023970 - DNA, 16 bp, Homo sapiens
gtgcagctgcctggta

SEQ ID NO: 7023971 - DNA, 22 bp, Homo sapiens
aagacgggagtcaggtgagctc

SEQ ID NO: 7023972 - DNA, 22 bp, Homo sapiens
ctttttccagcttcagggtggg

SEQ ID NO: 7023973 - DNA, 22 bp, Homo sapiens
agtgcagctccctcacctgctt

SEQ ID NO: 7023974 - DNA, 22 bp, Homo sapiens
ttagtatctggaaatcacatta

SEQ ID NO: 7023975 - DNA, 22 bp, Homo sapiens
cggcagcggttggaggttgtag

SEQ ID NO: 7023976 - DNA, 22 bp, Homo sapiens
agaagtattctgcatgtactga

SEQ ID NO: 7023977 - DNA, 22 bp, Homo sapiens
agcctttatactgtgtaaggca

SEQ ID NO: 7023978 - DNA, 22 bp, Homo sapiens
actagtttatgctcagatgtct

SEQ ID NO: 7023979 - DNA, 22 bp, Homo sapiens
atggtctttttgttatgagaga

SEQ ID NO: 7023980 - DNA, 22 bp, Homo sapiens
atggatcagaatcccgggaggg

SEQ ID NO: 7023981 - DNA, 17 bp, Homo sapiens
tggaaacaaaacttatt

SEQ ID NO: 7023982 - DNA, 18 bp, Homo sapiens
tgatctttgagtataatg

SEQ ID NO: 7023983 - DNA, 22 bp, Homo sapiens
gactttctaatgctctgtagat

SEQ ID NO: 7023984 - DNA, 22 bp, Homo sapiens
cggcttcagtctcatcatcgcc

SEQ ID NO: 7023985 - DNA, 22 bp, Homo sapiens
ccatgtgttcaataagggagtt

SEQ ID NO: 7023986 - DNA, 22 bp, Homo sapiens
gctgaggcttagctaaaaattt

SEQ ID NO: 7023987 - DNA, 22 bp, Homo sapiens
ctcctggaccaccttgtggcca

SEQ ID NO: 7023988 - DNA, 22 bp, Homo sapiens
tttaccactgcttgcaggaagt

SEQ ID NO: 7023989 - DNA, 17 bp, Homo sapiens
ctgtggccacctggatg

SEQ ID NO: 7023990 - DNA, 21 bp, Homo sapiens
ttaatcagtctccctgtctcc

SEQ ID NO: 7023991 - DNA, 22 bp, Homo sapiens
gtgtctttattcctctatgttt

SEQ ID NO: 7023992 - DNA, 22 bp, Homo sapiens
ttccacaaatacactccacatt

SEQ ID NO: 7023993 - DNA, 22 bp, Homo sapiens
tagcagcatttttgtagagtat

SEQ ID NO: 7023994 - DNA, 22 bp, Homo sapiens
aatgtcctcagaggtgtgtaga

SEQ ID NO: 7023995 - DNA, 22 bp, Homo sapiens
gcaggctcgttggaagtcccct

SEQ ID NO: 7023996 - DNA, 21 bp, Homo sapiens
gagagctaacagtgacagctc

SEQ ID NO: 7023997 - DNA, 22 bp, Homo sapiens
ccaaagagagacctttcttctc

SEQ ID NO: 7023998 - DNA, 22 bp, Homo sapiens
cagtgcagttggtggcaggggt

SEQ ID NO: 7023999 - DNA, 22 bp, Homo sapiens
ttggaaatggctgtagttatga

SEQ ID NO: 7024000 - DNA, 21 bp, Homo sapiens
ggctttgctcagcttaccaaa

SEQ ID NO: 7024001 - DNA, 22 bp, Homo sapiens
tgcttaatagtgcactggtttc

SEQ ID NO: 7024002 - DNA, 22 bp, Homo sapiens
aacatctcagaagtgaccctga

SEQ ID NO: 7024003 - DNA, 22 bp, Homo sapiens
cttgagggactctatgacttag

SEQ ID NO: 7024004 - DNA, 20 bp, Homo sapiens
gctgggggtgtgctgagtga

SEQ ID NO: 7024005 - DNA, 22 bp, Homo sapiens
tggctggatatcagaggaagtg

SEQ ID NO: 7024006 - DNA, 22 bp, Homo sapiens
ttgcaaagtgtcatgcaaagta

SEQ ID NO: 7024007 - DNA, 22 bp, Homo sapiens
cctggcaggttacaaccagtta

SEQ ID NO: 7024008 - DNA, 22 bp, Homo sapiens
ctggggatgggacctggcataa

SEQ ID NO: 7024009 - DNA, 22 bp, Homo sapiens
taagttacctgttttgtcatca

SEQ ID NO: 7024010 - DNA, 22 bp, Homo sapiens
taccatgaggacccctgtgtca

SEQ ID NO: 7024011 - DNA, 21 bp, Homo sapiens
aagagtggctgaggaggtgat

SEQ ID NO: 7024012 - DNA, 19 bp, Homo sapiens
agcattaggcaaattttga

SEQ ID NO: 7024013 - DNA, 22 bp, Homo sapiens
agggtctgactcctctggcaag

SEQ ID NO: 7024014 - DNA, 22 bp, Homo sapiens
gcacccagagggcagggtctcc

SEQ ID NO: 7024015 - DNA, 22 bp, Homo sapiens
tctctggtcccacctggccatt

SEQ ID NO: 7024016 - DNA, 22 bp, Homo sapiens
aacctgaagaaaatatttgctg

SEQ ID NO: 7024017 - DNA, 22 bp, Homo sapiens
tgctttctttagctcctgagtc

SEQ ID NO: 7024018 - DNA, 22 bp, Homo sapiens
aagtaatatctggcaccaggaa

SEQ ID NO: 7024019 - DNA, 22 bp, Homo sapiens
ctggcagccaagtgggatactc

SEQ ID NO: 7024020 - DNA, 22 bp, Homo sapiens
tcctcaggggtttcaggtgtac

SEQ ID NO: 7024021 - DNA, 22 bp, Homo sapiens
aggacaattgagagtttgttga

SEQ ID NO: 7024022 - DNA, 22 bp, Homo sapiens
catataatgtttgaagatgtgg

SEQ ID NO: 7024023 - DNA, 22 bp, Homo sapiens
gaatgtttaaaaggtgcagttt

SEQ ID NO: 7024024 - DNA, 22 bp, Homo sapiens
agtgtccaactcagcttgtcaa

SEQ ID NO: 7024025 - DNA, 22 bp, Homo sapiens
gatttctgtggcttgtacatat

SEQ ID NO: 7024026 - DNA, 22 bp, Homo sapiens
cacaaaagtaggaggcaggcgg

SEQ ID NO: 7024027 - DNA, 23 bp, Homo sapiens
atttgagaaagtatttttaagac

SEQ ID NO: 7024028 - DNA, 22 bp, Homo sapiens
cttgaatgtaaataatgtacag

SEQ ID NO: 7024029 - DNA, 22 bp, Homo sapiens
tgctttattcccttctgatgtg

SEQ ID NO: 7024030 - DNA, 22 bp, Homo sapiens
tccaggcaagggaggagcatgg

SEQ ID NO: 7024031 - DNA, 22 bp, Homo sapiens
tttgacaagagggcatcttcag

SEQ ID NO: 7024032 - DNA, 22 bp, Homo sapiens
ttgtaaacatctgttgcttaga

SEQ ID NO: 7024033 - DNA, 22 bp, Homo sapiens
ttgatacacaatggaacaatgt

SEQ ID NO: 7024034 - DNA, 22 bp, Homo sapiens
aacgtgcattaggacctctcca

SEQ ID NO: 7024035 - DNA, 22 bp, Homo sapiens
agcaggtgttggctgggccatc

SEQ ID NO: 7024036 - DNA, 22 bp, Homo sapiens
tgtctcagggcagcagcagggg

SEQ ID NO: 7024037 - DNA, 22 bp, Homo sapiens
cacttatttatgcagaaaagtt

SEQ ID NO: 7024038 - DNA, 22 bp, Homo sapiens
cggggcctagtctacctcggca

SEQ ID NO: 7024039 - DNA, 18 bp, Homo sapiens
tcacacttcctttgggtc

SEQ ID NO: 7024040 - DNA, 22 bp, Homo sapiens
tgtaagaaaacctgtacaaaga

SEQ ID NO: 7024041 - DNA, 22 bp, Homo sapiens
ttcctgcatggattgaggctat

SEQ ID NO: 7024042 - DNA, 22 bp, Homo sapiens
gagtcagacagggtcacccaga

SEQ ID NO: 7024043 - DNA, 22 bp, Homo sapiens
ctggctttggaaacaatttatc

SEQ ID NO: 7024044 - DNA, 20 bp, Homo sapiens
tcagccctgagtccaggctg

SEQ ID NO: 7024045 - DNA, 22 bp, Homo sapiens
tgacaaatacaataagatctgt

SEQ ID NO: 7024046 - DNA, 22 bp, Homo sapiens
aggaatgtgcctagcctccctg

SEQ ID NO: 7024047 - DNA, 22 bp, Homo sapiens
tttatgtcactttgaaagagag

SEQ ID NO: 7024048 - DNA, 22 bp, Homo sapiens
aagatcctgcttttgcttctgt

SEQ ID NO: 7024049 - DNA, 22 bp, Homo sapiens
gtgacattttttaagcccttgt

SEQ ID NO: 7024050 - DNA, 22 bp, Homo sapiens
tctgcaggtaagcgttcttgga

SEQ ID NO: 7024051 - DNA, 22 bp, Homo sapiens
ttccatgaagggcagcctctca

SEQ ID NO: 7024052 - DNA, 22 bp, Homo sapiens
ctgaaactggtcaattaatctg

SEQ ID NO: 7024053 - DNA, 22 bp, Homo sapiens
ggcaggcaacggaccactagtc

SEQ ID NO: 7024054 - DNA, 22 bp, Homo sapiens
aacctagaagttagagtatcat

SEQ ID NO: 7024055 - DNA, 22 bp, Homo sapiens
ctgggagcttggagcctttggt

SEQ ID NO: 7024056 - DNA, 23 bp, Homo sapiens
gggacctggtaggaggtgattgg

SEQ ID NO: 7024057 - DNA, 22 bp, Homo sapiens
cctctgagttagagatctagat

SEQ ID NO: 7024058 - DNA, 22 bp, Homo sapiens
gctgtggcttgcagctggggct

SEQ ID NO: 7024059 - DNA, 22 bp, Homo sapiens
ataacagacttagagttacaag

SEQ ID NO: 7024060 - DNA, 19 bp, Homo sapiens
tggaagaggaagggaaata

SEQ ID NO: 7024061 - DNA, 22 bp, Homo sapiens
aagcagcatgctatgctggtgg

SEQ ID NO: 7024062 - DNA, 22 bp, Homo sapiens
cttgtagaattgaaatggtctc

SEQ ID NO: 7024063 - DNA, 22 bp, Homo sapiens
gtacagtggaggtctgtgttca

SEQ ID NO: 7024064 - DNA, 22 bp, Homo sapiens
tccagccatatcttgtagccct

SEQ ID NO: 7024065 - DNA, 21 bp, Homo sapiens
agatgctgatgctgcaggtcc

SEQ ID NO: 7024066 - DNA, 22 bp, Homo sapiens
ctggaggtcacccttagaacat

SEQ ID NO: 7024067 - DNA, 22 bp, Homo sapiens
tatgagcagacagtggttttac

SEQ ID NO: 7024068 - DNA, 22 bp, Homo sapiens
tggccctgccgcactatcctca

SEQ ID NO: 7024069 - DNA, 21 bp, Homo sapiens
ggtgctcctccatgctgctct

SEQ ID NO: 7024070 - DNA, 22 bp, Homo sapiens
ggtgaattgaccaaaatcagac

SEQ ID NO: 7024071 - DNA, 22 bp, Homo sapiens
ggccagtctgggccacggtcgg

SEQ ID NO: 7024072 - DNA, 22 bp, Homo sapiens
tagggcttagaaaagaatttac

SEQ ID NO: 7024073 - DNA, 19 bp, Homo sapiens
acatatgtggatatacatg

SEQ ID NO: 7024074 - DNA, 22 bp, Homo sapiens
gcaaagtgcttcagtgggagct

SEQ ID NO: 7024075 - DNA, 22 bp, Homo sapiens
tggctggggccacagttttcct

SEQ ID NO: 7024076 - DNA, 22 bp, Homo sapiens
tgagctgctagatgatttatga

SEQ ID NO: 7024077 - DNA, 22 bp, Homo sapiens
tagcttttagtacttaatggct

SEQ ID NO: 7024078 - DNA, 22 bp, Homo sapiens
agccatttggacttctggtagg

SEQ ID NO: 7024079 - DNA, 22 bp, Homo sapiens
tactctcagggttagtacagga

SEQ ID NO: 7024080 - DNA, 22 bp, Homo sapiens
aacattgagaaacattgggata

SEQ ID NO: 7024081 - DNA, 21 bp, Homo sapiens
ttacagttgatggagtattcc

SEQ ID NO: 7024082 - DNA, 22 bp, Homo sapiens
gctctttggattcctttacaaa

SEQ ID NO: 7024083 - DNA, 22 bp, Homo sapiens
cccaggcacaccccgaacggaa

SEQ ID NO: 7024084 - DNA, 22 bp, Homo sapiens
aaattgtatattccatttgtat

SEQ ID NO: 7024085 - DNA, 22 bp, Homo sapiens
aaggcaatgctaagaggtttgg

SEQ ID NO: 7024086 - DNA, 22 bp, Homo sapiens
tgggccagggcacccagtccag

SEQ ID NO: 7024087 - DNA, 22 bp, Homo sapiens
gcagctgcagagaccgggtggg

SEQ ID NO: 7024088 - DNA, 22 bp, Homo sapiens
tgcctgttgcccacctgataaa

SEQ ID NO: 7024089 - DNA, 22 bp, Homo sapiens
ctctcggggaaggaggtacatt

SEQ ID NO: 7024090 - DNA, 22 bp, Homo sapiens
aggagctccagcccagggaagt

SEQ ID NO: 7024091 - DNA, 18 bp, Homo sapiens
agccatatggagactctg

SEQ ID NO: 7024092 - DNA, 23 bp, Homo sapiens
aggtggcctttgcctctttctct

SEQ ID NO: 7024093 - DNA, 22 bp, Homo sapiens
agctggcaaacagcttacggcc

SEQ ID NO: 7024094 - DNA, 22 bp, Homo sapiens
gcctggggggcatgtcataata

SEQ ID NO: 7024095 - DNA, 22 bp, Homo sapiens
tgctgggtcccttgagagctca

SEQ ID NO: 7024096 - DNA, 22 bp, Homo sapiens
ctggtttatgtatcatctagaa

SEQ ID NO: 7024097 - DNA, 22 bp, Homo sapiens
tcagaagttgagatattcaggg

SEQ ID NO: 7024098 - DNA, 22 bp, Homo sapiens
tgaacagtcatttagaatgtgc

SEQ ID NO: 7024099 - DNA, 20 bp, Homo sapiens
tttgctatgcatatctgacc

SEQ ID NO: 7024100 - DNA, 22 bp, Homo sapiens
tgggccaggcatgtgatcagca

SEQ ID NO: 7024101 - DNA, 22 bp, Homo sapiens
agccttgagttcaagtgctggc

SEQ ID NO: 7024102 - DNA, 22 bp, Homo sapiens
agctaagaacttgagctctgga

SEQ ID NO: 7024103 - DNA, 22 bp, Homo sapiens
tggcttctccctccccatctag

SEQ ID NO: 7024104 - DNA, 22 bp, Homo sapiens
gcaggctgagtattaccctagt

SEQ ID NO: 7024105 - DNA, 22 bp, Homo sapiens
gatggcctcagtgcccaaagga

SEQ ID NO: 7024106 - DNA, 22 bp, Homo sapiens
atactaaagtatagaacttagt

SEQ ID NO: 7024107 - DNA, 22 bp, Homo sapiens
catcagaatgttagagaaggga

SEQ ID NO: 7024108 - DNA, 22 bp, Homo sapiens
ttgggcaggcacatagagttta

SEQ ID NO: 7024109 - DNA, 22 bp, Homo sapiens
tggtctgataccggattccagt

SEQ ID NO: 7024110 - DNA, 22 bp, Homo sapiens
gccttggcaggctgataacatg

SEQ ID NO: 7024111 - DNA, 22 bp, Homo sapiens
ggcagtgaatgaaacagaggct

SEQ ID NO: 7024112 - DNA, 22 bp, Homo sapiens
ccttggcaagacagtggagggt

SEQ ID NO: 7024113 - DNA, 22 bp, Homo sapiens
ggaacctttgtgctccactggg

SEQ ID NO: 7024114 - DNA, 22 bp, Homo sapiens
cagctctctaaggtcttgcttt

SEQ ID NO: 7024115 - DNA, 22 bp, Homo sapiens
tccttcttcatgaagatatatg

SEQ ID NO: 7024116 - DNA, 22 bp, Homo sapiens
agtatgtgtccccccaggagcc

SEQ ID NO: 7024117 - DNA, 22 bp, Homo sapiens
agcatttacctcaatgcatctg

SEQ ID NO: 7024118 - DNA, 22 bp, Homo sapiens
tttaattatatctgggcagtta

SEQ ID NO: 7024119 - DNA, 22 bp, Homo sapiens
tccatacagtgactcaggaatc

SEQ ID NO: 7024120 - DNA, 22 bp, Homo sapiens
acagtgatgccgggcgagaatg

SEQ ID NO: 7024121 - DNA, 20 bp, Homo sapiens
gcctcagccaacccatgggg

SEQ ID NO: 7024122 - DNA, 22 bp, Homo sapiens
tctcattgccttcactcttcag

SEQ ID NO: 7024123 - DNA, 22 bp, Homo sapiens
ctgtttctcccatgtccaagtg

SEQ ID NO: 7024124 - DNA, 22 bp, Homo sapiens
cctctccagcggcctcagggcc

SEQ ID NO: 7024125 - DNA, 22 bp, Homo sapiens
gcctgagagttgaagttcagtg

SEQ ID NO: 7024126 - DNA, 21 bp, Homo sapiens
gcctgcagttttgaagccctt

SEQ ID NO: 7024127 - DNA, 22 bp, Homo sapiens
aatgttctcaacaaaaggaagc

SEQ ID NO: 7024128 - DNA, 22 bp, Homo sapiens
actgactatgtgactttaggca

SEQ ID NO: 7024129 - DNA, 22 bp, Homo sapiens
ctctttagtggtgatgatgcta

SEQ ID NO: 7024130 - DNA, 22 bp, Homo sapiens
gcaggggctaaggacacagaga

SEQ ID NO: 7024131 - DNA, 22 bp, Homo sapiens
tgaagcacatttcttgagatga

SEQ ID NO: 7024132 - DNA, 22 bp, Homo sapiens
tgaacagagctgattcagctca

SEQ ID NO: 7024133 - DNA, 22 bp, Homo sapiens
cctggcacacggtggcattcaa

SEQ ID NO: 7024134 - DNA, 22 bp, Homo sapiens
ggcagttgcgtgcatcagtggt

SEQ ID NO: 7024135 - DNA, 22 bp, Homo sapiens
gtgacagcctcttgggaggttg

SEQ ID NO: 7024136 - DNA, 19 bp, Homo sapiens
cccaactggatccatcata

SEQ ID NO: 7024137 - DNA, 22 bp, Homo sapiens
cttcacattgggcttgatatga

SEQ ID NO: 7024138 - DNA, 22 bp, Homo sapiens
gtgcaaaagtcattgtggtttt

SEQ ID NO: 7024139 - DNA, 22 bp, Homo sapiens
aaggatacttttagagcctgag

SEQ ID NO: 7024140 - DNA, 22 bp, Homo sapiens
aagttcatggtaggttggaagg

SEQ ID NO: 7024141 - DNA, 22 bp, Homo sapiens
gttatacacattcctggtgagg

SEQ ID NO: 7024142 - DNA, 22 bp, Homo sapiens
aatcatgtttacgtgacatgtc

SEQ ID NO: 7024143 - DNA, 17 bp, Homo sapiens
gagtagttacaacagac

SEQ ID NO: 7024144 - DNA, 22 bp, Homo sapiens
tgtgggaatgctgatgggatct

SEQ ID NO: 7024145 - DNA, 22 bp, Homo sapiens
ggacatggagcatgtagagaaa

SEQ ID NO: 7024146 - DNA, 22 bp, Homo sapiens
tccatgttggtgattctaatgt

SEQ ID NO: 7024147 - DNA, 22 bp, Homo sapiens
tgaatgcacattagtaagtgca

SEQ ID NO: 7024148 - DNA, 23 bp, Homo sapiens
tcactagtcaagtgcctttgagt

SEQ ID NO: 7024149 - DNA, 22 bp, Homo sapiens
aaagcagctgtttgactttcca

SEQ ID NO: 7024150 - DNA, 22 bp, Homo sapiens
tctgctgtaaagaatttctgcc

SEQ ID NO: 7024151 - DNA, 22 bp, Homo sapiens
aactactattcttttccaaact

SEQ ID NO: 7024152 - DNA, 22 bp, Homo sapiens
agctgtgttctggttgattcac

SEQ ID NO: 7024153 - DNA, 22 bp, Homo sapiens
aagggtccagcacctcggctcc

SEQ ID NO: 7024154 - DNA, 22 bp, Homo sapiens
aatggctgaaacataatagaag

SEQ ID NO: 7024155 - DNA, 22 bp, Homo sapiens
agaagttttgttgaatgtgtga

SEQ ID NO: 7024156 - DNA, 18 bp, Homo sapiens
acttattcactaggtgga

SEQ ID NO: 7024157 - DNA, 22 bp, Homo sapiens
agccctgcaggatgagggaggt

SEQ ID NO: 7024158 - DNA, 22 bp, Homo sapiens
tttctgtctgacatccctgcct

SEQ ID NO: 7024159 - DNA, 23 bp, Homo sapiens
tcacttgaagctagaatctgccc

SEQ ID NO: 7024160 - DNA, 22 bp, Homo sapiens
caggatgcttctggggccaggc

SEQ ID NO: 7024161 - DNA, 22 bp, Homo sapiens
gtcaatatattctgtctctttg

SEQ ID NO: 7024162 - DNA, 22 bp, Homo sapiens
agttgaattatgagtgtctttg

SEQ ID NO: 7024163 - DNA, 20 bp, Homo sapiens
atataccatcccacaacagg

SEQ ID NO: 7024164 - DNA, 22 bp, Homo sapiens
aggctttcgatgaacgcttgct

SEQ ID NO: 7024165 - DNA, 22 bp, Homo sapiens
cttgctgagataaatgctgtct

SEQ ID NO: 7024166 - DNA, 22 bp, Homo sapiens
ttgtccattgtgacaagtgtgg

SEQ ID NO: 7024167 - DNA, 22 bp, Homo sapiens
tgccaggccctcccacagatta

SEQ ID NO: 7024168 - DNA, 22 bp, Homo sapiens
gattgtacacatctggtgcctt

SEQ ID NO: 7024169 - DNA, 22 bp, Homo sapiens
ctgccctgatatgatttagaac

SEQ ID NO: 7024170 - DNA, 22 bp, Homo sapiens
tcccatttcatgctggctgtgg

SEQ ID NO: 7024171 - DNA, 22 bp, Homo sapiens
atgaagatattcttgttttctg

SEQ ID NO: 7024172 - DNA, 22 bp, Homo sapiens
ggaaggcagaggtgtcgtgggg

SEQ ID NO: 7024173 - DNA, 22 bp, Homo sapiens
catggccagccctgaggttcag

SEQ ID NO: 7024174 - DNA, 22 bp, Homo sapiens
aactgttccttaagatgttaat

SEQ ID NO: 7024175 - DNA, 23 bp, Homo sapiens
ttccagtgagactgagaggtctt

SEQ ID NO: 7024176 - DNA, 19 bp, Homo sapiens
tttcttccaaagactatgg

SEQ ID NO: 7024177 - DNA, 22 bp, Homo sapiens
tacaagaaggaaaactagcaat

SEQ ID NO: 7024178 - DNA, 22 bp, Homo sapiens
cagaggctcaccagcctttcac

SEQ ID NO: 7024179 - DNA, 22 bp, Homo sapiens
cagtgctgttgggcccagagag

SEQ ID NO: 7024180 - DNA, 22 bp, Homo sapiens
aggccagctgttactagagcca

SEQ ID NO: 7024181 - DNA, 22 bp, Homo sapiens
tgcaaatttctttagtacataa

SEQ ID NO: 7024182 - DNA, 22 bp, Homo sapiens
aacaatgtaatctactctgctc

SEQ ID NO: 7024183 - DNA, 22 bp, Homo sapiens
ccaagaggttgaggctgcagtg

SEQ ID NO: 7024184 - DNA, 22 bp, Homo sapiens
catctgtctgcatgctctgggt

SEQ ID NO: 7024185 - DNA, 22 bp, Homo sapiens
ttcaaaaaggtatgttcaagtc

SEQ ID NO: 7024186 - DNA, 22 bp, Homo sapiens
ctagcatcagatgagaagctgt

SEQ ID NO: 7024187 - DNA, 22 bp, Homo sapiens
tctggctgggctgacattgaac

SEQ ID NO: 7024188 - DNA, 22 bp, Homo sapiens
aacccactctacctggctccat

SEQ ID NO: 7024189 - DNA, 22 bp, Homo sapiens
tcattgcaggcattcccctgcc

SEQ ID NO: 7024190 - DNA, 22 bp, Homo sapiens
tattccagccgcttgagctcgc

SEQ ID NO: 7024191 - DNA, 22 bp, Homo sapiens
acaccagtttcttaagaatatt

SEQ ID NO: 7024192 - DNA, 22 bp, Homo sapiens
tattattaaatggcagaatttt

SEQ ID NO: 7024193 - DNA, 22 bp, Homo sapiens
atcaacatgtcataaagtgaaa

SEQ ID NO: 7024194 - DNA, 22 bp, Homo sapiens
gatctagaccagaagctgttgt

SEQ ID NO: 7024195 - DNA, 22 bp, Homo sapiens
caggcagacatttttgacatag

SEQ ID NO: 7024196 - DNA, 22 bp, Homo sapiens
gccccttccatcatgtgaggac

SEQ ID NO: 7024197 - DNA, 22 bp, Homo sapiens
gaaggtgtgcagggccaaagtt

SEQ ID NO: 7024198 - DNA, 23 bp, Homo sapiens
agtctggaagtgcagtggctgga

SEQ ID NO: 7024199 - DNA, 22 bp, Homo sapiens
ttgtttttatgaacatccagga

SEQ ID NO: 7024200 - DNA, 22 bp, Homo sapiens
tgtgttctggctgtgacagctg

SEQ ID NO: 7024201 - DNA, 22 bp, Homo sapiens
gatggcaggtgatagccgagtc

SEQ ID NO: 7024202 - DNA, 22 bp, Homo sapiens
agtgcaagctccataatcttca

SEQ ID NO: 7024203 - DNA, 22 bp, Homo sapiens
cacagaattttctctttacaat

SEQ ID NO: 7024204 - DNA, 22 bp, Homo sapiens
aaacatgatgcctgtactaaga

SEQ ID NO: 7024205 - DNA, 22 bp, Homo sapiens
cccacatctcacatcttggaac

SEQ ID NO: 7024206 - DNA, 22 bp, Homo sapiens
ccccactctcggccagataggc

SEQ ID NO: 7024207 - DNA, 20 bp, Homo sapiens
ttggcagcttcagggtacta

SEQ ID NO: 7024208 - DNA, 22 bp, Homo sapiens
aaaatagcagggatgtgggaaa

SEQ ID NO: 7024209 - DNA, 22 bp, Homo sapiens
atggctaaacctgaactggtct

SEQ ID NO: 7024210 - DNA, 23 bp, Homo sapiens
ctgcctgctggggagacagatct

SEQ ID NO: 7024211 - DNA, 22 bp, Homo sapiens
tcttcaaatgagtgtggattat

SEQ ID NO: 7024212 - DNA, 22 bp, Homo sapiens
ttccagaccattccacgggaga

SEQ ID NO: 7024213 - DNA, 22 bp, Homo sapiens
acatatctgttagacacagcag

SEQ ID NO: 7024214 - DNA, 22 bp, Homo sapiens
acaggcttttttgctctcgaat

SEQ ID NO: 7024215 - DNA, 22 bp, Homo sapiens
caagaagaggtgattggtaagt

SEQ ID NO: 7024216 - DNA, 22 bp, Homo sapiens
ctgagctgggcaactcttagat

SEQ ID NO: 7024217 - DNA, 22 bp, Homo sapiens
agctttctccctgacgctttgg

SEQ ID NO: 7024218 - DNA, 22 bp, Homo sapiens
cctaaggtctcatgcagctttt

SEQ ID NO: 7024219 - DNA, 22 bp, Homo sapiens
tgggagataattcattgtgttc

SEQ ID NO: 7024220 - DNA, 22 bp, Homo sapiens
tttagcattcctgggatgattt

SEQ ID NO: 7024221 - DNA, 22 bp, Homo sapiens
tctagagactataatgtgtcct

SEQ ID NO: 7024222 - DNA, 22 bp, Homo sapiens
aagtctgtagaaaaacagttta

SEQ ID NO: 7024223 - DNA, 22 bp, Homo sapiens
gaaacttgataattgaaacaga

SEQ ID NO: 7024224 - DNA, 22 bp, Homo sapiens
tctaagccaggactgagagacg

SEQ ID NO: 7024225 - DNA, 22 bp, Homo sapiens
ggcaggcacagtaatacatgtt

SEQ ID NO: 7024226 - DNA, 22 bp, Homo sapiens
ctggctgttttcaatgttgatg

SEQ ID NO: 7024227 - DNA, 22 bp, Homo sapiens
ggaaacattccaagagttgaaa

SEQ ID NO: 7024228 - DNA, 22 bp, Homo sapiens
ctggcaccaggcatgctgggag

SEQ ID NO: 7024229 - DNA, 22 bp, Homo sapiens
tcaggcctgccctgaaagcaca

SEQ ID NO: 7024230 - DNA, 22 bp, Homo sapiens
accaagatttaacatgcctttt

SEQ ID NO: 7024231 - DNA, 22 bp, Homo sapiens
ttctagttcttaggaacagaca

SEQ ID NO: 7024232 - DNA, 22 bp, Homo sapiens
agcagccacccagctgctcatt

SEQ ID NO: 7024233 - DNA, 22 bp, Homo sapiens
ccacttgcaaaagagaaagtta

SEQ ID NO: 7024234 - DNA, 20 bp, Homo sapiens
gtgtctgcatatagcaggtg

SEQ ID NO: 7024235 - DNA, 22 bp, Homo sapiens
ttctcccagaccaaaggcagca

SEQ ID NO: 7024236 - DNA, 22 bp, Homo sapiens
caggaaattcaagagaggctgc

SEQ ID NO: 7024237 - DNA, 22 bp, Homo sapiens
attggcatgacagatttgaggc

SEQ ID NO: 7024238 - DNA, 22 bp, Homo sapiens
atatggctgttgcacatctaag

SEQ ID NO: 7024239 - DNA, 22 bp, Homo sapiens
gctggcacctgcaccaagcagg

SEQ ID NO: 7024240 - DNA, 19 bp, Homo sapiens
atgtttgcttgagtaataa

SEQ ID NO: 7024241 - DNA, 19 bp, Homo sapiens
tcgcagacctgagttctaa

SEQ ID NO: 7024242 - DNA, 22 bp, Homo sapiens
acacaggagaaaagatctccca

SEQ ID NO: 7024243 - DNA, 22 bp, Homo sapiens
tggaacgtcgtaatgttggtta

SEQ ID NO: 7024244 - DNA, 22 bp, Homo sapiens
tgccttttccagcttccaggag

SEQ ID NO: 7024245 - DNA, 21 bp, Homo sapiens
tctgtagatctgagtctgtct

SEQ ID NO: 7024246 - DNA, 22 bp, Homo sapiens
atgaaaagggagtgatatttgt

SEQ ID NO: 7024247 - DNA, 22 bp, Homo sapiens
ctctggggttagatctgatgct

SEQ ID NO: 7024248 - DNA, 22 bp, Homo sapiens
gcccaggaggttgggctgtgca

SEQ ID NO: 7024249 - DNA, 22 bp, Homo sapiens
aaaagagtgactgataagtata

SEQ ID NO: 7024250 - DNA, 22 bp, Homo sapiens
taggctctccaagcccaggacc

SEQ ID NO: 7024251 - DNA, 22 bp, Homo sapiens
ttgaaggacatcttgtttctag

SEQ ID NO: 7024252 - DNA, 22 bp, Homo sapiens
gctttagaaatgtaggagatac

SEQ ID NO: 7024253 - DNA, 22 bp, Homo sapiens
attatgaagttgagggaccctg

SEQ ID NO: 7024254 - DNA, 22 bp, Homo sapiens
ctctcctacatttcattcacaa

SEQ ID NO: 7024255 - DNA, 19 bp, Homo sapiens
ggcatccacagctggagag

SEQ ID NO: 7024256 - DNA, 22 bp, Homo sapiens
attcttattatagtaaaacagt

SEQ ID NO: 7024257 - DNA, 18 bp, Homo sapiens
gctttttagtgcatcttc

SEQ ID NO: 7024258 - DNA, 22 bp, Homo sapiens
atattcatcgtgtagaaatact

SEQ ID NO: 7024259 - DNA, 22 bp, Homo sapiens
cctcctctgggaagattcagag

SEQ ID NO: 7024260 - DNA, 22 bp, Homo sapiens
tgcttctcaaagaagcataatg

SEQ ID NO: 7024261 - DNA, 22 bp, Homo sapiens
ttgaggtaataaacagccattc

SEQ ID NO: 7024262 - DNA, 22 bp, Homo sapiens
ttctatattgttaaaggttata

SEQ ID NO: 7024263 - DNA, 22 bp, Homo sapiens
ccatggctcttaccttgttata

SEQ ID NO: 7024264 - DNA, 22 bp, Homo sapiens
acaatgcatacctagcagctca

SEQ ID NO: 7024265 - DNA, 22 bp, Homo sapiens
gaccactgaatgcacttctaat

SEQ ID NO: 7024266 - DNA, 20 bp, Homo sapiens
gcagtccagatgcttttaac

SEQ ID NO: 7024267 - DNA, 22 bp, Homo sapiens
agttattcccttctggaggaga

SEQ ID NO: 7024268 - DNA, 22 bp, Homo sapiens
cagtcctgctagtgtgaaaagc

SEQ ID NO: 7024269 - DNA, 22 bp, Homo sapiens
tgtgccaatttgttcaggtaag

SEQ ID NO: 7024270 - DNA, 22 bp, Homo sapiens
agccagctggtgggtcagctgg

SEQ ID NO: 7024271 - DNA, 22 bp, Homo sapiens
gtacattggcaactctcttaga

SEQ ID NO: 7024272 - DNA, 22 bp, Homo sapiens
gtgggacaaggatgaagatatt

SEQ ID NO: 7024273 - DNA, 22 bp, Homo sapiens
ggctcctgtagatctctaaagc

SEQ ID NO: 7024274 - DNA, 22 bp, Homo sapiens
actcttgacgggtgaggatatg

SEQ ID NO: 7024275 - DNA, 22 bp, Homo sapiens
tagtaaaaagcaatggtgagta

SEQ ID NO: 7024276 - DNA, 22 bp, Homo sapiens
ccagtcactctgtgagagctac

SEQ ID NO: 7024277 - DNA, 22 bp, Homo sapiens
aagattgttttgggggaagtgg

SEQ ID NO: 7024278 - DNA, 22 bp, Homo sapiens
gtaggctgtgtgaggctagaga

SEQ ID NO: 7024279 - DNA, 22 bp, Homo sapiens
gtgtcgtgcttgccatgggtac

SEQ ID NO: 7024280 - DNA, 22 bp, Homo sapiens
tgttgattagtgtttagactta

SEQ ID NO: 7024281 - DNA, 22 bp, Homo sapiens
aagtgcctgggcaacatagcaa

SEQ ID NO: 7024282 - DNA, 22 bp, Homo sapiens
tcctagagcctccagagggaga

SEQ ID NO: 7024283 - DNA, 22 bp, Homo sapiens
tctggctccgtgtccgctccca

SEQ ID NO: 7024284 - DNA, 22 bp, Homo sapiens
gaagtcttttcttccacccaaa

SEQ ID NO: 7024285 - DNA, 22 bp, Homo sapiens
gctgagctgaggcagggctggg

SEQ ID NO: 7024286 - DNA, 22 bp, Homo sapiens
tctccaggtgaaacttgcaggg

SEQ ID NO: 7024287 - DNA, 22 bp, Homo sapiens
attgtgtagtagtattctgttt

SEQ ID NO: 7024288 - DNA, 22 bp, Homo sapiens
agcctctttttcaaggtccaca

SEQ ID NO: 7024289 - DNA, 22 bp, Homo sapiens
agccaggaatgcatgctctgct

SEQ ID NO: 7024290 - DNA, 22 bp, Homo sapiens
tggtcacacatgtatctcaatg

SEQ ID NO: 7024291 - DNA, 22 bp, Homo sapiens
cactgagttccctgacatttca

SEQ ID NO: 7024292 - DNA, 22 bp, Homo sapiens
ggaacagcgtggggctctcctg

SEQ ID NO: 7024293 - DNA, 22 bp, Homo sapiens
atttggaatgctagtgaatgta

SEQ ID NO: 7024294 - DNA, 22 bp, Homo sapiens
agccaagtgtctccgtttactc

SEQ ID NO: 7024295 - DNA, 22 bp, Homo sapiens
aaacagtgtgtttcagagaggc

SEQ ID NO: 7024296 - DNA, 22 bp, Homo sapiens
agagctgttcaacgtagcaatg

SEQ ID NO: 7024297 - DNA, 22 bp, Homo sapiens
gcatggcattaacaagatggaa

SEQ ID NO: 7024298 - DNA, 22 bp, Homo sapiens
gctctgtgctagaactaagaat

SEQ ID NO: 7024299 - DNA, 22 bp, Homo sapiens
cccctctggtcaaccagtcaca

SEQ ID NO: 7024300 - DNA, 22 bp, Homo sapiens
tgaagtctttcagggctagaat

SEQ ID NO: 7024301 - DNA, 22 bp, Homo sapiens
aggcctttgtacaataatcata

SEQ ID NO: 7024302 - DNA, 22 bp, Homo sapiens
tcacaaatatagtgagaaccag

SEQ ID NO: 7024303 - DNA, 22 bp, Homo sapiens
gcatgcagagtccctctgcatt

SEQ ID NO: 7024304 - DNA, 22 bp, Homo sapiens
ggagctgaaggggtgggctcag

SEQ ID NO: 7024305 - DNA, 19 bp, Homo sapiens
agatggctaggatcaccct

SEQ ID NO: 7024306 - DNA, 18 bp, Homo sapiens
atctttccatagcatgtt

SEQ ID NO: 7024307 - DNA, 22 bp, Homo sapiens
gtgatttcaaatatagagtgag

SEQ ID NO: 7024308 - DNA, 17 bp, Homo sapiens
gccagggagaggaagcc

SEQ ID NO: 7024309 - DNA, 22 bp, Homo sapiens
tgtacacattaagctctttaga

SEQ ID NO: 7024310 - DNA, 22 bp, Homo sapiens
agcaggttaaaccaaaatataa

SEQ ID NO: 7024311 - DNA, 22 bp, Homo sapiens
gcagacagactgcagtgatttt

SEQ ID NO: 7024312 - DNA, 21 bp, Homo sapiens
agcagtgctcctgggatgagg

SEQ ID NO: 7024313 - DNA, 22 bp, Homo sapiens
atatatgtgcaggctcacacat

SEQ ID NO: 7024314 - DNA, 22 bp, Homo sapiens
ttgcaaagttccctacacatgt

SEQ ID NO: 7024315 - DNA, 22 bp, Homo sapiens
aatgcattccactgagatttgt

SEQ ID NO: 7024316 - DNA, 22 bp, Homo sapiens
atgtttacagaggaagtgcctc

SEQ ID NO: 7024317 - DNA, 22 bp, Homo sapiens
cctccaaggtgagagaggatgg

SEQ ID NO: 7024318 - DNA, 21 bp, Homo sapiens
tagagtgtctgtgtgggaatt

SEQ ID NO: 7024319 - DNA, 22 bp, Homo sapiens
atactgaaggcattcagataac

SEQ ID NO: 7024320 - DNA, 22 bp, Homo sapiens
aggtaaggggctcccaagtccc

SEQ ID NO: 7024321 - DNA, 22 bp, Homo sapiens
gctcagagaatttactgctgcc

SEQ ID NO: 7024322 - DNA, 22 bp, Homo sapiens
gaggtcaaggtcaagagacaga

SEQ ID NO: 7024323 - DNA, 22 bp, Homo sapiens
aacactgagaacaatacagagt

SEQ ID NO: 7024324 - DNA, 22 bp, Homo sapiens
aatgaacatgggagtactaata

SEQ ID NO: 7024325 - DNA, 23 bp, Homo sapiens
ggcatcttgtctagagaaatctg

SEQ ID NO: 7024326 - DNA, 22 bp, Homo sapiens
acttggtggcgaacgagggtca

SEQ ID NO: 7024327 - DNA, 22 bp, Homo sapiens
cagtgaggtgcccagcctgccc

SEQ ID NO: 7024328 - DNA, 22 bp, Homo sapiens
cttttacagtggacctgccatt

SEQ ID NO: 7024329 - DNA, 22 bp, Homo sapiens
taggacttggtgactctcaatg

SEQ ID NO: 7024330 - DNA, 22 bp, Homo sapiens
aacatagacccagttcaacaaa

SEQ ID NO: 7024331 - DNA, 22 bp, Homo sapiens
ctagtgcctgtccctacccaaa

SEQ ID NO: 7024332 - DNA, 22 bp, Homo sapiens
aaggctgaggtagggcctaaaa

SEQ ID NO: 7024333 - DNA, 22 bp, Homo sapiens
gcacgagtgtctcacggagtca

SEQ ID NO: 7024334 - DNA, 22 bp, Homo sapiens
tttcagagctctaggctctcag

SEQ ID NO: 7024335 - DNA, 22 bp, Homo sapiens
ttctggataggggtatggagct

SEQ ID NO: 7024336 - DNA, 22 bp, Homo sapiens
caaatcaccacttaatgggtta

SEQ ID NO: 7024337 - DNA, 23 bp, Homo sapiens
gtgattctctctgtgtgggcagg

SEQ ID NO: 7024338 - DNA, 22 bp, Homo sapiens
aactctttccctttggtgccac

SEQ ID NO: 7024339 - DNA, 22 bp, Homo sapiens
gagtacttaactccaaatagga

SEQ ID NO: 7024340 - DNA, 22 bp, Homo sapiens
agagctggacgtctgagcccta

SEQ ID NO: 7024341 - DNA, 22 bp, Homo sapiens
ctctgctgtctccagggcagtc

SEQ ID NO: 7024342 - DNA, 22 bp, Homo sapiens
catgtaaaaagaagaatctgga

SEQ ID NO: 7024343 - DNA, 22 bp, Homo sapiens
cctgagtcttcccaaaactcct

SEQ ID NO: 7024344 - DNA, 22 bp, Homo sapiens
tcagcttgtttatgataagcag

SEQ ID NO: 7024345 - DNA, 23 bp, Homo sapiens
gggggcgtgtcatggagggccac

SEQ ID NO: 7024346 - DNA, 22 bp, Homo sapiens
ggcttcaggggcccagtcagca

SEQ ID NO: 7024347 - DNA, 22 bp, Homo sapiens
gagggcactgggtttcaatgtc

SEQ ID NO: 7024348 - DNA, 22 bp, Homo sapiens
tatgtacaatcagcagttcata

SEQ ID NO: 7024349 - DNA, 19 bp, Homo sapiens
cttggtgcttgcccttggc

SEQ ID NO: 7024350 - DNA, 22 bp, Homo sapiens
gcactaggtaagtgggtggcaa

SEQ ID NO: 7024351 - DNA, 22 bp, Homo sapiens
atgctaaggcccaggagaaaat

SEQ ID NO: 7024352 - DNA, 22 bp, Homo sapiens
gactgaaggtctcagcatgtga

SEQ ID NO: 7024353 - DNA, 22 bp, Homo sapiens
agcaggcttactttctgattag

SEQ ID NO: 7024354 - DNA, 22 bp, Homo sapiens
ggcgtggggccttctgcccgct

SEQ ID NO: 7024355 - DNA, 22 bp, Homo sapiens
aacatccccttcatgtcatgat

SEQ ID NO: 7024356 - DNA, 22 bp, Homo sapiens
tggcttggtgagcagagtgtag

SEQ ID NO: 7024357 - DNA, 22 bp, Homo sapiens
aatagcttatgggatagatgtt

SEQ ID NO: 7024358 - DNA, 22 bp, Homo sapiens
gacttaagtggtgtgataagtg

SEQ ID NO: 7024359 - DNA, 22 bp, Homo sapiens
tgagattttaatattgagaaaa

SEQ ID NO: 7024360 - DNA, 22 bp, Homo sapiens
ccacagaacctcagctttgagc

SEQ ID NO: 7024361 - DNA, 22 bp, Homo sapiens
tcttccagtgctgtgtagagct

SEQ ID NO: 7024362 - DNA, 21 bp, Homo sapiens
tacagcaccgagtaggccctc

SEQ ID NO: 7024363 - DNA, 22 bp, Homo sapiens
atgaataaacaggtgcctcttc

SEQ ID NO: 7024364 - DNA, 22 bp, Homo sapiens
gggggatgctcaggaggctgct

SEQ ID NO: 7024365 - DNA, 22 bp, Homo sapiens
tggcttgtcatgtatctgaggc

SEQ ID NO: 7024366 - DNA, 20 bp, Homo sapiens
ttctgtcagattatatggga

SEQ ID NO: 7024367 - DNA, 22 bp, Homo sapiens
gagctcttctggttagatgttg

SEQ ID NO: 7024368 - DNA, 22 bp, Homo sapiens
tagttacaggagtttctgaaat

SEQ ID NO: 7024369 - DNA, 22 bp, Homo sapiens
gcaagtgattgtcacgtccctt

SEQ ID NO: 7024370 - DNA, 22 bp, Homo sapiens
tcagggcccagtctgtgcatct

SEQ ID NO: 7024371 - DNA, 22 bp, Homo sapiens
atgtaattctaagactgaagaa

SEQ ID NO: 7024372 - DNA, 22 bp, Homo sapiens
gtcctagagggtgagctaggct

SEQ ID NO: 7024373 - DNA, 22 bp, Homo sapiens
gcacatacgtcagtggctgtca

SEQ ID NO: 7024374 - DNA, 22 bp, Homo sapiens
tttgaagtccatctggcccagt

SEQ ID NO: 7024375 - DNA, 22 bp, Homo sapiens
ttccactcatgcaaaggtccca

SEQ ID NO: 7024376 - DNA, 22 bp, Homo sapiens
catgtagtcctaatgctggtga

SEQ ID NO: 7024377 - DNA, 22 bp, Homo sapiens
agtgacgtttattgggtgtgaa

SEQ ID NO: 7024378 - DNA, 22 bp, Homo sapiens
ttctgcataacttcctgggtca

SEQ ID NO: 7024379 - DNA, 22 bp, Homo sapiens
tcaggaattttgttctgtatcc

SEQ ID NO: 7024380 - DNA, 18 bp, Homo sapiens
tgaacttttcctgctgct

SEQ ID NO: 7024381 - DNA, 22 bp, Homo sapiens
ataaatagtgaagggagccggt

SEQ ID NO: 7024382 - DNA, 20 bp, Homo sapiens
gctggaagggctagagggct

SEQ ID NO: 7024383 - DNA, 22 bp, Homo sapiens
atgtttactgaaaagatttcaa

SEQ ID NO: 7024384 - DNA, 22 bp, Homo sapiens
ctaatatttttagaaatcacga

SEQ ID NO: 7024385 - DNA, 22 bp, Homo sapiens
ggcaggtggcactgctgctccc

SEQ ID NO: 7024386 - DNA, 22 bp, Homo sapiens
agtcacttaatctaagtctcag

SEQ ID NO: 7024387 - DNA, 22 bp, Homo sapiens
taaggccaaactattatagttc

SEQ ID NO: 7024388 - DNA, 22 bp, Homo sapiens
tacagctagagggcacgtgaac

SEQ ID NO: 7024389 - DNA, 22 bp, Homo sapiens
tctaacttgtgagtatagatga

SEQ ID NO: 7024390 - DNA, 22 bp, Homo sapiens
ggccctggcagccacgaaagcc

SEQ ID NO: 7024391 - DNA, 22 bp, Homo sapiens
aaagctgctgtgaatggtttgg

SEQ ID NO: 7024392 - DNA, 22 bp, Homo sapiens
gattgaaagactgtttgggaga

SEQ ID NO: 7024393 - DNA, 22 bp, Homo sapiens
ctgggagagacacttctgatta

SEQ ID NO: 7024394 - DNA, 22 bp, Homo sapiens
ccagctgcagaatgttggggaa

SEQ ID NO: 7024395 - DNA, 22 bp, Homo sapiens
tggccaggctggtctggaacgc

SEQ ID NO: 7024396 - DNA, 22 bp, Homo sapiens
gagattggatttaatggccaaa

SEQ ID NO: 7024397 - DNA, 22 bp, Homo sapiens
gcttttaattagttgcttccat

SEQ ID NO: 7024398 - DNA, 20 bp, Homo sapiens
accagagatagcaatagtgc

SEQ ID NO: 7024399 - DNA, 22 bp, Homo sapiens
cgggtcacctatcaattttgtg

SEQ ID NO: 7024400 - DNA, 22 bp, Homo sapiens
aagttacacagagttggaggct

SEQ ID NO: 7024401 - DNA, 22 bp, Homo sapiens
tcagcccttgatgtttgggggt

SEQ ID NO: 7024402 - DNA, 22 bp, Homo sapiens
aagccagggattcctgagggag

SEQ ID NO: 7024403 - DNA, 22 bp, Homo sapiens
aggaatgtggaaggtggcggcg

SEQ ID NO: 7024404 - DNA, 21 bp, Homo sapiens
agcagcagatctggtgagggc

SEQ ID NO: 7024405 - DNA, 22 bp, Homo sapiens
gcttctgcgcacgcttcttccc

SEQ ID NO: 7024406 - DNA, 22 bp, Homo sapiens
agttggaccttgggaaaaggta

SEQ ID NO: 7024407 - DNA, 22 bp, Homo sapiens
gcagtagaaatttcattgctct

SEQ ID NO: 7024408 - DNA, 22 bp, Homo sapiens
atagacatatggctttgtttct

SEQ ID NO: 7024409 - DNA, 22 bp, Homo sapiens
agtgctggcccatagctgctgg

SEQ ID NO: 7024410 - DNA, 22 bp, Homo sapiens
ttgagatggagcctcagtcttg

SEQ ID NO: 7024411 - DNA, 22 bp, Homo sapiens
gctagggatttctttctcacta

SEQ ID NO: 7024412 - DNA, 22 bp, Homo sapiens
gtggtcctggcaaccatggtga

SEQ ID NO: 7024413 - DNA, 22 bp, Homo sapiens
aaaattggttcctttctgaggc

SEQ ID NO: 7024414 - DNA, 22 bp, Homo sapiens
aatgcttattattaatagaatg

SEQ ID NO: 7024415 - DNA, 22 bp, Homo sapiens
atgtggattgtaggaaactgat

SEQ ID NO: 7024416 - DNA, 23 bp, Homo sapiens
agtgtttatgttcagtgaccctc

SEQ ID NO: 7024417 - DNA, 22 bp, Homo sapiens
tgtttccaaagtcttttcttaa

SEQ ID NO: 7024418 - DNA, 22 bp, Homo sapiens
tcccacagaccatgagtggaag

SEQ ID NO: 7024419 - DNA, 22 bp, Homo sapiens
gtccagtgttggaggttttacc

SEQ ID NO: 7024420 - DNA, 23 bp, Homo sapiens
agtcaagatgcatctgtgaggaa

SEQ ID NO: 7024421 - DNA, 22 bp, Homo sapiens
cagaggattatggagatggtct

SEQ ID NO: 7024422 - DNA, 22 bp, Homo sapiens
tattgtgttttctctgtgcgga

SEQ ID NO: 7024423 - DNA, 22 bp, Homo sapiens
gctgtgtgaaaactgggcctgg

SEQ ID NO: 7024424 - DNA, 22 bp, Homo sapiens
taaagagcgatatgctttaaag

SEQ ID NO: 7024425 - DNA, 22 bp, Homo sapiens
gctcctgtttgtttgttcctga

SEQ ID NO: 7024426 - DNA, 22 bp, Homo sapiens
ctgggccttggattgacactgt

SEQ ID NO: 7024427 - DNA, 22 bp, Homo sapiens
actggaaatgagatgatatcag

SEQ ID NO: 7024428 - DNA, 20 bp, Homo sapiens
caggtattacttcctttatg

SEQ ID NO: 7024429 - DNA, 22 bp, Homo sapiens
atgcaatatgtgtttctgttta

SEQ ID NO: 7024430 - DNA, 22 bp, Homo sapiens
aagcattctgcattttcaaaga

SEQ ID NO: 7024431 - DNA, 22 bp, Homo sapiens
acagcatcatatagtggaagaa

SEQ ID NO: 7024432 - DNA, 22 bp, Homo sapiens
tgagggtggccttgtgtggact

SEQ ID NO: 7024433 - DNA, 22 bp, Homo sapiens
tgcttctgaagtggatgggtgc

SEQ ID NO: 7024434 - DNA, 22 bp, Homo sapiens
tacctgcaaagttccttttgcc

SEQ ID NO: 7024435 - DNA, 22 bp, Homo sapiens
cccaagttaatttgtagctgaa

SEQ ID NO: 7024436 - DNA, 22 bp, Homo sapiens
ctacaagtggagttctgacgca

SEQ ID NO: 7024437 - DNA, 22 bp, Homo sapiens
ttcagcaatgggatggtgcagg

SEQ ID NO: 7024438 - DNA, 22 bp, Homo sapiens
gactggtaaggtattggaattc

SEQ ID NO: 7024439 - DNA, 22 bp, Homo sapiens
agacaggcagaggctgcagagg

SEQ ID NO: 7024440 - DNA, 22 bp, Homo sapiens
ctccagctcttaactgcggaag

SEQ ID NO: 7024441 - DNA, 22 bp, Homo sapiens
tatgtgtatgttcattcatgca

SEQ ID NO: 7024442 - DNA, 22 bp, Homo sapiens
tgcaggtgattctgatgcagtt

SEQ ID NO: 7024443 - DNA, 22 bp, Homo sapiens
accagtatgtgccttcagtgtc

SEQ ID NO: 7024444 - DNA, 20 bp, Homo sapiens
tcttccaggtacagtctgca

SEQ ID NO: 7024445 - DNA, 22 bp, Homo sapiens
ggaatgtagtttgtgcactgta

SEQ ID NO: 7024446 - DNA, 22 bp, Homo sapiens
gatcttctatgtaatgaagtgt

SEQ ID NO: 7024447 - DNA, 23 bp, Homo sapiens
agggctagcattgagtacccact

SEQ ID NO: 7024448 - DNA, 22 bp, Homo sapiens
atgtacacatgcatgcatgtgc

SEQ ID NO: 7024449 - DNA, 22 bp, Homo sapiens
atttgctgaatcaatgaatttt

SEQ ID NO: 7024450 - DNA, 22 bp, Homo sapiens
caggggtgtttttggccaggag

SEQ ID NO: 7024451 - DNA, 22 bp, Homo sapiens
agcagggactacgtgaaagtga

SEQ ID NO: 7024452 - DNA, 22 bp, Homo sapiens
tattcccagcacatggccattt

SEQ ID NO: 7024453 - DNA, 22 bp, Homo sapiens
cacacaggagagtgctggaggt

SEQ ID NO: 7024454 - DNA, 22 bp, Homo sapiens
ttactgttggttggtaagagtt

SEQ ID NO: 7024455 - DNA, 22 bp, Homo sapiens
tgtgtgtagaaagggccctggt

SEQ ID NO: 7024456 - DNA, 20 bp, Homo sapiens
aggaactggaagggaggaaa

SEQ ID NO: 7024457 - DNA, 22 bp, Homo sapiens
ctccaggctggggtgcaggttg

SEQ ID NO: 7024458 - DNA, 22 bp, Homo sapiens
ctgggacctcggggtgatcaaa

SEQ ID NO: 7024459 - DNA, 22 bp, Homo sapiens
tcccaggcagcttctttcatca

SEQ ID NO: 7024460 - DNA, 20 bp, Homo sapiens
aacactgcttctatattttc

SEQ ID NO: 7024461 - DNA, 22 bp, Homo sapiens
tgagctctgacttttgggaatt

SEQ ID NO: 7024462 - DNA, 22 bp, Homo sapiens
aagcacagatgcaagggggacc

SEQ ID NO: 7024463 - DNA, 22 bp, Homo sapiens
tgtcccagatcacaggagggga

SEQ ID NO: 7024464 - DNA, 22 bp, Homo sapiens
atggactaggaaagataaagat

SEQ ID NO: 7024465 - DNA, 22 bp, Homo sapiens
cttcctcctccatctcgaaggc

SEQ ID NO: 7024466 - DNA, 22 bp, Homo sapiens
acagtttataaaaataatgagg

SEQ ID NO: 7024467 - DNA, 22 bp, Homo sapiens
agaaatcaatgaagtctgctaa

SEQ ID NO: 7024468 - DNA, 22 bp, Homo sapiens
aaattaagagtaactctgtaga

SEQ ID NO: 7024469 - DNA, 22 bp, Homo sapiens
cagtcttgctttactgagatgg

SEQ ID NO: 7024470 - DNA, 22 bp, Homo sapiens
aagaggttattgttcccagctt

SEQ ID NO: 7024471 - DNA, 22 bp, Homo sapiens
ccagggcaataggaacactttt

SEQ ID NO: 7024472 - DNA, 22 bp, Homo sapiens
agctactcagagttccactcta

SEQ ID NO: 7024473 - DNA, 20 bp, Homo sapiens
cccagaggttgcggcaggag

SEQ ID NO: 7024474 - DNA, 22 bp, Homo sapiens
taggctaaagctccggctctgg

SEQ ID NO: 7024475 - DNA, 22 bp, Homo sapiens
gcacacagctagattaccattc

SEQ ID NO: 7024476 - DNA, 22 bp, Homo sapiens
aaactttaaatttgtacctctg

SEQ ID NO: 7024477 - DNA, 22 bp, Homo sapiens
catagcaagatcacattctgta

SEQ ID NO: 7024478 - DNA, 22 bp, Homo sapiens
tccagagccttcgataagaaga

SEQ ID NO: 7024479 - DNA, 22 bp, Homo sapiens
aagaacagtgtcctgggactcg

SEQ ID NO: 7024480 - DNA, 22 bp, Homo sapiens
gcagccaggaagcccaggacac

SEQ ID NO: 7024481 - DNA, 22 bp, Homo sapiens
tcagatctggtgaagttatagt

SEQ ID NO: 7024482 - DNA, 19 bp, Homo sapiens
cttgtgcagttcacgctca

SEQ ID NO: 7024483 - DNA, 22 bp, Homo sapiens
aaaacctgattgaattctattt

SEQ ID NO: 7024484 - DNA, 22 bp, Homo sapiens
ctgtgccttctacttcactcta

SEQ ID NO: 7024485 - DNA, 22 bp, Homo sapiens
aaccatgtcttgttttcctagt

SEQ ID NO: 7024486 - DNA, 22 bp, Homo sapiens
aaataagtagtttagtgttgtg

SEQ ID NO: 7024487 - DNA, 22 bp, Homo sapiens
tttgacatgtgcttataacttt

SEQ ID NO: 7024488 - DNA, 22 bp, Homo sapiens
accacatcgggcggacactggg

SEQ ID NO: 7024489 - DNA, 22 bp, Homo sapiens
cgatgccacggacttgttcctg

SEQ ID NO: 7024490 - DNA, 22 bp, Homo sapiens
ggggcggggctctgagaagcat

SEQ ID NO: 7024491 - DNA, 17 bp, Homo sapiens
ttcacatccgagaacaa

SEQ ID NO: 7024492 - DNA, 22 bp, Homo sapiens
gcctcgaggctgagaaggcaca

SEQ ID NO: 7024493 - DNA, 22 bp, Homo sapiens
tagggcaatatttcccagaaaa

SEQ ID NO: 7024494 - DNA, 22 bp, Homo sapiens
tgaaacattgcactgtatgaat

SEQ ID NO: 7024495 - DNA, 22 bp, Homo sapiens
ggactgtagacatcagcctgta

SEQ ID NO: 7024496 - DNA, 23 bp, Homo sapiens
gctgtttcacaacagccgtgttt

SEQ ID NO: 7024497 - DNA, 22 bp, Homo sapiens
cagcacatctgattatatgact

SEQ ID NO: 7024498 - DNA, 22 bp, Homo sapiens
atggatttggatgagattactt

SEQ ID NO: 7024499 - DNA, 20 bp, Homo sapiens
ctgtgcctcctgctagtcct

SEQ ID NO: 7024500 - DNA, 22 bp, Homo sapiens
tgtgcacctagggcattttcca

SEQ ID NO: 7024501 - DNA, 22 bp, Homo sapiens
caaacctgtccttttgtctcct

SEQ ID NO: 7024502 - DNA, 18 bp, Homo sapiens
ctgcccagagcacttgtg

SEQ ID NO: 7024503 - DNA, 22 bp, Homo sapiens
tctgctcataccccatggtttc

SEQ ID NO: 7024504 - DNA, 22 bp, Homo sapiens
aatcagaacttctcagggtggg

SEQ ID NO: 7024505 - DNA, 22 bp, Homo sapiens
ccactgcctgacttagatgaca

SEQ ID NO: 7024506 - DNA, 22 bp, Homo sapiens
ctacagctgtaaaaggaatgtc

SEQ ID NO: 7024507 - DNA, 21 bp, Homo sapiens
aggctgtcctttgccagccct

SEQ ID NO: 7024508 - DNA, 22 bp, Homo sapiens
tcaggagactggcagtgcccac

SEQ ID NO: 7024509 - DNA, 22 bp, Homo sapiens
ttttaagtgcaatctgaatgcg

SEQ ID NO: 7024510 - DNA, 22 bp, Homo sapiens
ctcctagtgcacacctgtccac

SEQ ID NO: 7024511 - DNA, 22 bp, Homo sapiens
tcccgataggcagggctctggc

SEQ ID NO: 7024512 - DNA, 22 bp, Homo sapiens
atactgtatatctgagagccca

SEQ ID NO: 7024513 - DNA, 22 bp, Homo sapiens
attccttgtatatctacatgca

SEQ ID NO: 7024514 - DNA, 22 bp, Homo sapiens
cttgcctacttgtcaaccagca

SEQ ID NO: 7024515 - DNA, 22 bp, Homo sapiens
tataatctcctgagttaggtag

SEQ ID NO: 7024516 - DNA, 22 bp, Homo sapiens
tgctggctggagtgcctctgga

SEQ ID NO: 7024517 - DNA, 22 bp, Homo sapiens
tgaaggagggaagaaggctctg

SEQ ID NO: 7024518 - DNA, 22 bp, Homo sapiens
tgttagttgttcatgttaagag

SEQ ID NO: 7024519 - DNA, 22 bp, Homo sapiens
gtctctgtgcccccatttccgt

SEQ ID NO: 7024520 - DNA, 22 bp, Homo sapiens
ttgtactatgtctaagtcactg

SEQ ID NO: 7024521 - DNA, 21 bp, Homo sapiens
ggctccctggcaggggtctgg

SEQ ID NO: 7024522 - DNA, 22 bp, Homo sapiens
ctgactcctatgccccatgggc

SEQ ID NO: 7024523 - DNA, 22 bp, Homo sapiens
tctctgtgtgtgtgacagcatt

SEQ ID NO: 7024524 - DNA, 22 bp, Homo sapiens
cctgccagccagatcactcgcc

SEQ ID NO: 7024525 - DNA, 21 bp, Homo sapiens
aatggctgggcaaggtctctc

SEQ ID NO: 7024526 - DNA, 22 bp, Homo sapiens
catatccaggtttctttggttt

SEQ ID NO: 7024527 - DNA, 22 bp, Homo sapiens
agccctcttccagccagcacag

SEQ ID NO: 7024528 - DNA, 22 bp, Homo sapiens
catttgtatcatatgtatctta

SEQ ID NO: 7024529 - DNA, 22 bp, Homo sapiens
ccacagaaagttgtctagagta

SEQ ID NO: 7024530 - DNA, 22 bp, Homo sapiens
taatactgaaaggagtatcagc

SEQ ID NO: 7024531 - DNA, 22 bp, Homo sapiens
ttagcactggattaatcaaagt

SEQ ID NO: 7024532 - DNA, 22 bp, Homo sapiens
agtttacatatttgtcggagtc

SEQ ID NO: 7024533 - DNA, 22 bp, Homo sapiens
aggccacacaactcttagagat

SEQ ID NO: 7024534 - DNA, 22 bp, Homo sapiens
tttgagattccttagctcagag

SEQ ID NO: 7024535 - DNA, 22 bp, Homo sapiens
catggctgcctgtggacactgc

SEQ ID NO: 7024536 - DNA, 22 bp, Homo sapiens
atttggcaatgctagagaagtt

SEQ ID NO: 7024537 - DNA, 22 bp, Homo sapiens
gaagctaggctggggttcagga

SEQ ID NO: 7024538 - DNA, 22 bp, Homo sapiens
acagcagagtagttttccaact

SEQ ID NO: 7024539 - DNA, 22 bp, Homo sapiens
aactccagggggtcaatattta

SEQ ID NO: 7024540 - DNA, 22 bp, Homo sapiens
gagggctcctcacattctctat

SEQ ID NO: 7024541 - DNA, 22 bp, Homo sapiens
cagtgcagtcaaggaagaacca

SEQ ID NO: 7024542 - DNA, 22 bp, Homo sapiens
ttgctttacaaaaattgatggt

SEQ ID NO: 7024543 - DNA, 22 bp, Homo sapiens
cagatgctatgtattatgtatg

SEQ ID NO: 7024544 - DNA, 22 bp, Homo sapiens
aaagtcacagtttaggggatat

SEQ ID NO: 7024545 - DNA, 22 bp, Homo sapiens
tgtccctatcctcatgcaggcc

SEQ ID NO: 7024546 - DNA, 22 bp, Homo sapiens
tgacatctggcttgtgccctgc

SEQ ID NO: 7024547 - DNA, 22 bp, Homo sapiens
gggctgaactcaagtcagctcc

SEQ ID NO: 7024548 - DNA, 22 bp, Homo sapiens
tggcacttccactgtggctgct

SEQ ID NO: 7024549 - DNA, 22 bp, Homo sapiens
cttcctctatgttcaggtagaa

SEQ ID NO: 7024550 - DNA, 22 bp, Homo sapiens
tctctgggatcaggtggcccag

SEQ ID NO: 7024551 - DNA, 22 bp, Homo sapiens
acattcacaagcctacaaggtt

SEQ ID NO: 7024552 - DNA, 22 bp, Homo sapiens
tgctgaagtccaagagctccaa

SEQ ID NO: 7024553 - DNA, 22 bp, Homo sapiens
tgagatggctgggccccaggag

SEQ ID NO: 7024554 - DNA, 22 bp, Homo sapiens
acagctttgggcaatgctatga

SEQ ID NO: 7024555 - DNA, 22 bp, Homo sapiens
tcctgtggagaggactggaggt

SEQ ID NO: 7024556 - DNA, 22 bp, Homo sapiens
tttcctgtcttttgtgaaggat

SEQ ID NO: 7024557 - DNA, 20 bp, Homo sapiens
ttgcaactgtaagaagcagg

SEQ ID NO: 7024558 - DNA, 22 bp, Homo sapiens
ccattcatacaattttgttcta

SEQ ID NO: 7024559 - DNA, 22 bp, Homo sapiens
tatgacattgctttttagaact

SEQ ID NO: 7024560 - DNA, 22 bp, Homo sapiens
tttccaggtgcatagaaaacag

SEQ ID NO: 7024561 - DNA, 22 bp, Homo sapiens
tggcagctagctgttttcatgc

SEQ ID NO: 7024562 - DNA, 22 bp, Homo sapiens
aatgttacaggacaaagatgga

SEQ ID NO: 7024563 - DNA, 22 bp, Homo sapiens
tcctcaggtgactaggtatctt

SEQ ID NO: 7024564 - DNA, 22 bp, Homo sapiens
tcccagaacctcagagtgtgac

SEQ ID NO: 7024565 - DNA, 22 bp, Homo sapiens
ttggaattcagcttgcttataa

SEQ ID NO: 7024566 - DNA, 17 bp, Homo sapiens
tatctgtgttcctggct

SEQ ID NO: 7024567 - DNA, 22 bp, Homo sapiens
agcaggagatggggcgtgatgt

SEQ ID NO: 7024568 - DNA, 22 bp, Homo sapiens
tttgaataatcactgggcatta

SEQ ID NO: 7024569 - DNA, 22 bp, Homo sapiens
aagcttaatcagtctggttgca

SEQ ID NO: 7024570 - DNA, 22 bp, Homo sapiens
gattcaaagttaatgaagatgc

SEQ ID NO: 7024571 - DNA, 22 bp, Homo sapiens
ctgaggagaacaatgagatcaa

SEQ ID NO: 7024572 - DNA, 22 bp, Homo sapiens
gtagaaatagtggttgacagga

SEQ ID NO: 7024573 - DNA, 22 bp, Homo sapiens
gaaaggctactgtcatcaatta

SEQ ID NO: 7024574 - DNA, 22 bp, Homo sapiens
agcagggggagttagactagat

SEQ ID NO: 7024575 - DNA, 22 bp, Homo sapiens
tgcagctgctggcccaggtgct

SEQ ID NO: 7024576 - DNA, 22 bp, Homo sapiens
atgcagtggcttcagtgtcagt

SEQ ID NO: 7024577 - DNA, 22 bp, Homo sapiens
ctcctccccttgagtctgggat

SEQ ID NO: 7024578 - DNA, 22 bp, Homo sapiens
aaggggctcttgtcaggcgcag

SEQ ID NO: 7024579 - DNA, 22 bp, Homo sapiens
agcacctgtgttcatgcctcat

SEQ ID NO: 7024580 - DNA, 22 bp, Homo sapiens
tttgtctacaaaaagtgtacag

SEQ ID NO: 7024581 - DNA, 22 bp, Homo sapiens
tctgaagaggctcttgataaga

SEQ ID NO: 7024582 - DNA, 22 bp, Homo sapiens
ctggcctttaaaatgaccttat

SEQ ID NO: 7024583 - DNA, 22 bp, Homo sapiens
atgcaaggacatgtaatgatgt

SEQ ID NO: 7024584 - DNA, 22 bp, Homo sapiens
cccctacacacccctcttggca

SEQ ID NO: 7024585 - DNA, 22 bp, Homo sapiens
cccctgaagacaatggagaggt

SEQ ID NO: 7024586 - DNA, 22 bp, Homo sapiens
gctgttcccttgtgcctctgtc

SEQ ID NO: 7024587 - DNA, 22 bp, Homo sapiens
tctggcccatcttctgccacca

SEQ ID NO: 7024588 - DNA, 22 bp, Homo sapiens
aatacactattttgtgctcagt

SEQ ID NO: 7024589 - DNA, 23 bp, Homo sapiens
tccctggaggcaggtccagggcc

SEQ ID NO: 7024590 - DNA, 22 bp, Homo sapiens
ttcacaataggagcatgcaaat

SEQ ID NO: 7024591 - DNA, 22 bp, Homo sapiens
ccctgcagggaggattctgaag

SEQ ID NO: 7024592 - DNA, 22 bp, Homo sapiens
gggctggactgcattgcctcgc

SEQ ID NO: 7024593 - DNA, 22 bp, Homo sapiens
agtctctgtcgtagatcagcgt

SEQ ID NO: 7024594 - DNA, 22 bp, Homo sapiens
tctgtttctataaagacaagag

SEQ ID NO: 7024595 - DNA, 22 bp, Homo sapiens
ctcaaagagccaggtaatcacc

SEQ ID NO: 7024596 - DNA, 22 bp, Homo sapiens
tttgacagtgttggggcaggct

SEQ ID NO: 7024597 - DNA, 22 bp, Homo sapiens
tgctagaaatctgaaactagca

SEQ ID NO: 7024598 - DNA, 22 bp, Homo sapiens
cctgtggctggtagtatcgttt

SEQ ID NO: 7024599 - DNA, 22 bp, Homo sapiens
cgaggcctcctcgccgccaccg

SEQ ID NO: 7024600 - DNA, 22 bp, Homo sapiens
ggtgatcagccttctgatttct

SEQ ID NO: 7024601 - DNA, 22 bp, Homo sapiens
catttgaaaatactcttttcca

SEQ ID NO: 7024602 - DNA, 22 bp, Homo sapiens
gaggacaggagactcactgttt

SEQ ID NO: 7024603 - DNA, 22 bp, Homo sapiens
agaaagagctcgggattaacag

SEQ ID NO: 7024604 - DNA, 22 bp, Homo sapiens
catgcaaagcgttttgaccagc

SEQ ID NO: 7024605 - DNA, 22 bp, Homo sapiens
cgctgcacgtgtcacactaacc

SEQ ID NO: 7024606 - DNA, 22 bp, Homo sapiens
ttgaacagttttgtcaggttca

SEQ ID NO: 7024607 - DNA, 22 bp, Homo sapiens
accatcctgtgactccgcttcc

SEQ ID NO: 7024608 - DNA, 22 bp, Homo sapiens
caatatcaggtccgcgtaagtc

SEQ ID NO: 7024609 - DNA, 22 bp, Homo sapiens
ctcagctacgctttcaccagct

SEQ ID NO: 7024610 - DNA, 22 bp, Homo sapiens
gtggagggaatgaatcttctct

SEQ ID NO: 7024611 - DNA, 22 bp, Homo sapiens
ctgcagtatcttaaaatttgta

SEQ ID NO: 7024612 - DNA, 22 bp, Homo sapiens
tatctgttatgggctgaattgc

SEQ ID NO: 7024613 - DNA, 22 bp, Homo sapiens
gcagaggcctgaaggtggcggg

SEQ ID NO: 7024614 - DNA, 19 bp, Homo sapiens
cttctgcagggtgacagtg

SEQ ID NO: 7024615 - DNA, 22 bp, Homo sapiens
atatgttgagcaagcatgatta

SEQ ID NO: 7024616 - DNA, 22 bp, Homo sapiens
cttatttgaatgtatgagtttt

SEQ ID NO: 7024617 - DNA, 23 bp, Homo sapiens
tcccatcaaccagagtgaaacac

SEQ ID NO: 7024618 - DNA, 22 bp, Homo sapiens
accgggaagtcctgcactgggc

SEQ ID NO: 7024619 - DNA, 22 bp, Homo sapiens
tcctggggccaggcacctctgg

SEQ ID NO: 7024620 - DNA, 22 bp, Homo sapiens
tctcagagtgacaatgagaatt

SEQ ID NO: 7024621 - DNA, 22 bp, Homo sapiens
tatgagaaaataaatatctgtt

SEQ ID NO: 7024622 - DNA, 19 bp, Homo sapiens
aagcagactctgagccagg

SEQ ID NO: 7024623 - DNA, 22 bp, Homo sapiens
gtctcctagtcttcacttattg

SEQ ID NO: 7024624 - DNA, 22 bp, Homo sapiens
tttcacagcagtgtgctgcttt

SEQ ID NO: 7024625 - DNA, 22 bp, Homo sapiens
taactcatggagaggcggagtt

SEQ ID NO: 7024626 - DNA, 19 bp, Homo sapiens
ctggtttaggtagtgagtc

SEQ ID NO: 7024627 - DNA, 22 bp, Homo sapiens
agtaaatttcagctccattgta

SEQ ID NO: 7024628 - DNA, 22 bp, Homo sapiens
tgaaggcacttgcctaggggca

SEQ ID NO: 7024629 - DNA, 22 bp, Homo sapiens
ccctgcatccaaaggcctcctc

SEQ ID NO: 7024630 - DNA, 22 bp, Homo sapiens
gggcatcaccaagaaggaggac

SEQ ID NO: 7024631 - DNA, 22 bp, Homo sapiens
tttcaagttctgttctagggta

SEQ ID NO: 7024632 - DNA, 22 bp, Homo sapiens
agagctgccctgccagttctaa

SEQ ID NO: 7024633 - DNA, 22 bp, Homo sapiens
tctgaacactgagtgtcatcac

SEQ ID NO: 7024634 - DNA, 22 bp, Homo sapiens
gagctttagctgagacctgctt

SEQ ID NO: 7024635 - DNA, 22 bp, Homo sapiens
aaaacagacagccagtgtagag

SEQ ID NO: 7024636 - DNA, 22 bp, Homo sapiens
ctagcccaggaatgccgtggcc

SEQ ID NO: 7024637 - DNA, 22 bp, Homo sapiens
ctccagatccagctgagctgca

SEQ ID NO: 7024638 - DNA, 18 bp, Homo sapiens
gctgaggtggtgtcagag

SEQ ID NO: 7024639 - DNA, 22 bp, Homo sapiens
ggagtgcaatggcgtgatctca

SEQ ID NO: 7024640 - DNA, 18 bp, Homo sapiens
atgttcctgaggagaggt

SEQ ID NO: 7024641 - DNA, 22 bp, Homo sapiens
tattactgaaaaggcaaagtag

SEQ ID NO: 7024642 - DNA, 22 bp, Homo sapiens
agtgcagactgaaatgaccttc

SEQ ID NO: 7024643 - DNA, 23 bp, Homo sapiens
tgcaacaatgaggaaagctactg

SEQ ID NO: 7024644 - DNA, 22 bp, Homo sapiens
atcaaagaatgtgactgaaata

SEQ ID NO: 7024645 - DNA, 22 bp, Homo sapiens
gacatacagcatggtctatgaa

SEQ ID NO: 7024646 - DNA, 22 bp, Homo sapiens
cgtctggacgggaaggagaagt

SEQ ID NO: 7024647 - DNA, 19 bp, Homo sapiens
ttccaccatcactctgttt

SEQ ID NO: 7024648 - DNA, 22 bp, Homo sapiens
tggatctgacaaggacgggaaa

SEQ ID NO: 7024649 - DNA, 22 bp, Homo sapiens
ggtgactcccagctgctctctt

SEQ ID NO: 7024650 - DNA, 22 bp, Homo sapiens
gtttgtatgaatgttttatgct

SEQ ID NO: 7024651 - DNA, 22 bp, Homo sapiens
ttcccaaagctttgtctgtgaa

SEQ ID NO: 7024652 - DNA, 22 bp, Homo sapiens
aactgcagagaacatctgggtt

SEQ ID NO: 7024653 - DNA, 22 bp, Homo sapiens
gaggctggacgtgcatttctac

SEQ ID NO: 7024654 - DNA, 17 bp, Homo sapiens
aggagctgggggtggtg

SEQ ID NO: 7024655 - DNA, 22 bp, Homo sapiens
taagtgaaaatggtttcccagc

SEQ ID NO: 7024656 - DNA, 22 bp, Homo sapiens
gtggaattgatgaggcacatta

SEQ ID NO: 7024657 - DNA, 22 bp, Homo sapiens
aaagtagtccttggagcgaaat

SEQ ID NO: 7024658 - DNA, 23 bp, Homo sapiens
cctgtgtgcccttaattcacagc

SEQ ID NO: 7024659 - DNA, 22 bp, Homo sapiens
atcttcccaggctggggagagg

SEQ ID NO: 7024660 - DNA, 18 bp, Homo sapiens
tcaagccattctcctgcc

SEQ ID NO: 7024661 - DNA, 23 bp, Homo sapiens
ggacacagagataagtgagacaa

SEQ ID NO: 7024662 - DNA, 22 bp, Homo sapiens
agcccagggacagggcggatgt

SEQ ID NO: 7024663 - DNA, 22 bp, Homo sapiens
atttcatccagagtcctattag

SEQ ID NO: 7024664 - DNA, 21 bp, Homo sapiens
atggccactatggtgcagcag

SEQ ID NO: 7024665 - DNA, 20 bp, Homo sapiens
tggtatcaattactagattg

SEQ ID NO: 7024666 - DNA, 22 bp, Homo sapiens
ctggctttctgttataaagaca

SEQ ID NO: 7024667 - DNA, 22 bp, Homo sapiens
agaaccagtttaagatttgggt

SEQ ID NO: 7024668 - DNA, 22 bp, Homo sapiens
tggaagaggcccatgactgcct

SEQ ID NO: 7024669 - DNA, 22 bp, Homo sapiens
atggtctgaatgtgtgctccaa

SEQ ID NO: 7024670 - DNA, 22 bp, Homo sapiens
gcaggactcaaatctgaaggca

SEQ ID NO: 7024671 - DNA, 22 bp, Homo sapiens
ctgagaaagatttgcctccgtg

SEQ ID NO: 7024672 - DNA, 22 bp, Homo sapiens
aggcaggtttcccggctgtcaa

SEQ ID NO: 7024673 - DNA, 20 bp, Homo sapiens
gtggcaggcagtgaaggagc

SEQ ID NO: 7024674 - DNA, 22 bp, Homo sapiens
aagctgaagacacagctccagt

SEQ ID NO: 7024675 - DNA, 22 bp, Homo sapiens
actcaatcatttcctgtcacag

SEQ ID NO: 7024676 - DNA, 22 bp, Homo sapiens
tcctagaatctttgtaagattg

SEQ ID NO: 7024677 - DNA, 23 bp, Homo sapiens
cacaccaggagccgtctgggcca

SEQ ID NO: 7024678 - DNA, 20 bp, Homo sapiens
tggtccaggacctggtgtcc

SEQ ID NO: 7024679 - DNA, 22 bp, Homo sapiens
cagggcagaacatatagatagt

SEQ ID NO: 7024680 - DNA, 23 bp, Homo sapiens
aggctccactccctgggatgtgg

SEQ ID NO: 7024681 - DNA, 22 bp, Homo sapiens
agggctctcttcttggtttgca

SEQ ID NO: 7024682 - DNA, 22 bp, Homo sapiens
cattacttctcatgcttcatgc

SEQ ID NO: 7024683 - DNA, 22 bp, Homo sapiens
tggttagacacatgcatgtcat

SEQ ID NO: 7024684 - DNA, 22 bp, Homo sapiens
gaagccagcagtggagaaagga

SEQ ID NO: 7024685 - DNA, 22 bp, Homo sapiens
acagtttagaatgccacatagt

SEQ ID NO: 7024686 - DNA, 22 bp, Homo sapiens
ctcttagctgctgttctttgag

SEQ ID NO: 7024687 - DNA, 23 bp, Homo sapiens
ttggaatatattgtttgacatag

SEQ ID NO: 7024688 - DNA, 22 bp, Homo sapiens
gcaggctagggagctgcagtcc

SEQ ID NO: 7024689 - DNA, 22 bp, Homo sapiens
tcctgagagcagctgctttgga

SEQ ID NO: 7024690 - DNA, 22 bp, Homo sapiens
ttctctttctacagtgtgattg

SEQ ID NO: 7024691 - DNA, 22 bp, Homo sapiens
ttaaggaatttatagttgtact

SEQ ID NO: 7024692 - DNA, 23 bp, Homo sapiens
tccttcaagttaggaagtgaaca

SEQ ID NO: 7024693 - DNA, 22 bp, Homo sapiens
aaagctgttaaatgcataatgc

SEQ ID NO: 7024694 - DNA, 22 bp, Homo sapiens
gtgtcgtatgtaatatggtcca

SEQ ID NO: 7024695 - DNA, 22 bp, Homo sapiens
atgtgtcttggagttttaatgt

SEQ ID NO: 7024696 - DNA, 22 bp, Homo sapiens
actgtcctcagatattcttctg

SEQ ID NO: 7024697 - DNA, 22 bp, Homo sapiens
cagctaggaagtccttggcgaa

SEQ ID NO: 7024698 - DNA, 22 bp, Homo sapiens
aatagcataagatgtcaaatag

SEQ ID NO: 7024699 - DNA, 22 bp, Homo sapiens
atctttctatggtactttctcc

SEQ ID NO: 7024700 - DNA, 22 bp, Homo sapiens
cctgcccatactgacctctaat

SEQ ID NO: 7024701 - DNA, 22 bp, Homo sapiens
gggtggaggtgggttttgagat

SEQ ID NO: 7024702 - DNA, 22 bp, Homo sapiens
cacatcctatcagtcacggttt

SEQ ID NO: 7024703 - DNA, 22 bp, Homo sapiens
gctgaccatgaattaagcatct

SEQ ID NO: 7024704 - DNA, 16 bp, Homo sapiens
acagacatgagtgagc

SEQ ID NO: 7024705 - DNA, 22 bp, Homo sapiens
tgtccctgcctgcccactctgt

SEQ ID NO: 7024706 - DNA, 22 bp, Homo sapiens
tttgaggttagctagcagatca

SEQ ID NO: 7024707 - DNA, 21 bp, Homo sapiens
cgctgccttgggagtggacct

SEQ ID NO: 7024708 - DNA, 22 bp, Homo sapiens
gctggcttaatgtagctaaaaa

SEQ ID NO: 7024709 - DNA, 22 bp, Homo sapiens
attgtctctttcaataacttgt

SEQ ID NO: 7024710 - DNA, 22 bp, Homo sapiens
gcaacagttggattccagagga

SEQ ID NO: 7024711 - DNA, 22 bp, Homo sapiens
agagaccctggagttcttcact

SEQ ID NO: 7024712 - DNA, 22 bp, Homo sapiens
tgctgggctagggtggagctct

SEQ ID NO: 7024713 - DNA, 22 bp, Homo sapiens
gtccacttctgcctttctggat

SEQ ID NO: 7024714 - DNA, 22 bp, Homo sapiens
ctcttattttatggcatttgtg

SEQ ID NO: 7024715 - DNA, 21 bp, Homo sapiens
tggtaggatccaggaatctgc

SEQ ID NO: 7024716 - DNA, 22 bp, Homo sapiens
tggttcaggcagggtgttgctg

SEQ ID NO: 7024717 - DNA, 22 bp, Homo sapiens
gagaaggaggcgaagcgtgtgc

SEQ ID NO: 7024718 - DNA, 22 bp, Homo sapiens
ttggcataccttagtggtggag

SEQ ID NO: 7024719 - DNA, 22 bp, Homo sapiens
ctgtggagcagggcagggtcac

SEQ ID NO: 7024720 - DNA, 22 bp, Homo sapiens
tggcctggtccttgtcaaggca

SEQ ID NO: 7024721 - DNA, 22 bp, Homo sapiens
ttacatagattcatttagttaa

SEQ ID NO: 7024722 - DNA, 22 bp, Homo sapiens
aatgaaatagttggctgtagag

SEQ ID NO: 7024723 - DNA, 22 bp, Homo sapiens
gactgtggtctgttctccaggt

SEQ ID NO: 7024724 - DNA, 22 bp, Homo sapiens
aagcccagctgaaagcattttt

SEQ ID NO: 7024725 - DNA, 22 bp, Homo sapiens
tggaggtgggagggactgtcct

SEQ ID NO: 7024726 - DNA, 22 bp, Homo sapiens
gagtggctccttacaagttcca

SEQ ID NO: 7024727 - DNA, 22 bp, Homo sapiens
tccaggagaggtagagggttcc

SEQ ID NO: 7024728 - DNA, 22 bp, Homo sapiens
aaagttctgggggagaagaacg

SEQ ID NO: 7024729 - DNA, 22 bp, Homo sapiens
tgacatctgggccctcagctaa

SEQ ID NO: 7024730 - DNA, 22 bp, Homo sapiens
aaggaagttaagtcttagaatg

SEQ ID NO: 7024731 - DNA, 22 bp, Homo sapiens
tccactggcccacctcctcagt

SEQ ID NO: 7024732 - DNA, 23 bp, Homo sapiens
gggtccagccaattccaaggaaa

SEQ ID NO: 7024733 - DNA, 22 bp, Homo sapiens
cttctacacatccctcttgctt

SEQ ID NO: 7024734 - DNA, 22 bp, Homo sapiens
cctgggaggtggaggttgcagt

SEQ ID NO: 7024735 - DNA, 22 bp, Homo sapiens
tgataggcttaattttcctgtc

SEQ ID NO: 7024736 - DNA, 22 bp, Homo sapiens
tagagagctgtttgaaagcagg

SEQ ID NO: 7024737 - DNA, 22 bp, Homo sapiens
cagtagcaggatttgggattat

SEQ ID NO: 7024738 - DNA, 22 bp, Homo sapiens
gacgctttcaagggcctttctt

SEQ ID NO: 7024739 - DNA, 22 bp, Homo sapiens
atgtaacattgaattatatagt

SEQ ID NO: 7024740 - DNA, 18 bp, Homo sapiens
aacatgcattagaactgc

SEQ ID NO: 7024741 - DNA, 20 bp, Homo sapiens
gtctacacgggcagtgtaga

SEQ ID NO: 7024742 - DNA, 22 bp, Homo sapiens
taagtcatcgcaggagtttggt

SEQ ID NO: 7024743 - DNA, 22 bp, Homo sapiens
ggctccatgcctagagcaggct

SEQ ID NO: 7024744 - DNA, 22 bp, Homo sapiens
atgactaatggaaaatacaatg

SEQ ID NO: 7024745 - DNA, 22 bp, Homo sapiens
gctcactgcaacctccgccttc

SEQ ID NO: 7024746 - DNA, 22 bp, Homo sapiens
aaggaagatatatcaagcttaa

SEQ ID NO: 7024747 - DNA, 22 bp, Homo sapiens
tctcatgaagatagaatagtat

SEQ ID NO: 7024748 - DNA, 22 bp, Homo sapiens
tctctatgtgcacaccttggtg

SEQ ID NO: 7024749 - DNA, 22 bp, Homo sapiens
tacaggaaggctctggaggtgc

SEQ ID NO: 7024750 - DNA, 22 bp, Homo sapiens
gagggcaccttcagtaatagct

SEQ ID NO: 7024751 - DNA, 22 bp, Homo sapiens
aggtagcagcctagcagggact

SEQ ID NO: 7024752 - DNA, 22 bp, Homo sapiens
cagtagcttacttttcttgatc

SEQ ID NO: 7024753 - DNA, 22 bp, Homo sapiens
gcactagaagtacgccttgtaa

SEQ ID NO: 7024754 - DNA, 22 bp, Homo sapiens
tcttccagggagcctcaaacct

SEQ ID NO: 7024755 - DNA, 17 bp, Homo sapiens
tgcctgtgataagcaca

SEQ ID NO: 7024756 - DNA, 22 bp, Homo sapiens
ggacccaggtagggaggaagat

SEQ ID NO: 7024757 - DNA, 22 bp, Homo sapiens
gaggctcagagactttaagttt

SEQ ID NO: 7024758 - DNA, 19 bp, Homo sapiens
agaattgttttatgtcttc

SEQ ID NO: 7024759 - DNA, 22 bp, Homo sapiens
aaggtttttttccagtatctct

SEQ ID NO: 7024760 - DNA, 22 bp, Homo sapiens
ttggttttgaaatagcttattg

SEQ ID NO: 7024761 - DNA, 20 bp, Homo sapiens
ctagaactgagaaatttaaa

SEQ ID NO: 7024762 - DNA, 22 bp, Homo sapiens
ctctggtcttcaaggccacctc

SEQ ID NO: 7024763 - DNA, 22 bp, Homo sapiens
aagtatactgaaggtatccagg

SEQ ID NO: 7024764 - DNA, 22 bp, Homo sapiens
tcatggctggaagctcagttag

SEQ ID NO: 7024765 - DNA, 22 bp, Homo sapiens
gagaggctgcatatgcacactg

SEQ ID NO: 7024766 - DNA, 22 bp, Homo sapiens
cctgtctgggcttgagtattta

SEQ ID NO: 7024767 - DNA, 22 bp, Homo sapiens
ggctgcttgatggaaggggacg

SEQ ID NO: 7024768 - DNA, 22 bp, Homo sapiens
aaagatgtcagtttgaaataac

SEQ ID NO: 7024769 - DNA, 22 bp, Homo sapiens
catatcatttgcttataaatct

SEQ ID NO: 7024770 - DNA, 22 bp, Homo sapiens
agggtataaagagcaagcagaa

SEQ ID NO: 7024771 - DNA, 22 bp, Homo sapiens
atctgcttgaatgagcaacagg

SEQ ID NO: 7024772 - DNA, 22 bp, Homo sapiens
cccaggagactgagctgtaacc

SEQ ID NO: 7024773 - DNA, 22 bp, Homo sapiens
gtggccaaggcagagaaagagc

SEQ ID NO: 7024774 - DNA, 22 bp, Homo sapiens
tttttctaatggcttaggatgt

SEQ ID NO: 7024775 - DNA, 22 bp, Homo sapiens
tatcactgacctgtatcagttg

SEQ ID NO: 7024776 - DNA, 22 bp, Homo sapiens
tagcagctctgattctgggccc

SEQ ID NO: 7024777 - DNA, 22 bp, Homo sapiens
accttattaaaatgatgatgta

SEQ ID NO: 7024778 - DNA, 22 bp, Homo sapiens
tgctgtagtcaaagcaaagctg

SEQ ID NO: 7024779 - DNA, 22 bp, Homo sapiens
tgccatttataaccagtggcct

SEQ ID NO: 7024780 - DNA, 23 bp, Homo sapiens
ccagtagcacagttacccagtgg

SEQ ID NO: 7024781 - DNA, 22 bp, Homo sapiens
taggaaatactgtaagtttggg

SEQ ID NO: 7024782 - DNA, 22 bp, Homo sapiens
cacagcagatccaggggttgtg

SEQ ID NO: 7024783 - DNA, 22 bp, Homo sapiens
gctgtgtggcaaagggattaca

SEQ ID NO: 7024784 - DNA, 22 bp, Homo sapiens
tttctctagctattcattaaat

SEQ ID NO: 7024785 - DNA, 22 bp, Homo sapiens
ggcaggtgcccagagagcacga

SEQ ID NO: 7024786 - DNA, 21 bp, Homo sapiens
ggtgaatttctaggaagtggc

SEQ ID NO: 7024787 - DNA, 22 bp, Homo sapiens
tcagaaagcttagtgtcttgca

SEQ ID NO: 7024788 - DNA, 22 bp, Homo sapiens
agaagtatcaggaagattctca

SEQ ID NO: 7024789 - DNA, 22 bp, Homo sapiens
cctctgggagactgctactgag

SEQ ID NO: 7024790 - DNA, 22 bp, Homo sapiens
tctgtactttacatgcagtgct

SEQ ID NO: 7024791 - DNA, 19 bp, Homo sapiens
ccagcagacacagctgccc

SEQ ID NO: 7024792 - DNA, 22 bp, Homo sapiens
tgtcaatgctggtcttgaatga

SEQ ID NO: 7024793 - DNA, 22 bp, Homo sapiens
aaactgttgtggtttatcatta

SEQ ID NO: 7024794 - DNA, 22 bp, Homo sapiens
cagccgtcagatgtgccgcagc

SEQ ID NO: 7024795 - DNA, 22 bp, Homo sapiens
aatcacttttctctaatgtagc

SEQ ID NO: 7024796 - DNA, 22 bp, Homo sapiens
atcaacattccaatgtggtaga

SEQ ID NO: 7024797 - DNA, 22 bp, Homo sapiens
caaagtgctgggattataggca

SEQ ID NO: 7024798 - DNA, 22 bp, Homo sapiens
tgacccttgtttatcatttctg

SEQ ID NO: 7024799 - DNA, 22 bp, Homo sapiens
gtgctgattgggagctgggatt

SEQ ID NO: 7024800 - DNA, 22 bp, Homo sapiens
tgcaggctggcagatatctcat

SEQ ID NO: 7024801 - DNA, 22 bp, Homo sapiens
tctggggagcagccctggtgag

SEQ ID NO: 7024802 - DNA, 22 bp, Homo sapiens
gcaggctccaactggaggagtt

SEQ ID NO: 7024803 - DNA, 22 bp, Homo sapiens
tcccactgtgaatccaaggcct

SEQ ID NO: 7024804 - DNA, 22 bp, Homo sapiens
tctgcagacaggaagctgaggc

SEQ ID NO: 7024805 - DNA, 22 bp, Homo sapiens
tgcagggtagatgcaggctgtg

SEQ ID NO: 7024806 - DNA, 22 bp, Homo sapiens
ccaaagtgctgagattacaggt

SEQ ID NO: 7024807 - DNA, 23 bp, Homo sapiens
aggatcctggtacaggagcagag

SEQ ID NO: 7024808 - DNA, 22 bp, Homo sapiens
agggggctggagacacctcctc

SEQ ID NO: 7024809 - DNA, 22 bp, Homo sapiens
acttgttttatctgtcaataga

SEQ ID NO: 7024810 - DNA, 22 bp, Homo sapiens
atcagtttggtgctttcagtga

SEQ ID NO: 7024811 - DNA, 22 bp, Homo sapiens
aggcagcagaaaacaaatggtt

SEQ ID NO: 7024812 - DNA, 22 bp, Homo sapiens
cccagctcaagcagagagctaa

SEQ ID NO: 7024813 - DNA, 22 bp, Homo sapiens
gcactttaaatgttcacggaaa

SEQ ID NO: 7024814 - DNA, 18 bp, Homo sapiens
tctctgaatattttatgt

SEQ ID NO: 7024815 - DNA, 22 bp, Homo sapiens
tcactgctttcaaaaattattg

SEQ ID NO: 7024816 - DNA, 22 bp, Homo sapiens
gccaggaaattcatgccagatc

SEQ ID NO: 7024817 - DNA, 22 bp, Homo sapiens
agggtcaagaggcagagttctt

SEQ ID NO: 7024818 - DNA, 22 bp, Homo sapiens
agtctggtcatctgattctttt

SEQ ID NO: 7024819 - DNA, 22 bp, Homo sapiens
tggtcctgatcaccgctgggca

SEQ ID NO: 7024820 - DNA, 22 bp, Homo sapiens
ttccttttcatatgccccgcgt

SEQ ID NO: 7024821 - DNA, 22 bp, Homo sapiens
cgtagctgggaacttcactctc

SEQ ID NO: 7024822 - DNA, 22 bp, Homo sapiens
ctgcagctgtagaggacagtgg

SEQ ID NO: 7024823 - DNA, 22 bp, Homo sapiens
gaagaattgcccatttctgtct

SEQ ID NO: 7024824 - DNA, 22 bp, Homo sapiens
tcctccccaaagcccagcctgg

SEQ ID NO: 7024825 - DNA, 22 bp, Homo sapiens
gaagctggagaatgggtctagg

SEQ ID NO: 7024826 - DNA, 22 bp, Homo sapiens
ttctgttacatggggcacagtg

SEQ ID NO: 7024827 - DNA, 22 bp, Homo sapiens
caggagaaggtttggagtgcag

SEQ ID NO: 7024828 - DNA, 22 bp, Homo sapiens
agggctggctaggtgcgttccc

SEQ ID NO: 7024829 - DNA, 22 bp, Homo sapiens
ataatctgtggatggttttgag

SEQ ID NO: 7024830 - DNA, 22 bp, Homo sapiens
atggctctgttttttatgctct

SEQ ID NO: 7024831 - DNA, 23 bp, Homo sapiens
tggctccaggagaagccagaagc

SEQ ID NO: 7024832 - DNA, 22 bp, Homo sapiens
cctgtgccagctgggccctgcc

SEQ ID NO: 7024833 - DNA, 22 bp, Homo sapiens
ctgcagatttggtgtctggtga

SEQ ID NO: 7024834 - DNA, 22 bp, Homo sapiens
tcccacagtggtacagccctga

SEQ ID NO: 7024835 - DNA, 22 bp, Homo sapiens
ccagctttatcaagtctgagct

SEQ ID NO: 7024836 - DNA, 22 bp, Homo sapiens
tgcagatggggatcagtggctc

SEQ ID NO: 7024837 - DNA, 22 bp, Homo sapiens
cttgatattttaaacatacagt

SEQ ID NO: 7024838 - DNA, 22 bp, Homo sapiens
tcatggttcatgagtgtccttt

SEQ ID NO: 7024839 - DNA, 22 bp, Homo sapiens
cctatgcctgtcactctgcgct

SEQ ID NO: 7024840 - DNA, 22 bp, Homo sapiens
ggccacagggctgaacgtggac

SEQ ID NO: 7024841 - DNA, 22 bp, Homo sapiens
cttgccttctctggggtggcag

SEQ ID NO: 7024842 - DNA, 22 bp, Homo sapiens
ctattccattccatagtagaaa

SEQ ID NO: 7024843 - DNA, 17 bp, Homo sapiens
acacagacaggcagaca

SEQ ID NO: 7024844 - DNA, 22 bp, Homo sapiens
ttctgggggccaggacagtggt

SEQ ID NO: 7024845 - DNA, 17 bp, Homo sapiens
attgctctggggatttt

SEQ ID NO: 7024846 - DNA, 22 bp, Homo sapiens
tcttggctcctgttgtcatcag

SEQ ID NO: 7024847 - DNA, 22 bp, Homo sapiens
gcttagcagtgtgtgcttttga

SEQ ID NO: 7024848 - DNA, 23 bp, Homo sapiens
acatgggagggacatggaggctg

SEQ ID NO: 7024849 - DNA, 22 bp, Homo sapiens
gtgaatgacatattttgtactg

SEQ ID NO: 7024850 - DNA, 22 bp, Homo sapiens
gtaactgaggcagcttttaaga

SEQ ID NO: 7024851 - DNA, 22 bp, Homo sapiens
tgccctggtagacacagactgt

SEQ ID NO: 7024852 - DNA, 22 bp, Homo sapiens
tcccaggctggggccaggtgac

SEQ ID NO: 7024853 - DNA, 22 bp, Homo sapiens
accactttacagaaatggaaag

SEQ ID NO: 7024854 - DNA, 22 bp, Homo sapiens
tcaaagttacttgtggttttct

SEQ ID NO: 7024855 - DNA, 22 bp, Homo sapiens
tggtggcaaggtgataagtggg

SEQ ID NO: 7024856 - DNA, 22 bp, Homo sapiens
gtgcaagaaggggagactgggt

SEQ ID NO: 7024857 - DNA, 22 bp, Homo sapiens
gtctctgaagtcagtttttcta

SEQ ID NO: 7024858 - DNA, 22 bp, Homo sapiens
gtcatgccagcggagctcggga

SEQ ID NO: 7024859 - DNA, 22 bp, Homo sapiens
tgggaatgcaaggaaagctgtt

SEQ ID NO: 7024860 - DNA, 22 bp, Homo sapiens
aaagggctgaagtagtctctgt

SEQ ID NO: 7024861 - DNA, 19 bp, Homo sapiens
ttttcctgcctcattgttt

SEQ ID NO: 7024862 - DNA, 22 bp, Homo sapiens
attcccactagctctttataga

SEQ ID NO: 7024863 - DNA, 23 bp, Homo sapiens
tggtggttgatctggggcacagc

SEQ ID NO: 7024864 - DNA, 22 bp, Homo sapiens
cttgggccagcccagggggcat

SEQ ID NO: 7024865 - DNA, 22 bp, Homo sapiens
ttctgataccttgcaggatcct

SEQ ID NO: 7024866 - DNA, 22 bp, Homo sapiens
tggctggagcgccctcctctgc

SEQ ID NO: 7024867 - DNA, 22 bp, Homo sapiens
ttagaatctaacattcttatct

SEQ ID NO: 7024868 - DNA, 22 bp, Homo sapiens
tggccccatcaagggatgagtt

SEQ ID NO: 7024869 - DNA, 22 bp, Homo sapiens
ccaaaataacagcccaattcac

SEQ ID NO: 7024870 - DNA, 22 bp, Homo sapiens
tgctcagaactgtgaatacatg

SEQ ID NO: 7024871 - DNA, 22 bp, Homo sapiens
ggcaggtcatcaactgtaattt

SEQ ID NO: 7024872 - DNA, 22 bp, Homo sapiens
tctttgtacaggaaggcactgt

SEQ ID NO: 7024873 - DNA, 22 bp, Homo sapiens
agcagcagaagggagacccagg

SEQ ID NO: 7024874 - DNA, 23 bp, Homo sapiens
aatagctggtaatgatagcacaa

SEQ ID NO: 7024875 - DNA, 22 bp, Homo sapiens
acatccatttgtcagctcttga

SEQ ID NO: 7024876 - DNA, 19 bp, Homo sapiens
atgaaacacagtggcctgg

SEQ ID NO: 7024877 - DNA, 22 bp, Homo sapiens
ttgagaaaggggtcaatatctc

SEQ ID NO: 7024878 - DNA, 22 bp, Homo sapiens
ttcaacatgttctacataaggg

SEQ ID NO: 7024879 - DNA, 22 bp, Homo sapiens
tgctggccctggctcagggaac

SEQ ID NO: 7024880 - DNA, 22 bp, Homo sapiens
acagaattctagtatgtggctt

SEQ ID NO: 7024881 - DNA, 22 bp, Homo sapiens
gggactctgagagcctgagggt

SEQ ID NO: 7024882 - DNA, 22 bp, Homo sapiens
actggaatcctctagagggtga

SEQ ID NO: 7024883 - DNA, 22 bp, Homo sapiens
tgtggcgagaacattggaccat

SEQ ID NO: 7024884 - DNA, 22 bp, Homo sapiens
ggctggcacaaagctccaaatc

SEQ ID NO: 7024885 - DNA, 22 bp, Homo sapiens
caggtattttcaaggcttgtgt

SEQ ID NO: 7024886 - DNA, 22 bp, Homo sapiens
atttagagtgaaacattatgca

SEQ ID NO: 7024887 - DNA, 22 bp, Homo sapiens
ctttggttctgtccttcccaga

SEQ ID NO: 7024888 - DNA, 22 bp, Homo sapiens
gcagtcagtaaggcagccagaa

SEQ ID NO: 7024889 - DNA, 22 bp, Homo sapiens
tagagctggaaaactgcaggta

SEQ ID NO: 7024890 - DNA, 22 bp, Homo sapiens
tcccttgaacgctggggctgga

SEQ ID NO: 7024891 - DNA, 22 bp, Homo sapiens
caggaacctacatctgtttggg

SEQ ID NO: 7024892 - DNA, 22 bp, Homo sapiens
ttccatcctaataaaagaagtt

SEQ ID NO: 7024893 - DNA, 22 bp, Homo sapiens
actctctgtgatggaggccagc

SEQ ID NO: 7024894 - DNA, 22 bp, Homo sapiens
ataagccataatttctgccttt

SEQ ID NO: 7024895 - DNA, 22 bp, Homo sapiens
acaggtggcactgctgttactc

SEQ ID NO: 7024896 - DNA, 22 bp, Homo sapiens
ccagatagggatgagagtgcta

SEQ ID NO: 7024897 - DNA, 22 bp, Homo sapiens
ctctcagcaggaaagcatgcaa

SEQ ID NO: 7024898 - DNA, 22 bp, Homo sapiens
ggtgtagctctgtgtcccactg

SEQ ID NO: 7024899 - DNA, 22 bp, Homo sapiens
tagtggagagttgttttgtgca

SEQ ID NO: 7024900 - DNA, 18 bp, Homo sapiens
tcagaggtacagaaaagt

SEQ ID NO: 7024901 - DNA, 22 bp, Homo sapiens
tcagttcttagtaatgcagtct

SEQ ID NO: 7024902 - DNA, 22 bp, Homo sapiens
ttccaggcagaacaatcatgct

SEQ ID NO: 7024903 - DNA, 22 bp, Homo sapiens
agtgctttagaccttttggggt

SEQ ID NO: 7024904 - DNA, 22 bp, Homo sapiens
aaatggctacaagatgtgctct

SEQ ID NO: 7024905 - DNA, 22 bp, Homo sapiens
ctcagggagtagcacatgtgga

SEQ ID NO: 7024906 - DNA, 22 bp, Homo sapiens
accaagcttcgtggaggaagtt

SEQ ID NO: 7024907 - DNA, 22 bp, Homo sapiens
gtggccagcaagtgctgcctct

SEQ ID NO: 7024908 - DNA, 22 bp, Homo sapiens
agcaggcttggtccccagcctc

SEQ ID NO: 7024909 - DNA, 22 bp, Homo sapiens
agaggcctcaaaccagacctga

SEQ ID NO: 7024910 - DNA, 22 bp, Homo sapiens
actctgtgaactctatcagata

SEQ ID NO: 7024911 - DNA, 22 bp, Homo sapiens
gtcaagttaagataaggtcatg

SEQ ID NO: 7024912 - DNA, 22 bp, Homo sapiens
gcacatgcaacagagattttca

SEQ ID NO: 7024913 - DNA, 22 bp, Homo sapiens
agtggacaaccatgctgagatt

SEQ ID NO: 7024914 - DNA, 22 bp, Homo sapiens
tgaggggtaagtaaaggaattg

SEQ ID NO: 7024915 - DNA, 22 bp, Homo sapiens
cctgggaggctgaggctgcagt

SEQ ID NO: 7024916 - DNA, 22 bp, Homo sapiens
gcttacaagggtaggaagtcta

SEQ ID NO: 7024917 - DNA, 22 bp, Homo sapiens
gtttctaaatgttctgagtttt

SEQ ID NO: 7024918 - DNA, 22 bp, Homo sapiens
tatgtcttgaaatgagaagcca

SEQ ID NO: 7024919 - DNA, 22 bp, Homo sapiens
ctggcccccacacctgtcaggg

SEQ ID NO: 7024920 - DNA, 22 bp, Homo sapiens
taatactgatgtctgagcccca

SEQ ID NO: 7024921 - DNA, 22 bp, Homo sapiens
atcacagctagtaagtggagga

SEQ ID NO: 7024922 - DNA, 22 bp, Homo sapiens
ggaacacagtgccttacaaact

SEQ ID NO: 7024923 - DNA, 22 bp, Homo sapiens
tgaggccagcttcagcagtgga

SEQ ID NO: 7024924 - DNA, 22 bp, Homo sapiens
cagcaaaatttgaggattgcct

SEQ ID NO: 7024925 - DNA, 22 bp, Homo sapiens
cgcatgcttacacacaaacaga

SEQ ID NO: 7024926 - DNA, 22 bp, Homo sapiens
catggcttcgtcacagagggca

SEQ ID NO: 7024927 - DNA, 22 bp, Homo sapiens
cagcggccggtgaggaagggga

SEQ ID NO: 7024928 - DNA, 22 bp, Homo sapiens
tgcccaaggtcacctagttagt

SEQ ID NO: 7024929 - DNA, 22 bp, Homo sapiens
tcctggacaagcccttcaccct

SEQ ID NO: 7024930 - DNA, 22 bp, Homo sapiens
tttaaactgttgattttatgaa

SEQ ID NO: 7024931 - DNA, 22 bp, Homo sapiens
actgttatttgtaatccattat

SEQ ID NO: 7024932 - DNA, 22 bp, Homo sapiens
atgcctttgttgaccactataa

SEQ ID NO: 7024933 - DNA, 22 bp, Homo sapiens
tgtttacatagtagctgccctg

SEQ ID NO: 7024934 - DNA, 22 bp, Homo sapiens
tcagcagtgtcagttcccagag

SEQ ID NO: 7024935 - DNA, 22 bp, Homo sapiens
tctcctggtatgtatgcacctg

SEQ ID NO: 7024936 - DNA, 22 bp, Homo sapiens
gcatgggcaagaggactggggg

SEQ ID NO: 7024937 - DNA, 22 bp, Homo sapiens
tttcacagaaagacaacagata

SEQ ID NO: 7024938 - DNA, 22 bp, Homo sapiens
tcctttaaactcctttcaagtc

SEQ ID NO: 7024939 - DNA, 22 bp, Homo sapiens
aggtggctatgaggatgcagtc

SEQ ID NO: 7024940 - DNA, 22 bp, Homo sapiens
cagctcctagatcggcgaagtg

SEQ ID NO: 7024941 - DNA, 22 bp, Homo sapiens
tgtaacatggttcttactctca

SEQ ID NO: 7024942 - DNA, 22 bp, Homo sapiens
tggcctcctcgggctgaccctg

SEQ ID NO: 7024943 - DNA, 22 bp, Homo sapiens
agtgaactctcagtaaataaat

SEQ ID NO: 7024944 - DNA, 22 bp, Homo sapiens
ttttcatggccaccgcaagtga

SEQ ID NO: 7024945 - DNA, 22 bp, Homo sapiens
ctgggctcaagtgatccaccca

SEQ ID NO: 7024946 - DNA, 22 bp, Homo sapiens
aaacgctttgccatgtttatgt

SEQ ID NO: 7024947 - DNA, 22 bp, Homo sapiens
ttgcatggatggatggttcgat

SEQ ID NO: 7024948 - DNA, 22 bp, Homo sapiens
actgtctaatcagattcacttg

SEQ ID NO: 7024949 - DNA, 22 bp, Homo sapiens
tttgaacttctacctgtcatat

SEQ ID NO: 7024950 - DNA, 22 bp, Homo sapiens
tgctgtctgtttactggctata

SEQ ID NO: 7024951 - DNA, 22 bp, Homo sapiens
tttgcatttgtttagaacctga

SEQ ID NO: 7024952 - DNA, 23 bp, Homo sapiens
atcctctctccatcccactgtgc

SEQ ID NO: 7024953 - DNA, 23 bp, Homo sapiens
tccatctgtgagcatgccctgga

SEQ ID NO: 7024954 - DNA, 19 bp, Homo sapiens
ggcagcctgcacgggctgc

SEQ ID NO: 7024955 - DNA, 20 bp, Homo sapiens
cagagcccactttcttatca

SEQ ID NO: 7024956 - DNA, 22 bp, Homo sapiens
attaacagaattttacatgctt

SEQ ID NO: 7024957 - DNA, 22 bp, Homo sapiens
agtcagctacaagttcattcac

SEQ ID NO: 7024958 - DNA, 22 bp, Homo sapiens
tcaatgattagagtttagtgtg

SEQ ID NO: 7024959 - DNA, 22 bp, Homo sapiens
cacaggagagctgggaggtgcc

SEQ ID NO: 7024960 - DNA, 18 bp, Homo sapiens
gagcagaggctcaactgg

SEQ ID NO: 7024961 - DNA, 22 bp, Homo sapiens
catttctgttctcttcctgtac

SEQ ID NO: 7024962 - DNA, 22 bp, Homo sapiens
gactgttagaatgtaaaatata

SEQ ID NO: 7024963 - DNA, 22 bp, Homo sapiens
tagatctttcactactgtgtag

SEQ ID NO: 7024964 - DNA, 22 bp, Homo sapiens
aggtaacatgtggtgctataag

SEQ ID NO: 7024965 - DNA, 21 bp, Homo sapiens
tgctttgggaattctcagtct

SEQ ID NO: 7024966 - DNA, 22 bp, Homo sapiens
aaagtcattttccagaccagta

SEQ ID NO: 7024967 - DNA, 22 bp, Homo sapiens
gtgcctgctacctgacttgttt

SEQ ID NO: 7024968 - DNA, 22 bp, Homo sapiens
cttgggccctccccttgtgaat

SEQ ID NO: 7024969 - DNA, 22 bp, Homo sapiens
aagcaaagacagtttgagtgga

SEQ ID NO: 7024970 - DNA, 22 bp, Homo sapiens
ggagagaatctgaacctgctcc

SEQ ID NO: 7024971 - DNA, 22 bp, Homo sapiens
ccattactttccaatatatcag

SEQ ID NO: 7024972 - DNA, 22 bp, Homo sapiens
ttggcctttattctgtacttct

SEQ ID NO: 7024973 - DNA, 22 bp, Homo sapiens
tctagaagggtgccgatcttag

SEQ ID NO: 7024974 - DNA, 22 bp, Homo sapiens
ggttcctgtacttagctatgta

SEQ ID NO: 7024975 - DNA, 22 bp, Homo sapiens
cacaatgatttggttcaaaaat

SEQ ID NO: 7024976 - DNA, 22 bp, Homo sapiens
gagtagaactggttatctaata

SEQ ID NO: 7024977 - DNA, 22 bp, Homo sapiens
tgatgacaatgttgctgcaata

SEQ ID NO: 7024978 - DNA, 18 bp, Homo sapiens
tgaaacaagaatggtgca

SEQ ID NO: 7024979 - DNA, 22 bp, Homo sapiens
gcatgcaattatggtattagat

SEQ ID NO: 7024980 - DNA, 18 bp, Homo sapiens
tctggaacaacttcatgt

SEQ ID NO: 7024981 - DNA, 22 bp, Homo sapiens
gcagctcccagcttgaaaggtc

SEQ ID NO: 7024982 - DNA, 22 bp, Homo sapiens
gtggcagttttgacatcacaaa

SEQ ID NO: 7024983 - DNA, 22 bp, Homo sapiens
tgctgggcactgtctaggtact

SEQ ID NO: 7024984 - DNA, 22 bp, Homo sapiens
gggcctggcatgcagccccgtt

SEQ ID NO: 7024985 - DNA, 22 bp, Homo sapiens
gagccacagtggattgattcca

SEQ ID NO: 7024986 - DNA, 20 bp, Homo sapiens
ctgggcaggtgtttgatctc

SEQ ID NO: 7024987 - DNA, 22 bp, Homo sapiens
tggcagagtcatcacatctgga

SEQ ID NO: 7024988 - DNA, 22 bp, Homo sapiens
caggtacccaggctctttccaa

SEQ ID NO: 7024989 - DNA, 18 bp, Homo sapiens
cctgcgctcaaggtgctc

SEQ ID NO: 7024990 - DNA, 22 bp, Homo sapiens
tattacactttcttcttcaagc

SEQ ID NO: 7024991 - DNA, 22 bp, Homo sapiens
tgtcatatgtaatatgttcatt

SEQ ID NO: 7024992 - DNA, 22 bp, Homo sapiens
attgcaaagcattgtgagcgca

SEQ ID NO: 7024993 - DNA, 22 bp, Homo sapiens
atcagttagttactgctaagat

SEQ ID NO: 7024994 - DNA, 22 bp, Homo sapiens
ggtgtgtggtcctctcacttag

SEQ ID NO: 7024995 - DNA, 22 bp, Homo sapiens
taacaacttgcttttatcttag

SEQ ID NO: 7024996 - DNA, 22 bp, Homo sapiens
gatatatgtaaaagtagacaga

SEQ ID NO: 7024997 - DNA, 22 bp, Homo sapiens
cctgtctgcaggaaattaccag

SEQ ID NO: 7024998 - DNA, 22 bp, Homo sapiens
gcctgcaagatggctggtcact

SEQ ID NO: 7024999 - DNA, 22 bp, Homo sapiens
tacagtaaatgtggtagaaact

SEQ ID NO: 7025000 - DNA, 21 bp, Homo sapiens
tgaggcctctcctgggctggc

SEQ ID NO: 7025001 - DNA, 22 bp, Homo sapiens
gagcaacactccacattgctag

SEQ ID NO: 7025002 - DNA, 17 bp, Homo sapiens
ctctggggacagttcta

SEQ ID NO: 7025003 - DNA, 22 bp, Homo sapiens
actgtgtgactgttattactgt

SEQ ID NO: 7025004 - DNA, 19 bp, Homo sapiens
ttctccagcctgacctgag

SEQ ID NO: 7025005 - DNA, 21 bp, Homo sapiens
agtcttctccagaggctgggg

SEQ ID NO: 7025006 - DNA, 22 bp, Homo sapiens
gggctgcttgctggagacagac

SEQ ID NO: 7025007 - DNA, 21 bp, Homo sapiens
tgtgtgtgcaggcacacacac

SEQ ID NO: 7025008 - DNA, 22 bp, Homo sapiens
tgtggggaggctgcagtgctgc

SEQ ID NO: 7025009 - DNA, 22 bp, Homo sapiens
cctggcagcgtgccgagctgcg

SEQ ID NO: 7025010 - DNA, 22 bp, Homo sapiens
cttaggtaggttttagcctaac

SEQ ID NO: 7025011 - DNA, 22 bp, Homo sapiens
ggtggactgtgttggagttgac

SEQ ID NO: 7025012 - DNA, 22 bp, Homo sapiens
tcagtttatggtctagttcatg

SEQ ID NO: 7025013 - DNA, 22 bp, Homo sapiens
ttcctggcttgtcacatctacg

SEQ ID NO: 7025014 - DNA, 22 bp, Homo sapiens
gtcataggcatggatgtgggtt

SEQ ID NO: 7025015 - DNA, 22 bp, Homo sapiens
tgcaagaggaattctagaagca

SEQ ID NO: 7025016 - DNA, 17 bp, Homo sapiens
tctagtgttcttgctca

SEQ ID NO: 7025017 - DNA, 22 bp, Homo sapiens
agtctgcttcctggagaactca

SEQ ID NO: 7025018 - DNA, 22 bp, Homo sapiens
ggattaacagctcctgggtggt

SEQ ID NO: 7025019 - DNA, 22 bp, Homo sapiens
ggcgcggagctggcttttggcc

SEQ ID NO: 7025020 - DNA, 22 bp, Homo sapiens
cctggacacccattccttggct

SEQ ID NO: 7025021 - DNA, 22 bp, Homo sapiens
aagtccattcttccagccagct

SEQ ID NO: 7025022 - DNA, 22 bp, Homo sapiens
ttagtgtttaaaggtttcagag

SEQ ID NO: 7025023 - DNA, 20 bp, Homo sapiens
tctgctcagccctcagtggc

SEQ ID NO: 7025024 - DNA, 19 bp, Homo sapiens
tgtgcccttggcaatggga

SEQ ID NO: 7025025 - DNA, 20 bp, Homo sapiens
cccaaagcttcatatgagcc

SEQ ID NO: 7025026 - DNA, 22 bp, Homo sapiens
tctctgtgtctcatgttcctat

SEQ ID NO: 7025027 - DNA, 22 bp, Homo sapiens
acattctgtgatgctgtcccaa

SEQ ID NO: 7025028 - DNA, 21 bp, Homo sapiens
ttgatttagcagatctagctg

SEQ ID NO: 7025029 - DNA, 22 bp, Homo sapiens
cgcagcttcagggccaggaggg

SEQ ID NO: 7025030 - DNA, 22 bp, Homo sapiens
gatggcaggtagtggtctcatc

SEQ ID NO: 7025031 - DNA, 22 bp, Homo sapiens
tctggagctgggggcttagtat

SEQ ID NO: 7025032 - DNA, 22 bp, Homo sapiens
ctgtcctgaagttttcatgaga

SEQ ID NO: 7025033 - DNA, 22 bp, Homo sapiens
cagcgagagacaaagagctgtg

SEQ ID NO: 7025034 - DNA, 22 bp, Homo sapiens
tcagggctcagtgggataggtc

SEQ ID NO: 7025035 - DNA, 22 bp, Homo sapiens
aatttgacccatcttggaattt

SEQ ID NO: 7025036 - DNA, 22 bp, Homo sapiens
tgtaacactcaatctgtttaac

SEQ ID NO: 7025037 - DNA, 22 bp, Homo sapiens
attcatccttaccagtccccgg

SEQ ID NO: 7025038 - DNA, 22 bp, Homo sapiens
aggtgggcacagatggagaagt

SEQ ID NO: 7025039 - DNA, 22 bp, Homo sapiens
ggtgtgggccctgatgtcagca

SEQ ID NO: 7025040 - DNA, 22 bp, Homo sapiens
attaggcattcatgcagctcct

SEQ ID NO: 7025041 - DNA, 22 bp, Homo sapiens
tctctgggttctcactcagcac

SEQ ID NO: 7025042 - DNA, 22 bp, Homo sapiens
aaagcctgtctggtcatagcta

SEQ ID NO: 7025043 - DNA, 22 bp, Homo sapiens
ggctatccatggatctgaactc

SEQ ID NO: 7025044 - DNA, 19 bp, Homo sapiens
gctgcagaggtgaagaaga

SEQ ID NO: 7025045 - DNA, 22 bp, Homo sapiens
tttgttaaatatttattgagtg

SEQ ID NO: 7025046 - DNA, 22 bp, Homo sapiens
gtgcaacctcgtcagagcacct

SEQ ID NO: 7025047 - DNA, 22 bp, Homo sapiens
gcaaaggctagagacacaggga

SEQ ID NO: 7025048 - DNA, 22 bp, Homo sapiens
gggcaatgtggcaaaaccctgt

SEQ ID NO: 7025049 - DNA, 22 bp, Homo sapiens
agtgttggaccgaggtggagcc

SEQ ID NO: 7025050 - DNA, 22 bp, Homo sapiens
cccatgtggtaccttctgtgga

SEQ ID NO: 7025051 - DNA, 20 bp, Homo sapiens
actgagaccaataagtagaa

SEQ ID NO: 7025052 - DNA, 22 bp, Homo sapiens
gcagcaggaatttaaatttata

SEQ ID NO: 7025053 - DNA, 22 bp, Homo sapiens
tatttcacatgtgggaaacata

SEQ ID NO: 7025054 - DNA, 22 bp, Homo sapiens
ccagagaggcaaaactccttcc

SEQ ID NO: 7025055 - DNA, 22 bp, Homo sapiens
gtgtggggccaggatcagggct

SEQ ID NO: 7025056 - DNA, 22 bp, Homo sapiens
agtctctcacagaggattctcc

SEQ ID NO: 7025057 - DNA, 23 bp, Homo sapiens
acagaagccaggagccgctgggc

SEQ ID NO: 7025058 - DNA, 22 bp, Homo sapiens
tgcatgaggactcagagcttct

SEQ ID NO: 7025059 - DNA, 23 bp, Homo sapiens
aaagtttgaagcaacagtagttg

SEQ ID NO: 7025060 - DNA, 22 bp, Homo sapiens
caagatttaagagtcagccttg

SEQ ID NO: 7025061 - DNA, 22 bp, Homo sapiens
gtgtttgttcatcctctcttct

SEQ ID NO: 7025062 - DNA, 22 bp, Homo sapiens
tatgaactagctgatttagttt

SEQ ID NO: 7025063 - DNA, 22 bp, Homo sapiens
gtggtgtttgccagttaataac

SEQ ID NO: 7025064 - DNA, 22 bp, Homo sapiens
tagggaggagggttttcaaatc

SEQ ID NO: 7025065 - DNA, 22 bp, Homo sapiens
gcatgcaaaaaatgtatttgtt

SEQ ID NO: 7025066 - DNA, 22 bp, Homo sapiens
attaattttacctttgtaaaca

SEQ ID NO: 7025067 - DNA, 22 bp, Homo sapiens
attagtagagggagaagcttgg

SEQ ID NO: 7025068 - DNA, 22 bp, Homo sapiens
taatgatgctagatttatctgg

SEQ ID NO: 7025069 - DNA, 22 bp, Homo sapiens
tatgagtggttgaatggtaaac

SEQ ID NO: 7025070 - DNA, 21 bp, Homo sapiens
ctgtctacatatatacacaca

SEQ ID NO: 7025071 - DNA, 21 bp, Homo sapiens
gctcagagtattgcactgttt

SEQ ID NO: 7025072 - DNA, 22 bp, Homo sapiens
aaaaaattatcatagttcctga

SEQ ID NO: 7025073 - DNA, 21 bp, Homo sapiens
acagcagagatcaagactaag

SEQ ID NO: 7025074 - DNA, 22 bp, Homo sapiens
atgtcgaggctcccctagttat

SEQ ID NO: 7025075 - DNA, 22 bp, Homo sapiens
tacaacagtaatcaaggttttt

SEQ ID NO: 7025076 - DNA, 22 bp, Homo sapiens
gtggcctagaggtgcaaggaac

SEQ ID NO: 7025077 - DNA, 22 bp, Homo sapiens
agtcatgtgttcatctttcatt

SEQ ID NO: 7025078 - DNA, 22 bp, Homo sapiens
tgggggtgtcctggtgcacaca

SEQ ID NO: 7025079 - DNA, 22 bp, Homo sapiens
ttctcccctctgaaatggggct

SEQ ID NO: 7025080 - DNA, 22 bp, Homo sapiens
accatataacaagtttaggaga

SEQ ID NO: 7025081 - DNA, 22 bp, Homo sapiens
acatctgggcctaaggctatat

SEQ ID NO: 7025082 - DNA, 22 bp, Homo sapiens
gctggagatagtaggatccata

SEQ ID NO: 7025083 - DNA, 22 bp, Homo sapiens
agtaaaacagagaaatcactca

SEQ ID NO: 7025084 - DNA, 19 bp, Homo sapiens
ctgcagctgcaccatccca

SEQ ID NO: 7025085 - DNA, 22 bp, Homo sapiens
tcacacttcaaagggttagatc

SEQ ID NO: 7025086 - DNA, 22 bp, Homo sapiens
cccagagatctactgagcccag

SEQ ID NO: 7025087 - DNA, 22 bp, Homo sapiens
ctttctcaatgccggaaggcac

SEQ ID NO: 7025088 - DNA, 22 bp, Homo sapiens
actgctgtgttcggctccccgt

SEQ ID NO: 7025089 - DNA, 22 bp, Homo sapiens
tcagtgcatggacagatttaga

SEQ ID NO: 7025090 - DNA, 22 bp, Homo sapiens
atctaagacaatgagtgagact

SEQ ID NO: 7025091 - DNA, 22 bp, Homo sapiens
ggaaagctactggtgtcctctg

SEQ ID NO: 7025092 - DNA, 22 bp, Homo sapiens
atagtcataggcaaatagaaga

SEQ ID NO: 7025093 - DNA, 22 bp, Homo sapiens
ctgctgtcgccgagctgcatgc

SEQ ID NO: 7025094 - DNA, 22 bp, Homo sapiens
caggcagaggaagtctgggtct

SEQ ID NO: 7025095 - DNA, 22 bp, Homo sapiens
ccatggccaggaaagccaaggt

SEQ ID NO: 7025096 - DNA, 21 bp, Homo sapiens
tcatgcatgagtttatatata

SEQ ID NO: 7025097 - DNA, 17 bp, Homo sapiens
cgttagtgattcctgcc

SEQ ID NO: 7025098 - DNA, 22 bp, Homo sapiens
gagcagctctgtgcctggagac

SEQ ID NO: 7025099 - DNA, 22 bp, Homo sapiens
tcattgcagtgatgttgtatgt

SEQ ID NO: 7025100 - DNA, 22 bp, Homo sapiens
ccctcccggcgtgctgggctcg

SEQ ID NO: 7025101 - DNA, 22 bp, Homo sapiens
aatgcaaagtgaggtgagtggc

SEQ ID NO: 7025102 - DNA, 22 bp, Homo sapiens
tccttggctttctggagcttct

SEQ ID NO: 7025103 - DNA, 22 bp, Homo sapiens
tttcaacaccagagaccatgcg

SEQ ID NO: 7025104 - DNA, 22 bp, Homo sapiens
acagactgtcatgacactatat

SEQ ID NO: 7025105 - DNA, 22 bp, Homo sapiens
aaggagaaatggtagatgtgca

SEQ ID NO: 7025106 - DNA, 22 bp, Homo sapiens
tagtgattctgatgtaagacaa

SEQ ID NO: 7025107 - DNA, 22 bp, Homo sapiens
cttggtctagtgagtgagcata

SEQ ID NO: 7025108 - DNA, 22 bp, Homo sapiens
caggaagtctttgcccaggcca

SEQ ID NO: 7025109 - DNA, 22 bp, Homo sapiens
gtaactaggggcatggacacat

SEQ ID NO: 7025110 - DNA, 22 bp, Homo sapiens
cccaggctagaaaggccaacaa

SEQ ID NO: 7025111 - DNA, 22 bp, Homo sapiens
gagatggcaggtgtgtgggaca

SEQ ID NO: 7025112 - DNA, 22 bp, Homo sapiens
gctctgtatgagggtgagagat

SEQ ID NO: 7025113 - DNA, 22 bp, Homo sapiens
ctagaggggaaaaaggtcttgt

SEQ ID NO: 7025114 - DNA, 22 bp, Homo sapiens
aaagagaaacttagaagcctga

SEQ ID NO: 7025115 - DNA, 22 bp, Homo sapiens
tgatcttttctatttatggtag

SEQ ID NO: 7025116 - DNA, 19 bp, Homo sapiens
agtctggagtaaaaggaat

SEQ ID NO: 7025117 - DNA, 22 bp, Homo sapiens
aagcaatagcaacaactttaca

SEQ ID NO: 7025118 - DNA, 22 bp, Homo sapiens
ctgtaaactaggtcatttttaa

SEQ ID NO: 7025119 - DNA, 22 bp, Homo sapiens
cctgctcaacgaatatggcgat

SEQ ID NO: 7025120 - DNA, 22 bp, Homo sapiens
cgtgtctgtatgtcaatcagct

SEQ ID NO: 7025121 - DNA, 22 bp, Homo sapiens
ttcggtcattcaatgagggcag

SEQ ID NO: 7025122 - DNA, 22 bp, Homo sapiens
aagctcagcagccaggccctgt

SEQ ID NO: 7025123 - DNA, 22 bp, Homo sapiens
aacacttcccatcagagggaca

SEQ ID NO: 7025124 - DNA, 22 bp, Homo sapiens
cagttagctgacaagtaggcta

SEQ ID NO: 7025125 - DNA, 22 bp, Homo sapiens
aggcctctgtagggccctgaag

SEQ ID NO: 7025126 - DNA, 22 bp, Homo sapiens
tgcaatccccgcctcaacagga

SEQ ID NO: 7025127 - DNA, 19 bp, Homo sapiens
tgagttctgtggttctcaa

SEQ ID NO: 7025128 - DNA, 20 bp, Homo sapiens
tttctgtgagaaacactgtt

SEQ ID NO: 7025129 - DNA, 22 bp, Homo sapiens
tgcatttgctggggatgtgatt

SEQ ID NO: 7025130 - DNA, 22 bp, Homo sapiens
atgttaccagtgcacatttgat

SEQ ID NO: 7025131 - DNA, 22 bp, Homo sapiens
taggaatgataatagtaaagag

SEQ ID NO: 7025132 - DNA, 22 bp, Homo sapiens
tctctgtgcaggatgctgagtt

SEQ ID NO: 7025133 - DNA, 22 bp, Homo sapiens
ctgggtcccaatagcttttgtt

SEQ ID NO: 7025134 - DNA, 22 bp, Homo sapiens
aaggccaggccagatgacagtc

SEQ ID NO: 7025135 - DNA, 22 bp, Homo sapiens
ggcttctcccattcttcagggg

SEQ ID NO: 7025136 - DNA, 22 bp, Homo sapiens
tagcaagagtgggctttgtggg

SEQ ID NO: 7025137 - DNA, 22 bp, Homo sapiens
ggcttcttagaatttgacttac

SEQ ID NO: 7025138 - DNA, 22 bp, Homo sapiens
ctgcctgtgccaatgctccttt

SEQ ID NO: 7025139 - DNA, 22 bp, Homo sapiens
ggtgtcaatgctcccaccttgg

SEQ ID NO: 7025140 - DNA, 22 bp, Homo sapiens
tctgcgctgccttgatccttgg

SEQ ID NO: 7025141 - DNA, 21 bp, Homo sapiens
agcagcatcagcctcacctga

SEQ ID NO: 7025142 - DNA, 22 bp, Homo sapiens
gaggggggcgccctgcagtgca

SEQ ID NO: 7025143 - DNA, 22 bp, Homo sapiens
tccacattgcacagccagaaca

SEQ ID NO: 7025144 - DNA, 22 bp, Homo sapiens
cagaaggtgaaggcagaacctt

SEQ ID NO: 7025145 - DNA, 22 bp, Homo sapiens
ttccacagtcatcctgggaatt

SEQ ID NO: 7025146 - DNA, 20 bp, Homo sapiens
tcaacctactgtgctcaagt

SEQ ID NO: 7025147 - DNA, 22 bp, Homo sapiens
taagagttagggctagcaatat

SEQ ID NO: 7025148 - DNA, 22 bp, Homo sapiens
ccagccctcggtagtcccatag

SEQ ID NO: 7025149 - DNA, 22 bp, Homo sapiens
aatgggaagtcactactgttac

SEQ ID NO: 7025150 - DNA, 22 bp, Homo sapiens
gagaggccggcgtcgctgcggc

SEQ ID NO: 7025151 - DNA, 22 bp, Homo sapiens
tagttatatccagtctttaaaa

SEQ ID NO: 7025152 - DNA, 22 bp, Homo sapiens
gaacactggggtatcattgagc

SEQ ID NO: 7025153 - DNA, 22 bp, Homo sapiens
taaatgtctgttaacatgaatg

SEQ ID NO: 7025154 - DNA, 23 bp, Homo sapiens
ggtaccagcacagagtggagagg

SEQ ID NO: 7025155 - DNA, 19 bp, Homo sapiens
cggtggcttgcagggaggt

SEQ ID NO: 7025156 - DNA, 22 bp, Homo sapiens
ttctgtgattcctccagccagc

SEQ ID NO: 7025157 - DNA, 22 bp, Homo sapiens
gaaattgtcagcttctttcagt

SEQ ID NO: 7025158 - DNA, 22 bp, Homo sapiens
cagctgttcggggctggcatgt

SEQ ID NO: 7025159 - DNA, 22 bp, Homo sapiens
gtcttatagtacaatttgaagt

SEQ ID NO: 7025160 - DNA, 19 bp, Homo sapiens
actgtagcactgcagtata

SEQ ID NO: 7025161 - DNA, 22 bp, Homo sapiens
tccaggagaccagatgtaggcc

SEQ ID NO: 7025162 - DNA, 23 bp, Homo sapiens
ccattttgtgttttggagaaaca

SEQ ID NO: 7025163 - DNA, 22 bp, Homo sapiens
acaagtctgttatgcacctgga

SEQ ID NO: 7025164 - DNA, 22 bp, Homo sapiens
atgggctgtcctagtccagccc

SEQ ID NO: 7025165 - DNA, 22 bp, Homo sapiens
ttaacagtggctaagactgagg

SEQ ID NO: 7025166 - DNA, 22 bp, Homo sapiens
agaagcagctttcaaggtgatt

SEQ ID NO: 7025167 - DNA, 22 bp, Homo sapiens
agtgttaatggtgtatattagg

SEQ ID NO: 7025168 - DNA, 22 bp, Homo sapiens
tgggagtttgttagaaatgcag

SEQ ID NO: 7025169 - DNA, 22 bp, Homo sapiens
tagatgttttgatatttgctga

SEQ ID NO: 7025170 - DNA, 22 bp, Homo sapiens
ctgatgcccctggacctgtgac

SEQ ID NO: 7025171 - DNA, 22 bp, Homo sapiens
agaagtgccatactgtggtcca

SEQ ID NO: 7025172 - DNA, 22 bp, Homo sapiens
accaggagcattttttattagt

SEQ ID NO: 7025173 - DNA, 22 bp, Homo sapiens
tcattgaatatggggccataca

SEQ ID NO: 7025174 - DNA, 22 bp, Homo sapiens
aagtcacccacaggcagcagaa

SEQ ID NO: 7025175 - DNA, 22 bp, Homo sapiens
cctgcagtttgttgtgaccccg

SEQ ID NO: 7025176 - DNA, 21 bp, Homo sapiens
gctgggcctgtacttgccctg

SEQ ID NO: 7025177 - DNA, 22 bp, Homo sapiens
cattctatcttggactggatct

SEQ ID NO: 7025178 - DNA, 22 bp, Homo sapiens
aatgtcaacacttggtatgtca

SEQ ID NO: 7025179 - DNA, 22 bp, Homo sapiens
ggctgtgcaccatccacctccc

SEQ ID NO: 7025180 - DNA, 22 bp, Homo sapiens
tcagtgcctactttgatcaatt

SEQ ID NO: 7025181 - DNA, 22 bp, Homo sapiens
tctcccagtgtctggcagtcag

SEQ ID NO: 7025182 - DNA, 22 bp, Homo sapiens
tctctgtcacacaatctacaca

SEQ ID NO: 7025183 - DNA, 23 bp, Homo sapiens
ttgaggagtgctttttctatcca

SEQ ID NO: 7025184 - DNA, 22 bp, Homo sapiens
aggctgtagatctagacatgta

SEQ ID NO: 7025185 - DNA, 22 bp, Homo sapiens
tgccacagttgtttgtgctcta

SEQ ID NO: 7025186 - DNA, 22 bp, Homo sapiens
gctgccctgtccggctctcctg

SEQ ID NO: 7025187 - DNA, 22 bp, Homo sapiens
aattcctctatctttcttcaag

SEQ ID NO: 7025188 - DNA, 22 bp, Homo sapiens
gcctgctggaggagcctcaggg

SEQ ID NO: 7025189 - DNA, 22 bp, Homo sapiens
cagtgcaacttttgcctcccgg

SEQ ID NO: 7025190 - DNA, 22 bp, Homo sapiens
catagaaagtattatggaattt

SEQ ID NO: 7025191 - DNA, 22 bp, Homo sapiens
gctgtgcccatattctgctgac

SEQ ID NO: 7025192 - DNA, 22 bp, Homo sapiens
ccagctccaggactgggagctg

SEQ ID NO: 7025193 - DNA, 22 bp, Homo sapiens
tacttgctgggtgtaattttct

SEQ ID NO: 7025194 - DNA, 20 bp, Homo sapiens
gagacagcaaaagcctctcc

SEQ ID NO: 7025195 - DNA, 22 bp, Homo sapiens
atttatagggcattgaaaactg

SEQ ID NO: 7025196 - DNA, 22 bp, Homo sapiens
aaagtgtggagattgaactaaa

SEQ ID NO: 7025197 - DNA, 22 bp, Homo sapiens
caccaggataaaacctctagat

SEQ ID NO: 7025198 - DNA, 22 bp, Homo sapiens
ctggagagatcctcctgaaaaa

SEQ ID NO: 7025199 - DNA, 22 bp, Homo sapiens
ggtggctctgttgtcaactgat

SEQ ID NO: 7025200 - DNA, 22 bp, Homo sapiens
tacctctctaaacccagggaca

SEQ ID NO: 7025201 - DNA, 22 bp, Homo sapiens
aattaggaataaatgagtactt

SEQ ID NO: 7025202 - DNA, 22 bp, Homo sapiens
aagtaacaggtgcttagtttat

SEQ ID NO: 7025203 - DNA, 22 bp, Homo sapiens
cagaggagtgggccgttatggt

SEQ ID NO: 7025204 - DNA, 22 bp, Homo sapiens
gccaggctggcaaaaggaaacc

SEQ ID NO: 7025205 - DNA, 22 bp, Homo sapiens
agctgggcaccccgctgcgtct

SEQ ID NO: 7025206 - DNA, 22 bp, Homo sapiens
actgccagatataaaaactgtg

SEQ ID NO: 7025207 - DNA, 22 bp, Homo sapiens
gtccacataggaacccagcttc

SEQ ID NO: 7025208 - DNA, 22 bp, Homo sapiens
gctgggctggccgccgagatcg

SEQ ID NO: 7025209 - DNA, 22 bp, Homo sapiens
ccagaggtggtggtgtctagaa

SEQ ID NO: 7025210 - DNA, 22 bp, Homo sapiens
tctgagggaatagctattgtag

SEQ ID NO: 7025211 - DNA, 22 bp, Homo sapiens
cacttctcacaaagtgacattc

SEQ ID NO: 7025212 - DNA, 22 bp, Homo sapiens
tctttggatatcgctagaccgt

SEQ ID NO: 7025213 - DNA, 22 bp, Homo sapiens
agttccagctgtgaccagaaaa

SEQ ID NO: 7025214 - DNA, 22 bp, Homo sapiens
aaaaagacagaggatgaggcag

SEQ ID NO: 7025215 - DNA, 22 bp, Homo sapiens
tattcctggtgttggctgggtc

SEQ ID NO: 7025216 - DNA, 23 bp, Homo sapiens
ccctgcactaagaggagaaggtg

SEQ ID NO: 7025217 - DNA, 22 bp, Homo sapiens
ggtgcagctggacagagaagcc

SEQ ID NO: 7025218 - DNA, 22 bp, Homo sapiens
ttgtactgtggatctgtatttg

SEQ ID NO: 7025219 - DNA, 22 bp, Homo sapiens
ggtcacccatgatcacatcacc

SEQ ID NO: 7025220 - DNA, 22 bp, Homo sapiens
tgtcttttctactgtaagcata

SEQ ID NO: 7025221 - DNA, 22 bp, Homo sapiens
tctgctttgaccttcttgatgc

SEQ ID NO: 7025222 - DNA, 22 bp, Homo sapiens
taagttcattagactacagata

SEQ ID NO: 7025223 - DNA, 22 bp, Homo sapiens
ttaccacagtgcatgacttctg

SEQ ID NO: 7025224 - DNA, 22 bp, Homo sapiens
tgtaaaaggaaatcaaagcact

SEQ ID NO: 7025225 - DNA, 19 bp, Homo sapiens
gaatacagataataagcag

SEQ ID NO: 7025226 - DNA, 22 bp, Homo sapiens
cccaggagcttctctctgcctc

SEQ ID NO: 7025227 - DNA, 22 bp, Homo sapiens
ctcagggaggccaatttatcaa

SEQ ID NO: 7025228 - DNA, 22 bp, Homo sapiens
ctgtgccatccgcttgacctgg

SEQ ID NO: 7025229 - DNA, 22 bp, Homo sapiens
tgcattaagtgtctgcatatgg

SEQ ID NO: 7025230 - DNA, 22 bp, Homo sapiens
gtctgaattctgtgtaactcta

SEQ ID NO: 7025231 - DNA, 22 bp, Homo sapiens
tgtgtgcaattcttaacataca

SEQ ID NO: 7025232 - DNA, 22 bp, Homo sapiens
taagccatcatcatggctttgg

SEQ ID NO: 7025233 - DNA, 22 bp, Homo sapiens
cccagaggtgcttcagaggtgc

SEQ ID NO: 7025234 - DNA, 22 bp, Homo sapiens
tcccaagactcaatttccttac

SEQ ID NO: 7025235 - DNA, 20 bp, Homo sapiens
ggcactgcaccagttagtag

SEQ ID NO: 7025236 - DNA, 18 bp, Homo sapiens
tccagttttcccagcatc

SEQ ID NO: 7025237 - DNA, 22 bp, Homo sapiens
acaataaggatttttaggggca

SEQ ID NO: 7025238 - DNA, 22 bp, Homo sapiens
aagtttggaggtcactggtctt

SEQ ID NO: 7025239 - DNA, 22 bp, Homo sapiens
gtattagttatctactgctgtg

SEQ ID NO: 7025240 - DNA, 22 bp, Homo sapiens
cagtggcatggttgactgcagt

SEQ ID NO: 7025241 - DNA, 22 bp, Homo sapiens
agctgcagcctcatgattcggt

SEQ ID NO: 7025242 - DNA, 22 bp, Homo sapiens
cattaagatttttttctactgg

SEQ ID NO: 7025243 - DNA, 22 bp, Homo sapiens
ggcatcctggccacagtacctg

SEQ ID NO: 7025244 - DNA, 22 bp, Homo sapiens
actgaaccaggcagagaaaaat

SEQ ID NO: 7025245 - DNA, 22 bp, Homo sapiens
aacatctagttcctatataata

SEQ ID NO: 7025246 - DNA, 22 bp, Homo sapiens
ctgaccctagcatctctgtgca

SEQ ID NO: 7025247 - DNA, 22 bp, Homo sapiens
ctgagcagcgtggggagctggc

SEQ ID NO: 7025248 - DNA, 22 bp, Homo sapiens
tggcaggatttgcccggaagga

SEQ ID NO: 7025249 - DNA, 22 bp, Homo sapiens
tacagttcctctcgtggaggtg

SEQ ID NO: 7025250 - DNA, 22 bp, Homo sapiens
atgcctgtggagatatttaagg

SEQ ID NO: 7025251 - DNA, 22 bp, Homo sapiens
agctccaggccttgggccccgg

SEQ ID NO: 7025252 - DNA, 23 bp, Homo sapiens
atagaaactaacaatttggctta

SEQ ID NO: 7025253 - DNA, 22 bp, Homo sapiens
tagggaccttagaattgtatgt

SEQ ID NO: 7025254 - DNA, 22 bp, Homo sapiens
acttcataaattagactaatgg

SEQ ID NO: 7025255 - DNA, 22 bp, Homo sapiens
gcatgcacggggcatatgggac

SEQ ID NO: 7025256 - DNA, 22 bp, Homo sapiens
actgagggactcccacctggca

SEQ ID NO: 7025257 - DNA, 22 bp, Homo sapiens
tgaaatggatgagagcagaggt

SEQ ID NO: 7025258 - DNA, 22 bp, Homo sapiens
tccttctttgacaagtggcaga

SEQ ID NO: 7025259 - DNA, 22 bp, Homo sapiens
ttccagttggtagaatgtaagg

SEQ ID NO: 7025260 - DNA, 22 bp, Homo sapiens
cagagaggatggattccatagc

SEQ ID NO: 7025261 - DNA, 22 bp, Homo sapiens
tagtagcaccagtcatatttga

SEQ ID NO: 7025262 - DNA, 22 bp, Homo sapiens
gagaaacactgttagtttatta

SEQ ID NO: 7025263 - DNA, 22 bp, Homo sapiens
tatgtacacggtggctctgaag

SEQ ID NO: 7025264 - DNA, 19 bp, Homo sapiens
gaaagtcatagagcttgtc

SEQ ID NO: 7025265 - DNA, 22 bp, Homo sapiens
tgtcctggagacacaaggtggt

SEQ ID NO: 7025266 - DNA, 19 bp, Homo sapiens
tcagggagtttacagcatg

SEQ ID NO: 7025267 - DNA, 22 bp, Homo sapiens
ttaattggcctcttagaggtta

SEQ ID NO: 7025268 - DNA, 22 bp, Homo sapiens
ctcagtgctttggatcctggat

SEQ ID NO: 7025269 - DNA, 22 bp, Homo sapiens
ggtccatgataggaagttccga

SEQ ID NO: 7025270 - DNA, 23 bp, Homo sapiens
caggtattgatttttcttctagg

SEQ ID NO: 7025271 - DNA, 22 bp, Homo sapiens
tgagagttttgacgcttgtaac

SEQ ID NO: 7025272 - DNA, 19 bp, Homo sapiens
agttggggcagggaagaga

SEQ ID NO: 7025273 - DNA, 22 bp, Homo sapiens
gggctccacgcacgcgagaggt

SEQ ID NO: 7025274 - DNA, 22 bp, Homo sapiens
ttctgctgtttgtagtaatgta

SEQ ID NO: 7025275 - DNA, 22 bp, Homo sapiens
aaattggcagttcagggaatta

SEQ ID NO: 7025276 - DNA, 22 bp, Homo sapiens
atgactgctctgggctcccatg

SEQ ID NO: 7025277 - DNA, 22 bp, Homo sapiens
gctgtctgggatgtcactgctg

SEQ ID NO: 7025278 - DNA, 22 bp, Homo sapiens
cttgctggggtaagtctgtgct

SEQ ID NO: 7025279 - DNA, 22 bp, Homo sapiens
tacagtgatttctactggtgtt

SEQ ID NO: 7025280 - DNA, 20 bp, Homo sapiens
acagatgaggatgcggaggc

SEQ ID NO: 7025281 - DNA, 22 bp, Homo sapiens
tctggctctcaacaaatattta

SEQ ID NO: 7025282 - DNA, 22 bp, Homo sapiens
accttggaaatgcccattgcct

SEQ ID NO: 7025283 - DNA, 18 bp, Homo sapiens
tcacatcatcccatgctt

SEQ ID NO: 7025284 - DNA, 22 bp, Homo sapiens
atgggctatcaaatggaggtat

SEQ ID NO: 7025285 - DNA, 22 bp, Homo sapiens
gcccaagcagcttcccgagctt

SEQ ID NO: 7025286 - DNA, 18 bp, Homo sapiens
agggagcatctggttgcc

SEQ ID NO: 7025287 - DNA, 22 bp, Homo sapiens
aggtctgattttttattcccag

SEQ ID NO: 7025288 - DNA, 22 bp, Homo sapiens
tggtgcccactctggacccagc

SEQ ID NO: 7025289 - DNA, 22 bp, Homo sapiens
tcctcaggagagctcctatgcc

SEQ ID NO: 7025290 - DNA, 22 bp, Homo sapiens
agagggccccagctgatctgag

SEQ ID NO: 7025291 - DNA, 22 bp, Homo sapiens
tcaggcctagggagaaaattca

SEQ ID NO: 7025292 - DNA, 22 bp, Homo sapiens
agacagggccactcatcctcac

SEQ ID NO: 7025293 - DNA, 22 bp, Homo sapiens
tcatgtatttgtgatagatgac

SEQ ID NO: 7025294 - DNA, 22 bp, Homo sapiens
aataagctggagctatattgag

SEQ ID NO: 7025295 - DNA, 21 bp, Homo sapiens
cagatcaatttacttgtccct

SEQ ID NO: 7025296 - DNA, 22 bp, Homo sapiens
cagaaggtttgaaagatgtctt

SEQ ID NO: 7025297 - DNA, 22 bp, Homo sapiens
ttgatgtagggattcctgtaaa

SEQ ID NO: 7025298 - DNA, 19 bp, Homo sapiens
atcttcaaagccagcagca

SEQ ID NO: 7025299 - DNA, 22 bp, Homo sapiens
gtgtgagggacagagaaagggg

SEQ ID NO: 7025300 - DNA, 21 bp, Homo sapiens
gaaatactgccttaggagctg

SEQ ID NO: 7025301 - DNA, 21 bp, Homo sapiens
cgggctggccgggccctcacc

SEQ ID NO: 7025302 - DNA, 22 bp, Homo sapiens
taagccccctcaccctggcttc

SEQ ID NO: 7025303 - DNA, 22 bp, Homo sapiens
tctcccacggtacaggataaac

SEQ ID NO: 7025304 - DNA, 22 bp, Homo sapiens
agatgacagctacgggatgaaa

SEQ ID NO: 7025305 - DNA, 22 bp, Homo sapiens
tctggatgggatgaggcaacaa

SEQ ID NO: 7025306 - DNA, 22 bp, Homo sapiens
taggaccaagtggagtgcaggt

SEQ ID NO: 7025307 - DNA, 22 bp, Homo sapiens
ttagaacttaagaatactgtct

SEQ ID NO: 7025308 - DNA, 20 bp, Homo sapiens
ttctggaggctacaagtctg

SEQ ID NO: 7025309 - DNA, 22 bp, Homo sapiens
ttattccaggtacttggtttct

SEQ ID NO: 7025310 - DNA, 22 bp, Homo sapiens
tgtgacactggccatctgggtt

SEQ ID NO: 7025311 - DNA, 22 bp, Homo sapiens
tatcttctcagtatatgggatg

SEQ ID NO: 7025312 - DNA, 22 bp, Homo sapiens
agtatatttaccattgggtggg

SEQ ID NO: 7025313 - DNA, 22 bp, Homo sapiens
gttgtacaggactgcccagtgt

SEQ ID NO: 7025314 - DNA, 22 bp, Homo sapiens
ctggtcagggctctttgggagc

SEQ ID NO: 7025315 - DNA, 20 bp, Homo sapiens
tgtgccctgcagacttcttt

SEQ ID NO: 7025316 - DNA, 22 bp, Homo sapiens
tgcctgcagcgtctccagcagg

SEQ ID NO: 7025317 - DNA, 22 bp, Homo sapiens
taaatcaagaatatcagcttgt

SEQ ID NO: 7025318 - DNA, 22 bp, Homo sapiens
tccagggctgggttggctcagc

SEQ ID NO: 7025319 - DNA, 22 bp, Homo sapiens
aggcacgagcaatggccgagga

SEQ ID NO: 7025320 - DNA, 22 bp, Homo sapiens
ctcagtagacatactcatgcca

SEQ ID NO: 7025321 - DNA, 22 bp, Homo sapiens
tcttggaagggttgtgggatga

SEQ ID NO: 7025322 - DNA, 22 bp, Homo sapiens
cagacagctgctttcttgctgt

SEQ ID NO: 7025323 - DNA, 23 bp, Homo sapiens
gcatgcaaagaatataggtgttc

SEQ ID NO: 7025324 - DNA, 22 bp, Homo sapiens
aagagtttttggagtgtgagtt

SEQ ID NO: 7025325 - DNA, 22 bp, Homo sapiens
ccaggctagagtgcaatggcgc

SEQ ID NO: 7025326 - DNA, 22 bp, Homo sapiens
actcagagcctcgagggactgc

SEQ ID NO: 7025327 - DNA, 22 bp, Homo sapiens
agaaacctgtgtgctgtgatga

SEQ ID NO: 7025328 - DNA, 22 bp, Homo sapiens
aagtcctactacctattgtgca

SEQ ID NO: 7025329 - DNA, 22 bp, Homo sapiens
accacactggctagtgaagaag

SEQ ID NO: 7025330 - DNA, 22 bp, Homo sapiens
ctgccctctagaggaggactga

SEQ ID NO: 7025331 - DNA, 22 bp, Homo sapiens
aaagtacttgatgctacagagt

SEQ ID NO: 7025332 - DNA, 22 bp, Homo sapiens
gtcctgaatgcctttaggcaga

SEQ ID NO: 7025333 - DNA, 22 bp, Homo sapiens
gttcagtgtttgatttctgctg

SEQ ID NO: 7025334 - DNA, 22 bp, Homo sapiens
ggtgaggctaagtgacacaggg

SEQ ID NO: 7025335 - DNA, 22 bp, Homo sapiens
ttaagagtttagtgccacctgg

SEQ ID NO: 7025336 - DNA, 22 bp, Homo sapiens
gagggtgggccagatatgaggg

SEQ ID NO: 7025337 - DNA, 22 bp, Homo sapiens
gactgaaattataccaagtggt

SEQ ID NO: 7025338 - DNA, 22 bp, Homo sapiens
tgtaggaagatataaaatatct

SEQ ID NO: 7025339 - DNA, 22 bp, Homo sapiens
ctcccctgagcatagactctgt

SEQ ID NO: 7025340 - DNA, 22 bp, Homo sapiens
tgtacagaacttgctgtccctt

SEQ ID NO: 7025341 - DNA, 22 bp, Homo sapiens
ttggagtgacagatgaggaaac

SEQ ID NO: 7025342 - DNA, 18 bp, Homo sapiens
gcagcaaagggcccgggg

SEQ ID NO: 7025343 - DNA, 22 bp, Homo sapiens
actgatggcagggtaggggtca

SEQ ID NO: 7025344 - DNA, 22 bp, Homo sapiens
gaggcagcatctatggtgggaa

SEQ ID NO: 7025345 - DNA, 22 bp, Homo sapiens
aaggcagctttaaaaaagatgc

SEQ ID NO: 7025346 - DNA, 22 bp, Homo sapiens
tcggagagttcatgaagacccg

SEQ ID NO: 7025347 - DNA, 22 bp, Homo sapiens
gcagatgctgctcctctctaga

SEQ ID NO: 7025348 - DNA, 22 bp, Homo sapiens
atttggaatagctgtagaaata

SEQ ID NO: 7025349 - DNA, 22 bp, Homo sapiens
ttgttacatcttatgtaagtgg

SEQ ID NO: 7025350 - DNA, 22 bp, Homo sapiens
tagtttcagctccttcatcctg

SEQ ID NO: 7025351 - DNA, 22 bp, Homo sapiens
tttacactgcttgaacaatctc

SEQ ID NO: 7025352 - DNA, 22 bp, Homo sapiens
ttattctgactaatgtataact

SEQ ID NO: 7025353 - DNA, 22 bp, Homo sapiens
tacttctgtaagtgcgccaagg

SEQ ID NO: 7025354 - DNA, 22 bp, Homo sapiens
aggatgagagatacatggagca

SEQ ID NO: 7025355 - DNA, 22 bp, Homo sapiens
tatgtatctagaagggaaatta

SEQ ID NO: 7025356 - DNA, 19 bp, Homo sapiens
ttagatcattaccatgagg

SEQ ID NO: 7025357 - DNA, 19 bp, Homo sapiens
cggtccatccgattttaca

SEQ ID NO: 7025358 - DNA, 22 bp, Homo sapiens
agtgagtcaaacatatcctgac

SEQ ID NO: 7025359 - DNA, 22 bp, Homo sapiens
tagaaagtgaaggttaattaat

SEQ ID NO: 7025360 - DNA, 22 bp, Homo sapiens
tttgttagagtgtgggaggctg

SEQ ID NO: 7025361 - DNA, 19 bp, Homo sapiens
tggctgagctggactgagg

SEQ ID NO: 7025362 - DNA, 22 bp, Homo sapiens
aagtggttattttgatctagaa

SEQ ID NO: 7025363 - DNA, 22 bp, Homo sapiens
agactggaagcctgccaagcaa

SEQ ID NO: 7025364 - DNA, 22 bp, Homo sapiens
tatactgtcgcattacactcac

SEQ ID NO: 7025365 - DNA, 22 bp, Homo sapiens
tactgataagagttgtaggagt

SEQ ID NO: 7025366 - DNA, 22 bp, Homo sapiens
tacttaggtgagatattttctt

SEQ ID NO: 7025367 - DNA, 22 bp, Homo sapiens
tgacacagtgggggatcctttt

SEQ ID NO: 7025368 - DNA, 19 bp, Homo sapiens
tcatttactttctgggtga

SEQ ID NO: 7025369 - DNA, 22 bp, Homo sapiens
tctgaaatctaatgctctgtgg

SEQ ID NO: 7025370 - DNA, 22 bp, Homo sapiens
ttggagtagaaaaaatcatgct

SEQ ID NO: 7025371 - DNA, 22 bp, Homo sapiens
agctttgccaggaggcttggtc

SEQ ID NO: 7025372 - DNA, 22 bp, Homo sapiens
gctttctgctctgtaaaatggg

SEQ ID NO: 7025373 - DNA, 22 bp, Homo sapiens
gaggcctggaccagccacagag

SEQ ID NO: 7025374 - DNA, 22 bp, Homo sapiens
ttattgtttactagtttgcaga

SEQ ID NO: 7025375 - DNA, 22 bp, Homo sapiens
ttctgcatcccagaagaggaca

SEQ ID NO: 7025376 - DNA, 22 bp, Homo sapiens
aaactgaattcccaagggcatg

SEQ ID NO: 7025377 - DNA, 22 bp, Homo sapiens
tgagtttaatgatatttatatg

SEQ ID NO: 7025378 - DNA, 22 bp, Homo sapiens
tgagctttcatgtatgaaaaga

SEQ ID NO: 7025379 - DNA, 22 bp, Homo sapiens
tgaaatctgtcccactttagct

SEQ ID NO: 7025380 - DNA, 22 bp, Homo sapiens
ttgggagtaataaaaaattcca

SEQ ID NO: 7025381 - DNA, 22 bp, Homo sapiens
ttgggctggcccttgtctctgg

SEQ ID NO: 7025382 - DNA, 22 bp, Homo sapiens
cagggctgtctccaaaggcccc

SEQ ID NO: 7025383 - DNA, 22 bp, Homo sapiens
gccctgagaatgtgtgtgtcta

SEQ ID NO: 7025384 - DNA, 22 bp, Homo sapiens
aaacagtaagttctagtattat

SEQ ID NO: 7025385 - DNA, 22 bp, Homo sapiens
aagtgatttgtacaaaatgtcg

SEQ ID NO: 7025386 - DNA, 22 bp, Homo sapiens
taggaaatttgaaatatgtggg

SEQ ID NO: 7025387 - DNA, 22 bp, Homo sapiens
ctgcagatgtctcaattttatt

SEQ ID NO: 7025388 - DNA, 22 bp, Homo sapiens
taagcattatggtaaagaagta

SEQ ID NO: 7025389 - DNA, 22 bp, Homo sapiens
tgcatttatggagttacctcat

SEQ ID NO: 7025390 - DNA, 18 bp, Homo sapiens
cctcagaggcaaattgtt

SEQ ID NO: 7025391 - DNA, 22 bp, Homo sapiens
atctttgtgctaatgtagttct

SEQ ID NO: 7025392 - DNA, 22 bp, Homo sapiens
acagggcaggtggctactggtc

SEQ ID NO: 7025393 - DNA, 22 bp, Homo sapiens
ctgaggcagagaatgagtttgt

SEQ ID NO: 7025394 - DNA, 22 bp, Homo sapiens
tcttcttcctccacagggccca

SEQ ID NO: 7025395 - DNA, 22 bp, Homo sapiens
gtcacagaggctgccagggttg

SEQ ID NO: 7025396 - DNA, 22 bp, Homo sapiens
atgtccttcatctaggagatgg

SEQ ID NO: 7025397 - DNA, 22 bp, Homo sapiens
tatttctaagctgtaagtctga

SEQ ID NO: 7025398 - DNA, 22 bp, Homo sapiens
cttcagcctcatctcagcccgt

SEQ ID NO: 7025399 - DNA, 21 bp, Homo sapiens
taagagctattattgcaaacc

SEQ ID NO: 7025400 - DNA, 16 bp, Homo sapiens
agactcagtgcacttt

SEQ ID NO: 7025401 - DNA, 22 bp, Homo sapiens
agtttttccgtggctacgataa

SEQ ID NO: 7025402 - DNA, 22 bp, Homo sapiens
ctgcccagaagccagatgggca

SEQ ID NO: 7025403 - DNA, 22 bp, Homo sapiens
gcaggaggagcattaactgagc

SEQ ID NO: 7025404 - DNA, 22 bp, Homo sapiens
ttgagctttgatgcatggcagg

SEQ ID NO: 7025405 - DNA, 22 bp, Homo sapiens
atgggcagagctggtgggaggc

SEQ ID NO: 7025406 - DNA, 22 bp, Homo sapiens
gtatgtgctgagctttccccgc

SEQ ID NO: 7025407 - DNA, 22 bp, Homo sapiens
cagtgccgtgagggtagaagct

SEQ ID NO: 7025408 - DNA, 15 bp, Homo sapiens
ggaggccaggctgtg

SEQ ID NO: 7025409 - DNA, 22 bp, Homo sapiens
acatgacaaaatgcacaggatt

SEQ ID NO: 7025410 - DNA, 22 bp, Homo sapiens
gtgaatgaaaggatgattcttt

SEQ ID NO: 7025411 - DNA, 22 bp, Homo sapiens
agcaggggctcctccacagcca

SEQ ID NO: 7025412 - DNA, 20 bp, Homo sapiens
cagcatctagtgagatttgc

SEQ ID NO: 7025413 - DNA, 22 bp, Homo sapiens
aacatgatttcatgcatttaga

SEQ ID NO: 7025414 - DNA, 22 bp, Homo sapiens
tgtgggtcttccaaagaagggc

SEQ ID NO: 7025415 - DNA, 22 bp, Homo sapiens
gcttagcaaacatctgtagtcc

SEQ ID NO: 7025416 - DNA, 22 bp, Homo sapiens
acttaaaggttagctattctac

SEQ ID NO: 7025417 - DNA, 22 bp, Homo sapiens
ttagtttataattcatttctgt

SEQ ID NO: 7025418 - DNA, 22 bp, Homo sapiens
aataacctttatttcaaagtgt

SEQ ID NO: 7025419 - DNA, 22 bp, Homo sapiens
gtgggccagcttttctcctggg

SEQ ID NO: 7025420 - DNA, 20 bp, Homo sapiens
gagtgggccatggagtgaga

SEQ ID NO: 7025421 - DNA, 22 bp, Homo sapiens
tgttccttttaaatgagtcagt

SEQ ID NO: 7025422 - DNA, 21 bp, Homo sapiens
agaaaatggcgttttagattt

SEQ ID NO: 7025423 - DNA, 18 bp, Homo sapiens
aagccagagaccactgcc

SEQ ID NO: 7025424 - DNA, 22 bp, Homo sapiens
acatgacacctctggctgggtg

SEQ ID NO: 7025425 - DNA, 22 bp, Homo sapiens
gccaggtgcatattagaagcat

SEQ ID NO: 7025426 - DNA, 22 bp, Homo sapiens
gtgctctaaggcaccactgagc

SEQ ID NO: 7025427 - DNA, 22 bp, Homo sapiens
tgtcctctccaacagcctctgt

SEQ ID NO: 7025428 - DNA, 22 bp, Homo sapiens
ttgcatggggattggagcacag

SEQ ID NO: 7025429 - DNA, 22 bp, Homo sapiens
ttccaagagtcagctgatccca

SEQ ID NO: 7025430 - DNA, 22 bp, Homo sapiens
ggcaatttggtcatttgtattg

SEQ ID NO: 7025431 - DNA, 22 bp, Homo sapiens
atacataggatatgtacgtgca

SEQ ID NO: 7025432 - DNA, 22 bp, Homo sapiens
agctacacaggaggactcttct

SEQ ID NO: 7025433 - DNA, 22 bp, Homo sapiens
gccacattagccctcaccatct

SEQ ID NO: 7025434 - DNA, 22 bp, Homo sapiens
cagcccaaagccccaggctaga

SEQ ID NO: 7025435 - DNA, 22 bp, Homo sapiens
gtgttttatcagacaaagtata

SEQ ID NO: 7025436 - DNA, 22 bp, Homo sapiens
cacatttaagtgcttgttcaga

SEQ ID NO: 7025437 - DNA, 22 bp, Homo sapiens
gtctcgttgctttataaataga

SEQ ID NO: 7025438 - DNA, 22 bp, Homo sapiens
aagaggttgtctgtgatgagtt

SEQ ID NO: 7025439 - DNA, 22 bp, Homo sapiens
tctttgctattgtgaatagtgc

SEQ ID NO: 7025440 - DNA, 20 bp, Homo sapiens
ctcctggtccaggagcctga

SEQ ID NO: 7025441 - DNA, 22 bp, Homo sapiens
aggtggccggtgccagccgggc

SEQ ID NO: 7025442 - DNA, 22 bp, Homo sapiens
tttcacagtagaaatcattatg

SEQ ID NO: 7025443 - DNA, 22 bp, Homo sapiens
ctgtattagtccatttgagctg

SEQ ID NO: 7025444 - DNA, 22 bp, Homo sapiens
ggcctgctgggccccacagtcc

SEQ ID NO: 7025445 - DNA, 22 bp, Homo sapiens
ccaaccacgaaaccaaggtggc

SEQ ID NO: 7025446 - DNA, 22 bp, Homo sapiens
gccctgagggtctgggttccca

SEQ ID NO: 7025447 - DNA, 22 bp, Homo sapiens
ttctttggctgccagtctggag

SEQ ID NO: 7025448 - DNA, 22 bp, Homo sapiens
agccctagagctggaggtcagt

SEQ ID NO: 7025449 - DNA, 22 bp, Homo sapiens
aggctgtgcaattagggtaaga

SEQ ID NO: 7025450 - DNA, 22 bp, Homo sapiens
tctaggagctgagagtgtgtac

SEQ ID NO: 7025451 - DNA, 22 bp, Homo sapiens
agtgttacattagccggggcca

SEQ ID NO: 7025452 - DNA, 22 bp, Homo sapiens
gctctgagacacaaagggtgca

SEQ ID NO: 7025453 - DNA, 22 bp, Homo sapiens
gacaataagaaaagaggaggca

SEQ ID NO: 7025454 - DNA, 22 bp, Homo sapiens
aggcgctgtctggggtcgcggc

SEQ ID NO: 7025455 - DNA, 22 bp, Homo sapiens
tcttttctgccacagcctgagc

SEQ ID NO: 7025456 - DNA, 22 bp, Homo sapiens
tcaagagttggtcaaatccaaa

SEQ ID NO: 7025457 - DNA, 22 bp, Homo sapiens
gtgaggtaaagcacagaaatag

SEQ ID NO: 7025458 - DNA, 20 bp, Homo sapiens
gcttcagaacctgggtgctg

SEQ ID NO: 7025459 - DNA, 22 bp, Homo sapiens
accctcagtaatcgtgcagttt

SEQ ID NO: 7025460 - DNA, 19 bp, Homo sapiens
ggtgggtgacctccccacc

SEQ ID NO: 7025461 - DNA, 22 bp, Homo sapiens
atgcttctgaagaagaaaagac

SEQ ID NO: 7025462 - DNA, 22 bp, Homo sapiens
gaactttaccatttaggtaact

SEQ ID NO: 7025463 - DNA, 22 bp, Homo sapiens
gaacagcatgtaagaagctact

SEQ ID NO: 7025464 - DNA, 22 bp, Homo sapiens
tgtaagtcctcccggaagacca

SEQ ID NO: 7025465 - DNA, 18 bp, Homo sapiens
caagaatctctaaagaag

SEQ ID NO: 7025466 - DNA, 20 bp, Homo sapiens
ccagcaccctctcagctgaa

SEQ ID NO: 7025467 - DNA, 22 bp, Homo sapiens
cccttagaggctggaggcagca

SEQ ID NO: 7025468 - DNA, 23 bp, Homo sapiens
tacagttatgttcctgggtcact

SEQ ID NO: 7025469 - DNA, 22 bp, Homo sapiens
cccagccaagtgatctgaccgc

SEQ ID NO: 7025470 - DNA, 22 bp, Homo sapiens
attaatatcctgctggctaaat

SEQ ID NO: 7025471 - DNA, 22 bp, Homo sapiens
ctgtttatggaggtaaggcatc

SEQ ID NO: 7025472 - DNA, 23 bp, Homo sapiens
aggaaagcattcatttttaccat

SEQ ID NO: 7025473 - DNA, 22 bp, Homo sapiens
tgcacgtatggcagtggagccc

SEQ ID NO: 7025474 - DNA, 22 bp, Homo sapiens
agcatgaagacttcagagctag

SEQ ID NO: 7025475 - DNA, 22 bp, Homo sapiens
tgatggaggacccagcgtggga

SEQ ID NO: 7025476 - DNA, 22 bp, Homo sapiens
cttgggccttgagaatgttctg

SEQ ID NO: 7025477 - DNA, 22 bp, Homo sapiens
ctaggcagactgagctctaggg

SEQ ID NO: 7025478 - DNA, 22 bp, Homo sapiens
gggaagctgcgtggtctagggc

SEQ ID NO: 7025479 - DNA, 22 bp, Homo sapiens
agatctgagtggctgcatgtaa

SEQ ID NO: 7025480 - DNA, 22 bp, Homo sapiens
ccggaggaggacgagcccgcgg

SEQ ID NO: 7025481 - DNA, 22 bp, Homo sapiens
agctgcctgccatgccgctggt

SEQ ID NO: 7025482 - DNA, 22 bp, Homo sapiens
cagaatcaagtccaattagcac

SEQ ID NO: 7025483 - DNA, 22 bp, Homo sapiens
acatgggacagagaaagaggcc

SEQ ID NO: 7025484 - DNA, 22 bp, Homo sapiens
aaactcagaaggtacagaaggg

SEQ ID NO: 7025485 - DNA, 22 bp, Homo sapiens
tgctctgtcaagaaaagatgcc

SEQ ID NO: 7025486 - DNA, 22 bp, Homo sapiens
tggaggaatcagggcttaggct

SEQ ID NO: 7025487 - DNA, 22 bp, Homo sapiens
tcaaagtctctgcttctgtaac

SEQ ID NO: 7025488 - DNA, 22 bp, Homo sapiens
gttcaagttcatatctcttaac

SEQ ID NO: 7025489 - DNA, 22 bp, Homo sapiens
ttctttgagttagtacagtcca

SEQ ID NO: 7025490 - DNA, 22 bp, Homo sapiens
cccgttcctataatagcataga

SEQ ID NO: 7025491 - DNA, 22 bp, Homo sapiens
aagcttttattaaaatcttgcc

SEQ ID NO: 7025492 - DNA, 22 bp, Homo sapiens
gaaggcattctattctacatat

SEQ ID NO: 7025493 - DNA, 22 bp, Homo sapiens
ctccatgtctgtaacacatgac

SEQ ID NO: 7025494 - DNA, 22 bp, Homo sapiens
acaggtggtagagtggaaagag

SEQ ID NO: 7025495 - DNA, 22 bp, Homo sapiens
agtttattctctggtcttagta

SEQ ID NO: 7025496 - DNA, 22 bp, Homo sapiens
cttgtgcagcctcctcttgcag

SEQ ID NO: 7025497 - DNA, 22 bp, Homo sapiens
gggggagaagattctgctgctt

SEQ ID NO: 7025498 - DNA, 22 bp, Homo sapiens
agtggaaggtcaggggacagtg

SEQ ID NO: 7025499 - DNA, 22 bp, Homo sapiens
attacagaatgcagttccttat

SEQ ID NO: 7025500 - DNA, 21 bp, Homo sapiens
aaggctcctcctctaggcctc

SEQ ID NO: 7025501 - DNA, 22 bp, Homo sapiens
tgaggttatttattatgcatga

SEQ ID NO: 7025502 - DNA, 22 bp, Homo sapiens
ttcacagatgtattggaactcc

SEQ ID NO: 7025503 - DNA, 22 bp, Homo sapiens
ggtctggaataaggtccaggaa

SEQ ID NO: 7025504 - DNA, 22 bp, Homo sapiens
ggagtattgtagcttccagttc

SEQ ID NO: 7025505 - DNA, 22 bp, Homo sapiens
tccttctacactgcctctgaga

SEQ ID NO: 7025506 - DNA, 22 bp, Homo sapiens
ccctagggtttggccagagccc

SEQ ID NO: 7025507 - DNA, 22 bp, Homo sapiens
gctggccttgtgtctgaggaag

SEQ ID NO: 7025508 - DNA, 22 bp, Homo sapiens
gggcagctcagccaccatgcag

SEQ ID NO: 7025509 - DNA, 22 bp, Homo sapiens
atgcttggcagagttctttttc

SEQ ID NO: 7025510 - DNA, 22 bp, Homo sapiens
tctcagtatgcttgattggatt

SEQ ID NO: 7025511 - DNA, 22 bp, Homo sapiens
gctactgttcggcatgctgaag

SEQ ID NO: 7025512 - DNA, 22 bp, Homo sapiens
tgcacacaggtctaggacatgg

SEQ ID NO: 7025513 - DNA, 22 bp, Homo sapiens
gtgtccagggggtatcccagct

SEQ ID NO: 7025514 - DNA, 19 bp, Homo sapiens
tttacagggaatggagacc

SEQ ID NO: 7025515 - DNA, 22 bp, Homo sapiens
aagcagcacagtaatattggtg

SEQ ID NO: 7025516 - DNA, 22 bp, Homo sapiens
gggactgtcctacatggagagg

SEQ ID NO: 7025517 - DNA, 22 bp, Homo sapiens
agtgaaggtttacagggcccct

SEQ ID NO: 7025518 - DNA, 22 bp, Homo sapiens
ggtcccagtcctctccctgcta

SEQ ID NO: 7025519 - DNA, 22 bp, Homo sapiens
acagctaacagaatctggagag

SEQ ID NO: 7025520 - DNA, 22 bp, Homo sapiens
agaattcctctaggatctgccc

SEQ ID NO: 7025521 - DNA, 22 bp, Homo sapiens
cctctgagccagcgtcttctct

SEQ ID NO: 7025522 - DNA, 22 bp, Homo sapiens
ttaatgcttgtctagatcttct

SEQ ID NO: 7025523 - DNA, 22 bp, Homo sapiens
tgaggaacaactcctgtgacta

SEQ ID NO: 7025524 - DNA, 22 bp, Homo sapiens
acagaagagcacatttagtatg

SEQ ID NO: 7025525 - DNA, 22 bp, Homo sapiens
tttcttccaaaggcacgttctc

SEQ ID NO: 7025526 - DNA, 22 bp, Homo sapiens
aaagctcttatgtaaacagaaa

SEQ ID NO: 7025527 - DNA, 22 bp, Homo sapiens
ctccagggagcttggaaagacc

SEQ ID NO: 7025528 - DNA, 22 bp, Homo sapiens
acaggtgtatgaatatgttcca

SEQ ID NO: 7025529 - DNA, 22 bp, Homo sapiens
catgtgtaccagctgttctttg

SEQ ID NO: 7025530 - DNA, 22 bp, Homo sapiens
tatttaccctggcagctgtagc

SEQ ID NO: 7025531 - DNA, 22 bp, Homo sapiens
caacaatgaatgtttgagtgcc

SEQ ID NO: 7025532 - DNA, 22 bp, Homo sapiens
gccaatttatcttactcgtgct

SEQ ID NO: 7025533 - DNA, 22 bp, Homo sapiens
ttccaggctattccctttggag

SEQ ID NO: 7025534 - DNA, 22 bp, Homo sapiens
gtgttggacagcttctactgtg

SEQ ID NO: 7025535 - DNA, 23 bp, Homo sapiens
tctcagtgcacgcaccatgcctg

SEQ ID NO: 7025536 - DNA, 22 bp, Homo sapiens
tttgtacattcaaatgtcccat

SEQ ID NO: 7025537 - DNA, 22 bp, Homo sapiens
caatgtctgaccgttttgccca

SEQ ID NO: 7025538 - DNA, 22 bp, Homo sapiens
tgcttgggcggccagcatggcg

SEQ ID NO: 7025539 - DNA, 22 bp, Homo sapiens
cctctggggtgagtgggccact

SEQ ID NO: 7025540 - DNA, 22 bp, Homo sapiens
gggcagcctcggtgcctgctgc

SEQ ID NO: 7025541 - DNA, 22 bp, Homo sapiens
tacctcaagttccaggaaagcg

SEQ ID NO: 7025542 - DNA, 22 bp, Homo sapiens
atagacttggttagtaaatttg

SEQ ID NO: 7025543 - DNA, 22 bp, Homo sapiens
ggcagcaaatattgtcagctgt

SEQ ID NO: 7025544 - DNA, 22 bp, Homo sapiens
atgaaaatgtacatgtgtataa

SEQ ID NO: 7025545 - DNA, 22 bp, Homo sapiens
attattcaacacttgagaaatt

SEQ ID NO: 7025546 - DNA, 22 bp, Homo sapiens
attgatgttactattctggtct

SEQ ID NO: 7025547 - DNA, 22 bp, Homo sapiens
gccacaggcttaggagggaggt

SEQ ID NO: 7025548 - DNA, 19 bp, Homo sapiens
acagggcttggcctgacat

SEQ ID NO: 7025549 - DNA, 22 bp, Homo sapiens
ttttcagttttccaggtagccg

SEQ ID NO: 7025550 - DNA, 22 bp, Homo sapiens
cagagtgtatctgtgtaagcat

SEQ ID NO: 7025551 - DNA, 22 bp, Homo sapiens
ccagaacacagtggaagaatat

SEQ ID NO: 7025552 - DNA, 22 bp, Homo sapiens
agtttttgctgatagcatgctt

SEQ ID NO: 7025553 - DNA, 22 bp, Homo sapiens
acactgtaaattgagtgcgtga

SEQ ID NO: 7025554 - DNA, 22 bp, Homo sapiens
tctcagtgactgctgggtcccc

SEQ ID NO: 7025555 - DNA, 22 bp, Homo sapiens
cctgagatcagtgcatttggtg

SEQ ID NO: 7025556 - DNA, 22 bp, Homo sapiens
acatccttaaggttagggtttc

SEQ ID NO: 7025557 - DNA, 22 bp, Homo sapiens
ttcatactcttccctgggcaaa

SEQ ID NO: 7025558 - DNA, 23 bp, Homo sapiens
ggacatgtctctgggtattttga

SEQ ID NO: 7025559 - DNA, 22 bp, Homo sapiens
gtttcatatgcagttaacagca

SEQ ID NO: 7025560 - DNA, 22 bp, Homo sapiens
ttccagcagcgtgggagaagta

SEQ ID NO: 7025561 - DNA, 22 bp, Homo sapiens
tttggtaatgtttcattgcaga

SEQ ID NO: 7025562 - DNA, 22 bp, Homo sapiens
cacctggcccagctccagtgct

SEQ ID NO: 7025563 - DNA, 22 bp, Homo sapiens
tgctggctccaacctggcatct

SEQ ID NO: 7025564 - DNA, 22 bp, Homo sapiens
gctctaaagaacccagaggagt

SEQ ID NO: 7025565 - DNA, 22 bp, Homo sapiens
aaagtgttttccatgcaatgaa

SEQ ID NO: 7025566 - DNA, 22 bp, Homo sapiens
aggcatggcattcctcaagcaa

SEQ ID NO: 7025567 - DNA, 22 bp, Homo sapiens
gccctgagattcttggattctg

SEQ ID NO: 7025568 - DNA, 22 bp, Homo sapiens
tttagacagcatctggtgactt

SEQ ID NO: 7025569 - DNA, 22 bp, Homo sapiens
ttcagcagcttttagtacattg

SEQ ID NO: 7025570 - DNA, 22 bp, Homo sapiens
gtgaaagagatgcagcataatg

SEQ ID NO: 7025571 - DNA, 20 bp, Homo sapiens
aagcttccaggatctggtgt

SEQ ID NO: 7025572 - DNA, 22 bp, Homo sapiens
ggtccctagagtgggatgactt

SEQ ID NO: 7025573 - DNA, 22 bp, Homo sapiens
agaagtttgttatgtaaacaaa

SEQ ID NO: 7025574 - DNA, 22 bp, Homo sapiens
gggcgtcctggaccctcccctg

SEQ ID NO: 7025575 - DNA, 22 bp, Homo sapiens
aagtctctctgtgtgggataag

SEQ ID NO: 7025576 - DNA, 22 bp, Homo sapiens
atctgcttcctgggctccatga

SEQ ID NO: 7025577 - DNA, 22 bp, Homo sapiens
tctgccgtgcgaggtcccacca

SEQ ID NO: 7025578 - DNA, 22 bp, Homo sapiens
gctgttattttacaagacttat

SEQ ID NO: 7025579 - DNA, 22 bp, Homo sapiens
atcttgcttgctgggcattttc

SEQ ID NO: 7025580 - DNA, 19 bp, Homo sapiens
tgggcagtgccagggctta

SEQ ID NO: 7025581 - DNA, 22 bp, Homo sapiens
agtgtcaagtacatggtagtga

SEQ ID NO: 7025582 - DNA, 22 bp, Homo sapiens
cagtgagaattcagtaggtact

SEQ ID NO: 7025583 - DNA, 22 bp, Homo sapiens
tgaggagtcgagaaggggtaat

SEQ ID NO: 7025584 - DNA, 22 bp, Homo sapiens
cagggctgtggaaaactggtgc

SEQ ID NO: 7025585 - DNA, 22 bp, Homo sapiens
gaaggcttgcagctctgtggca

SEQ ID NO: 7025586 - DNA, 22 bp, Homo sapiens
tgagggactgcatacccagctt

SEQ ID NO: 7025587 - DNA, 22 bp, Homo sapiens
actcagagtgcatctcctattt

SEQ ID NO: 7025588 - DNA, 20 bp, Homo sapiens
aagcaatatagtgcaaatgt

SEQ ID NO: 7025589 - DNA, 22 bp, Homo sapiens
agctgtctttaagtgagctttg

SEQ ID NO: 7025590 - DNA, 22 bp, Homo sapiens
tttacagatctgttgatttgtt

SEQ ID NO: 7025591 - DNA, 22 bp, Homo sapiens
gaggtggaaggcaggaacaaat

SEQ ID NO: 7025592 - DNA, 22 bp, Homo sapiens
cagcagaggttggaacagttct

SEQ ID NO: 7025593 - DNA, 20 bp, Homo sapiens
gcagtagaccatgcttggaa

SEQ ID NO: 7025594 - DNA, 22 bp, Homo sapiens
tgccctggggagcccagccagg

SEQ ID NO: 7025595 - DNA, 22 bp, Homo sapiens
cattagctcagatacctctgag

SEQ ID NO: 7025596 - DNA, 22 bp, Homo sapiens
gggaggtgattaggaccatgta

SEQ ID NO: 7025597 - DNA, 22 bp, Homo sapiens
ttaagtgccagtgctccctcag

SEQ ID NO: 7025598 - DNA, 22 bp, Homo sapiens
gcatgtttcttaagattgcatt

SEQ ID NO: 7025599 - DNA, 17 bp, Homo sapiens
tacagaaggcaccacaa

SEQ ID NO: 7025600 - DNA, 22 bp, Homo sapiens
aaggccctaatagagcacatat

SEQ ID NO: 7025601 - DNA, 22 bp, Homo sapiens
gagctgcctgaacaagcagcag

SEQ ID NO: 7025602 - DNA, 22 bp, Homo sapiens
ccagaaatgagtagaggatgct

SEQ ID NO: 7025603 - DNA, 22 bp, Homo sapiens
agtcaggtactccgagggcatg

SEQ ID NO: 7025604 - DNA, 22 bp, Homo sapiens
ttctaggaccctgcgtgagaac

SEQ ID NO: 7025605 - DNA, 22 bp, Homo sapiens
tgtatttagtccagtctctcat

SEQ ID NO: 7025606 - DNA, 22 bp, Homo sapiens
gctgcccaattacagggccgtg

SEQ ID NO: 7025607 - DNA, 22 bp, Homo sapiens
ttctggagctaaagtccactct

SEQ ID NO: 7025608 - DNA, 22 bp, Homo sapiens
tatgtgttgtatatgtgcagag

SEQ ID NO: 7025609 - DNA, 22 bp, Homo sapiens
gactggggctctagccaggcct

SEQ ID NO: 7025610 - DNA, 22 bp, Homo sapiens
actgccttctttaatcctagtt

SEQ ID NO: 7025611 - DNA, 22 bp, Homo sapiens
gcaggcaaggaacagagactgt

SEQ ID NO: 7025612 - DNA, 22 bp, Homo sapiens
tcttggctcccttgtaggccct

SEQ ID NO: 7025613 - DNA, 22 bp, Homo sapiens
ttctggagtcttcaattttaga

SEQ ID NO: 7025614 - DNA, 22 bp, Homo sapiens
ttgtttttaaacatgtgactga

SEQ ID NO: 7025615 - DNA, 22 bp, Homo sapiens
gccctcagtggattcttattgt

SEQ ID NO: 7025616 - DNA, 22 bp, Homo sapiens
ccacctggggctgtggcccctt

SEQ ID NO: 7025617 - DNA, 22 bp, Homo sapiens
gcaagctgatgtgatagtgaaa

SEQ ID NO: 7025618 - DNA, 22 bp, Homo sapiens
tgcaaatttatatggtgactgc

SEQ ID NO: 7025619 - DNA, 22 bp, Homo sapiens
gacttgttctctgactgcttta

SEQ ID NO: 7025620 - DNA, 22 bp, Homo sapiens
atgagaaaattgaggcccatag

SEQ ID NO: 7025621 - DNA, 22 bp, Homo sapiens
tttttctctatgccaggggcct

SEQ ID NO: 7025622 - DNA, 22 bp, Homo sapiens
cgaggccaccgtggtttccgag

SEQ ID NO: 7025623 - DNA, 22 bp, Homo sapiens
aaagttctgatgctgatcaaag

SEQ ID NO: 7025624 - DNA, 22 bp, Homo sapiens
ttgtagctttttaatgtgctgc

SEQ ID NO: 7025625 - DNA, 22 bp, Homo sapiens
tttactttgtgtcaagtcaaga

SEQ ID NO: 7025626 - DNA, 22 bp, Homo sapiens
ataacaatagtggtagtgctgg

SEQ ID NO: 7025627 - DNA, 22 bp, Homo sapiens
ggagggtctaagggagaactga

SEQ ID NO: 7025628 - DNA, 22 bp, Homo sapiens
taacttcaaaattgccacatgt

SEQ ID NO: 7025629 - DNA, 22 bp, Homo sapiens
agacacattttcagctctgcca

SEQ ID NO: 7025630 - DNA, 22 bp, Homo sapiens
aactacatcaccctatttctgt

SEQ ID NO: 7025631 - DNA, 22 bp, Homo sapiens
ttagaacagtagaagaaagggt

SEQ ID NO: 7025632 - DNA, 23 bp, Homo sapiens
aaggtgttctgtatttaactcag

SEQ ID NO: 7025633 - DNA, 22 bp, Homo sapiens
ctccagaactgggagagaataa

SEQ ID NO: 7025634 - DNA, 22 bp, Homo sapiens
atattattctagtaacagtgat

SEQ ID NO: 7025635 - DNA, 22 bp, Homo sapiens
gtccactctagggcagctctcg

SEQ ID NO: 7025636 - DNA, 23 bp, Homo sapiens
aactggttgaaggctgttaattg

SEQ ID NO: 7025637 - DNA, 22 bp, Homo sapiens
taagggcttagttactggcaga

SEQ ID NO: 7025638 - DNA, 22 bp, Homo sapiens
gggcatggtgctggtgttcatg

SEQ ID NO: 7025639 - DNA, 22 bp, Homo sapiens
cactgaaggctgcagctcagcc

SEQ ID NO: 7025640 - DNA, 22 bp, Homo sapiens
gctcaactgctaactgttttga

SEQ ID NO: 7025641 - DNA, 22 bp, Homo sapiens
ggtgaggcgtccccaccatggg

SEQ ID NO: 7025642 - DNA, 21 bp, Homo sapiens
cagtgctcaggaatagagaga

SEQ ID NO: 7025643 - DNA, 22 bp, Homo sapiens
acagtgtttaagagatggcatt

SEQ ID NO: 7025644 - DNA, 22 bp, Homo sapiens
cttgaagacaatggcagattcc

SEQ ID NO: 7025645 - DNA, 22 bp, Homo sapiens
gctgaggacatacacattgtgc

SEQ ID NO: 7025646 - DNA, 22 bp, Homo sapiens
ggtacaatggttcattttatgt

SEQ ID NO: 7025647 - DNA, 22 bp, Homo sapiens
atggcttatggtaaatatttct

SEQ ID NO: 7025648 - DNA, 22 bp, Homo sapiens
tgtgaaatatttatatactcaa

SEQ ID NO: 7025649 - DNA, 22 bp, Homo sapiens
acatttgtttctctagagtagg

SEQ ID NO: 7025650 - DNA, 22 bp, Homo sapiens
gcattgttagtctatgcagata

SEQ ID NO: 7025651 - DNA, 22 bp, Homo sapiens
tgtatatgagtctgagtgtaca

SEQ ID NO: 7025652 - DNA, 22 bp, Homo sapiens
tggctgcagaacctcctcagga

SEQ ID NO: 7025653 - DNA, 22 bp, Homo sapiens
acattctagatatgttatattt

SEQ ID NO: 7025654 - DNA, 22 bp, Homo sapiens
ctacatttttcaccgagcctct

SEQ ID NO: 7025655 - DNA, 22 bp, Homo sapiens
taaagcaaaaatgaactgccat

SEQ ID NO: 7025656 - DNA, 22 bp, Homo sapiens
agtcatgctacttcatcttctg

SEQ ID NO: 7025657 - DNA, 22 bp, Homo sapiens
ttgcaagaaattaggaagtgaa

SEQ ID NO: 7025658 - DNA, 22 bp, Homo sapiens
cttgtacaggtctgttgtgggc

SEQ ID NO: 7025659 - DNA, 22 bp, Homo sapiens
cttctctcggtgcatccctcac

SEQ ID NO: 7025660 - DNA, 22 bp, Homo sapiens
attgtttaaagatacatccctg

SEQ ID NO: 7025661 - DNA, 22 bp, Homo sapiens
atgctgaaatttattggtaagg

SEQ ID NO: 7025662 - DNA, 22 bp, Homo sapiens
gctctttagtccaagccatgtc

SEQ ID NO: 7025663 - DNA, 22 bp, Homo sapiens
tgagacactctcgggcacattt

SEQ ID NO: 7025664 - DNA, 22 bp, Homo sapiens
gaaatgttatgagatatgtact

SEQ ID NO: 7025665 - DNA, 22 bp, Homo sapiens
actcagctcaggagctggctgg

SEQ ID NO: 7025666 - DNA, 22 bp, Homo sapiens
acttccagtgtctgctgctagc

SEQ ID NO: 7025667 - DNA, 22 bp, Homo sapiens
tggtacaatggcatctatctat

SEQ ID NO: 7025668 - DNA, 22 bp, Homo sapiens
tggaggcagtcaaatgactgac

SEQ ID NO: 7025669 - DNA, 22 bp, Homo sapiens
aacaatgcctgatgacctcctg

SEQ ID NO: 7025670 - DNA, 22 bp, Homo sapiens
aggatatttgtaaagattttga

SEQ ID NO: 7025671 - DNA, 22 bp, Homo sapiens
gagtggtagtttctagaggtgt

SEQ ID NO: 7025672 - DNA, 22 bp, Homo sapiens
tggaagaatgctccacagggaa

SEQ ID NO: 7025673 - DNA, 22 bp, Homo sapiens
agcatataaatggacatatttg

SEQ ID NO: 7025674 - DNA, 22 bp, Homo sapiens
tgtgttcaccctagcacttaac

SEQ ID NO: 7025675 - DNA, 22 bp, Homo sapiens
ggacagccgagtggccttctcc

SEQ ID NO: 7025676 - DNA, 22 bp, Homo sapiens
agaaacatcctgctttccattt

SEQ ID NO: 7025677 - DNA, 21 bp, Homo sapiens
ttttcaccaataaaaggactt

SEQ ID NO: 7025678 - DNA, 22 bp, Homo sapiens
taattgtatggagaaggctgca

SEQ ID NO: 7025679 - DNA, 22 bp, Homo sapiens
aagagacaatgtcttttggata

SEQ ID NO: 7025680 - DNA, 22 bp, Homo sapiens
tcctcagcatggaatctggact

SEQ ID NO: 7025681 - DNA, 22 bp, Homo sapiens
gatctgaaccttgcctgttggg

SEQ ID NO: 7025682 - DNA, 22 bp, Homo sapiens
gtgtatactgagaaatgtcagc

SEQ ID NO: 7025683 - DNA, 22 bp, Homo sapiens
gtggcagaggctctgggaccag

SEQ ID NO: 7025684 - DNA, 19 bp, Homo sapiens
gctgaaggaggtgcctgca

SEQ ID NO: 7025685 - DNA, 22 bp, Homo sapiens
tggccttgtgttttagagaaag

SEQ ID NO: 7025686 - DNA, 18 bp, Homo sapiens
cgaggcaggcggatcacg

SEQ ID NO: 7025687 - DNA, 22 bp, Homo sapiens
tgagtgcctgaacatagagtag

SEQ ID NO: 7025688 - DNA, 22 bp, Homo sapiens
tcctggcaaagatgttggtgtt

SEQ ID NO: 7025689 - DNA, 22 bp, Homo sapiens
gggcagctcggaagtgggaaag

SEQ ID NO: 7025690 - DNA, 22 bp, Homo sapiens
agagggtgggcacgtgatggat

SEQ ID NO: 7025691 - DNA, 23 bp, Homo sapiens
attcttcattatcttctagaaaa

SEQ ID NO: 7025692 - DNA, 22 bp, Homo sapiens
cctggccaggcatggagtcaca

SEQ ID NO: 7025693 - DNA, 22 bp, Homo sapiens
ttgacaagaatcgttgccttgg

SEQ ID NO: 7025694 - DNA, 21 bp, Homo sapiens
ccagggatgttgaactgaaag

SEQ ID NO: 7025695 - DNA, 22 bp, Homo sapiens
acttttcttatcagaaaggcca

SEQ ID NO: 7025696 - DNA, 22 bp, Homo sapiens
gcttagtcaacctagggccatc

SEQ ID NO: 7025697 - DNA, 22 bp, Homo sapiens
ccatgttgtcaaacttagagta

SEQ ID NO: 7025698 - DNA, 22 bp, Homo sapiens
ttgcaatgcccgtagcatccta

SEQ ID NO: 7025699 - DNA, 22 bp, Homo sapiens
accaaaggctcctgaagaactg

SEQ ID NO: 7025700 - DNA, 22 bp, Homo sapiens
cagagcctcagaatcctgtgga

SEQ ID NO: 7025701 - DNA, 22 bp, Homo sapiens
gccaggtgcatggctgagtctc

SEQ ID NO: 7025702 - DNA, 22 bp, Homo sapiens
ttctgtatattgtaaagactca

SEQ ID NO: 7025703 - DNA, 22 bp, Homo sapiens
tttcgaatgatgtttggaatat

SEQ ID NO: 7025704 - DNA, 22 bp, Homo sapiens
attcatgcaggattgtctccaa

SEQ ID NO: 7025705 - DNA, 22 bp, Homo sapiens
atgttgcccattccaggagata

SEQ ID NO: 7025706 - DNA, 22 bp, Homo sapiens
tggtctggttatttcttaatga

SEQ ID NO: 7025707 - DNA, 22 bp, Homo sapiens
ccgcgcgcgtgggcgtccaggg

SEQ ID NO: 7025708 - DNA, 22 bp, Homo sapiens
cagtcactggaatagctgagga

SEQ ID NO: 7025709 - DNA, 22 bp, Homo sapiens
cactgtgctccttccttagcac

SEQ ID NO: 7025710 - DNA, 22 bp, Homo sapiens
aatgtgatctgtcatgatggca

SEQ ID NO: 7025711 - DNA, 22 bp, Homo sapiens
tctcccccagtctctacagcag

SEQ ID NO: 7025712 - DNA, 17 bp, Homo sapiens
tgccatcccccttgggc

SEQ ID NO: 7025713 - DNA, 22 bp, Homo sapiens
tgggccagttatttcacctctg

SEQ ID NO: 7025714 - DNA, 22 bp, Homo sapiens
gtcctgagggcccaggcattct

SEQ ID NO: 7025715 - DNA, 22 bp, Homo sapiens
tacactgtttgaactgtggtcg

SEQ ID NO: 7025716 - DNA, 22 bp, Homo sapiens
tcttgtcactactgttatgcat

SEQ ID NO: 7025717 - DNA, 22 bp, Homo sapiens
ctgttactgctggagccattga

SEQ ID NO: 7025718 - DNA, 22 bp, Homo sapiens
atggttctggagactggtaatc

SEQ ID NO: 7025719 - DNA, 21 bp, Homo sapiens
cagtttaataacaaagaagga

SEQ ID NO: 7025720 - DNA, 18 bp, Homo sapiens
aagaggaggagcaggttg

SEQ ID NO: 7025721 - DNA, 22 bp, Homo sapiens
agactgttcctagtggctgttc

SEQ ID NO: 7025722 - DNA, 22 bp, Homo sapiens
ggtgacgaatccatagcatcga

SEQ ID NO: 7025723 - DNA, 22 bp, Homo sapiens
ctcagggacaaggggagacccc

SEQ ID NO: 7025724 - DNA, 22 bp, Homo sapiens
aattactgatctacaaaatcca

SEQ ID NO: 7025725 - DNA, 20 bp, Homo sapiens
tgatatattactcaggggaa

SEQ ID NO: 7025726 - DNA, 22 bp, Homo sapiens
tttatggcacacaaatatcaaa

SEQ ID NO: 7025727 - DNA, 23 bp, Homo sapiens
tagcatgcaggtcccgcgaatgc

SEQ ID NO: 7025728 - DNA, 21 bp, Homo sapiens
ggtggctcacctgattggata

SEQ ID NO: 7025729 - DNA, 22 bp, Homo sapiens
tgcttccctgaaggcacaggag

SEQ ID NO: 7025730 - DNA, 22 bp, Homo sapiens
actttagaaaaggaacagagga

SEQ ID NO: 7025731 - DNA, 22 bp, Homo sapiens
cttgccagcacttggccagctg

SEQ ID NO: 7025732 - DNA, 22 bp, Homo sapiens
ctgcagaaagctgagatgatta

SEQ ID NO: 7025733 - DNA, 22 bp, Homo sapiens
gtctgagactttttctgtgtgg

SEQ ID NO: 7025734 - DNA, 23 bp, Homo sapiens
ttgtggagtggttgttttctagg

SEQ ID NO: 7025735 - DNA, 22 bp, Homo sapiens
gaaatgtataagctggtctttt

SEQ ID NO: 7025736 - DNA, 22 bp, Homo sapiens
atgcttccctttgctccacatg

SEQ ID NO: 7025737 - DNA, 22 bp, Homo sapiens
cttcacagtcaccctgctgtgt

SEQ ID NO: 7025738 - DNA, 22 bp, Homo sapiens
caccttgcattcttttaattta

SEQ ID NO: 7025739 - DNA, 22 bp, Homo sapiens
tgccctgttatcttggaagagt

SEQ ID NO: 7025740 - DNA, 22 bp, Homo sapiens
gtatgatcaacttcatgtccta

SEQ ID NO: 7025741 - DNA, 22 bp, Homo sapiens
gcaggcagaggtggaggagaca

SEQ ID NO: 7025742 - DNA, 22 bp, Homo sapiens
ttccttagggtcagccagatct

SEQ ID NO: 7025743 - DNA, 22 bp, Homo sapiens
tgtatgtctgtgaattcatatt

SEQ ID NO: 7025744 - DNA, 22 bp, Homo sapiens
cctgagtcccctcattcactct

SEQ ID NO: 7025745 - DNA, 22 bp, Homo sapiens
tccatgcaaacagtggctagct

SEQ ID NO: 7025746 - DNA, 22 bp, Homo sapiens
tgtccatacctttacctgtgta

SEQ ID NO: 7025747 - DNA, 22 bp, Homo sapiens
gtattacaaataaatgttactg

SEQ ID NO: 7025748 - DNA, 22 bp, Homo sapiens
ctgaactatttggaatgaagat

SEQ ID NO: 7025749 - DNA, 22 bp, Homo sapiens
tcaggagaatcagggctgtcct

SEQ ID NO: 7025750 - DNA, 22 bp, Homo sapiens
gttcctgggcctgcattcacca

SEQ ID NO: 7025751 - DNA, 22 bp, Homo sapiens
tcaaagaagtgcaaacctcatc

SEQ ID NO: 7025752 - DNA, 22 bp, Homo sapiens
atgtagcatgcatgttgttttg

SEQ ID NO: 7025753 - DNA, 22 bp, Homo sapiens
tgagcatcaaattgatgggact

SEQ ID NO: 7025754 - DNA, 22 bp, Homo sapiens
cccagtggctgtccccatgggc

SEQ ID NO: 7025755 - DNA, 22 bp, Homo sapiens
cactggcccataaaggcctggg

SEQ ID NO: 7025756 - DNA, 22 bp, Homo sapiens
ctttttcctcgtagagcctaat

SEQ ID NO: 7025757 - DNA, 22 bp, Homo sapiens
tgaaggcagcatgcacactagt

SEQ ID NO: 7025758 - DNA, 22 bp, Homo sapiens
tttcacatatggttgttgattg

SEQ ID NO: 7025759 - DNA, 22 bp, Homo sapiens
tatgtgactctggacccattga

SEQ ID NO: 7025760 - DNA, 22 bp, Homo sapiens
ttgaatgtaggtcttggtgagc

SEQ ID NO: 7025761 - DNA, 22 bp, Homo sapiens
acacaggaaatggtttagtttt

SEQ ID NO: 7025762 - DNA, 22 bp, Homo sapiens
tgcatgctgcacacatgcgtag

SEQ ID NO: 7025763 - DNA, 22 bp, Homo sapiens
gaattttgcttttatgtcaagt

SEQ ID NO: 7025764 - DNA, 22 bp, Homo sapiens
aatgggtttctgtcccagctct

SEQ ID NO: 7025765 - DNA, 22 bp, Homo sapiens
aactttcttggatgtctcaaca

SEQ ID NO: 7025766 - DNA, 22 bp, Homo sapiens
catttgcagagggtgacactct

SEQ ID NO: 7025767 - DNA, 22 bp, Homo sapiens
aggacatgtaaatggagaggga

SEQ ID NO: 7025768 - DNA, 18 bp, Homo sapiens
atgcatattttaagttgt

SEQ ID NO: 7025769 - DNA, 22 bp, Homo sapiens
tgcagcggtagttctcgtggaa

SEQ ID NO: 7025770 - DNA, 18 bp, Homo sapiens
gaccccgggatctgtcga

SEQ ID NO: 7025771 - DNA, 22 bp, Homo sapiens
ggcgatttatactggtatttgg

SEQ ID NO: 7025772 - DNA, 22 bp, Homo sapiens
tggctcatttctaaacccagct

SEQ ID NO: 7025773 - DNA, 22 bp, Homo sapiens
tgcagtggaagaggtggagatc

SEQ ID NO: 7025774 - DNA, 22 bp, Homo sapiens
ttctaatcctgactcagctgct

SEQ ID NO: 7025775 - DNA, 18 bp, Homo sapiens
gggcagcacagcagcctc

SEQ ID NO: 7025776 - DNA, 22 bp, Homo sapiens
gatgacataacctaattacagt

SEQ ID NO: 7025777 - DNA, 22 bp, Homo sapiens
agttttagagtaagaattactg

SEQ ID NO: 7025778 - DNA, 22 bp, Homo sapiens
gcagcatggagaagtagctaga

SEQ ID NO: 7025779 - DNA, 22 bp, Homo sapiens
tgcatcacttagctgcacaact

SEQ ID NO: 7025780 - DNA, 22 bp, Homo sapiens
ttgagcccaggaggcctgggtg

SEQ ID NO: 7025781 - DNA, 22 bp, Homo sapiens
gctgatattttgaagggcaagg

SEQ ID NO: 7025782 - DNA, 22 bp, Homo sapiens
tagccattgacttaaagcttat

SEQ ID NO: 7025783 - DNA, 22 bp, Homo sapiens
actgaggtctcaggtggggaag

SEQ ID NO: 7025784 - DNA, 22 bp, Homo sapiens
gcacagttgagacttcacagct

SEQ ID NO: 7025785 - DNA, 22 bp, Homo sapiens
attagtagctgtaataactggg

SEQ ID NO: 7025786 - DNA, 22 bp, Homo sapiens
tgtgtgcatgcttggggcagca

SEQ ID NO: 7025787 - DNA, 22 bp, Homo sapiens
agcacatgacttttagtcgagt

SEQ ID NO: 7025788 - DNA, 22 bp, Homo sapiens
aataaatcaatcctattggtag

SEQ ID NO: 7025789 - DNA, 22 bp, Homo sapiens
taggtcatgaccatacatatcc

SEQ ID NO: 7025790 - DNA, 21 bp, Homo sapiens
tcacacttgattggcttagac

SEQ ID NO: 7025791 - DNA, 22 bp, Homo sapiens
ctggctggccatgtagagatga

SEQ ID NO: 7025792 - DNA, 22 bp, Homo sapiens
aagcatggtttctgacgtcatg

SEQ ID NO: 7025793 - DNA, 22 bp, Homo sapiens
aggtggaacgttcaggtgctag

SEQ ID NO: 7025794 - DNA, 22 bp, Homo sapiens
tgacatcacaagccatctgcag

SEQ ID NO: 7025795 - DNA, 22 bp, Homo sapiens
ctatggctctgtcttttaagtt

SEQ ID NO: 7025796 - DNA, 22 bp, Homo sapiens
tcaaaacaatcattggatgtgc

SEQ ID NO: 7025797 - DNA, 21 bp, Homo sapiens
agagaagggattccaggccct

SEQ ID NO: 7025798 - DNA, 19 bp, Homo sapiens
ggaagccctgggtcagagc

SEQ ID NO: 7025799 - DNA, 22 bp, Homo sapiens
ccctgtgggaactcctgagttg

SEQ ID NO: 7025800 - DNA, 22 bp, Homo sapiens
agattggggtccagactcctga

SEQ ID NO: 7025801 - DNA, 22 bp, Homo sapiens
cttctgggatttttgaagactc

SEQ ID NO: 7025802 - DNA, 22 bp, Homo sapiens
atgtgcttgtaatgttaaatgt

SEQ ID NO: 7025803 - DNA, 22 bp, Homo sapiens
agctggtccttccctgccctgt

SEQ ID NO: 7025804 - DNA, 22 bp, Homo sapiens
tatgtcctgttcagatcagaga

SEQ ID NO: 7025805 - DNA, 22 bp, Homo sapiens
gcaataaagtagcagctcatca

SEQ ID NO: 7025806 - DNA, 22 bp, Homo sapiens
gttacaactccctgaacctcgg

SEQ ID NO: 7025807 - DNA, 22 bp, Homo sapiens
agggctcaggggccccaagctg

SEQ ID NO: 7025808 - DNA, 22 bp, Homo sapiens
tgatcagcatcttcccagctcg

SEQ ID NO: 7025809 - DNA, 22 bp, Homo sapiens
tcatgccaatttctgcatggct

SEQ ID NO: 7025810 - DNA, 22 bp, Homo sapiens
gggattgaattgggggatcaca

SEQ ID NO: 7025811 - DNA, 22 bp, Homo sapiens
gtgggccacatcccagggctct

SEQ ID NO: 7025812 - DNA, 22 bp, Homo sapiens
ttaaaggctatggctgcctggg

SEQ ID NO: 7025813 - DNA, 22 bp, Homo sapiens
aacatctctgtattttatagac

SEQ ID NO: 7025814 - DNA, 22 bp, Homo sapiens
tagctttctcaattttctgcca

SEQ ID NO: 7025815 - DNA, 22 bp, Homo sapiens
aggctgtgagcaagaacaccta

SEQ ID NO: 7025816 - DNA, 22 bp, Homo sapiens
ggccttggtaaattggcatttg

SEQ ID NO: 7025817 - DNA, 22 bp, Homo sapiens
tcatgctgcaggcccaggcagg

SEQ ID NO: 7025818 - DNA, 22 bp, Homo sapiens
tccagagggcgatggctggggg

SEQ ID NO: 7025819 - DNA, 22 bp, Homo sapiens
atcatttggggaattgtggaca

SEQ ID NO: 7025820 - DNA, 22 bp, Homo sapiens
gcatttatattctgttcggata

SEQ ID NO: 7025821 - DNA, 22 bp, Homo sapiens
gtcagcatccagctgtgaaagg

SEQ ID NO: 7025822 - DNA, 22 bp, Homo sapiens
ggaggccttgcctgcaggcaca

SEQ ID NO: 7025823 - DNA, 22 bp, Homo sapiens
acctcatctggtttgtaaggca

SEQ ID NO: 7025824 - DNA, 22 bp, Homo sapiens
ggcacaaggtttaaataacatc

SEQ ID NO: 7025825 - DNA, 21 bp, Homo sapiens
gaacctgagtgaagacttggg

SEQ ID NO: 7025826 - DNA, 22 bp, Homo sapiens
cctggccatttgaacttcagac

SEQ ID NO: 7025827 - DNA, 22 bp, Homo sapiens
tggcaataattgtaattcaatt

SEQ ID NO: 7025828 - DNA, 22 bp, Homo sapiens
tagcagttaatctgagccaaga

SEQ ID NO: 7025829 - DNA, 22 bp, Homo sapiens
aagggaaatggccaggcagaga

SEQ ID NO: 7025830 - DNA, 22 bp, Homo sapiens
cccaggcattttcaactttagt

SEQ ID NO: 7025831 - DNA, 22 bp, Homo sapiens
cagaaatatcagttgaaagtgc

SEQ ID NO: 7025832 - DNA, 22 bp, Homo sapiens
ggcactgaatttcttggcatct

SEQ ID NO: 7025833 - DNA, 21 bp, Homo sapiens
gctgaaggtgggttgtacagg

SEQ ID NO: 7025834 - DNA, 22 bp, Homo sapiens
cggtggctcaggcccccagcag

SEQ ID NO: 7025835 - DNA, 22 bp, Homo sapiens
aaatctcactgtagtcaaagtg

SEQ ID NO: 7025836 - DNA, 23 bp, Homo sapiens
atacatacagtcttactgacttt

SEQ ID NO: 7025837 - DNA, 22 bp, Homo sapiens
ggagctggaatatattgaaacc

SEQ ID NO: 7025838 - DNA, 19 bp, Homo sapiens
aaacacagatttcttacca

SEQ ID NO: 7025839 - DNA, 22 bp, Homo sapiens
tgagggctaaattgtggcaggt

SEQ ID NO: 7025840 - DNA, 22 bp, Homo sapiens
ctggcagggtgggctttgcttt

SEQ ID NO: 7025841 - DNA, 22 bp, Homo sapiens
accatgaggaaatacatttgtg

SEQ ID NO: 7025842 - DNA, 22 bp, Homo sapiens
tgtgacaccacacccgactaat

SEQ ID NO: 7025843 - DNA, 22 bp, Homo sapiens
catgataacttcattacacaat

SEQ ID NO: 7025844 - DNA, 22 bp, Homo sapiens
caggcccatttgtagccacttt

SEQ ID NO: 7025845 - DNA, 22 bp, Homo sapiens
tccaggtactcattggctgtta

SEQ ID NO: 7025846 - DNA, 22 bp, Homo sapiens
gcttccatgttgctgctggtca

SEQ ID NO: 7025847 - DNA, 23 bp, Homo sapiens
tgtgtgtgtattctacgcaaggt

SEQ ID NO: 7025848 - DNA, 22 bp, Homo sapiens
tggctcctcatcacagttggtg

SEQ ID NO: 7025849 - DNA, 22 bp, Homo sapiens
tggacaggcaagcaagacatac

SEQ ID NO: 7025850 - DNA, 22 bp, Homo sapiens
atgtctctcatgaccaaagaag

SEQ ID NO: 7025851 - DNA, 22 bp, Homo sapiens
tcaagtcactggcagggatgct

SEQ ID NO: 7025852 - DNA, 22 bp, Homo sapiens
attgctctctatgtgtcggaca

SEQ ID NO: 7025853 - DNA, 22 bp, Homo sapiens
atgtcccttgtctgtgatgtct

SEQ ID NO: 7025854 - DNA, 22 bp, Homo sapiens
tgtcttggccactaggagtgcc

SEQ ID NO: 7025855 - DNA, 22 bp, Homo sapiens
gttgcttctcttaagtccagct

SEQ ID NO: 7025856 - DNA, 22 bp, Homo sapiens
gctatacaagtgtagaatagag

SEQ ID NO: 7025857 - DNA, 22 bp, Homo sapiens
aggcactagagttcaaagatga

SEQ ID NO: 7025858 - DNA, 22 bp, Homo sapiens
tcagctgcctttcccatgctag

SEQ ID NO: 7025859 - DNA, 22 bp, Homo sapiens
agactgaaacaatctgcaggca

SEQ ID NO: 7025860 - DNA, 22 bp, Homo sapiens
tgtctttggggctgtacctgtt

SEQ ID NO: 7025861 - DNA, 22 bp, Homo sapiens
gggaaaggatttacagtttgat

SEQ ID NO: 7025862 - DNA, 22 bp, Homo sapiens
atcttgaaatactttctagaat

SEQ ID NO: 7025863 - DNA, 22 bp, Homo sapiens
gagaagaacttgggcaaagtca

SEQ ID NO: 7025864 - DNA, 19 bp, Homo sapiens
ctgggccagaatcagctca

SEQ ID NO: 7025865 - DNA, 22 bp, Homo sapiens
ttacaagtactgaatatgattt

SEQ ID NO: 7025866 - DNA, 22 bp, Homo sapiens
gactcccctgggccccatccag

SEQ ID NO: 7025867 - DNA, 18 bp, Homo sapiens
ttatctctggcatgtgcc

SEQ ID NO: 7025868 - DNA, 22 bp, Homo sapiens
tggatggattgacgaaggcagc

SEQ ID NO: 7025869 - DNA, 22 bp, Homo sapiens
caggagagatatgagtccccac

SEQ ID NO: 7025870 - DNA, 22 bp, Homo sapiens
agatctattagcaaactgccat

SEQ ID NO: 7025871 - DNA, 22 bp, Homo sapiens
gccagggtgagggctgagaggt

SEQ ID NO: 7025872 - DNA, 22 bp, Homo sapiens
tcctctggggtcagggcactac

SEQ ID NO: 7025873 - DNA, 20 bp, Homo sapiens
tccagccctcatgtcgctca

SEQ ID NO: 7025874 - DNA, 22 bp, Homo sapiens
ccttggctggaattactctggg

SEQ ID NO: 7025875 - DNA, 22 bp, Homo sapiens
actcagagtctgagataaatct

SEQ ID NO: 7025876 - DNA, 22 bp, Homo sapiens
ccacccagcagaggaggcaaga

SEQ ID NO: 7025877 - DNA, 22 bp, Homo sapiens
gcacagagtcactagctaagca

SEQ ID NO: 7025878 - DNA, 22 bp, Homo sapiens
tagcccaggagaattgtctttc

SEQ ID NO: 7025879 - DNA, 22 bp, Homo sapiens
aagctgccatagaacgagaggt

SEQ ID NO: 7025880 - DNA, 22 bp, Homo sapiens
ggacaggctgcatctgagcatg

SEQ ID NO: 7025881 - DNA, 22 bp, Homo sapiens
agggagctggtatttataatga

SEQ ID NO: 7025882 - DNA, 22 bp, Homo sapiens
gagagctaggccactggggctt

SEQ ID NO: 7025883 - DNA, 22 bp, Homo sapiens
ctagctttgtccattgtcttgc

SEQ ID NO: 7025884 - DNA, 22 bp, Homo sapiens
ttattgttagtgagactgtaga

SEQ ID NO: 7025885 - DNA, 23 bp, Homo sapiens
cctctaggagattagggggcttc

SEQ ID NO: 7025886 - DNA, 22 bp, Homo sapiens
aaagaacagatgtgtggtgcat

SEQ ID NO: 7025887 - DNA, 22 bp, Homo sapiens
aattcagcacagaggaaccagt

SEQ ID NO: 7025888 - DNA, 22 bp, Homo sapiens
cctgggcataaatcactccaag

SEQ ID NO: 7025889 - DNA, 22 bp, Homo sapiens
gggagccactcagctgagagtt

SEQ ID NO: 7025890 - DNA, 22 bp, Homo sapiens
aggcttctgtgagctcatacaa

SEQ ID NO: 7025891 - DNA, 22 bp, Homo sapiens
tctgagcaccttatattcttga

SEQ ID NO: 7025892 - DNA, 22 bp, Homo sapiens
agaatctttctgaatgactgtg

SEQ ID NO: 7025893 - DNA, 21 bp, Homo sapiens
gacacaaagggtagtaatggt

SEQ ID NO: 7025894 - DNA, 22 bp, Homo sapiens
ccagctctcaaggctccctggg

SEQ ID NO: 7025895 - DNA, 22 bp, Homo sapiens
gagtcctgggtcacggcctctt

SEQ ID NO: 7025896 - DNA, 22 bp, Homo sapiens
attattatatagggaaagtccc

SEQ ID NO: 7025897 - DNA, 22 bp, Homo sapiens
acctctgaagggccaagcaatg

SEQ ID NO: 7025898 - DNA, 22 bp, Homo sapiens
ctgatgggagcaacagcaacag

SEQ ID NO: 7025899 - DNA, 22 bp, Homo sapiens
acctgtggatcagattcttgta

SEQ ID NO: 7025900 - DNA, 22 bp, Homo sapiens
gccatctcggagctatcaaagg

SEQ ID NO: 7025901 - DNA, 22 bp, Homo sapiens
tcgctgaccccccagctctatc

SEQ ID NO: 7025902 - DNA, 22 bp, Homo sapiens
gaaagagaggggctgagatgca

SEQ ID NO: 7025903 - DNA, 22 bp, Homo sapiens
gtgcatccagccatgagaacca

SEQ ID NO: 7025904 - DNA, 22 bp, Homo sapiens
tgcaatacatacttagacccag

SEQ ID NO: 7025905 - DNA, 22 bp, Homo sapiens
ctggcaggtggaggttgcagtg

SEQ ID NO: 7025906 - DNA, 22 bp, Homo sapiens
actctgggtcctgccattcact

SEQ ID NO: 7025907 - DNA, 22 bp, Homo sapiens
gctggacaggccacatggagga

SEQ ID NO: 7025908 - DNA, 22 bp, Homo sapiens
taacctactatgattctgggaa

SEQ ID NO: 7025909 - DNA, 22 bp, Homo sapiens
agaattacagcttttagaatag

SEQ ID NO: 7025910 - DNA, 22 bp, Homo sapiens
acacaagtgaatattttaagga

SEQ ID NO: 7025911 - DNA, 22 bp, Homo sapiens
ggaaatctcagatctcccagat

SEQ ID NO: 7025912 - DNA, 22 bp, Homo sapiens
tgcgcaggacacttgcagtgac

SEQ ID NO: 7025913 - DNA, 22 bp, Homo sapiens
ttctccacccactcttttgttg

SEQ ID NO: 7025914 - DNA, 22 bp, Homo sapiens
tagcattccatcttggacttgt

SEQ ID NO: 7025915 - DNA, 21 bp, Homo sapiens
cactttaaaaatatctttata

SEQ ID NO: 7025916 - DNA, 22 bp, Homo sapiens
ctgctgcctgattgcagacctc

SEQ ID NO: 7025917 - DNA, 22 bp, Homo sapiens
tgctgcctttctgaatggtgga

SEQ ID NO: 7025918 - DNA, 22 bp, Homo sapiens
ctgggtctcttaccatgtgact

SEQ ID NO: 7025919 - DNA, 22 bp, Homo sapiens
cagcagagaccaagtgatttga

SEQ ID NO: 7025920 - DNA, 22 bp, Homo sapiens
cagctaggagaaaaggtgtttt

SEQ ID NO: 7025921 - DNA, 22 bp, Homo sapiens
taacttctctgagcctcattcc

SEQ ID NO: 7025922 - DNA, 22 bp, Homo sapiens
gaggagaaagcagtgatttgtg

SEQ ID NO: 7025923 - DNA, 22 bp, Homo sapiens
gatgcccctgtgctctttttcc

SEQ ID NO: 7025924 - DNA, 22 bp, Homo sapiens
aaacctatatagtcttagaagc

SEQ ID NO: 7025925 - DNA, 22 bp, Homo sapiens
tgctacatgcactgtgatctag

SEQ ID NO: 7025926 - DNA, 22 bp, Homo sapiens
gaggaagaagcaaaccagctaa

SEQ ID NO: 7025927 - DNA, 22 bp, Homo sapiens
gtggagagagtgacagcatctt

SEQ ID NO: 7025928 - DNA, 22 bp, Homo sapiens
tgatggcttatggagagagcaa

SEQ ID NO: 7025929 - DNA, 22 bp, Homo sapiens
ttgacacagttttctcattaag

SEQ ID NO: 7025930 - DNA, 22 bp, Homo sapiens
tggcaggaggttttctccagga

SEQ ID NO: 7025931 - DNA, 22 bp, Homo sapiens
atctttctatttctaaaaacta

SEQ ID NO: 7025932 - DNA, 22 bp, Homo sapiens
agtctctggggaggagtggaaa

SEQ ID NO: 7025933 - DNA, 23 bp, Homo sapiens
aaatgggtttctgttttgtggac

SEQ ID NO: 7025934 - DNA, 22 bp, Homo sapiens
aggcagcttaagccctggccca

SEQ ID NO: 7025935 - DNA, 22 bp, Homo sapiens
catattctttaagcaatgctct

SEQ ID NO: 7025936 - DNA, 15 bp, Homo sapiens
tcctggcctgctctg

SEQ ID NO: 7025937 - DNA, 22 bp, Homo sapiens
tctgtccagctctcaggagaca

SEQ ID NO: 7025938 - DNA, 22 bp, Homo sapiens
gcctgtctgcgtcacgcttatt

SEQ ID NO: 7025939 - DNA, 22 bp, Homo sapiens
atccctcagccacctttgagga

SEQ ID NO: 7025940 - DNA, 22 bp, Homo sapiens
ttgcagctccattttaatggct

SEQ ID NO: 7025941 - DNA, 22 bp, Homo sapiens
gctttgggagtcagatttgcgc

SEQ ID NO: 7025942 - DNA, 22 bp, Homo sapiens
aggatgtgagccagcctggcct

SEQ ID NO: 7025943 - DNA, 22 bp, Homo sapiens
atgactagaggagggatggcca

SEQ ID NO: 7025944 - DNA, 22 bp, Homo sapiens
tctgtgtggtagtttcagtgaa

SEQ ID NO: 7025945 - DNA, 22 bp, Homo sapiens
ctgggagcccgcgtcctggtgg

SEQ ID NO: 7025946 - DNA, 22 bp, Homo sapiens
tttcctgttctagttgttgcca

SEQ ID NO: 7025947 - DNA, 22 bp, Homo sapiens
gccagtggtgagattccctggg

SEQ ID NO: 7025948 - DNA, 22 bp, Homo sapiens
gcaggcactcctaggaccatca

SEQ ID NO: 7025949 - DNA, 22 bp, Homo sapiens
tagaatagtgttttcattatgg

SEQ ID NO: 7025950 - DNA, 23 bp, Homo sapiens
atagttctgcttagaaatcagtg

SEQ ID NO: 7025951 - DNA, 22 bp, Homo sapiens
gcagagaggatattattgtcca

SEQ ID NO: 7025952 - DNA, 22 bp, Homo sapiens
agccttccacccagatcccctt

SEQ ID NO: 7025953 - DNA, 22 bp, Homo sapiens
cacggccagggctgtgggtgcg

SEQ ID NO: 7025954 - DNA, 22 bp, Homo sapiens
acccacagccgctgtgcgtccc

SEQ ID NO: 7025955 - DNA, 22 bp, Homo sapiens
aggtggctggtccaggctgcag

SEQ ID NO: 7025956 - DNA, 22 bp, Homo sapiens
ggggagaataaatcagatttta

SEQ ID NO: 7025957 - DNA, 22 bp, Homo sapiens
atgccaggaacaaacagtggtg

SEQ ID NO: 7025958 - DNA, 22 bp, Homo sapiens
cctcatgagaactgggctcctg

SEQ ID NO: 7025959 - DNA, 22 bp, Homo sapiens
cagagcaggggtttcccaggtt

SEQ ID NO: 7025960 - DNA, 22 bp, Homo sapiens
accattctgtctctttacaaat

SEQ ID NO: 7025961 - DNA, 22 bp, Homo sapiens
tgcaaattgcgatttttattag

SEQ ID NO: 7025962 - DNA, 22 bp, Homo sapiens
tctttcatgtatatgcaaccta

SEQ ID NO: 7025963 - DNA, 21 bp, Homo sapiens
ggctgcagggagccctggggt

SEQ ID NO: 7025964 - DNA, 22 bp, Homo sapiens
gctagctttataatgctgggcg

SEQ ID NO: 7025965 - DNA, 22 bp, Homo sapiens
ggggaagggagtccaagtgtta

SEQ ID NO: 7025966 - DNA, 22 bp, Homo sapiens
tggcgagccccgactgagtgtt

SEQ ID NO: 7025967 - DNA, 22 bp, Homo sapiens
gagaccccagctcagcctccag

SEQ ID NO: 7025968 - DNA, 22 bp, Homo sapiens
tcaatatattccatgttttctc

SEQ ID NO: 7025969 - DNA, 22 bp, Homo sapiens
ttgaaactatgaagacaaccat

SEQ ID NO: 7025970 - DNA, 22 bp, Homo sapiens
gtgcaggacagcacatctcctg

SEQ ID NO: 7025971 - DNA, 22 bp, Homo sapiens
ggaggccaggtgggagtcatct

SEQ ID NO: 7025972 - DNA, 22 bp, Homo sapiens
tttaactctgtcattctcttta

SEQ ID NO: 7025973 - DNA, 22 bp, Homo sapiens
gggagagtagctggaaggttct

SEQ ID NO: 7025974 - DNA, 22 bp, Homo sapiens
gctcagtgttcatctgtatgca

SEQ ID NO: 7025975 - DNA, 18 bp, Homo sapiens
tcatgaggaaggagaaga

SEQ ID NO: 7025976 - DNA, 22 bp, Homo sapiens
ctttgtgatagtgttaagacca

SEQ ID NO: 7025977 - DNA, 17 bp, Homo sapiens
acacaagcaccttgagg

SEQ ID NO: 7025978 - DNA, 22 bp, Homo sapiens
taatgtcttagtaccttaattt

SEQ ID NO: 7025979 - DNA, 22 bp, Homo sapiens
ttgagggagcacagattcttat

SEQ ID NO: 7025980 - DNA, 22 bp, Homo sapiens
aatatttctgcagaatggtttt

SEQ ID NO: 7025981 - DNA, 22 bp, Homo sapiens
tcagctgcctctccctggaaga

SEQ ID NO: 7025982 - DNA, 22 bp, Homo sapiens
tatgtactttcctgggaatgtt

SEQ ID NO: 7025983 - DNA, 22 bp, Homo sapiens
ctctgcccgtgcctttcccagt

SEQ ID NO: 7025984 - DNA, 20 bp, Homo sapiens
atagatatcatctttagaag

SEQ ID NO: 7025985 - DNA, 22 bp, Homo sapiens
aatgaaactcgaaataatcaca

SEQ ID NO: 7025986 - DNA, 22 bp, Homo sapiens
gctgatgggagctggctcaccc

SEQ ID NO: 7025987 - DNA, 22 bp, Homo sapiens
ttgggtgttgtgtcaaggaagg

SEQ ID NO: 7025988 - DNA, 22 bp, Homo sapiens
gggcaggtactgggtggtgagc

SEQ ID NO: 7025989 - DNA, 22 bp, Homo sapiens
ttcctcagagagacagaaacta

SEQ ID NO: 7025990 - DNA, 22 bp, Homo sapiens
tggcaatttcatatggttcaag

SEQ ID NO: 7025991 - DNA, 23 bp, Homo sapiens
attgagctagtaatatagaccag

SEQ ID NO: 7025992 - DNA, 22 bp, Homo sapiens
cctgctgtaatgtgtctttatt

SEQ ID NO: 7025993 - DNA, 22 bp, Homo sapiens
ggccttagagaccacctagtct

SEQ ID NO: 7025994 - DNA, 21 bp, Homo sapiens
acatgggacctgcgaaaggaa

SEQ ID NO: 7025995 - DNA, 22 bp, Homo sapiens
agggcagagagatgaatgggat

SEQ ID NO: 7025996 - DNA, 22 bp, Homo sapiens
aaagccagtggtatgagagaaa

SEQ ID NO: 7025997 - DNA, 22 bp, Homo sapiens
ttctaagtctgctgtcttcatc

SEQ ID NO: 7025998 - DNA, 22 bp, Homo sapiens
gtatgtgttgaattcaggggtc

SEQ ID NO: 7025999 - DNA, 23 bp, Homo sapiens
ggcctcagcgcacagaaactgct

SEQ ID NO: 7026000 - DNA, 22 bp, Homo sapiens
gaggtgtgctgcggcccggtgc

SEQ ID NO: 7026001 - DNA, 22 bp, Homo sapiens
acagtaattgtgtacgaggaca

SEQ ID NO: 7026002 - DNA, 22 bp, Homo sapiens
actggggattagggactcagtg

SEQ ID NO: 7026003 - DNA, 22 bp, Homo sapiens
gccttagcatcttaaagctgtg

SEQ ID NO: 7026004 - DNA, 21 bp, Homo sapiens
ctgcccatttgtgatgtcccc

SEQ ID NO: 7026005 - DNA, 22 bp, Homo sapiens
gggctggattactgaactgagt

SEQ ID NO: 7026006 - DNA, 22 bp, Homo sapiens
gtctggctaattttggtaattt

SEQ ID NO: 7026007 - DNA, 22 bp, Homo sapiens
ttgagctaggcactacaggtca

SEQ ID NO: 7026008 - DNA, 18 bp, Homo sapiens
gtttggacttttctccct

SEQ ID NO: 7026009 - DNA, 22 bp, Homo sapiens
aggtcatgatccattggtgagt

SEQ ID NO: 7026010 - DNA, 22 bp, Homo sapiens
tcagcactggcgctgggcaggt

SEQ ID NO: 7026011 - DNA, 22 bp, Homo sapiens
gggtggagccagttgactctgt

SEQ ID NO: 7026012 - DNA, 22 bp, Homo sapiens
tgagatccccaggaaggacaac

SEQ ID NO: 7026013 - DNA, 22 bp, Homo sapiens
atttccaccatctctctgggcc

SEQ ID NO: 7026014 - DNA, 22 bp, Homo sapiens
tctagtactagttaggaagagt

SEQ ID NO: 7026015 - DNA, 18 bp, Homo sapiens
ggcctgaggatttcagca

SEQ ID NO: 7026016 - DNA, 22 bp, Homo sapiens
gtgcaagtccagaaagaactct

SEQ ID NO: 7026017 - DNA, 22 bp, Homo sapiens
gcttcagatttatgtatcattg

SEQ ID NO: 7026018 - DNA, 22 bp, Homo sapiens
aatgtcttaaagtcgtgttaca

SEQ ID NO: 7026019 - DNA, 22 bp, Homo sapiens
gtagaacatggtagggcaggtg

SEQ ID NO: 7026020 - DNA, 22 bp, Homo sapiens
acagctggaggccccattgtcc

SEQ ID NO: 7026021 - DNA, 22 bp, Homo sapiens
tgcaaactgggatactattcaa

SEQ ID NO: 7026022 - DNA, 22 bp, Homo sapiens
agctcctgcccaggaaggctct

SEQ ID NO: 7026023 - DNA, 22 bp, Homo sapiens
aataccttccacagtgaccttg

SEQ ID NO: 7026024 - DNA, 22 bp, Homo sapiens
cggcttaattctaactgtaagg

SEQ ID NO: 7026025 - DNA, 22 bp, Homo sapiens
gagttatctatttaaaatgtcc

SEQ ID NO: 7026026 - DNA, 20 bp, Homo sapiens
cgtgtccttggcgggagagc

SEQ ID NO: 7026027 - DNA, 21 bp, Homo sapiens
ttcctcctctggagaagaaga

SEQ ID NO: 7026028 - DNA, 22 bp, Homo sapiens
atagaatcatctgtgcactagt

SEQ ID NO: 7026029 - DNA, 22 bp, Homo sapiens
ctttccaatgcatttccaatgt

SEQ ID NO: 7026030 - DNA, 22 bp, Homo sapiens
gcagtatctatgtgatgggttg

SEQ ID NO: 7026031 - DNA, 22 bp, Homo sapiens
gagccactgttgggcactttcc

SEQ ID NO: 7026032 - DNA, 22 bp, Homo sapiens
cccttggcaaagctccccagtc

SEQ ID NO: 7026033 - DNA, 22 bp, Homo sapiens
taggagcctgctctgcagggac

SEQ ID NO: 7026034 - DNA, 22 bp, Homo sapiens
ttggctggttttgagtatgtgc

SEQ ID NO: 7026035 - DNA, 22 bp, Homo sapiens
tgtgtttgcaatgggaatgaga

SEQ ID NO: 7026036 - DNA, 22 bp, Homo sapiens
gttacagtgcatgtggcttctg

SEQ ID NO: 7026037 - DNA, 22 bp, Homo sapiens
ttccttagatccttcaatcacg

SEQ ID NO: 7026038 - DNA, 22 bp, Homo sapiens
ctgcctgtttcctcttgctccc

SEQ ID NO: 7026039 - DNA, 22 bp, Homo sapiens
gagaaaagcgaaggacctggag

SEQ ID NO: 7026040 - DNA, 22 bp, Homo sapiens
ctgcggctctgcgggcagctgg

SEQ ID NO: 7026041 - DNA, 22 bp, Homo sapiens
aaactgtaagtttgaggggaaa

SEQ ID NO: 7026042 - DNA, 22 bp, Homo sapiens
gaactatatcttcaagaaaatg

SEQ ID NO: 7026043 - DNA, 22 bp, Homo sapiens
tgtctccacaggtgtcagctca

SEQ ID NO: 7026044 - DNA, 22 bp, Homo sapiens
agtagacagacagaacacagcc

SEQ ID NO: 7026045 - DNA, 22 bp, Homo sapiens
aaatccctgataatgtaggtct

SEQ ID NO: 7026046 - DNA, 22 bp, Homo sapiens
ggccctcccggtgatgaagagc

SEQ ID NO: 7026047 - DNA, 22 bp, Homo sapiens
attgttccacttccttgtttgc

SEQ ID NO: 7026048 - DNA, 22 bp, Homo sapiens
gcagatgagtgagatagacttc

SEQ ID NO: 7026049 - DNA, 22 bp, Homo sapiens
cctgctctagactctgggaagg

SEQ ID NO: 7026050 - DNA, 22 bp, Homo sapiens
ttacagatacatttcttttgtt

SEQ ID NO: 7026051 - DNA, 22 bp, Homo sapiens
acagtgtgttctgggacctcca

SEQ ID NO: 7026052 - DNA, 22 bp, Homo sapiens
cacttggtgagaaaagcacagg

SEQ ID NO: 7026053 - DNA, 22 bp, Homo sapiens
gcccatctaatatgtactgtgt

SEQ ID NO: 7026054 - DNA, 22 bp, Homo sapiens
gatgaggctgtagagggtggca

SEQ ID NO: 7026055 - DNA, 22 bp, Homo sapiens
aaaaccaggtagcaaaggagac

SEQ ID NO: 7026056 - DNA, 22 bp, Homo sapiens
atgccactgcacttcagcctgg

SEQ ID NO: 7026057 - DNA, 19 bp, Homo sapiens
gcccagcgaaggggatgac

SEQ ID NO: 7026058 - DNA, 22 bp, Homo sapiens
cctcagggccatctctgtccct

SEQ ID NO: 7026059 - DNA, 22 bp, Homo sapiens
tattcctaaagtccctgtgctt

SEQ ID NO: 7026060 - DNA, 22 bp, Homo sapiens
ttcaggatggagtaccttttat

SEQ ID NO: 7026061 - DNA, 22 bp, Homo sapiens
gctgtattggaacacatccatg

SEQ ID NO: 7026062 - DNA, 22 bp, Homo sapiens
atgtgcttgagggaaatcagtt

SEQ ID NO: 7026063 - DNA, 22 bp, Homo sapiens
caaaggtagtatatatattgtt

SEQ ID NO: 7026064 - DNA, 22 bp, Homo sapiens
tgctttaaaatggactgttttg

SEQ ID NO: 7026065 - DNA, 22 bp, Homo sapiens
cttctcttggtagttcttgttg

SEQ ID NO: 7026066 - DNA, 22 bp, Homo sapiens
tgaccatttgatctacattcca

SEQ ID NO: 7026067 - DNA, 22 bp, Homo sapiens
gcatccagaggtagccactgtg

SEQ ID NO: 7026068 - DNA, 22 bp, Homo sapiens
gccactgtggtcctcccatgat

SEQ ID NO: 7026069 - DNA, 22 bp, Homo sapiens
atgtgtggtacagtcccgttta

SEQ ID NO: 7026070 - DNA, 22 bp, Homo sapiens
gctcaggctctcccaggggaat

SEQ ID NO: 7026071 - DNA, 21 bp, Homo sapiens
ggtgggcacaggagagcagag

SEQ ID NO: 7026072 - DNA, 20 bp, Homo sapiens
caagggtttgcattggcttt

SEQ ID NO: 7026073 - DNA, 22 bp, Homo sapiens
tcatgcaatgttagtttgaaag

SEQ ID NO: 7026074 - DNA, 22 bp, Homo sapiens
tgtccccaaggttcagcccaca

SEQ ID NO: 7026075 - DNA, 22 bp, Homo sapiens
gaggatgtgtctggtctgggca

SEQ ID NO: 7026076 - DNA, 22 bp, Homo sapiens
gtgctctatgaggatatagggt

SEQ ID NO: 7026077 - DNA, 21 bp, Homo sapiens
gccacccctggcacaggtgct

SEQ ID NO: 7026078 - DNA, 22 bp, Homo sapiens
cctggatcccgatggctgtgag

SEQ ID NO: 7026079 - DNA, 22 bp, Homo sapiens
gttagacatgagtgtgcttaca

SEQ ID NO: 7026080 - DNA, 22 bp, Homo sapiens
ttgctgaaagtggcaagaagta

SEQ ID NO: 7026081 - DNA, 22 bp, Homo sapiens
tgtgaagattaagttactgggc

SEQ ID NO: 7026082 - DNA, 22 bp, Homo sapiens
tgaggttcagttcttggccaca

SEQ ID NO: 7026083 - DNA, 22 bp, Homo sapiens
gcagacagcatgttgggctatt

SEQ ID NO: 7026084 - DNA, 22 bp, Homo sapiens
caaaccatgacatgaagcgtga

SEQ ID NO: 7026085 - DNA, 22 bp, Homo sapiens
tttgttctgaaaactcaagtcc

SEQ ID NO: 7026086 - DNA, 22 bp, Homo sapiens
gtggcatcagagctccctccag

SEQ ID NO: 7026087 - DNA, 22 bp, Homo sapiens
agagaacagacagatgcaatga

SEQ ID NO: 7026088 - DNA, 22 bp, Homo sapiens
gaggggcttgaggccctgatgg

SEQ ID NO: 7026089 - DNA, 22 bp, Homo sapiens
ctcagagaagtctttgctaaac

SEQ ID NO: 7026090 - DNA, 22 bp, Homo sapiens
ctcctgttgcactagttcctga

SEQ ID NO: 7026091 - DNA, 22 bp, Homo sapiens
agctggttcattcattcatggt

SEQ ID NO: 7026092 - DNA, 22 bp, Homo sapiens
gccacaggctccagcatcagta

SEQ ID NO: 7026093 - DNA, 22 bp, Homo sapiens
agtttcacacaacatttgcatg

SEQ ID NO: 7026094 - DNA, 22 bp, Homo sapiens
acagcacaggagttgaatgggc

SEQ ID NO: 7026095 - DNA, 21 bp, Homo sapiens
agacaggtcagggagaggtga

SEQ ID NO: 7026096 - DNA, 22 bp, Homo sapiens
gggccttccgactcccaaggcc

SEQ ID NO: 7026097 - DNA, 22 bp, Homo sapiens
aactgcaagctctttactgcta

SEQ ID NO: 7026098 - DNA, 19 bp, Homo sapiens
agtctcacccaagcagtct

SEQ ID NO: 7026099 - DNA, 19 bp, Homo sapiens
tctcagaattaagagtgct

SEQ ID NO: 7026100 - DNA, 22 bp, Homo sapiens
ttgcttcttagatattcctctc

SEQ ID NO: 7026101 - DNA, 22 bp, Homo sapiens
ctaggttgatgcaaaaggaact

SEQ ID NO: 7026102 - DNA, 22 bp, Homo sapiens
tccagccctcagccaagtggaa

SEQ ID NO: 7026103 - DNA, 22 bp, Homo sapiens
atctgttgtttgtttgctaaag

SEQ ID NO: 7026104 - DNA, 22 bp, Homo sapiens
acttccagcaacttggtgctat

SEQ ID NO: 7026105 - DNA, 20 bp, Homo sapiens
atcaaaggctgattcagtcc

SEQ ID NO: 7026106 - DNA, 22 bp, Homo sapiens
tcattgtctctcttttcatata

SEQ ID NO: 7026107 - DNA, 22 bp, Homo sapiens
tccatccatttgagagtggagt

SEQ ID NO: 7026108 - DNA, 23 bp, Homo sapiens
aaaatcttctgcctatgaagaaa

SEQ ID NO: 7026109 - DNA, 20 bp, Homo sapiens
tccagccctgcttctctctt

SEQ ID NO: 7026110 - DNA, 22 bp, Homo sapiens
ccctccagccatggacccaggt

SEQ ID NO: 7026111 - DNA, 22 bp, Homo sapiens
caattatatttagaatgataca

SEQ ID NO: 7026112 - DNA, 22 bp, Homo sapiens
tgcaaggctgcctctgaggacc

SEQ ID NO: 7026113 - DNA, 22 bp, Homo sapiens
ggagccaacccttgtgaagaca

SEQ ID NO: 7026114 - DNA, 22 bp, Homo sapiens
caagaaatttcttaagaactaa

SEQ ID NO: 7026115 - DNA, 20 bp, Homo sapiens
gaaatacttacccaactgtt

SEQ ID NO: 7026116 - DNA, 22 bp, Homo sapiens
tgtgtaaatggcatctctcagc

SEQ ID NO: 7026117 - DNA, 20 bp, Homo sapiens
ttcaatacattactttgatt

SEQ ID NO: 7026118 - DNA, 22 bp, Homo sapiens
tgatgaattagtaacaaatgag

SEQ ID NO: 7026119 - DNA, 22 bp, Homo sapiens
tctgcaacattcctctccccac

SEQ ID NO: 7026120 - DNA, 22 bp, Homo sapiens
tgggtcaaatggtaattctatg

SEQ ID NO: 7026121 - DNA, 22 bp, Homo sapiens
gtcacacaatagtaagtggtcc

SEQ ID NO: 7026122 - DNA, 23 bp, Homo sapiens
caacactgccttcaggtgaagaa

SEQ ID NO: 7026123 - DNA, 22 bp, Homo sapiens
cagtgctgccaaagggaccttg

SEQ ID NO: 7026124 - DNA, 23 bp, Homo sapiens
taggaactttatatttgttagtc

SEQ ID NO: 7026125 - DNA, 19 bp, Homo sapiens
gtccagcctttgggtctta

SEQ ID NO: 7026126 - DNA, 22 bp, Homo sapiens
tcagcagaggagtgtcttgccc

SEQ ID NO: 7026127 - DNA, 17 bp, Homo sapiens
acagagtgtcccgcagt

SEQ ID NO: 7026128 - DNA, 22 bp, Homo sapiens
cttttgcacccagagttatttg

SEQ ID NO: 7026129 - DNA, 22 bp, Homo sapiens
gccttccttacacctgctcagc

SEQ ID NO: 7026130 - DNA, 22 bp, Homo sapiens
tagaattgggcctaacttccat

SEQ ID NO: 7026131 - DNA, 22 bp, Homo sapiens
ggtcccacggtgaattcgtgcc

SEQ ID NO: 7026132 - DNA, 22 bp, Homo sapiens
caaagatgctgatgttggatca

SEQ ID NO: 7026133 - DNA, 19 bp, Homo sapiens
aggtgacatgtgacagcct

SEQ ID NO: 7026134 - DNA, 21 bp, Homo sapiens
agagtctgagctcttaaccac

SEQ ID NO: 7026135 - DNA, 22 bp, Homo sapiens
gttaaccaaggcaccaagtgta

SEQ ID NO: 7026136 - DNA, 22 bp, Homo sapiens
acattcctgcctccccggagat

SEQ ID NO: 7026137 - DNA, 22 bp, Homo sapiens
cttcttattaatccttctctgt

SEQ ID NO: 7026138 - DNA, 22 bp, Homo sapiens
tgaatgtaggtctaatatccca

SEQ ID NO: 7026139 - DNA, 22 bp, Homo sapiens
tgttttggtggtctataggaaa

SEQ ID NO: 7026140 - DNA, 22 bp, Homo sapiens
gtgttactcaagagatagcttt

SEQ ID NO: 7026141 - DNA, 22 bp, Homo sapiens
tagaagtttcaaaagacttcat

SEQ ID NO: 7026142 - DNA, 22 bp, Homo sapiens
agggtgcatgtttgcaagagtg

SEQ ID NO: 7026143 - DNA, 20 bp, Homo sapiens
tctagacagggcacaggaat

SEQ ID NO: 7026144 - DNA, 22 bp, Homo sapiens
tgcatgtggacccctggtgcct

SEQ ID NO: 7026145 - DNA, 22 bp, Homo sapiens
tgtttgtagagacagctgatgc

SEQ ID NO: 7026146 - DNA, 22 bp, Homo sapiens
attcatctatgactctaatgtg

SEQ ID NO: 7026147 - DNA, 22 bp, Homo sapiens
tggccagacctgactgtcaggg

SEQ ID NO: 7026148 - DNA, 22 bp, Homo sapiens
ttggcatgttcttcatttggtg

SEQ ID NO: 7026149 - DNA, 22 bp, Homo sapiens
gctgccctctctggccccacac

SEQ ID NO: 7026150 - DNA, 22 bp, Homo sapiens
aacactgtatcagtcttcaata

SEQ ID NO: 7026151 - DNA, 21 bp, Homo sapiens
tagcaggagcgaattttgatg

SEQ ID NO: 7026152 - DNA, 19 bp, Homo sapiens
ctagagtaataagtacttt

SEQ ID NO: 7026153 - DNA, 22 bp, Homo sapiens
agaagcactacgataggtggtc

SEQ ID NO: 7026154 - DNA, 22 bp, Homo sapiens
atctatactcagagttaatatc

SEQ ID NO: 7026155 - DNA, 22 bp, Homo sapiens
acttagcagagttgaatgtact

SEQ ID NO: 7026156 - DNA, 22 bp, Homo sapiens
tcctttctgggcctcagtgact

SEQ ID NO: 7026157 - DNA, 22 bp, Homo sapiens
ctcactgcaagctccgcctccc

SEQ ID NO: 7026158 - DNA, 19 bp, Homo sapiens
caggaatgaggtaatggct

SEQ ID NO: 7026159 - DNA, 22 bp, Homo sapiens
tcaggacatttgtcagcaggag

SEQ ID NO: 7026160 - DNA, 23 bp, Homo sapiens
ccacagcgaggtaggtgtgggag

SEQ ID NO: 7026161 - DNA, 16 bp, Homo sapiens
gggtggtcttggagac

SEQ ID NO: 7026162 - DNA, 22 bp, Homo sapiens
ttcttcagtctaggcctttctt

SEQ ID NO: 7026163 - DNA, 22 bp, Homo sapiens
acagaatactcataagaagggg

SEQ ID NO: 7026164 - DNA, 22 bp, Homo sapiens
tgtagaaggctatagactagga

SEQ ID NO: 7026165 - DNA, 22 bp, Homo sapiens
agtgtatgtcaagtatatacac

SEQ ID NO: 7026166 - DNA, 22 bp, Homo sapiens
tcatttcaagttctgacagcta

SEQ ID NO: 7026167 - DNA, 22 bp, Homo sapiens
tatctactcctctttcagatgc

SEQ ID NO: 7026168 - DNA, 22 bp, Homo sapiens
tgcaagataacctgcttcttcc

SEQ ID NO: 7026169 - DNA, 22 bp, Homo sapiens
gcttgctctttagccatggcca

SEQ ID NO: 7026170 - DNA, 22 bp, Homo sapiens
tggagttcatccatgacagctt

SEQ ID NO: 7026171 - DNA, 22 bp, Homo sapiens
actgtcactccaactgagtcgt

SEQ ID NO: 7026172 - DNA, 22 bp, Homo sapiens
gaaaccacagtacccaggaaaa

SEQ ID NO: 7026173 - DNA, 22 bp, Homo sapiens
tttccagtctcagccctgtaac

SEQ ID NO: 7026174 - DNA, 22 bp, Homo sapiens
ggtcagagctggagagataggg

SEQ ID NO: 7026175 - DNA, 22 bp, Homo sapiens
accttctgaccagttatcttga

SEQ ID NO: 7026176 - DNA, 22 bp, Homo sapiens
gtgggagtttgaacttcatgtt

SEQ ID NO: 7026177 - DNA, 23 bp, Homo sapiens
ttggaagccagacagctgtgcag

SEQ ID NO: 7026178 - DNA, 22 bp, Homo sapiens
tagtgtatgataaaaaattctt

SEQ ID NO: 7026179 - DNA, 22 bp, Homo sapiens
gcctgagccgcctgagcggcgg

SEQ ID NO: 7026180 - DNA, 22 bp, Homo sapiens
tctgaggaaagagagtgggatg

SEQ ID NO: 7026181 - DNA, 22 bp, Homo sapiens
ttatgctagtatagtccttaga

SEQ ID NO: 7026182 - DNA, 22 bp, Homo sapiens
agacgagggcccccaggacagc

SEQ ID NO: 7026183 - DNA, 22 bp, Homo sapiens
acacatgtttgtgtagtcagtt

SEQ ID NO: 7026184 - DNA, 22 bp, Homo sapiens
actgcactgatttatcatccca

SEQ ID NO: 7026185 - DNA, 22 bp, Homo sapiens
gggtccacctgagcagcagcct

SEQ ID NO: 7026186 - DNA, 20 bp, Homo sapiens
cctgggaaggcagccccagc

SEQ ID NO: 7026187 - DNA, 22 bp, Homo sapiens
ttcctgtggctgtcactcctgg

SEQ ID NO: 7026188 - DNA, 22 bp, Homo sapiens
tttcctacccttccaggcagag

SEQ ID NO: 7026189 - DNA, 22 bp, Homo sapiens
atggctgggcttttagtcagat

SEQ ID NO: 7026190 - DNA, 22 bp, Homo sapiens
tggcatgaatttagctttccat

SEQ ID NO: 7026191 - DNA, 22 bp, Homo sapiens
cttcatcatttgcactctaaga

SEQ ID NO: 7026192 - DNA, 22 bp, Homo sapiens
aggctttatttgatctatatgc

SEQ ID NO: 7026193 - DNA, 22 bp, Homo sapiens
taaagacagatggaccagccat

SEQ ID NO: 7026194 - DNA, 22 bp, Homo sapiens
ctgggactttgtaggccagttg

SEQ ID NO: 7026195 - DNA, 22 bp, Homo sapiens
atagtgtgttagtgacataggc

SEQ ID NO: 7026196 - DNA, 19 bp, Homo sapiens
gcaccccatcttcctcctg

SEQ ID NO: 7026197 - DNA, 22 bp, Homo sapiens
ggtcaggccactcaacccttat

SEQ ID NO: 7026198 - DNA, 22 bp, Homo sapiens
tgaaggccctatctccatatac

SEQ ID NO: 7026199 - DNA, 22 bp, Homo sapiens
ctttaaggtgatgagagatgct

SEQ ID NO: 7026200 - DNA, 22 bp, Homo sapiens
tttcacatcccgcgcgccctta

SEQ ID NO: 7026201 - DNA, 22 bp, Homo sapiens
tcagggctttggcttttactct

SEQ ID NO: 7026202 - DNA, 22 bp, Homo sapiens
cctccagcattactggcccatg

SEQ ID NO: 7026203 - DNA, 22 bp, Homo sapiens
gtggccagccccatggacagtt

SEQ ID NO: 7026204 - DNA, 22 bp, Homo sapiens
tctctgatgattggaagcttag

SEQ ID NO: 7026205 - DNA, 22 bp, Homo sapiens
ctgaagttctacaagcctcagg

SEQ ID NO: 7026206 - DNA, 22 bp, Homo sapiens
agaggctctggtgcagcatgca

SEQ ID NO: 7026207 - DNA, 22 bp, Homo sapiens
attccagaggggattcccggcc

SEQ ID NO: 7026208 - DNA, 18 bp, Homo sapiens
cagagtgggccaagagac

SEQ ID NO: 7026209 - DNA, 22 bp, Homo sapiens
gccatcctgatgacaggccact

SEQ ID NO: 7026210 - DNA, 22 bp, Homo sapiens
agctggcagagcatttgtggcc

SEQ ID NO: 7026211 - DNA, 22 bp, Homo sapiens
ttagaaccagggttacgattct

SEQ ID NO: 7026212 - DNA, 22 bp, Homo sapiens
cagcagaaaatacctgtaactc

SEQ ID NO: 7026213 - DNA, 22 bp, Homo sapiens
ctgcttgcaaagtgttggtgat

SEQ ID NO: 7026214 - DNA, 22 bp, Homo sapiens
attttggtagtgggaggttgag

SEQ ID NO: 7026215 - DNA, 22 bp, Homo sapiens
tcagttaatcaatgtggtctaa

SEQ ID NO: 7026216 - DNA, 22 bp, Homo sapiens
tagcaatatgctaccttaaatg

SEQ ID NO: 7026217 - DNA, 22 bp, Homo sapiens
ttcttggctgttcatggtcagg

SEQ ID NO: 7026218 - DNA, 22 bp, Homo sapiens
cctggtgtctgtttacagcagc

SEQ ID NO: 7026219 - DNA, 22 bp, Homo sapiens
ttccatgtgagtacactgtgat

SEQ ID NO: 7026220 - DNA, 22 bp, Homo sapiens
aatggtaatatttcatagttgt

SEQ ID NO: 7026221 - DNA, 22 bp, Homo sapiens
tccagagatctctcttccctgt

SEQ ID NO: 7026222 - DNA, 22 bp, Homo sapiens
ccagtctcttccctcctgccag

SEQ ID NO: 7026223 - DNA, 22 bp, Homo sapiens
atctgcttttgagaatttactt

SEQ ID NO: 7026224 - DNA, 22 bp, Homo sapiens
tgaagctagtattaactcagat

SEQ ID NO: 7026225 - DNA, 23 bp, Homo sapiens
tgcccacaaaagtaaagacattt

SEQ ID NO: 7026226 - DNA, 22 bp, Homo sapiens
caggaacctaaagagacattac

SEQ ID NO: 7026227 - DNA, 22 bp, Homo sapiens
ttcattgaaccactttattctt

SEQ ID NO: 7026228 - DNA, 22 bp, Homo sapiens
tctctaggggagccccgtttgt

SEQ ID NO: 7026229 - DNA, 22 bp, Homo sapiens
ggaattcagggaagtcaaaaag

SEQ ID NO: 7026230 - DNA, 22 bp, Homo sapiens
aagcagggctagaccaagaaga

SEQ ID NO: 7026231 - DNA, 22 bp, Homo sapiens
aaaagcagatctccaaagtcta

SEQ ID NO: 7026232 - DNA, 22 bp, Homo sapiens
acctccagctttttagagacat

SEQ ID NO: 7026233 - DNA, 22 bp, Homo sapiens
ccaggctctgtctggtcagaag

SEQ ID NO: 7026234 - DNA, 22 bp, Homo sapiens
taagcatacattctctcctttc

SEQ ID NO: 7026235 - DNA, 22 bp, Homo sapiens
caggacaggagtggggtcaaag
